United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 74

SEQ ID NO: 2671359 - RNA, 22 nt, Escherichia coli CFT073
uuccugcggagcaaccugcacg

SEQ ID NO: 2671360 - RNA, 22 nt, Escherichia coli CFT073
uuccugcggcagacgcucgcca

SEQ ID NO: 2671361 - RNA, 13 nt, Escherichia coli CFT073
uuccugcucauca

SEQ ID NO: 2671362 - RNA, 14 nt, Escherichia coli CFT073
uuccugcucaucag

SEQ ID NO: 2671363 - RNA, 22 nt, Escherichia coli CFT073
uuccugcucggcaaacugcuga

SEQ ID NO: 2671364 - RNA, 21 nt, Escherichia coli CFT073
uuccugcuggcuguaaaauua

SEQ ID NO: 2671365 - RNA, 21 nt, Escherichia coli CFT073
uuccuggaaccagugaauacu

SEQ ID NO: 2671366 - RNA, 22 nt, Escherichia coli CFT073
uuccuggcgguugauaaugauu

SEQ ID NO: 2671367 - RNA, 23 nt, Escherichia coli CFT073
uuccuggcuggcgcuacugaagc

SEQ ID NO: 2671368 - RNA, 22 nt, Escherichia coli CFT073
uuccuguaaagagugugaauau

SEQ ID NO: 2671369 - RNA, 21 nt, Escherichia coli CFT073
uuccuuaagccagcgcccguu

SEQ ID NO: 2671370 - RNA, 17 nt, Escherichia coli CFT073
uuccuuaugcugcuuac

SEQ ID NO: 2671371 - RNA, 15 nt, Escherichia coli CFT073
uuccuucaagccauc

SEQ ID NO: 2671372 - RNA, 15 nt, Escherichia coli CFT073
uuccuucagcagcag

SEQ ID NO: 2671373 - RNA, 13 nt, Escherichia coli CFT073
uuccuuccagaaa

SEQ ID NO: 2671374 - RNA, 16 nt, Escherichia coli CFT073
uuccuucgcugaauau

SEQ ID NO: 2671375 - RNA, 20 nt, Escherichia coli CFT073
uuccuucgcuuccuguauau

SEQ ID NO: 2671376 - RNA, 15 nt, Escherichia coli CFT073
uuccuugaaaaagag

SEQ ID NO: 2671377 - RNA, 19 nt, Escherichia coli CFT073
uuccuugaaaaagagguug

SEQ ID NO: 2671378 - RNA, 21 nt, Escherichia coli CFT073
uuccuugcugauuuuauuuca

SEQ ID NO: 2671379 - RNA, 15 nt, Escherichia coli CFT073
uuccuuugcugcucu

SEQ ID NO: 2671380 - RNA, 18 nt, Escherichia coli CFT073
uucgaaacagaaauacca

SEQ ID NO: 2671381 - RNA, 12 nt, Escherichia coli CFT073
uucgaacgccgc

SEQ ID NO: 2671382 - RNA, 12 nt, Escherichia coli CFT073
uucgaagaaaaa

SEQ ID NO: 2671383 - RNA, 11 nt, Escherichia coli CFT073
uucgaagcugu

SEQ ID NO: 2671384 - RNA, 18 nt, Escherichia coli CFT073
uucgaaucuucugaagca

SEQ ID NO: 2671385 - RNA, 12 nt, Escherichia coli CFT073
uucgacaacuuu

SEQ ID NO: 2671386 - RNA, 14 nt, Escherichia coli CFT073
uucgacaauaauca

SEQ ID NO: 2671387 - RNA, 20 nt, Escherichia coli CFT073
uucgacagcguuucgccgcc

SEQ ID NO: 2671388 - RNA, 23 nt, Escherichia coli CFT073
uucgacagcguuucgccgcccag

SEQ ID NO: 2671389 - RNA, 13 nt, Escherichia coli CFT073
uucgaccacaccu

SEQ ID NO: 2671390 - RNA, 18 nt, Escherichia coli CFT073
uucgaccagccaggccgc

SEQ ID NO: 2671391 - RNA, 15 nt, Escherichia coli CFT073
uucgaccgucaccag

SEQ ID NO: 2671392 - RNA, 18 nt, Escherichia coli CFT073
uucgacuuccaccagcgg

SEQ ID NO: 2671393 - RNA, 21 nt, Escherichia coli CFT073
uucgagaaugaagucaccaaa

SEQ ID NO: 2671394 - RNA, 23 nt, Escherichia coli CFT073
uucgagagaauuaaccagaaaua

SEQ ID NO: 2671395 - RNA, 18 nt, Escherichia coli CFT073
uucgagcuggaagccaca

SEQ ID NO: 2671396 - RNA, 23 nt, Escherichia coli CFT073
uucgaguacauccacugcauacu

SEQ ID NO: 2671397 - RNA, 19 nt, Escherichia coli CFT073
uucgauaacuguuaaauaa

SEQ ID NO: 2671398 - RNA, 13 nt, Escherichia coli CFT073
uucgauauccaga

SEQ ID NO: 2671399 - RNA, 14 nt, Escherichia coli CFT073
uucgaugagagcgg

SEQ ID NO: 2671400 - RNA, 19 nt, Escherichia coli CFT073
uucgauggugaugagcuga

SEQ ID NO: 2671401 - RNA, 14 nt, Escherichia coli CFT073
uucgauuaacuaaa

SEQ ID NO: 2671402 - RNA, 16 nt, Escherichia coli CFT073
uucgauucccagcuuu

SEQ ID NO: 2671403 - RNA, 17 nt, Escherichia coli CFT073
uucgauuuguucuggug

SEQ ID NO: 2671404 - RNA, 20 nt, Escherichia coli CFT073
uucgcaaaacacaguuuuga

SEQ ID NO: 2671405 - RNA, 13 nt, Escherichia coli CFT073
uucgcaaaccaaa

SEQ ID NO: 2671406 - RNA, 21 nt, Escherichia coli CFT073
uucgcaaucaccuuacaucaa

SEQ ID NO: 2671407 - RNA, 20 nt, Escherichia coli CFT073
uucgcacaccgcugacuuuc

SEQ ID NO: 2671408 - RNA, 15 nt, Escherichia coli CFT073
uucgcaccaaaucca

SEQ ID NO: 2671409 - RNA, 21 nt, Escherichia coli CFT073
uucgcauccgguuaucgccug

SEQ ID NO: 2671410 - RNA, 20 nt, Escherichia coli CFT073
uucgccaaaugucaccagcc

SEQ ID NO: 2671411 - RNA, 19 nt, Escherichia coli CFT073
uucgccaauggcugccgcc

SEQ ID NO: 2671412 - RNA, 23 nt, Escherichia coli CFT073
uucgccaccguguucaugaccgu

SEQ ID NO: 2671413 - RNA, 9 nt, Escherichia coli CFT073
uucgccaga

SEQ ID NO: 2671414 - RNA, 22 nt, Escherichia coli CFT073
uucgccagacggaaugccaucu

SEQ ID NO: 2671415 - RNA, 23 nt, Escherichia coli CFT073
uucgccagcacggcgcagacggu

SEQ ID NO: 2671416 - RNA, 11 nt, Escherichia coli CFT073
uucgccagguc

SEQ ID NO: 2671417 - RNA, 19 nt, Escherichia coli CFT073
uucgccaggucagagagcc

SEQ ID NO: 2671418 - RNA, 13 nt, Escherichia coli CFT073
uucgccaguuuuu

SEQ ID NO: 2671419 - RNA, 18 nt, Escherichia coli CFT073
uucgccauaaaacagcag

SEQ ID NO: 2671420 - RNA, 21 nt, Escherichia coli CFT073
uucgccauguuuggcaaaaga

SEQ ID NO: 2671421 - RNA, 15 nt, Escherichia coli CFT073
uucgcccgccagcgu

SEQ ID NO: 2671422 - RNA, 11 nt, Escherichia coli CFT073
uucgcccgccg

SEQ ID NO: 2671423 - RNA, 16 nt, Escherichia coli CFT073
uucgcccgccgagaaa

SEQ ID NO: 2671424 - RNA, 17 nt, Escherichia coli CFT073
uucgcccgccgcuaaca

SEQ ID NO: 2671425 - RNA, 12 nt, Escherichia coli CFT073
uucgcccugcag

SEQ ID NO: 2671426 - RNA, 17 nt, Escherichia coli CFT073
uucgccgcagcaucguc

SEQ ID NO: 2671427 - RNA, 21 nt, Escherichia coli CFT073
uucgccgcagguagcagcagc

SEQ ID NO: 2671428 - RNA, 18 nt, Escherichia coli CFT073
uucgccgcaucgucacug

SEQ ID NO: 2671429 - RNA, 15 nt, Escherichia coli CFT073
uucgccgccagaucc

SEQ ID NO: 2671430 - RNA, 19 nt, Escherichia coli CFT073
uucgccgccagauccuggc

SEQ ID NO: 2671431 - RNA, 20 nt, Escherichia coli CFT073
uucgccgcccugcaacauca

SEQ ID NO: 2671432 - RNA, 23 nt, Escherichia coli CFT073
uucgccgcgcccgcguuccugac

SEQ ID NO: 2671433 - RNA, 13 nt, Escherichia coli CFT073
uucgccgguuuuu

SEQ ID NO: 2671434 - RNA, 21 nt, Escherichia coli CFT073
uucgccguguaauucgccguc

SEQ ID NO: 2671435 - RNA, 16 nt, Escherichia coli CFT073
uucgccguuaccagca

SEQ ID NO: 2671436 - RNA, 15 nt, Escherichia coli CFT073
uucgccugaaauaau

SEQ ID NO: 2671437 - RNA, 16 nt, Escherichia coli CFT073
uucgcgaaucgccaca

SEQ ID NO: 2671438 - RNA, 18 nt, Escherichia coli CFT073
uucgcgaaucgccacaac

SEQ ID NO: 2671439 - RNA, 18 nt, Escherichia coli CFT073
uucgcgacaucgcccggc

SEQ ID NO: 2671440 - RNA, 22 nt, Escherichia coli CFT073
uucgcgacguucguuaacaaca

SEQ ID NO: 2671441 - RNA, 13 nt, Escherichia coli CFT073
uucgcgaggagcg

SEQ ID NO: 2671442 - RNA, 22 nt, Escherichia coli CFT073
uucgcgcagucgggugcugccg

SEQ ID NO: 2671443 - RNA, 12 nt, Escherichia coli CFT073
uucgcgccaaca

SEQ ID NO: 2671444 - RNA, 18 nt, Escherichia coli CFT073
uucgcgcuuaacgcgggc

SEQ ID NO: 2671445 - RNA, 24 nt, Escherichia coli CFT073
uucgcggauguugcugcaccaggc

SEQ ID NO: 2671446 - RNA, 14 nt, Escherichia coli CFT073
uucgcggcaaacug

SEQ ID NO: 2671447 - RNA, 20 nt, Escherichia coli CFT073
uucgcuaaaaguauggacgu

SEQ ID NO: 2671448 - RNA, 16 nt, Escherichia coli CFT073
uucgcuaagauacccc

SEQ ID NO: 2671449 - RNA, 18 nt, Escherichia coli CFT073
uucgcugacgccugccag

SEQ ID NO: 2671450 - RNA, 21 nt, Escherichia coli CFT073
uucgcugauuuaaucgcuuca

SEQ ID NO: 2671451 - RNA, 22 nt, Escherichia coli CFT073
uucgcuggaauaaucguaccgu

SEQ ID NO: 2671452 - RNA, 18 nt, Escherichia coli CFT073
uucgcuggauguuggcgg

SEQ ID NO: 2671453 - RNA, 20 nt, Escherichia coli CFT073
uucgcuggcaaguucgucuu

SEQ ID NO: 2671454 - RNA, 16 nt, Escherichia coli CFT073
uucgcugguaccuguc

SEQ ID NO: 2671455 - RNA, 17 nt, Escherichia coli CFT073
uucgcuguguucugggc

SEQ ID NO: 2671456 - RNA, 20 nt, Escherichia coli CFT073
uucgcuuaacaguuccagca

SEQ ID NO: 2671457 - RNA, 23 nt, Escherichia coli CFT073
uucgcuuaacaguuccagcaaau

SEQ ID NO: 2671458 - RNA, 23 nt, Escherichia coli CFT073
uucgcuuaacucaccguaggcaa

SEQ ID NO: 2671459 - RNA, 16 nt, Escherichia coli CFT073
uucgcuuaccaugcca

SEQ ID NO: 2671460 - RNA, 16 nt, Escherichia coli CFT073
uucgcuucgauuccca

SEQ ID NO: 2671461 - RNA, 13 nt, Escherichia coli CFT073
uucgcuucuucag

SEQ ID NO: 2671462 - RNA, 18 nt, Escherichia coli CFT073
uucgcuugaucuuccuga

SEQ ID NO: 2671463 - RNA, 22 nt, Escherichia coli CFT073
uucgcuuuacccugguuagcaa

SEQ ID NO: 2671464 - RNA, 15 nt, Escherichia coli CFT073
uucgcuuucaagcuu

SEQ ID NO: 2671465 - RNA, 14 nt, Escherichia coli CFT073
uucgcuuucacuca

SEQ ID NO: 2671466 - RNA, 17 nt, Escherichia coli CFT073
uucgcuuucacucagug

SEQ ID NO: 2671467 - RNA, 15 nt, Escherichia coli CFT073
uucgcuuuuauuucu

SEQ ID NO: 2671468 - RNA, 19 nt, Escherichia coli CFT073
uucgcuuuucaccgccuua

SEQ ID NO: 2671469 - RNA, 20 nt, Escherichia coli CFT073
uucggacauguuuuccagca

SEQ ID NO: 2671470 - RNA, 13 nt, Escherichia coli CFT073
uucggauccagca

SEQ ID NO: 2671471 - RNA, 18 nt, Escherichia coli CFT073
uucggcagucacuuuuuu

SEQ ID NO: 2671472 - RNA, 18 nt, Escherichia coli CFT073
uucggcagugaaaacgca

SEQ ID NO: 2671473 - RNA, 22 nt, Escherichia coli CFT073
uucggcauuaauuaguaggccg

SEQ ID NO: 2671474 - RNA, 17 nt, Escherichia coli CFT073
uucggcccaugacaaac

SEQ ID NO: 2671475 - RNA, 20 nt, Escherichia coli CFT073
uucggccccgguucgcuuuu

SEQ ID NO: 2671476 - RNA, 22 nt, Escherichia coli CFT073
uucggcgaccagcgcagcuucc

SEQ ID NO: 2671477 - RNA, 21 nt, Escherichia coli CFT073
uucggcgucuuguugaacaga

SEQ ID NO: 2671478 - RNA, 13 nt, Escherichia coli CFT073
uucggcuucuucc

SEQ ID NO: 2671479 - RNA, 21 nt, Escherichia coli CFT073
uucggguuauugguuaacaag

SEQ ID NO: 2671480 - RNA, 14 nt, Escherichia coli CFT073
uucggucaugguga

SEQ ID NO: 2671481 - RNA, 23 nt, Escherichia coli CFT073
uucgguccgacgugcucgaacau

SEQ ID NO: 2671482 - RNA, 17 nt, Escherichia coli CFT073
uucggugaugaauccgg

SEQ ID NO: 2671483 - RNA, 15 nt, Escherichia coli CFT073
uucgguugccagcgc

SEQ ID NO: 2671484 - RNA, 12 nt, Escherichia coli CFT073
uucgguuuugcg

SEQ ID NO: 2671485 - RNA, 14 nt, Escherichia coli CFT073
uucguaauaaauca

SEQ ID NO: 2671486 - RNA, 21 nt, Escherichia coli CFT073
uucguaccaaaugaaccguga

SEQ ID NO: 2671487 - RNA, 12 nt, Escherichia coli CFT073
uucguauuuaaa

SEQ ID NO: 2671488 - RNA, 18 nt, Escherichia coli CFT073
uucgucaaagauauuauu

SEQ ID NO: 2671489 - RNA, 22 nt, Escherichia coli CFT073
uucgucaccugguagcggguga

SEQ ID NO: 2671490 - RNA, 13 nt, Escherichia coli CFT073
uucguccaccagg

SEQ ID NO: 2671491 - RNA, 20 nt, Escherichia coli CFT073
uucguccaccaggaacucag

SEQ ID NO: 2671492 - RNA, 13 nt, Escherichia coli CFT073
uucguccauccca

SEQ ID NO: 2671493 - RNA, 21 nt, Escherichia coli CFT073
uucgucccagucgucauccca

SEQ ID NO: 2671494 - RNA, 18 nt, Escherichia coli CFT073
uucguccccaguuuucca

SEQ ID NO: 2671495 - RNA, 18 nt, Escherichia coli CFT073
uucguccgagcggcacca

SEQ ID NO: 2671496 - RNA, 12 nt, Escherichia coli CFT073
uucgucgccagc

SEQ ID NO: 2671497 - RNA, 13 nt, Escherichia coli CFT073
uucgucgccauca

SEQ ID NO: 2671498 - RNA, 16 nt, Escherichia coli CFT073
uucgucgcguuugccc

SEQ ID NO: 2671499 - RNA, 19 nt, Escherichia coli CFT073
uucgugcaauucggcuuuu

SEQ ID NO: 2671500 - RNA, 17 nt, Escherichia coli CFT073
uucgugucgggaaagca

SEQ ID NO: 2671501 - RNA, 20 nt, Escherichia coli CFT073
uucguguuuaagcacuuuau

SEQ ID NO: 2671502 - RNA, 16 nt, Escherichia coli CFT073
uucguuaaacgccaaa

SEQ ID NO: 2671503 - RNA, 22 nt, Escherichia coli CFT073
uucguuaacaacaacuucuaau

SEQ ID NO: 2671504 - RNA, 17 nt, Escherichia coli CFT073
uucguuagcaaacgaca

SEQ ID NO: 2671505 - RNA, 17 nt, Escherichia coli CFT073
uucguugauaauaaagc

SEQ ID NO: 2671506 - RNA, 11 nt, Escherichia coli CFT073
uucguugauca

SEQ ID NO: 2671507 - RNA, 11 nt, Escherichia coli CFT073
uucguugcauu

SEQ ID NO: 2671508 - RNA, 22 nt, Escherichia coli CFT073
uucguugugucgccagcaauac

SEQ ID NO: 2671509 - RNA, 18 nt, Escherichia coli CFT073
uucguuuccccacauguu

SEQ ID NO: 2671510 - RNA, 17 nt, Escherichia coli CFT073
uucguuuuaaugcgauc

SEQ ID NO: 2671511 - RNA, 21 nt, Escherichia coli CFT073
uucuaaagcaacuccaucaag

SEQ ID NO: 2671512 - RNA, 12 nt, Escherichia coli CFT073
uucuaauugugc

SEQ ID NO: 2671513 - RNA, 22 nt, Escherichia coli CFT073
uucuaauugugcugcauuaucc

SEQ ID NO: 2671514 - RNA, 20 nt, Escherichia coli CFT073
uucuaauuuuuccagcauuu

SEQ ID NO: 2671515 - RNA, 15 nt, Escherichia coli CFT073
uucuacaagcagaga

SEQ ID NO: 2671516 - RNA, 15 nt, Escherichia coli CFT073
uucuaccauccgcug

SEQ ID NO: 2671517 - RNA, 22 nt, Escherichia coli CFT073
uucuaccgggcugaguccccca

SEQ ID NO: 2671518 - RNA, 16 nt, Escherichia coli CFT073
uucuaccguaucuacc

SEQ ID NO: 2671519 - RNA, 17 nt, Escherichia coli CFT073
uucuaccuuauccagca

SEQ ID NO: 2671520 - RNA, 17 nt, Escherichia coli CFT073
uucuacgccaucaguuu

SEQ ID NO: 2671521 - RNA, 19 nt, Escherichia coli CFT073
uucuaucaaccugaggccu

SEQ ID NO: 2671522 - RNA, 15 nt, Escherichia coli CFT073
uucuaucaucauauc

SEQ ID NO: 2671523 - RNA, 19 nt, Escherichia coli CFT073
uucuaucgcauuauccuuu

SEQ ID NO: 2671524 - RNA, 22 nt, Escherichia coli CFT073
uucuaucgcauuauccuuuauc

SEQ ID NO: 2671525 - RNA, 19 nt, Escherichia coli CFT073
uucuaucuucaucuccugg

SEQ ID NO: 2671526 - RNA, 21 nt, Escherichia coli CFT073
uucuauugcaggggcuuauau

SEQ ID NO: 2671527 - RNA, 22 nt, Escherichia coli CFT073
uucucaaaaaagagggcauagc

SEQ ID NO: 2671528 - RNA, 17 nt, Escherichia coli CFT073
uucucaaagguaauggu

SEQ ID NO: 2671529 - RNA, 17 nt, Escherichia coli CFT073
uucucaaugaugccgcc

SEQ ID NO: 2671530 - RNA, 20 nt, Escherichia coli CFT073
uucucaaugaugccgccaca

SEQ ID NO: 2671531 - RNA, 21 nt, Escherichia coli CFT073
uucucaccaacuggcgcagca

SEQ ID NO: 2671532 - RNA, 16 nt, Escherichia coli CFT073
uucucaccaucaaaca

SEQ ID NO: 2671533 - RNA, 20 nt, Escherichia coli CFT073
uucucaccaucaaacagccc

SEQ ID NO: 2671534 - RNA, 24 nt, Escherichia coli CFT073
uucucaccuacagccacaccuucu

SEQ ID NO: 2671535 - RNA, 19 nt, Escherichia coli CFT073
uucucacggauccagaacu

SEQ ID NO: 2671536 - RNA, 15 nt, Escherichia coli CFT073
uucucagcacauuga

SEQ ID NO: 2671537 - RNA, 23 nt, Escherichia coli CFT073
uucucagucauaacguucagcac

SEQ ID NO: 2671538 - RNA, 18 nt, Escherichia coli CFT073
uucucauauaucccuucc

SEQ ID NO: 2671539 - RNA, 20 nt, Escherichia coli CFT073
uucuccgcacuccaacucuu

SEQ ID NO: 2671540 - RNA, 16 nt, Escherichia coli CFT073
uucuccggcagcuuua

SEQ ID NO: 2671541 - RNA, 13 nt, Escherichia coli CFT073
uucucgccaccgg

SEQ ID NO: 2671542 - RNA, 18 nt, Escherichia coli CFT073
uucucgccguugcuggca

SEQ ID NO: 2671543 - RNA, 22 nt, Escherichia coli CFT073
uucucggcaaacaguugcugau

SEQ ID NO: 2671544 - RNA, 15 nt, Escherichia coli CFT073
uucucguaaauuccc

SEQ ID NO: 2671545 - RNA, 16 nt, Escherichia coli CFT073
uucucguaaauucccc

SEQ ID NO: 2671546 - RNA, 17 nt, Escherichia coli CFT073
uucucugacgcucucaa

SEQ ID NO: 2671547 - RNA, 23 nt, Escherichia coli CFT073
uucucugauacucaacucacaca

SEQ ID NO: 2671548 - RNA, 23 nt, Escherichia coli CFT073
uucucugucaggguuauagccuu

SEQ ID NO: 2671549 - RNA, 22 nt, Escherichia coli CFT073
uucucuucauuaccuucaauac

SEQ ID NO: 2671550 - RNA, 16 nt, Escherichia coli CFT073
uucucuuuccagcaac

SEQ ID NO: 2671551 - RNA, 20 nt, Escherichia coli CFT073
uucucuuuguuaaacagugc

SEQ ID NO: 2671552 - RNA, 21 nt, Escherichia coli CFT073
uucucuuuguuaaacagugcc

SEQ ID NO: 2671553 - RNA, 14 nt, Escherichia coli CFT073
uucugaauauguuu

SEQ ID NO: 2671554 - RNA, 13 nt, Escherichia coli CFT073
uucugaccagcca

SEQ ID NO: 2671555 - RNA, 23 nt, Escherichia coli CFT073
uucugaccgggauuuucaacauc

SEQ ID NO: 2671556 - RNA, 19 nt, Escherichia coli CFT073
uucugagaucaaugcgcca

SEQ ID NO: 2671557 - RNA, 14 nt, Escherichia coli CFT073
uucugagcaucaca

SEQ ID NO: 2671558 - RNA, 16 nt, Escherichia coli CFT073
uucugaggugagcaua

SEQ ID NO: 2671559 - RNA, 18 nt, Escherichia coli CFT073
uucugauaaaugaagaaa

SEQ ID NO: 2671560 - RNA, 21 nt, Escherichia coli CFT073
uucugauaaaugaagaaaaac

SEQ ID NO: 2671561 - RNA, 22 nt, Escherichia coli CFT073
uucugauaaaugaagaaaaacc

SEQ ID NO: 2671562 - RNA, 14 nt, Escherichia coli CFT073
uucugauaugcagu

SEQ ID NO: 2671563 - RNA, 15 nt, Escherichia coli CFT073
uucugauucccugcc

SEQ ID NO: 2671564 - RNA, 11 nt, Escherichia coli CFT073
uucugauuuug

SEQ ID NO: 2671565 - RNA, 16 nt, Escherichia coli CFT073
uucugcaaccagaaag

SEQ ID NO: 2671566 - RNA, 18 nt, Escherichia coli CFT073
uucugcaaucgucugcug

SEQ ID NO: 2671567 - RNA, 13 nt, Escherichia coli CFT073
uucugcacacaca

SEQ ID NO: 2671568 - RNA, 21 nt, Escherichia coli CFT073
uucugcacgguuuuuccagcu

SEQ ID NO: 2671569 - RNA, 21 nt, Escherichia coli CFT073
uucugccaaacgcucccagcc

SEQ ID NO: 2671570 - RNA, 16 nt, Escherichia coli CFT073
uucugccaccagguuc

SEQ ID NO: 2671571 - RNA, 17 nt, Escherichia coli CFT073
uucugccggaauaauca

SEQ ID NO: 2671572 - RNA, 20 nt, Escherichia coli CFT073
uucugccucgucccaaaagc

SEQ ID NO: 2671573 - RNA, 18 nt, Escherichia coli CFT073
uucugccuggucaaagac

SEQ ID NO: 2671574 - RNA, 20 nt, Escherichia coli CFT073
uucugcgcuacgaccgauca

SEQ ID NO: 2671575 - RNA, 23 nt, Escherichia coli CFT073
uucugcggccauuuuuuuaccca

SEQ ID NO: 2671576 - RNA, 20 nt, Escherichia coli CFT073
uucugcggcguaacgcacca

SEQ ID NO: 2671577 - RNA, 14 nt, Escherichia coli CFT073
uucugcugccuaca

SEQ ID NO: 2671578 - RNA, 11 nt, Escherichia coli CFT073
uucugcugcuu

SEQ ID NO: 2671579 - RNA, 19 nt, Escherichia coli CFT073
uucuggaaguaaucacgaa

SEQ ID NO: 2671580 - RNA, 16 nt, Escherichia coli CFT073
uucuggagucggagcc

SEQ ID NO: 2671581 - RNA, 21 nt, Escherichia coli CFT073
uucuggauauacgcuuucagc

SEQ ID NO: 2671582 - RNA, 19 nt, Escherichia coli CFT073
uucuggcaauuaacgcaca

SEQ ID NO: 2671583 - RNA, 13 nt, Escherichia coli CFT073
uucuggcaccagu

SEQ ID NO: 2671584 - RNA, 19 nt, Escherichia coli CFT073
uucuggcagauugucgguu

SEQ ID NO: 2671585 - RNA, 16 nt, Escherichia coli CFT073
uucuggccgcuucaga

SEQ ID NO: 2671586 - RNA, 14 nt, Escherichia coli CFT073
uucuggcggccaaa

SEQ ID NO: 2671587 - RNA, 14 nt, Escherichia coli CFT073
uucuggcggcggca

SEQ ID NO: 2671588 - RNA, 12 nt, Escherichia coli CFT073
uucuggcuacac

SEQ ID NO: 2671589 - RNA, 21 nt, Escherichia coli CFT073
uucuggcugacauaaacacca

SEQ ID NO: 2671590 - RNA, 17 nt, Escherichia coli CFT073
uucuggcuucccguagc

SEQ ID NO: 2671591 - RNA, 22 nt, Escherichia coli CFT073
uucuguaacucgaauuauucag

SEQ ID NO: 2671592 - RNA, 13 nt, Escherichia coli CFT073
uucuguaauccau

SEQ ID NO: 2671593 - RNA, 15 nt, Escherichia coli CFT073
uucuguaauccauug

SEQ ID NO: 2671594 - RNA, 14 nt, Escherichia coli CFT073
uucugucacgcugg

SEQ ID NO: 2671595 - RNA, 14 nt, Escherichia coli CFT073
uucugucgcucugc

SEQ ID NO: 2671596 - RNA, 20 nt, Escherichia coli CFT073
uucugucuuaacgcaccaug

SEQ ID NO: 2671597 - RNA, 13 nt, Escherichia coli CFT073
uucugugcaauca

SEQ ID NO: 2671598 - RNA, 19 nt, Escherichia coli CFT073
uucugugcagccaaaaaug

SEQ ID NO: 2671599 - RNA, 16 nt, Escherichia coli CFT073
uucuguggcagggcag

SEQ ID NO: 2671600 - RNA, 21 nt, Escherichia coli CFT073
uucuguuaaaucauccuguuc

SEQ ID NO: 2671601 - RNA, 15 nt, Escherichia coli CFT073
uucuguugauaaaac

SEQ ID NO: 2671602 - RNA, 16 nt, Escherichia coli CFT073
uucuguugauaaaaca

SEQ ID NO: 2671603 - RNA, 14 nt, Escherichia coli CFT073
uucuguuucugucg

SEQ ID NO: 2671604 - RNA, 19 nt, Escherichia coli CFT073
uucuuaagguuuuuuccuu

SEQ ID NO: 2671605 - RNA, 13 nt, Escherichia coli CFT073
uucuuaauugcac

SEQ ID NO: 2671606 - RNA, 23 nt, Escherichia coli CFT073
uucuuacuauauaaaccuucugu

SEQ ID NO: 2671607 - RNA, 13 nt, Escherichia coli CFT073
uucuuauucagaa

SEQ ID NO: 2671608 - RNA, 13 nt, Escherichia coli CFT073
uucuuauucauau

SEQ ID NO: 2671609 - RNA, 13 nt, Escherichia coli CFT073
uucuucaaaaaua

SEQ ID NO: 2671610 - RNA, 15 nt, Escherichia coli CFT073
uucuucaacaauuga

SEQ ID NO: 2671611 - RNA, 24 nt, Escherichia coli CFT073
uucuucaacaccaacugccucguc

SEQ ID NO: 2671612 - RNA, 17 nt, Escherichia coli CFT073
uucuucaagccaggcuu

SEQ ID NO: 2671613 - RNA, 21 nt, Escherichia coli CFT073
uucuucaagccaggcuuuaaa

SEQ ID NO: 2671614 - RNA, 23 nt, Escherichia coli CFT073
uucuucaaguguggccgccagug

SEQ ID NO: 2671615 - RNA, 15 nt, Escherichia coli CFT073
uucuucacccuuuuc

SEQ ID NO: 2671616 - RNA, 14 nt, Escherichia coli CFT073
uucuucacugacgc

SEQ ID NO: 2671617 - RNA, 12 nt, Escherichia coli CFT073
uucuucagcuuu

SEQ ID NO: 2671618 - RNA, 21 nt, Escherichia coli CFT073
uucuucauucccggaaauugc

SEQ ID NO: 2671619 - RNA, 23 nt, Escherichia coli CFT073
uucuucauucccggaaauugcca

SEQ ID NO: 2671620 - RNA, 15 nt, Escherichia coli CFT073
uucuuccacaccacu

SEQ ID NO: 2671621 - RNA, 11 nt, Escherichia coli CFT073
uucuuccagca

SEQ ID NO: 2671622 - RNA, 12 nt, Escherichia coli CFT073
uucuuccagcau

SEQ ID NO: 2671623 - RNA, 21 nt, Escherichia coli CFT073
uucuuccagcaucgcccccau

SEQ ID NO: 2671624 - RNA, 15 nt, Escherichia coli CFT073
uucuuccagcggcag

SEQ ID NO: 2671625 - RNA, 18 nt, Escherichia coli CFT073
uucuuccagguuaaccca

SEQ ID NO: 2671626 - RNA, 21 nt, Escherichia coli CFT073
uucuuccgggcuauacacccu

SEQ ID NO: 2671627 - RNA, 16 nt, Escherichia coli CFT073
uucuucgcagcaaauc

SEQ ID NO: 2671628 - RNA, 20 nt, Escherichia coli CFT073
uucuucgcgccauccagcuc

SEQ ID NO: 2671629 - RNA, 20 nt, Escherichia coli CFT073
uucuucgcugacaguaccca

SEQ ID NO: 2671630 - RNA, 22 nt, Escherichia coli CFT073
uucuucgucgucuucgucccag

SEQ ID NO: 2671631 - RNA, 12 nt, Escherichia coli CFT073
uucuucuuucag

SEQ ID NO: 2671632 - RNA, 12 nt, Escherichia coli CFT073
uucuucuuucgc

SEQ ID NO: 2671633 - RNA, 12 nt, Escherichia coli CFT073
uucuugcguuuu

SEQ ID NO: 2671634 - RNA, 21 nt, Escherichia coli CFT073
uucuuggcgucgaauauugga

SEQ ID NO: 2671635 - RNA, 18 nt, Escherichia coli CFT073
uucuuuaaaacgcuucuc

SEQ ID NO: 2671636 - RNA, 15 nt, Escherichia coli CFT073
uucuuuaccaccaaa

SEQ ID NO: 2671637 - RNA, 17 nt, Escherichia coli CFT073
uucuuuaguugagcuuu

SEQ ID NO: 2671638 - RNA, 22 nt, Escherichia coli CFT073
uucuuuaguugagcuuuuuccg

SEQ ID NO: 2671639 - RNA, 21 nt, Escherichia coli CFT073
uucuuuauaucugguuugcca

SEQ ID NO: 2671640 - RNA, 14 nt, Escherichia coli CFT073
uucuuuauccgcuu

SEQ ID NO: 2671641 - RNA, 12 nt, Escherichia coli CFT073
uucuuucagagu

SEQ ID NO: 2671642 - RNA, 16 nt, Escherichia coli CFT073
uucuuucaucagauca

SEQ ID NO: 2671643 - RNA, 20 nt, Escherichia coli CFT073
uucuuucgcacugguuugca

SEQ ID NO: 2671644 - RNA, 15 nt, Escherichia coli CFT073
uucuuucucuuucuu

SEQ ID NO: 2671645 - RNA, 23 nt, Escherichia coli CFT073
uucuuugcgcccccgauccagcg

SEQ ID NO: 2671646 - RNA, 13 nt, Escherichia coli CFT073
uucuuugcgguaa

SEQ ID NO: 2671647 - RNA, 17 nt, Escherichia coli CFT073
uucuuuguucuucuguu

SEQ ID NO: 2671648 - RNA, 20 nt, Escherichia coli CFT073
uucuuuguuuccccugguuc

SEQ ID NO: 2671649 - RNA, 14 nt, Escherichia coli CFT073
uucuuuugccuguu

SEQ ID NO: 2671650 - RNA, 13 nt, Escherichia coli CFT073
uucuuuuuuucau

SEQ ID NO: 2671651 - RNA, 13 nt, Escherichia coli CFT073
uugaaaacguagc

SEQ ID NO: 2671652 - RNA, 18 nt, Escherichia coli CFT073
uugaaaagaguucaucgg

SEQ ID NO: 2671653 - RNA, 21 nt, Escherichia coli CFT073
uugaaaccgguuuguaggccg

SEQ ID NO: 2671654 - RNA, 17 nt, Escherichia coli CFT073
uugaaacguuaugcacc

SEQ ID NO: 2671655 - RNA, 13 nt, Escherichia coli CFT073
uugaaagaugcug

SEQ ID NO: 2671656 - RNA, 13 nt, Escherichia coli CFT073
uugaaaucgaaca

SEQ ID NO: 2671657 - RNA, 14 nt, Escherichia coli CFT073
uugaaaugagaaaa

SEQ ID NO: 2671658 - RNA, 15 nt, Escherichia coli CFT073
uugaaaugcggcgac

SEQ ID NO: 2671659 - RNA, 15 nt, Escherichia coli CFT073
uugaacagcagaaca

SEQ ID NO: 2671660 - RNA, 19 nt, Escherichia coli CFT073
uugaacauaucagcgcaaa

SEQ ID NO: 2671661 - RNA, 19 nt, Escherichia coli CFT073
uugaacccggcaucaacca

SEQ ID NO: 2671662 - RNA, 15 nt, Escherichia coli CFT073
uugaacucugaaucg

SEQ ID NO: 2671663 - RNA, 12 nt, Escherichia coli CFT073
uugaacugguua

SEQ ID NO: 2671664 - RNA, 13 nt, Escherichia coli CFT073
uugaacugguuaa

SEQ ID NO: 2671665 - RNA, 13 nt, Escherichia coli CFT073
uugaagaaaucag

SEQ ID NO: 2671666 - RNA, 21 nt, Escherichia coli CFT073
uugaagcaauccauaccagca

SEQ ID NO: 2671667 - RNA, 18 nt, Escherichia coli CFT073
uugaagcagcgcuggaga

SEQ ID NO: 2671668 - RNA, 13 nt, Escherichia coli CFT073
uugaaggaaaaau

SEQ ID NO: 2671669 - RNA, 15 nt, Escherichia coli CFT073
uugaaggauaagacg

SEQ ID NO: 2671670 - RNA, 11 nt, Escherichia coli CFT073
uugaagucagg

SEQ ID NO: 2671671 - RNA, 18 nt, Escherichia coli CFT073
uugaagugaccgaaaucc

SEQ ID NO: 2671672 - RNA, 21 nt, Escherichia coli CFT073
uugaauaaauuggcuggggua

SEQ ID NO: 2671673 - RNA, 13 nt, Escherichia coli CFT073
uugaauguugacg

SEQ ID NO: 2671674 - RNA, 23 nt, Escherichia coli CFT073
uugaauguugcgcgguuagaaaa

SEQ ID NO: 2671675 - RNA, 16 nt, Escherichia coli CFT073
uugaauuuaaugcacu

SEQ ID NO: 2671676 - RNA, 12 nt, Escherichia coli CFT073
uugaauuucaaa

SEQ ID NO: 2671677 - RNA, 18 nt, Escherichia coli CFT073
uugaauuugguagaauuu

SEQ ID NO: 2671678 - RNA, 17 nt, Escherichia coli CFT073
uugacacaauauugcgg

SEQ ID NO: 2671679 - RNA, 24 nt, Escherichia coli CFT073
uugacagaccguugcucagaauca

SEQ ID NO: 2671680 - RNA, 19 nt, Escherichia coli CFT073
uugacagcuuuuacaaaau

SEQ ID NO: 2671681 - RNA, 17 nt, Escherichia coli CFT073
uugacaucgucaggggc

SEQ ID NO: 2671682 - RNA, 12 nt, Escherichia coli CFT073
uugaccaagaac

SEQ ID NO: 2671683 - RNA, 16 nt, Escherichia coli CFT073
uugaccagugcagacu

SEQ ID NO: 2671684 - RNA, 15 nt, Escherichia coli CFT073
uugaccauaucauca

SEQ ID NO: 2671685 - RNA, 14 nt, Escherichia coli CFT073
uugaccgccagcgc

SEQ ID NO: 2671686 - RNA, 16 nt, Escherichia coli CFT073
uugaccgccagcgcca

SEQ ID NO: 2671687 - RNA, 15 nt, Escherichia coli CFT073
uugacgccaaggagu

SEQ ID NO: 2671688 - RNA, 21 nt, Escherichia coli CFT073
uugacgcgucuuaucaggccu

SEQ ID NO: 2671689 - RNA, 22 nt, Escherichia coli CFT073
uugacgucccacaguuguccau

SEQ ID NO: 2671690 - RNA, 23 nt, Escherichia coli CFT073
uugacugcccaagugcagccauu

SEQ ID NO: 2671691 - RNA, 24 nt, Escherichia coli CFT073
uugacuguccgcauccccuacucu

SEQ ID NO: 2671692 - RNA, 18 nt, Escherichia coli CFT073
uugagauuguuggucaca

SEQ ID NO: 2671693 - RNA, 24 nt, Escherichia coli CFT073
uugagauuguuggucacaaugcgu

SEQ ID NO: 2671694 - RNA, 15 nt, Escherichia coli CFT073
uugagauuuaccgga

SEQ ID NO: 2671695 - RNA, 15 nt, Escherichia coli CFT073
uugagauuucaccaa

SEQ ID NO: 2671696 - RNA, 20 nt, Escherichia coli CFT073
uugagcaaagacgcguucau

SEQ ID NO: 2671697 - RNA, 22 nt, Escherichia coli CFT073
uugagcaaagacgcguucaucu

SEQ ID NO: 2671698 - RNA, 20 nt, Escherichia coli CFT073
uugagcaguuucgucaacuu

SEQ ID NO: 2671699 - RNA, 15 nt, Escherichia coli CFT073
uugagcaucugcaaa

SEQ ID NO: 2671700 - RNA, 19 nt, Escherichia coli CFT073
uugagccucgcugcucaca

SEQ ID NO: 2671701 - RNA, 16 nt, Escherichia coli CFT073
uugagcgcaaauugcu

SEQ ID NO: 2671702 - RNA, 19 nt, Escherichia coli CFT073
uugagcggaaacagcggcu

SEQ ID NO: 2671703 - RNA, 12 nt, Escherichia coli CFT073
uugagcggaucg

SEQ ID NO: 2671704 - RNA, 21 nt, Escherichia coli CFT073
uugagcuuuauccugcccgcu

SEQ ID NO: 2671705 - RNA, 22 nt, Escherichia coli CFT073
uugaggaaguuauacagacuca

SEQ ID NO: 2671706 - RNA, 14 nt, Escherichia coli CFT073
uugaggccuuuaga

SEQ ID NO: 2671707 - RNA, 20 nt, Escherichia coli CFT073
uugagguuagugacauaggc

SEQ ID NO: 2671708 - RNA, 22 nt, Escherichia coli CFT073
uugaguagccacgcgacauaaa

SEQ ID NO: 2671709 - RNA, 13 nt, Escherichia coli CFT073
uugaguauuaaau

SEQ ID NO: 2671710 - RNA, 15 nt, Escherichia coli CFT073
uugaguucacugccg

SEQ ID NO: 2671711 - RNA, 19 nt, Escherichia coli CFT073
uugaguuuuucaucccucu

SEQ ID NO: 2671712 - RNA, 13 nt, Escherichia coli CFT073
uugauaagcaagu

SEQ ID NO: 2671713 - RNA, 16 nt, Escherichia coli CFT073
uugauaauaaagcuac

SEQ ID NO: 2671714 - RNA, 23 nt, Escherichia coli CFT073
uugauaaucguuugcauccggca

SEQ ID NO: 2671715 - RNA, 17 nt, Escherichia coli CFT073
uugauaauuagugcugc

SEQ ID NO: 2671716 - RNA, 15 nt, Escherichia coli CFT073
uugauagauuucucu

SEQ ID NO: 2671717 - RNA, 20 nt, Escherichia coli CFT073
uugauagauuucucuaaaaa

SEQ ID NO: 2671718 - RNA, 22 nt, Escherichia coli CFT073
uugauagcaaugccaucaccaa

SEQ ID NO: 2671719 - RNA, 21 nt, Escherichia coli CFT073
uugauagcccaacgaucccaa

SEQ ID NO: 2671720 - RNA, 12 nt, Escherichia coli CFT073
uugauauccgca

SEQ ID NO: 2671721 - RNA, 12 nt, Escherichia coli CFT073
uugauauguauu

SEQ ID NO: 2671722 - RNA, 21 nt, Escherichia coli CFT073
uugaucaagcaccgccauauu

SEQ ID NO: 2671723 - RNA, 14 nt, Escherichia coli CFT073
uugaucaagcucau

SEQ ID NO: 2671724 - RNA, 16 nt, Escherichia coli CFT073
uugaucaauucgagca

SEQ ID NO: 2671725 - RNA, 19 nt, Escherichia coli CFT073
uugaucaggugauggcagc

SEQ ID NO: 2671726 - RNA, 21 nt, Escherichia coli CFT073
uugaucagugcacugacgcua

SEQ ID NO: 2671727 - RNA, 21 nt, Escherichia coli CFT073
uugaucccugcaccaaugacu

SEQ ID NO: 2671728 - RNA, 17 nt, Escherichia coli CFT073
uugaucgccccggaagc

SEQ ID NO: 2671729 - RNA, 23 nt, Escherichia coli CFT073
uugaucgcuggcagccauaauca

SEQ ID NO: 2671730 - RNA, 17 nt, Escherichia coli CFT073
uugaucugcugccagga

SEQ ID NO: 2671731 - RNA, 15 nt, Escherichia coli CFT073
uugaucuucucuuau

SEQ ID NO: 2671732 - RNA, 20 nt, Escherichia coli CFT073
uugaugaagcuugagccgua

SEQ ID NO: 2671733 - RNA, 20 nt, Escherichia coli CFT073
uugaugaccgguucuacauc

SEQ ID NO: 2671734 - RNA, 19 nt, Escherichia coli CFT073
uugaugccaccaggcagca

SEQ ID NO: 2671735 - RNA, 19 nt, Escherichia coli CFT073
uugaugcgaguaaucaggc

SEQ ID NO: 2671736 - RNA, 20 nt, Escherichia coli CFT073
uugauggaaaauuguuccgu

SEQ ID NO: 2671737 - RNA, 14 nt, Escherichia coli CFT073
uugauggauauaau

SEQ ID NO: 2671738 - RNA, 18 nt, Escherichia coli CFT073
uugauggcaaaauccaga

SEQ ID NO: 2671739 - RNA, 11 nt, Escherichia coli CFT073
uugauggcacu

SEQ ID NO: 2671740 - RNA, 13 nt, Escherichia coli CFT073
uugaugguaaaau

SEQ ID NO: 2671741 - RNA, 22 nt, Escherichia coli CFT073
uugauguugccggauggaaaca

SEQ ID NO: 2671742 - RNA, 20 nt, Escherichia coli CFT073
uugauuacacaaguccagca

SEQ ID NO: 2671743 - RNA, 18 nt, Escherichia coli CFT073
uugauuauccucuguaaa

SEQ ID NO: 2671744 - RNA, 16 nt, Escherichia coli CFT073
uugauucugcggguua

SEQ ID NO: 2671745 - RNA, 20 nt, Escherichia coli CFT073
uugauuggcgcgaaccauca

SEQ ID NO: 2671746 - RNA, 17 nt, Escherichia coli CFT073
uugauuggcuuuaaaag

SEQ ID NO: 2671747 - RNA, 17 nt, Escherichia coli CFT073
uugauuguuuuaaauau

SEQ ID NO: 2671748 - RNA, 18 nt, Escherichia coli CFT073
uugauuuuuuugauaaac

SEQ ID NO: 2671749 - RNA, 19 nt, Escherichia coli CFT073
uugauuuuuuugauaaacc

SEQ ID NO: 2671750 - RNA, 20 nt, Escherichia coli CFT073
uugcaaagagaacugagcga

SEQ ID NO: 2671751 - RNA, 20 nt, Escherichia coli CFT073
uugcaaggaacgcugcauac

SEQ ID NO: 2671752 - RNA, 21 nt, Escherichia coli CFT073
uugcaauaauggaaccuaacg

SEQ ID NO: 2671753 - RNA, 20 nt, Escherichia coli CFT073
uugcaauaguuugaugaccg

SEQ ID NO: 2671754 - RNA, 21 nt, Escherichia coli CFT073
uugcaauaugguuauuaccaa

SEQ ID NO: 2671755 - RNA, 20 nt, Escherichia coli CFT073
uugcaaucuccuguugugau

SEQ ID NO: 2671756 - RNA, 19 nt, Escherichia coli CFT073
uugcaaucucugacauaaa

SEQ ID NO: 2671757 - RNA, 17 nt, Escherichia coli CFT073
uugcaaugcaucagcug

SEQ ID NO: 2671758 - RNA, 13 nt, Escherichia coli CFT073
uugcaauuuuuau

SEQ ID NO: 2671759 - RNA, 19 nt, Escherichia coli CFT073
uugcacauuccagaugcgc

SEQ ID NO: 2671760 - RNA, 14 nt, Escherichia coli CFT073
uugcaccacaucgg

SEQ ID NO: 2671761 - RNA, 23 nt, Escherichia coli CFT073
uugcaccagaucuuccagcggca

SEQ ID NO: 2671762 - RNA, 14 nt, Escherichia coli CFT073
uugcaccagcaaua

SEQ ID NO: 2671763 - RNA, 21 nt, Escherichia coli CFT073
uugcaccagcaauaagccagu

SEQ ID NO: 2671764 - RNA, 18 nt, Escherichia coli CFT073
uugcacuggcaccgcaga

SEQ ID NO: 2671765 - RNA, 20 nt, Escherichia coli CFT073
uugcagaaguugugaaacga

SEQ ID NO: 2671766 - RNA, 20 nt, Escherichia coli CFT073
uugcagacgggcauuuucuu

SEQ ID NO: 2671767 - RNA, 23 nt, Escherichia coli CFT073
uugcagaggugcgaccagcaaua

SEQ ID NO: 2671768 - RNA, 15 nt, Escherichia coli CFT073
uugcagcauucauca

SEQ ID NO: 2671769 - RNA, 22 nt, Escherichia coli CFT073
uugcagcuccccacaccaccau

SEQ ID NO: 2671770 - RNA, 14 nt, Escherichia coli CFT073
uugcaggaaaaacu

SEQ ID NO: 2671771 - RNA, 20 nt, Escherichia coli CFT073
uugcaggccauaugacacca

SEQ ID NO: 2671772 - RNA, 18 nt, Escherichia coli CFT073
uugcaggccugauaagcg

SEQ ID NO: 2671773 - RNA, 17 nt, Escherichia coli CFT073
uugcagggugcaagagu

SEQ ID NO: 2671774 - RNA, 21 nt, Escherichia coli CFT073
uugcaggucguccugcaaagc

SEQ ID NO: 2671775 - RNA, 14 nt, Escherichia coli CFT073
uugcagguucugcu

SEQ ID NO: 2671776 - RNA, 18 nt, Escherichia coli CFT073
uugcaguauguaauuaaa

SEQ ID NO: 2671777 - RNA, 14 nt, Escherichia coli CFT073
uugcagucccaucu

SEQ ID NO: 2671778 - RNA, 18 nt, Escherichia coli CFT073
uugcaguccgcuaaaaau

SEQ ID NO: 2671779 - RNA, 23 nt, Escherichia coli CFT073
uugcaguuggucagcaagaaacu

SEQ ID NO: 2671780 - RNA, 14 nt, Escherichia coli CFT073
uugcaguuguaauc

SEQ ID NO: 2671781 - RNA, 22 nt, Escherichia coli CFT073
uugcauaaaugccgcaaugugc

SEQ ID NO: 2671782 - RNA, 22 nt, Escherichia coli CFT073
uugcauaaugguggaguggccc

SEQ ID NO: 2671783 - RNA, 18 nt, Escherichia coli CFT073
uugcauagcggcgacuug

SEQ ID NO: 2671784 - RNA, 13 nt, Escherichia coli CFT073
uugcaucaucaag

SEQ ID NO: 2671785 - RNA, 19 nt, Escherichia coli CFT073
uugcauccacaacccguga

SEQ ID NO: 2671786 - RNA, 21 nt, Escherichia coli CFT073
uugcauccggcaugauaccga

SEQ ID NO: 2671787 - RNA, 21 nt, Escherichia coli CFT073
uugcaucgccugcgcgauacu

SEQ ID NO: 2671788 - RNA, 16 nt, Escherichia coli CFT073
uugcaugggaacugcu

SEQ ID NO: 2671789 - RNA, 17 nt, Escherichia coli CFT073
uugccaaccgaugccac

SEQ ID NO: 2671790 - RNA, 20 nt, Escherichia coli CFT073
uugccaccgguacaaacauc

SEQ ID NO: 2671791 - RNA, 16 nt, Escherichia coli CFT073
uugccacucaggcaaa

SEQ ID NO: 2671792 - RNA, 13 nt, Escherichia coli CFT073
uugccagcaacug

SEQ ID NO: 2671793 - RNA, 18 nt, Escherichia coli CFT073
uugccagcauaaucacca

SEQ ID NO: 2671794 - RNA, 15 nt, Escherichia coli CFT073
uugccagccacacca

SEQ ID NO: 2671795 - RNA, 19 nt, Escherichia coli CFT073
uugccagccaucgccugcu

SEQ ID NO: 2671796 - RNA, 17 nt, Escherichia coli CFT073
uugccagcgagaagucg

SEQ ID NO: 2671797 - RNA, 18 nt, Escherichia coli CFT073
uugccaggcaacagauaa

SEQ ID NO: 2671798 - RNA, 19 nt, Escherichia coli CFT073
uugccaggucgcuugccgc

SEQ ID NO: 2671799 - RNA, 14 nt, Escherichia coli CFT073
uugccagugacaug

SEQ ID NO: 2671800 - RNA, 22 nt, Escherichia coli CFT073
uugccagugguacaaaagcaau

SEQ ID NO: 2671801 - RNA, 12 nt, Escherichia coli CFT073
uugccauaucca

SEQ ID NO: 2671802 - RNA, 12 nt, Escherichia coli CFT073
uugccauaucuu

SEQ ID NO: 2671803 - RNA, 13 nt, Escherichia coli CFT073
uugccaugaucgu

SEQ ID NO: 2671804 - RNA, 13 nt, Escherichia coli CFT073
uugccaugugccg

SEQ ID NO: 2671805 - RNA, 16 nt, Escherichia coli CFT073
uugccauguugauccc

SEQ ID NO: 2671806 - RNA, 16 nt, Escherichia coli CFT073
uugccauguuuuccuu

SEQ ID NO: 2671807 - RNA, 18 nt, Escherichia coli CFT073
uugccauguuuuccuuuu

SEQ ID NO: 2671808 - RNA, 19 nt, Escherichia coli CFT073
uugccauuacuacaaacaa

SEQ ID NO: 2671809 - RNA, 17 nt, Escherichia coli CFT073
uugccauuuucugacaa

SEQ ID NO: 2671810 - RNA, 14 nt, Escherichia coli CFT073
uugcccgcagaugu

SEQ ID NO: 2671811 - RNA, 18 nt, Escherichia coli CFT073
uugcccggugucaacuca

SEQ ID NO: 2671812 - RNA, 22 nt, Escherichia coli CFT073
uugcccggugucaacucacugu

SEQ ID NO: 2671813 - RNA, 16 nt, Escherichia coli CFT073
uugcccgucugcugcu

SEQ ID NO: 2671814 - RNA, 17 nt, Escherichia coli CFT073
uugcccguuuuuuuauc

SEQ ID NO: 2671815 - RNA, 21 nt, Escherichia coli CFT073
uugcccucugaauaacaccca

SEQ ID NO: 2671816 - RNA, 13 nt, Escherichia coli CFT073
uugcccugacgcu

SEQ ID NO: 2671817 - RNA, 23 nt, Escherichia coli CFT073
uugcccuucacagguggucacag

SEQ ID NO: 2671818 - RNA, 23 nt, Escherichia coli CFT073
uugccgaauggcugcacuuucag

SEQ ID NO: 2671819 - RNA, 22 nt, Escherichia coli CFT073
uugccgacuggcaucuguuauc

SEQ ID NO: 2671820 - RNA, 21 nt, Escherichia coli CFT073
uugccgauauagaccaucggc

SEQ ID NO: 2671821 - RNA, 21 nt, Escherichia coli CFT073
uugccgaugucuuugcguuug

SEQ ID NO: 2671822 - RNA, 14 nt, Escherichia coli CFT073
uugccgcaccaacc

SEQ ID NO: 2671823 - RNA, 14 nt, Escherichia coli CFT073
uugccgcacucuga

SEQ ID NO: 2671824 - RNA, 16 nt, Escherichia coli CFT073
uugccgcagacaaaau

SEQ ID NO: 2671825 - RNA, 22 nt, Escherichia coli CFT073
uugccgccgcgugcaauaucaa

SEQ ID NO: 2671826 - RNA, 18 nt, Escherichia coli CFT073
uugccgcgucuuaucagg

SEQ ID NO: 2671827 - RNA, 16 nt, Escherichia coli CFT073
uugccgcucaguuccg

SEQ ID NO: 2671828 - RNA, 22 nt, Escherichia coli CFT073
uugccggaagcgccaccagcgc

SEQ ID NO: 2671829 - RNA, 16 nt, Escherichia coli CFT073
uugccggaucuuucag

SEQ ID NO: 2671830 - RNA, 18 nt, Escherichia coli CFT073
uugccgggcgugcugccu

SEQ ID NO: 2671831 - RNA, 23 nt, Escherichia coli CFT073
uugccggggagauauuccccaga

SEQ ID NO: 2671832 - RNA, 18 nt, Escherichia coli CFT073
uugccguaaucgccucca

SEQ ID NO: 2671833 - RNA, 21 nt, Escherichia coli CFT073
uugccguauaacgcgauuaca

SEQ ID NO: 2671834 - RNA, 19 nt, Escherichia coli CFT073
uugccguccggcaucgcaa

SEQ ID NO: 2671835 - RNA, 19 nt, Escherichia coli CFT073
uugccgucgaaaucggcaa

SEQ ID NO: 2671836 - RNA, 20 nt, Escherichia coli CFT073
uugccgucgauaugcaaauc

SEQ ID NO: 2671837 - RNA, 15 nt, Escherichia coli CFT073
uugccguucuucccg

SEQ ID NO: 2671838 - RNA, 13 nt, Escherichia coli CFT073
uugccguuggcgg

SEQ ID NO: 2671839 - RNA, 13 nt, Escherichia coli CFT073
uugccucccugca

SEQ ID NO: 2671840 - RNA, 13 nt, Escherichia coli CFT073
uugccugaaaaau

SEQ ID NO: 2671841 - RNA, 13 nt, Escherichia coli CFT073
uugccugaauaca

SEQ ID NO: 2671842 - RNA, 14 nt, Escherichia coli CFT073
uugccugaucgcgc

SEQ ID NO: 2671843 - RNA, 19 nt, Escherichia coli CFT073
uugccugaugcgcugcgcu

SEQ ID NO: 2671844 - RNA, 12 nt, Escherichia coli CFT073
uugccugcagga

SEQ ID NO: 2671845 - RNA, 15 nt, Escherichia coli CFT073
uugccugccgccuuu

SEQ ID NO: 2671846 - RNA, 22 nt, Escherichia coli CFT073
uugccuggcauguuaugaauau

SEQ ID NO: 2671847 - RNA, 15 nt, Escherichia coli CFT073
uugccugugcaaccu

SEQ ID NO: 2671848 - RNA, 15 nt, Escherichia coli CFT073
uugcgacagccaucc

SEQ ID NO: 2671849 - RNA, 20 nt, Escherichia coli CFT073
uugcgcauaacauucagcaa

SEQ ID NO: 2671850 - RNA, 14 nt, Escherichia coli CFT073
uugcgcaugacaca

SEQ ID NO: 2671851 - RNA, 16 nt, Escherichia coli CFT073
uugcgcaugacacacu

SEQ ID NO: 2671852 - RNA, 21 nt, Escherichia coli CFT073
uugcgccaaucccgucuucgu

SEQ ID NO: 2671853 - RNA, 12 nt, Escherichia coli CFT073
uugcgccagcgc

SEQ ID NO: 2671854 - RNA, 23 nt, Escherichia coli CFT073
uugcgcccgacaauaugcagcag

SEQ ID NO: 2671855 - RNA, 11 nt, Escherichia coli CFT073
uugcgccgccc

SEQ ID NO: 2671856 - RNA, 15 nt, Escherichia coli CFT073
uugcgccucaagaau

SEQ ID NO: 2671857 - RNA, 18 nt, Escherichia coli CFT073
uugcgcgacguugcuucu

SEQ ID NO: 2671858 - RNA, 15 nt, Escherichia coli CFT073
uugcgcgcguaccug

SEQ ID NO: 2671859 - RNA, 24 nt, Escherichia coli CFT073
uugcgcggauggccucugccagcu

SEQ ID NO: 2671860 - RNA, 21 nt, Escherichia coli CFT073
uugcgcuacguaucagggcua

SEQ ID NO: 2671861 - RNA, 17 nt, Escherichia coli CFT073
uugcggcaaacgguucg

SEQ ID NO: 2671862 - RNA, 13 nt, Escherichia coli CFT073
uugcggcacccau

SEQ ID NO: 2671863 - RNA, 17 nt, Escherichia coli CFT073
uugcggcagagcaaaca

SEQ ID NO: 2671864 - RNA, 22 nt, Escherichia coli CFT073
uugcgguggauuuaaugccaau

SEQ ID NO: 2671865 - RNA, 21 nt, Escherichia coli CFT073
uugcgguguguggcugucaac

SEQ ID NO: 2671866 - RNA, 13 nt, Escherichia coli CFT073
uugcgguuuuucu

SEQ ID NO: 2671867 - RNA, 13 nt, Escherichia coli CFT073
uugcguaucguuc

SEQ ID NO: 2671868 - RNA, 23 nt, Escherichia coli CFT073
uugcguaucguucgccagcucca

SEQ ID NO: 2671869 - RNA, 16 nt, Escherichia coli CFT073
uugcgucagcuucaga

SEQ ID NO: 2671870 - RNA, 22 nt, Escherichia coli CFT073
uugcguccacuggucugacgcu

SEQ ID NO: 2671871 - RNA, 15 nt, Escherichia coli CFT073
uugcgugauauuaca

SEQ ID NO: 2671872 - RNA, 13 nt, Escherichia coli CFT073
uugcguucaucag

SEQ ID NO: 2671873 - RNA, 15 nt, Escherichia coli CFT073
uugcuaagcucucag

SEQ ID NO: 2671874 - RNA, 19 nt, Escherichia coli CFT073
uugcuaagcucucagcaua

SEQ ID NO: 2671875 - RNA, 19 nt, Escherichia coli CFT073
uugcuaucgcgaaucccua

SEQ ID NO: 2671876 - RNA, 23 nt, Escherichia coli CFT073
uugcuaucggcgauguagcgcug

SEQ ID NO: 2671877 - RNA, 13 nt, Escherichia coli CFT073
uugcuauuucccc

SEQ ID NO: 2671878 - RNA, 21 nt, Escherichia coli CFT073
uugcuauuucccccucccccu

SEQ ID NO: 2671879 - RNA, 16 nt, Escherichia coli CFT073
uugcucaaauccauca

SEQ ID NO: 2671880 - RNA, 19 nt, Escherichia coli CFT073
uugcucagaaucacgccaa

SEQ ID NO: 2671881 - RNA, 23 nt, Escherichia coli CFT073
uugcucaggaguaaacuuucccu

SEQ ID NO: 2671882 - RNA, 16 nt, Escherichia coli CFT073
uugcucauccauugcu

SEQ ID NO: 2671883 - RNA, 16 nt, Escherichia coli CFT073
uugcuccacgcucaga

SEQ ID NO: 2671884 - RNA, 19 nt, Escherichia coli CFT073
uugcucgaagaguuccagc

SEQ ID NO: 2671885 - RNA, 21 nt, Escherichia coli CFT073
uugcucugcgcccacaucacg

SEQ ID NO: 2671886 - RNA, 13 nt, Escherichia coli CFT073
uugcucuguuuuc

SEQ ID NO: 2671887 - RNA, 19 nt, Escherichia coli CFT073
uugcucuucgcguaauguu

SEQ ID NO: 2671888 - RNA, 15 nt, Escherichia coli CFT073
uugcugacgaucggc

SEQ ID NO: 2671889 - RNA, 14 nt, Escherichia coli CFT073
uugcugcacauccg

SEQ ID NO: 2671890 - RNA, 13 nt, Escherichia coli CFT073
uugcugcaccagc

SEQ ID NO: 2671891 - RNA, 14 nt, Escherichia coli CFT073
uugcugcaccaggc

SEQ ID NO: 2671892 - RNA, 10 nt, Escherichia coli CFT073
uugcugccag

SEQ ID NO: 2671893 - RNA, 23 nt, Escherichia coli CFT073
uugcugcccccgccacuccguca

SEQ ID NO: 2671894 - RNA, 15 nt, Escherichia coli CFT073
uugcugccguucuca

SEQ ID NO: 2671895 - RNA, 19 nt, Escherichia coli CFT073
uugcugccguucucaaagg

SEQ ID NO: 2671896 - RNA, 13 nt, Escherichia coli CFT073
uugcugccuucac

SEQ ID NO: 2671897 - RNA, 13 nt, Escherichia coli CFT073
uugcugccuuucg

SEQ ID NO: 2671898 - RNA, 20 nt, Escherichia coli CFT073
uugcugcgcccgcagcggcg

SEQ ID NO: 2671899 - RNA, 20 nt, Escherichia coli CFT073
uugcugcggcguuccccagu

SEQ ID NO: 2671900 - RNA, 12 nt, Escherichia coli CFT073
uugcugcugccg

SEQ ID NO: 2671901 - RNA, 16 nt, Escherichia coli CFT073
uugcuggugauugcaa

SEQ ID NO: 2671902 - RNA, 14 nt, Escherichia coli CFT073
uugcugguuuugua

SEQ ID NO: 2671903 - RNA, 23 nt, Escherichia coli CFT073
uugcugucgauuuucacauaagc

SEQ ID NO: 2671904 - RNA, 12 nt, Escherichia coli CFT073
uugcugucgcgc

SEQ ID NO: 2671905 - RNA, 16 nt, Escherichia coli CFT073
uugcugucgcgcagca

SEQ ID NO: 2671906 - RNA, 11 nt, Escherichia coli CFT073
uugcugugaag

SEQ ID NO: 2671907 - RNA, 15 nt, Escherichia coli CFT073
uugcugugcuuuaca

SEQ ID NO: 2671908 - RNA, 17 nt, Escherichia coli CFT073
uugcuguugauucugcg

SEQ ID NO: 2671909 - RNA, 16 nt, Escherichia coli CFT073
uugcuguuguuccagc

SEQ ID NO: 2671910 - RNA, 17 nt, Escherichia coli CFT073
uugcuguuguuccagcu

SEQ ID NO: 2671911 - RNA, 23 nt, Escherichia coli CFT073
uugcuuaaauacgccucuucaua

SEQ ID NO: 2671912 - RNA, 18 nt, Escherichia coli CFT073
uugcuucaagaugccauu

SEQ ID NO: 2671913 - RNA, 12 nt, Escherichia coli CFT073
uugcuucucuug

SEQ ID NO: 2671914 - RNA, 14 nt, Escherichia coli CFT073
uugcuucuguuuuc

SEQ ID NO: 2671915 - RNA, 22 nt, Escherichia coli CFT073
uugcuucuuacuauauaaaccu

SEQ ID NO: 2671916 - RNA, 15 nt, Escherichia coli CFT073
uugcuugcaauauac

SEQ ID NO: 2671917 - RNA, 13 nt, Escherichia coli CFT073
uugcuuuccagcu

SEQ ID NO: 2671918 - RNA, 21 nt, Escherichia coli CFT073
uugcuuugaucaagcaccgcc

SEQ ID NO: 2671919 - RNA, 11 nt, Escherichia coli CFT073
uuggaaaucac

SEQ ID NO: 2671920 - RNA, 13 nt, Escherichia coli CFT073
uuggacaugugcg

SEQ ID NO: 2671921 - RNA, 15 nt, Escherichia coli CFT073
uuggaccguagacug

SEQ ID NO: 2671922 - RNA, 17 nt, Escherichia coli CFT073
uuggacucauuaaacca

SEQ ID NO: 2671923 - RNA, 14 nt, Escherichia coli CFT073
uuggcaaaaccaaa

SEQ ID NO: 2671924 - RNA, 22 nt, Escherichia coli CFT073
uuggcacacaccagauccagca

SEQ ID NO: 2671925 - RNA, 17 nt, Escherichia coli CFT073
uuggcacagguuuguac

SEQ ID NO: 2671926 - RNA, 15 nt, Escherichia coli CFT073
uuggcaccaucccua

SEQ ID NO: 2671927 - RNA, 20 nt, Escherichia coli CFT073
uuggcaccaucccuaugcau

SEQ ID NO: 2671928 - RNA, 12 nt, Escherichia coli CFT073
uuggcaccgccu

SEQ ID NO: 2671929 - RNA, 14 nt, Escherichia coli CFT073
uuggcagcggcaag

SEQ ID NO: 2671930 - RNA, 14 nt, Escherichia coli CFT073
uuggcaucaccgga

SEQ ID NO: 2671931 - RNA, 12 nt, Escherichia coli CFT073
uuggcaucaggc

SEQ ID NO: 2671932 - RNA, 12 nt, Escherichia coli CFT073
uuggccugaaua

SEQ ID NO: 2671933 - RNA, 16 nt, Escherichia coli CFT073
uuggcgauaccccaac

SEQ ID NO: 2671934 - RNA, 16 nt, Escherichia coli CFT073
uuggcgcauaacucac

SEQ ID NO: 2671935 - RNA, 15 nt, Escherichia coli CFT073
uuggcguaccauuaa

SEQ ID NO: 2671936 - RNA, 21 nt, Escherichia coli CFT073
uuggcgucaaacgacuaaagc

SEQ ID NO: 2671937 - RNA, 14 nt, Escherichia coli CFT073
uuggcuucacugau

SEQ ID NO: 2671938 - RNA, 15 nt, Escherichia coli CFT073
uuggcuuugauauuc

SEQ ID NO: 2671939 - RNA, 16 nt, Escherichia coli CFT073
uuggcuuugauauuca

SEQ ID NO: 2671940 - RNA, 21 nt, Escherichia coli CFT073
uugggaauuugcuccgccacu

SEQ ID NO: 2671941 - RNA, 15 nt, Escherichia coli CFT073
uugggacagugcagg

SEQ ID NO: 2671942 - RNA, 17 nt, Escherichia coli CFT073
uugggcgaucucccgcu

SEQ ID NO: 2671943 - RNA, 18 nt, Escherichia coli CFT073
uuggggaugacgaauaau

SEQ ID NO: 2671944 - RNA, 19 nt, Escherichia coli CFT073
uugguaaagcaauaaacca

SEQ ID NO: 2671945 - RNA, 18 nt, Escherichia coli CFT073
uugguauggcugucgcac

SEQ ID NO: 2671946 - RNA, 17 nt, Escherichia coli CFT073
uugguauuccaguucag

SEQ ID NO: 2671947 - RNA, 17 nt, Escherichia coli CFT073
uugguccgaucccugca

SEQ ID NO: 2671948 - RNA, 17 nt, Escherichia coli CFT073
uuggugaaugccugauc

SEQ ID NO: 2671949 - RNA, 15 nt, Escherichia coli CFT073
uuggugauguauauc

SEQ ID NO: 2671950 - RNA, 11 nt, Escherichia coli CFT073
uuggugcauag

SEQ ID NO: 2671951 - RNA, 23 nt, Escherichia coli CFT073
uuggugcccaggguaagaugaau

SEQ ID NO: 2671952 - RNA, 20 nt, Escherichia coli CFT073
uuggugcgaacuucguggua

SEQ ID NO: 2671953 - RNA, 21 nt, Escherichia coli CFT073
uugguggcaaccggaauguuc

SEQ ID NO: 2671954 - RNA, 17 nt, Escherichia coli CFT073
uugguggcgucaugcuc

SEQ ID NO: 2671955 - RNA, 20 nt, Escherichia coli CFT073
uugguuaaauaauauuuccc

SEQ ID NO: 2671956 - RNA, 14 nt, Escherichia coli CFT073
uugguuaacugaau

SEQ ID NO: 2671957 - RNA, 22 nt, Escherichia coli CFT073
uugguuaacugaauauuccagu

SEQ ID NO: 2671958 - RNA, 14 nt, Escherichia coli CFT073
uugguuauccagca

SEQ ID NO: 2671959 - RNA, 14 nt, Escherichia coli CFT073
uugguuauuaacug

SEQ ID NO: 2671960 - RNA, 16 nt, Escherichia coli CFT073
uugguuucgaugccuu

SEQ ID NO: 2671961 - RNA, 14 nt, Escherichia coli CFT073
uugguuucgucgug

SEQ ID NO: 2671962 - RNA, 14 nt, Escherichia coli CFT073
uuguaaagcgccaa

SEQ ID NO: 2671963 - RNA, 12 nt, Escherichia coli CFT073
uuguaaaugaac

SEQ ID NO: 2671964 - RNA, 22 nt, Escherichia coli CFT073
uuguaacgucgcaucuggucag

SEQ ID NO: 2671965 - RNA, 19 nt, Escherichia coli CFT073
uuguaccagcuucagaaua

SEQ ID NO: 2671966 - RNA, 14 nt, Escherichia coli CFT073
uuguacuuuaaaau

SEQ ID NO: 2671967 - RNA, 13 nt, Escherichia coli CFT073
uuguagaccugau

SEQ ID NO: 2671968 - RNA, 13 nt, Escherichia coli CFT073
uuguagagcagca

SEQ ID NO: 2671969 - RNA, 14 nt, Escherichia coli CFT073
uuguagauuuugca

SEQ ID NO: 2671970 - RNA, 19 nt, Escherichia coli CFT073
uuguagcuaaacugaucuu

SEQ ID NO: 2671971 - RNA, 22 nt, Escherichia coli CFT073
uuguagcuuuuuccucagcuua

SEQ ID NO: 2671972 - RNA, 20 nt, Escherichia coli CFT073
uuguaggcaggauaaggcgu

SEQ ID NO: 2671973 - RNA, 14 nt, Escherichia coli CFT073
uuguaggccggaua

SEQ ID NO: 2671974 - RNA, 20 nt, Escherichia coli CFT073
uuguaggccggauaaggcau

SEQ ID NO: 2671975 - RNA, 20 nt, Escherichia coli CFT073
uuguaggccugauaagacac

SEQ ID NO: 2671976 - RNA, 20 nt, Escherichia coli CFT073
uuguaggcuggauaaggcgu

SEQ ID NO: 2671977 - RNA, 16 nt, Escherichia coli CFT073
uuguaggucagguucu

SEQ ID NO: 2671978 - RNA, 14 nt, Escherichia coli CFT073
uuguaucaccacac

SEQ ID NO: 2671979 - RNA, 18 nt, Escherichia coli CFT073
uuguaucuagggacauag

SEQ ID NO: 2671980 - RNA, 15 nt, Escherichia coli CFT073
uuguauggccuggug

SEQ ID NO: 2671981 - RNA, 14 nt, Escherichia coli CFT073
uuguaugguuuugu

SEQ ID NO: 2671982 - RNA, 12 nt, Escherichia coli CFT073
uuguauucaguu

SEQ ID NO: 2671983 - RNA, 21 nt, Escherichia coli CFT073
uuguauuuuuccgcacauacu

SEQ ID NO: 2671984 - RNA, 16 nt, Escherichia coli CFT073
uugucaccguaaccac

SEQ ID NO: 2671985 - RNA, 18 nt, Escherichia coli CFT073
uugucaccguaaccacca

SEQ ID NO: 2671986 - RNA, 23 nt, Escherichia coli CFT073
uugucagacggugccagguaaug

SEQ ID NO: 2671987 - RNA, 18 nt, Escherichia coli CFT073
uugucaggccggaauaac

SEQ ID NO: 2671988 - RNA, 13 nt, Escherichia coli CFT073
uugucauaaccaa

SEQ ID NO: 2671989 - RNA, 19 nt, Escherichia coli CFT073
uugucauagcgacuaccac

SEQ ID NO: 2671990 - RNA, 23 nt, Escherichia coli CFT073
uugucauauaauguaucugaagu

SEQ ID NO: 2671991 - RNA, 13 nt, Escherichia coli CFT073
uugucaucgguca

SEQ ID NO: 2671992 - RNA, 19 nt, Escherichia coli CFT073
uugucauuguuauaauguu

SEQ ID NO: 2671993 - RNA, 17 nt, Escherichia coli CFT073
uuguccgucugaaaacu

SEQ ID NO: 2671994 - RNA, 14 nt, Escherichia coli CFT073
uugucgauuuccau

SEQ ID NO: 2671995 - RNA, 20 nt, Escherichia coli CFT073
uugucgcccuguaauucgua

SEQ ID NO: 2671996 - RNA, 23 nt, Escherichia coli CFT073
uugucggaucgcugaacgcaccu

SEQ ID NO: 2671997 - RNA, 17 nt, Escherichia coli CFT073
uugucgggcaggagcug

SEQ ID NO: 2671998 - RNA, 15 nt, Escherichia coli CFT073
uugucguugggauca

SEQ ID NO: 2671999 - RNA, 18 nt, Escherichia coli CFT073
uugucuuuuucaaaguca

SEQ ID NO: 2672000 - RNA, 21 nt, Escherichia coli CFT073
uugugaacuucgccaggauag

SEQ ID NO: 2672001 - RNA, 13 nt, Escherichia coli CFT073
uugugacaaacug

SEQ ID NO: 2672002 - RNA, 21 nt, Escherichia coli CFT073
uugugacauggcuaugcguug

SEQ ID NO: 2672003 - RNA, 20 nt, Escherichia coli CFT073
uugugacauuaaccaaccac

SEQ ID NO: 2672004 - RNA, 21 nt, Escherichia coli CFT073
uugugaccacggacuuaugag

SEQ ID NO: 2672005 - RNA, 15 nt, Escherichia coli CFT073
uugugagcaugugca

SEQ ID NO: 2672006 - RNA, 18 nt, Escherichia coli CFT073
uugugauuaccgcaaauc

SEQ ID NO: 2672007 - RNA, 16 nt, Escherichia coli CFT073
uugugauuuauuuucc

SEQ ID NO: 2672008 - RNA, 18 nt, Escherichia coli CFT073
uugugcaaaaaaauuuca

SEQ ID NO: 2672009 - RNA, 16 nt, Escherichia coli CFT073
uugugcaaugugguga

SEQ ID NO: 2672010 - RNA, 20 nt, Escherichia coli CFT073
uugugcacagaaaagcagag

SEQ ID NO: 2672011 - RNA, 14 nt, Escherichia coli CFT073
uugugcaccaccaa

SEQ ID NO: 2672012 - RNA, 17 nt, Escherichia coli CFT073
uugugcaccagcuggcu

SEQ ID NO: 2672013 - RNA, 17 nt, Escherichia coli CFT073
uugugccagaccgaaca

SEQ ID NO: 2672014 - RNA, 21 nt, Escherichia coli CFT073
uugugccagaccgaacagcau

SEQ ID NO: 2672015 - RNA, 22 nt, Escherichia coli CFT073
uugugccagagcacugcauucg

SEQ ID NO: 2672016 - RNA, 13 nt, Escherichia coli CFT073
uugugcuucaguu

SEQ ID NO: 2672017 - RNA, 20 nt, Escherichia coli CFT073
uuguggaaauuccagcggca

SEQ ID NO: 2672018 - RNA, 14 nt, Escherichia coli CFT073
uuguggaucgauuu

SEQ ID NO: 2672019 - RNA, 21 nt, Escherichia coli CFT073
uuguggcgguuuuucagcuua

SEQ ID NO: 2672020 - RNA, 15 nt, Escherichia coli CFT073
uugugggcaggaaaa

SEQ ID NO: 2672021 - RNA, 21 nt, Escherichia coli CFT073
uugugggcaggaaaaucagca

SEQ ID NO: 2672022 - RNA, 19 nt, Escherichia coli CFT073
uugugggccgaaaugagau

SEQ ID NO: 2672023 - RNA, 14 nt, Escherichia coli CFT073
uugugggccugaua

SEQ ID NO: 2672024 - RNA, 20 nt, Escherichia coli CFT073
uugugucugauugccggaug

SEQ ID NO: 2672025 - RNA, 17 nt, Escherichia coli CFT073
uugugugcuggccauca

SEQ ID NO: 2672026 - RNA, 16 nt, Escherichia coli CFT073
uuguguuuauuuaaug

SEQ ID NO: 2672027 - RNA, 18 nt, Escherichia coli CFT073
uuguuaaauccagauccu

SEQ ID NO: 2672028 - RNA, 17 nt, Escherichia coli CFT073
uuguuacccccauccac

SEQ ID NO: 2672029 - RNA, 23 nt, Escherichia coli CFT073
uuguuauauucacuugccugcug

SEQ ID NO: 2672030 - RNA, 13 nt, Escherichia coli CFT073
uuguuauccagcu

SEQ ID NO: 2672031 - RNA, 15 nt, Escherichia coli CFT073
uuguuauccaucagc

SEQ ID NO: 2672032 - RNA, 23 nt, Escherichia coli CFT073
uuguuaugcgaaauagcgccaua

SEQ ID NO: 2672033 - RNA, 12 nt, Escherichia coli CFT073
uuguuauuuccg

SEQ ID NO: 2672034 - RNA, 16 nt, Escherichia coli CFT073
uuguucaugccggaug

SEQ ID NO: 2672035 - RNA, 15 nt, Escherichia coli CFT073
uuguucugcaaauuc

SEQ ID NO: 2672036 - RNA, 11 nt, Escherichia coli CFT073
uuguucugguc

SEQ ID NO: 2672037 - RNA, 13 nt, Escherichia coli CFT073
uuguugaacagac

SEQ ID NO: 2672038 - RNA, 14 nt, Escherichia coli CFT073
uuguugaacagacg

SEQ ID NO: 2672039 - RNA, 19 nt, Escherichia coli CFT073
uuguugccgcccguuuucu

SEQ ID NO: 2672040 - RNA, 18 nt, Escherichia coli CFT073
uuguugcgcugaaauaau

SEQ ID NO: 2672041 - RNA, 19 nt, Escherichia coli CFT073
uuguugcgucgaaaccaca

SEQ ID NO: 2672042 - RNA, 15 nt, Escherichia coli CFT073
uuguuggcauggugg

SEQ ID NO: 2672043 - RNA, 17 nt, Escherichia coli CFT073
uuguugguacaccugcu

SEQ ID NO: 2672044 - RNA, 16 nt, Escherichia coli CFT073
uuguuuacgccggaug

SEQ ID NO: 2672045 - RNA, 18 nt, Escherichia coli CFT073
uuguuuacuaaaaguuau

SEQ ID NO: 2672046 - RNA, 19 nt, Escherichia coli CFT073
uuguuuagauccauaucca

SEQ ID NO: 2672047 - RNA, 23 nt, Escherichia coli CFT073
uuguuucuucgauggcuggggua

SEQ ID NO: 2672048 - RNA, 20 nt, Escherichia coli CFT073
uuguuuguuucuuauucaga

SEQ ID NO: 2672049 - RNA, 10 nt, Escherichia coli CFT073
uuguuuugcu

SEQ ID NO: 2672050 - RNA, 11 nt, Escherichia coli CFT073
uuguuuuucag

SEQ ID NO: 2672051 - RNA, 18 nt, Escherichia coli CFT073
uuguuuuuuuaacauauc

SEQ ID NO: 2672052 - RNA, 13 nt, Escherichia coli CFT073
uuuaaaaaaauua

SEQ ID NO: 2672053 - RNA, 13 nt, Escherichia coli CFT073
uuuaaaaaugcca

SEQ ID NO: 2672054 - RNA, 23 nt, Escherichia coli CFT073
uuuaaaaucgcuucgaugguugg

SEQ ID NO: 2672055 - RNA, 21 nt, Escherichia coli CFT073
uuuaaaauugauaaccaauag

SEQ ID NO: 2672056 - RNA, 14 nt, Escherichia coli CFT073
uuuaaaccaacuuc

SEQ ID NO: 2672057 - RNA, 18 nt, Escherichia coli CFT073
uuuaaauauuguuuuuau

SEQ ID NO: 2672058 - RNA, 22 nt, Escherichia coli CFT073
uuuaaaugcccgacaaaaauua

SEQ ID NO: 2672059 - RNA, 17 nt, Escherichia coli CFT073
uuuaaaugccggaaugc

SEQ ID NO: 2672060 - RNA, 15 nt, Escherichia coli CFT073
uuuaacaacucacca

SEQ ID NO: 2672061 - RNA, 14 nt, Escherichia coli CFT073
uuuaacaauucucc

SEQ ID NO: 2672062 - RNA, 16 nt, Escherichia coli CFT073
uuuaacacgcaacacg

SEQ ID NO: 2672063 - RNA, 15 nt, Escherichia coli CFT073
uuuaacacgcucugg

SEQ ID NO: 2672064 - RNA, 11 nt, Escherichia coli CFT073
uuuaaccaccu

SEQ ID NO: 2672065 - RNA, 14 nt, Escherichia coli CFT073
uuuaaccguggugc

SEQ ID NO: 2672066 - RNA, 11 nt, Escherichia coli CFT073
uuuaacgccac

SEQ ID NO: 2672067 - RNA, 22 nt, Escherichia coli CFT073
uuuaacgcccugaugcaucaac

SEQ ID NO: 2672068 - RNA, 22 nt, Escherichia coli CFT073
uuuaacuucgcguucuguggca

SEQ ID NO: 2672069 - RNA, 14 nt, Escherichia coli CFT073
uuuaacuuuaauuu

SEQ ID NO: 2672070 - RNA, 13 nt, Escherichia coli CFT073
uuuaagccauuaa

SEQ ID NO: 2672071 - RNA, 15 nt, Escherichia coli CFT073
uuuaagcgaaagcgu

SEQ ID NO: 2672072 - RNA, 12 nt, Escherichia coli CFT073
uuuaauaaaaag

SEQ ID NO: 2672073 - RNA, 13 nt, Escherichia coli CFT073
uuuaauaacagcu

SEQ ID NO: 2672074 - RNA, 22 nt, Escherichia coli CFT073
uuuaauaacagcuggauaucaa

SEQ ID NO: 2672075 - RNA, 23 nt, Escherichia coli CFT073
uuuaauaaucucgccuuaucaga

SEQ ID NO: 2672076 - RNA, 19 nt, Escherichia coli CFT073
uuuaauagauaauuuugaa

SEQ ID NO: 2672077 - RNA, 11 nt, Escherichia coli CFT073
uuuaauauuac

SEQ ID NO: 2672078 - RNA, 12 nt, Escherichia coli CFT073
uuuaaucaccug

SEQ ID NO: 2672079 - RNA, 17 nt, Escherichia coli CFT073
uuuaaucccgugccugc

SEQ ID NO: 2672080 - RNA, 16 nt, Escherichia coli CFT073
uuuaaucuauauaugu

SEQ ID NO: 2672081 - RNA, 18 nt, Escherichia coli CFT073
uuuaaugauuuccaggau

SEQ ID NO: 2672082 - RNA, 15 nt, Escherichia coli CFT073
uuuaaugcugucuca

SEQ ID NO: 2672083 - RNA, 13 nt, Escherichia coli CFT073
uuuaauucaaaug

SEQ ID NO: 2672084 - RNA, 12 nt, Escherichia coli CFT073
uuuaauuccugc

SEQ ID NO: 2672085 - RNA, 16 nt, Escherichia coli CFT073
uuuaauuggcgucacg

SEQ ID NO: 2672086 - RNA, 16 nt, Escherichia coli CFT073
uuuacaaauaauuucu

SEQ ID NO: 2672087 - RNA, 17 nt, Escherichia coli CFT073
uuuacagauuucccauu

SEQ ID NO: 2672088 - RNA, 23 nt, Escherichia coli CFT073
uuuacagccagccgcuaacuucc

SEQ ID NO: 2672089 - RNA, 21 nt, Escherichia coli CFT073
uuuacaucaucagaaaugcca

SEQ ID NO: 2672090 - RNA, 18 nt, Escherichia coli CFT073
uuuacauggcagaccaaa

SEQ ID NO: 2672091 - RNA, 17 nt, Escherichia coli CFT073
uuuaccaaaggugacug

SEQ ID NO: 2672092 - RNA, 13 nt, Escherichia coli CFT073
uuuaccagcagcc

SEQ ID NO: 2672093 - RNA, 20 nt, Escherichia coli CFT073
uuuacccaacucuuuacaga

SEQ ID NO: 2672094 - RNA, 16 nt, Escherichia coli CFT073
uuuacccaauccccca

SEQ ID NO: 2672095 - RNA, 14 nt, Escherichia coli CFT073
uuuacccagcagca

SEQ ID NO: 2672096 - RNA, 22 nt, Escherichia coli CFT073
uuuaccgaguccgccauuauua

SEQ ID NO: 2672097 - RNA, 15 nt, Escherichia coli CFT073
uuuaccggcaacucu

SEQ ID NO: 2672098 - RNA, 17 nt, Escherichia coli CFT073
uuuaccggucaugucgg

SEQ ID NO: 2672099 - RNA, 17 nt, Escherichia coli CFT073
uuuaccggugccagcaa

SEQ ID NO: 2672100 - RNA, 15 nt, Escherichia coli CFT073
uuuaccguuccggua

SEQ ID NO: 2672101 - RNA, 20 nt, Escherichia coli CFT073
uuuaccugcuuaaucauauu

SEQ ID NO: 2672102 - RNA, 13 nt, Escherichia coli CFT073
uuuaccuucaucc

SEQ ID NO: 2672103 - RNA, 18 nt, Escherichia coli CFT073
uuuaccuuuaaacuguuu

SEQ ID NO: 2672104 - RNA, 14 nt, Escherichia coli CFT073
uuuaccuuucucgu

SEQ ID NO: 2672105 - RNA, 14 nt, Escherichia coli CFT073
uuuacgaacauuaa

SEQ ID NO: 2672106 - RNA, 19 nt, Escherichia coli CFT073
uuuacgauggcagggcagc

SEQ ID NO: 2672107 - RNA, 12 nt, Escherichia coli CFT073
uuuacgccgcau

SEQ ID NO: 2672108 - RNA, 15 nt, Escherichia coli CFT073
uuuacgccgcauccg

SEQ ID NO: 2672109 - RNA, 19 nt, Escherichia coli CFT073
uuuacgccgcauccggcaa

SEQ ID NO: 2672110 - RNA, 18 nt, Escherichia coli CFT073
uuuacgcucccacggaau

SEQ ID NO: 2672111 - RNA, 21 nt, Escherichia coli CFT073
uuuacgguauaacccaguaca

SEQ ID NO: 2672112 - RNA, 13 nt, Escherichia coli CFT073
uuuacuaaaaguu

SEQ ID NO: 2672113 - RNA, 21 nt, Escherichia coli CFT073
uuuacuaauagcaaaauauaa

SEQ ID NO: 2672114 - RNA, 20 nt, Escherichia coli CFT073
uuuacucacaucugacaaaa

SEQ ID NO: 2672115 - RNA, 17 nt, Escherichia coli CFT073
uuuacucuucuuuaauu

SEQ ID NO: 2672116 - RNA, 23 nt, Escherichia coli CFT073
uuuacugccgcgauggguuguug

SEQ ID NO: 2672117 - RNA, 20 nt, Escherichia coli CFT073
uuuacuguggucgacaacca

SEQ ID NO: 2672118 - RNA, 11 nt, Escherichia coli CFT073
uuuacuuaaua

SEQ ID NO: 2672119 - RNA, 13 nt, Escherichia coli CFT073
uuuacuugccugu

SEQ ID NO: 2672120 - RNA, 13 nt, Escherichia coli CFT073
uuuacuuucuugc

SEQ ID NO: 2672121 - RNA, 15 nt, Escherichia coli CFT073
uuuagaaaagaguau

SEQ ID NO: 2672122 - RNA, 21 nt, Escherichia coli CFT073
uuuagaacugaucaauaaauu

SEQ ID NO: 2672123 - RNA, 17 nt, Escherichia coli CFT073
uuuagacacaucagcaa

SEQ ID NO: 2672124 - RNA, 19 nt, Escherichia coli CFT073
uuuagcaguucaucaagcu

SEQ ID NO: 2672125 - RNA, 20 nt, Escherichia coli CFT073
uuuagcaugugcaaucuaca

SEQ ID NO: 2672126 - RNA, 16 nt, Escherichia coli CFT073
uuuagcgaauaacaaa

SEQ ID NO: 2672127 - RNA, 12 nt, Escherichia coli CFT073
uuuagcucagaa

SEQ ID NO: 2672128 - RNA, 21 nt, Escherichia coli CFT073
uuuaggaaaguaagugccgga

SEQ ID NO: 2672129 - RNA, 17 nt, Escherichia coli CFT073
uuuagguacaaagccaa

SEQ ID NO: 2672130 - RNA, 16 nt, Escherichia coli CFT073
uuuagucgccacaauc

SEQ ID NO: 2672131 - RNA, 16 nt, Escherichia coli CFT073
uuuagucguugccgga

SEQ ID NO: 2672132 - RNA, 16 nt, Escherichia coli CFT073
uuuaguuuacauuaau

SEQ ID NO: 2672133 - RNA, 21 nt, Escherichia coli CFT073
uuuauaaaacgagcgauccaa

SEQ ID NO: 2672134 - RNA, 13 nt, Escherichia coli CFT073
uuuauaaaaucca

SEQ ID NO: 2672135 - RNA, 16 nt, Escherichia coli CFT073
uuuauaaaauccaacu

SEQ ID NO: 2672136 - RNA, 16 nt, Escherichia coli CFT073
uuuauaaauugcaauu

SEQ ID NO: 2672137 - RNA, 15 nt, Escherichia coli CFT073
uuuauaacuauauga

SEQ ID NO: 2672138 - RNA, 16 nt, Escherichia coli CFT073
uuuauaacuauaugac

SEQ ID NO: 2672139 - RNA, 22 nt, Escherichia coli CFT073
uuuauaacuauaugacucauaa

SEQ ID NO: 2672140 - RNA, 17 nt, Escherichia coli CFT073
uuuauaccaacaaaaaa

SEQ ID NO: 2672141 - RNA, 20 nt, Escherichia coli CFT073
uuuauacggcguuuccagcu

SEQ ID NO: 2672142 - RNA, 17 nt, Escherichia coli CFT073
uuuauagcguugcccga

SEQ ID NO: 2672143 - RNA, 20 nt, Escherichia coli CFT073
uuuauagcugauaucaccug

SEQ ID NO: 2672144 - RNA, 12 nt, Escherichia coli CFT073
uuuauauaauga

SEQ ID NO: 2672145 - RNA, 17 nt, Escherichia coli CFT073
uuuaucaaugacaucug

SEQ ID NO: 2672146 - RNA, 23 nt, Escherichia coli CFT073
uuuaucaauuaacugugccagcg

SEQ ID NO: 2672147 - RNA, 19 nt, Escherichia coli CFT073
uuuaucagcucauaggccu

SEQ ID NO: 2672148 - RNA, 12 nt, Escherichia coli CFT073
uuuaucaggccu

SEQ ID NO: 2672149 - RNA, 14 nt, Escherichia coli CFT073
uuuaucauaauagu

SEQ ID NO: 2672150 - RNA, 11 nt, Escherichia coli CFT073
uuuauccagca

SEQ ID NO: 2672151 - RNA, 19 nt, Escherichia coli CFT073
uuuaucccggcaaaaaaca

SEQ ID NO: 2672152 - RNA, 15 nt, Escherichia coli CFT073
uuuaucccuucucca

SEQ ID NO: 2672153 - RNA, 22 nt, Escherichia coli CFT073
uuuauccgaacacucguccagu

SEQ ID NO: 2672154 - RNA, 22 nt, Escherichia coli CFT073
uuuaucgcgcaaccacaacgca

SEQ ID NO: 2672155 - RNA, 22 nt, Escherichia coli CFT073
uuuaucgucacgcaucacgaca

SEQ ID NO: 2672156 - RNA, 20 nt, Escherichia coli CFT073
uuuaucugugaacucaggcu

SEQ ID NO: 2672157 - RNA, 12 nt, Escherichia coli CFT073
uuuaucuuccca

SEQ ID NO: 2672158 - RNA, 14 nt, Escherichia coli CFT073
uuuauggagaaaac

SEQ ID NO: 2672159 - RNA, 18 nt, Escherichia coli CFT073
uuuauuaaugacauucag

SEQ ID NO: 2672160 - RNA, 16 nt, Escherichia coli CFT073
uuuauuagcccagcca

SEQ ID NO: 2672161 - RNA, 22 nt, Escherichia coli CFT073
uuuauuagcccgggauuugguu

SEQ ID NO: 2672162 - RNA, 17 nt, Escherichia coli CFT073
uuuauucugucucaacu

SEQ ID NO: 2672163 - RNA, 20 nt, Escherichia coli CFT073
uuuauugaauuuguaggccu

SEQ ID NO: 2672164 - RNA, 16 nt, Escherichia coli CFT073
uuuauugacauguuga

SEQ ID NO: 2672165 - RNA, 18 nt, Escherichia coli CFT073
uuuauuucaaaauuaucu

SEQ ID NO: 2672166 - RNA, 13 nt, Escherichia coli CFT073
uuuauuucauaau

SEQ ID NO: 2672167 - RNA, 15 nt, Escherichia coli CFT073
uuuauuucauaaucc

SEQ ID NO: 2672168 - RNA, 18 nt, Escherichia coli CFT073
uuuauuuguuuuucagga

SEQ ID NO: 2672169 - RNA, 12 nt, Escherichia coli CFT073
uuucaaaaacaa

SEQ ID NO: 2672170 - RNA, 15 nt, Escherichia coli CFT073
uuucaaacaggcggu

SEQ ID NO: 2672171 - RNA, 12 nt, Escherichia coli CFT073
uuucaaacgcca

SEQ ID NO: 2672172 - RNA, 15 nt, Escherichia coli CFT073
uuucaaaucaccaaa

SEQ ID NO: 2672173 - RNA, 20 nt, Escherichia coli CFT073
uuucaaaucaccaaacugcu

SEQ ID NO: 2672174 - RNA, 17 nt, Escherichia coli CFT073
uuucaacggaccaauaa

SEQ ID NO: 2672175 - RNA, 13 nt, Escherichia coli CFT073
uuucaacuuccca

SEQ ID NO: 2672176 - RNA, 20 nt, Escherichia coli CFT073
uuucaauaaccgcugccagg

SEQ ID NO: 2672177 - RNA, 22 nt, Escherichia coli CFT073
uuucaauccagggguuguuauu

SEQ ID NO: 2672178 - RNA, 23 nt, Escherichia coli CFT073
uuucaaugauaaaggucaucaca

SEQ ID NO: 2672179 - RNA, 21 nt, Escherichia coli CFT073
uuucaaugccuuucuuuguuc

SEQ ID NO: 2672180 - RNA, 22 nt, Escherichia coli CFT073
uuucaaugccuuucuuuguucu

SEQ ID NO: 2672181 - RNA, 13 nt, Escherichia coli CFT073
uuucaauuccugg

SEQ ID NO: 2672182 - RNA, 16 nt, Escherichia coli CFT073
uuucaauugauaauaa

SEQ ID NO: 2672183 - RNA, 17 nt, Escherichia coli CFT073
uuucaauuugcaggcua

SEQ ID NO: 2672184 - RNA, 18 nt, Escherichia coli CFT073
uuucacaccaucaacaaa

SEQ ID NO: 2672185 - RNA, 19 nt, Escherichia coli CFT073
uuucacagaagugaagcau

SEQ ID NO: 2672186 - RNA, 20 nt, Escherichia coli CFT073
uuucacaguaauuuccugcc

SEQ ID NO: 2672187 - RNA, 12 nt, Escherichia coli CFT073
uuucacauauuc

SEQ ID NO: 2672188 - RNA, 16 nt, Escherichia coli CFT073
uuucacauauucauua

SEQ ID NO: 2672189 - RNA, 22 nt, Escherichia coli CFT073
uuucacauauucauuacuuauc

SEQ ID NO: 2672190 - RNA, 12 nt, Escherichia coli CFT073
uuucacaucauu

SEQ ID NO: 2672191 - RNA, 15 nt, Escherichia coli CFT073
uuucacccacacuuc

SEQ ID NO: 2672192 - RNA, 21 nt, Escherichia coli CFT073
uuucacccagcguuugcugcu

SEQ ID NO: 2672193 - RNA, 16 nt, Escherichia coli CFT073
uuucaccgacgacaaa

SEQ ID NO: 2672194 - RNA, 17 nt, Escherichia coli CFT073
uuucaccgaugcacaga

SEQ ID NO: 2672195 - RNA, 11 nt, Escherichia coli CFT073
uuucaccucuu

SEQ ID NO: 2672196 - RNA, 18 nt, Escherichia coli CFT073
uuucacgauguaauccug

SEQ ID NO: 2672197 - RNA, 14 nt, Escherichia coli CFT073
uuucacgccgccaa

SEQ ID NO: 2672198 - RNA, 19 nt, Escherichia coli CFT073
uuucacgcucagcaacaug

SEQ ID NO: 2672199 - RNA, 18 nt, Escherichia coli CFT073
uuucacggucggccagua

SEQ ID NO: 2672200 - RNA, 20 nt, Escherichia coli CFT073
uuucacuaagauguuguuca

SEQ ID NO: 2672201 - RNA, 20 nt, Escherichia coli CFT073
uuucacuucaaccacauuca

SEQ ID NO: 2672202 - RNA, 20 nt, Escherichia coli CFT073
uuucacuucagcaacgugcu

SEQ ID NO: 2672203 - RNA, 15 nt, Escherichia coli CFT073
uuucacuucaguaaa

SEQ ID NO: 2672204 - RNA, 19 nt, Escherichia coli CFT073
uuucacuucaguaaauacu

SEQ ID NO: 2672205 - RNA, 20 nt, Escherichia coli CFT073
uuucacuucgucagaaaugg

SEQ ID NO: 2672206 - RNA, 14 nt, Escherichia coli CFT073
uuucacuuuaccuu

SEQ ID NO: 2672207 - RNA, 15 nt, Escherichia coli CFT073
uuucagacgggccau

SEQ ID NO: 2672208 - RNA, 20 nt, Escherichia coli CFT073
uuucagagcggccuucuucu

SEQ ID NO: 2672209 - RNA, 15 nt, Escherichia coli CFT073
uuucagauaucccau

SEQ ID NO: 2672210 - RNA, 16 nt, Escherichia coli CFT073
uuucagcaauaaucag

SEQ ID NO: 2672211 - RNA, 13 nt, Escherichia coli CFT073
uuucagcauccca

SEQ ID NO: 2672212 - RNA, 12 nt, Escherichia coli CFT073
uuucagccaguc

SEQ ID NO: 2672213 - RNA, 10 nt, Escherichia coli CFT073
uuucagccgg

SEQ ID NO: 2672214 - RNA, 12 nt, Escherichia coli CFT073
uuucagcugccc

SEQ ID NO: 2672215 - RNA, 18 nt, Escherichia coli CFT073
uuucaggaaauaaauaau

SEQ ID NO: 2672216 - RNA, 17 nt, Escherichia coli CFT073
uuucaggcaacaaaaaa

SEQ ID NO: 2672217 - RNA, 20 nt, Escherichia coli CFT073
uuucaggcuuuuuuccagcu

SEQ ID NO: 2672218 - RNA, 16 nt, Escherichia coli CFT073
uuucagguuacgcccu

SEQ ID NO: 2672219 - RNA, 20 nt, Escherichia coli CFT073
uuucagguuacgcccuuccc

SEQ ID NO: 2672220 - RNA, 19 nt, Escherichia coli CFT073
uuucaguacuggaugacga

SEQ ID NO: 2672221 - RNA, 22 nt, Escherichia coli CFT073
uuucaguagcaugaacauugcu

SEQ ID NO: 2672222 - RNA, 14 nt, Escherichia coli CFT073
uuucaguccgcggu

SEQ ID NO: 2672223 - RNA, 19 nt, Escherichia coli CFT073
uuucagugcugacugauga

SEQ ID NO: 2672224 - RNA, 13 nt, Escherichia coli CFT073
uuucaguuugccg

SEQ ID NO: 2672225 - RNA, 12 nt, Escherichia coli CFT073
uuucaguuuuag

SEQ ID NO: 2672226 - RNA, 14 nt, Escherichia coli CFT073
uuucauaauccugu

SEQ ID NO: 2672227 - RNA, 14 nt, Escherichia coli CFT073
uuucauacugccga

SEQ ID NO: 2672228 - RNA, 19 nt, Escherichia coli CFT073
uuucauagauuaauuuccc

SEQ ID NO: 2672229 - RNA, 20 nt, Escherichia coli CFT073
uuucauagauuaauuuccca

SEQ ID NO: 2672230 - RNA, 15 nt, Escherichia coli CFT073
uuucauagcaaauuc

SEQ ID NO: 2672231 - RNA, 21 nt, Escherichia coli CFT073
uuucaucaacugacuauccug

SEQ ID NO: 2672232 - RNA, 22 nt, Escherichia coli CFT073
uuucaucaacugacuauccugg

SEQ ID NO: 2672233 - RNA, 13 nt, Escherichia coli CFT073
uuucaucaucacg

SEQ ID NO: 2672234 - RNA, 19 nt, Escherichia coli CFT073
uuucaucauuaaaggcaaa

SEQ ID NO: 2672235 - RNA, 13 nt, Escherichia coli CFT073
uuucauccagcgg

SEQ ID NO: 2672236 - RNA, 16 nt, Escherichia coli CFT073
uuucauccagcggcaa

SEQ ID NO: 2672237 - RNA, 19 nt, Escherichia coli CFT073
uuucaucccgagucgcuga

SEQ ID NO: 2672238 - RNA, 13 nt, Escherichia coli CFT073
uuucaucucauca

SEQ ID NO: 2672239 - RNA, 18 nt, Escherichia coli CFT073
uuucaugcuauuccuuga

SEQ ID NO: 2672240 - RNA, 17 nt, Escherichia coli CFT073
uuucauuacuauaaccc

SEQ ID NO: 2672241 - RNA, 22 nt, Escherichia coli CFT073
uuucauucagaacacuucuucu

SEQ ID NO: 2672242 - RNA, 14 nt, Escherichia coli CFT073
uuucauucuccauu

SEQ ID NO: 2672243 - RNA, 21 nt, Escherichia coli CFT073
uuuccacgaaacgguguugag

SEQ ID NO: 2672244 - RNA, 14 nt, Escherichia coli CFT073
uuuccacuuccacc

SEQ ID NO: 2672245 - RNA, 11 nt, Escherichia coli CFT073
uuuccagaaag

SEQ ID NO: 2672246 - RNA, 12 nt, Escherichia coli CFT073
uuuccagaaagu

SEQ ID NO: 2672247 - RNA, 15 nt, Escherichia coli CFT073
uuuccagcauuucuu

SEQ ID NO: 2672248 - RNA, 16 nt, Escherichia coli CFT073
uuuccagcgccuguug

SEQ ID NO: 2672249 - RNA, 20 nt, Escherichia coli CFT073
uuuccagcucggcgaucugu

SEQ ID NO: 2672250 - RNA, 15 nt, Escherichia coli CFT073
uuuccaggcagccau

SEQ ID NO: 2672251 - RNA, 21 nt, Escherichia coli CFT073
uuuccaggcuggcaggccuca

SEQ ID NO: 2672252 - RNA, 17 nt, Escherichia coli CFT073
uuuccaguguucauaua

SEQ ID NO: 2672253 - RNA, 14 nt, Escherichia coli CFT073
uuuccaguugaaca

SEQ ID NO: 2672254 - RNA, 23 nt, Escherichia coli CFT073
uuuccaguugaacaaucugguuu

SEQ ID NO: 2672255 - RNA, 16 nt, Escherichia coli CFT073
uuuccaguugugagac

SEQ ID NO: 2672256 - RNA, 16 nt, Escherichia coli CFT073
uuuccaguuugcguuc

SEQ ID NO: 2672257 - RNA, 18 nt, Escherichia coli CFT073
uuuccaucgucagacgcu

SEQ ID NO: 2672258 - RNA, 22 nt, Escherichia coli CFT073
uuuccaucgucagacgcucugg

SEQ ID NO: 2672259 - RNA, 16 nt, Escherichia coli CFT073
uuuccaucuuuccuca

SEQ ID NO: 2672260 - RNA, 16 nt, Escherichia coli CFT073
uuuccaugccaucugc

SEQ ID NO: 2672261 - RNA, 13 nt, Escherichia coli CFT073
uuucccaccacua

SEQ ID NO: 2672262 - RNA, 16 nt, Escherichia coli CFT073
uuucccagcaggauca

SEQ ID NO: 2672263 - RNA, 14 nt, Escherichia coli CFT073
uuuccccauuccga

SEQ ID NO: 2672264 - RNA, 19 nt, Escherichia coli CFT073
uuuccccggugcgcgguga

SEQ ID NO: 2672265 - RNA, 17 nt, Escherichia coli CFT073
uuucccgauaaccuucu

SEQ ID NO: 2672266 - RNA, 18 nt, Escherichia coli CFT073
uuucccgcuccaaaauuu

SEQ ID NO: 2672267 - RNA, 18 nt, Escherichia coli CFT073
uuucccggcaaucaccgc

SEQ ID NO: 2672268 - RNA, 18 nt, Escherichia coli CFT073
uuucccggguaaacacca

SEQ ID NO: 2672269 - RNA, 14 nt, Escherichia coli CFT073
uuucccuguugccu

SEQ ID NO: 2672270 - RNA, 16 nt, Escherichia coli CFT073
uuucccuguugcgcuc

SEQ ID NO: 2672271 - RNA, 18 nt, Escherichia coli CFT073
uuucccuucccgcaaugc

SEQ ID NO: 2672272 - RNA, 13 nt, Escherichia coli CFT073
uuucccuucuugu

SEQ ID NO: 2672273 - RNA, 14 nt, Escherichia coli CFT073
uuucccuuucuuau

SEQ ID NO: 2672274 - RNA, 18 nt, Escherichia coli CFT073
uuuccgacgguuugccuu

SEQ ID NO: 2672275 - RNA, 15 nt, Escherichia coli CFT073
uuuccggaaaaauca

SEQ ID NO: 2672276 - RNA, 18 nt, Escherichia coli CFT073
uuuccggaucgccaaagc

SEQ ID NO: 2672277 - RNA, 20 nt, Escherichia coli CFT073
uuuccggaugcgcuucuuua

SEQ ID NO: 2672278 - RNA, 18 nt, Escherichia coli CFT073
uuuccggauuauccagcc

SEQ ID NO: 2672279 - RNA, 14 nt, Escherichia coli CFT073
uuuccggcagaagc

SEQ ID NO: 2672280 - RNA, 20 nt, Escherichia coli CFT073
uuuccggcauuucuugugca

SEQ ID NO: 2672281 - RNA, 17 nt, Escherichia coli CFT073
uuuccgggagcaauuug

SEQ ID NO: 2672282 - RNA, 14 nt, Escherichia coli CFT073
uuuccgggcuucuc

SEQ ID NO: 2672283 - RNA, 14 nt, Escherichia coli CFT073
uuuccgggucggaa

SEQ ID NO: 2672284 - RNA, 11 nt, Escherichia coli CFT073
uuuccggugcc

SEQ ID NO: 2672285 - RNA, 20 nt, Escherichia coli CFT073
uuuccgucagcggcagcucu

SEQ ID NO: 2672286 - RNA, 16 nt, Escherichia coli CFT073
uuuccguuuuccagcc

SEQ ID NO: 2672287 - RNA, 18 nt, Escherichia coli CFT073
uuuccuaaacuccucgcc

SEQ ID NO: 2672288 - RNA, 21 nt, Escherichia coli CFT073
uuuccucaguaccgugcagcg

SEQ ID NO: 2672289 - RNA, 19 nt, Escherichia coli CFT073
uuuccugcggaugcgccau

SEQ ID NO: 2672290 - RNA, 15 nt, Escherichia coli CFT073
uuuccuggacuucuu

SEQ ID NO: 2672291 - RNA, 19 nt, Escherichia coli CFT073
uuuccuggguuaguugaua

SEQ ID NO: 2672292 - RNA, 15 nt, Escherichia coli CFT073
uuucgaaccgauagu

SEQ ID NO: 2672293 - RNA, 18 nt, Escherichia coli CFT073
uuucgacaauaaucaacg

SEQ ID NO: 2672294 - RNA, 11 nt, Escherichia coli CFT073
uuucgacaccu

SEQ ID NO: 2672295 - RNA, 13 nt, Escherichia coli CFT073
uuucgauaaucaa

SEQ ID NO: 2672296 - RNA, 23 nt, Escherichia coli CFT073
uuucgaugcguaccauuucuucu

SEQ ID NO: 2672297 - RNA, 12 nt, Escherichia coli CFT073
uuucgcacugca

SEQ ID NO: 2672298 - RNA, 18 nt, Escherichia coli CFT073
uuucgcauguaacugccu

SEQ ID NO: 2672299 - RNA, 22 nt, Escherichia coli CFT073
uuucgcauguaacugccuuucc

SEQ ID NO: 2672300 - RNA, 10 nt, Escherichia coli CFT073
uuucgccagc

SEQ ID NO: 2672301 - RNA, 11 nt, Escherichia coli CFT073
uuucgccgccc

SEQ ID NO: 2672302 - RNA, 20 nt, Escherichia coli CFT073
uuucgccugcaaaucggcaa

SEQ ID NO: 2672303 - RNA, 19 nt, Escherichia coli CFT073
uuucgcggcauaacagaau

SEQ ID NO: 2672304 - RNA, 22 nt, Escherichia coli CFT073
uuucgcuucaaccaccucagua

SEQ ID NO: 2672305 - RNA, 13 nt, Escherichia coli CFT073
uuucgcuucuuca

SEQ ID NO: 2672306 - RNA, 17 nt, Escherichia coli CFT073
uuucgcuucuucagccu

SEQ ID NO: 2672307 - RNA, 19 nt, Escherichia coli CFT073
uuucgcuugaucuuccuga

SEQ ID NO: 2672308 - RNA, 13 nt, Escherichia coli CFT073
uuucgcuuugccc

SEQ ID NO: 2672309 - RNA, 18 nt, Escherichia coli CFT073
uuucgucaacuucuuuag

SEQ ID NO: 2672310 - RNA, 14 nt, Escherichia coli CFT073
uuucgucguggcaa

SEQ ID NO: 2672311 - RNA, 22 nt, Escherichia coli CFT073
uuucgucugguucgccaaaugu

SEQ ID NO: 2672312 - RNA, 13 nt, Escherichia coli CFT073
uuucguuaaacgc

SEQ ID NO: 2672313 - RNA, 21 nt, Escherichia coli CFT073
uuucguuagcaaacgacacau

SEQ ID NO: 2672314 - RNA, 12 nt, Escherichia coli CFT073
uuucuacaagca

SEQ ID NO: 2672315 - RNA, 16 nt, Escherichia coli CFT073
uuucuacuucuuucac

SEQ ID NO: 2672316 - RNA, 18 nt, Escherichia coli CFT073
uuucuaucaaccugaggc

SEQ ID NO: 2672317 - RNA, 18 nt, Escherichia coli CFT073
uuucucaaaauacugccu

SEQ ID NO: 2672318 - RNA, 20 nt, Escherichia coli CFT073
uuucucaaaauacugccuau

SEQ ID NO: 2672319 - RNA, 17 nt, Escherichia coli CFT073
uuucucaagucugggua

SEQ ID NO: 2672320 - RNA, 13 nt, Escherichia coli CFT073
uuucucacuggcg

SEQ ID NO: 2672321 - RNA, 13 nt, Escherichia coli CFT073
uuucucauuuuua

SEQ ID NO: 2672322 - RNA, 20 nt, Escherichia coli CFT073
uuucuccccaaggacgcguc

SEQ ID NO: 2672323 - RNA, 15 nt, Escherichia coli CFT073
uuucuccgagcauuu

SEQ ID NO: 2672324 - RNA, 19 nt, Escherichia coli CFT073
uuucuccgagcauuuucag

SEQ ID NO: 2672325 - RNA, 15 nt, Escherichia coli CFT073
uuucucgccugaguu

SEQ ID NO: 2672326 - RNA, 20 nt, Escherichia coli CFT073
uuucucgcgcccaaccagca

SEQ ID NO: 2672327 - RNA, 20 nt, Escherichia coli CFT073
uuucucgguauuacaaugcg

SEQ ID NO: 2672328 - RNA, 20 nt, Escherichia coli CFT073
uuucucgucugaaagauauu

SEQ ID NO: 2672329 - RNA, 16 nt, Escherichia coli CFT073
uuucucgugccgccag

SEQ ID NO: 2672330 - RNA, 12 nt, Escherichia coli CFT073
uuucucuaaaaa

SEQ ID NO: 2672331 - RNA, 12 nt, Escherichia coli CFT073
uuucucuuucac

SEQ ID NO: 2672332 - RNA, 12 nt, Escherichia coli CFT073
uuucucuuucuu

SEQ ID NO: 2672333 - RNA, 18 nt, Escherichia coli CFT073
uuucugaaaccaccauuu

SEQ ID NO: 2672334 - RNA, 21 nt, Escherichia coli CFT073
uuucugaccaauagauauuca

SEQ ID NO: 2672335 - RNA, 22 nt, Escherichia coli CFT073
uuucugaccaugcauauaagau

SEQ ID NO: 2672336 - RNA, 15 nt, Escherichia coli CFT073
uuucugagcaucaca

SEQ ID NO: 2672337 - RNA, 17 nt, Escherichia coli CFT073
uuucugcaaucgucugc

SEQ ID NO: 2672338 - RNA, 23 nt, Escherichia coli CFT073
uuucugcgggggcggcaaucgcu

SEQ ID NO: 2672339 - RNA, 22 nt, Escherichia coli CFT073
uuucugcguuagaaaacgccug

SEQ ID NO: 2672340 - RNA, 19 nt, Escherichia coli CFT073
uuucugcugcuuuaucagc

SEQ ID NO: 2672341 - RNA, 23 nt, Escherichia coli CFT073
uuucugcuucgccaucuccauca

SEQ ID NO: 2672342 - RNA, 19 nt, Escherichia coli CFT073
uuucuggaaauagauuuuc

SEQ ID NO: 2672343 - RNA, 16 nt, Escherichia coli CFT073
uuucuggaugccaucg

SEQ ID NO: 2672344 - RNA, 17 nt, Escherichia coli CFT073
uuucuuaagauaagaau

SEQ ID NO: 2672345 - RNA, 12 nt, Escherichia coli CFT073
uuucuuauuaag

SEQ ID NO: 2672346 - RNA, 13 nt, Escherichia coli CFT073
uuucuuccagguu

SEQ ID NO: 2672347 - RNA, 15 nt, Escherichia coli CFT073
uuucuuccagguuaa

SEQ ID NO: 2672348 - RNA, 15 nt, Escherichia coli CFT073
uuucuuccugcauca

SEQ ID NO: 2672349 - RNA, 20 nt, Escherichia coli CFT073
uuucuucuaauugugcugca

SEQ ID NO: 2672350 - RNA, 15 nt, Escherichia coli CFT073
uuucuucucuacgca

SEQ ID NO: 2672351 - RNA, 12 nt, Escherichia coli CFT073
uuucuugccgga

SEQ ID NO: 2672352 - RNA, 11 nt, Escherichia coli CFT073
uuucuuuaauu

SEQ ID NO: 2672353 - RNA, 12 nt, Escherichia coli CFT073
uuucuuuaauug

SEQ ID NO: 2672354 - RNA, 13 nt, Escherichia coli CFT073
uuucuuucaucag

SEQ ID NO: 2672355 - RNA, 17 nt, Escherichia coli CFT073
uuucuuucgcacugguu

SEQ ID NO: 2672356 - RNA, 15 nt, Escherichia coli CFT073
uuucuuuguucuucu

SEQ ID NO: 2672357 - RNA, 14 nt, Escherichia coli CFT073
uuucuuuuaacaaa

SEQ ID NO: 2672358 - RNA, 16 nt, Escherichia coli CFT073
uuugaaaagaguucau

SEQ ID NO: 2672359 - RNA, 12 nt, Escherichia coli CFT073
uuugaaagaugc

SEQ ID NO: 2672360 - RNA, 18 nt, Escherichia coli CFT073
uuugaaauaaaaucagcu

SEQ ID NO: 2672361 - RNA, 12 nt, Escherichia coli CFT073
uuugaacauauc

SEQ ID NO: 2672362 - RNA, 22 nt, Escherichia coli CFT073
uuugaacauaucagcgcaaaga

SEQ ID NO: 2672363 - RNA, 23 nt, Escherichia coli CFT073
uuugaauuagcacgauuuuguag

SEQ ID NO: 2672364 - RNA, 21 nt, Escherichia coli CFT073
uuugacacaauauugcggaua

SEQ ID NO: 2672365 - RNA, 15 nt, Escherichia coli CFT073
uuugagaacauucau

SEQ ID NO: 2672366 - RNA, 22 nt, Escherichia coli CFT073
uuugagcaucaaacuuuuaaau

SEQ ID NO: 2672367 - RNA, 16 nt, Escherichia coli CFT073
uuugaguggucgacaa

SEQ ID NO: 2672368 - RNA, 22 nt, Escherichia coli CFT073
uuugauaaaccuccagcaucag

SEQ ID NO: 2672369 - RNA, 14 nt, Escherichia coli CFT073
uuugauaaguacau

SEQ ID NO: 2672370 - RNA, 19 nt, Escherichia coli CFT073
uuugauaaguacauuaaaa

SEQ ID NO: 2672371 - RNA, 13 nt, Escherichia coli CFT073
uuugauauucauu

SEQ ID NO: 2672372 - RNA, 14 nt, Escherichia coli CFT073
uuugaucaaucugc

SEQ ID NO: 2672373 - RNA, 12 nt, Escherichia coli CFT073
uuugaugccacc

SEQ ID NO: 2672374 - RNA, 18 nt, Escherichia coli CFT073
uuugauguacucaauugc

SEQ ID NO: 2672375 - RNA, 16 nt, Escherichia coli CFT073
uuugauugauuuuucc

SEQ ID NO: 2672376 - RNA, 23 nt, Escherichia coli CFT073
uuugauuugcugcucacggugag

SEQ ID NO: 2672377 - RNA, 13 nt, Escherichia coli CFT073
uuugcaauuugca

SEQ ID NO: 2672378 - RNA, 16 nt, Escherichia coli CFT073
uuugcaauuugcagcc

SEQ ID NO: 2672379 - RNA, 16 nt, Escherichia coli CFT073
uuugcacauuccagau

SEQ ID NO: 2672380 - RNA, 20 nt, Escherichia coli CFT073
uuugcacgcuuucugcguga

SEQ ID NO: 2672381 - RNA, 18 nt, Escherichia coli CFT073
uuugcagcuuacgcgcca

SEQ ID NO: 2672382 - RNA, 14 nt, Escherichia coli CFT073
uuugcaggaaaaac

SEQ ID NO: 2672383 - RNA, 18 nt, Escherichia coli CFT073
uuugcaggaaaaacugcc

SEQ ID NO: 2672384 - RNA, 15 nt, Escherichia coli CFT073
uuugcaggccugaua

SEQ ID NO: 2672385 - RNA, 20 nt, Escherichia coli CFT073
uuugcagugaucgugugcca

SEQ ID NO: 2672386 - RNA, 16 nt, Escherichia coli CFT073
uuugcagugcuuguua

SEQ ID NO: 2672387 - RNA, 14 nt, Escherichia coli CFT073
uuugcauaauuucc

SEQ ID NO: 2672388 - RNA, 16 nt, Escherichia coli CFT073
uuugcauccacaaccc

SEQ ID NO: 2672389 - RNA, 17 nt, Escherichia coli CFT073
uuugcauccacaacccg

SEQ ID NO: 2672390 - RNA, 18 nt, Escherichia coli CFT073
uuugcauuacugcuaucu

SEQ ID NO: 2672391 - RNA, 23 nt, Escherichia coli CFT073
uuugcauuacugcuaucugucag

SEQ ID NO: 2672392 - RNA, 24 nt, Escherichia coli CFT073
uuugcauuacugcuaucugucaga

SEQ ID NO: 2672393 - RNA, 19 nt, Escherichia coli CFT073
uuugcauuuggauugcuau

SEQ ID NO: 2672394 - RNA, 19 nt, Escherichia coli CFT073
uuugccaggucgcuugccg

SEQ ID NO: 2672395 - RNA, 17 nt, Escherichia coli CFT073
uuugccaguucguuaua

SEQ ID NO: 2672396 - RNA, 19 nt, Escherichia coli CFT073
uuugcccaucaggccaggc

SEQ ID NO: 2672397 - RNA, 21 nt, Escherichia coli CFT073
uuugccccauugcucuuucac

SEQ ID NO: 2672398 - RNA, 15 nt, Escherichia coli CFT073
uuugccccuggcugg

SEQ ID NO: 2672399 - RNA, 23 nt, Escherichia coli CFT073
uuugcccgaucaucaaaaaacac

SEQ ID NO: 2672400 - RNA, 15 nt, Escherichia coli CFT073
uuugcccgucugcug

SEQ ID NO: 2672401 - RNA, 22 nt, Escherichia coli CFT073
uuugcccuucacagguggucac

SEQ ID NO: 2672402 - RNA, 19 nt, Escherichia coli CFT073
uuugccgcccagucacggc

SEQ ID NO: 2672403 - RNA, 22 nt, Escherichia coli CFT073
uuugccggauacguuugauguc

SEQ ID NO: 2672404 - RNA, 19 nt, Escherichia coli CFT073
uuugccgggcggcggcaca

SEQ ID NO: 2672405 - RNA, 20 nt, Escherichia coli CFT073
uuugccuccgcaacauauaa

SEQ ID NO: 2672406 - RNA, 21 nt, Escherichia coli CFT073
uuugccuuuauucauuucgau

SEQ ID NO: 2672407 - RNA, 20 nt, Escherichia coli CFT073
uuugcgacaaagcucaccug

SEQ ID NO: 2672408 - RNA, 23 nt, Escherichia coli CFT073
uuugcgcaggcaagccuugcagc

SEQ ID NO: 2672409 - RNA, 20 nt, Escherichia coli CFT073
uuugcgccacgcucugguga

SEQ ID NO: 2672410 - RNA, 12 nt, Escherichia coli CFT073
uuugcgccauca

SEQ ID NO: 2672411 - RNA, 13 nt, Escherichia coli CFT073
uuugcgccaucaa

SEQ ID NO: 2672412 - RNA, 15 nt, Escherichia coli CFT073
uuugcgccaucaacc

SEQ ID NO: 2672413 - RNA, 14 nt, Escherichia coli CFT073
uuugcgcgugcugg

SEQ ID NO: 2672414 - RNA, 16 nt, Escherichia coli CFT073
uuugcgcuccuguucc

SEQ ID NO: 2672415 - RNA, 14 nt, Escherichia coli CFT073
uuugcgcucgcuga

SEQ ID NO: 2672416 - RNA, 22 nt, Escherichia coli CFT073
uuugcguagucugaccucuucu

SEQ ID NO: 2672417 - RNA, 15 nt, Escherichia coli CFT073
uuugcgucgcauccg

SEQ ID NO: 2672418 - RNA, 21 nt, Escherichia coli CFT073
uuugcuaaggucaccaguuca

SEQ ID NO: 2672419 - RNA, 20 nt, Escherichia coli CFT073
uuugcucgcgacguaauuua

SEQ ID NO: 2672420 - RNA, 18 nt, Escherichia coli CFT073
uuugcucggcaaucucuu

SEQ ID NO: 2672421 - RNA, 20 nt, Escherichia coli CFT073
uuugcucggcaaucucuucc

SEQ ID NO: 2672422 - RNA, 22 nt, Escherichia coli CFT073
uuugcucggcaaucucuuccag

SEQ ID NO: 2672423 - RNA, 19 nt, Escherichia coli CFT073
uuugcucguaucagguggu

SEQ ID NO: 2672424 - RNA, 23 nt, Escherichia coli CFT073
uuugcugaauuggguucuuuccu

SEQ ID NO: 2672425 - RNA, 22 nt, Escherichia coli CFT073
uuugcuggcaaaguagagcgaa

SEQ ID NO: 2672426 - RNA, 20 nt, Escherichia coli CFT073
uuugcugguggcauuuuuau

SEQ ID NO: 2672427 - RNA, 18 nt, Escherichia coli CFT073
uuugcuguaaacauugau

SEQ ID NO: 2672428 - RNA, 15 nt, Escherichia coli CFT073
uuugcugucaauuga

SEQ ID NO: 2672429 - RNA, 12 nt, Escherichia coli CFT073
uuugcugugaag

SEQ ID NO: 2672430 - RNA, 16 nt, Escherichia coli CFT073
uuugcugugaagcacc

SEQ ID NO: 2672431 - RNA, 15 nt, Escherichia coli CFT073
uuugcuguuccagca

SEQ ID NO: 2672432 - RNA, 16 nt, Escherichia coli CFT073
uuugcuguuccagcau

SEQ ID NO: 2672433 - RNA, 14 nt, Escherichia coli CFT073
uuugcuuauaacca

SEQ ID NO: 2672434 - RNA, 19 nt, Escherichia coli CFT073
uuugcuugccggaagcaaa

SEQ ID NO: 2672435 - RNA, 22 nt, Escherichia coli CFT073
uuugcuugccgguuauuuugcu

SEQ ID NO: 2672436 - RNA, 13 nt, Escherichia coli CFT073
uuuggacuguugu

SEQ ID NO: 2672437 - RNA, 16 nt, Escherichia coli CFT073
uuuggacuguugugaa

SEQ ID NO: 2672438 - RNA, 21 nt, Escherichia coli CFT073
uuuggagagcggcguuuugua

SEQ ID NO: 2672439 - RNA, 17 nt, Escherichia coli CFT073
uuuggcaucgaguaucu

SEQ ID NO: 2672440 - RNA, 17 nt, Escherichia coli CFT073
uuuggcgaaauauagaa

SEQ ID NO: 2672441 - RNA, 16 nt, Escherichia coli CFT073
uuugggcggcuuuuug

SEQ ID NO: 2672442 - RNA, 17 nt, Escherichia coli CFT073
uuuguaaggaguuuugu

SEQ ID NO: 2672443 - RNA, 13 nt, Escherichia coli CFT073
uuuguaaucaaca

SEQ ID NO: 2672444 - RNA, 21 nt, Escherichia coli CFT073
uuuguacaggauauauuucau

SEQ ID NO: 2672445 - RNA, 23 nt, Escherichia coli CFT073
uuuguagcagaaaagaaccaaug

SEQ ID NO: 2672446 - RNA, 15 nt, Escherichia coli CFT073
uuuguaggccugaua

SEQ ID NO: 2672447 - RNA, 16 nt, Escherichia coli CFT073
uuuguaugguuuugua

SEQ ID NO: 2672448 - RNA, 18 nt, Escherichia coli CFT073
uuuguaugguuuuguagg

SEQ ID NO: 2672449 - RNA, 13 nt, Escherichia coli CFT073
uuuguauuuuucc

SEQ ID NO: 2672450 - RNA, 19 nt, Escherichia coli CFT073
uuugucagcaaaauaacag

SEQ ID NO: 2672451 - RNA, 20 nt, Escherichia coli CFT073
uuugucagcaaacugaaaaa

SEQ ID NO: 2672452 - RNA, 19 nt, Escherichia coli CFT073
uuuguccagugcaacuuua

SEQ ID NO: 2672453 - RNA, 15 nt, Escherichia coli CFT073
uuuguccgcaguggc

SEQ ID NO: 2672454 - RNA, 16 nt, Escherichia coli CFT073
uuuguccucaccuaaa

SEQ ID NO: 2672455 - RNA, 21 nt, Escherichia coli CFT073
uuugucgaugggggaggucaa

SEQ ID NO: 2672456 - RNA, 11 nt, Escherichia coli CFT073
uuugucggcau

SEQ ID NO: 2672457 - RNA, 23 nt, Escherichia coli CFT073
uuugucguaccagugcagaugca

SEQ ID NO: 2672458 - RNA, 15 nt, Escherichia coli CFT073
uuugucuauuccgcg

SEQ ID NO: 2672459 - RNA, 12 nt, Escherichia coli CFT073
uuugugaugucu

SEQ ID NO: 2672460 - RNA, 22 nt, Escherichia coli CFT073
uuuguuaacaauauuaacaaca

SEQ ID NO: 2672461 - RNA, 15 nt, Escherichia coli CFT073
uuuguucagcgggca

SEQ ID NO: 2672462 - RNA, 13 nt, Escherichia coli CFT073
uuuguucaucaug

SEQ ID NO: 2672463 - RNA, 13 nt, Escherichia coli CFT073
uuuguucucuucu

SEQ ID NO: 2672464 - RNA, 13 nt, Escherichia coli CFT073
uuuguucuucugu

SEQ ID NO: 2672465 - RNA, 19 nt, Escherichia coli CFT073
uuuguugauaaacaaacag

SEQ ID NO: 2672466 - RNA, 16 nt, Escherichia coli CFT073
uuuguuucacacugac

SEQ ID NO: 2672467 - RNA, 20 nt, Escherichia coli CFT073
uuuguuucuuauucagaauc

SEQ ID NO: 2672468 - RNA, 21 nt, Escherichia coli CFT073
uuuguuuuguccgauuucgcu

SEQ ID NO: 2672469 - RNA, 19 nt, Escherichia coli CFT073
uuuguuuuucaggaaauaa

SEQ ID NO: 2672470 - RNA, 22 nt, Escherichia coli CFT073
uuuuaaaaacagaguagaaaua

SEQ ID NO: 2672471 - RNA, 13 nt, Escherichia coli CFT073
uuuuaaacaucag

SEQ ID NO: 2672472 - RNA, 22 nt, Escherichia coli CFT073
uuuuaaacggcauaaauuucag

SEQ ID NO: 2672473 - RNA, 22 nt, Escherichia coli CFT073
uuuuaaaucauccugaaucgcu

SEQ ID NO: 2672474 - RNA, 22 nt, Escherichia coli CFT073
uuuuaaaugcccgacaaaaauu

SEQ ID NO: 2672475 - RNA, 23 nt, Escherichia coli CFT073
uuuuaacaucuuaauagcugcca

SEQ ID NO: 2672476 - RNA, 14 nt, Escherichia coli CFT073
uuuuaacggugcca

SEQ ID NO: 2672477 - RNA, 11 nt, Escherichia coli CFT073
uuuuaacuuac

SEQ ID NO: 2672478 - RNA, 13 nt, Escherichia coli CFT073
uuuuaacuuuaau

SEQ ID NO: 2672479 - RNA, 20 nt, Escherichia coli CFT073
uuuuaagauccaguugaccu

SEQ ID NO: 2672480 - RNA, 14 nt, Escherichia coli CFT073
uuuuaagcaaauaa

SEQ ID NO: 2672481 - RNA, 21 nt, Escherichia coli CFT073
uuuuaagccauuaaaucagcc

SEQ ID NO: 2672482 - RNA, 12 nt, Escherichia coli CFT073
uuuuaagugaug

SEQ ID NO: 2672483 - RNA, 13 nt, Escherichia coli CFT073
uuuuaauauuuca

SEQ ID NO: 2672484 - RNA, 15 nt, Escherichia coli CFT073
uuuuaauauuucauu

SEQ ID NO: 2672485 - RNA, 19 nt, Escherichia coli CFT073
uuuuaaucuauauauguuu

SEQ ID NO: 2672486 - RNA, 12 nt, Escherichia coli CFT073
uuuuaauuucau

SEQ ID NO: 2672487 - RNA, 12 nt, Escherichia coli CFT073
uuuuacaucauc

SEQ ID NO: 2672488 - RNA, 12 nt, Escherichia coli CFT073
uuuuacaugcuc

SEQ ID NO: 2672489 - RNA, 19 nt, Escherichia coli CFT073
uuuuacccacuaacugauc

SEQ ID NO: 2672490 - RNA, 23 nt, Escherichia coli CFT073
uuuuacccacuaacugaucacgu

SEQ ID NO: 2672491 - RNA, 14 nt, Escherichia coli CFT073
uuuuaccguuuacu

SEQ ID NO: 2672492 - RNA, 21 nt, Escherichia coli CFT073
uuuuacgaugcaauuaucauu

SEQ ID NO: 2672493 - RNA, 18 nt, Escherichia coli CFT073
uuuuacgccugcaauuua

SEQ ID NO: 2672494 - RNA, 17 nt, Escherichia coli CFT073
uuuuacuaucuugccga

SEQ ID NO: 2672495 - RNA, 20 nt, Escherichia coli CFT073
uuuuacucuucuuuaauuaa

SEQ ID NO: 2672496 - RNA, 18 nt, Escherichia coli CFT073
uuuuagauuguuuucaau

SEQ ID NO: 2672497 - RNA, 22 nt, Escherichia coli CFT073
uuuuauaacuauaugacucaua

SEQ ID NO: 2672498 - RNA, 23 nt, Escherichia coli CFT073
uuuuauacucuguuucugguggc

SEQ ID NO: 2672499 - RNA, 14 nt, Escherichia coli CFT073
uuuuaucaauucuu

SEQ ID NO: 2672500 - RNA, 22 nt, Escherichia coli CFT073
uuuuaucacuuguaguuacauu

SEQ ID NO: 2672501 - RNA, 20 nt, Escherichia coli CFT073
uuuuaucauuaacgauaauu

SEQ ID NO: 2672502 - RNA, 18 nt, Escherichia coli CFT073
uuuuaucccggcaaaaaa

SEQ ID NO: 2672503 - RNA, 13 nt, Escherichia coli CFT073
uuuuaucccuucu

SEQ ID NO: 2672504 - RNA, 18 nt, Escherichia coli CFT073
uuuuaucccuucuccaca

SEQ ID NO: 2672505 - RNA, 24 nt, Escherichia coli CFT073
uuuuaucguugugguuaaacguga

SEQ ID NO: 2672506 - RNA, 15 nt, Escherichia coli CFT073
uuuuaucugugaacu

SEQ ID NO: 2672507 - RNA, 13 nt, Escherichia coli CFT073
uuuuaugcaccuu

SEQ ID NO: 2672508 - RNA, 18 nt, Escherichia coli CFT073
uuuuaugcuucagccaga

SEQ ID NO: 2672509 - RNA, 17 nt, Escherichia coli CFT073
uuuuauggagaaaacau

SEQ ID NO: 2672510 - RNA, 22 nt, Escherichia coli CFT073
uuuuauggcagaauacuucaca

SEQ ID NO: 2672511 - RNA, 21 nt, Escherichia coli CFT073
uuuuauuauccgcuaaucaau

SEQ ID NO: 2672512 - RNA, 17 nt, Escherichia coli CFT073
uuuuauugacauguuga

SEQ ID NO: 2672513 - RNA, 15 nt, Escherichia coli CFT073
uuuuauugauuguuu

SEQ ID NO: 2672514 - RNA, 16 nt, Escherichia coli CFT073
uuuuauugcauuaaaa

SEQ ID NO: 2672515 - RNA, 12 nt, Escherichia coli CFT073
uuuucaaaugcg

SEQ ID NO: 2672516 - RNA, 13 nt, Escherichia coli CFT073
uuuucaaugcaua

SEQ ID NO: 2672517 - RNA, 18 nt, Escherichia coli CFT073
uuuucaauggcgcugcaa

SEQ ID NO: 2672518 - RNA, 22 nt, Escherichia coli CFT073
uuuucacaguaauuuccugcca

SEQ ID NO: 2672519 - RNA, 14 nt, Escherichia coli CFT073
uuuucacauaagcu

SEQ ID NO: 2672520 - RNA, 12 nt, Escherichia coli CFT073
uuuucaccaguu

SEQ ID NO: 2672521 - RNA, 19 nt, Escherichia coli CFT073
uuuucacccacacuucaau

SEQ ID NO: 2672522 - RNA, 18 nt, Escherichia coli CFT073
uuuucaccuucaaaauuu

SEQ ID NO: 2672523 - RNA, 19 nt, Escherichia coli CFT073
uuuucaccuucaaaauuua

SEQ ID NO: 2672524 - RNA, 17 nt, Escherichia coli CFT073
uuuucagauaaaagcuu

SEQ ID NO: 2672525 - RNA, 19 nt, Escherichia coli CFT073
uuuucagcguuuucuucaa

SEQ ID NO: 2672526 - RNA, 21 nt, Escherichia coli CFT073
uuuucagguuacgcccuuccc

SEQ ID NO: 2672527 - RNA, 18 nt, Escherichia coli CFT073
uuuucaucauacugauaa

SEQ ID NO: 2672528 - RNA, 12 nt, Escherichia coli CFT073
uuuucaucuuuu

SEQ ID NO: 2672529 - RNA, 21 nt, Escherichia coli CFT073
uuuuccagaucggcuucaauc

SEQ ID NO: 2672530 - RNA, 16 nt, Escherichia coli CFT073
uuuuccagcugugcca

SEQ ID NO: 2672531 - RNA, 17 nt, Escherichia coli CFT073
uuuuccagcugugccag

SEQ ID NO: 2672532 - RNA, 18 nt, Escherichia coli CFT073
uuuucccaacuaucaacc

SEQ ID NO: 2672533 - RNA, 14 nt, Escherichia coli CFT073
uuuucccacuaacu

SEQ ID NO: 2672534 - RNA, 21 nt, Escherichia coli CFT073
uuuucccacuaacugcgcgcu

SEQ ID NO: 2672535 - RNA, 15 nt, Escherichia coli CFT073
uuuuccccaucggau

SEQ ID NO: 2672536 - RNA, 15 nt, Escherichia coli CFT073
uuuucccgauauaac

SEQ ID NO: 2672537 - RNA, 18 nt, Escherichia coli CFT073
uuuucccuuccgccauca

SEQ ID NO: 2672538 - RNA, 23 nt, Escherichia coli CFT073
uuuuccgagaaucgacaccaguu

SEQ ID NO: 2672539 - RNA, 23 nt, Escherichia coli CFT073
uuuuccgcacauacuggacacug

SEQ ID NO: 2672540 - RNA, 17 nt, Escherichia coli CFT073
uuuuccgccucaucauc

SEQ ID NO: 2672541 - RNA, 23 nt, Escherichia coli CFT073
uuuucgaugcguaccauuucuuc

SEQ ID NO: 2672542 - RNA, 16 nt, Escherichia coli CFT073
uuuucgccacuucagc

SEQ ID NO: 2672543 - RNA, 21 nt, Escherichia coli CFT073
uuuucgcgucaaucacacuga

SEQ ID NO: 2672544 - RNA, 17 nt, Escherichia coli CFT073
uuuucgcuaccagcaaa

SEQ ID NO: 2672545 - RNA, 15 nt, Escherichia coli CFT073
uuuucgcuggcagac

SEQ ID NO: 2672546 - RNA, 19 nt, Escherichia coli CFT073
uuuucggcaaccgcaucca

SEQ ID NO: 2672547 - RNA, 16 nt, Escherichia coli CFT073
uuuucugccagacaaa

SEQ ID NO: 2672548 - RNA, 19 nt, Escherichia coli CFT073
uuuucugccagacaaaacu

SEQ ID NO: 2672549 - RNA, 22 nt, Escherichia coli CFT073
uuuucuuauuaagcuaacgcgu

SEQ ID NO: 2672550 - RNA, 12 nt, Escherichia coli CFT073
uuuucuucaguu

SEQ ID NO: 2672551 - RNA, 13 nt, Escherichia coli CFT073
uuuucuugccgga

SEQ ID NO: 2672552 - RNA, 19 nt, Escherichia coli CFT073
uuuucuuucacgccaucau

SEQ ID NO: 2672553 - RNA, 17 nt, Escherichia coli CFT073
uuuugaacgaguugcgg

SEQ ID NO: 2672554 - RNA, 21 nt, Escherichia coli CFT073
uuuugaaggaauuaaucccuu

SEQ ID NO: 2672555 - RNA, 17 nt, Escherichia coli CFT073
uuuugaaucgguggcgg

SEQ ID NO: 2672556 - RNA, 17 nt, Escherichia coli CFT073
uuuugcaacgcuuugcu

SEQ ID NO: 2672557 - RNA, 18 nt, Escherichia coli CFT073
uuuugcagcauucaucac

SEQ ID NO: 2672558 - RNA, 16 nt, Escherichia coli CFT073
uuuugcauaauuucca

SEQ ID NO: 2672559 - RNA, 17 nt, Escherichia coli CFT073
uuuugcaucggcaaagc

SEQ ID NO: 2672560 - RNA, 18 nt, Escherichia coli CFT073
uuuugcaucuucagucgc

SEQ ID NO: 2672561 - RNA, 23 nt, Escherichia coli CFT073
uuuugccagcaguugcugacuuu

SEQ ID NO: 2672562 - RNA, 23 nt, Escherichia coli CFT073
uuuugccaggcuaaccaguaaaa

SEQ ID NO: 2672563 - RNA, 20 nt, Escherichia coli CFT073
uuuugcccggcaacaacagg

SEQ ID NO: 2672564 - RNA, 21 nt, Escherichia coli CFT073
uuuugccgcccagucacggcu

SEQ ID NO: 2672565 - RNA, 19 nt, Escherichia coli CFT073
uuuugccuuacgcaccgga

SEQ ID NO: 2672566 - RNA, 16 nt, Escherichia coli CFT073
uuuugcgauauauuuu

SEQ ID NO: 2672567 - RNA, 19 nt, Escherichia coli CFT073
uuuugcgccguccacaaac

SEQ ID NO: 2672568 - RNA, 14 nt, Escherichia coli CFT073
uuuugcuacgccac

SEQ ID NO: 2672569 - RNA, 21 nt, Escherichia coli CFT073
uuuugcucggcaaucucuucc

SEQ ID NO: 2672570 - RNA, 11 nt, Escherichia coli CFT073
uuuugcugccg

SEQ ID NO: 2672571 - RNA, 22 nt, Escherichia coli CFT073
uuuugcuucugaaucucuaagc

SEQ ID NO: 2672572 - RNA, 22 nt, Escherichia coli CFT073
uuuuggaauacguugcaaauau

SEQ ID NO: 2672573 - RNA, 20 nt, Escherichia coli CFT073
uuuuggaauaguaaaaggca

SEQ ID NO: 2672574 - RNA, 22 nt, Escherichia coli CFT073
uuuugggcgggaucuccacaag

SEQ ID NO: 2672575 - RNA, 20 nt, Escherichia coli CFT073
uuuugguaaagcaauaaacc

SEQ ID NO: 2672576 - RNA, 18 nt, Escherichia coli CFT073
uuuuguaucgaacaagau

SEQ ID NO: 2672577 - RNA, 14 nt, Escherichia coli CFT073
uuuugucgacauca

SEQ ID NO: 2672578 - RNA, 17 nt, Escherichia coli CFT073
uuuugucgcugauucgc

SEQ ID NO: 2672579 - RNA, 12 nt, Escherichia coli CFT073
uuuugucucugc

SEQ ID NO: 2672580 - RNA, 15 nt, Escherichia coli CFT073
uuuugugauuuauuu

SEQ ID NO: 2672581 - RNA, 19 nt, Escherichia coli CFT073
uuuugugggccugauaaga

SEQ ID NO: 2672582 - RNA, 13 nt, Escherichia coli CFT073
uuuuuaaauaaca

SEQ ID NO: 2672583 - RNA, 14 nt, Escherichia coli CFT073
uuuuuaagguuuaa

SEQ ID NO: 2672584 - RNA, 22 nt, Escherichia coli CFT073
uuuuuaauaacuuuuaguaaac

SEQ ID NO: 2672585 - RNA, 20 nt, Escherichia coli CFT073
uuuuuaauauuucauucucc

SEQ ID NO: 2672586 - RNA, 16 nt, Escherichia coli CFT073
uuuuuaaucagaacaa

SEQ ID NO: 2672587 - RNA, 20 nt, Escherichia coli CFT073
uuuuuaauguggcuggggua

SEQ ID NO: 2672588 - RNA, 18 nt, Escherichia coli CFT073
uuuuuacagccagccgcu

SEQ ID NO: 2672589 - RNA, 13 nt, Escherichia coli CFT073
uuuuuacgccugc

SEQ ID NO: 2672590 - RNA, 13 nt, Escherichia coli CFT073
uuuuuacgccugu

SEQ ID NO: 2672591 - RNA, 20 nt, Escherichia coli CFT073
uuuuuacucucguuccacuc

SEQ ID NO: 2672592 - RNA, 19 nt, Escherichia coli CFT073
uuuuuagcguguuccagcg

SEQ ID NO: 2672593 - RNA, 23 nt, Escherichia coli CFT073
uuuuuauagucagugaagccauu

SEQ ID NO: 2672594 - RNA, 12 nt, Escherichia coli CFT073
uuuuuaucuuca

SEQ ID NO: 2672595 - RNA, 18 nt, Escherichia coli CFT073
uuuuuaugcccuggaucg

SEQ ID NO: 2672596 - RNA, 17 nt, Escherichia coli CFT073
uuuuucauccagcggca

SEQ ID NO: 2672597 - RNA, 12 nt, Escherichia coli CFT073
uuuuucaucccu

SEQ ID NO: 2672598 - RNA, 17 nt, Escherichia coli CFT073
uuuuucaugcuauuccu

SEQ ID NO: 2672599 - RNA, 23 nt, Escherichia coli CFT073
uuuuucauuucccgaauauggga

SEQ ID NO: 2672600 - RNA, 17 nt, Escherichia coli CFT073
uuuuuccacuccgcuua

SEQ ID NO: 2672601 - RNA, 23 nt, Escherichia coli CFT073
uuuuuccagaucggcuucaaucu

SEQ ID NO: 2672602 - RNA, 16 nt, Escherichia coli CFT073
uuuuucccucuucaau

SEQ ID NO: 2672603 - RNA, 15 nt, Escherichia coli CFT073
uuuuucguaccagug

SEQ ID NO: 2672604 - RNA, 15 nt, Escherichia coli CFT073
uuuuucuccuacacc

SEQ ID NO: 2672605 - RNA, 19 nt, Escherichia coli CFT073
uuuuucuggcaccugaacc

SEQ ID NO: 2672606 - RNA, 11 nt, Escherichia coli CFT073
uuuuucuuauu

SEQ ID NO: 2672607 - RNA, 12 nt, Escherichia coli CFT073
uuuuugaacaga

SEQ ID NO: 2672608 - RNA, 23 nt, Escherichia coli CFT073
uuuuugcauaauuuccagcagug

SEQ ID NO: 2672609 - RNA, 16 nt, Escherichia coli CFT073
uuuuugcgcauaacau

SEQ ID NO: 2672610 - RNA, 16 nt, Escherichia coli CFT073
uuuuugcgcgaagaaa

SEQ ID NO: 2672611 - RNA, 20 nt, Escherichia coli CFT073
uuuuuggaggugaagguaag

SEQ ID NO: 2672612 - RNA, 21 nt, Escherichia coli CFT073
uuuuuggcgaucucggcggcu

SEQ ID NO: 2672613 - RNA, 13 nt, Escherichia coli CFT073
uuuuuuacgccug

SEQ ID NO: 2672614 - RNA, 13 nt, Escherichia coli CFT073
uuuuuuauuugau

SEQ ID NO: 2672615 - RNA, 13 nt, Escherichia coli CFT073
uuuuuucuuccca

SEQ ID NO: 2672616 - RNA, 16 nt, Escherichia coli CFT073
uuuuuugaaaaaugca

SEQ ID NO: 2672617 - RNA, 19 nt, Escherichia coli CFT073
ucuucccguuuucaguccu

SEQ ID NO: 2672618 - RNA, 21 nt, Escherichia coli CFT073
ucuucccugcugaauccccuu

SEQ ID NO: 2672619 - RNA, 14 nt, Escherichia coli CFT073
ucuuccgccagaca

SEQ ID NO: 2672620 - RNA, 19 nt, Escherichia coli CFT073
ucuuccggaaccaccagau

SEQ ID NO: 2672621 - RNA, 16 nt, Escherichia coli CFT073
ucuuccggagcugcuc

SEQ ID NO: 2672622 - RNA, 23 nt, Escherichia coli CFT073
ucuuccggaguaaugaaaccgaa

SEQ ID NO: 2672623 - RNA, 16 nt, Escherichia coli CFT073
ucuuccggcagcaaau

SEQ ID NO: 2672624 - RNA, 15 nt, Escherichia coli CFT073
ucuuccggcuguagc

SEQ ID NO: 2672625 - RNA, 15 nt, Escherichia coli CFT073
ucuuccgggcaacaa

SEQ ID NO: 2672626 - RNA, 15 nt, Escherichia coli CFT073
ucuuccgggcuauac

SEQ ID NO: 2672627 - RNA, 15 nt, Escherichia coli CFT073
ucuuccgugccugac

SEQ ID NO: 2672628 - RNA, 17 nt, Escherichia coli CFT073
ucuuccucgccagcgau

SEQ ID NO: 2672629 - RNA, 20 nt, Escherichia coli CFT073
ucuuccuggggaagugguga

SEQ ID NO: 2672630 - RNA, 19 nt, Escherichia coli CFT073
ucuuccuuaagcacaaucc

SEQ ID NO: 2672631 - RNA, 16 nt, Escherichia coli CFT073
ucuucgacaaucgcaa

SEQ ID NO: 2672632 - RNA, 20 nt, Escherichia coli CFT073
ucuucgacaaucgcaaauau

SEQ ID NO: 2672633 - RNA, 19 nt, Escherichia coli CFT073
ucuucgaccgucaccaguc

SEQ ID NO: 2672634 - RNA, 16 nt, Escherichia coli CFT073
ucuucgaguaaaaaga

SEQ ID NO: 2672635 - RNA, 15 nt, Escherichia coli CFT073
ucuucgccugaaaca

SEQ ID NO: 2672636 - RNA, 22 nt, Escherichia coli CFT073
ucuucgcguuacggaucagagu

SEQ ID NO: 2672637 - RNA, 13 nt, Escherichia coli CFT073
ucuucgcuuucaa

SEQ ID NO: 2672638 - RNA, 18 nt, Escherichia coli CFT073
ucuucggccauugaauau

SEQ ID NO: 2672639 - RNA, 16 nt, Escherichia coli CFT073
ucuucggcuucuaccu

SEQ ID NO: 2672640 - RNA, 20 nt, Escherichia coli CFT073
ucuucggcuucuaccuuauc

SEQ ID NO: 2672641 - RNA, 20 nt, Escherichia coli CFT073
ucuucguagcguuuuuucau

SEQ ID NO: 2672642 - RNA, 15 nt, Escherichia coli CFT073
ucuucgucccagucg

SEQ ID NO: 2672643 - RNA, 16 nt, Escherichia coli CFT073
ucuucguggcccgcca

SEQ ID NO: 2672644 - RNA, 18 nt, Escherichia coli CFT073
ucuucguggcccgccagc

SEQ ID NO: 2672645 - RNA, 23 nt, Escherichia coli CFT073
ucuucguuuucugcgcugaggau

SEQ ID NO: 2672646 - RNA, 12 nt, Escherichia coli CFT073
ucuucucaccgc

SEQ ID NO: 2672647 - RNA, 15 nt, Escherichia coli CFT073
ucuucucacugcccu

SEQ ID NO: 2672648 - RNA, 17 nt, Escherichia coli CFT073
ucuucucacugcccugc

SEQ ID NO: 2672649 - RNA, 15 nt, Escherichia coli CFT073
ucuucuccagcugcg

SEQ ID NO: 2672650 - RNA, 15 nt, Escherichia coli CFT073
ucuucugaauaucau

SEQ ID NO: 2672651 - RNA, 18 nt, Escherichia coli CFT073
ucuucugcagucaccugc

SEQ ID NO: 2672652 - RNA, 12 nt, Escherichia coli CFT073
ucuucugccagg

SEQ ID NO: 2672653 - RNA, 17 nt, Escherichia coli CFT073
ucuucugcuuuacccac

SEQ ID NO: 2672654 - RNA, 18 nt, Escherichia coli CFT073
ucuucuguuaaaucaucc

SEQ ID NO: 2672655 - RNA, 17 nt, Escherichia coli CFT073
ucuucuuaggcauugcc

SEQ ID NO: 2672656 - RNA, 14 nt, Escherichia coli CFT073
ucuucuuccgcuuc

SEQ ID NO: 2672657 - RNA, 18 nt, Escherichia coli CFT073
ucuucuucguaacggcau

SEQ ID NO: 2672658 - RNA, 19 nt, Escherichia coli CFT073
ucuucuucguugagcggau

SEQ ID NO: 2672659 - RNA, 13 nt, Escherichia coli CFT073
ucuucuuuaaaac

SEQ ID NO: 2672660 - RNA, 15 nt, Escherichia coli CFT073
ucuucuuucaucaug

SEQ ID NO: 2672661 - RNA, 17 nt, Escherichia coli CFT073
ucuucuuuuuccgggcc

SEQ ID NO: 2672662 - RNA, 19 nt, Escherichia coli CFT073
ucuugacggcuccccgccc

SEQ ID NO: 2672663 - RNA, 21 nt, Escherichia coli CFT073
ucuugauuugcuuguuucauu

SEQ ID NO: 2672664 - RNA, 15 nt, Escherichia coli CFT073
ucuugccgcucaguc

SEQ ID NO: 2672665 - RNA, 15 nt, Escherichia coli CFT073
ucuugccucccugca

SEQ ID NO: 2672666 - RNA, 22 nt, Escherichia coli CFT073
ucuugcgcggauggccucugcc

SEQ ID NO: 2672667 - RNA, 20 nt, Escherichia coli CFT073
ucuugcugauacuauucauu

SEQ ID NO: 2672668 - RNA, 13 nt, Escherichia coli CFT073
ucuugcugcgcuu

SEQ ID NO: 2672669 - RNA, 19 nt, Escherichia coli CFT073
ucuugguagagauuuuucc

SEQ ID NO: 2672670 - RNA, 21 nt, Escherichia coli CFT073
ucuugguuacgcaagccaggu

SEQ ID NO: 2672671 - RNA, 22 nt, Escherichia coli CFT073
ucuuguaacgaguacaaaaaua

SEQ ID NO: 2672672 - RNA, 22 nt, Escherichia coli CFT073
ucuugugcaauguggugaaaug

SEQ ID NO: 2672673 - RNA, 21 nt, Escherichia coli CFT073
ucuuguucauagugccugaug

SEQ ID NO: 2672674 - RNA, 13 nt, Escherichia coli CFT073
ucuuuacacacaa

SEQ ID NO: 2672675 - RNA, 16 nt, Escherichia coli CFT073
ucuuuacaucauucaa

SEQ ID NO: 2672676 - RNA, 20 nt, Escherichia coli CFT073
ucuuuacucauuaugucauu

SEQ ID NO: 2672677 - RNA, 21 nt, Escherichia coli CFT073
ucuuuaguugagcuuuuuccg

SEQ ID NO: 2672678 - RNA, 15 nt, Escherichia coli CFT073
ucuuuaucaaucagc

SEQ ID NO: 2672679 - RNA, 23 nt, Escherichia coli CFT073
ucuuuaucaccaaugauaaguuu

SEQ ID NO: 2672680 - RNA, 13 nt, Escherichia coli CFT073
ucuuuauccagca

SEQ ID NO: 2672681 - RNA, 11 nt, Escherichia coli CFT073
ucuuuaucugc

SEQ ID NO: 2672682 - RNA, 19 nt, Escherichia coli CFT073
ucuuuauguaauaaaccug

SEQ ID NO: 2672683 - RNA, 14 nt, Escherichia coli CFT073
ucuuucaacacaug

SEQ ID NO: 2672684 - RNA, 14 nt, Escherichia coli CFT073
ucuuucaccagugg

SEQ ID NO: 2672685 - RNA, 14 nt, Escherichia coli CFT073
ucuuucaccucuuc

SEQ ID NO: 2672686 - RNA, 17 nt, Escherichia coli CFT073
ucuuucaccucuucauu

SEQ ID NO: 2672687 - RNA, 11 nt, Escherichia coli CFT073
ucuuucacgcc

SEQ ID NO: 2672688 - RNA, 21 nt, Escherichia coli CFT073
ucuuucacgccaucauccuga

SEQ ID NO: 2672689 - RNA, 14 nt, Escherichia coli CFT073
ucuuucacuuugcu

SEQ ID NO: 2672690 - RNA, 16 nt, Escherichia coli CFT073
ucuuucagacugagau

SEQ ID NO: 2672691 - RNA, 17 nt, Escherichia coli CFT073
ucuuucagcaccagccc

SEQ ID NO: 2672692 - RNA, 16 nt, Escherichia coli CFT073
ucuuucagcaccgcga

SEQ ID NO: 2672693 - RNA, 17 nt, Escherichia coli CFT073
ucuuucagcaccgcgaa

SEQ ID NO: 2672694 - RNA, 23 nt, Escherichia coli CFT073
ucuuucaggaacagcgacagauu

SEQ ID NO: 2672695 - RNA, 16 nt, Escherichia coli CFT073
ucuuucgccacaaagc

SEQ ID NO: 2672696 - RNA, 20 nt, Escherichia coli CFT073
ucuuucgcuugacaaaaaga

SEQ ID NO: 2672697 - RNA, 20 nt, Escherichia coli CFT073
ucuuucucgccuuucuuaaa

SEQ ID NO: 2672698 - RNA, 16 nt, Escherichia coli CFT073
ucuuucugaaaugggc

SEQ ID NO: 2672699 - RNA, 19 nt, Escherichia coli CFT073
ucuuucuuugaaugacgau

SEQ ID NO: 2672700 - RNA, 17 nt, Escherichia coli CFT073
ucuuucuuuuuuucacu

SEQ ID NO: 2672701 - RNA, 17 nt, Escherichia coli CFT073
ucuuugaaauaauauug

SEQ ID NO: 2672702 - RNA, 21 nt, Escherichia coli CFT073
ucuuugaaugacgaucaaccc

SEQ ID NO: 2672703 - RNA, 20 nt, Escherichia coli CFT073
ucuuugagcaucaaacuuuu

SEQ ID NO: 2672704 - RNA, 15 nt, Escherichia coli CFT073
ucuuugagucaacau

SEQ ID NO: 2672705 - RNA, 19 nt, Escherichia coli CFT073
ucuuugauugaagaaauca

SEQ ID NO: 2672706 - RNA, 19 nt, Escherichia coli CFT073
ucuuugccgcuuuuaugug

SEQ ID NO: 2672707 - RNA, 22 nt, Escherichia coli CFT073
ucuuugcgcccccgauccagcg

SEQ ID NO: 2672708 - RNA, 18 nt, Escherichia coli CFT073
ucuuugcgguuaaagcag

SEQ ID NO: 2672709 - RNA, 22 nt, Escherichia coli CFT073
ucuuugggcagaaaauccagca

SEQ ID NO: 2672710 - RNA, 17 nt, Escherichia coli CFT073
ucuuugggcucacccau

SEQ ID NO: 2672711 - RNA, 17 nt, Escherichia coli CFT073
ucuuuguaggccugaua

SEQ ID NO: 2672712 - RNA, 20 nt, Escherichia coli CFT073
ucuuuguaggccugauaaga

SEQ ID NO: 2672713 - RNA, 14 nt, Escherichia coli CFT073
ucuuuguucuucug

SEQ ID NO: 2672714 - RNA, 12 nt, Escherichia coli CFT073
ucuuuucacgca

SEQ ID NO: 2672715 - RNA, 18 nt, Escherichia coli CFT073
ucuuuuggcauaugcaaa

SEQ ID NO: 2672716 - RNA, 19 nt, Escherichia coli CFT073
ucuuuuuacugccgcgaug

SEQ ID NO: 2672717 - RNA, 13 nt, Escherichia coli CFT073
ucuuuuucaaucc

SEQ ID NO: 2672718 - RNA, 14 nt, Escherichia coli CFT073
ucuuuuucagcaac

SEQ ID NO: 2672719 - RNA, 15 nt, Escherichia coli CFT073
ucuuuuugauaagau

SEQ ID NO: 2672720 - RNA, 17 nt, Escherichia coli CFT073
ucuuuuuuuaccugaau

SEQ ID NO: 2672721 - RNA, 15 nt, Escherichia coli CFT073
ugaaaaaaagugcau

SEQ ID NO: 2672722 - RNA, 17 nt, Escherichia coli CFT073
ugaaaaaauuuuaucca

SEQ ID NO: 2672723 - RNA, 14 nt, Escherichia coli CFT073
ugaaaaacgaacau

SEQ ID NO: 2672724 - RNA, 12 nt, Escherichia coli CFT073
ugaaaaaugagc

SEQ ID NO: 2672725 - RNA, 15 nt, Escherichia coli CFT073
ugaaaacccugcgca

SEQ ID NO: 2672726 - RNA, 20 nt, Escherichia coli CFT073
ugaaaaccguccggcuguuu

SEQ ID NO: 2672727 - RNA, 19 nt, Escherichia coli CFT073
ugaaaacgcauaccagucg

SEQ ID NO: 2672728 - RNA, 16 nt, Escherichia coli CFT073
ugaaaagucauccggc

SEQ ID NO: 2672729 - RNA, 19 nt, Escherichia coli CFT073
ugaaaagugcuguaaagca

SEQ ID NO: 2672730 - RNA, 23 nt, Escherichia coli CFT073
ugaaaagugcuguaaagcacaga

SEQ ID NO: 2672731 - RNA, 17 nt, Escherichia coli CFT073
ugaaaauaacguagugu

SEQ ID NO: 2672732 - RNA, 15 nt, Escherichia coli CFT073
ugaaaaugaaauaaa

SEQ ID NO: 2672733 - RNA, 13 nt, Escherichia coli CFT073
ugaaaauuaacgg

SEQ ID NO: 2672734 - RNA, 14 nt, Escherichia coli CFT073
ugaaaauugucuuu

SEQ ID NO: 2672735 - RNA, 21 nt, Escherichia coli CFT073
ugaaacagaagguauacugca

SEQ ID NO: 2672736 - RNA, 19 nt, Escherichia coli CFT073
ugaaaccgaauccuuugga

SEQ ID NO: 2672737 - RNA, 16 nt, Escherichia coli CFT073
ugaaaccuuuaugcag

SEQ ID NO: 2672738 - RNA, 15 nt, Escherichia coli CFT073
ugaaacgaaaucuug

SEQ ID NO: 2672739 - RNA, 14 nt, Escherichia coli CFT073
ugaaacgauggcgu

SEQ ID NO: 2672740 - RNA, 11 nt, Escherichia coli CFT073
ugaaacgcaaa

SEQ ID NO: 2672741 - RNA, 14 nt, Escherichia coli CFT073
ugaaacgcucgcag

SEQ ID NO: 2672742 - RNA, 12 nt, Escherichia coli CFT073
ugaaacucaagc

SEQ ID NO: 2672743 - RNA, 20 nt, Escherichia coli CFT073
ugaaacucaagcuaaaccaa

SEQ ID NO: 2672744 - RNA, 23 nt, Escherichia coli CFT073
ugaaacucaagcuaaaccaauaa

SEQ ID NO: 2672745 - RNA, 18 nt, Escherichia coli CFT073
ugaaacuuuccaugccau

SEQ ID NO: 2672746 - RNA, 14 nt, Escherichia coli CFT073
ugaaagaaaaugag

SEQ ID NO: 2672747 - RNA, 16 nt, Escherichia coli CFT073
ugaaagagaucaaagu

SEQ ID NO: 2672748 - RNA, 18 nt, Escherichia coli CFT073
ugaaagagaucaaaguga

SEQ ID NO: 2672749 - RNA, 22 nt, Escherichia coli CFT073
ugaaagagccgauaaacaccgu

SEQ ID NO: 2672750 - RNA, 21 nt, Escherichia coli CFT073
ugaaagaggcggagguuuuuu

SEQ ID NO: 2672751 - RNA, 15 nt, Escherichia coli CFT073
ugaaagauauucaag

SEQ ID NO: 2672752 - RNA, 20 nt, Escherichia coli CFT073
ugaaagaugaagaguggaac

SEQ ID NO: 2672753 - RNA, 16 nt, Escherichia coli CFT073
ugaaagcaaaaaagaa

SEQ ID NO: 2672754 - RNA, 13 nt, Escherichia coli CFT073
ugaaagcauggca

SEQ ID NO: 2672755 - RNA, 18 nt, Escherichia coli CFT073
ugaaagcaugucaggcag

SEQ ID NO: 2672756 - RNA, 13 nt, Escherichia coli CFT073
ugaaagcggccuu

SEQ ID NO: 2672757 - RNA, 18 nt, Escherichia coli CFT073
ugaaagcgggcuuuuuua

SEQ ID NO: 2672758 - RNA, 22 nt, Escherichia coli CFT073
ugaaagcgggcuuuuuuaugca

SEQ ID NO: 2672759 - RNA, 19 nt, Escherichia coli CFT073
ugaaagcguuguguuuuuu

SEQ ID NO: 2672760 - RNA, 20 nt, Escherichia coli CFT073
ugaaagcugagaaaauguau

SEQ ID NO: 2672761 - RNA, 23 nt, Escherichia coli CFT073
ugaaaggcacucauuuucucuuu

SEQ ID NO: 2672762 - RNA, 15 nt, Escherichia coli CFT073
ugaaaggucaucauc

SEQ ID NO: 2672763 - RNA, 17 nt, Escherichia coli CFT073
ugaaagugacacuguca

SEQ ID NO: 2672764 - RNA, 22 nt, Escherichia coli CFT073
ugaaagugcuguaaagcacaga

SEQ ID NO: 2672765 - RNA, 15 nt, Escherichia coli CFT073
ugaaaguggaaacac

SEQ ID NO: 2672766 - RNA, 19 nt, Escherichia coli CFT073
ugaaaguggaaacacgcuc

SEQ ID NO: 2672767 - RNA, 15 nt, Escherichia coli CFT073
ugaaaguuguccauu

SEQ ID NO: 2672768 - RNA, 15 nt, Escherichia coli CFT073
ugaaauaaaaucagc

SEQ ID NO: 2672769 - RNA, 20 nt, Escherichia coli CFT073
ugaaauaauacguagcacca

SEQ ID NO: 2672770 - RNA, 13 nt, Escherichia coli CFT073
ugaaauacaguua

SEQ ID NO: 2672771 - RNA, 15 nt, Escherichia coli CFT073
ugaaauacuaaauau

SEQ ID NO: 2672772 - RNA, 17 nt, Escherichia coli CFT073
ugaaauacuaaauauga

SEQ ID NO: 2672773 - RNA, 18 nt, Escherichia coli CFT073
ugaaauacuaaauaugaa

SEQ ID NO: 2672774 - RNA, 14 nt, Escherichia coli CFT073
ugaaauagacauua

SEQ ID NO: 2672775 - RNA, 22 nt, Escherichia coli CFT073
ugaaauaguugcauuccagucc

SEQ ID NO: 2672776 - RNA, 11 nt, Escherichia coli CFT073
ugaaauauuau

SEQ ID NO: 2672777 - RNA, 17 nt, Escherichia coli CFT073
ugaaauauugcuaacug

SEQ ID NO: 2672778 - RNA, 20 nt, Escherichia coli CFT073
ugaaaucaccgccaccagcg

SEQ ID NO: 2672779 - RNA, 20 nt, Escherichia coli CFT073
ugaaaucccgcugaauuccc

SEQ ID NO: 2672780 - RNA, 21 nt, Escherichia coli CFT073
ugaaaucccgcugaauucccc

SEQ ID NO: 2672781 - RNA, 23 nt, Escherichia coli CFT073
ugaaaucccgcugaauuccccuc

SEQ ID NO: 2672782 - RNA, 17 nt, Escherichia coli CFT073
ugaaaugagaaaacuau

SEQ ID NO: 2672783 - RNA, 22 nt, Escherichia coli CFT073
ugaaaugauuacucccuugccu

SEQ ID NO: 2672784 - RNA, 22 nt, Escherichia coli CFT073
ugaaaugccaaauauuucuuua

SEQ ID NO: 2672785 - RNA, 22 nt, Escherichia coli CFT073
ugaaaugugccggaugcaucac

SEQ ID NO: 2672786 - RNA, 14 nt, Escherichia coli CFT073
ugaaauucacuguc

SEQ ID NO: 2672787 - RNA, 20 nt, Escherichia coli CFT073
ugaaauuccugagaggauga

SEQ ID NO: 2672788 - RNA, 15 nt, Escherichia coli CFT073
ugaaauugauggguu

SEQ ID NO: 2672789 - RNA, 17 nt, Escherichia coli CFT073
ugaaauugcaaacgcgu

SEQ ID NO: 2672790 - RNA, 18 nt, Escherichia coli CFT073
ugaaauugcggcaaacgg

SEQ ID NO: 2672791 - RNA, 13 nt, Escherichia coli CFT073
ugaaauugcuggu

SEQ ID NO: 2672792 - RNA, 14 nt, Escherichia coli CFT073
ugaaauugcugguu

SEQ ID NO: 2672793 - RNA, 16 nt, Escherichia coli CFT073
ugaacacacccggaga

SEQ ID NO: 2672794 - RNA, 21 nt, Escherichia coli CFT073
ugaacacauuugucggaugcg

SEQ ID NO: 2672795 - RNA, 16 nt, Escherichia coli CFT073
ugaacaccaaggucuu

SEQ ID NO: 2672796 - RNA, 17 nt, Escherichia coli CFT073
ugaacaccaaggucuuu

SEQ ID NO: 2672797 - RNA, 19 nt, Escherichia coli CFT073
ugaacaccagaaccagcaa

SEQ ID NO: 2672798 - RNA, 14 nt, Escherichia coli CFT073
ugaacaccuuaucc

SEQ ID NO: 2672799 - RNA, 20 nt, Escherichia coli CFT073
ugaacacgcaacaccagcag

SEQ ID NO: 2672800 - RNA, 15 nt, Escherichia coli CFT073
ugaacagaacuggcg

SEQ ID NO: 2672801 - RNA, 16 nt, Escherichia coli CFT073
ugaacagaacuggcgc

SEQ ID NO: 2672802 - RNA, 19 nt, Escherichia coli CFT073
ugaacagaccacauuccag

SEQ ID NO: 2672803 - RNA, 22 nt, Escherichia coli CFT073
ugaacagcagaacaucagcugg

SEQ ID NO: 2672804 - RNA, 13 nt, Escherichia coli CFT073
ugaacagccugug

SEQ ID NO: 2672805 - RNA, 17 nt, Escherichia coli CFT073
ugaacagcuuuuuccug

SEQ ID NO: 2672806 - RNA, 18 nt, Escherichia coli CFT073
ugaacaguuuaccgagcg

SEQ ID NO: 2672807 - RNA, 15 nt, Escherichia coli CFT073
ugaacaguuuucgca

SEQ ID NO: 2672808 - RNA, 19 nt, Escherichia coli CFT073
ugaaccagaccgccuuuga

SEQ ID NO: 2672809 - RNA, 22 nt, Escherichia coli CFT073
ugaacccggcaucaaccagcac

SEQ ID NO: 2672810 - RNA, 19 nt, Escherichia coli CFT073
ugaacccggcgauugauag

SEQ ID NO: 2672811 - RNA, 23 nt, Escherichia coli CFT073
ugaaccgccccggguuuccugga

SEQ ID NO: 2672812 - RNA, 21 nt, Escherichia coli CFT073
ugaaccgucacuguugcugua

SEQ ID NO: 2672813 - RNA, 14 nt, Escherichia coli CFT073
ugaacgacacacag

SEQ ID NO: 2672814 - RNA, 15 nt, Escherichia coli CFT073
ugaacgacacacagu

SEQ ID NO: 2672815 - RNA, 20 nt, Escherichia coli CFT073
ugaacgcaccuuccaguuug

SEQ ID NO: 2672816 - RNA, 16 nt, Escherichia coli CFT073
ugaacgcaggccgccc

SEQ ID NO: 2672817 - RNA, 18 nt, Escherichia coli CFT073
ugaacgccaaauucuuua

SEQ ID NO: 2672818 - RNA, 20 nt, Escherichia coli CFT073
ugaacgccaaauucuuuauc

SEQ ID NO: 2672819 - RNA, 20 nt, Escherichia coli CFT073
ugaacgccugauucggccua

SEQ ID NO: 2672820 - RNA, 14 nt, Escherichia coli CFT073
ugaacgccuuaucc

SEQ ID NO: 2672821 - RNA, 19 nt, Escherichia coli CFT073
ugaacgccuuauccgaccu

SEQ ID NO: 2672822 - RNA, 21 nt, Escherichia coli CFT073
ugaacgcgaaggccagcacca

SEQ ID NO: 2672823 - RNA, 21 nt, Escherichia coli CFT073
ugaacgcuggcggcaggccua

SEQ ID NO: 2672824 - RNA, 17 nt, Escherichia coli CFT073
ugaacggcgguaaagaa

SEQ ID NO: 2672825 - RNA, 15 nt, Escherichia coli CFT073
ugaacggucgaggca

SEQ ID NO: 2672826 - RNA, 20 nt, Escherichia coli CFT073
ugaacgucgcguaauuccag

SEQ ID NO: 2672827 - RNA, 23 nt, Escherichia coli CFT073
ugaacgucuuugcgcuccaucag

SEQ ID NO: 2672828 - RNA, 16 nt, Escherichia coli CFT073
ugaacgugcaaaauca

SEQ ID NO: 2672829 - RNA, 18 nt, Escherichia coli CFT073
ugaacgugcaaaaucaaa

SEQ ID NO: 2672830 - RNA, 19 nt, Escherichia coli CFT073
ugaacgugcaaaaucaaac

SEQ ID NO: 2672831 - RNA, 15 nt, Escherichia coli CFT073
ugaacuagaagagga

SEQ ID NO: 2672832 - RNA, 20 nt, Escherichia coli CFT073
ugaacucaacgccuucuucg

SEQ ID NO: 2672833 - RNA, 19 nt, Escherichia coli CFT073
ugaacucggugaccgagcg

SEQ ID NO: 2672834 - RNA, 20 nt, Escherichia coli CFT073
ugaacucuuaagguucacuu

SEQ ID NO: 2672835 - RNA, 16 nt, Escherichia coli CFT073
ugaacugaaccccaaa

SEQ ID NO: 2672836 - RNA, 19 nt, Escherichia coli CFT073
ugaacugggccugcauauc

SEQ ID NO: 2672837 - RNA, 20 nt, Escherichia coli CFT073
ugaacugggcuauggcaaca

SEQ ID NO: 2672838 - RNA, 18 nt, Escherichia coli CFT073
ugaacugguuaaauuuaa

SEQ ID NO: 2672839 - RNA, 16 nt, Escherichia coli CFT073
ugaacuguaggccgga

SEQ ID NO: 2672840 - RNA, 14 nt, Escherichia coli CFT073
ugaacuucagguga

SEQ ID NO: 2672841 - RNA, 13 nt, Escherichia coli CFT073
ugaacuuucucug

SEQ ID NO: 2672842 - RNA, 12 nt, Escherichia coli CFT073
ugaagaaaucag

SEQ ID NO: 2672843 - RNA, 14 nt, Escherichia coli CFT073
ugaagaaccgcacc

SEQ ID NO: 2672844 - RNA, 18 nt, Escherichia coli CFT073
ugaagaaccgcaccaggc

SEQ ID NO: 2672845 - RNA, 14 nt, Escherichia coli CFT073
ugaagacgccucgc

SEQ ID NO: 2672846 - RNA, 16 nt, Escherichia coli CFT073
ugaagacugcauacug

SEQ ID NO: 2672847 - RNA, 15 nt, Escherichia coli CFT073
ugaagagauaaacga

SEQ ID NO: 2672848 - RNA, 13 nt, Escherichia coli CFT073
ugaagaucaugau

SEQ ID NO: 2672849 - RNA, 21 nt, Escherichia coli CFT073
ugaagauggucuguaccacca

SEQ ID NO: 2672850 - RNA, 15 nt, Escherichia coli CFT073
ugaagauuugcagau

SEQ ID NO: 2672851 - RNA, 20 nt, Escherichia coli CFT073
ugaagcaauccauaccagca

SEQ ID NO: 2672852 - RNA, 22 nt, Escherichia coli CFT073
ugaagcaauccauaccagcaca

SEQ ID NO: 2672853 - RNA, 22 nt, Escherichia coli CFT073
ugaagcaaugauaaguccgaug

SEQ ID NO: 2672854 - RNA, 17 nt, Escherichia coli CFT073
ugaagcaguuucaccag

SEQ ID NO: 2672855 - RNA, 20 nt, Escherichia coli CFT073
ugaagcaguuucaccagcag

SEQ ID NO: 2672856 - RNA, 16 nt, Escherichia coli CFT073
ugaagccaccagcgcc

SEQ ID NO: 2672857 - RNA, 15 nt, Escherichia coli CFT073
ugaagcccaguaccg

SEQ ID NO: 2672858 - RNA, 19 nt, Escherichia coli CFT073
ugaagcccaguaccgccag

SEQ ID NO: 2672859 - RNA, 20 nt, Escherichia coli CFT073
ugaagcccaguaccgccagu

SEQ ID NO: 2672860 - RNA, 19 nt, Escherichia coli CFT073
ugaagccuucgccuuucag

SEQ ID NO: 2672861 - RNA, 16 nt, Escherichia coli CFT073
ugaagcgaccaccacc

SEQ ID NO: 2672862 - RNA, 17 nt, Escherichia coli CFT073
ugaagcgcgccuggcgu

SEQ ID NO: 2672863 - RNA, 12 nt, Escherichia coli CFT073
ugaagcggcaga

SEQ ID NO: 2672864 - RNA, 23 nt, Escherichia coli CFT073
ugaagcucguuguuuacgccgga

SEQ ID NO: 2672865 - RNA, 18 nt, Escherichia coli CFT073
ugaagcugacaggcgcug

SEQ ID NO: 2672866 - RNA, 15 nt, Escherichia coli CFT073
ugaaggaauuaaucc

SEQ ID NO: 2672867 - RNA, 16 nt, Escherichia coli CFT073
ugaaggauaagacgag

SEQ ID NO: 2672868 - RNA, 19 nt, Escherichia coli CFT073
ugaaggcaauugcauuuga

SEQ ID NO: 2672869 - RNA, 15 nt, Escherichia coli CFT073
ugaagggcaucagcc

SEQ ID NO: 2672870 - RNA, 23 nt, Escherichia coli CFT073
ugaagguccuuuacuucaccauu

SEQ ID NO: 2672871 - RNA, 16 nt, Escherichia coli CFT073
ugaaggugauucccag

SEQ ID NO: 2672872 - RNA, 18 nt, Escherichia coli CFT073
ugaaggugauucccagca

SEQ ID NO: 2672873 - RNA, 21 nt, Escherichia coli CFT073
ugaaguaaauacuaaaaagcg

SEQ ID NO: 2672874 - RNA, 15 nt, Escherichia coli CFT073
ugaaguaguaacugu

SEQ ID NO: 2672875 - RNA, 15 nt, Escherichia coli CFT073
ugaaguauuaauguc

SEQ ID NO: 2672876 - RNA, 15 nt, Escherichia coli CFT073
ugaaguauuuaaaaa

SEQ ID NO: 2672877 - RNA, 20 nt, Escherichia coli CFT073
ugaagucaggggcuuccagc

SEQ ID NO: 2672878 - RNA, 13 nt, Escherichia coli CFT073
ugaagugguugag

SEQ ID NO: 2672879 - RNA, 19 nt, Escherichia coli CFT073
ugaagugugcaaacgauaa

SEQ ID NO: 2672880 - RNA, 23 nt, Escherichia coli CFT073
ugaagugugcaaacgauaaaagu

SEQ ID NO: 2672881 - RNA, 21 nt, Escherichia coli CFT073
ugaaguucguccccaccagug

SEQ ID NO: 2672882 - RNA, 20 nt, Escherichia coli CFT073
ugaaguucucgucaaacuca

SEQ ID NO: 2672883 - RNA, 23 nt, Escherichia coli CFT073
ugaaguugccggauguguugcau

SEQ ID NO: 2672884 - RNA, 18 nt, Escherichia coli CFT073
ugaaguuuaaugucgcca

SEQ ID NO: 2672885 - RNA, 19 nt, Escherichia coli CFT073
ugaauaaacgguacacgac

SEQ ID NO: 2672886 - RNA, 13 nt, Escherichia coli CFT073
ugaauaacuuccu

SEQ ID NO: 2672887 - RNA, 23 nt, Escherichia coli CFT073
ugaauaacuuccuguaaccaccg

SEQ ID NO: 2672888 - RNA, 14 nt, Escherichia coli CFT073
ugaauacacaucag

SEQ ID NO: 2672889 - RNA, 16 nt, Escherichia coli CFT073
ugaauaccaagucuca

SEQ ID NO: 2672890 - RNA, 15 nt, Escherichia coli CFT073
ugaauacccgccaga

SEQ ID NO: 2672891 - RNA, 15 nt, Escherichia coli CFT073
ugaauacgcaccaca

SEQ ID NO: 2672892 - RNA, 13 nt, Escherichia coli CFT073
ugaauacgcagcg

SEQ ID NO: 2672893 - RNA, 14 nt, Escherichia coli CFT073
ugaauacugcgcgu

SEQ ID NO: 2672894 - RNA, 20 nt, Escherichia coli CFT073
ugaauagugccgcaccagcu

SEQ ID NO: 2672895 - RNA, 13 nt, Escherichia coli CFT073
ugaauaucaucac

SEQ ID NO: 2672896 - RNA, 16 nt, Escherichia coli CFT073
ugaauauccugacuuu

SEQ ID NO: 2672897 - RNA, 18 nt, Escherichia coli CFT073
ugaauauccuguucagac

SEQ ID NO: 2672898 - RNA, 22 nt, Escherichia coli CFT073
ugaauauccuguucagacauua

SEQ ID NO: 2672899 - RNA, 16 nt, Escherichia coli CFT073
ugaauaucuaauuauu

SEQ ID NO: 2672900 - RNA, 19 nt, Escherichia coli CFT073
ugaauaucuaauuauuacc

SEQ ID NO: 2672901 - RNA, 14 nt, Escherichia coli CFT073
ugaauaucuuucuc

SEQ ID NO: 2672902 - RNA, 23 nt, Escherichia coli CFT073
ugaauaucuuucucgcggcagua

SEQ ID NO: 2672903 - RNA, 20 nt, Escherichia coli CFT073
ugaauauuccaguuaucacg

SEQ ID NO: 2672904 - RNA, 17 nt, Escherichia coli CFT073
ugaauauugcugaaaag

SEQ ID NO: 2672905 - RNA, 18 nt, Escherichia coli CFT073
ugaaucaaaucaaccagg

SEQ ID NO: 2672906 - RNA, 21 nt, Escherichia coli CFT073
ugaaucaccugauugaccgcc

SEQ ID NO: 2672907 - RNA, 12 nt, Escherichia coli CFT073
ugaaucagcaga

SEQ ID NO: 2672908 - RNA, 13 nt, Escherichia coli CFT073
ugaaucagcagau

SEQ ID NO: 2672909 - RNA, 22 nt, Escherichia coli CFT073
ugaaucagcagauccaucgccu

SEQ ID NO: 2672910 - RNA, 13 nt, Escherichia coli CFT073
ugaaucagccagu

SEQ ID NO: 2672911 - RNA, 15 nt, Escherichia coli CFT073
ugaaucauggcguga

SEQ ID NO: 2672912 - RNA, 17 nt, Escherichia coli CFT073
ugaauccacuggcuguu

SEQ ID NO: 2672913 - RNA, 18 nt, Escherichia coli CFT073
ugaauccacuggcuguua

SEQ ID NO: 2672914 - RNA, 18 nt, Escherichia coli CFT073
ugaauccaggccagauac

SEQ ID NO: 2672915 - RNA, 19 nt, Escherichia coli CFT073
ugaauccaggccagauacu

SEQ ID NO: 2672916 - RNA, 20 nt, Escherichia coli CFT073
ugaaucccaguacuguacaa

SEQ ID NO: 2672917 - RNA, 21 nt, Escherichia coli CFT073
ugaauccguuauguuucaucc

SEQ ID NO: 2672918 - RNA, 20 nt, Escherichia coli CFT073
ugaaucggaucaauccccag

SEQ ID NO: 2672919 - RNA, 23 nt, Escherichia coli CFT073
ugaaucggcgcagcaauuauucc

SEQ ID NO: 2672920 - RNA, 13 nt, Escherichia coli CFT073
ugaaucgggaaug

SEQ ID NO: 2672921 - RNA, 19 nt, Escherichia coli CFT073
ugaaucucaggcaaauaug

SEQ ID NO: 2672922 - RNA, 23 nt, Escherichia coli CFT073
ugaaucucuuaucauccagguga

SEQ ID NO: 2672923 - RNA, 14 nt, Escherichia coli CFT073
ugaaucuggcuuca

SEQ ID NO: 2672924 - RNA, 19 nt, Escherichia coli CFT073
ugaaucuuacuucuucuua

SEQ ID NO: 2672925 - RNA, 12 nt, Escherichia coli CFT073
ugaaugaggcuu

SEQ ID NO: 2672926 - RNA, 15 nt, Escherichia coli CFT073
ugaaugcaacugccc

SEQ ID NO: 2672927 - RNA, 16 nt, Escherichia coli CFT073
ugaaugccgcgcccca

SEQ ID NO: 2672928 - RNA, 19 nt, Escherichia coli CFT073
ugaaugccguaggcccagc

SEQ ID NO: 2672929 - RNA, 11 nt, Escherichia coli CFT073
ugaaugccuga

SEQ ID NO: 2672930 - RNA, 17 nt, Escherichia coli CFT073
ugaauggguaaacccgc

SEQ ID NO: 2672931 - RNA, 18 nt, Escherichia coli CFT073
ugaauggugaccugcaau

SEQ ID NO: 2672932 - RNA, 22 nt, Escherichia coli CFT073
ugaaugguggcgaugauuuccg

SEQ ID NO: 2672933 - RNA, 18 nt, Escherichia coli CFT073
ugaaugucggcggcgauc

SEQ ID NO: 2672934 - RNA, 15 nt, Escherichia coli CFT073
ugaauuaaguuuucc

SEQ ID NO: 2672935 - RNA, 22 nt, Escherichia coli CFT073
ugaauucaucguaaucucuuuc

SEQ ID NO: 2672936 - RNA, 19 nt, Escherichia coli CFT073
ugaauucccccauugaaac

SEQ ID NO: 2672937 - RNA, 17 nt, Escherichia coli CFT073
ugaauugccagcaucag

SEQ ID NO: 2672938 - RNA, 18 nt, Escherichia coli CFT073
ugaauugcuuaacagcau

SEQ ID NO: 2672939 - RNA, 15 nt, Escherichia coli CFT073
ugaauugugaugguu

SEQ ID NO: 2672940 - RNA, 15 nt, Escherichia coli CFT073
ugaauuguugauggu

SEQ ID NO: 2672941 - RNA, 22 nt, Escherichia coli CFT073
ugaauuguuuugacgaguuagc

SEQ ID NO: 2672942 - RNA, 22 nt, Escherichia coli CFT073
ugaauuucaaaucaccaaacug

SEQ ID NO: 2672943 - RNA, 21 nt, Escherichia coli CFT073
ugaauuuccugcgcuuucugc

SEQ ID NO: 2672944 - RNA, 17 nt, Escherichia coli CFT073
ugaauuugucgauuucc

SEQ ID NO: 2672945 - RNA, 19 nt, Escherichia coli CFT073
ugaauuuuaggaugcugca

SEQ ID NO: 2672946 - RNA, 18 nt, Escherichia coli CFT073
ugaauuuugaaggaaaaa

SEQ ID NO: 2672947 - RNA, 15 nt, Escherichia coli CFT073
ugaauuuuuacuucu

SEQ ID NO: 2672948 - RNA, 15 nt, Escherichia coli CFT073
ugacaaaaaagccaa

SEQ ID NO: 2672949 - RNA, 22 nt, Escherichia coli CFT073
ugacaaaaccgagaagcuugcc

SEQ ID NO: 2672950 - RNA, 15 nt, Escherichia coli CFT073
ugacaaacacagcag

SEQ ID NO: 2672951 - RNA, 18 nt, Escherichia coli CFT073
ugacaaaccguacuucac

SEQ ID NO: 2672952 - RNA, 19 nt, Escherichia coli CFT073
ugacaaacgcaaaacugcc

SEQ ID NO: 2672953 - RNA, 22 nt, Escherichia coli CFT073
ugacaaacgcaaaauugccuga

SEQ ID NO: 2672954 - RNA, 12 nt, Escherichia coli CFT073
ugacaacaacau

SEQ ID NO: 2672955 - RNA, 16 nt, Escherichia coli CFT073
ugacaacguccucguc

SEQ ID NO: 2672956 - RNA, 20 nt, Escherichia coli CFT073
ugacaacuccuguugcaaua

SEQ ID NO: 2672957 - RNA, 19 nt, Escherichia coli CFT073
ugacaauaauucccagcac

SEQ ID NO: 2672958 - RNA, 21 nt, Escherichia coli CFT073
ugacaauaauugucaacggca

SEQ ID NO: 2672959 - RNA, 22 nt, Escherichia coli CFT073
ugacaauccuucccugcaguaa

SEQ ID NO: 2672960 - RNA, 14 nt, Escherichia coli CFT073
ugacaaucgccagu

SEQ ID NO: 2672961 - RNA, 15 nt, Escherichia coli CFT073
ugacaauuacaaaau

SEQ ID NO: 2672962 - RNA, 16 nt, Escherichia coli CFT073
ugacacaggcagcaau

SEQ ID NO: 2672963 - RNA, 13 nt, Escherichia coli CFT073
ugacacccaaugu

SEQ ID NO: 2672964 - RNA, 13 nt, Escherichia coli CFT073
ugacacgcgcgca

SEQ ID NO: 2672965 - RNA, 14 nt, Escherichia coli CFT073
ugacacggaacaac

SEQ ID NO: 2672966 - RNA, 19 nt, Escherichia coli CFT073
ugacacuauucgccagcac

SEQ ID NO: 2672967 - RNA, 14 nt, Escherichia coli CFT073
ugacacugaauggc

SEQ ID NO: 2672968 - RNA, 15 nt, Escherichia coli CFT073
ugacagaccacucuc

SEQ ID NO: 2672969 - RNA, 15 nt, Escherichia coli CFT073
ugacagaccgccagu

SEQ ID NO: 2672970 - RNA, 22 nt, Escherichia coli CFT073
ugacagacugcuuugaugugca

SEQ ID NO: 2672971 - RNA, 17 nt, Escherichia coli CFT073
ugacagcauaccuucac

SEQ ID NO: 2672972 - RNA, 19 nt, Escherichia coli CFT073
ugacagccccaccagcaaa

SEQ ID NO: 2672973 - RNA, 22 nt, Escherichia coli CFT073
ugacagccccaccagcaaauau

SEQ ID NO: 2672974 - RNA, 17 nt, Escherichia coli CFT073
ugacagccccaguuccu

SEQ ID NO: 2672975 - RNA, 19 nt, Escherichia coli CFT073
ugacagcgcccgacaagau

SEQ ID NO: 2672976 - RNA, 16 nt, Escherichia coli CFT073
ugacagcgugguuuuc

SEQ ID NO: 2672977 - RNA, 19 nt, Escherichia coli CFT073
ugacagcuccuccgggagc

SEQ ID NO: 2672978 - RNA, 23 nt, Escherichia coli CFT073
ugacaggcgggaagaacggcaac

SEQ ID NO: 2672979 - RNA, 16 nt, Escherichia coli CFT073
ugacagguaugguguu

SEQ ID NO: 2672980 - RNA, 16 nt, Escherichia coli CFT073
ugacaguaucaccaac

SEQ ID NO: 2672981 - RNA, 17 nt, Escherichia coli CFT073
ugacaguaucaccaacu

SEQ ID NO: 2672982 - RNA, 14 nt, Escherichia coli CFT073
ugacauaaacacca

SEQ ID NO: 2672983 - RNA, 16 nt, Escherichia coli CFT073
ugacaucaaucagcgg

SEQ ID NO: 2672984 - RNA, 22 nt, Escherichia coli CFT073
ugacauccacguuucuucuaau

SEQ ID NO: 2672985 - RNA, 16 nt, Escherichia coli CFT073
ugacauccagaucacg

SEQ ID NO: 2672986 - RNA, 19 nt, Escherichia coli CFT073
ugacauccagaucacgcag

SEQ ID NO: 2672987 - RNA, 22 nt, Escherichia coli CFT073
ugacaucgcccucuuucaccag

SEQ ID NO: 2672988 - RNA, 15 nt, Escherichia coli CFT073
ugacaucgcccugau

SEQ ID NO: 2672989 - RNA, 18 nt, Escherichia coli CFT073
ugacaucgucaggggcau

SEQ ID NO: 2672990 - RNA, 19 nt, Escherichia coli CFT073
ugacauggcaauagcuucu

SEQ ID NO: 2672991 - RNA, 18 nt, Escherichia coli CFT073
ugacauuaaagcuuuacu

SEQ ID NO: 2672992 - RNA, 14 nt, Escherichia coli CFT073
ugacauuuuuucau

SEQ ID NO: 2672993 - RNA, 20 nt, Escherichia coli CFT073
ugaccaaagaaguucuccau

SEQ ID NO: 2672994 - RNA, 22 nt, Escherichia coli CFT073
ugaccaccaacccaacuuauug

SEQ ID NO: 2672995 - RNA, 22 nt, Escherichia coli CFT073
ugaccaccaauaaccggcacuu

SEQ ID NO: 2672996 - RNA, 21 nt, Escherichia coli CFT073
ugaccaccaccaccugcaucu

SEQ ID NO: 2672997 - RNA, 13 nt, Escherichia coli CFT073
ugaccaccagcac

SEQ ID NO: 2672998 - RNA, 14 nt, Escherichia coli CFT073
ugaccaccagcacg

SEQ ID NO: 2672999 - RNA, 13 nt, Escherichia coli CFT073
ugaccaccgcagc

SEQ ID NO: 2673000 - RNA, 21 nt, Escherichia coli CFT073
ugaccagcgccgcgagcaucg

SEQ ID NO: 2673001 - RNA, 22 nt, Escherichia coli CFT073
ugaccagcgccgcgagcaucgc

SEQ ID NO: 2673002 - RNA, 17 nt, Escherichia coli CFT073
ugaccagcuccagcagu

SEQ ID NO: 2673003 - RNA, 19 nt, Escherichia coli CFT073
ugaccaguaauauccccag

SEQ ID NO: 2673004 - RNA, 17 nt, Escherichia coli CFT073
ugaccaguaccaccgcg

SEQ ID NO: 2673005 - RNA, 14 nt, Escherichia coli CFT073
ugaccagugcagau

SEQ ID NO: 2673006 - RNA, 21 nt, Escherichia coli CFT073
ugaccagugcagauaccacca

SEQ ID NO: 2673007 - RNA, 15 nt, Escherichia coli CFT073
ugaccauaacccgcu

SEQ ID NO: 2673008 - RNA, 21 nt, Escherichia coli CFT073
ugaccauaaguaguuguucag

SEQ ID NO: 2673009 - RNA, 13 nt, Escherichia coli CFT073
ugaccauauuaac

SEQ ID NO: 2673010 - RNA, 18 nt, Escherichia coli CFT073
ugaccauauuaacgcagc

SEQ ID NO: 2673011 - RNA, 19 nt, Escherichia coli CFT073
ugaccauauuaacgcagca

SEQ ID NO: 2673012 - RNA, 14 nt, Escherichia coli CFT073
ugaccaucgcccac

SEQ ID NO: 2673013 - RNA, 22 nt, Escherichia coli CFT073
ugaccaucuuccagcaucagca

SEQ ID NO: 2673014 - RNA, 17 nt, Escherichia coli CFT073
ugaccauuaucaaacag

SEQ ID NO: 2673015 - RNA, 21 nt, Escherichia coli CFT073
ugacccacgccuuuuucuccg

SEQ ID NO: 2673016 - RNA, 18 nt, Escherichia coli CFT073
ugacccagaagacgagcc

SEQ ID NO: 2673017 - RNA, 12 nt, Escherichia coli CFT073
ugacccagaccg

SEQ ID NO: 2673018 - RNA, 18 nt, Escherichia coli CFT073
ugacccagaccgauacac

SEQ ID NO: 2673019 - RNA, 13 nt, Escherichia coli CFT073
ugacccagcacca

SEQ ID NO: 2673020 - RNA, 15 nt, Escherichia coli CFT073
ugaccccggcggcua

SEQ ID NO: 2673021 - RNA, 16 nt, Escherichia coli CFT073
ugaccccguaauuacg

SEQ ID NO: 2673022 - RNA, 19 nt, Escherichia coli CFT073
ugacccgcagccagcacug

SEQ ID NO: 2673023 - RNA, 18 nt, Escherichia coli CFT073
ugacccucucggcauaua

SEQ ID NO: 2673024 - RNA, 19 nt, Escherichia coli CFT073
ugaccgaaccuguuuucac

SEQ ID NO: 2673025 - RNA, 20 nt, Escherichia coli CFT073
ugaccgacaccggcagagau

SEQ ID NO: 2673026 - RNA, 17 nt, Escherichia coli CFT073
ugaccgagcgcccgcca

SEQ ID NO: 2673027 - RNA, 18 nt, Escherichia coli CFT073
ugaccgagcgcccgccaa

SEQ ID NO: 2673028 - RNA, 20 nt, Escherichia coli CFT073
ugaccgauaaccugccgcgc

SEQ ID NO: 2673029 - RNA, 23 nt, Escherichia coli CFT073
ugaccgccacgguaucaagcccg

SEQ ID NO: 2673030 - RNA, 13 nt, Escherichia coli CFT073
ugaccgccagcgc

SEQ ID NO: 2673031 - RNA, 22 nt, Escherichia coli CFT073
ugaccgccgucguaacaggaaa

SEQ ID NO: 2673032 - RNA, 23 nt, Escherichia coli CFT073
ugaccgccuaauaccagaacuga

SEQ ID NO: 2673033 - RNA, 11 nt, Escherichia coli CFT073
ugaccgccugc

SEQ ID NO: 2673034 - RNA, 16 nt, Escherichia coli CFT073
ugaccgcgccauccau

SEQ ID NO: 2673035 - RNA, 19 nt, Escherichia coli CFT073
ugaccgcuaauagcgcagc

SEQ ID NO: 2673036 - RNA, 14 nt, Escherichia coli CFT073
ugaccgcuccgcca

SEQ ID NO: 2673037 - RNA, 16 nt, Escherichia coli CFT073
ugaccgcuccgccauc

SEQ ID NO: 2673038 - RNA, 20 nt, Escherichia coli CFT073
ugaccgcuguuaugcacacg

SEQ ID NO: 2673039 - RNA, 15 nt, Escherichia coli CFT073
ugaccgggaauauaa

SEQ ID NO: 2673040 - RNA, 19 nt, Escherichia coli CFT073
ugaccgguugcuggaucaa

SEQ ID NO: 2673041 - RNA, 18 nt, Escherichia coli CFT073
ugaccgucaaacaugccg

SEQ ID NO: 2673042 - RNA, 23 nt, Escherichia coli CFT073
ugaccguccgggcuaauacccuc

SEQ ID NO: 2673043 - RNA, 22 nt, Escherichia coli CFT073
ugaccuagcaaacuaucugugu

SEQ ID NO: 2673044 - RNA, 15 nt, Escherichia coli CFT073
ugaccuauuucauuc

SEQ ID NO: 2673045 - RNA, 17 nt, Escherichia coli CFT073
ugaccuauuucauucag

SEQ ID NO: 2673046 - RNA, 23 nt, Escherichia coli CFT073
ugaccucagguucaaccgcagcu

SEQ ID NO: 2673047 - RNA, 17 nt, Escherichia coli CFT073
ugaccucucaacgugcg

SEQ ID NO: 2673048 - RNA, 15 nt, Escherichia coli CFT073
ugaccugacauuaag

SEQ ID NO: 2673049 - RNA, 15 nt, Escherichia coli CFT073
ugaccuuaauaaacu

SEQ ID NO: 2673050 - RNA, 16 nt, Escherichia coli CFT073
ugaccuuaccaccuua

SEQ ID NO: 2673051 - RNA, 15 nt, Escherichia coli CFT073
ugaccuuccagcgcu

SEQ ID NO: 2673052 - RNA, 13 nt, Escherichia coli CFT073
ugaccuucuucag

SEQ ID NO: 2673053 - RNA, 15 nt, Escherichia coli CFT073
ugacgaaaacucgcu

SEQ ID NO: 2673054 - RNA, 16 nt, Escherichia coli CFT073
ugacgaaggugccgga

SEQ ID NO: 2673055 - RNA, 22 nt, Escherichia coli CFT073
ugacgaauaccguauucaacga

SEQ ID NO: 2673056 - RNA, 16 nt, Escherichia coli CFT073
ugacgaauauguuuuu

SEQ ID NO: 2673057 - RNA, 18 nt, Escherichia coli CFT073
ugacgacaccugcuauuc

SEQ ID NO: 2673058 - RNA, 23 nt, Escherichia coli CFT073
ugacgaccaugcgcgugauacug

SEQ ID NO: 2673059 - RNA, 19 nt, Escherichia coli CFT073
ugacgacuucaguacccag

SEQ ID NO: 2673060 - RNA, 21 nt, Escherichia coli CFT073
ugacgaggaaaacgccuuuca

SEQ ID NO: 2673061 - RNA, 12 nt, Escherichia coli CFT073
ugacgauaaaag

SEQ ID NO: 2673062 - RNA, 18 nt, Escherichia coli CFT073
ugacgauaaaagugcaga

SEQ ID NO: 2673063 - RNA, 21 nt, Escherichia coli CFT073
ugacgaucaacccaguugauc

SEQ ID NO: 2673064 - RNA, 22 nt, Escherichia coli CFT073
ugacgaugcgucacguaggcuu

SEQ ID NO: 2673065 - RNA, 21 nt, Escherichia coli CFT073
ugacgaugguguuuauuccgc

SEQ ID NO: 2673066 - RNA, 16 nt, Escherichia coli CFT073
ugacgauuauuuuccg

SEQ ID NO: 2673067 - RNA, 22 nt, Escherichia coli CFT073
ugacgcagaucccacucaucaa

SEQ ID NO: 2673068 - RNA, 17 nt, Escherichia coli CFT073
ugacgcauacagccaga

SEQ ID NO: 2673069 - RNA, 15 nt, Escherichia coli CFT073
ugacgccaccauucg

SEQ ID NO: 2673070 - RNA, 19 nt, Escherichia coli CFT073
ugacgccaucaacgaaaga

SEQ ID NO: 2673071 - RNA, 14 nt, Escherichia coli CFT073
ugacgccauucuca

SEQ ID NO: 2673072 - RNA, 16 nt, Escherichia coli CFT073
ugacgccauucucacc

SEQ ID NO: 2673073 - RNA, 22 nt, Escherichia coli CFT073
ugacgccccuggcgaugccccc

SEQ ID NO: 2673074 - RNA, 22 nt, Escherichia coli CFT073
ugacgccgcuggugucgcaccu

SEQ ID NO: 2673075 - RNA, 16 nt, Escherichia coli CFT073
ugacgccugcagcauc

SEQ ID NO: 2673076 - RNA, 17 nt, Escherichia coli CFT073
ugacgccugcagcaucg

SEQ ID NO: 2673077 - RNA, 16 nt, Escherichia coli CFT073
ugacgccugccagcuc

SEQ ID NO: 2673078 - RNA, 21 nt, Escherichia coli CFT073
ugacgcggugcuuccggaaca

SEQ ID NO: 2673079 - RNA, 20 nt, Escherichia coli CFT073
ugacgcgucuuaucaggccu

SEQ ID NO: 2673080 - RNA, 21 nt, Escherichia coli CFT073
ugacgcgucuuaucaggccua

SEQ ID NO: 2673081 - RNA, 20 nt, Escherichia coli CFT073
ugacgcgucuuauccggccu

SEQ ID NO: 2673082 - RNA, 21 nt, Escherichia coli CFT073
ugacgcgucuuauccggccua

SEQ ID NO: 2673083 - RNA, 17 nt, Escherichia coli CFT073
ugacgcuauuacgauga

SEQ ID NO: 2673084 - RNA, 21 nt, Escherichia coli CFT073
ugacgcucucaacgcccugua

SEQ ID NO: 2673085 - RNA, 14 nt, Escherichia coli CFT073
ugacgcucugcuuu

SEQ ID NO: 2673086 - RNA, 22 nt, Escherichia coli CFT073
ugacgcugaauaauccccacau

SEQ ID NO: 2673087 - RNA, 16 nt, Escherichia coli CFT073
ugacgcugcucaggcg

SEQ ID NO: 2673088 - RNA, 19 nt, Escherichia coli CFT073
ugacggaaaucauccagca

SEQ ID NO: 2673089 - RNA, 20 nt, Escherichia coli CFT073
ugacggaucuuccagcgcau

SEQ ID NO: 2673090 - RNA, 22 nt, Escherichia coli CFT073
ugacggaucuuccagcgcaucg

SEQ ID NO: 2673091 - RNA, 22 nt, Escherichia coli CFT073
ugacggccaguugcgcaacgua

SEQ ID NO: 2673092 - RNA, 22 nt, Escherichia coli CFT073
ugacggcguucuuuacacagcg

SEQ ID NO: 2673093 - RNA, 13 nt, Escherichia coli CFT073
ugacggcuucucg

SEQ ID NO: 2673094 - RNA, 15 nt, Escherichia coli CFT073
ugacgggccaagcag

SEQ ID NO: 2673095 - RNA, 21 nt, Escherichia coli CFT073
ugacggucgaugcgcaacgca

SEQ ID NO: 2673096 - RNA, 19 nt, Escherichia coli CFT073
ugacgguuuccacuuccac

SEQ ID NO: 2673097 - RNA, 15 nt, Escherichia coli CFT073
ugacguaaucaugaa

SEQ ID NO: 2673098 - RNA, 16 nt, Escherichia coli CFT073
ugacguacaccauuua

SEQ ID NO: 2673099 - RNA, 19 nt, Escherichia coli CFT073
ugacguagcagcuccgcca

SEQ ID NO: 2673100 - RNA, 22 nt, Escherichia coli CFT073
ugacguagcagcuccgccagcu

SEQ ID NO: 2673101 - RNA, 14 nt, Escherichia coli CFT073
ugacguccagaacc

SEQ ID NO: 2673102 - RNA, 21 nt, Escherichia coli CFT073
ugacgugauugguuucaaccu

SEQ ID NO: 2673103 - RNA, 15 nt, Escherichia coli CFT073
ugacgugcacaaacu

SEQ ID NO: 2673104 - RNA, 14 nt, Escherichia coli CFT073
ugacguuaagaaaa

SEQ ID NO: 2673105 - RNA, 16 nt, Escherichia coli CFT073
ugacguuaagaucaaa

SEQ ID NO: 2673106 - RNA, 14 nt, Escherichia coli CFT073
ugacguucaguuca

SEQ ID NO: 2673107 - RNA, 15 nt, Escherichia coli CFT073
ugacuaaugccgcca

SEQ ID NO: 2673108 - RNA, 14 nt, Escherichia coli CFT073
ugacuacaaaaaaa

SEQ ID NO: 2673109 - RNA, 15 nt, Escherichia coli CFT073
ugacuacaaaaaaag

SEQ ID NO: 2673110 - RNA, 16 nt, Escherichia coli CFT073
ugacuacaaaaaaagc

SEQ ID NO: 2673111 - RNA, 15 nt, Escherichia coli CFT073
ugacuaucacagaaa

SEQ ID NO: 2673112 - RNA, 21 nt, Escherichia coli CFT073
ugacuauccuggacuuuaaac

SEQ ID NO: 2673113 - RNA, 20 nt, Escherichia coli CFT073
ugacucaaagaugaaauaaa

SEQ ID NO: 2673114 - RNA, 19 nt, Escherichia coli CFT073
ugacucagaccauauuccc

SEQ ID NO: 2673115 - RNA, 14 nt, Escherichia coli CFT073
ugacucauaaaaau

SEQ ID NO: 2673116 - RNA, 21 nt, Escherichia coli CFT073
ugacucgccgcaaaacccagg

SEQ ID NO: 2673117 - RNA, 20 nt, Escherichia coli CFT073
ugacucggcugcugccagca

SEQ ID NO: 2673118 - RNA, 23 nt, Escherichia coli CFT073
ugacucgguaaaaucaacgccgc

SEQ ID NO: 2673119 - RNA, 21 nt, Escherichia coli CFT073
ugacugaaucaggaaccacaa

SEQ ID NO: 2673120 - RNA, 15 nt, Escherichia coli CFT073
ugacugacagacugc

SEQ ID NO: 2673121 - RNA, 18 nt, Escherichia coli CFT073
ugacugauugccgauacc

SEQ ID NO: 2673122 - RNA, 15 nt, Escherichia coli CFT073
ugacugccgccagca

SEQ ID NO: 2673123 - RNA, 22 nt, Escherichia coli CFT073
ugacugcuuuuucaauuuccag

SEQ ID NO: 2673124 - RNA, 20 nt, Escherichia coli CFT073
ugacugguaacguggcagca

SEQ ID NO: 2673125 - RNA, 21 nt, Escherichia coli CFT073
ugacuguccacgacagaaccc

SEQ ID NO: 2673126 - RNA, 15 nt, Escherichia coli CFT073
ugacuuauaagucuc

SEQ ID NO: 2673127 - RNA, 22 nt, Escherichia coli CFT073
ugacuucagcgacgacuggcgc

SEQ ID NO: 2673128 - RNA, 15 nt, Escherichia coli CFT073
ugacuuccacuuccu

SEQ ID NO: 2673129 - RNA, 13 nt, Escherichia coli CFT073
ugacuuccgccac

SEQ ID NO: 2673130 - RNA, 13 nt, Escherichia coli CFT073
ugacuugccagcc

SEQ ID NO: 2673131 - RNA, 14 nt, Escherichia coli CFT073
ugacuugccagcca

SEQ ID NO: 2673132 - RNA, 13 nt, Escherichia coli CFT073
ugacuugccaggu

SEQ ID NO: 2673133 - RNA, 17 nt, Escherichia coli CFT073
ugacuugcgaacucacc

SEQ ID NO: 2673134 - RNA, 13 nt, Escherichia coli CFT073
ugacuuuaaaaaa

SEQ ID NO: 2673135 - RNA, 21 nt, Escherichia coli CFT073
ugacuuuaaaaaaauuaauuu

SEQ ID NO: 2673136 - RNA, 13 nt, Escherichia coli CFT073
ugacuuucuuuuc

SEQ ID NO: 2673137 - RNA, 16 nt, Escherichia coli CFT073
ugacuuuugcccggca

SEQ ID NO: 2673138 - RNA, 17 nt, Escherichia coli CFT073
ugagaaauauuuucagg

SEQ ID NO: 2673139 - RNA, 18 nt, Escherichia coli CFT073
ugagaacacgaccugcca

SEQ ID NO: 2673140 - RNA, 23 nt, Escherichia coli CFT073
ugagaacauucaucauuucauuu

SEQ ID NO: 2673141 - RNA, 13 nt, Escherichia coli CFT073
ugagaacuguucc

SEQ ID NO: 2673142 - RNA, 19 nt, Escherichia coli CFT073
ugagaacuucggcagagaa

SEQ ID NO: 2673143 - RNA, 21 nt, Escherichia coli CFT073
ugagaacuucggcagagaaag

SEQ ID NO: 2673144 - RNA, 19 nt, Escherichia coli CFT073
ugagaagccaccgcaccac

SEQ ID NO: 2673145 - RNA, 21 nt, Escherichia coli CFT073
ugagaauuccggcagagaaag

SEQ ID NO: 2673146 - RNA, 16 nt, Escherichia coli CFT073
ugagaauugccggaug

SEQ ID NO: 2673147 - RNA, 13 nt, Escherichia coli CFT073
ugagaccagacca

SEQ ID NO: 2673148 - RNA, 14 nt, Escherichia coli CFT073
ugagacgcacccuc

SEQ ID NO: 2673149 - RNA, 23 nt, Escherichia coli CFT073
ugagacgguuaaaaacagccagc

SEQ ID NO: 2673150 - RNA, 14 nt, Escherichia coli CFT073
ugagacuuuacccg

SEQ ID NO: 2673151 - RNA, 13 nt, Escherichia coli CFT073
ugagagaagaaac

SEQ ID NO: 2673152 - RNA, 16 nt, Escherichia coli CFT073
ugagagcaaacaccgc

SEQ ID NO: 2673153 - RNA, 12 nt, Escherichia coli CFT073
ugagagcaacca

SEQ ID NO: 2673154 - RNA, 20 nt, Escherichia coli CFT073
ugagagcaaccagcaaugcc

SEQ ID NO: 2673155 - RNA, 21 nt, Escherichia coli CFT073
ugagauaaucaaauacaccac

SEQ ID NO: 2673156 - RNA, 16 nt, Escherichia coli CFT073
ugagaucaaugcgcca

SEQ ID NO: 2673157 - RNA, 12 nt, Escherichia coli CFT073
ugagauccagcg

SEQ ID NO: 2673158 - RNA, 14 nt, Escherichia coli CFT073
ugagauccgcuuca

SEQ ID NO: 2673159 - RNA, 13 nt, Escherichia coli CFT073
ugagauccugcca

SEQ ID NO: 2673160 - RNA, 16 nt, Escherichia coli CFT073
ugagauccugccaggc

SEQ ID NO: 2673161 - RNA, 22 nt, Escherichia coli CFT073
ugagaucggggucaacuucgcu

SEQ ID NO: 2673162 - RNA, 19 nt, Escherichia coli CFT073
ugagaucguuaagcacagc

SEQ ID NO: 2673163 - RNA, 22 nt, Escherichia coli CFT073
ugagaucguuaugcaaaugaga

SEQ ID NO: 2673164 - RNA, 12 nt, Escherichia coli CFT073
ugagaucuuuaa

SEQ ID NO: 2673165 - RNA, 15 nt, Escherichia coli CFT073
ugagauuacauuggg

SEQ ID NO: 2673166 - RNA, 18 nt, Escherichia coli CFT073
ugagauucaacaucucua

SEQ ID NO: 2673167 - RNA, 19 nt, Escherichia coli CFT073
ugagcaaacaguucugcag

SEQ ID NO: 2673168 - RNA, 18 nt, Escherichia coli CFT073
ugagcaaggcauaggcuu

SEQ ID NO: 2673169 - RNA, 12 nt, Escherichia coli CFT073
ugagcacaucag

SEQ ID NO: 2673170 - RNA, 14 nt, Escherichia coli CFT073
ugagcacgguuuug

SEQ ID NO: 2673171 - RNA, 14 nt, Escherichia coli CFT073
ugagcaggaugaca

SEQ ID NO: 2673172 - RNA, 22 nt, Escherichia coli CFT073
ugagcagggugaauaaaagaaa

SEQ ID NO: 2673173 - RNA, 21 nt, Escherichia coli CFT073
ugagcaugugcaauuucguug

SEQ ID NO: 2673174 - RNA, 14 nt, Escherichia coli CFT073
ugagccagugagcg

SEQ ID NO: 2673175 - RNA, 16 nt, Escherichia coli CFT073
ugagccgccaccagaa

SEQ ID NO: 2673176 - RNA, 18 nt, Escherichia coli CFT073
ugagccgccaccagaacc

SEQ ID NO: 2673177 - RNA, 13 nt, Escherichia coli CFT073
ugagcgauaaaca

SEQ ID NO: 2673178 - RNA, 17 nt, Escherichia coli CFT073
ugagcgcaaauugcugg

SEQ ID NO: 2673179 - RNA, 21 nt, Escherichia coli CFT073
ugagcgccgauuucucaucaa

SEQ ID NO: 2673180 - RNA, 22 nt, Escherichia coli CFT073
ugagcgcgagguggaacaucag

SEQ ID NO: 2673181 - RNA, 17 nt, Escherichia coli CFT073
ugagcggagcacaucag

SEQ ID NO: 2673182 - RNA, 13 nt, Escherichia coli CFT073
ugagcgucauuau

SEQ ID NO: 2673183 - RNA, 23 nt, Escherichia coli CFT073
ugagcgugagguuaucgcccugc

SEQ ID NO: 2673184 - RNA, 13 nt, Escherichia coli CFT073
ugagcgugcgcgc

SEQ ID NO: 2673185 - RNA, 22 nt, Escherichia coli CFT073
ugagcguuucaaaaacaaagaa

SEQ ID NO: 2673186 - RNA, 18 nt, Escherichia coli CFT073
ugagcucgugcaucugaa

SEQ ID NO: 2673187 - RNA, 19 nt, Escherichia coli CFT073
ugagcucgugcaucugaag

SEQ ID NO: 2673188 - RNA, 18 nt, Escherichia coli CFT073
ugagcugaauuucaucac

SEQ ID NO: 2673189 - RNA, 20 nt, Escherichia coli CFT073
ugagcugcgcgacucccuga

SEQ ID NO: 2673190 - RNA, 17 nt, Escherichia coli CFT073
ugagcuucucuggcugc

SEQ ID NO: 2673191 - RNA, 21 nt, Escherichia coli CFT073
ugagcuucucuggcugcuuca

SEQ ID NO: 2673192 - RNA, 16 nt, Escherichia coli CFT073
ugagcuuucuuccagg

SEQ ID NO: 2673193 - RNA, 22 nt, Escherichia coli CFT073
ugaggaagcgcaacagcgcgcc

SEQ ID NO: 2673194 - RNA, 14 nt, Escherichia coli CFT073
ugaggaagcgcgcc

SEQ ID NO: 2673195 - RNA, 22 nt, Escherichia coli CFT073
ugaggacgguaaauacugguca

SEQ ID NO: 2673196 - RNA, 14 nt, Escherichia coli CFT073
ugaggaucaccagu

SEQ ID NO: 2673197 - RNA, 23 nt, Escherichia coli CFT073
ugaggaugcgagucaggccagga

SEQ ID NO: 2673198 - RNA, 15 nt, Escherichia coli CFT073
ugaggcgcugaaugu

SEQ ID NO: 2673199 - RNA, 23 nt, Escherichia coli CFT073
ugaggcggucuguauuuggcugc

SEQ ID NO: 2673200 - RNA, 16 nt, Escherichia coli CFT073
ugaggcguaauauaaa

SEQ ID NO: 2673201 - RNA, 21 nt, Escherichia coli CFT073
ugaggcguuucaacucccacc

SEQ ID NO: 2673202 - RNA, 15 nt, Escherichia coli CFT073
ugaggcuaauaaaca

SEQ ID NO: 2673203 - RNA, 19 nt, Escherichia coli CFT073
ugagggagcguccugcucg

SEQ ID NO: 2673204 - RNA, 13 nt, Escherichia coli CFT073
ugagggcaauaau

SEQ ID NO: 2673205 - RNA, 23 nt, Escherichia coli CFT073
ugagguauuucgucuaagcggcc

SEQ ID NO: 2673206 - RNA, 12 nt, Escherichia coli CFT073
ugagguuaugca

SEQ ID NO: 2673207 - RNA, 23 nt, Escherichia coli CFT073
ugaguacgcgguuuuugucugcc

SEQ ID NO: 2673208 - RNA, 15 nt, Escherichia coli CFT073
ugaguagccucugcg

SEQ ID NO: 2673209 - RNA, 19 nt, Escherichia coli CFT073
ugaguaucgaaaacaucaa

SEQ ID NO: 2673210 - RNA, 18 nt, Escherichia coli CFT073
ugaguaucuuauugaaag

SEQ ID NO: 2673211 - RNA, 19 nt, Escherichia coli CFT073
ugaguaucuuauugaaaga

SEQ ID NO: 2673212 - RNA, 14 nt, Escherichia coli CFT073
ugaguauuaaaugu

SEQ ID NO: 2673213 - RNA, 13 nt, Escherichia coli CFT073
ugagucagcagcg

SEQ ID NO: 2673214 - RNA, 19 nt, Escherichia coli CFT073
ugagucgccgcaaucagcc

SEQ ID NO: 2673215 - RNA, 15 nt, Escherichia coli CFT073
ugagucuggaagaau

SEQ ID NO: 2673216 - RNA, 18 nt, Escherichia coli CFT073
ugagugaggcguggcgcc

SEQ ID NO: 2673217 - RNA, 22 nt, Escherichia coli CFT073
ugagugaugugcucuaaccaac

SEQ ID NO: 2673218 - RNA, 15 nt, Escherichia coli CFT073
ugaguggcgcgcgcc

SEQ ID NO: 2673219 - RNA, 14 nt, Escherichia coli CFT073
ugaguggucgacaa

SEQ ID NO: 2673220 - RNA, 16 nt, Escherichia coli CFT073
ugaguuaauuaaaucc

SEQ ID NO: 2673221 - RNA, 14 nt, Escherichia coli CFT073
ugaguucaccgcca

SEQ ID NO: 2673222 - RNA, 14 nt, Escherichia coli CFT073
ugaguucacugccg

SEQ ID NO: 2673223 - RNA, 15 nt, Escherichia coli CFT073
ugaguucacugccgu

SEQ ID NO: 2673224 - RNA, 21 nt, Escherichia coli CFT073
ugaguucgucgaguuuauagc

SEQ ID NO: 2673225 - RNA, 13 nt, Escherichia coli CFT073
ugaguuuuucauc

SEQ ID NO: 2673226 - RNA, 12 nt, Escherichia coli CFT073
ugauaaaaaacc

SEQ ID NO: 2673227 - RNA, 21 nt, Escherichia coli CFT073
ugauaaacaaacagcgcgcca

SEQ ID NO: 2673228 - RNA, 16 nt, Escherichia coli CFT073
ugauaaaccuccagca

SEQ ID NO: 2673229 - RNA, 19 nt, Escherichia coli CFT073
ugauaaaccuccagcauca

SEQ ID NO: 2673230 - RNA, 17 nt, Escherichia coli CFT073
ugauaaacggcacugua

SEQ ID NO: 2673231 - RNA, 14 nt, Escherichia coli CFT073
ugauaaaucaccug

SEQ ID NO: 2673232 - RNA, 18 nt, Escherichia coli CFT073
ugauaaaugaagaaaaac

SEQ ID NO: 2673233 - RNA, 19 nt, Escherichia coli CFT073
ugauaaaugaagaaaaacc

SEQ ID NO: 2673234 - RNA, 15 nt, Escherichia coli CFT073
ugauaaauugccugc

SEQ ID NO: 2673235 - RNA, 20 nt, Escherichia coli CFT073
ugauaaccccgcaauuucau

SEQ ID NO: 2673236 - RNA, 20 nt, Escherichia coli CFT073
ugauaaccgcgcgugccgga

SEQ ID NO: 2673237 - RNA, 22 nt, Escherichia coli CFT073
ugauaaccguagcguuccugga

SEQ ID NO: 2673238 - RNA, 13 nt, Escherichia coli CFT073
ugauaaccuucca

SEQ ID NO: 2673239 - RNA, 23 nt, Escherichia coli CFT073
ugauaacgaaucgggcaaaguca

SEQ ID NO: 2673240 - RNA, 22 nt, Escherichia coli CFT073
ugauaacgccacgccaccagcg

SEQ ID NO: 2673241 - RNA, 15 nt, Escherichia coli CFT073
ugauaacucaaaaau

SEQ ID NO: 2673242 - RNA, 15 nt, Escherichia coli CFT073
ugauaagagagcaac

SEQ ID NO: 2673243 - RNA, 20 nt, Escherichia coli CFT073
ugauaagaugcguuaagcgu

SEQ ID NO: 2673244 - RNA, 14 nt, Escherichia coli CFT073
ugauaagcguagcg

SEQ ID NO: 2673245 - RNA, 15 nt, Escherichia coli CFT073
ugauaauaauucaga

SEQ ID NO: 2673246 - RNA, 14 nt, Escherichia coli CFT073
ugauaaucaacagg

SEQ ID NO: 2673247 - RNA, 19 nt, Escherichia coli CFT073
ugauaaucaacaggaacau

SEQ ID NO: 2673248 - RNA, 20 nt, Escherichia coli CFT073
ugauaaucauacucccagcg

SEQ ID NO: 2673249 - RNA, 14 nt, Escherichia coli CFT073
ugauaaucauccca

SEQ ID NO: 2673250 - RNA, 21 nt, Escherichia coli CFT073
ugauacaaaacagauacacgg

SEQ ID NO: 2673251 - RNA, 14 nt, Escherichia coli CFT073
ugauacacaccgag

SEQ ID NO: 2673252 - RNA, 17 nt, Escherichia coli CFT073
ugauacaggaacagcca

SEQ ID NO: 2673253 - RNA, 14 nt, Escherichia coli CFT073
ugauacaucaaguc

SEQ ID NO: 2673254 - RNA, 19 nt, Escherichia coli CFT073
ugauacaucaagucagaug

SEQ ID NO: 2673255 - RNA, 13 nt, Escherichia coli CFT073
ugauacaugcugu

SEQ ID NO: 2673256 - RNA, 15 nt, Escherichia coli CFT073
ugauaccgugcagca

SEQ ID NO: 2673257 - RNA, 17 nt, Escherichia coli CFT073
ugauaccgugcagcacg

SEQ ID NO: 2673258 - RNA, 16 nt, Escherichia coli CFT073
ugauacgccugcuggc

SEQ ID NO: 2673259 - RNA, 19 nt, Escherichia coli CFT073
ugauacgcgcaccggaaca

SEQ ID NO: 2673260 - RNA, 20 nt, Escherichia coli CFT073
ugauacgcgccaaucggcaa

SEQ ID NO: 2673261 - RNA, 18 nt, Escherichia coli CFT073
ugauacguuauaucugua

SEQ ID NO: 2673262 - RNA, 19 nt, Escherichia coli CFT073
ugauacucaacucacacaa

SEQ ID NO: 2673263 - RNA, 21 nt, Escherichia coli CFT073
ugauacucgucgcgcacgccc

SEQ ID NO: 2673264 - RNA, 17 nt, Escherichia coli CFT073
ugauagagcucaucagg

SEQ ID NO: 2673265 - RNA, 22 nt, Escherichia coli CFT073
ugauagauuucucuaaaaacuc

SEQ ID NO: 2673266 - RNA, 22 nt, Escherichia coli CFT073
ugauagcaaugccaucaccaac

SEQ ID NO: 2673267 - RNA, 23 nt, Escherichia coli CFT073
ugauagcgcacaauaaugugguc

SEQ ID NO: 2673268 - RNA, 17 nt, Escherichia coli CFT073
ugauagugcugccaucu

SEQ ID NO: 2673269 - RNA, 14 nt, Escherichia coli CFT073
ugauauaccguaga

SEQ ID NO: 2673270 - RNA, 23 nt, Escherichia coli CFT073
ugauaucagccugcaaacgcuuu

SEQ ID NO: 2673271 - RNA, 15 nt, Escherichia coli CFT073
ugauauccagccagg

SEQ ID NO: 2673272 - RNA, 17 nt, Escherichia coli CFT073
ugauaucgcucugguug

SEQ ID NO: 2673273 - RNA, 16 nt, Escherichia coli CFT073
ugauaucgcuggcagg

SEQ ID NO: 2673274 - RNA, 23 nt, Escherichia coli CFT073
ugauaugggcaaacaaaaaaccu

SEQ ID NO: 2673275 - RNA, 18 nt, Escherichia coli CFT073
ugauauguucucuaaucu

SEQ ID NO: 2673276 - RNA, 18 nt, Escherichia coli CFT073
ugauauguuuuaaagcga

SEQ ID NO: 2673277 - RNA, 18 nt, Escherichia coli CFT073
ugauauuacauaccagca

SEQ ID NO: 2673278 - RNA, 22 nt, Escherichia coli CFT073
ugauauucacguuuuucaucca

SEQ ID NO: 2673279 - RNA, 17 nt, Escherichia coli CFT073
ugauauucucgcuccag

SEQ ID NO: 2673280 - RNA, 16 nt, Escherichia coli CFT073
ugauauugauaauaaa

SEQ ID NO: 2673281 - RNA, 14 nt, Escherichia coli CFT073
ugauauuuagccag

SEQ ID NO: 2673282 - RNA, 20 nt, Escherichia coli CFT073
ugauauuuauuuccuucgcu

SEQ ID NO: 2673283 - RNA, 20 nt, Escherichia coli CFT073
ugauauuuguuuucauccac

SEQ ID NO: 2673284 - RNA, 23 nt, Escherichia coli CFT073
ugauauuuguuuuuguuaauugc

SEQ ID NO: 2673285 - RNA, 14 nt, Escherichia coli CFT073
ugaucaaaaaaauc

SEQ ID NO: 2673286 - RNA, 14 nt, Escherichia coli CFT073
ugaucaaauacuuc

SEQ ID NO: 2673287 - RNA, 17 nt, Escherichia coli CFT073
ugaucaacgaccagaaa

SEQ ID NO: 2673288 - RNA, 21 nt, Escherichia coli CFT073
ugaucaacgaccagaaagacu

SEQ ID NO: 2673289 - RNA, 17 nt, Escherichia coli CFT073
ugaucaacucaggaaca

SEQ ID NO: 2673290 - RNA, 16 nt, Escherichia coli CFT073
ugaucaagcuggcgcu

SEQ ID NO: 2673291 - RNA, 20 nt, Escherichia coli CFT073
ugaucaagcuggcgcuggcg

SEQ ID NO: 2673292 - RNA, 16 nt, Escherichia coli CFT073
ugaucaauaagcgucg

SEQ ID NO: 2673293 - RNA, 23 nt, Escherichia coli CFT073
ugaucaauaaucucuuuacccag

SEQ ID NO: 2673294 - RNA, 16 nt, Escherichia coli CFT073
ugaucacccacaccac

SEQ ID NO: 2673295 - RNA, 13 nt, Escherichia coli CFT073
ugaucacccacau

SEQ ID NO: 2673296 - RNA, 13 nt, Escherichia coli CFT073
ugaucaccguaga

SEQ ID NO: 2673297 - RNA, 16 nt, Escherichia coli CFT073
ugaucacgacuuguac

SEQ ID NO: 2673298 - RNA, 18 nt, Escherichia coli CFT073
ugaucacgauauucugua

SEQ ID NO: 2673299 - RNA, 14 nt, Escherichia coli CFT073
ugaucagcaacgcc

SEQ ID NO: 2673300 - RNA, 15 nt, Escherichia coli CFT073
ugaucagcacgauaa

SEQ ID NO: 2673301 - RNA, 17 nt, Escherichia coli CFT073
ugaucagccucucucug

SEQ ID NO: 2673302 - RNA, 23 nt, Escherichia coli CFT073
ugaucaggugauggcagccauuu

SEQ ID NO: 2673303 - RNA, 17 nt, Escherichia coli CFT073
ugaucagugcacugacg

SEQ ID NO: 2673304 - RNA, 23 nt, Escherichia coli CFT073
ugaucaguucuuugauuucgucc

SEQ ID NO: 2673305 - RNA, 11 nt, Escherichia coli CFT073
ugaucaucauu

SEQ ID NO: 2673306 - RNA, 14 nt, Escherichia coli CFT073
ugaucauccggcuu

SEQ ID NO: 2673307 - RNA, 17 nt, Escherichia coli CFT073
ugaucauuaucacccug

SEQ ID NO: 2673308 - RNA, 15 nt, Escherichia coli CFT073
ugauccacaccggcg

SEQ ID NO: 2673309 - RNA, 13 nt, Escherichia coli CFT073
ugauccacccuug

SEQ ID NO: 2673310 - RNA, 18 nt, Escherichia coli CFT073
ugauccacgguucuccac

SEQ ID NO: 2673311 - RNA, 15 nt, Escherichia coli CFT073
ugaucccggcuuccu

SEQ ID NO: 2673312 - RNA, 18 nt, Escherichia coli CFT073
ugaucccggcuuccugca

SEQ ID NO: 2673313 - RNA, 21 nt, Escherichia coli CFT073
ugaucccggcuuccugcagcg

SEQ ID NO: 2673314 - RNA, 14 nt, Escherichia coli CFT073
ugauccucuauaaa

SEQ ID NO: 2673315 - RNA, 21 nt, Escherichia coli CFT073
ugauccugcaacaacaccagc

SEQ ID NO: 2673316 - RNA, 17 nt, Escherichia coli CFT073
ugauccuggauuucuuc

SEQ ID NO: 2673317 - RNA, 14 nt, Escherichia coli CFT073
ugaucgaaaaugcg

SEQ ID NO: 2673318 - RNA, 19 nt, Escherichia coli CFT073
ugaucgacaguugcugcgu

SEQ ID NO: 2673319 - RNA, 16 nt, Escherichia coli CFT073
ugaucgauaagccagc

SEQ ID NO: 2673320 - RNA, 11 nt, Escherichia coli CFT073
ugaucgcccau

SEQ ID NO: 2673321 - RNA, 14 nt, Escherichia coli CFT073
ugaucgccgccagu

SEQ ID NO: 2673322 - RNA, 21 nt, Escherichia coli CFT073
ugaucgccgccagugccacca

SEQ ID NO: 2673323 - RNA, 16 nt, Escherichia coli CFT073
ugaucgcgcaaguucg

SEQ ID NO: 2673324 - RNA, 22 nt, Escherichia coli CFT073
ugaucgcgcaguaaauccgcca

SEQ ID NO: 2673325 - RNA, 21 nt, Escherichia coli CFT073
ugaucgcgcaguuuaugcagu

SEQ ID NO: 2673326 - RNA, 14 nt, Escherichia coli CFT073
ugaucggagaacag

SEQ ID NO: 2673327 - RNA, 21 nt, Escherichia coli CFT073
ugaucggagaacaggaauaaa

SEQ ID NO: 2673328 - RNA, 23 nt, Escherichia coli CFT073
ugaucggagaacaggaauaaauc

SEQ ID NO: 2673329 - RNA, 23 nt, Escherichia coli CFT073
ugaucguaacggguacgguaaag

SEQ ID NO: 2673330 - RNA, 21 nt, Escherichia coli CFT073
ugaucgucagcacucacgcca

SEQ ID NO: 2673331 - RNA, 23 nt, Escherichia coli CFT073
ugaucgugccaggaccauucaca

SEQ ID NO: 2673332 - RNA, 18 nt, Escherichia coli CFT073
ugaucgugcgcgccguga

SEQ ID NO: 2673333 - RNA, 14 nt, Escherichia coli CFT073
ugaucguuaaaucc

SEQ ID NO: 2673334 - RNA, 13 nt, Escherichia coli CFT073
ugaucucuuucca

SEQ ID NO: 2673335 - RNA, 14 nt, Escherichia coli CFT073
ugaucugcacagca

SEQ ID NO: 2673336 - RNA, 15 nt, Escherichia coli CFT073
ugaucugcacagcau

SEQ ID NO: 2673337 - RNA, 14 nt, Escherichia coli CFT073
ugaucugccccaua

SEQ ID NO: 2673338 - RNA, 15 nt, Escherichia coli CFT073
ugaucugccccauag

SEQ ID NO: 2673339 - RNA, 21 nt, Escherichia coli CFT073
ugaucugcuaaacguaacaca

SEQ ID NO: 2673340 - RNA, 17 nt, Escherichia coli CFT073
ugaucugugugguuuug

SEQ ID NO: 2673341 - RNA, 21 nt, Escherichia coli CFT073
ugaucugugugguuuuguagu

SEQ ID NO: 2673342 - RNA, 22 nt, Escherichia coli CFT073
ugaucuuacguuuaauauuacc

SEQ ID NO: 2673343 - RNA, 12 nt, Escherichia coli CFT073
ugaucuuccuga

SEQ ID NO: 2673344 - RNA, 15 nt, Escherichia coli CFT073
ugaucuucucuuaua

SEQ ID NO: 2673345 - RNA, 14 nt, Escherichia coli CFT073
ugaucuuuuuuauu

SEQ ID NO: 2673346 - RNA, 13 nt, Escherichia coli CFT073
ugaugaaaaaacc

SEQ ID NO: 2673347 - RNA, 20 nt, Escherichia coli CFT073
ugaugaaaaacguugccgga

SEQ ID NO: 2673348 - RNA, 22 nt, Escherichia coli CFT073
ugaugaaaaacguugccggaua

SEQ ID NO: 2673349 - RNA, 20 nt, Escherichia coli CFT073
ugaugaacgguugcaauauc

SEQ ID NO: 2673350 - RNA, 20 nt, Escherichia coli CFT073
ugaugaagucaggugaaauu

SEQ ID NO: 2673351 - RNA, 18 nt, Escherichia coli CFT073
ugaugaaguugaaaucac

SEQ ID NO: 2673352 - RNA, 23 nt, Escherichia coli CFT073
ugaugaauuuuaauauguugacu

SEQ ID NO: 2673353 - RNA, 13 nt, Escherichia coli CFT073
ugaugaccagugc

SEQ ID NO: 2673354 - RNA, 16 nt, Escherichia coli CFT073
ugaugacgcagauccc

SEQ ID NO: 2673355 - RNA, 14 nt, Escherichia coli CFT073
ugaugacuugccuc

SEQ ID NO: 2673356 - RNA, 22 nt, Escherichia coli CFT073
ugaugagcggagcacaucaggc

SEQ ID NO: 2673357 - RNA, 17 nt, Escherichia coli CFT073
ugaugauaaguucaagu

SEQ ID NO: 2673358 - RNA, 22 nt, Escherichia coli CFT073
ugaugaucggcguacccagcgu

SEQ ID NO: 2673359 - RNA, 18 nt, Escherichia coli CFT073
ugaugauuaaaucgaagc

SEQ ID NO: 2673360 - RNA, 22 nt, Escherichia coli CFT073
ugaugauuaaaucgaagcguac

SEQ ID NO: 2673361 - RNA, 16 nt, Escherichia coli CFT073
ugaugcaacuguuuua

SEQ ID NO: 2673362 - RNA, 18 nt, Escherichia coli CFT073
ugaugccaaacgcaaaau

SEQ ID NO: 2673363 - RNA, 13 nt, Escherichia coli CFT073
ugaugccacaaac

SEQ ID NO: 2673364 - RNA, 20 nt, Escherichia coli CFT073
ugaugccagcacucugugcg

SEQ ID NO: 2673365 - RNA, 11 nt, Escherichia coli CFT073
ugaugccaucg

SEQ ID NO: 2673366 - RNA, 23 nt, Escherichia coli CFT073
ugaugcccgguugugaagugcaa

SEQ ID NO: 2673367 - RNA, 12 nt, Escherichia coli CFT073
ugaugccggaug

SEQ ID NO: 2673368 - RNA, 22 nt, Escherichia coli CFT073
ugaugccggaugcgacgcuuga

SEQ ID NO: 2673369 - RNA, 14 nt, Escherichia coli CFT073
ugaugccggguuug

SEQ ID NO: 2673370 - RNA, 18 nt, Escherichia coli CFT073
ugaugcgcacacgcgcug

SEQ ID NO: 2673371 - RNA, 22 nt, Escherichia coli CFT073
ugaugcgcgagguaacaauaaa

SEQ ID NO: 2673372 - RNA, 16 nt, Escherichia coli CFT073
ugaugcgcggcuccag

SEQ ID NO: 2673373 - RNA, 17 nt, Escherichia coli CFT073
ugaugcgcuacgcuuau

SEQ ID NO: 2673374 - RNA, 14 nt, Escherichia coli CFT073
ugaugcgcuaugcu

SEQ ID NO: 2673375 - RNA, 19 nt, Escherichia coli CFT073
ugaugcgcuccgcuuauca

SEQ ID NO: 2673376 - RNA, 20 nt, Escherichia coli CFT073
ugaugcgcuccgcuuaucag

SEQ ID NO: 2673377 - RNA, 18 nt, Escherichia coli CFT073
ugaugcgcugcgcuucuc

SEQ ID NO: 2673378 - RNA, 20 nt, Escherichia coli CFT073
ugaugcgcugcgcuucucag

SEQ ID NO: 2673379 - RNA, 23 nt, Escherichia coli CFT073
ugaugcgcuucgcuuaccaugcc

SEQ ID NO: 2673380 - RNA, 16 nt, Escherichia coli CFT073
ugaugcggucgcugcc

SEQ ID NO: 2673381 - RNA, 18 nt, Escherichia coli CFT073
ugaugcggucgcugccgc

SEQ ID NO: 2673382 - RNA, 20 nt, Escherichia coli CFT073
ugaugcguugccguaugacc

SEQ ID NO: 2673383 - RNA, 14 nt, Escherichia coli CFT073
ugaugcuccgccag

SEQ ID NO: 2673384 - RNA, 22 nt, Escherichia coli CFT073
ugauggaaaauuguuccgucag

SEQ ID NO: 2673385 - RNA, 22 nt, Escherichia coli CFT073
ugauggaaauccgggcuaucau

SEQ ID NO: 2673386 - RNA, 16 nt, Escherichia coli CFT073
ugauggaauuucauca

SEQ ID NO: 2673387 - RNA, 17 nt, Escherichia coli CFT073
ugauggaauuucaucau

SEQ ID NO: 2673388 - RNA, 22 nt, Escherichia coli CFT073
ugauggcaaaugcaacauuauc

SEQ ID NO: 2673389 - RNA, 15 nt, Escherichia coli CFT073
ugauggcacuauauc

SEQ ID NO: 2673390 - RNA, 20 nt, Escherichia coli CFT073
ugauggcauaacguugcagc

SEQ ID NO: 2673391 - RNA, 22 nt, Escherichia coli CFT073
ugauggccagauaacccagggg

SEQ ID NO: 2673392 - RNA, 21 nt, Escherichia coli CFT073
ugauggcccaucgucacaccu

SEQ ID NO: 2673393 - RNA, 21 nt, Escherichia coli CFT073
ugauggcgccaguuauucauu

SEQ ID NO: 2673394 - RNA, 11 nt, Escherichia coli CFT073
ugauggcgcgc

SEQ ID NO: 2673395 - RNA, 14 nt, Escherichia coli CFT073
ugauggcgcgccac

SEQ ID NO: 2673396 - RNA, 14 nt, Escherichia coli CFT073
ugauggcguacuca

SEQ ID NO: 2673397 - RNA, 15 nt, Escherichia coli CFT073
ugaugggauaaagau

SEQ ID NO: 2673398 - RNA, 23 nt, Escherichia coli CFT073
ugaugggcaccaggcaauuggca

SEQ ID NO: 2673399 - RNA, 16 nt, Escherichia coli CFT073
ugaugggcagaauaac

SEQ ID NO: 2673400 - RNA, 16 nt, Escherichia coli CFT073
ugaugggcuccacaaa

SEQ ID NO: 2673401 - RNA, 15 nt, Escherichia coli CFT073
ugaugguaacgcgcc

SEQ ID NO: 2673402 - RNA, 18 nt, Escherichia coli CFT073
ugaugguccuucagcacc

SEQ ID NO: 2673403 - RNA, 13 nt, Escherichia coli CFT073
ugauguaacaguu

SEQ ID NO: 2673404 - RNA, 21 nt, Escherichia coli CFT073
ugauguacuaaccaugcgccc

SEQ ID NO: 2673405 - RNA, 15 nt, Escherichia coli CFT073
ugauguauauuucug

SEQ ID NO: 2673406 - RNA, 15 nt, Escherichia coli CFT073
ugauguauccggcau

SEQ ID NO: 2673407 - RNA, 13 nt, Escherichia coli CFT073
ugauguccugcgg

SEQ ID NO: 2673408 - RNA, 22 nt, Escherichia coli CFT073
ugauguccuuuauaacugucuu

SEQ ID NO: 2673409 - RNA, 14 nt, Escherichia coli CFT073
ugaugugcuuauca

SEQ ID NO: 2673410 - RNA, 22 nt, Escherichia coli CFT073
ugauguggacuguagauauuca

SEQ ID NO: 2673411 - RNA, 22 nt, Escherichia coli CFT073
ugauguuaccaacacugaaagu

SEQ ID NO: 2673412 - RNA, 15 nt, Escherichia coli CFT073
ugauguucuggcgaa

SEQ ID NO: 2673413 - RNA, 20 nt, Escherichia coli CFT073
ugauguuucugcgcgaaauu

SEQ ID NO: 2673414 - RNA, 21 nt, Escherichia coli CFT073
ugauuaaaucgaagcguacug

SEQ ID NO: 2673415 - RNA, 13 nt, Escherichia coli CFT073
ugauuaaauucag

SEQ ID NO: 2673416 - RNA, 22 nt, Escherichia coli CFT073
ugauuaagaucgugcagcaccg

SEQ ID NO: 2673417 - RNA, 20 nt, Escherichia coli CFT073
ugauuaagcggguuuugaau

SEQ ID NO: 2673418 - RNA, 13 nt, Escherichia coli CFT073
ugauuaauauuga

SEQ ID NO: 2673419 - RNA, 15 nt, Escherichia coli CFT073
ugauuacaggaugcg

SEQ ID NO: 2673420 - RNA, 13 nt, Escherichia coli CFT073
ugauuaccaaaac

SEQ ID NO: 2673421 - RNA, 17 nt, Escherichia coli CFT073
ugauuaccgcaaaucac

SEQ ID NO: 2673422 - RNA, 20 nt, Escherichia coli CFT073
ugauuaccggagcugcagcc

SEQ ID NO: 2673423 - RNA, 16 nt, Escherichia coli CFT073
ugauuacgcaucaccc

SEQ ID NO: 2673424 - RNA, 18 nt, Escherichia coli CFT073
ugauuacgguauugcuau

SEQ ID NO: 2673425 - RNA, 15 nt, Escherichia coli CFT073
ugauuacucauuaau

SEQ ID NO: 2673426 - RNA, 14 nt, Escherichia coli CFT073
ugauuauccucugu

SEQ ID NO: 2673427 - RNA, 23 nt, Escherichia coli CFT073
ugauuauugucgugccgcuacug

SEQ ID NO: 2673428 - RNA, 13 nt, Escherichia coli CFT073
ugauucaccaccg

SEQ ID NO: 2673429 - RNA, 20 nt, Escherichia coli CFT073
ugauucacgcugacaacucc

SEQ ID NO: 2673430 - RNA, 20 nt, Escherichia coli CFT073
ugauucauaguaagcagauu

SEQ ID NO: 2673431 - RNA, 21 nt, Escherichia coli CFT073
ugauucauggcauuuucucgu

SEQ ID NO: 2673432 - RNA, 12 nt, Escherichia coli CFT073
ugauucccagca

SEQ ID NO: 2673433 - RNA, 18 nt, Escherichia coli CFT073
ugauucccugccugacag

SEQ ID NO: 2673434 - RNA, 20 nt, Escherichia coli CFT073
ugauuccggguagagaucuu

SEQ ID NO: 2673435 - RNA, 21 nt, Escherichia coli CFT073
ugauugaaaaacaccucaucg

SEQ ID NO: 2673436 - RNA, 15 nt, Escherichia coli CFT073
ugauugaagaaauca

SEQ ID NO: 2673437 - RNA, 16 nt, Escherichia coli CFT073
ugauugaccauauuaa

SEQ ID NO: 2673438 - RNA, 17 nt, Escherichia coli CFT073
ugauugacgcguucgcu

SEQ ID NO: 2673439 - RNA, 14 nt, Escherichia coli CFT073
ugauugauuuuucc

SEQ ID NO: 2673440 - RNA, 19 nt, Escherichia coli CFT073
ugauugcacucgaccuuaa

SEQ ID NO: 2673441 - RNA, 22 nt, Escherichia coli CFT073
ugauugccccuccgcacagggg

SEQ ID NO: 2673442 - RNA, 14 nt, Escherichia coli CFT073
ugauugcuuuuguu

SEQ ID NO: 2673443 - RNA, 14 nt, Escherichia coli CFT073
ugauuggccccauu

SEQ ID NO: 2673444 - RNA, 12 nt, Escherichia coli CFT073
ugauuggcgcga

SEQ ID NO: 2673445 - RNA, 16 nt, Escherichia coli CFT073
ugauuguuuguagccg

SEQ ID NO: 2673446 - RNA, 15 nt, Escherichia coli CFT073
ugauuguuuuaaaua

SEQ ID NO: 2673447 - RNA, 18 nt, Escherichia coli CFT073
ugauuguuuuaaauauug

SEQ ID NO: 2673448 - RNA, 19 nt, Escherichia coli CFT073
ugauuuaacagcaaaacac

SEQ ID NO: 2673449 - RNA, 22 nt, Escherichia coli CFT073
ugauuuauaccggcauuucggc

SEQ ID NO: 2673450 - RNA, 21 nt, Escherichia coli CFT073
ugauuuauuucucauuuugau

SEQ ID NO: 2673451 - RNA, 13 nt, Escherichia coli CFT073
ugauuuauuuuua

SEQ ID NO: 2673452 - RNA, 17 nt, Escherichia coli CFT073
ugauuucaaaauuaaag

SEQ ID NO: 2673453 - RNA, 12 nt, Escherichia coli CFT073
ugauuuccgccg

SEQ ID NO: 2673454 - RNA, 19 nt, Escherichia coli CFT073
ugauuuccguuaccggaag

SEQ ID NO: 2673455 - RNA, 21 nt, Escherichia coli CFT073
ugauuucguccauguuggaga

SEQ ID NO: 2673456 - RNA, 18 nt, Escherichia coli CFT073
ugauuucucuggagaaau

SEQ ID NO: 2673457 - RNA, 20 nt, Escherichia coli CFT073
ugauuucuuauucauaucuu

SEQ ID NO: 2673458 - RNA, 15 nt, Escherichia coli CFT073
ugauuugauguacuc

SEQ ID NO: 2673459 - RNA, 16 nt, Escherichia coli CFT073
ugauuugauguacuca

SEQ ID NO: 2673460 - RNA, 17 nt, Escherichia coli CFT073
ugauuugcugccggaug

SEQ ID NO: 2673461 - RNA, 16 nt, Escherichia coli CFT073
ugauuuucuuccagua

SEQ ID NO: 2673462 - RNA, 21 nt, Escherichia coli CFT073
ugauuuugacgcuaaauugaa

SEQ ID NO: 2673463 - RNA, 17 nt, Escherichia coli CFT073
ugauuuuguaggucgga

SEQ ID NO: 2673464 - RNA, 16 nt, Escherichia coli CFT073
ugauuuuuccacuccg

SEQ ID NO: 2673465 - RNA, 17 nt, Escherichia coli CFT073
ugauuuuucguuuuaau

SEQ ID NO: 2673466 - RNA, 23 nt, Escherichia coli CFT073
ugauuuuucguuuuaaugcgauc

SEQ ID NO: 2673467 - RNA, 18 nt, Escherichia coli CFT073
ugauuuuuguaggucgga

SEQ ID NO: 2673468 - RNA, 19 nt, Escherichia coli CFT073
ugauuuuuuccaacaggcg

SEQ ID NO: 2673469 - RNA, 17 nt, Escherichia coli CFT073
ugauuuuuuugauaaac

SEQ ID NO: 2673470 - RNA, 20 nt, Escherichia coli CFT073
ugcaaaagcaggagcaauuu

SEQ ID NO: 2673471 - RNA, 16 nt, Escherichia coli CFT073
ugcaaaauaccaauaa

SEQ ID NO: 2673472 - RNA, 22 nt, Escherichia coli CFT073
ugcaaaaucuguugaaauuauu

SEQ ID NO: 2673473 - RNA, 20 nt, Escherichia coli CFT073
ugcaaacaacgcuucaaacc

SEQ ID NO: 2673474 - RNA, 19 nt, Escherichia coli CFT073
ugcaaacaguaacccagca

SEQ ID NO: 2673475 - RNA, 17 nt, Escherichia coli CFT073
ugcaaacgauaaaagug

SEQ ID NO: 2673476 - RNA, 18 nt, Escherichia coli CFT073
ugcaaacgcguuaagccc

SEQ ID NO: 2673477 - RNA, 14 nt, Escherichia coli CFT073
ugcaaagagaacug

SEQ ID NO: 2673478 - RNA, 19 nt, Escherichia coli CFT073
ugcaaagagaacugagcga

SEQ ID NO: 2673479 - RNA, 19 nt, Escherichia coli CFT073
ugcaaagcugauaaucauc

SEQ ID NO: 2673480 - RNA, 16 nt, Escherichia coli CFT073
ugcaaaggccaauggu

SEQ ID NO: 2673481 - RNA, 19 nt, Escherichia coli CFT073
ugcaaaggcugugaaaguu

SEQ ID NO: 2673482 - RNA, 18 nt, Escherichia coli CFT073
ugcaaauacccaaaaaau

SEQ ID NO: 2673483 - RNA, 22 nt, Escherichia coli CFT073
ugcaaauuuuaacgcauaauaa

SEQ ID NO: 2673484 - RNA, 13 nt, Escherichia coli CFT073
ugcaaauuuuuaa

SEQ ID NO: 2673485 - RNA, 11 nt, Escherichia coli CFT073
ugcaacaacac

SEQ ID NO: 2673486 - RNA, 14 nt, Escherichia coli CFT073
ugcaacaacaccag

SEQ ID NO: 2673487 - RNA, 20 nt, Escherichia coli CFT073
ugcaacaaggguaugcugua

SEQ ID NO: 2673488 - RNA, 15 nt, Escherichia coli CFT073
ugcaacacaagccaa

SEQ ID NO: 2673489 - RNA, 17 nt, Escherichia coli CFT073
ugcaacacuaccgguca

SEQ ID NO: 2673490 - RNA, 21 nt, Escherichia coli CFT073
ugcaacacucguuucaaauuu

SEQ ID NO: 2673491 - RNA, 21 nt, Escherichia coli CFT073
ugcaaccagaaagucuucacc

SEQ ID NO: 2673492 - RNA, 20 nt, Escherichia coli CFT073
ugcaaccgacgacgaccagc

SEQ ID NO: 2673493 - RNA, 16 nt, Escherichia coli CFT073
ugcaaccuguaggccg

SEQ ID NO: 2673494 - RNA, 21 nt, Escherichia coli CFT073
ugcaaccuuuuccauugccgc

SEQ ID NO: 2673495 - RNA, 17 nt, Escherichia coli CFT073
ugcaacgaaccaaucac

SEQ ID NO: 2673496 - RNA, 13 nt, Escherichia coli CFT073
ugcaacguuuuaa

SEQ ID NO: 2673497 - RNA, 18 nt, Escherichia coli CFT073
ugcaacguuuuaagcaaa

SEQ ID NO: 2673498 - RNA, 21 nt, Escherichia coli CFT073
ugcaacguuuuaagcaaauaa

SEQ ID NO: 2673499 - RNA, 24 nt, Escherichia coli CFT073
ugcaacguuuuaagcaaauaauuc

SEQ ID NO: 2673500 - RNA, 15 nt, Escherichia coli CFT073
ugcaacucuuucacu

SEQ ID NO: 2673501 - RNA, 23 nt, Escherichia coli CFT073
ugcaacugcccaggcaaaaaggc

SEQ ID NO: 2673502 - RNA, 18 nt, Escherichia coli CFT073
ugcaacuggcggcggcga

SEQ ID NO: 2673503 - RNA, 16 nt, Escherichia coli CFT073
ugcaacugugcggcaa

SEQ ID NO: 2673504 - RNA, 12 nt, Escherichia coli CFT073
ugcaacuugaag

SEQ ID NO: 2673505 - RNA, 18 nt, Escherichia coli CFT073
ugcaacuugaaguaugac

SEQ ID NO: 2673506 - RNA, 20 nt, Escherichia coli CFT073
ugcaagaucgcgcaucagcu

SEQ ID NO: 2673507 - RNA, 20 nt, Escherichia coli CFT073
ugcaagccgcggaauuggcc

SEQ ID NO: 2673508 - RNA, 17 nt, Escherichia coli CFT073
ugcaaggcaacgcagcc

SEQ ID NO: 2673509 - RNA, 17 nt, Escherichia coli CFT073
ugcaaggccaucggcag

SEQ ID NO: 2673510 - RNA, 22 nt, Escherichia coli CFT073
ugcaagguggucagacggaaca

SEQ ID NO: 2673511 - RNA, 20 nt, Escherichia coli CFT073
ugcaaguaguggaugaaucu

SEQ ID NO: 2673512 - RNA, 17 nt, Escherichia coli CFT073
ugcaagucuugcugcgc

SEQ ID NO: 2673513 - RNA, 22 nt, Escherichia coli CFT073
ugcaauaauggaaccuaacgcu

SEQ ID NO: 2673514 - RNA, 21 nt, Escherichia coli CFT073
ugcaauauauugaauuagcaa

SEQ ID NO: 2673515 - RNA, 20 nt, Escherichia coli CFT073
ugcaaucagcggugccgcga

SEQ ID NO: 2673516 - RNA, 17 nt, Escherichia coli CFT073
ugcaauccacaagcaca

SEQ ID NO: 2673517 - RNA, 16 nt, Escherichia coli CFT073
ugcaaucgucugcuga

SEQ ID NO: 2673518 - RNA, 21 nt, Escherichia coli CFT073
ugcaaucuccuguugugaugc

SEQ ID NO: 2673519 - RNA, 20 nt, Escherichia coli CFT073
ugcaaucucugacauaaaaa

SEQ ID NO: 2673520 - RNA, 13 nt, Escherichia coli CFT073
ugcaaucuuuccu

SEQ ID NO: 2673521 - RNA, 18 nt, Escherichia coli CFT073
ugcaaucuuucgaguaaa

SEQ ID NO: 2673522 - RNA, 18 nt, Escherichia coli CFT073
ugcaaugaaaaaccgugu

SEQ ID NO: 2673523 - RNA, 19 nt, Escherichia coli CFT073
ugcaaugccguuugcugca

SEQ ID NO: 2673524 - RNA, 15 nt, Escherichia coli CFT073
ugcaauggaauucgc

SEQ ID NO: 2673525 - RNA, 21 nt, Escherichia coli CFT073
ugcaauuccugcgcgaaauag

SEQ ID NO: 2673526 - RNA, 21 nt, Escherichia coli CFT073
ugcaauuguuuacuaaaaguu

SEQ ID NO: 2673527 - RNA, 13 nt, Escherichia coli CFT073
ugcaauuuaucgc

SEQ ID NO: 2673528 - RNA, 21 nt, Escherichia coli CFT073
ugcaauuuccgcuuucaacgc

SEQ ID NO: 2673529 - RNA, 16 nt, Escherichia coli CFT073
ugcaauuugugcguca

SEQ ID NO: 2673530 - RNA, 22 nt, Escherichia coli CFT073
ugcaauuugugcgucauuuuca

SEQ ID NO: 2673531 - RNA, 13 nt, Escherichia coli CFT073
ugcaauuuuuaua

SEQ ID NO: 2673532 - RNA, 17 nt, Escherichia coli CFT073
ugcacaaacuucuucag

SEQ ID NO: 2673533 - RNA, 20 nt, Escherichia coli CFT073
ugcacaaccggaaccagcgc

SEQ ID NO: 2673534 - RNA, 22 nt, Escherichia coli CFT073
ugcacaagcggcaguuucagcc

SEQ ID NO: 2673535 - RNA, 24 nt, Escherichia coli CFT073
ugcacaaucagcguuugcgacagu

SEQ ID NO: 2673536 - RNA, 15 nt, Escherichia coli CFT073
ugcacaaugccuuuu

SEQ ID NO: 2673537 - RNA, 20 nt, Escherichia coli CFT073
ugcacaccgcggaacgcacu

SEQ ID NO: 2673538 - RNA, 22 nt, Escherichia coli CFT073
ugcacacgcggagccaguucgu

SEQ ID NO: 2673539 - RNA, 20 nt, Escherichia coli CFT073
ugcacagacuuaauauugcc

SEQ ID NO: 2673540 - RNA, 22 nt, Escherichia coli CFT073
ugcacagcauccgaacgcugac

SEQ ID NO: 2673541 - RNA, 14 nt, Escherichia coli CFT073
ugcacagcucugaa

SEQ ID NO: 2673542 - RNA, 18 nt, Escherichia coli CFT073
ugcacagcucugaauaaa

SEQ ID NO: 2673543 - RNA, 23 nt, Escherichia coli CFT073
ugcacagcucugaauaaacggua

SEQ ID NO: 2673544 - RNA, 18 nt, Escherichia coli CFT073
ugcacagcuuaaaaugcu

SEQ ID NO: 2673545 - RNA, 17 nt, Escherichia coli CFT073
ugcacagguaaacgcau

SEQ ID NO: 2673546 - RNA, 21 nt, Escherichia coli CFT073
ugcacagguggcaaacgccac

SEQ ID NO: 2673547 - RNA, 20 nt, Escherichia coli CFT073
ugcacauccacgccuuuuuu

SEQ ID NO: 2673548 - RNA, 23 nt, Escherichia coli CFT073
ugcaccacaacaccuuucacgcc

SEQ ID NO: 2673549 - RNA, 22 nt, Escherichia coli CFT073
ugcaccacuguuuuucagcacg

SEQ ID NO: 2673550 - RNA, 17 nt, Escherichia coli CFT073
ugcaccagaucuuccag

SEQ ID NO: 2673551 - RNA, 12 nt, Escherichia coli CFT073
ugcaccagcaau

SEQ ID NO: 2673552 - RNA, 11 nt, Escherichia coli CFT073
ugcaccagcag

SEQ ID NO: 2673553 - RNA, 19 nt, Escherichia coli CFT073
ugcaccagguuuucgucgu

SEQ ID NO: 2673554 - RNA, 18 nt, Escherichia coli CFT073
ugcaccaucaggcauauu

SEQ ID NO: 2673555 - RNA, 22 nt, Escherichia coli CFT073
ugcacccaguacgggcagcgca

SEQ ID NO: 2673556 - RNA, 16 nt, Escherichia coli CFT073
ugcaccccacaaacag

SEQ ID NO: 2673557 - RNA, 15 nt, Escherichia coli CFT073
ugcaccgauuucgag

SEQ ID NO: 2673558 - RNA, 18 nt, Escherichia coli CFT073
ugcaccgcgccacuggcg

SEQ ID NO: 2673559 - RNA, 19 nt, Escherichia coli CFT073
ugcaccggcgauaucccag

SEQ ID NO: 2673560 - RNA, 18 nt, Escherichia coli CFT073
ugcaccguuggacggucu

SEQ ID NO: 2673561 - RNA, 21 nt, Escherichia coli CFT073
ugcaccucauccugacaggcc

SEQ ID NO: 2673562 - RNA, 14 nt, Escherichia coli CFT073
ugcaccugauccag

SEQ ID NO: 2673563 - RNA, 18 nt, Escherichia coli CFT073
ugcaccugauccagcucu

SEQ ID NO: 2673564 - RNA, 20 nt, Escherichia coli CFT073
ugcaccugauccagcucuuc

SEQ ID NO: 2673565 - RNA, 18 nt, Escherichia coli CFT073
ugcacgaugcauugucag

SEQ ID NO: 2673566 - RNA, 18 nt, Escherichia coli CFT073
ugcacgaugccucaucac

SEQ ID NO: 2673567 - RNA, 15 nt, Escherichia coli CFT073
ugcacgcagaucggu

SEQ ID NO: 2673568 - RNA, 21 nt, Escherichia coli CFT073
ugcacgcgauggcuuuccacc

SEQ ID NO: 2673569 - RNA, 13 nt, Escherichia coli CFT073
ugcacgcucuuca

SEQ ID NO: 2673570 - RNA, 15 nt, Escherichia coli CFT073
ugcacgcugccuggu

SEQ ID NO: 2673571 - RNA, 21 nt, Escherichia coli CFT073
ugcacgugcuuauaacugccc

SEQ ID NO: 2673572 - RNA, 17 nt, Escherichia coli CFT073
ugcacguuaucagacac

SEQ ID NO: 2673573 - RNA, 16 nt, Escherichia coli CFT073
ugcacuaccguaaaua

SEQ ID NO: 2673574 - RNA, 17 nt, Escherichia coli CFT073
ugcacucgccaguugac

SEQ ID NO: 2673575 - RNA, 14 nt, Escherichia coli CFT073
ugcacucguaacau

SEQ ID NO: 2673576 - RNA, 15 nt, Escherichia coli CFT073
ugcacugcucauuaa

SEQ ID NO: 2673577 - RNA, 17 nt, Escherichia coli CFT073
ugcacugucccaaaaug

SEQ ID NO: 2673578 - RNA, 20 nt, Escherichia coli CFT073
ugcacugucccaaaaugucg

SEQ ID NO: 2673579 - RNA, 18 nt, Escherichia coli CFT073
ugcacuucuucacaucaa

SEQ ID NO: 2673580 - RNA, 14 nt, Escherichia coli CFT073
ugcacuuucaguac

SEQ ID NO: 2673581 - RNA, 20 nt, Escherichia coli CFT073
ugcacuuucaguacguuuuu

SEQ ID NO: 2673582 - RNA, 15 nt, Escherichia coli CFT073
ugcacuuugugucag

SEQ ID NO: 2673583 - RNA, 23 nt, Escherichia coli CFT073
ugcagaaauaaaagccugaucaa

SEQ ID NO: 2673584 - RNA, 15 nt, Escherichia coli CFT073
ugcagaaucaaucuc

SEQ ID NO: 2673585 - RNA, 17 nt, Escherichia coli CFT073
ugcagaauuugcaccac

SEQ ID NO: 2673586 - RNA, 19 nt, Escherichia coli CFT073
ugcagacgaucuucggcgu

SEQ ID NO: 2673587 - RNA, 16 nt, Escherichia coli CFT073
ugcagacugaagcucc

SEQ ID NO: 2673588 - RNA, 19 nt, Escherichia coli CFT073
ugcagagaaguguacgaac

SEQ ID NO: 2673589 - RNA, 14 nt, Escherichia coli CFT073
ugcagagucaucag

SEQ ID NO: 2673590 - RNA, 17 nt, Escherichia coli CFT073
ugcagauaccacaucaa

SEQ ID NO: 2673591 - RNA, 17 nt, Escherichia coli CFT073
ugcagaucuuucugcag

SEQ ID NO: 2673592 - RNA, 21 nt, Escherichia coli CFT073
ugcagaucuuucugcagggca

SEQ ID NO: 2673593 - RNA, 23 nt, Escherichia coli CFT073
ugcagaucuuucugcagggcaau

SEQ ID NO: 2673594 - RNA, 16 nt, Escherichia coli CFT073
ugcagauggaugagca

SEQ ID NO: 2673595 - RNA, 19 nt, Escherichia coli CFT073
ugcagauuugccaguaccg

SEQ ID NO: 2673596 - RNA, 18 nt, Escherichia coli CFT073
ugcagcaaauaguaagaa

SEQ ID NO: 2673597 - RNA, 20 nt, Escherichia coli CFT073
ugcagcaagccacucagccc

SEQ ID NO: 2673598 - RNA, 17 nt, Escherichia coli CFT073
ugcagcacggagagacg

SEQ ID NO: 2673599 - RNA, 18 nt, Escherichia coli CFT073
ugcagcacucgauuccaa

SEQ ID NO: 2673600 - RNA, 15 nt, Escherichia coli CFT073
ugcagcacugauaau

SEQ ID NO: 2673601 - RNA, 17 nt, Escherichia coli CFT073
ugcagcagcaaacgccg

SEQ ID NO: 2673602 - RNA, 16 nt, Escherichia coli CFT073
ugcagcauagaagaaa

SEQ ID NO: 2673603 - RNA, 17 nt, Escherichia coli CFT073
ugcagcauagaagaaau

SEQ ID NO: 2673604 - RNA, 17 nt, Escherichia coli CFT073
ugcagcauauucgccgu

SEQ ID NO: 2673605 - RNA, 16 nt, Escherichia coli CFT073
ugcagcaucgauggug

SEQ ID NO: 2673606 - RNA, 12 nt, Escherichia coli CFT073
ugcagcauucau

SEQ ID NO: 2673607 - RNA, 18 nt, Escherichia coli CFT073
ugcagccagcguuaccca

SEQ ID NO: 2673608 - RNA, 14 nt, Escherichia coli CFT073
ugcagccaggccau

SEQ ID NO: 2673609 - RNA, 22 nt, Escherichia coli CFT073
ugcagccauuuuacucauggaa

SEQ ID NO: 2673610 - RNA, 12 nt, Escherichia coli CFT073
ugcagccccaua

SEQ ID NO: 2673611 - RNA, 21 nt, Escherichia coli CFT073
ugcagccccauaugcagcacu

SEQ ID NO: 2673612 - RNA, 14 nt, Escherichia coli CFT073
ugcagccgccaucg

SEQ ID NO: 2673613 - RNA, 15 nt, Escherichia coli CFT073
ugcagccggagcuuc

SEQ ID NO: 2673614 - RNA, 14 nt, Escherichia coli CFT073
ugcagccgucgccc

SEQ ID NO: 2673615 - RNA, 16 nt, Escherichia coli CFT073
ugcagccgucgcccac

SEQ ID NO: 2673616 - RNA, 17 nt, Escherichia coli CFT073
ugcagccgucgcccaca

SEQ ID NO: 2673617 - RNA, 20 nt, Escherichia coli CFT073
ugcagccguggaaugauuaa

SEQ ID NO: 2673618 - RNA, 19 nt, Escherichia coli CFT073
ugcagcgcaaucgccucca

SEQ ID NO: 2673619 - RNA, 17 nt, Escherichia coli CFT073
ugcagcgcaugauuuuc

SEQ ID NO: 2673620 - RNA, 20 nt, Escherichia coli CFT073
ugcagcgcggcgagagccuu

SEQ ID NO: 2673621 - RNA, 22 nt, Escherichia coli CFT073
ugcagcggagaucgccagcccu

SEQ ID NO: 2673622 - RNA, 18 nt, Escherichia coli CFT073
ugcagcggccaguagcuu

SEQ ID NO: 2673623 - RNA, 18 nt, Escherichia coli CFT073
ugcagcguuucgcgcgcg

SEQ ID NO: 2673624 - RNA, 19 nt, Escherichia coli CFT073
ugcagcucauauuccugca

SEQ ID NO: 2673625 - RNA, 17 nt, Escherichia coli CFT073
ugcagcucgcacgccac

SEQ ID NO: 2673626 - RNA, 15 nt, Escherichia coli CFT073
ugcagcucuguuuug

SEQ ID NO: 2673627 - RNA, 13 nt, Escherichia coli CFT073
ugcagcugcagau

SEQ ID NO: 2673628 - RNA, 19 nt, Escherichia coli CFT073
ugcagcuguugcgccagca

SEQ ID NO: 2673629 - RNA, 23 nt, Escherichia coli CFT073
ugcagcuucgccauuucgucguc

SEQ ID NO: 2673630 - RNA, 17 nt, Escherichia coli CFT073
ugcagcuucuucuccag

SEQ ID NO: 2673631 - RNA, 20 nt, Escherichia coli CFT073
ugcaggaaaucaaugccacc

SEQ ID NO: 2673632 - RNA, 12 nt, Escherichia coli CFT073
ugcaggaacaau

SEQ ID NO: 2673633 - RNA, 20 nt, Escherichia coli CFT073
ugcaggcaacgaccagaaau

SEQ ID NO: 2673634 - RNA, 16 nt, Escherichia coli CFT073
ugcaggcaucggugau

SEQ ID NO: 2673635 - RNA, 18 nt, Escherichia coli CFT073
ugcaggcaugcaauauuc

SEQ ID NO: 2673636 - RNA, 14 nt, Escherichia coli CFT073
ugcaggccaaacag

SEQ ID NO: 2673637 - RNA, 20 nt, Escherichia coli CFT073
ugcaggccagauaaggcguu

SEQ ID NO: 2673638 - RNA, 13 nt, Escherichia coli CFT073
ugcaggcuggccc

SEQ ID NO: 2673639 - RNA, 13 nt, Escherichia coli CFT073
ugcaggcuggugg

SEQ ID NO: 2673640 - RNA, 15 nt, Escherichia coli CFT073
ugcagggauggcucc

SEQ ID NO: 2673641 - RNA, 17 nt, Escherichia coli CFT073
ugcagggugagggcaau

SEQ ID NO: 2673642 - RNA, 14 nt, Escherichia coli CFT073
ugcaggucguccug

SEQ ID NO: 2673643 - RNA, 21 nt, Escherichia coli CFT073
ugcaggucguccugcaaagcu

SEQ ID NO: 2673644 - RNA, 15 nt, Escherichia coli CFT073
ugcagguuaggcuga

SEQ ID NO: 2673645 - RNA, 14 nt, Escherichia coli CFT073
ugcagguucuuuua

SEQ ID NO: 2673646 - RNA, 18 nt, Escherichia coli CFT073
ugcagguucuuuuaaacc

SEQ ID NO: 2673647 - RNA, 12 nt, Escherichia coli CFT073
ugcaguaaaauu

SEQ ID NO: 2673648 - RNA, 15 nt, Escherichia coli CFT073
ugcaguaaaccacau

SEQ ID NO: 2673649 - RNA, 16 nt, Escherichia coli CFT073
ugcaguaacugcugua

SEQ ID NO: 2673650 - RNA, 23 nt, Escherichia coli CFT073
ugcaguagcagcaggaauaauca

SEQ ID NO: 2673651 - RNA, 13 nt, Escherichia coli CFT073
ugcaguagccagu

SEQ ID NO: 2673652 - RNA, 17 nt, Escherichia coli CFT073
ugcagucaccugcccuc

SEQ ID NO: 2673653 - RNA, 21 nt, Escherichia coli CFT073
ugcagugaucgugugccacca

SEQ ID NO: 2673654 - RNA, 19 nt, Escherichia coli CFT073
ugcauaaaaacgaucgccg

SEQ ID NO: 2673655 - RNA, 14 nt, Escherichia coli CFT073
ugcauaaaaauugc

SEQ ID NO: 2673656 - RNA, 16 nt, Escherichia coli CFT073
ugcauaaacaccugcg

SEQ ID NO: 2673657 - RNA, 17 nt, Escherichia coli CFT073
ugcauaauccgccgcug

SEQ ID NO: 2673658 - RNA, 14 nt, Escherichia coli CFT073
ugcauaauccugcc

SEQ ID NO: 2673659 - RNA, 23 nt, Escherichia coli CFT073
ugcauaaucgcuacgccuuccgu

SEQ ID NO: 2673660 - RNA, 17 nt, Escherichia coli CFT073
ugcauaaugguggagug

SEQ ID NO: 2673661 - RNA, 19 nt, Escherichia coli CFT073
ugcauaaugucgcuggccg

SEQ ID NO: 2673662 - RNA, 13 nt, Escherichia coli CFT073
ugcauacauaaau

SEQ ID NO: 2673663 - RNA, 16 nt, Escherichia coli CFT073
ugcauaccauucacga

SEQ ID NO: 2673664 - RNA, 17 nt, Escherichia coli CFT073
ugcauacucgcgucugg

SEQ ID NO: 2673665 - RNA, 13 nt, Escherichia coli CFT073
ugcauaucggcau

SEQ ID NO: 2673666 - RNA, 22 nt, Escherichia coli CFT073
ugcauaucucccaguaagccua

SEQ ID NO: 2673667 - RNA, 22 nt, Escherichia coli CFT073
ugcauaugaaugccagccacga

SEQ ID NO: 2673668 - RNA, 15 nt, Escherichia coli CFT073
ugcaucaacauauau

SEQ ID NO: 2673669 - RNA, 17 nt, Escherichia coli CFT073
ugcaucacugacaucac

SEQ ID NO: 2673670 - RNA, 22 nt, Escherichia coli CFT073
ugcaucacugacaucacgccac

SEQ ID NO: 2673671 - RNA, 22 nt, Escherichia coli CFT073
ugcaucaggcaaacuucacgca

SEQ ID NO: 2673672 - RNA, 14 nt, Escherichia coli CFT073
ugcaucaucaaggu

SEQ ID NO: 2673673 - RNA, 21 nt, Escherichia coli CFT073
ugcauccaacuucguuacuua

SEQ ID NO: 2673674 - RNA, 13 nt, Escherichia coli CFT073
ugcauccagugcc

SEQ ID NO: 2673675 - RNA, 16 nt, Escherichia coli CFT073
ugcauccaguugcgcc

SEQ ID NO: 2673676 - RNA, 18 nt, Escherichia coli CFT073
ugcaucccggcaggaaua

SEQ ID NO: 2673677 - RNA, 13 nt, Escherichia coli CFT073
ugcauccguucuu

SEQ ID NO: 2673678 - RNA, 15 nt, Escherichia coli CFT073
ugcaucgagcgcagc

SEQ ID NO: 2673679 - RNA, 21 nt, Escherichia coli CFT073
ugcaucgagcgcagcaacauc

SEQ ID NO: 2673680 - RNA, 23 nt, Escherichia coli CFT073
ugcaucgagcgcagcaacaucac

SEQ ID NO: 2673681 - RNA, 18 nt, Escherichia coli CFT073
ugcaucgccaugaugagc

SEQ ID NO: 2673682 - RNA, 21 nt, Escherichia coli CFT073
ugcaucgccugauucaaugag

SEQ ID NO: 2673683 - RNA, 19 nt, Escherichia coli CFT073
ugcaucggcaaagcgcuga

SEQ ID NO: 2673684 - RNA, 19 nt, Escherichia coli CFT073
ugcaucggggaauugugcu

SEQ ID NO: 2673685 - RNA, 20 nt, Escherichia coli CFT073
ugcaucuacgcucucuucaa

SEQ ID NO: 2673686 - RNA, 18 nt, Escherichia coli CFT073
ugcaucuauagcacucuc

SEQ ID NO: 2673687 - RNA, 21 nt, Escherichia coli CFT073
ugcaucuccggcgcauccaug

SEQ ID NO: 2673688 - RNA, 23 nt, Escherichia coli CFT073
ugcaucuccggcgcauccaugau

SEQ ID NO: 2673689 - RNA, 12 nt, Escherichia coli CFT073
ugcaucuccuga

SEQ ID NO: 2673690 - RNA, 15 nt, Escherichia coli CFT073
ugcaucuccugacac

SEQ ID NO: 2673691 - RNA, 14 nt, Escherichia coli CFT073
ugcaucucuucaaa

SEQ ID NO: 2673692 - RNA, 14 nt, Escherichia coli CFT073
ugcaucuucauuaa

SEQ ID NO: 2673693 - RNA, 19 nt, Escherichia coli CFT073
ugcaugggcaaauuguuca

SEQ ID NO: 2673694 - RNA, 20 nt, Escherichia coli CFT073
ugcauguaaaucaagcgccg

SEQ ID NO: 2673695 - RNA, 22 nt, Escherichia coli CFT073
ugcauuagcauagcgguaaaug

SEQ ID NO: 2673696 - RNA, 13 nt, Escherichia coli CFT073
ugcauuauugaua

SEQ ID NO: 2673697 - RNA, 22 nt, Escherichia coli CFT073
ugcauuccaguccacaucaacc

SEQ ID NO: 2673698 - RNA, 18 nt, Escherichia coli CFT073
ugcauucggcgaccagcg

SEQ ID NO: 2673699 - RNA, 18 nt, Escherichia coli CFT073
ugcauugauggaguaguu

SEQ ID NO: 2673700 - RNA, 13 nt, Escherichia coli CFT073
ugcauugucagug

SEQ ID NO: 2673701 - RNA, 22 nt, Escherichia coli CFT073
ugcauuguguaauuaauuugcu

SEQ ID NO: 2673702 - RNA, 15 nt, Escherichia coli CFT073
ugcauuucuggaaug

SEQ ID NO: 2673703 - RNA, 19 nt, Escherichia coli CFT073
ugcauuugaacuggaaaaa

SEQ ID NO: 2673704 - RNA, 18 nt, Escherichia coli CFT073
ugcauuuuucgcuuuuca

SEQ ID NO: 2673705 - RNA, 21 nt, Escherichia coli CFT073
ugccaaaccagcuaauaaaac

SEQ ID NO: 2673706 - RNA, 21 nt, Escherichia coli CFT073
ugccaaagaaugcagucagua

SEQ ID NO: 2673707 - RNA, 14 nt, Escherichia coli CFT073
ugccaaagucauca

SEQ ID NO: 2673708 - RNA, 20 nt, Escherichia coli CFT073
ugccaaagucaucaauugca

SEQ ID NO: 2673709 - RNA, 14 nt, Escherichia coli CFT073
ugccaaauauuucu

SEQ ID NO: 2673710 - RNA, 15 nt, Escherichia coli CFT073
ugccaaauauuucuu

SEQ ID NO: 2673711 - RNA, 19 nt, Escherichia coli CFT073
ugccaaauccggcaaauaa

SEQ ID NO: 2673712 - RNA, 17 nt, Escherichia coli CFT073
ugccaaauccuucacuc

SEQ ID NO: 2673713 - RNA, 22 nt, Escherichia coli CFT073
ugccaaauguauccaucaccag

SEQ ID NO: 2673714 - RNA, 14 nt, Escherichia coli CFT073
ugccaacaccacaa

SEQ ID NO: 2673715 - RNA, 23 nt, Escherichia coli CFT073
ugccaaccguaacgacggcuaua

SEQ ID NO: 2673716 - RNA, 14 nt, Escherichia coli CFT073
ugccaacgcggccc

SEQ ID NO: 2673717 - RNA, 18 nt, Escherichia coli CFT073
ugccaaguccugccagaa

SEQ ID NO: 2673718 - RNA, 18 nt, Escherichia coli CFT073
ugccaauaaugcccgcac

SEQ ID NO: 2673719 - RNA, 21 nt, Escherichia coli CFT073
ugccaaucuucacaucaucau

SEQ ID NO: 2673720 - RNA, 21 nt, Escherichia coli CFT073
ugccaauguugauaaucaccg

SEQ ID NO: 2673721 - RNA, 22 nt, Escherichia coli CFT073
ugccacaaucgggaaaaucugc

SEQ ID NO: 2673722 - RNA, 21 nt, Escherichia coli CFT073
ugccacacaggccauuucccc

SEQ ID NO: 2673723 - RNA, 19 nt, Escherichia coli CFT073
ugccacaccugccgggaau

SEQ ID NO: 2673724 - RNA, 15 nt, Escherichia coli CFT073
ugccacacgacgcca

SEQ ID NO: 2673725 - RNA, 18 nt, Escherichia coli CFT073
ugccacacgacgccagcc

SEQ ID NO: 2673726 - RNA, 18 nt, Escherichia coli CFT073
ugccacauccagcggcag

SEQ ID NO: 2673727 - RNA, 15 nt, Escherichia coli CFT073
ugccacauuucucug

SEQ ID NO: 2673728 - RNA, 13 nt, Escherichia coli CFT073
ugccaccacacca

SEQ ID NO: 2673729 - RNA, 15 nt, Escherichia coli CFT073
ugccaccacaccaga

SEQ ID NO: 2673730 - RNA, 22 nt, Escherichia coli CFT073
ugccaccacaccagaccagaca

SEQ ID NO: 2673731 - RNA, 17 nt, Escherichia coli CFT073
ugccaccaccagcguac

SEQ ID NO: 2673732 - RNA, 16 nt, Escherichia coli CFT073
ugccaccagcacaccg

SEQ ID NO: 2673733 - RNA, 19 nt, Escherichia coli CFT073
ugccaccagcauuccuaaa

SEQ ID NO: 2673734 - RNA, 15 nt, Escherichia coli CFT073
ugccaccagcgcaau

SEQ ID NO: 2673735 - RNA, 17 nt, Escherichia coli CFT073
ugccaccagguucaaca

SEQ ID NO: 2673736 - RNA, 13 nt, Escherichia coli CFT073
ugccaccagugcc

SEQ ID NO: 2673737 - RNA, 14 nt, Escherichia coli CFT073
ugccaccagugccg

SEQ ID NO: 2673738 - RNA, 17 nt, Escherichia coli CFT073
ugccaccagugccggaa

SEQ ID NO: 2673739 - RNA, 15 nt, Escherichia coli CFT073
ugccaccauccccac

SEQ ID NO: 2673740 - RNA, 19 nt, Escherichia coli CFT073
ugccaccauccccaccaaa

SEQ ID NO: 2673741 - RNA, 15 nt, Escherichia coli CFT073
ugccacccauuacac

SEQ ID NO: 2673742 - RNA, 19 nt, Escherichia coli CFT073
ugccaccgggagauccagc

SEQ ID NO: 2673743 - RNA, 16 nt, Escherichia coli CFT073
ugccacgccacgcugc

SEQ ID NO: 2673744 - RNA, 19 nt, Escherichia coli CFT073
ugccacgccacgcugccgc

SEQ ID NO: 2673745 - RNA, 15 nt, Escherichia coli CFT073
ugccacgcuggacgc

SEQ ID NO: 2673746 - RNA, 22 nt, Escherichia coli CFT073
ugccacgguaugacccagcgcg

SEQ ID NO: 2673747 - RNA, 13 nt, Escherichia coli CFT073
ugccacucaggca

SEQ ID NO: 2673748 - RNA, 13 nt, Escherichia coli CFT073
ugccacuggaugu

SEQ ID NO: 2673749 - RNA, 12 nt, Escherichia coli CFT073
ugccacuggccu

SEQ ID NO: 2673750 - RNA, 19 nt, Escherichia coli CFT073
ugccacuucuuccagcggc

SEQ ID NO: 2673751 - RNA, 14 nt, Escherichia coli CFT073
ugccagaaaccagc

SEQ ID NO: 2673752 - RNA, 18 nt, Escherichia coli CFT073
ugccagaagcagaaugaa

SEQ ID NO: 2673753 - RNA, 19 nt, Escherichia coli CFT073
ugccagaauccccacugca

SEQ ID NO: 2673754 - RNA, 14 nt, Escherichia coli CFT073
ugccagaauuaacg

SEQ ID NO: 2673755 - RNA, 23 nt, Escherichia coli CFT073
ugccagaauuaacgcugacaccc

SEQ ID NO: 2673756 - RNA, 21 nt, Escherichia coli CFT073
ugccagacaaaacugacgcca

SEQ ID NO: 2673757 - RNA, 18 nt, Escherichia coli CFT073
ugccagacaacaugagaa

SEQ ID NO: 2673758 - RNA, 19 nt, Escherichia coli CFT073
ugccagaccuuaucacaau

SEQ ID NO: 2673759 - RNA, 15 nt, Escherichia coli CFT073
ugccagagcacugca

SEQ ID NO: 2673760 - RNA, 14 nt, Escherichia coli CFT073
ugccagauagccag

SEQ ID NO: 2673761 - RNA, 22 nt, Escherichia coli CFT073
ugccagaucaaacaaccguuca

SEQ ID NO: 2673762 - RNA, 15 nt, Escherichia coli CFT073
ugccagaucggccau

SEQ ID NO: 2673763 - RNA, 17 nt, Escherichia coli CFT073
ugccagaucggccaucg

SEQ ID NO: 2673764 - RNA, 16 nt, Escherichia coli CFT073
ugccagaugcagcggu

SEQ ID NO: 2673765 - RNA, 20 nt, Escherichia coli CFT073
ugccagaugcggugcgccac

SEQ ID NO: 2673766 - RNA, 20 nt, Escherichia coli CFT073
ugccagauucuccagcaucg

SEQ ID NO: 2673767 - RNA, 16 nt, Escherichia coli CFT073
ugccagauuuucuuca

SEQ ID NO: 2673768 - RNA, 22 nt, Escherichia coli CFT073
ugccagcaaaaaauagaacuga

SEQ ID NO: 2673769 - RNA, 16 nt, Escherichia coli CFT073
ugccagcaacuggcuu

SEQ ID NO: 2673770 - RNA, 18 nt, Escherichia coli CFT073
ugccagcaacuggcuugc

SEQ ID NO: 2673771 - RNA, 21 nt, Escherichia coli CFT073
ugccagcaacuguaacgcaga

SEQ ID NO: 2673772 - RNA, 16 nt, Escherichia coli CFT073
ugccagcaccaaacug

SEQ ID NO: 2673773 - RNA, 22 nt, Escherichia coli CFT073
ugccagcaccacuuuacgggca

SEQ ID NO: 2673774 - RNA, 23 nt, Escherichia coli CFT073
ugccagcagaggaauaucuuccc

SEQ ID NO: 2673775 - RNA, 13 nt, Escherichia coli CFT073
ugccagccacacc

SEQ ID NO: 2673776 - RNA, 22 nt, Escherichia coli CFT073
ugccagccaggauaugcgccuu

SEQ ID NO: 2673777 - RNA, 17 nt, Escherichia coli CFT073
ugccagccagucagucu

SEQ ID NO: 2673778 - RNA, 15 nt, Escherichia coli CFT073
ugccagcgacagaaa

SEQ ID NO: 2673779 - RNA, 19 nt, Escherichia coli CFT073
ugccagcgccagcgcaccu

SEQ ID NO: 2673780 - RNA, 14 nt, Escherichia coli CFT073
ugccagcgccccug

SEQ ID NO: 2673781 - RNA, 18 nt, Escherichia coli CFT073
ugccagcgccccuggcgc

SEQ ID NO: 2673782 - RNA, 20 nt, Escherichia coli CFT073
ugccagcguaaauccugacg

SEQ ID NO: 2673783 - RNA, 16 nt, Escherichia coli CFT073
ugccagcguaccauga

SEQ ID NO: 2673784 - RNA, 14 nt, Escherichia coli CFT073
ugccagcgugucga

SEQ ID NO: 2673785 - RNA, 22 nt, Escherichia coli CFT073
ugccagcucuuucgacagcgau

SEQ ID NO: 2673786 - RNA, 18 nt, Escherichia coli CFT073
ugccagcuugcuuuccag

SEQ ID NO: 2673787 - RNA, 15 nt, Escherichia coli CFT073
ugccagcuuucaccu

SEQ ID NO: 2673788 - RNA, 18 nt, Escherichia coli CFT073
ugccagcuuucaccugcg

SEQ ID NO: 2673789 - RNA, 21 nt, Escherichia coli CFT073
ugccagcuuuuguugucaccc

SEQ ID NO: 2673790 - RNA, 13 nt, Escherichia coli CFT073
ugccaggaccacu

SEQ ID NO: 2673791 - RNA, 14 nt, Escherichia coli CFT073
ugccaggaccauuc

SEQ ID NO: 2673792 - RNA, 21 nt, Escherichia coli CFT073
ugccaggaccgcugaaauauc

SEQ ID NO: 2673793 - RNA, 16 nt, Escherichia coli CFT073
ugccaggcaacagaua

SEQ ID NO: 2673794 - RNA, 14 nt, Escherichia coli CFT073
ugccaggccgauag

SEQ ID NO: 2673795 - RNA, 19 nt, Escherichia coli CFT073
ugccaggcuugauccagcg

SEQ ID NO: 2673796 - RNA, 15 nt, Escherichia coli CFT073
ugccagguagcguuu

SEQ ID NO: 2673797 - RNA, 16 nt, Escherichia coli CFT073
ugccagguagcguuuc

SEQ ID NO: 2673798 - RNA, 19 nt, Escherichia coli CFT073
ugccagguagcguuucacc

SEQ ID NO: 2673799 - RNA, 20 nt, Escherichia coli CFT073
ugccaggucgugccagaaaa

SEQ ID NO: 2673800 - RNA, 18 nt, Escherichia coli CFT073
ugccaggugaucccccug

SEQ ID NO: 2673801 - RNA, 15 nt, Escherichia coli CFT073
ugccaguaaagcagc

SEQ ID NO: 2673802 - RNA, 14 nt, Escherichia coli CFT073
ugccaguaauaaag

SEQ ID NO: 2673803 - RNA, 16 nt, Escherichia coli CFT073
ugccaguaauaaagac

SEQ ID NO: 2673804 - RNA, 19 nt, Escherichia coli CFT073
ugccaguaauccggcuucc

SEQ ID NO: 2673805 - RNA, 14 nt, Escherichia coli CFT073
ugccaguaccauca

SEQ ID NO: 2673806 - RNA, 16 nt, Escherichia coli CFT073
ugccaguacgcccacg

SEQ ID NO: 2673807 - RNA, 14 nt, Escherichia coli CFT073
ugccaguacugcag

SEQ ID NO: 2673808 - RNA, 17 nt, Escherichia coli CFT073
ugccagucaaugaaauu

SEQ ID NO: 2673809 - RNA, 15 nt, Escherichia coli CFT073
ugccagucagcucca

SEQ ID NO: 2673810 - RNA, 11 nt, Escherichia coli CFT073
ugccagucagu

SEQ ID NO: 2673811 - RNA, 17 nt, Escherichia coli CFT073
ugccagucaguuaagca

SEQ ID NO: 2673812 - RNA, 18 nt, Escherichia coli CFT073
ugccagucgcacgccugg

SEQ ID NO: 2673813 - RNA, 22 nt, Escherichia coli CFT073
ugccagucggggggaggcugca

SEQ ID NO: 2673814 - RNA, 14 nt, Escherichia coli CFT073
ugccagugcaaaaa

SEQ ID NO: 2673815 - RNA, 16 nt, Escherichia coli CFT073
ugccaguggagccauc

SEQ ID NO: 2673816 - RNA, 18 nt, Escherichia coli CFT073
ugccaguuaccaccgcca

SEQ ID NO: 2673817 - RNA, 16 nt, Escherichia coli CFT073
ugccaguugcgcuuca

SEQ ID NO: 2673818 - RNA, 20 nt, Escherichia coli CFT073
ugccaguuuacccagugaau

SEQ ID NO: 2673819 - RNA, 15 nt, Escherichia coli CFT073
ugccaguuucgucag

SEQ ID NO: 2673820 - RNA, 15 nt, Escherichia coli CFT073
ugccaguuucuuuua

SEQ ID NO: 2673821 - RNA, 14 nt, Escherichia coli CFT073
ugccauaaaaguca

SEQ ID NO: 2673822 - RNA, 17 nt, Escherichia coli CFT073
ugccauauaugccaucg

SEQ ID NO: 2673823 - RNA, 12 nt, Escherichia coli CFT073
ugccauauccag

SEQ ID NO: 2673824 - RNA, 14 nt, Escherichia coli CFT073
ugccauauccagcc

SEQ ID NO: 2673825 - RNA, 20 nt, Escherichia coli CFT073
ugccaucaauaaucaccgaa

SEQ ID NO: 2673826 - RNA, 13 nt, Escherichia coli CFT073
ugccaucacaccu

SEQ ID NO: 2673827 - RNA, 14 nt, Escherichia coli CFT073
ugccaucaccaacg

SEQ ID NO: 2673828 - RNA, 18 nt, Escherichia coli CFT073
ugccaucacuauucagau

SEQ ID NO: 2673829 - RNA, 21 nt, Escherichia coli CFT073
ugccaucauggcgaugagaau

SEQ ID NO: 2673830 - RNA, 13 nt, Escherichia coli CFT073
ugccauccagcuu

SEQ ID NO: 2673831 - RNA, 14 nt, Escherichia coli CFT073
ugccauccagcuuu

SEQ ID NO: 2673832 - RNA, 22 nt, Escherichia coli CFT073
ugccauccggcucgcaucaauu

SEQ ID NO: 2673833 - RNA, 21 nt, Escherichia coli CFT073
ugccaucgacuucucgcaagc

SEQ ID NO: 2673834 - RNA, 16 nt, Escherichia coli CFT073
ugccaucgccagcagc

SEQ ID NO: 2673835 - RNA, 13 nt, Escherichia coli CFT073
ugccaucucacuu

SEQ ID NO: 2673836 - RNA, 14 nt, Escherichia coli CFT073
ugccaucucacuuu

SEQ ID NO: 2673837 - RNA, 21 nt, Escherichia coli CFT073
ugccaucucggauaaggcuuc

SEQ ID NO: 2673838 - RNA, 19 nt, Escherichia coli CFT073
ugccaucugaacucacaca

SEQ ID NO: 2673839 - RNA, 14 nt, Escherichia coli CFT073
ugccaucugccagc

SEQ ID NO: 2673840 - RNA, 15 nt, Escherichia coli CFT073
ugccaugcacgcaaa

SEQ ID NO: 2673841 - RNA, 19 nt, Escherichia coli CFT073
ugccaugccguuuaacacg

SEQ ID NO: 2673842 - RNA, 16 nt, Escherichia coli CFT073
ugccaugcugagcuuc

SEQ ID NO: 2673843 - RNA, 22 nt, Escherichia coli CFT073
ugccaugguuuggaucuguugc

SEQ ID NO: 2673844 - RNA, 15 nt, Escherichia coli CFT073
ugccauuaaaccaac

SEQ ID NO: 2673845 - RNA, 17 nt, Escherichia coli CFT073
ugccauuaaaccaacaa

SEQ ID NO: 2673846 - RNA, 16 nt, Escherichia coli CFT073
ugccauuaacaucccu

SEQ ID NO: 2673847 - RNA, 17 nt, Escherichia coli CFT073
ugccauuaacuccacca

SEQ ID NO: 2673848 - RNA, 21 nt, Escherichia coli CFT073
ugccauuacuacaaacaaugc

SEQ ID NO: 2673849 - RNA, 14 nt, Escherichia coli CFT073
ugccauuccacaaa

SEQ ID NO: 2673850 - RNA, 16 nt, Escherichia coli CFT073
ugccauuucauaaauu

SEQ ID NO: 2673851 - RNA, 19 nt, Escherichia coli CFT073
ugccauuugaugaauuuua

SEQ ID NO: 2673852 - RNA, 22 nt, Escherichia coli CFT073
ugccauuuugcaccuucagaau

SEQ ID NO: 2673853 - RNA, 13 nt, Escherichia coli CFT073
ugcccaaagccaa

SEQ ID NO: 2673854 - RNA, 17 nt, Escherichia coli CFT073
ugcccaaucgagccacg

SEQ ID NO: 2673855 - RNA, 23 nt, Escherichia coli CFT073
ugcccacaaucuuaggggacauu

SEQ ID NO: 2673856 - RNA, 16 nt, Escherichia coli CFT073
ugcccaccagccgcau

SEQ ID NO: 2673857 - RNA, 16 nt, Escherichia coli CFT073
ugcccaccgcauccag

SEQ ID NO: 2673858 - RNA, 21 nt, Escherichia coli CFT073
ugcccagaaucgccaacgccu

SEQ ID NO: 2673859 - RNA, 21 nt, Escherichia coli CFT073
ugcccagcguuccggcgucca

SEQ ID NO: 2673860 - RNA, 22 nt, Escherichia coli CFT073
ugcccagcucaaucaacuccau

SEQ ID NO: 2673861 - RNA, 14 nt, Escherichia coli CFT073
ugcccaggcaaaaa

SEQ ID NO: 2673862 - RNA, 18 nt, Escherichia coli CFT073
ugcccaggguaagaugaa

SEQ ID NO: 2673863 - RNA, 15 nt, Escherichia coli CFT073
ugcccauacccggua

SEQ ID NO: 2673864 - RNA, 19 nt, Escherichia coli CFT073
ugcccaucaggccaggcgu

SEQ ID NO: 2673865 - RNA, 13 nt, Escherichia coli CFT073
ugcccaugccaau

SEQ ID NO: 2673866 - RNA, 13 nt, Escherichia coli CFT073
ugcccauucccca

SEQ ID NO: 2673867 - RNA, 16 nt, Escherichia coli CFT073
ugccccagacacaguu

SEQ ID NO: 2673868 - RNA, 19 nt, Escherichia coli CFT073
ugccccagcguuagcaucg

SEQ ID NO: 2673869 - RNA, 14 nt, Escherichia coli CFT073
ugccccauauggcc

SEQ ID NO: 2673870 - RNA, 18 nt, Escherichia coli CFT073
ugccccauugcugaugca

SEQ ID NO: 2673871 - RNA, 12 nt, Escherichia coli CFT073
ugcccccagucg

SEQ ID NO: 2673872 - RNA, 15 nt, Escherichia coli CFT073
ugccccuccgcacag

SEQ ID NO: 2673873 - RNA, 12 nt, Escherichia coli CFT073
ugccccuggcug

SEQ ID NO: 2673874 - RNA, 16 nt, Escherichia coli CFT073
ugcccgaccacuucau

SEQ ID NO: 2673875 - RNA, 19 nt, Escherichia coli CFT073
ugcccgaccagauaagaac

SEQ ID NO: 2673876 - RNA, 19 nt, Escherichia coli CFT073
ugcccgcaacggcugcuuc

SEQ ID NO: 2673877 - RNA, 14 nt, Escherichia coli CFT073
ugcccgcaccaccg

SEQ ID NO: 2673878 - RNA, 13 nt, Escherichia coli CFT073
ugcccgcaucugc

SEQ ID NO: 2673879 - RNA, 20 nt, Escherichia coli CFT073
ugcccgccagugcaucagcu

SEQ ID NO: 2673880 - RNA, 12 nt, Escherichia coli CFT073
ugcccgcccgac

SEQ ID NO: 2673881 - RNA, 15 nt, Escherichia coli CFT073
ugcccgccgaccauc

SEQ ID NO: 2673882 - RNA, 16 nt, Escherichia coli CFT073
ugcccgcugccaggau

SEQ ID NO: 2673883 - RNA, 23 nt, Escherichia coli CFT073
ugcccggcacguuuuggcaggca

SEQ ID NO: 2673884 - RNA, 17 nt, Escherichia coli CFT073
ugcccgggucagcgcca

SEQ ID NO: 2673885 - RNA, 19 nt, Escherichia coli CFT073
ugcccggugccgcguuuug

SEQ ID NO: 2673886 - RNA, 14 nt, Escherichia coli CFT073
ugcccgugaugcaa

SEQ ID NO: 2673887 - RNA, 15 nt, Escherichia coli CFT073
ugcccguuucucuua

SEQ ID NO: 2673888 - RNA, 17 nt, Escherichia coli CFT073
ugcccucaauaucuuuc

SEQ ID NO: 2673889 - RNA, 16 nt, Escherichia coli CFT073
ugcccugaucacccac

SEQ ID NO: 2673890 - RNA, 22 nt, Escherichia coli CFT073
ugcccugccaucacuauucaga

SEQ ID NO: 2673891 - RNA, 17 nt, Escherichia coli CFT073
ugcccugcccgcugcca

SEQ ID NO: 2673892 - RNA, 23 nt, Escherichia coli CFT073
ugcccuggaucguggcugaguga

SEQ ID NO: 2673893 - RNA, 22 nt, Escherichia coli CFT073
ugcccuguuugucgaucaucag

SEQ ID NO: 2673894 - RNA, 22 nt, Escherichia coli CFT073
ugcccuuccauacgaauugccg

SEQ ID NO: 2673895 - RNA, 15 nt, Escherichia coli CFT073
ugcccuuuuaauaca

SEQ ID NO: 2673896 - RNA, 20 nt, Escherichia coli CFT073
ugcccuuuuaauacaaucug

SEQ ID NO: 2673897 - RNA, 14 nt, Escherichia coli CFT073
ugccgaaccacuga

SEQ ID NO: 2673898 - RNA, 23 nt, Escherichia coli CFT073
ugccgaagaguuuuaaacgcagu

SEQ ID NO: 2673899 - RNA, 23 nt, Escherichia coli CFT073
ugccgaauggcugcacuuucagu

SEQ ID NO: 2673900 - RNA, 16 nt, Escherichia coli CFT073
ugccgacaucaaacag

SEQ ID NO: 2673901 - RNA, 17 nt, Escherichia coli CFT073
ugccgaccaucuguucu

SEQ ID NO: 2673902 - RNA, 13 nt, Escherichia coli CFT073
ugccgacgguuug

SEQ ID NO: 2673903 - RNA, 16 nt, Escherichia coli CFT073
ugccgaucucuuuauu

SEQ ID NO: 2673904 - RNA, 23 nt, Escherichia coli CFT073
ugccgaugauucccagucaggca

SEQ ID NO: 2673905 - RNA, 13 nt, Escherichia coli CFT073
ugccgcaauggcc

SEQ ID NO: 2673906 - RNA, 15 nt, Escherichia coli CFT073
ugccgcacauuuccc

SEQ ID NO: 2673907 - RNA, 15 nt, Escherichia coli CFT073
ugccgcacucugacc

SEQ ID NO: 2673908 - RNA, 18 nt, Escherichia coli CFT073
ugccgcacuuaaaaugcg

SEQ ID NO: 2673909 - RNA, 22 nt, Escherichia coli CFT073
ugccgcacuuaaaaugcgcuca

SEQ ID NO: 2673910 - RNA, 22 nt, Escherichia coli CFT073
ugccgcacuuacagcaacgccu

SEQ ID NO: 2673911 - RNA, 21 nt, Escherichia coli CFT073
ugccgcagacaaaauccugcc

SEQ ID NO: 2673912 - RNA, 18 nt, Escherichia coli CFT073
ugccgcaucagugaucag

SEQ ID NO: 2673913 - RNA, 20 nt, Escherichia coli CFT073
ugccgcauggaaccaguuca

SEQ ID NO: 2673914 - RNA, 15 nt, Escherichia coli CFT073
ugccgccacagcguu

SEQ ID NO: 2673915 - RNA, 14 nt, Escherichia coli CFT073
ugccgccaccacca

SEQ ID NO: 2673916 - RNA, 17 nt, Escherichia coli CFT073
ugccgccaccaccagcg

SEQ ID NO: 2673917 - RNA, 16 nt, Escherichia coli CFT073
ugccgccagcauuguc

SEQ ID NO: 2673918 - RNA, 15 nt, Escherichia coli CFT073
ugccgccaguucgau

SEQ ID NO: 2673919 - RNA, 15 nt, Escherichia coli CFT073
ugccgccaucaccag

SEQ ID NO: 2673920 - RNA, 17 nt, Escherichia coli CFT073
ugccgccccaaagggcg

SEQ ID NO: 2673921 - RNA, 22 nt, Escherichia coli CFT073
ugccgccgcacgauaaauacuc

SEQ ID NO: 2673922 - RNA, 13 nt, Escherichia coli CFT073
ugccgccucugcc

SEQ ID NO: 2673923 - RNA, 16 nt, Escherichia coli CFT073
ugccgccucugccgca

SEQ ID NO: 2673924 - RNA, 14 nt, Escherichia coli CFT073
ugccgccuggugca

SEQ ID NO: 2673925 - RNA, 14 nt, Escherichia coli CFT073
ugccgcgcagcgaa

SEQ ID NO: 2673926 - RNA, 22 nt, Escherichia coli CFT073
ugccgcgcagcgaaacucgcug

SEQ ID NO: 2673927 - RNA, 22 nt, Escherichia coli CFT073
ugccgcgcauagcaccaccgac

SEQ ID NO: 2673928 - RNA, 20 nt, Escherichia coli CFT073
ugccgcgccagaucagggaa

SEQ ID NO: 2673929 - RNA, 16 nt, Escherichia coli CFT073
ugccgcgcuguucguu

SEQ ID NO: 2673930 - RNA, 14 nt, Escherichia coli CFT073
ugccgcgucuuauc

SEQ ID NO: 2673931 - RNA, 14 nt, Escherichia coli CFT073
ugccgcguucgcca

SEQ ID NO: 2673932 - RNA, 19 nt, Escherichia coli CFT073
ugccgcguucgccagcguc

SEQ ID NO: 2673933 - RNA, 14 nt, Escherichia coli CFT073
ugccgcuacaucac

SEQ ID NO: 2673934 - RNA, 12 nt, Escherichia coli CFT073
ugccgcuaucag

SEQ ID NO: 2673935 - RNA, 18 nt, Escherichia coli CFT073
ugccgcuccagauauugc

SEQ ID NO: 2673936 - RNA, 15 nt, Escherichia coli CFT073
ugccgcucccggcau

SEQ ID NO: 2673937 - RNA, 19 nt, Escherichia coli CFT073
ugccgcucccggcauaaca

SEQ ID NO: 2673938 - RNA, 22 nt, Escherichia coli CFT073
ugccgcuggcaucgagcauaaa

SEQ ID NO: 2673939 - RNA, 20 nt, Escherichia coli CFT073
ugccgcuguucugauuuuga

SEQ ID NO: 2673940 - RNA, 22 nt, Escherichia coli CFT073
ugccgcuguucugauuuugaau

SEQ ID NO: 2673941 - RNA, 12 nt, Escherichia coli CFT073
ugccgcuguugc

SEQ ID NO: 2673942 - RNA, 14 nt, Escherichia coli CFT073
ugccgcuucccgca

SEQ ID NO: 2673943 - RNA, 17 nt, Escherichia coli CFT073
ugccgcuuuaugugcuu

SEQ ID NO: 2673944 - RNA, 19 nt, Escherichia coli CFT073
ugccgcuuuuaugugcaau

SEQ ID NO: 2673945 - RNA, 17 nt, Escherichia coli CFT073
ugccggaacgccgcugg

SEQ ID NO: 2673946 - RNA, 20 nt, Escherichia coli CFT073
ugccggaacgccgcuggugg

SEQ ID NO: 2673947 - RNA, 18 nt, Escherichia coli CFT073
ugccggaagacacauugu

SEQ ID NO: 2673948 - RNA, 13 nt, Escherichia coli CFT073
ugccggaauaauc

SEQ ID NO: 2673949 - RNA, 19 nt, Escherichia coli CFT073
ugccggaccaucuuccagc

SEQ ID NO: 2673950 - RNA, 20 nt, Escherichia coli CFT073
ugccggacgucaggccgcca

SEQ ID NO: 2673951 - RNA, 21 nt, Escherichia coli CFT073
ugccggagauucaaagacuuc

SEQ ID NO: 2673952 - RNA, 21 nt, Escherichia coli CFT073
ugccggauaaauuaaacgccu

SEQ ID NO: 2673953 - RNA, 18 nt, Escherichia coli CFT073
ugccggauacgcuuuauc

SEQ ID NO: 2673954 - RNA, 20 nt, Escherichia coli CFT073
ugccggaucuuucaggaaca

SEQ ID NO: 2673955 - RNA, 22 nt, Escherichia coli CFT073
ugccggaugcgacgcuggccgc

SEQ ID NO: 2673956 - RNA, 15 nt, Escherichia coli CFT073
ugccggaugcggcgu

SEQ ID NO: 2673957 - RNA, 23 nt, Escherichia coli CFT073
ugccggaugcggcgugaacgccu

SEQ ID NO: 2673958 - RNA, 22 nt, Escherichia coli CFT073
ugccggaugcggcgugauaaaa

SEQ ID NO: 2673959 - RNA, 16 nt, Escherichia coli CFT073
ugccggauggcacgca

SEQ ID NO: 2673960 - RNA, 18 nt, Escherichia coli CFT073
ugccggauggcacgcauc

SEQ ID NO: 2673961 - RNA, 23 nt, Escherichia coli CFT073
ugccggauggcguuuaaucgccu

SEQ ID NO: 2673962 - RNA, 20 nt, Escherichia coli CFT073
ugccggaugguaugccaucc

SEQ ID NO: 2673963 - RNA, 17 nt, Escherichia coli CFT073
ugccggaugugaugcau

SEQ ID NO: 2673964 - RNA, 23 nt, Escherichia coli CFT073
ugccggauguggcguaaacgccu

SEQ ID NO: 2673965 - RNA, 16 nt, Escherichia coli CFT073
ugccggccagcgccac

SEQ ID NO: 2673966 - RNA, 21 nt, Escherichia coli CFT073
ugccggggagauauuccccag

SEQ ID NO: 2673967 - RNA, 13 nt, Escherichia coli CFT073
ugccgggggcgac

SEQ ID NO: 2673968 - RNA, 16 nt, Escherichia coli CFT073
ugccgguaaagcaaug

SEQ ID NO: 2673969 - RNA, 19 nt, Escherichia coli CFT073
ugccgguaucacucgugau

SEQ ID NO: 2673970 - RNA, 21 nt, Escherichia coli CFT073
ugccggucuuguuaccggcau

SEQ ID NO: 2673971 - RNA, 16 nt, Escherichia coli CFT073
ugccggugagauggug

SEQ ID NO: 2673972 - RNA, 22 nt, Escherichia coli CFT073
ugccggugauggccgcgccgac

SEQ ID NO: 2673973 - RNA, 16 nt, Escherichia coli CFT073
ugccggugggaugaag

SEQ ID NO: 2673974 - RNA, 13 nt, Escherichia coli CFT073
ugccgguuauuuu

SEQ ID NO: 2673975 - RNA, 13 nt, Escherichia coli CFT073
ugccgguuccagc

SEQ ID NO: 2673976 - RNA, 15 nt, Escherichia coli CFT073
ugccguaaccagcgc

SEQ ID NO: 2673977 - RNA, 23 nt, Escherichia coli CFT073
ugccguaaccagcgcagacacca

SEQ ID NO: 2673978 - RNA, 16 nt, Escherichia coli CFT073
ugccguaagcaacgcc

SEQ ID NO: 2673979 - RNA, 16 nt, Escherichia coli CFT073
ugccguacucuucaau

SEQ ID NO: 2673980 - RNA, 18 nt, Escherichia coli CFT073
ugccguaggcccagccgu

SEQ ID NO: 2673981 - RNA, 19 nt, Escherichia coli CFT073
ugccguaggcccagccgug

SEQ ID NO: 2673982 - RNA, 16 nt, Escherichia coli CFT073
ugccgucaauccagcc

SEQ ID NO: 2673983 - RNA, 22 nt, Escherichia coli CFT073
ugccgucaaucggaucgauauc

SEQ ID NO: 2673984 - RNA, 15 nt, Escherichia coli CFT073
ugccgucaccagcau

SEQ ID NO: 2673985 - RNA, 17 nt, Escherichia coli CFT073
ugccgucagggccugcg

SEQ ID NO: 2673986 - RNA, 15 nt, Escherichia coli CFT073
ugccguccagcgccu

SEQ ID NO: 2673987 - RNA, 22 nt, Escherichia coli CFT073
ugccgucgggauucaguuucug

SEQ ID NO: 2673988 - RNA, 17 nt, Escherichia coli CFT073
ugccgucuaccaguaaa

SEQ ID NO: 2673989 - RNA, 14 nt, Escherichia coli CFT073
ugccgucugccacu

SEQ ID NO: 2673990 - RNA, 19 nt, Escherichia coli CFT073
ugccgucugccacuucuuc

SEQ ID NO: 2673991 - RNA, 19 nt, Escherichia coli CFT073
ugccgucugccccgccgcc

SEQ ID NO: 2673992 - RNA, 17 nt, Escherichia coli CFT073
ugccgucugggcaaaau

SEQ ID NO: 2673993 - RNA, 23 nt, Escherichia coli CFT073
ugccgucugggcaaaaucaucac

SEQ ID NO: 2673994 - RNA, 19 nt, Escherichia coli CFT073
ugccguuccuggcaccauc

SEQ ID NO: 2673995 - RNA, 21 nt, Escherichia coli CFT073
ugccguuuguaggccugauaa

SEQ ID NO: 2673996 - RNA, 21 nt, Escherichia coli CFT073
ugccuaaagugcugggcuggg

SEQ ID NO: 2673997 - RNA, 22 nt, Escherichia coli CFT073
ugccuacacaaugccugaugcg

SEQ ID NO: 2673998 - RNA, 16 nt, Escherichia coli CFT073
ugccuaccgccugcau

SEQ ID NO: 2673999 - RNA, 22 nt, Escherichia coli CFT073
ugccucaugcgcugcgcuuauc

SEQ ID NO: 2674000 - RNA, 14 nt, Escherichia coli CFT073
ugccucccugcaaa

SEQ ID NO: 2674001 - RNA, 15 nt, Escherichia coli CFT073
ugccucgcugauacg

SEQ ID NO: 2674002 - RNA, 19 nt, Escherichia coli CFT073
ugccucgggauccaugcac

SEQ ID NO: 2674003 - RNA, 21 nt, Escherichia coli CFT073
ugccucgucccuuugccugcc

SEQ ID NO: 2674004 - RNA, 17 nt, Escherichia coli CFT073
ugccucguuggucagcu

SEQ ID NO: 2674005 - RNA, 21 nt, Escherichia coli CFT073
ugccucuccccagcggaaaau

SEQ ID NO: 2674006 - RNA, 17 nt, Escherichia coli CFT073
ugccucugcgcccagca

SEQ ID NO: 2674007 - RNA, 20 nt, Escherichia coli CFT073
ugccucuuugccgcuuuuau

SEQ ID NO: 2674008 - RNA, 12 nt, Escherichia coli CFT073
ugccugaaaaau

SEQ ID NO: 2674009 - RNA, 13 nt, Escherichia coli CFT073
ugccugaaaaaug

SEQ ID NO: 2674010 - RNA, 21 nt, Escherichia coli CFT073
ugccugacagaccacucucug

SEQ ID NO: 2674011 - RNA, 22 nt, Escherichia coli CFT073
ugccugacagaccacucucugg

SEQ ID NO: 2674012 - RNA, 17 nt, Escherichia coli CFT073
ugccugaucaaagaccg

SEQ ID NO: 2674013 - RNA, 14 nt, Escherichia coli CFT073
ugccugauccugag

SEQ ID NO: 2674014 - RNA, 18 nt, Escherichia coli CFT073
ugccugaugcgcuucgcu

SEQ ID NO: 2674015 - RNA, 13 nt, Escherichia coli CFT073
ugccugauucagc

SEQ ID NO: 2674016 - RNA, 23 nt, Escherichia coli CFT073
ugccugauuguuuguagccgcca

SEQ ID NO: 2674017 - RNA, 15 nt, Escherichia coli CFT073
ugccugcaaugccgu

SEQ ID NO: 2674018 - RNA, 16 nt, Escherichia coli CFT073
ugccugcacugguggc

SEQ ID NO: 2674019 - RNA, 17 nt, Escherichia coli CFT073
ugccugcacuuuguguc

SEQ ID NO: 2674020 - RNA, 18 nt, Escherichia coli CFT073
ugccugcacuuuguguca

SEQ ID NO: 2674021 - RNA, 13 nt, Escherichia coli CFT073
ugccugcagcugc

SEQ ID NO: 2674022 - RNA, 21 nt, Escherichia coli CFT073
ugccugcagcugcucauuaca

SEQ ID NO: 2674023 - RNA, 22 nt, Escherichia coli CFT073
ugccugcaggaaaucaaugcca

SEQ ID NO: 2674024 - RNA, 13 nt, Escherichia coli CFT073
ugccugccaugcc

SEQ ID NO: 2674025 - RNA, 13 nt, Escherichia coli CFT073
ugccugcccagcc

SEQ ID NO: 2674026 - RNA, 17 nt, Escherichia coli CFT073
ugccugccgccuuuugc

SEQ ID NO: 2674027 - RNA, 21 nt, Escherichia coli CFT073
ugccugcgugcauaucgcugu

SEQ ID NO: 2674028 - RNA, 15 nt, Escherichia coli CFT073
ugccugcuaccggga

SEQ ID NO: 2674029 - RNA, 16 nt, Escherichia coli CFT073
ugccugcugugccagc

SEQ ID NO: 2674030 - RNA, 22 nt, Escherichia coli CFT073
ugccuggauaaggccaccagcg

SEQ ID NO: 2674031 - RNA, 17 nt, Escherichia coli CFT073
ugccuggcaguucccua

SEQ ID NO: 2674032 - RNA, 14 nt, Escherichia coli CFT073
ugccuggcauaacg

SEQ ID NO: 2674033 - RNA, 20 nt, Escherichia coli CFT073
ugccuggguuuucacagaag

SEQ ID NO: 2674034 - RNA, 16 nt, Escherichia coli CFT073
ugccuguccucuucag

SEQ ID NO: 2674035 - RNA, 21 nt, Escherichia coli CFT073
ugccugugcgauuuccuucag

SEQ ID NO: 2674036 - RNA, 17 nt, Escherichia coli CFT073
ugccuguucaaccucaa

SEQ ID NO: 2674037 - RNA, 12 nt, Escherichia coli CFT073
ugccuguuucau

SEQ ID NO: 2674038 - RNA, 20 nt, Escherichia coli CFT073
ugccuuaaacuccauaccac

SEQ ID NO: 2674039 - RNA, 21 nt, Escherichia coli CFT073
ugccuucacaggccgccaggc

SEQ ID NO: 2674040 - RNA, 14 nt, Escherichia coli CFT073
ugccuucauacugc

SEQ ID NO: 2674041 - RNA, 14 nt, Escherichia coli CFT073
ugccuuccaucccu

SEQ ID NO: 2674042 - RNA, 13 nt, Escherichia coli CFT073
ugccuucccuucu

SEQ ID NO: 2674043 - RNA, 16 nt, Escherichia coli CFT073
ugccuucccuucucuu

SEQ ID NO: 2674044 - RNA, 14 nt, Escherichia coli CFT073
ugccuuccuccggc

SEQ ID NO: 2674045 - RNA, 12 nt, Escherichia coli CFT073
ugccuuuauuca

SEQ ID NO: 2674046 - RNA, 12 nt, Escherichia coli CFT073
ugccuuucuuug

SEQ ID NO: 2674047 - RNA, 14 nt, Escherichia coli CFT073
ugccuuugaaaucg

SEQ ID NO: 2674048 - RNA, 14 nt, Escherichia coli CFT073
ugccuuuuccagcg

SEQ ID NO: 2674049 - RNA, 19 nt, Escherichia coli CFT073
ugcgaaaaaaauuacucau

SEQ ID NO: 2674050 - RNA, 13 nt, Escherichia coli CFT073
ugcgaaaaauaaa

SEQ ID NO: 2674051 - RNA, 13 nt, Escherichia coli CFT073
ugcgaaacuucuu

SEQ ID NO: 2674052 - RNA, 16 nt, Escherichia coli CFT073
ugcgaaagcgagcagu

SEQ ID NO: 2674053 - RNA, 21 nt, Escherichia coli CFT073
ugcgaagacgaguagaagcga

SEQ ID NO: 2674054 - RNA, 17 nt, Escherichia coli CFT073
ugcgaagcuuugcacuc

SEQ ID NO: 2674055 - RNA, 17 nt, Escherichia coli CFT073
ugcgaaguuuuuccgcc

SEQ ID NO: 2674056 - RNA, 20 nt, Escherichia coli CFT073
ugcgaauaagaauaugaaca

SEQ ID NO: 2674057 - RNA, 16 nt, Escherichia coli CFT073
ugcgaauaaugguauc

SEQ ID NO: 2674058 - RNA, 18 nt, Escherichia coli CFT073
ugcgaaucuaaaucaggu

SEQ ID NO: 2674059 - RNA, 13 nt, Escherichia coli CFT073
ugcgaaugccaau

SEQ ID NO: 2674060 - RNA, 15 nt, Escherichia coli CFT073
ugcgaauuuccugcc

SEQ ID NO: 2674061 - RNA, 13 nt, Escherichia coli CFT073
ugcgacaaaccag

SEQ ID NO: 2674062 - RNA, 15 nt, Escherichia coli CFT073
ugcgacaaacuucca

SEQ ID NO: 2674063 - RNA, 17 nt, Escherichia coli CFT073
ugcgacaaacuuccaga

SEQ ID NO: 2674064 - RNA, 21 nt, Escherichia coli CFT073
ugcgacaccagcauguuccau

SEQ ID NO: 2674065 - RNA, 22 nt, Escherichia coli CFT073
ugcgacagagauauucagcccg

SEQ ID NO: 2674066 - RNA, 22 nt, Escherichia coli CFT073
ugcgacagccauccccacgguc

SEQ ID NO: 2674067 - RNA, 18 nt, Escherichia coli CFT073
ugcgacauagcaaccgga

SEQ ID NO: 2674068 - RNA, 21 nt, Escherichia coli CFT073
ugcgacaugcgaucccaugcc

SEQ ID NO: 2674069 - RNA, 14 nt, Escherichia coli CFT073
ugcgaccaaacugc

SEQ ID NO: 2674070 - RNA, 21 nt, Escherichia coli CFT073
ugcgaccagcgucguauccag

SEQ ID NO: 2674071 - RNA, 15 nt, Escherichia coli CFT073
ugcgaccagugaaaa

SEQ ID NO: 2674072 - RNA, 18 nt, Escherichia coli CFT073
ugcgaccagugaaaaugg

SEQ ID NO: 2674073 - RNA, 22 nt, Escherichia coli CFT073
ugcgaccguacaaccaaaucug

SEQ ID NO: 2674074 - RNA, 16 nt, Escherichia coli CFT073
ugcgaccuacacaccu

SEQ ID NO: 2674075 - RNA, 16 nt, Escherichia coli CFT073
ugcgacgcauccggca

SEQ ID NO: 2674076 - RNA, 21 nt, Escherichia coli CFT073
ugcgacgcgacauccagccgu

SEQ ID NO: 2674077 - RNA, 15 nt, Escherichia coli CFT073
ugcgacgcgggccgc

SEQ ID NO: 2674078 - RNA, 15 nt, Escherichia coli CFT073
ugcgacgcuugccgc

SEQ ID NO: 2674079 - RNA, 16 nt, Escherichia coli CFT073
ugcgacgcuugccgcg

SEQ ID NO: 2674080 - RNA, 17 nt, Escherichia coli CFT073
ugcgacgucugaucggc

SEQ ID NO: 2674081 - RNA, 22 nt, Escherichia coli CFT073
ugcgacgugcccuuucaguggg

SEQ ID NO: 2674082 - RNA, 19 nt, Escherichia coli CFT073
ugcgacguuacaaccacau

SEQ ID NO: 2674083 - RNA, 15 nt, Escherichia coli CFT073
ugcgacuucauucag

SEQ ID NO: 2674084 - RNA, 20 nt, Escherichia coli CFT073
ugcgacuugucaucauacug

SEQ ID NO: 2674085 - RNA, 17 nt, Escherichia coli CFT073
ugcgagaugaccgacag

SEQ ID NO: 2674086 - RNA, 23 nt, Escherichia coli CFT073
ugcgagcucaauauauuaaaaga

SEQ ID NO: 2674087 - RNA, 14 nt, Escherichia coli CFT073
ugcgagcuuucgac

SEQ ID NO: 2674088 - RNA, 15 nt, Escherichia coli CFT073
ugcgagucaggccag

SEQ ID NO: 2674089 - RNA, 15 nt, Escherichia coli CFT073
ugcgaguccgcuucc

SEQ ID NO: 2674090 - RNA, 14 nt, Escherichia coli CFT073
ugcgauauggcugc

SEQ ID NO: 2674091 - RNA, 12 nt, Escherichia coli CFT073
ugcgauccacgc

SEQ ID NO: 2674092 - RNA, 20 nt, Escherichia coli CFT073
ugcgauccacgccauccccu

SEQ ID NO: 2674093 - RNA, 12 nt, Escherichia coli CFT073
ugcgaugaucgc

SEQ ID NO: 2674094 - RNA, 17 nt, Escherichia coli CFT073
ugcgaugcugacgcauc

SEQ ID NO: 2674095 - RNA, 16 nt, Escherichia coli CFT073
ugcgauguucccccag

SEQ ID NO: 2674096 - RNA, 21 nt, Escherichia coli CFT073
ugcgauuguaauuucacgcuu

SEQ ID NO: 2674097 - RNA, 17 nt, Escherichia coli CFT073
ugcgauuuccuucagca

SEQ ID NO: 2674098 - RNA, 13 nt, Escherichia coli CFT073
ugcgcaacuuuuu

SEQ ID NO: 2674099 - RNA, 21 nt, Escherichia coli CFT073
ugcgcaacuuuuucuugcuca

SEQ ID NO: 2674100 - RNA, 19 nt, Escherichia coli CFT073
ugcgcacaagcuaccagcc

SEQ ID NO: 2674101 - RNA, 22 nt, Escherichia coli CFT073
ugcgcacgaguuucuaucccuu

SEQ ID NO: 2674102 - RNA, 20 nt, Escherichia coli CFT073
ugcgcacgcguaauauccag

SEQ ID NO: 2674103 - RNA, 18 nt, Escherichia coli CFT073
ugcgcagaguuuccaggc

SEQ ID NO: 2674104 - RNA, 20 nt, Escherichia coli CFT073
ugcgcagaguuuccaggcug

SEQ ID NO: 2674105 - RNA, 16 nt, Escherichia coli CFT073
ugcgcagcaucggcgc

SEQ ID NO: 2674106 - RNA, 24 nt, Escherichia coli CFT073
ugcgcagccaguuaaccugcgccu

SEQ ID NO: 2674107 - RNA, 19 nt, Escherichia coli CFT073
ugcgcagcggaggcgauaa

SEQ ID NO: 2674108 - RNA, 19 nt, Escherichia coli CFT073
ugcgcagcggugagccagg

SEQ ID NO: 2674109 - RNA, 20 nt, Escherichia coli CFT073
ugcgcaggcaagccuugcag

SEQ ID NO: 2674110 - RNA, 12 nt, Escherichia coli CFT073
ugcgcaguacca

SEQ ID NO: 2674111 - RNA, 18 nt, Escherichia coli CFT073
ugcgcauggaagcgcagg

SEQ ID NO: 2674112 - RNA, 22 nt, Escherichia coli CFT073
ugcgcauguuuagucgccacaa

SEQ ID NO: 2674113 - RNA, 17 nt, Escherichia coli CFT073
ugcgcauucuacuuugc

SEQ ID NO: 2674114 - RNA, 20 nt, Escherichia coli CFT073
ugcgcauuucccagcaagaa

SEQ ID NO: 2674115 - RNA, 16 nt, Escherichia coli CFT073
ugcgccaacaucaaug

SEQ ID NO: 2674116 - RNA, 12 nt, Escherichia coli CFT073
ugcgccaauacc

SEQ ID NO: 2674117 - RNA, 12 nt, Escherichia coli CFT073
ugcgccacaucc

SEQ ID NO: 2674118 - RNA, 20 nt, Escherichia coli CFT073
ugcgccaccguuucugccgu

SEQ ID NO: 2674119 - RNA, 19 nt, Escherichia coli CFT073
ugcgccacuccacugcgca

SEQ ID NO: 2674120 - RNA, 22 nt, Escherichia coli CFT073
ugcgccagacgugcacgcagca

SEQ ID NO: 2674121 - RNA, 20 nt, Escherichia coli CFT073
ugcgccagagcccguuaccc

SEQ ID NO: 2674122 - RNA, 23 nt, Escherichia coli CFT073
ugcgccagagcccguuacccugg

SEQ ID NO: 2674123 - RNA, 16 nt, Escherichia coli CFT073
ugcgccagcaaaucag

SEQ ID NO: 2674124 - RNA, 23 nt, Escherichia coli CFT073
ugcgccagcaaaucagccauugc

SEQ ID NO: 2674125 - RNA, 17 nt, Escherichia coli CFT073
ugcgccagcgagaaaua

SEQ ID NO: 2674126 - RNA, 19 nt, Escherichia coli CFT073
ugcgccauaaccgccagca

SEQ ID NO: 2674127 - RNA, 20 nt, Escherichia coli CFT073
ugcgccauaaccgccagcac

SEQ ID NO: 2674128 - RNA, 21 nt, Escherichia coli CFT073
ugcgccauuuuuuugccugcu

SEQ ID NO: 2674129 - RNA, 12 nt, Escherichia coli CFT073
ugcgcccaggaa

SEQ ID NO: 2674130 - RNA, 22 nt, Escherichia coli CFT073
ugcgcccaguagugcgcagaac

SEQ ID NO: 2674131 - RNA, 11 nt, Escherichia coli CFT073
ugcgcccaguu

SEQ ID NO: 2674132 - RNA, 15 nt, Escherichia coli CFT073
ugcgcccaucaucau

SEQ ID NO: 2674133 - RNA, 11 nt, Escherichia coli CFT073
ugcgcccgccc

SEQ ID NO: 2674134 - RNA, 20 nt, Escherichia coli CFT073
ugcgcccgcuuuucgccagu

SEQ ID NO: 2674135 - RNA, 16 nt, Escherichia coli CFT073
ugcgcccuggcccauu

SEQ ID NO: 2674136 - RNA, 21 nt, Escherichia coli CFT073
ugcgcccugggcuucauccag

SEQ ID NO: 2674137 - RNA, 14 nt, Escherichia coli CFT073
ugcgcccuguucug

SEQ ID NO: 2674138 - RNA, 18 nt, Escherichia coli CFT073
ugcgccgaacaacagugc

SEQ ID NO: 2674139 - RNA, 17 nt, Escherichia coli CFT073
ugcgccgauugccugau

SEQ ID NO: 2674140 - RNA, 16 nt, Escherichia coli CFT073
ugcgccgcauucaggg

SEQ ID NO: 2674141 - RNA, 15 nt, Escherichia coli CFT073
ugcgccgccgcccau

SEQ ID NO: 2674142 - RNA, 20 nt, Escherichia coli CFT073
ugcgccgucagaguggcgua

SEQ ID NO: 2674143 - RNA, 21 nt, Escherichia coli CFT073
ugcgccuauaaggcucucuua

SEQ ID NO: 2674144 - RNA, 23 nt, Escherichia coli CFT073
ugcgccucuccacacggagaggc

SEQ ID NO: 2674145 - RNA, 18 nt, Escherichia coli CFT073
ugcgccugcgucuaucag

SEQ ID NO: 2674146 - RNA, 19 nt, Escherichia coli CFT073
ugcgccuguguuuuuacgc

SEQ ID NO: 2674147 - RNA, 14 nt, Escherichia coli CFT073
ugcgccuuccccgu

SEQ ID NO: 2674148 - RNA, 18 nt, Escherichia coli CFT073
ugcgccuuugaugccacc

SEQ ID NO: 2674149 - RNA, 20 nt, Escherichia coli CFT073
ugcgccuuuuuucgccgcag

SEQ ID NO: 2674150 - RNA, 16 nt, Escherichia coli CFT073
ugcgcgaaccagagac

SEQ ID NO: 2674151 - RNA, 18 nt, Escherichia coli CFT073
ugcgcgaagaaacgaccu

SEQ ID NO: 2674152 - RNA, 21 nt, Escherichia coli CFT073
ugcgcgaccaacugcaaggcc

SEQ ID NO: 2674153 - RNA, 21 nt, Escherichia coli CFT073
ugcgcgacggcggucaaguaa

SEQ ID NO: 2674154 - RNA, 17 nt, Escherichia coli CFT073
ugcgcgacucccugacu

SEQ ID NO: 2674155 - RNA, 19 nt, Escherichia coli CFT073
ugcgcgauaaucucaucag

SEQ ID NO: 2674156 - RNA, 16 nt, Escherichia coli CFT073
ugcgcgccgugaacgu

SEQ ID NO: 2674157 - RNA, 15 nt, Escherichia coli CFT073
ugcgcgcgaaaacau

SEQ ID NO: 2674158 - RNA, 22 nt, Escherichia coli CFT073
ugcgcgcgaaaacaucguugau

SEQ ID NO: 2674159 - RNA, 19 nt, Escherichia coli CFT073
ugcgcggauggccucugcc

SEQ ID NO: 2674160 - RNA, 12 nt, Escherichia coli CFT073
ugcgcggcagcu

SEQ ID NO: 2674161 - RNA, 18 nt, Escherichia coli CFT073
ugcgcggccagugccagu

SEQ ID NO: 2674162 - RNA, 14 nt, Escherichia coli CFT073
ugcgcgguuuugga

SEQ ID NO: 2674163 - RNA, 15 nt, Escherichia coli CFT073
ugcgcguggcaauug

SEQ ID NO: 2674164 - RNA, 13 nt, Escherichia coli CFT073
ugcgcguuauuug

SEQ ID NO: 2674165 - RNA, 22 nt, Escherichia coli CFT073
ugcgcguuauuuguugccggau

SEQ ID NO: 2674166 - RNA, 24 nt, Escherichia coli CFT073
ugcgcguuugggcgagaucuucuu

SEQ ID NO: 2674167 - RNA, 15 nt, Escherichia coli CFT073
ugcgcuaccagaaag

SEQ ID NO: 2674168 - RNA, 19 nt, Escherichia coli CFT073
ugcgcuacgaccgaucacc

SEQ ID NO: 2674169 - RNA, 18 nt, Escherichia coli CFT073
ugcgcucaauaaucaauc

SEQ ID NO: 2674170 - RNA, 22 nt, Escherichia coli CFT073
ugcgcucuucaacuucagcagc

SEQ ID NO: 2674171 - RNA, 12 nt, Escherichia coli CFT073
ugcgcucuuccg

SEQ ID NO: 2674172 - RNA, 17 nt, Escherichia coli CFT073
ugcgcucuuccgguuug

SEQ ID NO: 2674173 - RNA, 17 nt, Escherichia coli CFT073
ugcgcucuucgaggccg

SEQ ID NO: 2674174 - RNA, 18 nt, Escherichia coli CFT073
ugcgcugcgcuuaucagg

SEQ ID NO: 2674175 - RNA, 11 nt, Escherichia coli CFT073
ugcgcuggcaa

SEQ ID NO: 2674176 - RNA, 20 nt, Escherichia coli CFT073
ugcgcugucauucauucaga

SEQ ID NO: 2674177 - RNA, 12 nt, Escherichia coli CFT073
ugcgcuucccga

SEQ ID NO: 2674178 - RNA, 18 nt, Escherichia coli CFT073
ugcgcuuccggcagcuuc

SEQ ID NO: 2674179 - RNA, 22 nt, Escherichia coli CFT073
ugcgcuucgcuuaccaugccaa

SEQ ID NO: 2674180 - RNA, 16 nt, Escherichia coli CFT073
ugcgcuucuuccagca

SEQ ID NO: 2674181 - RNA, 17 nt, Escherichia coli CFT073
ugcgcuucuuccagcau

SEQ ID NO: 2674182 - RNA, 22 nt, Escherichia coli CFT073
ugcgcuucuuccagcaucgccc

SEQ ID NO: 2674183 - RNA, 17 nt, Escherichia coli CFT073
ugcgcuugcugccaguu

SEQ ID NO: 2674184 - RNA, 20 nt, Escherichia coli CFT073
ugcgcuugcugccaguuacc

SEQ ID NO: 2674185 - RNA, 22 nt, Escherichia coli CFT073
ugcgcuuguucauaauguuaug

SEQ ID NO: 2674186 - RNA, 21 nt, Escherichia coli CFT073
ugcggaaacugucaauaaacg

SEQ ID NO: 2674187 - RNA, 23 nt, Escherichia coli CFT073
ugcggaaaguuuacgucgccagu

SEQ ID NO: 2674188 - RNA, 21 nt, Escherichia coli CFT073
ugcggaaucaccggcaaaacc

SEQ ID NO: 2674189 - RNA, 22 nt, Escherichia coli CFT073
ugcggacaaaucgugacagcau

SEQ ID NO: 2674190 - RNA, 22 nt, Escherichia coli CFT073
ugcggacagucacguagcggcg

SEQ ID NO: 2674191 - RNA, 20 nt, Escherichia coli CFT073
ugcggacgaccaauuaaaua

SEQ ID NO: 2674192 - RNA, 23 nt, Escherichia coli CFT073
ugcggagaaagucguaggccuga

SEQ ID NO: 2674193 - RNA, 19 nt, Escherichia coli CFT073
ugcggagaucaccacauac

SEQ ID NO: 2674194 - RNA, 18 nt, Escherichia coli CFT073
ugcggaggcauagcguuc

SEQ ID NO: 2674195 - RNA, 20 nt, Escherichia coli CFT073
ugcggcaaacgguucgcggu

SEQ ID NO: 2674196 - RNA, 20 nt, Escherichia coli CFT073
ugcggcaauuagcggccagc

SEQ ID NO: 2674197 - RNA, 13 nt, Escherichia coli CFT073
ugcggcagcucca

SEQ ID NO: 2674198 - RNA, 20 nt, Escherichia coli CFT073
ugcggcaucauacacgccgc

SEQ ID NO: 2674199 - RNA, 15 nt, Escherichia coli CFT073
ugcggcauucccagc

SEQ ID NO: 2674200 - RNA, 14 nt, Escherichia coli CFT073
ugcggcauuuccag

SEQ ID NO: 2674201 - RNA, 12 nt, Escherichia coli CFT073
ugcggccagcag

SEQ ID NO: 2674202 - RNA, 13 nt, Escherichia coli CFT073
ugcggccagcagc

SEQ ID NO: 2674203 - RNA, 14 nt, Escherichia coli CFT073
ugcggccagcagcu

SEQ ID NO: 2674204 - RNA, 23 nt, Escherichia coli CFT073
ugcggccuccaacaacccugcau

SEQ ID NO: 2674205 - RNA, 20 nt, Escherichia coli CFT073
ugcggcgaaaacgccucauc

SEQ ID NO: 2674206 - RNA, 22 nt, Escherichia coli CFT073
ugcggcgaaagcgggcuugauc

SEQ ID NO: 2674207 - RNA, 20 nt, Escherichia coli CFT073
ugcggcgagaacgccuuauc

SEQ ID NO: 2674208 - RNA, 14 nt, Escherichia coli CFT073
ugcggcgaggaauc

SEQ ID NO: 2674209 - RNA, 18 nt, Escherichia coli CFT073
ugcggcgaugaugacgcg

SEQ ID NO: 2674210 - RNA, 22 nt, Escherichia coli CFT073
ugcggcgcugacgcgucuuauc

SEQ ID NO: 2674211 - RNA, 20 nt, Escherichia coli CFT073
ugcggcguaaacgccuuauc

SEQ ID NO: 2674212 - RNA, 11 nt, Escherichia coli CFT073
ugcggcguaau

SEQ ID NO: 2674213 - RNA, 16 nt, Escherichia coli CFT073
ugcggcguaaugccug

SEQ ID NO: 2674214 - RNA, 22 nt, Escherichia coli CFT073
ugcggcguaaugccugugcgau

SEQ ID NO: 2674215 - RNA, 20 nt, Escherichia coli CFT073
ugcggcgugaacaccuuauc

SEQ ID NO: 2674216 - RNA, 16 nt, Escherichia coli CFT073
ugcggcgugaacgccu

SEQ ID NO: 2674217 - RNA, 20 nt, Escherichia coli CFT073
ugcggcgugaacgccuuauc

SEQ ID NO: 2674218 - RNA, 20 nt, Escherichia coli CFT073
ugcggcgugaccgccuuauc

SEQ ID NO: 2674219 - RNA, 20 nt, Escherichia coli CFT073
ugcggcguuaacgccuuauc

SEQ ID NO: 2674220 - RNA, 21 nt, Escherichia coli CFT073
ugcggcguucaucgcaaagga

SEQ ID NO: 2674221 - RNA, 17 nt, Escherichia coli CFT073
ugcggcguucgguuuug

SEQ ID NO: 2674222 - RNA, 19 nt, Escherichia coli CFT073
ugcggcucucuuucuccag

SEQ ID NO: 2674223 - RNA, 18 nt, Escherichia coli CFT073
ugcggcugaacugauacu

SEQ ID NO: 2674224 - RNA, 18 nt, Escherichia coli CFT073
ugcggcugauaaucuucu

SEQ ID NO: 2674225 - RNA, 17 nt, Escherichia coli CFT073
ugcggcugcccaucauc

SEQ ID NO: 2674226 - RNA, 20 nt, Escherichia coli CFT073
ugcggcugguuacucaccag

SEQ ID NO: 2674227 - RNA, 20 nt, Escherichia coli CFT073
ugcggcuguagagcuaccgg

SEQ ID NO: 2674228 - RNA, 14 nt, Escherichia coli CFT073
ugcggcuucaacug

SEQ ID NO: 2674229 - RNA, 16 nt, Escherichia coli CFT073
ugcggcuucagcgaca

SEQ ID NO: 2674230 - RNA, 21 nt, Escherichia coli CFT073
ugcggcuuuuuuauugcugca

SEQ ID NO: 2674231 - RNA, 18 nt, Escherichia coli CFT073
ugcgggaaaaugccggau

SEQ ID NO: 2674232 - RNA, 13 nt, Escherichia coli CFT073
ugcgggaaauaac

SEQ ID NO: 2674233 - RNA, 18 nt, Escherichia coli CFT073
ugcgggaacauaugcaca

SEQ ID NO: 2674234 - RNA, 21 nt, Escherichia coli CFT073
ugcgggaacauaugcacauga

SEQ ID NO: 2674235 - RNA, 21 nt, Escherichia coli CFT073
ugcgggagaauugccaaccga

SEQ ID NO: 2674236 - RNA, 19 nt, Escherichia coli CFT073
ugcgggaguugaucgccag

SEQ ID NO: 2674237 - RNA, 19 nt, Escherichia coli CFT073
ugcgggcacaggcgaugcc

SEQ ID NO: 2674238 - RNA, 17 nt, Escherichia coli CFT073
ugcgggcauuacggaac

SEQ ID NO: 2674239 - RNA, 17 nt, Escherichia coli CFT073
ugcgggccgacgagaaa

SEQ ID NO: 2674240 - RNA, 17 nt, Escherichia coli CFT073
ugcgggcggcucuccug

SEQ ID NO: 2674241 - RNA, 21 nt, Escherichia coli CFT073
ugcgggcguggccccaggcau

SEQ ID NO: 2674242 - RNA, 17 nt, Escherichia coli CFT073
ugcgggcugggaucuga

SEQ ID NO: 2674243 - RNA, 18 nt, Escherichia coli CFT073
ugcggggagaaugccagc

SEQ ID NO: 2674244 - RNA, 15 nt, Escherichia coli CFT073
ugcgguaaauuuuuu

SEQ ID NO: 2674245 - RNA, 16 nt, Escherichia coli CFT073
ugcgguagcgggcgca

SEQ ID NO: 2674246 - RNA, 17 nt, Escherichia coli CFT073
ugcggucaaaagcugca

SEQ ID NO: 2674247 - RNA, 15 nt, Escherichia coli CFT073
ugcggugaagccacc

SEQ ID NO: 2674248 - RNA, 19 nt, Escherichia coli CFT073
ugcggugccauuaaaccaa

SEQ ID NO: 2674249 - RNA, 20 nt, Escherichia coli CFT073
ugcggugcgagcgccuuauc

SEQ ID NO: 2674250 - RNA, 19 nt, Escherichia coli CFT073
ugcggugcgccaaacugcc

SEQ ID NO: 2674251 - RNA, 16 nt, Escherichia coli CFT073
ugcgguggauuuaaug

SEQ ID NO: 2674252 - RNA, 21 nt, Escherichia coli CFT073
ugcgguggauuuaaugccaau

SEQ ID NO: 2674253 - RNA, 15 nt, Escherichia coli CFT073
ugcgguugaacgcca

SEQ ID NO: 2674254 - RNA, 16 nt, Escherichia coli CFT073
ugcgguugugcaaaaa

SEQ ID NO: 2674255 - RNA, 17 nt, Escherichia coli CFT073
ugcguaaaaccugccaa

SEQ ID NO: 2674256 - RNA, 16 nt, Escherichia coli CFT073
ugcguaaagccugcug

SEQ ID NO: 2674257 - RNA, 15 nt, Escherichia coli CFT073
ugcguaacgugacau

SEQ ID NO: 2674258 - RNA, 16 nt, Escherichia coli CFT073
ugcguaacugaucgua

SEQ ID NO: 2674259 - RNA, 16 nt, Escherichia coli CFT073
ugcguaaucgccgaac

SEQ ID NO: 2674260 - RNA, 19 nt, Escherichia coli CFT073
ugcguaaucgccgaaccag

SEQ ID NO: 2674261 - RNA, 15 nt, Escherichia coli CFT073
ugcguaaucuuuuca

SEQ ID NO: 2674262 - RNA, 18 nt, Escherichia coli CFT073
ugcguacaccaacaucac

SEQ ID NO: 2674263 - RNA, 13 nt, Escherichia coli CFT073
ugcguacccagcg

SEQ ID NO: 2674264 - RNA, 23 nt, Escherichia coli CFT073
ugcguaccggcguuucacauucu

SEQ ID NO: 2674265 - RNA, 18 nt, Escherichia coli CFT073
ugcguagccgauccgcgu

SEQ ID NO: 2674266 - RNA, 13 nt, Escherichia coli CFT073
ugcgucagcuuca

SEQ ID NO: 2674267 - RNA, 17 nt, Escherichia coli CFT073
ugcgucagggcgaacuu

SEQ ID NO: 2674268 - RNA, 22 nt, Escherichia coli CFT073
ugcgucccuacugcacucauag

SEQ ID NO: 2674269 - RNA, 14 nt, Escherichia coli CFT073
ugcgucgcacucuc

SEQ ID NO: 2674270 - RNA, 21 nt, Escherichia coli CFT073
ugcgucgcggccuguuccaau

SEQ ID NO: 2674271 - RNA, 14 nt, Escherichia coli CFT073
ugcgucuuauuggc

SEQ ID NO: 2674272 - RNA, 17 nt, Escherichia coli CFT073
ugcgucuuccacuucau

SEQ ID NO: 2674273 - RNA, 15 nt, Escherichia coli CFT073
ugcgucuuccgugcc

SEQ ID NO: 2674274 - RNA, 17 nt, Escherichia coli CFT073
ugcgugacgccugcucc

SEQ ID NO: 2674275 - RNA, 16 nt, Escherichia coli CFT073
ugcgugaguuuuuguc

SEQ ID NO: 2674276 - RNA, 15 nt, Escherichia coli CFT073
ugcgugauauuacau

SEQ ID NO: 2674277 - RNA, 21 nt, Escherichia coli CFT073
ugcgugauauuacauaccagc

SEQ ID NO: 2674278 - RNA, 22 nt, Escherichia coli CFT073
ugcgugauauuacauaccagca

SEQ ID NO: 2674279 - RNA, 19 nt, Escherichia coli CFT073
ugcgugaucgaaaaucgcu

SEQ ID NO: 2674280 - RNA, 17 nt, Escherichia coli CFT073
ugcgugcgcccaucauu

SEQ ID NO: 2674281 - RNA, 18 nt, Escherichia coli CFT073
ugcguggaguaaagcccg

SEQ ID NO: 2674282 - RNA, 20 nt, Escherichia coli CFT073
ugcguggcgcgcgucacgau

SEQ ID NO: 2674283 - RNA, 22 nt, Escherichia coli CFT073
ugcguuaauauugugugccggg

SEQ ID NO: 2674284 - RNA, 16 nt, Escherichia coli CFT073
ugcguuagaaaacgcc

SEQ ID NO: 2674285 - RNA, 20 nt, Escherichia coli CFT073
ugcguuauagcgauuuuuca

SEQ ID NO: 2674286 - RNA, 17 nt, Escherichia coli CFT073
ugcguuaucgccaucca

SEQ ID NO: 2674287 - RNA, 11 nt, Escherichia coli CFT073
ugcguuauuuu

SEQ ID NO: 2674288 - RNA, 13 nt, Escherichia coli CFT073
ugcguucagcagu

SEQ ID NO: 2674289 - RNA, 20 nt, Escherichia coli CFT073
ugcguucagcaguucugcca

SEQ ID NO: 2674290 - RNA, 15 nt, Escherichia coli CFT073
ugcguucgcaccacc

SEQ ID NO: 2674291 - RNA, 12 nt, Escherichia coli CFT073
ugcguucugucg

SEQ ID NO: 2674292 - RNA, 14 nt, Escherichia coli CFT073
ugcguugccgccaa

SEQ ID NO: 2674293 - RNA, 20 nt, Escherichia coli CFT073
ugcguuggcuucaccuuuca

SEQ ID NO: 2674294 - RNA, 15 nt, Escherichia coli CFT073
ugcguuuggcaucag

SEQ ID NO: 2674295 - RNA, 17 nt, Escherichia coli CFT073
ugcguuuguccgccaga

SEQ ID NO: 2674296 - RNA, 16 nt, Escherichia coli CFT073
ugcguuuuuaucuuca

SEQ ID NO: 2674297 - RNA, 18 nt, Escherichia coli CFT073
ugcguuuuuaucuucaca

SEQ ID NO: 2674298 - RNA, 18 nt, Escherichia coli CFT073
ugcuaaacguaacacaua

SEQ ID NO: 2674299 - RNA, 21 nt, Escherichia coli CFT073
ugcuaaaucggggaucauuaa

SEQ ID NO: 2674300 - RNA, 14 nt, Escherichia coli CFT073
ugcuaaugguugca

SEQ ID NO: 2674301 - RNA, 14 nt, Escherichia coli CFT073
ugcuacccggcguu

SEQ ID NO: 2674302 - RNA, 22 nt, Escherichia coli CFT073
ugcuacccggcguuuuuauugc

SEQ ID NO: 2674303 - RNA, 21 nt, Escherichia coli CFT073
ugcuaccgggaucuccuccag

SEQ ID NO: 2674304 - RNA, 20 nt, Escherichia coli CFT073
ugcuacuaugauuuuccuga

SEQ ID NO: 2674305 - RNA, 14 nt, Escherichia coli CFT073
ugcuagauaagcaa

SEQ ID NO: 2674306 - RNA, 17 nt, Escherichia coli CFT073
ugcuagauaagcaaggc

SEQ ID NO: 2674307 - RNA, 20 nt, Escherichia coli CFT073
ugcuaugggcggucccacaa

SEQ ID NO: 2674308 - RNA, 13 nt, Escherichia coli CFT073
ugcuauuccuuga

SEQ ID NO: 2674309 - RNA, 15 nt, Escherichia coli CFT073
ugcuauuccuugaaa

SEQ ID NO: 2674310 - RNA, 15 nt, Escherichia coli CFT073
ugcucaacggugacc

SEQ ID NO: 2674311 - RNA, 21 nt, Escherichia coli CFT073
ugcucaagcugaccgauaacc

SEQ ID NO: 2674312 - RNA, 19 nt, Escherichia coli CFT073
ugcucaaggguuucgcggu

SEQ ID NO: 2674313 - RNA, 22 nt, Escherichia coli CFT073
ugcucaaucgaacgcagcaaca

SEQ ID NO: 2674314 - RNA, 13 nt, Escherichia coli CFT073
ugcucaaucgcau

SEQ ID NO: 2674315 - RNA, 22 nt, Escherichia coli CFT073
ugcucacagaguauuuccagcu

SEQ ID NO: 2674316 - RNA, 23 nt, Escherichia coli CFT073
ugcucacagaguauuuccagcuc

SEQ ID NO: 2674317 - RNA, 11 nt, Escherichia coli CFT073
ugcucaccaau

SEQ ID NO: 2674318 - RNA, 21 nt, Escherichia coli CFT073
ugcucagaaucacgccaacaa

SEQ ID NO: 2674319 - RNA, 19 nt, Escherichia coli CFT073
ugcucagcacgccacucac

SEQ ID NO: 2674320 - RNA, 14 nt, Escherichia coli CFT073
ugcucagccucggu

SEQ ID NO: 2674321 - RNA, 20 nt, Escherichia coli CFT073
ugcucaggaguaaacuuucc

SEQ ID NO: 2674322 - RNA, 20 nt, Escherichia coli CFT073
ugcucauccccaucaacgca

SEQ ID NO: 2674323 - RNA, 14 nt, Escherichia coli CFT073
ugcucauuccgccg

SEQ ID NO: 2674324 - RNA, 20 nt, Escherichia coli CFT073
ugcucauuuucuugccggau

SEQ ID NO: 2674325 - RNA, 18 nt, Escherichia coli CFT073
ugcuccagcguaccugcc

SEQ ID NO: 2674326 - RNA, 18 nt, Escherichia coli CFT073
ugcuccauaauugccagc

SEQ ID NO: 2674327 - RNA, 20 nt, Escherichia coli CFT073
ugcuccauaauugccagcuu

SEQ ID NO: 2674328 - RNA, 19 nt, Escherichia coli CFT073
ugcuccaucaggucaucaa

SEQ ID NO: 2674329 - RNA, 21 nt, Escherichia coli CFT073
ugcuccaucgcaugccagcgc

SEQ ID NO: 2674330 - RNA, 22 nt, Escherichia coli CFT073
ugcuccauuaacccgagaucuu

SEQ ID NO: 2674331 - RNA, 17 nt, Escherichia coli CFT073
ugcuccccuuucuuauu

SEQ ID NO: 2674332 - RNA, 22 nt, Escherichia coli CFT073
ugcucccgaacucgaccugcaa

SEQ ID NO: 2674333 - RNA, 16 nt, Escherichia coli CFT073
ugcucccugagcaaca

SEQ ID NO: 2674334 - RNA, 13 nt, Escherichia coli CFT073
ugcuccgaaguga

SEQ ID NO: 2674335 - RNA, 11 nt, Escherichia coli CFT073
ugcuccgccag

SEQ ID NO: 2674336 - RNA, 23 nt, Escherichia coli CFT073
ugcuccgccgcagccgcauuuuu

SEQ ID NO: 2674337 - RNA, 22 nt, Escherichia coli CFT073
ugcuccuuucagguacagacua

SEQ ID NO: 2674338 - RNA, 18 nt, Escherichia coli CFT073
ugcucgaagaguuccagc

SEQ ID NO: 2674339 - RNA, 19 nt, Escherichia coli CFT073
ugcucgaauuaaaggauau

SEQ ID NO: 2674340 - RNA, 17 nt, Escherichia coli CFT073
ugcucgacuagauacug

SEQ ID NO: 2674341 - RNA, 13 nt, Escherichia coli CFT073
ugcucgcagaaau

SEQ ID NO: 2674342 - RNA, 22 nt, Escherichia coli CFT073
ugcucgcagaaauaccccgcca

SEQ ID NO: 2674343 - RNA, 20 nt, Escherichia coli CFT073
ugcucgccacgucacucuuu

SEQ ID NO: 2674344 - RNA, 16 nt, Escherichia coli CFT073
ugcucgcgaaaagaaa

SEQ ID NO: 2674345 - RNA, 20 nt, Escherichia coli CFT073
ugcucguaaagcaucagacu

SEQ ID NO: 2674346 - RNA, 16 nt, Escherichia coli CFT073
ugcucguaaguuaacu

SEQ ID NO: 2674347 - RNA, 15 nt, Escherichia coli CFT073
ugcucguagaagcca

SEQ ID NO: 2674348 - RNA, 20 nt, Escherichia coli CFT073
ugcucgucaaaaccgggcug

SEQ ID NO: 2674349 - RNA, 15 nt, Escherichia coli CFT073
ugcucuaacccuucc

SEQ ID NO: 2674350 - RNA, 18 nt, Escherichia coli CFT073
ugcucuaccagccccauc

SEQ ID NO: 2674351 - RNA, 20 nt, Escherichia coli CFT073
ugcucuaccagccccaucag

SEQ ID NO: 2674352 - RNA, 21 nt, Escherichia coli CFT073
ugcucuacgcuucucucugua

SEQ ID NO: 2674353 - RNA, 22 nt, Escherichia coli CFT073
ugcucuauugccguaaucgccu

SEQ ID NO: 2674354 - RNA, 17 nt, Escherichia coli CFT073
ugcucucgccagcacua

SEQ ID NO: 2674355 - RNA, 17 nt, Escherichia coli CFT073
ugcucucgggcaguaaa

SEQ ID NO: 2674356 - RNA, 22 nt, Escherichia coli CFT073
ugcucugaaguuuguuaaccac

SEQ ID NO: 2674357 - RNA, 12 nt, Escherichia coli CFT073
ugcucugccagc

SEQ ID NO: 2674358 - RNA, 15 nt, Escherichia coli CFT073
ugcucuggcagcacc

SEQ ID NO: 2674359 - RNA, 16 nt, Escherichia coli CFT073
ugcucuggcagcacca

SEQ ID NO: 2674360 - RNA, 12 nt, Escherichia coli CFT073
ugcucuggcaua

SEQ ID NO: 2674361 - RNA, 18 nt, Escherichia coli CFT073
ugcucuguguaggccgga

SEQ ID NO: 2674362 - RNA, 19 nt, Escherichia coli CFT073
ugcucuucgcguaauguuu

SEQ ID NO: 2674363 - RNA, 23 nt, Escherichia coli CFT073
ugcucuucguuaauuucugcuuu

SEQ ID NO: 2674364 - RNA, 14 nt, Escherichia coli CFT073
ugcucuucuuucau

SEQ ID NO: 2674365 - RNA, 18 nt, Escherichia coli CFT073
ugcucuucuuucaucaug

SEQ ID NO: 2674366 - RNA, 16 nt, Escherichia coli CFT073
ugcucuugauccauua

SEQ ID NO: 2674367 - RNA, 16 nt, Escherichia coli CFT073
ugcucuuucagcaccg

SEQ ID NO: 2674368 - RNA, 22 nt, Escherichia coli CFT073
ugcucuuuguaggccugauaag

SEQ ID NO: 2674369 - RNA, 15 nt, Escherichia coli CFT073
ugcugaaaaggcuaa

SEQ ID NO: 2674370 - RNA, 16 nt, Escherichia coli CFT073
ugcugaaacgcucgca

SEQ ID NO: 2674371 - RNA, 17 nt, Escherichia coli CFT073
ugcugaagcaacaguaa

SEQ ID NO: 2674372 - RNA, 16 nt, Escherichia coli CFT073
ugcugaauccccuucu

SEQ ID NO: 2674373 - RNA, 19 nt, Escherichia coli CFT073
ugcugaauuuccugcgcuu

SEQ ID NO: 2674374 - RNA, 14 nt, Escherichia coli CFT073
ugcugaccaccagc

SEQ ID NO: 2674375 - RNA, 15 nt, Escherichia coli CFT073
ugcugaccaccagca

SEQ ID NO: 2674376 - RNA, 18 nt, Escherichia coli CFT073
ugcugaccgaagucagua

SEQ ID NO: 2674377 - RNA, 20 nt, Escherichia coli CFT073
ugcugacguagcagcuccgc

SEQ ID NO: 2674378 - RNA, 19 nt, Escherichia coli CFT073
ugcugacucggcugcugcc

SEQ ID NO: 2674379 - RNA, 15 nt, Escherichia coli CFT073
ugcugacugaugaga

SEQ ID NO: 2674380 - RNA, 12 nt, Escherichia coli CFT073
ugcugacugcgc

SEQ ID NO: 2674381 - RNA, 17 nt, Escherichia coli CFT073
ugcugauaagacgcauc

SEQ ID NO: 2674382 - RNA, 15 nt, Escherichia coli CFT073
ugcugauacgcgcac

SEQ ID NO: 2674383 - RNA, 15 nt, Escherichia coli CFT073
ugcugauagagcuca

SEQ ID NO: 2674384 - RNA, 20 nt, Escherichia coli CFT073
ugcugcacauacugcaucag

SEQ ID NO: 2674385 - RNA, 17 nt, Escherichia coli CFT073
ugcugcaccccacaaac

SEQ ID NO: 2674386 - RNA, 16 nt, Escherichia coli CFT073
ugcugccaucaucuuc

SEQ ID NO: 2674387 - RNA, 14 nt, Escherichia coli CFT073
ugcugccgagcgca

SEQ ID NO: 2674388 - RNA, 15 nt, Escherichia coli CFT073
ugcugccgagcgcaa

SEQ ID NO: 2674389 - RNA, 12 nt, Escherichia coli CFT073
ugcugccgcuau

SEQ ID NO: 2674390 - RNA, 16 nt, Escherichia coli CFT073
ugcugccuuuuuuauu

SEQ ID NO: 2674391 - RNA, 16 nt, Escherichia coli CFT073
ugcugcgauucagggu

SEQ ID NO: 2674392 - RNA, 20 nt, Escherichia coli CFT073
ugcugcgccaguugcuuauc

SEQ ID NO: 2674393 - RNA, 19 nt, Escherichia coli CFT073
ugcugcgcggugacaucaa

SEQ ID NO: 2674394 - RNA, 21 nt, Escherichia coli CFT073
ugcugcgcggugacaucaaua

SEQ ID NO: 2674395 - RNA, 22 nt, Escherichia coli CFT073
ugcugcuaagagugagguauaa

SEQ ID NO: 2674396 - RNA, 12 nt, Escherichia coli CFT073
ugcugcuaccgg

SEQ ID NO: 2674397 - RNA, 14 nt, Escherichia coli CFT073
ugcugcucacggug

SEQ ID NO: 2674398 - RNA, 21 nt, Escherichia coli CFT073
ugcugcuccugcgacugcauu

SEQ ID NO: 2674399 - RNA, 15 nt, Escherichia coli CFT073
ugcugcucuucacgc

SEQ ID NO: 2674400 - RNA, 22 nt, Escherichia coli CFT073
ugcugcugaagcaacaguaaua

SEQ ID NO: 2674401 - RNA, 21 nt, Escherichia coli CFT073
ugcugcugauaaccgccgcca

SEQ ID NO: 2674402 - RNA, 22 nt, Escherichia coli CFT073
ugcugcuggaaaagguaaggau

SEQ ID NO: 2674403 - RNA, 18 nt, Escherichia coli CFT073
ugcugcuggcaucaccaa

SEQ ID NO: 2674404 - RNA, 18 nt, Escherichia coli CFT073
ugcuggaaccacagcgcc

SEQ ID NO: 2674405 - RNA, 20 nt, Escherichia coli CFT073
ugcuggacgauuucacccag

SEQ ID NO: 2674406 - RNA, 19 nt, Escherichia coli CFT073
ugcuggaucaaggauugca

SEQ ID NO: 2674407 - RNA, 15 nt, Escherichia coli CFT073
ugcuggaucccagaa

SEQ ID NO: 2674408 - RNA, 22 nt, Escherichia coli CFT073
ugcuggauccccugcccggcaa

SEQ ID NO: 2674409 - RNA, 23 nt, Escherichia coli CFT073
ugcuggcaaugaguaguuugguu

SEQ ID NO: 2674410 - RNA, 18 nt, Escherichia coli CFT073
ugcuggcaccgugaaaga

SEQ ID NO: 2674411 - RNA, 18 nt, Escherichia coli CFT073
ugcuggcaugaaugguca

SEQ ID NO: 2674412 - RNA, 15 nt, Escherichia coli CFT073
ugcuggcgagugcau

SEQ ID NO: 2674413 - RNA, 22 nt, Escherichia coli CFT073
ugcuggcgcacguucugucgcu

SEQ ID NO: 2674414 - RNA, 15 nt, Escherichia coli CFT073
ugcuggcgggcuggu

SEQ ID NO: 2674415 - RNA, 18 nt, Escherichia coli CFT073
ugcuggcugaacgccugc

SEQ ID NO: 2674416 - RNA, 22 nt, Escherichia coli CFT073
ugcuggcugcgggaguugcucc

SEQ ID NO: 2674417 - RNA, 15 nt, Escherichia coli CFT073
ugcugguauuuugcg

SEQ ID NO: 2674418 - RNA, 22 nt, Escherichia coli CFT073
ugcuggucuucguacaugguaa

SEQ ID NO: 2674419 - RNA, 12 nt, Escherichia coli CFT073
ugcuguaaacaa

SEQ ID NO: 2674420 - RNA, 21 nt, Escherichia coli CFT073
ugcuguaaacaacaugguccu

SEQ ID NO: 2674421 - RNA, 21 nt, Escherichia coli CFT073
ugcuguaaagucuggaagacc

SEQ ID NO: 2674422 - RNA, 12 nt, Escherichia coli CFT073
ugcuguacagua

SEQ ID NO: 2674423 - RNA, 22 nt, Escherichia coli CFT073
ugcuguaguuguucaacaguaa

SEQ ID NO: 2674424 - RNA, 17 nt, Escherichia coli CFT073
ugcugucggcaaaucaa

SEQ ID NO: 2674425 - RNA, 16 nt, Escherichia coli CFT073
ugcuguggcgucucga

SEQ ID NO: 2674426 - RNA, 15 nt, Escherichia coli CFT073
ugcugugugccgcga

SEQ ID NO: 2674427 - RNA, 13 nt, Escherichia coli CFT073
ugcuguuccagca

SEQ ID NO: 2674428 - RNA, 14 nt, Escherichia coli CFT073
ugcuguucuucugc

SEQ ID NO: 2674429 - RNA, 15 nt, Escherichia coli CFT073
ugcuguuuccaguaa

SEQ ID NO: 2674430 - RNA, 21 nt, Escherichia coli CFT073
ugcuuaaaagcacagaaucua

SEQ ID NO: 2674431 - RNA, 12 nt, Escherichia coli CFT073
ugcuuaaauggc

SEQ ID NO: 2674432 - RNA, 18 nt, Escherichia coli CFT073
ugcuuaaauuucuuacca

SEQ ID NO: 2674433 - RNA, 14 nt, Escherichia coli CFT073
ugcuuaaucauauu

SEQ ID NO: 2674434 - RNA, 17 nt, Escherichia coli CFT073
ugcuuacgcaacugcca

SEQ ID NO: 2674435 - RNA, 16 nt, Escherichia coli CFT073
ugcuuauaaccauuua

SEQ ID NO: 2674436 - RNA, 21 nt, Escherichia coli CFT073
ugcuuaucgcccugcuccagc

SEQ ID NO: 2674437 - RNA, 21 nt, Escherichia coli CFT073
ugcuuaucgcgauauucucgc

SEQ ID NO: 2674438 - RNA, 17 nt, Escherichia coli CFT073
ugcuuauuaaugcuuuc

SEQ ID NO: 2674439 - RNA, 19 nt, Escherichia coli CFT073
ugcuucaacgaaagcgccu

SEQ ID NO: 2674440 - RNA, 15 nt, Escherichia coli CFT073
ugcuucaagaugcca

SEQ ID NO: 2674441 - RNA, 19 nt, Escherichia coli CFT073
ugcuucaauaauccacggc

SEQ ID NO: 2674442 - RNA, 21 nt, Escherichia coli CFT073
ugcuucacgcggguugccacc

SEQ ID NO: 2674443 - RNA, 15 nt, Escherichia coli CFT073
ugcuucagauaccaa

SEQ ID NO: 2674444 - RNA, 20 nt, Escherichia coli CFT073
ugcuucagccagaggcggca

SEQ ID NO: 2674445 - RNA, 20 nt, Escherichia coli CFT073
ugcuucaucgugacaaucuc

SEQ ID NO: 2674446 - RNA, 20 nt, Escherichia coli CFT073
ugcuucauugcucucuucuc

SEQ ID NO: 2674447 - RNA, 13 nt, Escherichia coli CFT073
ugcuucgccgcau

SEQ ID NO: 2674448 - RNA, 13 nt, Escherichia coli CFT073
ugcuucgcucucu

SEQ ID NO: 2674449 - RNA, 19 nt, Escherichia coli CFT073
ugcuucggucagcacgcga

SEQ ID NO: 2674450 - RNA, 16 nt, Escherichia coli CFT073
ugcuucuaacaucaug

SEQ ID NO: 2674451 - RNA, 19 nt, Escherichia coli CFT073
ugcuucuaacaucaugauu

SEQ ID NO: 2674452 - RNA, 16 nt, Escherichia coli CFT073
ugcuucuagugccugc

SEQ ID NO: 2674453 - RNA, 22 nt, Escherichia coli CFT073
ugcuucucuucagccaacgcau

SEQ ID NO: 2674454 - RNA, 11 nt, Escherichia coli CFT073
ugcuucucuug

SEQ ID NO: 2674455 - RNA, 18 nt, Escherichia coli CFT073
ugcuucuuacuauauaaa

SEQ ID NO: 2674456 - RNA, 17 nt, Escherichia coli CFT073
ugcuucuuccugccagc

SEQ ID NO: 2674457 - RNA, 18 nt, Escherichia coli CFT073
ugcuugacgcgucuuauc

SEQ ID NO: 2674458 - RNA, 20 nt, Escherichia coli CFT073
ugcuugccggaagcaaaaua

SEQ ID NO: 2674459 - RNA, 23 nt, Escherichia coli CFT073
ugcuuuaucagcucauaggccug

SEQ ID NO: 2674460 - RNA, 23 nt, Escherichia coli CFT073
ugcuuucaccaauguugucgcag

SEQ ID NO: 2674461 - RNA, 17 nt, Escherichia coli CFT073
ugcuuucagcacuuauc

SEQ ID NO: 2674462 - RNA, 20 nt, Escherichia coli CFT073
ugcuuucagcacuuaucucu

SEQ ID NO: 2674463 - RNA, 19 nt, Escherichia coli CFT073
ugcuuuccagcuguaccag

SEQ ID NO: 2674464 - RNA, 23 nt, Escherichia coli CFT073
ugcuuucgccgcgaucucgucag

SEQ ID NO: 2674465 - RNA, 15 nt, Escherichia coli CFT073
ugcuuuuaaaugccc

SEQ ID NO: 2674466 - RNA, 17 nt, Escherichia coli CFT073
ugcuuuucauacaaucg

SEQ ID NO: 2674467 - RNA, 14 nt, Escherichia coli CFT073
ugcuuuuucaauuu

SEQ ID NO: 2674468 - RNA, 11 nt, Escherichia coli CFT073
ugcuuuuucgc

SEQ ID NO: 2674469 - RNA, 11 nt, Escherichia coli CFT073
uggaaaaaaug

SEQ ID NO: 2674470 - RNA, 13 nt, Escherichia coli CFT073
uggaaaaaaugcc

SEQ ID NO: 2674471 - RNA, 12 nt, Escherichia coli CFT073
uggaaaacaaca

SEQ ID NO: 2674472 - RNA, 23 nt, Escherichia coli CFT073
uggaaaauuuuuucagauaaaag

SEQ ID NO: 2674473 - RNA, 14 nt, Escherichia coli CFT073
uggaaacagcacca

SEQ ID NO: 2674474 - RNA, 20 nt, Escherichia coli CFT073
uggaaacagcaccauccgcc

SEQ ID NO: 2674475 - RNA, 21 nt, Escherichia coli CFT073
uggaaacagccaaucauaaac

SEQ ID NO: 2674476 - RNA, 18 nt, Escherichia coli CFT073
uggaaacgcccccaaaau

SEQ ID NO: 2674477 - RNA, 18 nt, Escherichia coli CFT073
uggaaaggccgcgaacca

SEQ ID NO: 2674478 - RNA, 19 nt, Escherichia coli CFT073
uggaaaguauaugagaaga

SEQ ID NO: 2674479 - RNA, 20 nt, Escherichia coli CFT073
uggaaauagaacguuuaucu

SEQ ID NO: 2674480 - RNA, 17 nt, Escherichia coli CFT073
uggaaauagauuuucag

SEQ ID NO: 2674481 - RNA, 12 nt, Escherichia coli CFT073
uggaaaucaaau

SEQ ID NO: 2674482 - RNA, 16 nt, Escherichia coli CFT073
uggaaaucacgccgca

SEQ ID NO: 2674483 - RNA, 17 nt, Escherichia coli CFT073
uggaacaaaauuuucag

SEQ ID NO: 2674484 - RNA, 21 nt, Escherichia coli CFT073
uggaacccgcagccgucgcca

SEQ ID NO: 2674485 - RNA, 17 nt, Escherichia coli CFT073
uggaacggcagauccaa

SEQ ID NO: 2674486 - RNA, 18 nt, Escherichia coli CFT073
uggaacucgaaaauauug

SEQ ID NO: 2674487 - RNA, 13 nt, Escherichia coli CFT073
uggaacugaaagg

SEQ ID NO: 2674488 - RNA, 15 nt, Escherichia coli CFT073
uggaagaaacgcuua

SEQ ID NO: 2674489 - RNA, 21 nt, Escherichia coli CFT073
uggaagagcgacaaucccugc

SEQ ID NO: 2674490 - RNA, 20 nt, Escherichia coli CFT073
uggaagcauaauaagcuuuu

SEQ ID NO: 2674491 - RNA, 22 nt, Escherichia coli CFT073
uggaaguacgcuucacgcacca

SEQ ID NO: 2674492 - RNA, 18 nt, Escherichia coli CFT073
uggaagugaucuuucagc

SEQ ID NO: 2674493 - RNA, 15 nt, Escherichia coli CFT073
uggaaguuacucaaa

SEQ ID NO: 2674494 - RNA, 19 nt, Escherichia coli CFT073
uggaauacguugcaaauau

SEQ ID NO: 2674495 - RNA, 15 nt, Escherichia coli CFT073
uggaauagcgaagaa

SEQ ID NO: 2674496 - RNA, 14 nt, Escherichia coli CFT073
uggaaucaauaauu

SEQ ID NO: 2674497 - RNA, 15 nt, Escherichia coli CFT073
uggaaucaccgccac

SEQ ID NO: 2674498 - RNA, 18 nt, Escherichia coli CFT073
uggaaucaccgccacgcc

SEQ ID NO: 2674499 - RNA, 12 nt, Escherichia coli CFT073
uggaaucacuca

SEQ ID NO: 2674500 - RNA, 19 nt, Escherichia coli CFT073
uggaaucacucaucaugca

SEQ ID NO: 2674501 - RNA, 15 nt, Escherichia coli CFT073
uggaaucaucaagca

SEQ ID NO: 2674502 - RNA, 16 nt, Escherichia coli CFT073
uggaaucaucaagcac

SEQ ID NO: 2674503 - RNA, 15 nt, Escherichia coli CFT073
uggaauggaaacagc

SEQ ID NO: 2674504 - RNA, 19 nt, Escherichia coli CFT073
uggaauggaaacagcacca

SEQ ID NO: 2674505 - RNA, 20 nt, Escherichia coli CFT073
uggaauuucugcuucaucgu

SEQ ID NO: 2674506 - RNA, 18 nt, Escherichia coli CFT073
uggacaccauugccggau

SEQ ID NO: 2674507 - RNA, 17 nt, Escherichia coli CFT073
uggacauagcucugcca

SEQ ID NO: 2674508 - RNA, 18 nt, Escherichia coli CFT073
uggacauagcucugccac

SEQ ID NO: 2674509 - RNA, 18 nt, Escherichia coli CFT073
uggacaucgucugcggug

SEQ ID NO: 2674510 - RNA, 17 nt, Escherichia coli CFT073
uggacauggguauuguu

SEQ ID NO: 2674511 - RNA, 21 nt, Escherichia coli CFT073
uggacaugugcgacaguugcc

SEQ ID NO: 2674512 - RNA, 18 nt, Escherichia coli CFT073
uggacauguuccggcgac

SEQ ID NO: 2674513 - RNA, 13 nt, Escherichia coli CFT073
uggacauguuuuu

SEQ ID NO: 2674514 - RNA, 19 nt, Escherichia coli CFT073
uggacauguuuuuauuaaa

SEQ ID NO: 2674515 - RNA, 13 nt, Escherichia coli CFT073
uggacauucuccg

SEQ ID NO: 2674516 - RNA, 23 nt, Escherichia coli CFT073
uggaccaauucaaugccccacag

SEQ ID NO: 2674517 - RNA, 12 nt, Escherichia coli CFT073
uggaccagaacg

SEQ ID NO: 2674518 - RNA, 15 nt, Escherichia coli CFT073
uggacgaacagcuca

SEQ ID NO: 2674519 - RNA, 19 nt, Escherichia coli CFT073
uggacgauuucacccagcg

SEQ ID NO: 2674520 - RNA, 14 nt, Escherichia coli CFT073
uggacgcacaucgc

SEQ ID NO: 2674521 - RNA, 22 nt, Escherichia coli CFT073
uggacgccguauucacuuucaa

SEQ ID NO: 2674522 - RNA, 14 nt, Escherichia coli CFT073
uggacguggugcgc

SEQ ID NO: 2674523 - RNA, 20 nt, Escherichia coli CFT073
uggacuguaagccaucaccg

SEQ ID NO: 2674524 - RNA, 19 nt, Escherichia coli CFT073
uggagagaaccagcgcaca

SEQ ID NO: 2674525 - RNA, 17 nt, Escherichia coli CFT073
uggagaguugcaccagc

SEQ ID NO: 2674526 - RNA, 20 nt, Escherichia coli CFT073
uggagaguugcaccagcaau

SEQ ID NO: 2674527 - RNA, 18 nt, Escherichia coli CFT073
uggagaucccgugacggu

SEQ ID NO: 2674528 - RNA, 19 nt, Escherichia coli CFT073
uggagcacugcgcccgcca

SEQ ID NO: 2674529 - RNA, 16 nt, Escherichia coli CFT073
uggagcaggugaauca

SEQ ID NO: 2674530 - RNA, 15 nt, Escherichia coli CFT073
uggagccaucaccau

SEQ ID NO: 2674531 - RNA, 18 nt, Escherichia coli CFT073
uggagcuaaacagagcug

SEQ ID NO: 2674532 - RNA, 13 nt, Escherichia coli CFT073
uggaguggcccag

SEQ ID NO: 2674533 - RNA, 15 nt, Escherichia coli CFT073
uggauaaauaugacg

SEQ ID NO: 2674534 - RNA, 14 nt, Escherichia coli CFT073
uggauaaccuguug

SEQ ID NO: 2674535 - RNA, 18 nt, Escherichia coli CFT073
uggauaaccuguugacca

SEQ ID NO: 2674536 - RNA, 16 nt, Escherichia coli CFT073
uggauaaggcaacgcc

SEQ ID NO: 2674537 - RNA, 18 nt, Escherichia coli CFT073
uggauaaggccaccagcg

SEQ ID NO: 2674538 - RNA, 21 nt, Escherichia coli CFT073
uggauaaggccaccagcggca

SEQ ID NO: 2674539 - RNA, 24 nt, Escherichia coli CFT073
uggauacgcugacgugcugcaucu

SEQ ID NO: 2674540 - RNA, 18 nt, Escherichia coli CFT073
uggauauacgcuuucagc

SEQ ID NO: 2674541 - RNA, 22 nt, Escherichia coli CFT073
uggauauugccggaugugaugc

SEQ ID NO: 2674542 - RNA, 18 nt, Escherichia coli CFT073
uggaucaaggauugcagc

SEQ ID NO: 2674543 - RNA, 22 nt, Escherichia coli CFT073
uggaucaaggauugcagcacug

SEQ ID NO: 2674544 - RNA, 22 nt, Escherichia coli CFT073
uggaucaauuucguugaccugu

SEQ ID NO: 2674545 - RNA, 20 nt, Escherichia coli CFT073
uggaucacauacgcgguauu

SEQ ID NO: 2674546 - RNA, 15 nt, Escherichia coli CFT073
uggaucccagaagau

SEQ ID NO: 2674547 - RNA, 23 nt, Escherichia coli CFT073
uggaucgcauaaugccugcaaca

SEQ ID NO: 2674548 - RNA, 13 nt, Escherichia coli CFT073
uggaucuguugcu

SEQ ID NO: 2674549 - RNA, 15 nt, Escherichia coli CFT073
uggaucuguugcugg

SEQ ID NO: 2674550 - RNA, 18 nt, Escherichia coli CFT073
uggaugaaucucaauucc

SEQ ID NO: 2674551 - RNA, 23 nt, Escherichia coli CFT073
uggaugcgauguucccccagcca

SEQ ID NO: 2674552 - RNA, 21 nt, Escherichia coli CFT073
uggaugcuuuugcaacaaggg

SEQ ID NO: 2674553 - RNA, 19 nt, Escherichia coli CFT073
uggauguugccaacaauca

SEQ ID NO: 2674554 - RNA, 14 nt, Escherichia coli CFT073
uggauguuggcggc

SEQ ID NO: 2674555 - RNA, 13 nt, Escherichia coli CFT073
uggauuaaauugc

SEQ ID NO: 2674556 - RNA, 12 nt, Escherichia coli CFT073
uggauuacucua

SEQ ID NO: 2674557 - RNA, 13 nt, Escherichia coli CFT073
uggauuaucuuca

SEQ ID NO: 2674558 - RNA, 14 nt, Escherichia coli CFT073
uggauuaucuucac

SEQ ID NO: 2674559 - RNA, 17 nt, Escherichia coli CFT073
uggauucauccggcaac

SEQ ID NO: 2674560 - RNA, 15 nt, Escherichia coli CFT073
uggauucaugauacu

SEQ ID NO: 2674561 - RNA, 17 nt, Escherichia coli CFT073
uggauuguuccccuucc

SEQ ID NO: 2674562 - RNA, 13 nt, Escherichia coli CFT073
uggauuuuucgcg

SEQ ID NO: 2674563 - RNA, 15 nt, Escherichia coli CFT073
uggcaaaagaagcac

SEQ ID NO: 2674564 - RNA, 20 nt, Escherichia coli CFT073
uggcaaagaaaucaacaaau

SEQ ID NO: 2674565 - RNA, 21 nt, Escherichia coli CFT073
uggcaaagcugucaccaauca

SEQ ID NO: 2674566 - RNA, 21 nt, Escherichia coli CFT073
uggcaaaucaaaucacgaugg

SEQ ID NO: 2674567 - RNA, 17 nt, Escherichia coli CFT073
uggcaaauugcccaaga

SEQ ID NO: 2674568 - RNA, 13 nt, Escherichia coli CFT073
uggcaacaacgca

SEQ ID NO: 2674569 - RNA, 15 nt, Escherichia coli CFT073
uggcaacacuuuauc

SEQ ID NO: 2674570 - RNA, 14 nt, Escherichia coli CFT073
uggcaacagcagcc

SEQ ID NO: 2674571 - RNA, 13 nt, Escherichia coli CFT073
uggcaacagccau

SEQ ID NO: 2674572 - RNA, 18 nt, Escherichia coli CFT073
uggcaacauaaucaacca

SEQ ID NO: 2674573 - RNA, 12 nt, Escherichia coli CFT073
uggcaacgcaaa

SEQ ID NO: 2674574 - RNA, 16 nt, Escherichia coli CFT073
uggcaacuuuaauaau

SEQ ID NO: 2674575 - RNA, 20 nt, Escherichia coli CFT073
uggcaagaaacgcuccacca

SEQ ID NO: 2674576 - RNA, 16 nt, Escherichia coli CFT073
uggcaauaauauccca

SEQ ID NO: 2674577 - RNA, 21 nt, Escherichia coli CFT073
uggcaauaauaucccaacgca

SEQ ID NO: 2674578 - RNA, 21 nt, Escherichia coli CFT073
uggcaauagcuucuuccacau

SEQ ID NO: 2674579 - RNA, 15 nt, Escherichia coli CFT073
uggcaauauauuugc

SEQ ID NO: 2674580 - RNA, 16 nt, Escherichia coli CFT073
uggcaauauauuugcu

SEQ ID NO: 2674581 - RNA, 18 nt, Escherichia coli CFT073
uggcaaucaucguacugu

SEQ ID NO: 2674582 - RNA, 13 nt, Escherichia coli CFT073
uggcaauccugcu

SEQ ID NO: 2674583 - RNA, 22 nt, Escherichia coli CFT073
uggcaaugaguaguuugguuaa

SEQ ID NO: 2674584 - RNA, 15 nt, Escherichia coli CFT073
uggcaaugcccggug

SEQ ID NO: 2674585 - RNA, 20 nt, Escherichia coli CFT073
uggcaaugucaagugaauaa

SEQ ID NO: 2674586 - RNA, 13 nt, Escherichia coli CFT073
uggcaauuuugcu

SEQ ID NO: 2674587 - RNA, 18 nt, Escherichia coli CFT073
uggcaauuuugcugugcu

SEQ ID NO: 2674588 - RNA, 13 nt, Escherichia coli CFT073
uggcacaagacug

SEQ ID NO: 2674589 - RNA, 15 nt, Escherichia coli CFT073
uggcacaagacugac

SEQ ID NO: 2674590 - RNA, 23 nt, Escherichia coli CFT073
uggcacaagacugacaaucaauc

SEQ ID NO: 2674591 - RNA, 15 nt, Escherichia coli CFT073
uggcacacaccagau

SEQ ID NO: 2674592 - RNA, 21 nt, Escherichia coli CFT073
uggcacauaauugagcagcaa

SEQ ID NO: 2674593 - RNA, 12 nt, Escherichia coli CFT073
uggcacaugacu

SEQ ID NO: 2674594 - RNA, 20 nt, Escherichia coli CFT073
uggcacaugcauaaagcggu

SEQ ID NO: 2674595 - RNA, 17 nt, Escherichia coli CFT073
uggcaccaguaaaccaa

SEQ ID NO: 2674596 - RNA, 14 nt, Escherichia coli CFT073
uggcaccaucagcu

SEQ ID NO: 2674597 - RNA, 15 nt, Escherichia coli CFT073
uggcaccaucagcuc

SEQ ID NO: 2674598 - RNA, 15 nt, Escherichia coli CFT073
uggcaccgacaucag

SEQ ID NO: 2674599 - RNA, 18 nt, Escherichia coli CFT073
uggcacuaauuaagacug

SEQ ID NO: 2674600 - RNA, 14 nt, Escherichia coli CFT073
uggcacucuuccag

SEQ ID NO: 2674601 - RNA, 22 nt, Escherichia coli CFT073
uggcacuggguucaucuuccag

SEQ ID NO: 2674602 - RNA, 21 nt, Escherichia coli CFT073
uggcacuguggucaacccaac

SEQ ID NO: 2674603 - RNA, 14 nt, Escherichia coli CFT073
uggcacuucaagau

SEQ ID NO: 2674604 - RNA, 15 nt, Escherichia coli CFT073
uggcagaccuuuugg

SEQ ID NO: 2674605 - RNA, 16 nt, Escherichia coli CFT073
uggcagacuuuuccuu

SEQ ID NO: 2674606 - RNA, 18 nt, Escherichia coli CFT073
uggcagagcgacauacag

SEQ ID NO: 2674607 - RNA, 19 nt, Escherichia coli CFT073
uggcagaguaucgccaucc

SEQ ID NO: 2674608 - RNA, 17 nt, Escherichia coli CFT073
uggcagaugaucaacga

SEQ ID NO: 2674609 - RNA, 22 nt, Escherichia coli CFT073
uggcagauugucgguuaauacg

SEQ ID NO: 2674610 - RNA, 16 nt, Escherichia coli CFT073
uggcagcaagcgcauc

SEQ ID NO: 2674611 - RNA, 17 nt, Escherichia coli CFT073
uggcagcaagcgcaucg

SEQ ID NO: 2674612 - RNA, 16 nt, Escherichia coli CFT073
uggcagcaccacgcag

SEQ ID NO: 2674613 - RNA, 18 nt, Escherichia coli CFT073
uggcagcaggaucuccag

SEQ ID NO: 2674614 - RNA, 18 nt, Escherichia coli CFT073
uggcagccauaaucacuc

SEQ ID NO: 2674615 - RNA, 23 nt, Escherichia coli CFT073
uggcagccauaaucacucuuccc

SEQ ID NO: 2674616 - RNA, 17 nt, Escherichia coli CFT073
uggcagccauuuguugg

SEQ ID NO: 2674617 - RNA, 18 nt, Escherichia coli CFT073
uggcagcuaaugccaacg

SEQ ID NO: 2674618 - RNA, 15 nt, Escherichia coli CFT073
uggcagcuuuuucag

SEQ ID NO: 2674619 - RNA, 22 nt, Escherichia coli CFT073
uggcaggccccgucagcaaaau

SEQ ID NO: 2674620 - RNA, 17 nt, Escherichia coli CFT073
uggcagggaaagaaacg

SEQ ID NO: 2674621 - RNA, 17 nt, Escherichia coli CFT073
uggcagguaauccgcau

SEQ ID NO: 2674622 - RNA, 20 nt, Escherichia coli CFT073
uggcaguagcgccucuucca

SEQ ID NO: 2674623 - RNA, 15 nt, Escherichia coli CFT073
uggcagucacuuccu

SEQ ID NO: 2674624 - RNA, 18 nt, Escherichia coli CFT073
uggcagucacuuccugau

SEQ ID NO: 2674625 - RNA, 13 nt, Escherichia coli CFT073
uggcagucuuaau

SEQ ID NO: 2674626 - RNA, 23 nt, Escherichia coli CFT073
uggcagugcgcgauaaucucauc

SEQ ID NO: 2674627 - RNA, 15 nt, Escherichia coli CFT073
uggcagugguaucaa

SEQ ID NO: 2674628 - RNA, 21 nt, Escherichia coli CFT073
uggcaguugccagcuuuuguu

SEQ ID NO: 2674629 - RNA, 19 nt, Escherichia coli CFT073
uggcauaaaagggcagcag

SEQ ID NO: 2674630 - RNA, 22 nt, Escherichia coli CFT073
uggcauaacguugcagcguuuc

SEQ ID NO: 2674631 - RNA, 22 nt, Escherichia coli CFT073
uggcauacacgucgucgccaau

SEQ ID NO: 2674632 - RNA, 14 nt, Escherichia coli CFT073
uggcauauuccgcc

SEQ ID NO: 2674633 - RNA, 19 nt, Escherichia coli CFT073
uggcaucaaugauaugugc

SEQ ID NO: 2674634 - RNA, 23 nt, Escherichia coli CFT073
uggcauccccugccccaucugcc

SEQ ID NO: 2674635 - RNA, 12 nt, Escherichia coli CFT073
uggcauccgcca

SEQ ID NO: 2674636 - RNA, 15 nt, Escherichia coli CFT073
uggcauccuguuuuc

SEQ ID NO: 2674637 - RNA, 13 nt, Escherichia coli CFT073
uggcauccuugcu

SEQ ID NO: 2674638 - RNA, 22 nt, Escherichia coli CFT073
uggcauccuugcuaaccaacaa

SEQ ID NO: 2674639 - RNA, 17 nt, Escherichia coli CFT073
uggcaucgcuucacgcg

SEQ ID NO: 2674640 - RNA, 16 nt, Escherichia coli CFT073
uggcaucggcgcacaa

SEQ ID NO: 2674641 - RNA, 19 nt, Escherichia coli CFT073
uggcaucggcgcacaaccg

SEQ ID NO: 2674642 - RNA, 14 nt, Escherichia coli CFT073
uggcaucguccguc

SEQ ID NO: 2674643 - RNA, 21 nt, Escherichia coli CFT073
uggcaucuguuaucucaacgu

SEQ ID NO: 2674644 - RNA, 24 nt, Escherichia coli CFT073
uggcauguuaccgauagauuuggu

SEQ ID NO: 2674645 - RNA, 16 nt, Escherichia coli CFT073
uggcauguuaugaaua

SEQ ID NO: 2674646 - RNA, 19 nt, Escherichia coli CFT073
uggcauuaaauucagcaaa

SEQ ID NO: 2674647 - RNA, 20 nt, Escherichia coli CFT073
uggcauuaaauucagcaaau

SEQ ID NO: 2674648 - RNA, 17 nt, Escherichia coli CFT073
uggcauuaauaugcuca

SEQ ID NO: 2674649 - RNA, 15 nt, Escherichia coli CFT073
uggcauuaccccgua

SEQ ID NO: 2674650 - RNA, 22 nt, Escherichia coli CFT073
uggcauuauuuacgcgucaguu

SEQ ID NO: 2674651 - RNA, 20 nt, Escherichia coli CFT073
uggcauuccgucaauaggca

SEQ ID NO: 2674652 - RNA, 17 nt, Escherichia coli CFT073
uggcauugguauuccag

SEQ ID NO: 2674653 - RNA, 18 nt, Escherichia coli CFT073
uggcauuugcaacaccgu

SEQ ID NO: 2674654 - RNA, 14 nt, Escherichia coli CFT073
uggcauuuuuauua

SEQ ID NO: 2674655 - RNA, 19 nt, Escherichia coli CFT073
uggcauuuuuauuaaauau

SEQ ID NO: 2674656 - RNA, 15 nt, Escherichia coli CFT073
uggccaauuggcugg

SEQ ID NO: 2674657 - RNA, 19 nt, Escherichia coli CFT073
uggccaauuggcuggcccu

SEQ ID NO: 2674658 - RNA, 20 nt, Escherichia coli CFT073
uggccaauuggcuggcccuu

SEQ ID NO: 2674659 - RNA, 14 nt, Escherichia coli CFT073
uggccagcaacagc

SEQ ID NO: 2674660 - RNA, 18 nt, Escherichia coli CFT073
uggccagcaacagcgcgu

SEQ ID NO: 2674661 - RNA, 17 nt, Escherichia coli CFT073
uggccaguuccacuucu

SEQ ID NO: 2674662 - RNA, 18 nt, Escherichia coli CFT073
uggccauaccaugacgau

SEQ ID NO: 2674663 - RNA, 17 nt, Escherichia coli CFT073
uggccaugaccaccgca

SEQ ID NO: 2674664 - RNA, 14 nt, Escherichia coli CFT073
uggccaugauuacc

SEQ ID NO: 2674665 - RNA, 19 nt, Escherichia coli CFT073
uggccaugauuaccagcau

SEQ ID NO: 2674666 - RNA, 21 nt, Escherichia coli CFT073
uggccaugauuaccagcauca

SEQ ID NO: 2674667 - RNA, 18 nt, Escherichia coli CFT073
uggccauggauucaagca

SEQ ID NO: 2674668 - RNA, 12 nt, Escherichia coli CFT073
uggcccaucauc

SEQ ID NO: 2674669 - RNA, 13 nt, Escherichia coli CFT073
uggcccaucaucu

SEQ ID NO: 2674670 - RNA, 12 nt, Escherichia coli CFT073
uggcccaugcca

SEQ ID NO: 2674671 - RNA, 18 nt, Escherichia coli CFT073
uggcccauugccagcgcu

SEQ ID NO: 2674672 - RNA, 22 nt, Escherichia coli CFT073
uggccccuggcuggucagcaau

SEQ ID NO: 2674673 - RNA, 22 nt, Escherichia coli CFT073
uggcccgcgcagcucuuuaucc

SEQ ID NO: 2674674 - RNA, 19 nt, Escherichia coli CFT073
uggccgcgcaauugcugaa

SEQ ID NO: 2674675 - RNA, 20 nt, Escherichia coli CFT073
uggccgcgcaauugcugaaa

SEQ ID NO: 2674676 - RNA, 17 nt, Escherichia coli CFT073
uggccguacccagcggu

SEQ ID NO: 2674677 - RNA, 14 nt, Escherichia coli CFT073
uggccuccagcacu

SEQ ID NO: 2674678 - RNA, 17 nt, Escherichia coli CFT073
uggccucguggaaaccg

SEQ ID NO: 2674679 - RNA, 14 nt, Escherichia coli CFT073
uggccucugccagc

SEQ ID NO: 2674680 - RNA, 13 nt, Escherichia coli CFT073
uggccugaauaac

SEQ ID NO: 2674681 - RNA, 16 nt, Escherichia coli CFT073
uggccugaauauccag

SEQ ID NO: 2674682 - RNA, 14 nt, Escherichia coli CFT073
uggccuuccggcac

SEQ ID NO: 2674683 - RNA, 20 nt, Escherichia coli CFT073
uggccuuccggcacaucgcc

SEQ ID NO: 2674684 - RNA, 15 nt, Escherichia coli CFT073
uggccuucuucaucg

SEQ ID NO: 2674685 - RNA, 16 nt, Escherichia coli CFT073
uggccuuuucacaacg

SEQ ID NO: 2674686 - RNA, 23 nt, Escherichia coli CFT073
uggcgaaauguguuggcaccauc

SEQ ID NO: 2674687 - RNA, 12 nt, Escherichia coli CFT073
uggcgaauggcg

SEQ ID NO: 2674688 - RNA, 15 nt, Escherichia coli CFT073
uggcgaauucugcag

SEQ ID NO: 2674689 - RNA, 17 nt, Escherichia coli CFT073
uggcgaauuuguucccc

SEQ ID NO: 2674690 - RNA, 20 nt, Escherichia coli CFT073
uggcgacggcgaaucaaccg

SEQ ID NO: 2674691 - RNA, 13 nt, Escherichia coli CFT073
uggcgacguacca

SEQ ID NO: 2674692 - RNA, 17 nt, Escherichia coli CFT073
uggcgacugccagccac

SEQ ID NO: 2674693 - RNA, 13 nt, Escherichia coli CFT073
uggcgagcagcaa

SEQ ID NO: 2674694 - RNA, 14 nt, Escherichia coli CFT073
uggcgaggaacgcc

SEQ ID NO: 2674695 - RNA, 21 nt, Escherichia coli CFT073
uggcgauaaaguugaagcuga

SEQ ID NO: 2674696 - RNA, 20 nt, Escherichia coli CFT073
uggcgauaaucagcgccagc

SEQ ID NO: 2674697 - RNA, 22 nt, Escherichia coli CFT073
uggcgauaaucgaaccaaacag

SEQ ID NO: 2674698 - RNA, 20 nt, Escherichia coli CFT073
uggcgauaaugaaccaauca

SEQ ID NO: 2674699 - RNA, 19 nt, Escherichia coli CFT073
uggcgauaucaauauuaag

SEQ ID NO: 2674700 - RNA, 13 nt, Escherichia coli CFT073
uggcgaugcugcg

SEQ ID NO: 2674701 - RNA, 16 nt, Escherichia coli CFT073
uggcgauguaauucag

SEQ ID NO: 2674702 - RNA, 21 nt, Escherichia coli CFT073
uggcgauucauaugcgccagc

SEQ ID NO: 2674703 - RNA, 22 nt, Escherichia coli CFT073
uggcgauugaagcagcgcugga

SEQ ID NO: 2674704 - RNA, 22 nt, Escherichia coli CFT073
uggcgcaacacccugaugugca

SEQ ID NO: 2674705 - RNA, 17 nt, Escherichia coli CFT073
uggcgcaacugcgccgc

SEQ ID NO: 2674706 - RNA, 20 nt, Escherichia coli CFT073
uggcgcaacugcgccgcgag

SEQ ID NO: 2674707 - RNA, 16 nt, Escherichia coli CFT073
uggcgcaaucaguuug

SEQ ID NO: 2674708 - RNA, 21 nt, Escherichia coli CFT073
uggcgcagcaguucgccgccg

SEQ ID NO: 2674709 - RNA, 22 nt, Escherichia coli CFT073
uggcgcaggggcagaaacaacc

SEQ ID NO: 2674710 - RNA, 22 nt, Escherichia coli CFT073
uggcgcaucagcagauaccaac

SEQ ID NO: 2674711 - RNA, 21 nt, Escherichia coli CFT073
uggcgcaucuuaucaggccua

SEQ ID NO: 2674712 - RNA, 21 nt, Escherichia coli CFT073
uggcgcauuaacucacuggcg

SEQ ID NO: 2674713 - RNA, 19 nt, Escherichia coli CFT073
uggcgcgaccaaugucagg

SEQ ID NO: 2674714 - RNA, 14 nt, Escherichia coli CFT073
uggcgcgccgauaa

SEQ ID NO: 2674715 - RNA, 17 nt, Escherichia coli CFT073
uggcgcgcgucacgaua

SEQ ID NO: 2674716 - RNA, 22 nt, Escherichia coli CFT073
uggcgcguccggcgucgcuucu

SEQ ID NO: 2674717 - RNA, 19 nt, Escherichia coli CFT073
uggcgcuacugaagcgacc

SEQ ID NO: 2674718 - RNA, 14 nt, Escherichia coli CFT073
uggcgcugcucagg

SEQ ID NO: 2674719 - RNA, 23 nt, Escherichia coli CFT073
uggcggauccguugaucgcucau

SEQ ID NO: 2674720 - RNA, 15 nt, Escherichia coli CFT073
uggcggauuacgcuc

SEQ ID NO: 2674721 - RNA, 23 nt, Escherichia coli CFT073
uggcggcagccuccugcacgguc

SEQ ID NO: 2674722 - RNA, 22 nt, Escherichia coli CFT073
uggcggcaguugcccgguuucg

SEQ ID NO: 2674723 - RNA, 18 nt, Escherichia coli CFT073
uggcggcaucugccaccg

SEQ ID NO: 2674724 - RNA, 17 nt, Escherichia coli CFT073
uggcggcuuggacgcac

SEQ ID NO: 2674725 - RNA, 21 nt, Escherichia coli CFT073
uggcgggauuuuuagcaugug

SEQ ID NO: 2674726 - RNA, 14 nt, Escherichia coli CFT073
uggcgggcuggugu

SEQ ID NO: 2674727 - RNA, 18 nt, Escherichia coli CFT073
uggcgguaguuccaccag

SEQ ID NO: 2674728 - RNA, 13 nt, Escherichia coli CFT073
uggcguaacgaca

SEQ ID NO: 2674729 - RNA, 15 nt, Escherichia coli CFT073
uggcguaguugcugc

SEQ ID NO: 2674730 - RNA, 23 nt, Escherichia coli CFT073
uggcgucagaccggcaaccagca

SEQ ID NO: 2674731 - RNA, 17 nt, Escherichia coli CFT073
uggcgucgauaucaacc

SEQ ID NO: 2674732 - RNA, 13 nt, Escherichia coli CFT073
uggcgucgcaucu

SEQ ID NO: 2674733 - RNA, 12 nt, Escherichia coli CFT073
uggcgucuccuc

SEQ ID NO: 2674734 - RNA, 18 nt, Escherichia coli CFT073
uggcgugaaagaaaauga

SEQ ID NO: 2674735 - RNA, 13 nt, Escherichia coli CFT073
uggcgugacacua

SEQ ID NO: 2674736 - RNA, 14 nt, Escherichia coli CFT073
uggcgugcgggaga

SEQ ID NO: 2674737 - RNA, 20 nt, Escherichia coli CFT073
uggcguggagcaacacgcca

SEQ ID NO: 2674738 - RNA, 21 nt, Escherichia coli CFT073
uggcgugguaucacguagcca

SEQ ID NO: 2674739 - RNA, 14 nt, Escherichia coli CFT073
uggcguucacugcc

SEQ ID NO: 2674740 - RNA, 15 nt, Escherichia coli CFT073
uggcguucacugccg

SEQ ID NO: 2674741 - RNA, 20 nt, Escherichia coli CFT073
uggcguugcaccgaggccaa

SEQ ID NO: 2674742 - RNA, 20 nt, Escherichia coli CFT073
uggcguugccguacucuuca

SEQ ID NO: 2674743 - RNA, 16 nt, Escherichia coli CFT073
uggcguuguccgccag

SEQ ID NO: 2674744 - RNA, 20 nt, Escherichia coli CFT073
uggcguuuccagcaguucca

SEQ ID NO: 2674745 - RNA, 15 nt, Escherichia coli CFT073
uggcguuuucuuuuu

SEQ ID NO: 2674746 - RNA, 11 nt, Escherichia coli CFT073
uggcucaucaa

SEQ ID NO: 2674747 - RNA, 12 nt, Escherichia coli CFT073
uggcucaucaau

SEQ ID NO: 2674748 - RNA, 15 nt, Escherichia coli CFT073
uggcucaucaauacg

SEQ ID NO: 2674749 - RNA, 20 nt, Escherichia coli CFT073
uggcuccgggugugacaaca

SEQ ID NO: 2674750 - RNA, 20 nt, Escherichia coli CFT073
uggcucguuauagguauucg

SEQ ID NO: 2674751 - RNA, 14 nt, Escherichia coli CFT073
uggcucucauccaa

SEQ ID NO: 2674752 - RNA, 22 nt, Escherichia coli CFT073
uggcugaacgccugcaccagcc

SEQ ID NO: 2674753 - RNA, 17 nt, Escherichia coli CFT073
uggcugacacuauucgc

SEQ ID NO: 2674754 - RNA, 22 nt, Escherichia coli CFT073
uggcugacacuauucgccagca

SEQ ID NO: 2674755 - RNA, 20 nt, Escherichia coli CFT073
uggcugacauaaacaccagc

SEQ ID NO: 2674756 - RNA, 19 nt, Escherichia coli CFT073
uggcugaccgucgcagcca

SEQ ID NO: 2674757 - RNA, 12 nt, Escherichia coli CFT073
uggcugauggaa

SEQ ID NO: 2674758 - RNA, 21 nt, Escherichia coli CFT073
uggcugauuaacguuuccauu

SEQ ID NO: 2674759 - RNA, 14 nt, Escherichia coli CFT073
uggcugcacuuuca

SEQ ID NO: 2674760 - RNA, 16 nt, Escherichia coli CFT073
uggcugccaugguuug

SEQ ID NO: 2674761 - RNA, 16 nt, Escherichia coli CFT073
uggcuggcgcggcgca

SEQ ID NO: 2674762 - RNA, 16 nt, Escherichia coli CFT073
uggcuguauuuuucca

SEQ ID NO: 2674763 - RNA, 19 nt, Escherichia coli CFT073
uggcuguauuuuuccagcu

SEQ ID NO: 2674764 - RNA, 19 nt, Escherichia coli CFT073
uggcuguuucgcuucuuca

SEQ ID NO: 2674765 - RNA, 22 nt, Escherichia coli CFT073
uggcuguuucgcuucuucagcc

SEQ ID NO: 2674766 - RNA, 18 nt, Escherichia coli CFT073
uggcuguuuucagcacca

SEQ ID NO: 2674767 - RNA, 18 nt, Escherichia coli CFT073
uggcuuaucuuccuguuc

SEQ ID NO: 2674768 - RNA, 17 nt, Escherichia coli CFT073
uggcuucccguagcagg

SEQ ID NO: 2674769 - RNA, 20 nt, Escherichia coli CFT073
uggcuucuuccccggaugag

SEQ ID NO: 2674770 - RNA, 15 nt, Escherichia coli CFT073
uggcuuuauaaauug

SEQ ID NO: 2674771 - RNA, 21 nt, Escherichia coli CFT073
uggcuuuaucuguacuuaaaa

SEQ ID NO: 2674772 - RNA, 17 nt, Escherichia coli CFT073
uggcuuuccaccaucac

SEQ ID NO: 2674773 - RNA, 20 nt, Escherichia coli CFT073
uggcuuuccaccaucacgcc

SEQ ID NO: 2674774 - RNA, 21 nt, Escherichia coli CFT073
uggcuuugcccuuucugcauc

SEQ ID NO: 2674775 - RNA, 19 nt, Escherichia coli CFT073
uggcuuuuuuguaguugcu

SEQ ID NO: 2674776 - RNA, 14 nt, Escherichia coli CFT073
ugggaaaugacauu

SEQ ID NO: 2674777 - RNA, 13 nt, Escherichia coli CFT073
ugggaaauggcug

SEQ ID NO: 2674778 - RNA, 22 nt, Escherichia coli CFT073
ugggaauuggcgucaguaaaug

SEQ ID NO: 2674779 - RNA, 18 nt, Escherichia coli CFT073
ugggacacauaaccaggu

SEQ ID NO: 2674780 - RNA, 23 nt, Escherichia coli CFT073
ugggagcagagcauucccgccau

SEQ ID NO: 2674781 - RNA, 20 nt, Escherichia coli CFT073
ugggauauaaacucgccaaa

SEQ ID NO: 2674782 - RNA, 16 nt, Escherichia coli CFT073
ugggaucugauuuucu

SEQ ID NO: 2674783 - RNA, 20 nt, Escherichia coli CFT073
ugggaugauagccaugaaaa

SEQ ID NO: 2674784 - RNA, 17 nt, Escherichia coli CFT073
ugggauuuggcagcacc

SEQ ID NO: 2674785 - RNA, 20 nt, Escherichia coli CFT073
ugggcaggccaggguaaaaa

SEQ ID NO: 2674786 - RNA, 20 nt, Escherichia coli CFT073
ugggccauagacgagugguu

SEQ ID NO: 2674787 - RNA, 13 nt, Escherichia coli CFT073
ugggccugauaag

SEQ ID NO: 2674788 - RNA, 13 nt, Escherichia coli CFT073
ugggcggaucugg

SEQ ID NO: 2674789 - RNA, 17 nt, Escherichia coli CFT073
ugggcggaucuggaacg

SEQ ID NO: 2674790 - RNA, 16 nt, Escherichia coli CFT073
ugggcgggaucuccac

SEQ ID NO: 2674791 - RNA, 15 nt, Escherichia coli CFT073
ugggcguuacagcug

SEQ ID NO: 2674792 - RNA, 19 nt, Escherichia coli CFT073
ugggcuaccgcgagcguag

SEQ ID NO: 2674793 - RNA, 15 nt, Escherichia coli CFT073
ugggcuccacaaaau

SEQ ID NO: 2674794 - RNA, 20 nt, Escherichia coli CFT073
ugggcugguugguaccguaa

SEQ ID NO: 2674795 - RNA, 18 nt, Escherichia coli CFT073
ugggcuucgauacugccu

SEQ ID NO: 2674796 - RNA, 17 nt, Escherichia coli CFT073
uggggaaaaaacacaaa

SEQ ID NO: 2674797 - RNA, 15 nt, Escherichia coli CFT073
uggggaaguggcgau

SEQ ID NO: 2674798 - RNA, 17 nt, Escherichia coli CFT073
uggggaucgugauaaua

SEQ ID NO: 2674799 - RNA, 18 nt, Escherichia coli CFT073
uggggauggcgcugcugc

SEQ ID NO: 2674800 - RNA, 19 nt, Escherichia coli CFT073
uggggauggcgcugcugca

SEQ ID NO: 2674801 - RNA, 18 nt, Escherichia coli CFT073
uggggauuuacgauggca

SEQ ID NO: 2674802 - RNA, 16 nt, Escherichia coli CFT073
uggggauuuccaacga

SEQ ID NO: 2674803 - RNA, 22 nt, Escherichia coli CFT073
uggggauuuccaacgaaucuuu

SEQ ID NO: 2674804 - RNA, 13 nt, Escherichia coli CFT073
uggggcaagguag

SEQ ID NO: 2674805 - RNA, 16 nt, Escherichia coli CFT073
uggggcauuuuuucca

SEQ ID NO: 2674806 - RNA, 17 nt, Escherichia coli CFT073
uggggcgucaacgcugc

SEQ ID NO: 2674807 - RNA, 23 nt, Escherichia coli CFT073
uggggcgucaacgcugccaugau

SEQ ID NO: 2674808 - RNA, 18 nt, Escherichia coli CFT073
uggggcguggaaacgccc

SEQ ID NO: 2674809 - RNA, 12 nt, Escherichia coli CFT073
uggggcuggcgg

SEQ ID NO: 2674810 - RNA, 15 nt, Escherichia coli CFT073
uggggcuuuucucug

SEQ ID NO: 2674811 - RNA, 21 nt, Escherichia coli CFT073
uggguaaagacaucgcccgau

SEQ ID NO: 2674812 - RNA, 22 nt, Escherichia coli CFT073
uggguaaccaucgauuuugcaa

SEQ ID NO: 2674813 - RNA, 21 nt, Escherichia coli CFT073
uggguagaguuugaacucaca

SEQ ID NO: 2674814 - RNA, 15 nt, Escherichia coli CFT073
uggguagcuuccugc

SEQ ID NO: 2674815 - RNA, 17 nt, Escherichia coli CFT073
ugggucuauccagugcc

SEQ ID NO: 2674816 - RNA, 16 nt, Escherichia coli CFT073
ugggugagcgaugcug

SEQ ID NO: 2674817 - RNA, 17 nt, Escherichia coli CFT073
ugggugauuaaauucag

SEQ ID NO: 2674818 - RNA, 15 nt, Escherichia coli CFT073
ugggugcaaucagua

SEQ ID NO: 2674819 - RNA, 20 nt, Escherichia coli CFT073
ugggugccggauacaaaaaa

SEQ ID NO: 2674820 - RNA, 16 nt, Escherichia coli CFT073
ugggugcuugaggcug

SEQ ID NO: 2674821 - RNA, 20 nt, Escherichia coli CFT073
ugggugugcguggguuuucc

SEQ ID NO: 2674822 - RNA, 18 nt, Escherichia coli CFT073
uggguucgauuucauuca

SEQ ID NO: 2674823 - RNA, 16 nt, Escherichia coli CFT073
uggguucuuuccugcg

SEQ ID NO: 2674824 - RNA, 15 nt, Escherichia coli CFT073
uggguuucauccugc

SEQ ID NO: 2674825 - RNA, 19 nt, Escherichia coli CFT073
ugguaaaaccgacuuaaaa

SEQ ID NO: 2674826 - RNA, 20 nt, Escherichia coli CFT073
ugguaaaaccgguuuugguu

SEQ ID NO: 2674827 - RNA, 16 nt, Escherichia coli CFT073
ugguaaacacaacgac

SEQ ID NO: 2674828 - RNA, 23 nt, Escherichia coli CFT073
ugguaaagccgauuaaucuucca

SEQ ID NO: 2674829 - RNA, 22 nt, Escherichia coli CFT073
ugguaaauggcugaccggaauu

SEQ ID NO: 2674830 - RNA, 12 nt, Escherichia coli CFT073
ugguaacaccag

SEQ ID NO: 2674831 - RNA, 18 nt, Escherichia coli CFT073
ugguaacaucaauaacaa

SEQ ID NO: 2674832 - RNA, 22 nt, Escherichia coli CFT073
ugguaacccauccagcagagau

SEQ ID NO: 2674833 - RNA, 16 nt, Escherichia coli CFT073
ugguaaccggugcaag

SEQ ID NO: 2674834 - RNA, 17 nt, Escherichia coli CFT073
ugguaacuuucuccggu

SEQ ID NO: 2674835 - RNA, 15 nt, Escherichia coli CFT073
ugguaauggcgaucg

SEQ ID NO: 2674836 - RNA, 13 nt, Escherichia coli CFT073
ugguaauucgcca

SEQ ID NO: 2674837 - RNA, 21 nt, Escherichia coli CFT073
ugguacaauggagcuaaacag

SEQ ID NO: 2674838 - RNA, 18 nt, Escherichia coli CFT073
ugguaccaugggaaaugg

SEQ ID NO: 2674839 - RNA, 12 nt, Escherichia coli CFT073
ugguaccugucg

SEQ ID NO: 2674840 - RNA, 21 nt, Escherichia coli CFT073
ugguaguugauuuuaacuauc

SEQ ID NO: 2674841 - RNA, 15 nt, Escherichia coli CFT073
ugguauaaaggguau

SEQ ID NO: 2674842 - RNA, 15 nt, Escherichia coli CFT073
ugguaucaaggcuga

SEQ ID NO: 2674843 - RNA, 13 nt, Escherichia coli CFT073
ugguaucaauauc

SEQ ID NO: 2674844 - RNA, 19 nt, Escherichia coli CFT073
ugguaucgcgccagccagu

SEQ ID NO: 2674845 - RNA, 18 nt, Escherichia coli CFT073
ugguaugccauccggcuc

SEQ ID NO: 2674846 - RNA, 21 nt, Escherichia coli CFT073
ugguauggcugucgcacggcg

SEQ ID NO: 2674847 - RNA, 21 nt, Escherichia coli CFT073
ugguauuaagccaguucucac

SEQ ID NO: 2674848 - RNA, 16 nt, Escherichia coli CFT073
ugguauugcagcucug

SEQ ID NO: 2674849 - RNA, 18 nt, Escherichia coli CFT073
ugguauuugccuuaugga

SEQ ID NO: 2674850 - RNA, 13 nt, Escherichia coli CFT073
uggucaaacugag

SEQ ID NO: 2674851 - RNA, 16 nt, Escherichia coli CFT073
uggucaccacaccgac

SEQ ID NO: 2674852 - RNA, 12 nt, Escherichia coli CFT073
uggucaccacgg

SEQ ID NO: 2674853 - RNA, 14 nt, Escherichia coli CFT073
uggucagaacgacc

SEQ ID NO: 2674854 - RNA, 16 nt, Escherichia coli CFT073
uggucagaucagccac

SEQ ID NO: 2674855 - RNA, 12 nt, Escherichia coli CFT073
uggucagcaucg

SEQ ID NO: 2674856 - RNA, 13 nt, Escherichia coli CFT073
uggucaggaaugg

SEQ ID NO: 2674857 - RNA, 20 nt, Escherichia coli CFT073
uggucaguuaacaauaacaa

SEQ ID NO: 2674858 - RNA, 17 nt, Escherichia coli CFT073
uggucaguuuaaacaga

SEQ ID NO: 2674859 - RNA, 19 nt, Escherichia coli CFT073
uggucaguuuaaacagaau

SEQ ID NO: 2674860 - RNA, 18 nt, Escherichia coli CFT073
uggucaucaucaggaaca

SEQ ID NO: 2674861 - RNA, 14 nt, Escherichia coli CFT073
uggucaucaucauu

SEQ ID NO: 2674862 - RNA, 16 nt, Escherichia coli CFT073
ugguccacacgcgccc

SEQ ID NO: 2674863 - RNA, 14 nt, Escherichia coli CFT073
ugguccgauuguac

SEQ ID NO: 2674864 - RNA, 21 nt, Escherichia coli CFT073
ugguccgauuguacuuuaaaa

SEQ ID NO: 2674865 - RNA, 20 nt, Escherichia coli CFT073
uggucgcaucauccgucggc

SEQ ID NO: 2674866 - RNA, 22 nt, Escherichia coli CFT073
uggucgcggaccaacaaaaauc

SEQ ID NO: 2674867 - RNA, 13 nt, Escherichia coli CFT073
uggucgcguagcc

SEQ ID NO: 2674868 - RNA, 19 nt, Escherichia coli CFT073
uggucggaaaaguaaacca

SEQ ID NO: 2674869 - RNA, 16 nt, Escherichia coli CFT073
uggucggaucguucuc

SEQ ID NO: 2674870 - RNA, 23 nt, Escherichia coli CFT073
uggucggcgagauauucccccac

SEQ ID NO: 2674871 - RNA, 17 nt, Escherichia coli CFT073
uggucgguaaacaucag

SEQ ID NO: 2674872 - RNA, 17 nt, Escherichia coli CFT073
uggucgguuaacuccac

SEQ ID NO: 2674873 - RNA, 16 nt, Escherichia coli CFT073
uggucgguuucagcca

SEQ ID NO: 2674874 - RNA, 21 nt, Escherichia coli CFT073
uggucuucauagauagccagc

SEQ ID NO: 2674875 - RNA, 22 nt, Escherichia coli CFT073
uggucuucauagauagccagca

SEQ ID NO: 2674876 - RNA, 18 nt, Escherichia coli CFT073
uggugaacgacacacagu

SEQ ID NO: 2674877 - RNA, 21 nt, Escherichia coli CFT073
uggugaauuugucgauuucca

SEQ ID NO: 2674878 - RNA, 15 nt, Escherichia coli CFT073
uggugacaccaugcc

SEQ ID NO: 2674879 - RNA, 20 nt, Escherichia coli CFT073
uggugacuuuugcccggcau

SEQ ID NO: 2674880 - RNA, 13 nt, Escherichia coli CFT073
uggugagcgcaca

SEQ ID NO: 2674881 - RNA, 22 nt, Escherichia coli CFT073
uggugccagauuuaacggcagc

SEQ ID NO: 2674882 - RNA, 19 nt, Escherichia coli CFT073
uggugccgggaauauuuac

SEQ ID NO: 2674883 - RNA, 22 nt, Escherichia coli CFT073
uggugccugcacugguggcacc

SEQ ID NO: 2674884 - RNA, 15 nt, Escherichia coli CFT073
uggugcgaaucaggu

SEQ ID NO: 2674885 - RNA, 16 nt, Escherichia coli CFT073
uggugcgauuaccaug

SEQ ID NO: 2674886 - RNA, 14 nt, Escherichia coli CFT073
uggugcgcaccagg

SEQ ID NO: 2674887 - RNA, 21 nt, Escherichia coli CFT073
uggugcuaauugcaccauccc

SEQ ID NO: 2674888 - RNA, 17 nt, Escherichia coli CFT073
uggugcuaauuugaaau

SEQ ID NO: 2674889 - RNA, 18 nt, Escherichia coli CFT073
uggugcuaauuugaaaug

SEQ ID NO: 2674890 - RNA, 17 nt, Escherichia coli CFT073
uggugcuguuuucuccc

SEQ ID NO: 2674891 - RNA, 19 nt, Escherichia coli CFT073
uggugcuugccagagcagc

SEQ ID NO: 2674892 - RNA, 20 nt, Escherichia coli CFT073
uggugcuugccagagcagca

SEQ ID NO: 2674893 - RNA, 18 nt, Escherichia coli CFT073
ugguggcaggcaaaaaug

SEQ ID NO: 2674894 - RNA, 12 nt, Escherichia coli CFT073
ugguggcgucau

SEQ ID NO: 2674895 - RNA, 21 nt, Escherichia coli CFT073
ugguggucugguaacgaucgu

SEQ ID NO: 2674896 - RNA, 16 nt, Escherichia coli CFT073
uggugguucagauaaa

SEQ ID NO: 2674897 - RNA, 15 nt, Escherichia coli CFT073
ugguguaaccuucac

SEQ ID NO: 2674898 - RNA, 20 nt, Escherichia coli CFT073
ugguguuauaggccccagcc

SEQ ID NO: 2674899 - RNA, 17 nt, Escherichia coli CFT073
ugguuaaauaauauuuc

SEQ ID NO: 2674900 - RNA, 17 nt, Escherichia coli CFT073
ugguuaaauuuaauauc

SEQ ID NO: 2674901 - RNA, 12 nt, Escherichia coli CFT073
ugguuacacggg

SEQ ID NO: 2674902 - RNA, 18 nt, Escherichia coli CFT073
ugguuaccaguaaccaga

SEQ ID NO: 2674903 - RNA, 18 nt, Escherichia coli CFT073
ugguuaccgaauccagca

SEQ ID NO: 2674904 - RNA, 21 nt, Escherichia coli CFT073
ugguuacgcaagccagguaaa

SEQ ID NO: 2674905 - RNA, 21 nt, Escherichia coli CFT073
ugguuagagcacaucacucau

SEQ ID NO: 2674906 - RNA, 19 nt, Escherichia coli CFT073
ugguuagcggcgguaaaau

SEQ ID NO: 2674907 - RNA, 23 nt, Escherichia coli CFT073
ugguuagcggcgguaaaaucauc

SEQ ID NO: 2674908 - RNA, 17 nt, Escherichia coli CFT073
ugguuaguuagcagauu

SEQ ID NO: 2674909 - RNA, 19 nt, Escherichia coli CFT073
ugguuauuaccaaaaacgg

SEQ ID NO: 2674910 - RNA, 13 nt, Escherichia coli CFT073
ugguuauucaaag

SEQ ID NO: 2674911 - RNA, 22 nt, Escherichia coli CFT073
ugguucagacgccacuuuuuuc

SEQ ID NO: 2674912 - RNA, 22 nt, Escherichia coli CFT073
ugguuccauucaaggacaaacc

SEQ ID NO: 2674913 - RNA, 16 nt, Escherichia coli CFT073
ugguucccaacaacag

SEQ ID NO: 2674914 - RNA, 16 nt, Escherichia coli CFT073
ugguucccgaugcugu

SEQ ID NO: 2674915 - RNA, 23 nt, Escherichia coli CFT073
ugguucccugaccugccauccac

SEQ ID NO: 2674916 - RNA, 16 nt, Escherichia coli CFT073
ugguucugcacagcuu

SEQ ID NO: 2674917 - RNA, 18 nt, Escherichia coli CFT073
ugguugcgucuuaucagg

SEQ ID NO: 2674918 - RNA, 16 nt, Escherichia coli CFT073
ugguugguuucaaaga

SEQ ID NO: 2674919 - RNA, 13 nt, Escherichia coli CFT073
ugguuguaaucca

SEQ ID NO: 2674920 - RNA, 15 nt, Escherichia coli CFT073
ugguuguaauccacc

SEQ ID NO: 2674921 - RNA, 24 nt, Escherichia coli CFT073
ugguugucgaaguacgcaguaaau

SEQ ID NO: 2674922 - RNA, 16 nt, Escherichia coli CFT073
ugguuuaccaccagcg

SEQ ID NO: 2674923 - RNA, 23 nt, Escherichia coli CFT073
ugguuuauuucccggauggcaac

SEQ ID NO: 2674924 - RNA, 14 nt, Escherichia coli CFT073
ugguuucaauacuc

SEQ ID NO: 2674925 - RNA, 14 nt, Escherichia coli CFT073
ugguuugcauccac

SEQ ID NO: 2674926 - RNA, 17 nt, Escherichia coli CFT073
ugguuugcauccacaac

SEQ ID NO: 2674927 - RNA, 14 nt, Escherichia coli CFT073
ugguuuggaucugu

SEQ ID NO: 2674928 - RNA, 22 nt, Escherichia coli CFT073
ugguuuuaacgaaucgggcaac

SEQ ID NO: 2674929 - RNA, 17 nt, Escherichia coli CFT073
ugguuuugcuuuauuaa

SEQ ID NO: 2674930 - RNA, 22 nt, Escherichia coli CFT073
uguaaaaacgcuuugcugccuu

SEQ ID NO: 2674931 - RNA, 14 nt, Escherichia coli CFT073
uguaaaacagccaa

SEQ ID NO: 2674932 - RNA, 13 nt, Escherichia coli CFT073
uguaaacccagcc

SEQ ID NO: 2674933 - RNA, 22 nt, Escherichia coli CFT073
uguaaagagugugaauauucag

SEQ ID NO: 2674934 - RNA, 14 nt, Escherichia coli CFT073
uguaaaguacgugu

SEQ ID NO: 2674935 - RNA, 14 nt, Escherichia coli CFT073
uguaaagugaaaua

SEQ ID NO: 2674936 - RNA, 16 nt, Escherichia coli CFT073
uguaaagugaaauauu

SEQ ID NO: 2674937 - RNA, 16 nt, Escherichia coli CFT073
uguaaauaucaggauc

SEQ ID NO: 2674938 - RNA, 19 nt, Escherichia coli CFT073
uguaaaucgcuguuguucu

SEQ ID NO: 2674939 - RNA, 14 nt, Escherichia coli CFT073
uguaaaugcaaauu

SEQ ID NO: 2674940 - RNA, 20 nt, Escherichia coli CFT073
uguaacaguugcaguuauua

SEQ ID NO: 2674941 - RNA, 15 nt, Escherichia coli CFT073
uguaacauaccuaaa

SEQ ID NO: 2674942 - RNA, 16 nt, Escherichia coli CFT073
uguaacccaccaugcc

SEQ ID NO: 2674943 - RNA, 17 nt, Escherichia coli CFT073
uguaaccuaauuuauua

SEQ ID NO: 2674944 - RNA, 12 nt, Escherichia coli CFT073
uguaacgauggc

SEQ ID NO: 2674945 - RNA, 14 nt, Escherichia coli CFT073
uguaacgauggcga

SEQ ID NO: 2674946 - RNA, 17 nt, Escherichia coli CFT073
uguaacguuuggcacgc

SEQ ID NO: 2674947 - RNA, 20 nt, Escherichia coli CFT073
uguaacucaggaacuuagua

SEQ ID NO: 2674948 - RNA, 17 nt, Escherichia coli CFT073
uguaacucgaauuauuc

SEQ ID NO: 2674949 - RNA, 20 nt, Escherichia coli CFT073
uguaacucgaauuauucaga

SEQ ID NO: 2674950 - RNA, 21 nt, Escherichia coli CFT073
uguaagacauuuaacccuuca

SEQ ID NO: 2674951 - RNA, 13 nt, Escherichia coli CFT073
uguaagcagggcc

SEQ ID NO: 2674952 - RNA, 15 nt, Escherichia coli CFT073
uguaagccucuuuca

SEQ ID NO: 2674953 - RNA, 18 nt, Escherichia coli CFT073
uguaagggcuaaucugaa

SEQ ID NO: 2674954 - RNA, 12 nt, Escherichia coli CFT073
uguaagucugaa

SEQ ID NO: 2674955 - RNA, 22 nt, Escherichia coli CFT073
uguaagucugaaucagucccug

SEQ ID NO: 2674956 - RNA, 20 nt, Escherichia coli CFT073
uguaaguuacuaaaaguaaa

SEQ ID NO: 2674957 - RNA, 15 nt, Escherichia coli CFT073
uguaauacaaacuca

SEQ ID NO: 2674958 - RNA, 23 nt, Escherichia coli CFT073
uguaauacaaacucacugccagc

SEQ ID NO: 2674959 - RNA, 12 nt, Escherichia coli CFT073
uguaauaugcag

SEQ ID NO: 2674960 - RNA, 14 nt, Escherichia coli CFT073
uguaaucaacaaaa

SEQ ID NO: 2674961 - RNA, 17 nt, Escherichia coli CFT073
uguaaucaacaaaagug

SEQ ID NO: 2674962 - RNA, 15 nt, Escherichia coli CFT073
uguaaugacaacauu

SEQ ID NO: 2674963 - RNA, 17 nt, Escherichia coli CFT073
uguaaugcagguccacg

SEQ ID NO: 2674964 - RNA, 18 nt, Escherichia coli CFT073
uguaauuaaauuaucaac

SEQ ID NO: 2674965 - RNA, 21 nt, Escherichia coli CFT073
uguaauucgccgucgucgauu

SEQ ID NO: 2674966 - RNA, 23 nt, Escherichia coli CFT073
uguaauuucacaccaucaacaaa

SEQ ID NO: 2674967 - RNA, 12 nt, Escherichia coli CFT073
uguaauuucagc

SEQ ID NO: 2674968 - RNA, 11 nt, Escherichia coli CFT073
uguacacuucc

SEQ ID NO: 2674969 - RNA, 14 nt, Escherichia coli CFT073
uguacacuucccag

SEQ ID NO: 2674970 - RNA, 16 nt, Escherichia coli CFT073
uguacaggauauauuu

SEQ ID NO: 2674971 - RNA, 14 nt, Escherichia coli CFT073
uguacaucgcgcca

SEQ ID NO: 2674972 - RNA, 14 nt, Escherichia coli CFT073
uguacaugcugcuu

SEQ ID NO: 2674973 - RNA, 12 nt, Escherichia coli CFT073
uguaccacccug

SEQ ID NO: 2674974 - RNA, 14 nt, Escherichia coli CFT073
uguaccguacagau

SEQ ID NO: 2674975 - RNA, 16 nt, Escherichia coli CFT073
uguaccugucgggaca

SEQ ID NO: 2674976 - RNA, 18 nt, Escherichia coli CFT073
uguacgcucauccugugg

SEQ ID NO: 2674977 - RNA, 21 nt, Escherichia coli CFT073
uguacuaaccaugcgcccauc

SEQ ID NO: 2674978 - RNA, 15 nt, Escherichia coli CFT073
uguacuguuacucau

SEQ ID NO: 2674979 - RNA, 14 nt, Escherichia coli CFT073
uguagacagcaucg

SEQ ID NO: 2674980 - RNA, 22 nt, Escherichia coli CFT073
uguagacagcaucgaccaugcu

SEQ ID NO: 2674981 - RNA, 17 nt, Escherichia coli CFT073
uguagauauuaaagcca

SEQ ID NO: 2674982 - RNA, 15 nt, Escherichia coli CFT073
uguagauauucuucc

SEQ ID NO: 2674983 - RNA, 16 nt, Escherichia coli CFT073
uguagauuuugcagau

SEQ ID NO: 2674984 - RNA, 19 nt, Escherichia coli CFT073
uguagauuuugcagaucac

SEQ ID NO: 2674985 - RNA, 15 nt, Escherichia coli CFT073
uguagcccaucaggu

SEQ ID NO: 2674986 - RNA, 20 nt, Escherichia coli CFT073
uguagcgauuucacgcucag

SEQ ID NO: 2674987 - RNA, 17 nt, Escherichia coli CFT073
uguagcgugcggcggcu

SEQ ID NO: 2674988 - RNA, 13 nt, Escherichia coli CFT073
uguagcuaaacug

SEQ ID NO: 2674989 - RNA, 22 nt, Escherichia coli CFT073
uguagcuaaacugaucuuuauc

SEQ ID NO: 2674990 - RNA, 13 nt, Escherichia coli CFT073
uguagcucaucug

SEQ ID NO: 2674991 - RNA, 20 nt, Escherichia coli CFT073
uguagcucgccuacaucgac

SEQ ID NO: 2674992 - RNA, 15 nt, Escherichia coli CFT073
uguaggcauacacau

SEQ ID NO: 2674993 - RNA, 17 nt, Escherichia coli CFT073
uguaggcauacacauca

SEQ ID NO: 2674994 - RNA, 18 nt, Escherichia coli CFT073
uguaggcauacacaucac

SEQ ID NO: 2674995 - RNA, 21 nt, Escherichia coli CFT073
uguaggcauauuugguaucaa

SEQ ID NO: 2674996 - RNA, 20 nt, Escherichia coli CFT073
uguaggccggacaaggcgcu

SEQ ID NO: 2674997 - RNA, 13 nt, Escherichia coli CFT073
uguaggccggaua

SEQ ID NO: 2674998 - RNA, 19 nt, Escherichia coli CFT073
uguaggccggauaaggcgu

SEQ ID NO: 2674999 - RNA, 20 nt, Escherichia coli CFT073
uguaggccggauaagguguu

SEQ ID NO: 2675000 - RNA, 20 nt, Escherichia coli CFT073
uguaggccugauaagcguag

SEQ ID NO: 2675001 - RNA, 20 nt, Escherichia coli CFT073
uguaggccugauaaggcauu

SEQ ID NO: 2675002 - RNA, 14 nt, Escherichia coli CFT073
uguaggguggggaa

SEQ ID NO: 2675003 - RNA, 12 nt, Escherichia coli CFT073
uguagguaaaac

SEQ ID NO: 2675004 - RNA, 14 nt, Escherichia coli CFT073
uguaggucggauaa

SEQ ID NO: 2675005 - RNA, 18 nt, Escherichia coli CFT073
uguaggucggauaagacg

SEQ ID NO: 2675006 - RNA, 20 nt, Escherichia coli CFT073
uguaggucggauaagacgcg

SEQ ID NO: 2675007 - RNA, 20 nt, Escherichia coli CFT073
uguaggucggauaaggcguu

SEQ ID NO: 2675008 - RNA, 20 nt, Escherichia coli CFT073
uguaguauuugaguucacug

SEQ ID NO: 2675009 - RNA, 15 nt, Escherichia coli CFT073
uguagucugaauuga

SEQ ID NO: 2675010 - RNA, 22 nt, Escherichia coli CFT073
uguagugauccugcauacugac

SEQ ID NO: 2675011 - RNA, 17 nt, Escherichia coli CFT073
uguaguguuuuauacca

SEQ ID NO: 2675012 - RNA, 12 nt, Escherichia coli CFT073
uguaguuaaaaa

SEQ ID NO: 2675013 - RNA, 13 nt, Escherichia coli CFT073
uguaguuaaaaaa

SEQ ID NO: 2675014 - RNA, 22 nt, Escherichia coli CFT073
uguaguuaaaaaaugcagcaaa

SEQ ID NO: 2675015 - RNA, 14 nt, Escherichia coli CFT073
uguaguuacauuuu

SEQ ID NO: 2675016 - RNA, 14 nt, Escherichia coli CFT073
uguaguuauccgca

SEQ ID NO: 2675017 - RNA, 22 nt, Escherichia coli CFT073
uguauacaaaaucuguacagga

SEQ ID NO: 2675018 - RNA, 15 nt, Escherichia coli CFT073
uguauaccgggcuuu

SEQ ID NO: 2675019 - RNA, 18 nt, Escherichia coli CFT073
uguauauuauccaucaaa

SEQ ID NO: 2675020 - RNA, 12 nt, Escherichia coli CFT073
uguaucccagcc

SEQ ID NO: 2675021 - RNA, 22 nt, Escherichia coli CFT073
uguauccggcaugaacaaaaca

SEQ ID NO: 2675022 - RNA, 15 nt, Escherichia coli CFT073
uguaucgaugcuguu

SEQ ID NO: 2675023 - RNA, 22 nt, Escherichia coli CFT073
uguaucgaugcuguuauacaca

SEQ ID NO: 2675024 - RNA, 17 nt, Escherichia coli CFT073
uguaucgcccuuaccau

SEQ ID NO: 2675025 - RNA, 21 nt, Escherichia coli CFT073
uguaucuucgccguguucuua

SEQ ID NO: 2675026 - RNA, 16 nt, Escherichia coli CFT073
uguaucuuucaucauu

SEQ ID NO: 2675027 - RNA, 22 nt, Escherichia coli CFT073
uguaugguauaucguuuuucau

SEQ ID NO: 2675028 - RNA, 12 nt, Escherichia coli CFT073
uguaugguuuug

SEQ ID NO: 2675029 - RNA, 11 nt, Escherichia coli CFT073
uguauuaauac

SEQ ID NO: 2675030 - RNA, 21 nt, Escherichia coli CFT073
uguauucuuugaucgccgcca

SEQ ID NO: 2675031 - RNA, 16 nt, Escherichia coli CFT073
uguauuguucgugcaa

SEQ ID NO: 2675032 - RNA, 18 nt, Escherichia coli CFT073
uguauuugaauuucaaau

SEQ ID NO: 2675033 - RNA, 20 nt, Escherichia coli CFT073
ugucaacagcguuucuucga

SEQ ID NO: 2675034 - RNA, 14 nt, Escherichia coli CFT073
ugucaauaaacgcc

SEQ ID NO: 2675035 - RNA, 15 nt, Escherichia coli CFT073
ugucaauaaacgccu

SEQ ID NO: 2675036 - RNA, 15 nt, Escherichia coli CFT073
ugucaaucagggcga

SEQ ID NO: 2675037 - RNA, 18 nt, Escherichia coli CFT073
ugucacaaucccuuccac

SEQ ID NO: 2675038 - RNA, 19 nt, Escherichia coli CFT073
ugucacaaucccuuccacc

SEQ ID NO: 2675039 - RNA, 22 nt, Escherichia coli CFT073
ugucaccaaucugaaaccagcg

SEQ ID NO: 2675040 - RNA, 15 nt, Escherichia coli CFT073
ugucaccagccgguc

SEQ ID NO: 2675041 - RNA, 21 nt, Escherichia coli CFT073
ugucaccagccggucauuggc

SEQ ID NO: 2675042 - RNA, 14 nt, Escherichia coli CFT073
ugucacuggccagc

SEQ ID NO: 2675043 - RNA, 13 nt, Escherichia coli CFT073
ugucagaaagaaa

SEQ ID NO: 2675044 - RNA, 14 nt, Escherichia coli CFT073
ugucagaaagaaau

SEQ ID NO: 2675045 - RNA, 16 nt, Escherichia coli CFT073
ugucagaagaaaaaau

SEQ ID NO: 2675046 - RNA, 22 nt, Escherichia coli CFT073
ugucagaagaaaaaaugcugca

SEQ ID NO: 2675047 - RNA, 21 nt, Escherichia coli CFT073
ugucagacggugccagguaau

SEQ ID NO: 2675048 - RNA, 15 nt, Escherichia coli CFT073
ugucagaugcggcgu

SEQ ID NO: 2675049 - RNA, 20 nt, Escherichia coli CFT073
ugucagcaaaauaacaggga

SEQ ID NO: 2675050 - RNA, 21 nt, Escherichia coli CFT073
ugucagcaucgcauccggcac

SEQ ID NO: 2675051 - RNA, 20 nt, Escherichia coli CFT073
ugucagcccuucccggugcg

SEQ ID NO: 2675052 - RNA, 16 nt, Escherichia coli CFT073
ugucagggacguacca

SEQ ID NO: 2675053 - RNA, 22 nt, Escherichia coli CFT073
ugucagggacguaccaaugacc

SEQ ID NO: 2675054 - RNA, 13 nt, Escherichia coli CFT073
ugucaguaauugc

SEQ ID NO: 2675055 - RNA, 14 nt, Escherichia coli CFT073
ugucagucugcuuu

SEQ ID NO: 2675056 - RNA, 20 nt, Escherichia coli CFT073
ugucaguugcauaccauuca

SEQ ID NO: 2675057 - RNA, 14 nt, Escherichia coli CFT073
ugucaguuggcugu

SEQ ID NO: 2675058 - RNA, 16 nt, Escherichia coli CFT073
ugucauacgagucgcc

SEQ ID NO: 2675059 - RNA, 13 nt, Escherichia coli CFT073
ugucauagcaaua

SEQ ID NO: 2675060 - RNA, 14 nt, Escherichia coli CFT073
ugucaucauugguu

SEQ ID NO: 2675061 - RNA, 15 nt, Escherichia coli CFT073
ugucaucgacaucaa

SEQ ID NO: 2675062 - RNA, 22 nt, Escherichia coli CFT073
ugucauguauauuauccaucaa

SEQ ID NO: 2675063 - RNA, 16 nt, Escherichia coli CFT073
ugucauuaccacaaca

SEQ ID NO: 2675064 - RNA, 18 nt, Escherichia coli CFT073
ugucauuaccacaacaaa

SEQ ID NO: 2675065 - RNA, 22 nt, Escherichia coli CFT073
ugucauucgccugacgcaauaa

SEQ ID NO: 2675066 - RNA, 13 nt, Escherichia coli CFT073
ugucauuguuaua

SEQ ID NO: 2675067 - RNA, 11 nt, Escherichia coli CFT073
uguccaaaugc

SEQ ID NO: 2675068 - RNA, 15 nt, Escherichia coli CFT073
uguccaaaugcagca

SEQ ID NO: 2675069 - RNA, 17 nt, Escherichia coli CFT073
uguccaccguugugaaa

SEQ ID NO: 2675070 - RNA, 12 nt, Escherichia coli CFT073
uguccacuuccg

SEQ ID NO: 2675071 - RNA, 18 nt, Escherichia coli CFT073
uguccagaucgggccugg

SEQ ID NO: 2675072 - RNA, 15 nt, Escherichia coli CFT073
uguccagaugcugua

SEQ ID NO: 2675073 - RNA, 15 nt, Escherichia coli CFT073
uguccagcuuaauuc

SEQ ID NO: 2675074 - RNA, 16 nt, Escherichia coli CFT073
uguccauaaauuauag

SEQ ID NO: 2675075 - RNA, 17 nt, Escherichia coli CFT073
uguccauaccggacucc

SEQ ID NO: 2675076 - RNA, 12 nt, Escherichia coli CFT073
uguccauauuuc

SEQ ID NO: 2675077 - RNA, 21 nt, Escherichia coli CFT073
uguccaucgcuacaggcuauc

SEQ ID NO: 2675078 - RNA, 14 nt, Escherichia coli CFT073
uguccauuaauacc

SEQ ID NO: 2675079 - RNA, 23 nt, Escherichia coli CFT073
uguccauuaauacccgggucauc

SEQ ID NO: 2675080 - RNA, 21 nt, Escherichia coli CFT073
ugucccaaaaugucggaugcg

SEQ ID NO: 2675081 - RNA, 21 nt, Escherichia coli CFT073
uguccgauuuguucucuucug

SEQ ID NO: 2675082 - RNA, 22 nt, Escherichia coli CFT073
uguccgcauccccuacucucug

SEQ ID NO: 2675083 - RNA, 21 nt, Escherichia coli CFT073
uguccgccagggcggacugau

SEQ ID NO: 2675084 - RNA, 14 nt, Escherichia coli CFT073
uguccggcaauaaa

SEQ ID NO: 2675085 - RNA, 15 nt, Escherichia coli CFT073
uguccggucgccauu

SEQ ID NO: 2675086 - RNA, 16 nt, Escherichia coli CFT073
uguccuauuggagaau

SEQ ID NO: 2675087 - RNA, 22 nt, Escherichia coli CFT073
uguccuuccaguaaccagccgu

SEQ ID NO: 2675088 - RNA, 23 nt, Escherichia coli CFT073
ugucgacaaagccgcaggcgugc

SEQ ID NO: 2675089 - RNA, 17 nt, Escherichia coli CFT073
ugucgacauagccaucc

SEQ ID NO: 2675090 - RNA, 19 nt, Escherichia coli CFT073
ugucgacggaauaaaccca

SEQ ID NO: 2675091 - RNA, 21 nt, Escherichia coli CFT073
ugucgaggccaauuuggcugc

SEQ ID NO: 2675092 - RNA, 17 nt, Escherichia coli CFT073
ugucgauuaucgacucg

SEQ ID NO: 2675093 - RNA, 16 nt, Escherichia coli CFT073
ugucgauuuguacucu

SEQ ID NO: 2675094 - RNA, 15 nt, Escherichia coli CFT073
ugucgcauccggcaa

SEQ ID NO: 2675095 - RNA, 22 nt, Escherichia coli CFT073
ugucgcauccggcaauuggugc

SEQ ID NO: 2675096 - RNA, 20 nt, Escherichia coli CFT073
ugucgccaucguuaaaaaac

SEQ ID NO: 2675097 - RNA, 21 nt, Escherichia coli CFT073
ugucgccaucguuaaaaaaca

SEQ ID NO: 2675098 - RNA, 12 nt, Escherichia coli CFT073
ugucgccugcag

SEQ ID NO: 2675099 - RNA, 14 nt, Escherichia coli CFT073
ugucgcgcagcacu

SEQ ID NO: 2675100 - RNA, 21 nt, Escherichia coli CFT073
ugucgcgcagcacuugcagcc

SEQ ID NO: 2675101 - RNA, 16 nt, Escherichia coli CFT073
ugucgcuauucaacgu

SEQ ID NO: 2675102 - RNA, 17 nt, Escherichia coli CFT073
ugucgcugcacuuucuc

SEQ ID NO: 2675103 - RNA, 21 nt, Escherichia coli CFT073
ugucgcugucggucaaauuca

SEQ ID NO: 2675104 - RNA, 20 nt, Escherichia coli CFT073
ugucggacuucaguuucuuc

SEQ ID NO: 2675105 - RNA, 15 nt, Escherichia coli CFT073
ugucggaugcggcgu

SEQ ID NO: 2675106 - RNA, 15 nt, Escherichia coli CFT073
ugucggcaagauacu

SEQ ID NO: 2675107 - RNA, 15 nt, Escherichia coli CFT073
ugucguaagcgccaa

SEQ ID NO: 2675108 - RNA, 14 nt, Escherichia coli CFT073
ugucguccgguacg

SEQ ID NO: 2675109 - RNA, 23 nt, Escherichia coli CFT073
ugucguccgguacgacaaucuca

SEQ ID NO: 2675110 - RNA, 16 nt, Escherichia coli CFT073
ugucgugguacugccg

SEQ ID NO: 2675111 - RNA, 17 nt, Escherichia coli CFT073
ugucgugguacugccgg

SEQ ID NO: 2675112 - RNA, 15 nt, Escherichia coli CFT073
ugucuaccagcaccu

SEQ ID NO: 2675113 - RNA, 15 nt, Escherichia coli CFT073
ugucucaaaacugaa

SEQ ID NO: 2675114 - RNA, 19 nt, Escherichia coli CFT073
ugucugagauuacauuggg

SEQ ID NO: 2675115 - RNA, 22 nt, Escherichia coli CFT073
ugucugaugcgacgcggcagcg

SEQ ID NO: 2675116 - RNA, 17 nt, Escherichia coli CFT073
ugucugccacaccugcc

SEQ ID NO: 2675117 - RNA, 12 nt, Escherichia coli CFT073
ugucugccauau

SEQ ID NO: 2675118 - RNA, 15 nt, Escherichia coli CFT073
ugucugccauauguc

SEQ ID NO: 2675119 - RNA, 16 nt, Escherichia coli CFT073
ugucugccauaugucc

SEQ ID NO: 2675120 - RNA, 15 nt, Escherichia coli CFT073
ugucugcugugugau

SEQ ID NO: 2675121 - RNA, 21 nt, Escherichia coli CFT073
ugucuggaaauuaagcggcaa

SEQ ID NO: 2675122 - RNA, 15 nt, Escherichia coli CFT073
ugucuggcauaaaag

SEQ ID NO: 2675123 - RNA, 19 nt, Escherichia coli CFT073
ugucuggcguuaagcauuc

SEQ ID NO: 2675124 - RNA, 15 nt, Escherichia coli CFT073
ugucugucagucugc

SEQ ID NO: 2675125 - RNA, 16 nt, Escherichia coli CFT073
ugucuuaucaggucaa

SEQ ID NO: 2675126 - RNA, 20 nt, Escherichia coli CFT073
ugucuucaucgaugcugcuc

SEQ ID NO: 2675127 - RNA, 15 nt, Escherichia coli CFT073
ugucuugccucccug

SEQ ID NO: 2675128 - RNA, 15 nt, Escherichia coli CFT073
ugucuuuacccggac

SEQ ID NO: 2675129 - RNA, 14 nt, Escherichia coli CFT073
ugucuuucaacaga

SEQ ID NO: 2675130 - RNA, 12 nt, Escherichia coli CFT073
ugugaaaauaac

SEQ ID NO: 2675131 - RNA, 21 nt, Escherichia coli CFT073
ugugaaaccuuuaugcagcuc

SEQ ID NO: 2675132 - RNA, 19 nt, Escherichia coli CFT073
ugugaagaauaaauuuggg

SEQ ID NO: 2675133 - RNA, 19 nt, Escherichia coli CFT073
ugugaaggggcgcaauuaa

SEQ ID NO: 2675134 - RNA, 20 nt, Escherichia coli CFT073
ugugaaggugauucccagca

SEQ ID NO: 2675135 - RNA, 14 nt, Escherichia coli CFT073
ugugaaugaccagg

SEQ ID NO: 2675136 - RNA, 17 nt, Escherichia coli CFT073
ugugacaacaacaucac

SEQ ID NO: 2675137 - RNA, 13 nt, Escherichia coli CFT073
ugugacagcagcg

SEQ ID NO: 2675138 - RNA, 16 nt, Escherichia coli CFT073
ugugacagcagcggca

SEQ ID NO: 2675139 - RNA, 18 nt, Escherichia coli CFT073
ugugacagcagcggcaga

SEQ ID NO: 2675140 - RNA, 18 nt, Escherichia coli CFT073
ugugacauccagaucacg

SEQ ID NO: 2675141 - RNA, 15 nt, Escherichia coli CFT073
ugugaccccaucauu

SEQ ID NO: 2675142 - RNA, 18 nt, Escherichia coli CFT073
ugugacuuuaaaaaaauu

SEQ ID NO: 2675143 - RNA, 20 nt, Escherichia coli CFT073
ugugacuuuaaaaaaauuaa

SEQ ID NO: 2675144 - RNA, 20 nt, Escherichia coli CFT073
ugugaguacccuuucacuuu

SEQ ID NO: 2675145 - RNA, 23 nt, Escherichia coli CFT073
ugugagucagaugcugugcaauc

SEQ ID NO: 2675146 - RNA, 19 nt, Escherichia coli CFT073
ugugauaaaaaucggcagg

SEQ ID NO: 2675147 - RNA, 12 nt, Escherichia coli CFT073
ugugauauucac

SEQ ID NO: 2675148 - RNA, 16 nt, Escherichia coli CFT073
ugugauccacugcaga

SEQ ID NO: 2675149 - RNA, 18 nt, Escherichia coli CFT073
ugugauccacugcagaau

SEQ ID NO: 2675150 - RNA, 14 nt, Escherichia coli CFT073
ugugaucgaauaua

SEQ ID NO: 2675151 - RNA, 12 nt, Escherichia coli CFT073
ugugauuacagc

SEQ ID NO: 2675152 - RNA, 22 nt, Escherichia coli CFT073
ugugauuacagccaggcgcugc

SEQ ID NO: 2675153 - RNA, 16 nt, Escherichia coli CFT073
ugugauugaugugcuu

SEQ ID NO: 2675154 - RNA, 19 nt, Escherichia coli CFT073
ugugauugcgcaguaccag

SEQ ID NO: 2675155 - RNA, 18 nt, Escherichia coli CFT073
ugugauuucuuuauugau

SEQ ID NO: 2675156 - RNA, 14 nt, Escherichia coli CFT073
ugugcaaaaaaagc

SEQ ID NO: 2675157 - RNA, 19 nt, Escherichia coli CFT073
ugugcaaaggccaaugguu

SEQ ID NO: 2675158 - RNA, 15 nt, Escherichia coli CFT073
ugugcaaccuuuucc

SEQ ID NO: 2675159 - RNA, 22 nt, Escherichia coli CFT073
ugugcaauguggugaaaugccu

SEQ ID NO: 2675160 - RNA, 19 nt, Escherichia coli CFT073
ugugcauuuaagagaaacg

SEQ ID NO: 2675161 - RNA, 16 nt, Escherichia coli CFT073
ugugccaauugccugg

SEQ ID NO: 2675162 - RNA, 14 nt, Escherichia coli CFT073
ugugccacauccag

SEQ ID NO: 2675163 - RNA, 12 nt, Escherichia coli CFT073
ugugccaccagc

SEQ ID NO: 2675164 - RNA, 19 nt, Escherichia coli CFT073
ugugccaccagcauuccua

SEQ ID NO: 2675165 - RNA, 18 nt, Escherichia coli CFT073
ugugccagcucgugcaga

SEQ ID NO: 2675166 - RNA, 19 nt, Escherichia coli CFT073
ugugccagcucgugcagaa

SEQ ID NO: 2675167 - RNA, 18 nt, Escherichia coli CFT073
ugugccgcgaccaccucg

SEQ ID NO: 2675168 - RNA, 18 nt, Escherichia coli CFT073
ugugccggauagguaaua

SEQ ID NO: 2675169 - RNA, 19 nt, Escherichia coli CFT073
ugugccugaauauacgcca

SEQ ID NO: 2675170 - RNA, 13 nt, Escherichia coli CFT073
ugugcgagugcau

SEQ ID NO: 2675171 - RNA, 15 nt, Escherichia coli CFT073
ugugcgcgguaaagc

SEQ ID NO: 2675172 - RNA, 18 nt, Escherichia coli CFT073
ugugcggaagucgcugcu

SEQ ID NO: 2675173 - RNA, 20 nt, Escherichia coli CFT073
ugugcggcgcauucaccagc

SEQ ID NO: 2675174 - RNA, 23 nt, Escherichia coli CFT073
ugugcguugcagcaaauaaaacu

SEQ ID NO: 2675175 - RNA, 15 nt, Escherichia coli CFT073
ugugcucuaaccaac

SEQ ID NO: 2675176 - RNA, 22 nt, Escherichia coli CFT073
ugugcucuaacccuuccagauu

SEQ ID NO: 2675177 - RNA, 18 nt, Escherichia coli CFT073
ugugcuuauuuuagcauu

SEQ ID NO: 2675178 - RNA, 15 nt, Escherichia coli CFT073
ugugcuuguaaaaca

SEQ ID NO: 2675179 - RNA, 14 nt, Escherichia coli CFT073
ugugcuuugugacc

SEQ ID NO: 2675180 - RNA, 17 nt, Escherichia coli CFT073
uguggaaagccccagcc

SEQ ID NO: 2675181 - RNA, 14 nt, Escherichia coli CFT073
uguggagcuucaac

SEQ ID NO: 2675182 - RNA, 19 nt, Escherichia coli CFT073
uguggauuaaauugcgcca

SEQ ID NO: 2675183 - RNA, 21 nt, Escherichia coli CFT073
uguggcaacauaaucaaccau

SEQ ID NO: 2675184 - RNA, 22 nt, Escherichia coli CFT073
uguggcgcaggggcagaaacaa

SEQ ID NO: 2675185 - RNA, 15 nt, Escherichia coli CFT073
uguggcgcgaccaga

SEQ ID NO: 2675186 - RNA, 23 nt, Escherichia coli CFT073
uguggcggaauaccgacaucacg

SEQ ID NO: 2675187 - RNA, 22 nt, Escherichia coli CFT073
uguggcgguuuuucagcuuauc

SEQ ID NO: 2675188 - RNA, 12 nt, Escherichia coli CFT073
uguggcuggggu

SEQ ID NO: 2675189 - RNA, 21 nt, Escherichia coli CFT073
uguggcugggguacgaggauu

SEQ ID NO: 2675190 - RNA, 18 nt, Escherichia coli CFT073
ugugggagcuauuuacca

SEQ ID NO: 2675191 - RNA, 20 nt, Escherichia coli CFT073
ugugggccggauaaggcguu

SEQ ID NO: 2675192 - RNA, 16 nt, Escherichia coli CFT073
ugugggguauuuccag

SEQ ID NO: 2675193 - RNA, 22 nt, Escherichia coli CFT073
ugugggucuaaaaacaauucuu

SEQ ID NO: 2675194 - RNA, 14 nt, Escherichia coli CFT073
ugugguaucaaaaa

SEQ ID NO: 2675195 - RNA, 14 nt, Escherichia coli CFT073
uguggucaccauga

SEQ ID NO: 2675196 - RNA, 22 nt, Escherichia coli CFT073
uguggugaaaugccucgcugau

SEQ ID NO: 2675197 - RNA, 17 nt, Escherichia coli CFT073
ugugguuaccaucaacc

SEQ ID NO: 2675198 - RNA, 13 nt, Escherichia coli CFT073
uguguaauaccga

SEQ ID NO: 2675199 - RNA, 18 nt, Escherichia coli CFT073
uguguaauuugcguuuuc

SEQ ID NO: 2675200 - RNA, 21 nt, Escherichia coli CFT073
uguguacauccuaaaggcaaa

SEQ ID NO: 2675201 - RNA, 13 nt, Escherichia coli CFT073
uguguaggccgga

SEQ ID NO: 2675202 - RNA, 23 nt, Escherichia coli CFT073
ugugucauaugcuuuuuuaaaaa

SEQ ID NO: 2675203 - RNA, 15 nt, Escherichia coli CFT073
ugugucgacauagcc

SEQ ID NO: 2675204 - RNA, 12 nt, Escherichia coli CFT073
ugugucgccagc

SEQ ID NO: 2675205 - RNA, 17 nt, Escherichia coli CFT073
ugugucuuuucaggccu

SEQ ID NO: 2675206 - RNA, 17 nt, Escherichia coli CFT073
uguguggcgcuuuuugg

SEQ ID NO: 2675207 - RNA, 14 nt, Escherichia coli CFT073
ugugugggcacucg

SEQ ID NO: 2675208 - RNA, 16 nt, Escherichia coli CFT073
ugugugggucuaaaaa

SEQ ID NO: 2675209 - RNA, 14 nt, Escherichia coli CFT073
ugugugguuuugua

SEQ ID NO: 2675210 - RNA, 13 nt, Escherichia coli CFT073
uguguuaauaaug

SEQ ID NO: 2675211 - RNA, 11 nt, Escherichia coli CFT073
uguguuuauaa

SEQ ID NO: 2675212 - RNA, 15 nt, Escherichia coli CFT073
uguguuugaucacuu

SEQ ID NO: 2675213 - RNA, 13 nt, Escherichia coli CFT073
uguuaacaauauu

SEQ ID NO: 2675214 - RNA, 21 nt, Escherichia coli CFT073
uguuaacaauauuaacaacau

SEQ ID NO: 2675215 - RNA, 15 nt, Escherichia coli CFT073
uguuaauucucccug

SEQ ID NO: 2675216 - RNA, 17 nt, Escherichia coli CFT073
uguuaccguaccaggca

SEQ ID NO: 2675217 - RNA, 23 nt, Escherichia coli CFT073
uguuaccuacgcuugcugcgauc

SEQ ID NO: 2675218 - RNA, 11 nt, Escherichia coli CFT073
uguuacugauu

SEQ ID NO: 2675219 - RNA, 22 nt, Escherichia coli CFT073
uguuagcaugcugacugcgcuc

SEQ ID NO: 2675220 - RNA, 20 nt, Escherichia coli CFT073
uguuagccacauccaugcuu

SEQ ID NO: 2675221 - RNA, 20 nt, Escherichia coli CFT073
uguuagcccugucgaggcca

SEQ ID NO: 2675222 - RNA, 20 nt, Escherichia coli CFT073
uguuagcgucaacuuuagca

SEQ ID NO: 2675223 - RNA, 13 nt, Escherichia coli CFT073
uguuagcgugcag

SEQ ID NO: 2675224 - RNA, 16 nt, Escherichia coli CFT073
uguuagcgugcaggac

SEQ ID NO: 2675225 - RNA, 14 nt, Escherichia coli CFT073
uguuauaauguugg

SEQ ID NO: 2675226 - RNA, 17 nt, Escherichia coli CFT073
uguuauaccaguccacc

SEQ ID NO: 2675227 - RNA, 16 nt, Escherichia coli CFT073
uguuaucccgaugaug

SEQ ID NO: 2675228 - RNA, 22 nt, Escherichia coli CFT073
uguuauccgacuuauucuucaa

SEQ ID NO: 2675229 - RNA, 13 nt, Escherichia coli CFT073
uguuaugcacacg

SEQ ID NO: 2675230 - RNA, 15 nt, Escherichia coli CFT073
uguuauucacagaga

SEQ ID NO: 2675231 - RNA, 18 nt, Escherichia coli CFT073
uguuauugaucagugcac

SEQ ID NO: 2675232 - RNA, 14 nt, Escherichia coli CFT073
uguucaaaggcaga

SEQ ID NO: 2675233 - RNA, 16 nt, Escherichia coli CFT073
uguucaaaggcagaaa

SEQ ID NO: 2675234 - RNA, 19 nt, Escherichia coli CFT073
uguucaaccaccggcacca

SEQ ID NO: 2675235 - RNA, 13 nt, Escherichia coli CFT073
uguucaagagcuu

SEQ ID NO: 2675236 - RNA, 17 nt, Escherichia coli CFT073
uguucagaaagcgccag

SEQ ID NO: 2675237 - RNA, 15 nt, Escherichia coli CFT073
uguucagagugccca

SEQ ID NO: 2675238 - RNA, 21 nt, Escherichia coli CFT073
uguucagccguuuaauugccu

SEQ ID NO: 2675239 - RNA, 17 nt, Escherichia coli CFT073
uguucagcgacagauua

SEQ ID NO: 2675240 - RNA, 13 nt, Escherichia coli CFT073
uguucauaucaaa

SEQ ID NO: 2675241 - RNA, 16 nt, Escherichia coli CFT073
uguucauaugcuuguu

SEQ ID NO: 2675242 - RNA, 20 nt, Escherichia coli CFT073
uguucauauuaaccucucag

SEQ ID NO: 2675243 - RNA, 20 nt, Escherichia coli CFT073
uguucaucaugaacugggcu

SEQ ID NO: 2675244 - RNA, 21 nt, Escherichia coli CFT073
uguucauuuuguaggccugau

SEQ ID NO: 2675245 - RNA, 19 nt, Escherichia coli CFT073
uguucccacgcacagaaca

SEQ ID NO: 2675246 - RNA, 21 nt, Escherichia coli CFT073
uguucccuguaggucggauaa

SEQ ID NO: 2675247 - RNA, 13 nt, Escherichia coli CFT073
uguuccgauaagu

SEQ ID NO: 2675248 - RNA, 20 nt, Escherichia coli CFT073
uguuccggcagaaaccaggu

SEQ ID NO: 2675249 - RNA, 17 nt, Escherichia coli CFT073
uguuccgucagccgccc

SEQ ID NO: 2675250 - RNA, 15 nt, Escherichia coli CFT073
uguuccugcucauca

SEQ ID NO: 2675251 - RNA, 21 nt, Escherichia coli CFT073
uguucgcaaccuaaccaaaca

SEQ ID NO: 2675252 - RNA, 11 nt, Escherichia coli CFT073
uguucgccaga

SEQ ID NO: 2675253 - RNA, 13 nt, Escherichia coli CFT073
uguucgcugguga

SEQ ID NO: 2675254 - RNA, 16 nt, Escherichia coli CFT073
uguucgcuuaacucac

SEQ ID NO: 2675255 - RNA, 17 nt, Escherichia coli CFT073
uguucugaggugagcau

SEQ ID NO: 2675256 - RNA, 23 nt, Escherichia coli CFT073
uguucugaggugagcauaucacc

SEQ ID NO: 2675257 - RNA, 13 nt, Escherichia coli CFT073
uguucuggaaaaa

SEQ ID NO: 2675258 - RNA, 14 nt, Escherichia coli CFT073
uguucuggaaaaaa

SEQ ID NO: 2675259 - RNA, 16 nt, Escherichia coli CFT073
uguucuggaaaaaauu

SEQ ID NO: 2675260 - RNA, 17 nt, Escherichia coli CFT073
uguucuggccguaccca

SEQ ID NO: 2675261 - RNA, 17 nt, Escherichia coli CFT073
uguucuggcguaucucc

SEQ ID NO: 2675262 - RNA, 14 nt, Escherichia coli CFT073
uguucuuacccacu

SEQ ID NO: 2675263 - RNA, 14 nt, Escherichia coli CFT073
uguucuuuuucaga

SEQ ID NO: 2675264 - RNA, 13 nt, Escherichia coli CFT073
uguugaaauacaa

SEQ ID NO: 2675265 - RNA, 20 nt, Escherichia coli CFT073
uguugaauuccgaauuucau

SEQ ID NO: 2675266 - RNA, 21 nt, Escherichia coli CFT073
uguugaauuccgaauuucauc

SEQ ID NO: 2675267 - RNA, 21 nt, Escherichia coli CFT073
uguugacgcgugcgccgaguu

SEQ ID NO: 2675268 - RNA, 15 nt, Escherichia coli CFT073
uguugacgcuaugug

SEQ ID NO: 2675269 - RNA, 15 nt, Escherichia coli CFT073
uguugaggaagcgca

SEQ ID NO: 2675270 - RNA, 16 nt, Escherichia coli CFT073
uguugaggaagcgcaa

SEQ ID NO: 2675271 - RNA, 13 nt, Escherichia coli CFT073
uguugauaaaaca

SEQ ID NO: 2675272 - RNA, 21 nt, Escherichia coli CFT073
uguugaucaggugauggcagc

SEQ ID NO: 2675273 - RNA, 23 nt, Escherichia coli CFT073
uguugaucucaauaccaaugaau

SEQ ID NO: 2675274 - RNA, 23 nt, Escherichia coli CFT073
uguugauucugcggguuagucug

SEQ ID NO: 2675275 - RNA, 22 nt, Escherichia coli CFT073
uguugcaguacucgcacuuuuc

SEQ ID NO: 2675276 - RNA, 19 nt, Escherichia coli CFT073
uguugccagcagcaaccau

SEQ ID NO: 2675277 - RNA, 22 nt, Escherichia coli CFT073
uguugccgccgcgugcaauauc

SEQ ID NO: 2675278 - RNA, 14 nt, Escherichia coli CFT073
uguugccuguuuca

SEQ ID NO: 2675279 - RNA, 21 nt, Escherichia coli CFT073
uguugcgaacuucaggcagga

SEQ ID NO: 2675280 - RNA, 22 nt, Escherichia coli CFT073
uguugcgccagcacacccagcg

SEQ ID NO: 2675281 - RNA, 21 nt, Escherichia coli CFT073
uguugcggaaagagcauccga

SEQ ID NO: 2675282 - RNA, 19 nt, Escherichia coli CFT073
uguugcuggauccccugcc

SEQ ID NO: 2675283 - RNA, 19 nt, Escherichia coli CFT073
uguugcugugcaccgccca

SEQ ID NO: 2675284 - RNA, 16 nt, Escherichia coli CFT073
uguuggaacccgcagc

SEQ ID NO: 2675285 - RNA, 15 nt, Escherichia coli CFT073
uguuggcagcggcaa

SEQ ID NO: 2675286 - RNA, 13 nt, Escherichia coli CFT073
uguuggcuaucua

SEQ ID NO: 2675287 - RNA, 16 nt, Escherichia coli CFT073
uguuggguuagccaac

SEQ ID NO: 2675288 - RNA, 13 nt, Escherichia coli CFT073
uguuguacaguac

SEQ ID NO: 2675289 - RNA, 12 nt, Escherichia coli CFT073
uguuguauucag

SEQ ID NO: 2675290 - RNA, 15 nt, Escherichia coli CFT073
uguugucgcagacga

SEQ ID NO: 2675291 - RNA, 20 nt, Escherichia coli CFT073
uguuguugcgcgccagcuuu

SEQ ID NO: 2675292 - RNA, 12 nt, Escherichia coli CFT073
uguuguuuucaa

SEQ ID NO: 2675293 - RNA, 13 nt, Escherichia coli CFT073
uguuuaaccaaca

SEQ ID NO: 2675294 - RNA, 18 nt, Escherichia coli CFT073
uguuuaaggaaaaacgaa

SEQ ID NO: 2675295 - RNA, 22 nt, Escherichia coli CFT073
uguuuagccacgccgaggcauu

SEQ ID NO: 2675296 - RNA, 23 nt, Escherichia coli CFT073
uguuuagccgcuucugcagcuuu

SEQ ID NO: 2675297 - RNA, 18 nt, Escherichia coli CFT073
uguuuagcguuauauuau

SEQ ID NO: 2675298 - RNA, 20 nt, Escherichia coli CFT073
uguuuaucuuccagcauuuc

SEQ ID NO: 2675299 - RNA, 13 nt, Escherichia coli CFT073
uguuucacacuga

SEQ ID NO: 2675300 - RNA, 18 nt, Escherichia coli CFT073
uguuucauccaggcacug

SEQ ID NO: 2675301 - RNA, 19 nt, Escherichia coli CFT073
uguuucauccaggcacugg

SEQ ID NO: 2675302 - RNA, 23 nt, Escherichia coli CFT073
uguuucaugaagcaacucaccau

SEQ ID NO: 2675303 - RNA, 18 nt, Escherichia coli CFT073
uguuucccccacugugca

SEQ ID NO: 2675304 - RNA, 19 nt, Escherichia coli CFT073
uguuucgacaauaaucaac

SEQ ID NO: 2675305 - RNA, 16 nt, Escherichia coli CFT073
uguuucgggcgguuug

SEQ ID NO: 2675306 - RNA, 13 nt, Escherichia coli CFT073
uguuucucuuucu

SEQ ID NO: 2675307 - RNA, 14 nt, Escherichia coli CFT073
uguuucuggcaucc

SEQ ID NO: 2675308 - RNA, 12 nt, Escherichia coli CFT073
uguuucuguugc

SEQ ID NO: 2675309 - RNA, 16 nt, Escherichia coli CFT073
uguuucuuauucagaa

SEQ ID NO: 2675310 - RNA, 14 nt, Escherichia coli CFT073
uguuugaagucaac

SEQ ID NO: 2675311 - RNA, 15 nt, Escherichia coli CFT073
uguuugacaacucau

SEQ ID NO: 2675312 - RNA, 14 nt, Escherichia coli CFT073
uguuugcgacaaac

SEQ ID NO: 2675313 - RNA, 15 nt, Escherichia coli CFT073
uguuuggugcagaau

SEQ ID NO: 2675314 - RNA, 13 nt, Escherichia coli CFT073
uguuuuaaauauu

SEQ ID NO: 2675315 - RNA, 20 nt, Escherichia coli CFT073
uguuuuaaauauuguuuuua

SEQ ID NO: 2675316 - RNA, 22 nt, Escherichia coli CFT073
uguuuuaacacacaauuaccuu

SEQ ID NO: 2675317 - RNA, 15 nt, Escherichia coli CFT073
uguuuuaccggcaac

SEQ ID NO: 2675318 - RNA, 22 nt, Escherichia coli CFT073
uguuuucaauugauugauaaug

SEQ ID NO: 2675319 - RNA, 12 nt, Escherichia coli CFT073
uguuuuccagca

SEQ ID NO: 2675320 - RNA, 22 nt, Escherichia coli CFT073
uguuuuccguugugcgauccac

SEQ ID NO: 2675321 - RNA, 14 nt, Escherichia coli CFT073
uuaaaaaacagugc

SEQ ID NO: 2675322 - RNA, 17 nt, Escherichia coli CFT073
uuaaaaacagccagcag

SEQ ID NO: 2675323 - RNA, 18 nt, Escherichia coli CFT073
uuaaaaagcagguuguua

SEQ ID NO: 2675324 - RNA, 18 nt, Escherichia coli CFT073
uuaaaacgcacgcugucg

SEQ ID NO: 2675325 - RNA, 12 nt, Escherichia coli CFT073
uuaaacaaccca

SEQ ID NO: 2675326 - RNA, 22 nt, Escherichia coli CFT073
uuaaacacgauucguauaauuu

SEQ ID NO: 2675327 - RNA, 20 nt, Escherichia coli CFT073
uuaaacagaauacccagcaa

SEQ ID NO: 2675328 - RNA, 16 nt, Escherichia coli CFT073
uuaaacaucucaucaa

SEQ ID NO: 2675329 - RNA, 21 nt, Escherichia coli CFT073
uuaaaccaacuucauacauug

SEQ ID NO: 2675330 - RNA, 18 nt, Escherichia coli CFT073
uuaaaccaggaacaguga

SEQ ID NO: 2675331 - RNA, 13 nt, Escherichia coli CFT073
uuaaaccaucagc

SEQ ID NO: 2675332 - RNA, 19 nt, Escherichia coli CFT073
uuaaacggcauaaauuuca

SEQ ID NO: 2675333 - RNA, 18 nt, Escherichia coli CFT073
uuaaacgggucaucaaaa

SEQ ID NO: 2675334 - RNA, 22 nt, Escherichia coli CFT073
uuaaacucaccuuguguuuugg

SEQ ID NO: 2675335 - RNA, 11 nt, Escherichia coli CFT073
uuaaacuggaa

SEQ ID NO: 2675336 - RNA, 12 nt, Escherichia coli CFT073
uuaaacuggaaa

SEQ ID NO: 2675337 - RNA, 13 nt, Escherichia coli CFT073
uuaaacuggaaaa

SEQ ID NO: 2675338 - RNA, 13 nt, Escherichia coli CFT073
uuaaagaaaguaa

SEQ ID NO: 2675339 - RNA, 15 nt, Escherichia coli CFT073
uuaaagauaaugcca

SEQ ID NO: 2675340 - RNA, 19 nt, Escherichia coli CFT073
uuaaagccgcgaaacugcg

SEQ ID NO: 2675341 - RNA, 12 nt, Escherichia coli CFT073
uuaaagccggug

SEQ ID NO: 2675342 - RNA, 18 nt, Escherichia coli CFT073
uuaaaguaguaaguagca

SEQ ID NO: 2675343 - RNA, 16 nt, Escherichia coli CFT073
uuaaauaauauuuccc

SEQ ID NO: 2675344 - RNA, 14 nt, Escherichia coli CFT073
uuaaauaccaagcc

SEQ ID NO: 2675345 - RNA, 12 nt, Escherichia coli CFT073
uuaaauacgccu

SEQ ID NO: 2675346 - RNA, 12 nt, Escherichia coli CFT073
uuaaauaguuuu

SEQ ID NO: 2675347 - RNA, 16 nt, Escherichia coli CFT073
uuaaauauuguuuuua

SEQ ID NO: 2675348 - RNA, 19 nt, Escherichia coli CFT073
uuaaauauuguuuuuauug

SEQ ID NO: 2675349 - RNA, 20 nt, Escherichia coli CFT073
uuaaauauuguuuuuauugu

SEQ ID NO: 2675350 - RNA, 15 nt, Escherichia coli CFT073
uuaaaucauccugaa

SEQ ID NO: 2675351 - RNA, 14 nt, Escherichia coli CFT073
uuaaauccugcaca

SEQ ID NO: 2675352 - RNA, 20 nt, Escherichia coli CFT073
uuaaaugacaauguggccuu

SEQ ID NO: 2675353 - RNA, 19 nt, Escherichia coli CFT073
uuaaaugcccgacaaaaau

SEQ ID NO: 2675354 - RNA, 20 nt, Escherichia coli CFT073
uuaaaugcccgacaaaaauu

SEQ ID NO: 2675355 - RNA, 17 nt, Escherichia coli CFT073
uuaaaugucauacuauu

SEQ ID NO: 2675356 - RNA, 16 nt, Escherichia coli CFT073
uuaaaugucaugacau

SEQ ID NO: 2675357 - RNA, 18 nt, Escherichia coli CFT073
uuaacaacauuaccgaau

SEQ ID NO: 2675358 - RNA, 19 nt, Escherichia coli CFT073
uuaacaauaacaauuaucu

SEQ ID NO: 2675359 - RNA, 21 nt, Escherichia coli CFT073
uuaacaauauuaacaacauua

SEQ ID NO: 2675360 - RNA, 18 nt, Escherichia coli CFT073
uuaacagauugagaauaa

SEQ ID NO: 2675361 - RNA, 23 nt, Escherichia coli CFT073
uuaacagauugagaauaaugccu

SEQ ID NO: 2675362 - RNA, 15 nt, Escherichia coli CFT073
uuaacagcaaaacac

SEQ ID NO: 2675363 - RNA, 16 nt, Escherichia coli CFT073
uuaacagguauagaau

SEQ ID NO: 2675364 - RNA, 15 nt, Escherichia coli CFT073
uuaacaguuccagca

SEQ ID NO: 2675365 - RNA, 15 nt, Escherichia coli CFT073
uuaacauaucugauu

SEQ ID NO: 2675366 - RNA, 14 nt, Escherichia coli CFT073
uuaacaucccuuca

SEQ ID NO: 2675367 - RNA, 20 nt, Escherichia coli CFT073
uuaacaucccuucaauuaug

SEQ ID NO: 2675368 - RNA, 21 nt, Escherichia coli CFT073
uuaacaucccuucaauuaugc

SEQ ID NO: 2675369 - RNA, 19 nt, Escherichia coli CFT073
uuaacauuacuaaacauuu

SEQ ID NO: 2675370 - RNA, 13 nt, Escherichia coli CFT073
uuaaccaauaagu

SEQ ID NO: 2675371 - RNA, 20 nt, Escherichia coli CFT073
uuaaccacaaacgauccugg

SEQ ID NO: 2675372 - RNA, 20 nt, Escherichia coli CFT073
uuaaccagcacguugaacug

SEQ ID NO: 2675373 - RNA, 19 nt, Escherichia coli CFT073
uuaaccaggcaaguucuuu

SEQ ID NO: 2675374 - RNA, 21 nt, Escherichia coli CFT073
uuaaccaggcaaguucuuuug

SEQ ID NO: 2675375 - RNA, 12 nt, Escherichia coli CFT073
uuaaccauaauc

SEQ ID NO: 2675376 - RNA, 19 nt, Escherichia coli CFT073
uuaacccaaauccgccauc

SEQ ID NO: 2675377 - RNA, 18 nt, Escherichia coli CFT073
uuaacccauuuaaaaauc

SEQ ID NO: 2675378 - RNA, 13 nt, Escherichia coli CFT073
uuaacccgcaaca

SEQ ID NO: 2675379 - RNA, 17 nt, Escherichia coli CFT073
uuaacccgcaacagcaa

SEQ ID NO: 2675380 - RNA, 20 nt, Escherichia coli CFT073
uuaaccgcuucgcuggcagc

SEQ ID NO: 2675381 - RNA, 23 nt, Escherichia coli CFT073
uuaaccugcgccucaguuucgac

SEQ ID NO: 2675382 - RNA, 18 nt, Escherichia coli CFT073
uuaacgaaacccgaacca

SEQ ID NO: 2675383 - RNA, 17 nt, Escherichia coli CFT073
uuaacgcagcaaaagca

SEQ ID NO: 2675384 - RNA, 13 nt, Escherichia coli CFT073
uuaacgcauaaua

SEQ ID NO: 2675385 - RNA, 15 nt, Escherichia coli CFT073
uuaacgcauaauaaa

SEQ ID NO: 2675386 - RNA, 16 nt, Escherichia coli CFT073
uuaacgccucguuugc

SEQ ID NO: 2675387 - RNA, 20 nt, Escherichia coli CFT073
uuaacgcgaaauaaucaaau

SEQ ID NO: 2675388 - RNA, 23 nt, Escherichia coli CFT073
uuaacgcgaaauaaucaaaugaa

SEQ ID NO: 2675389 - RNA, 18 nt, Escherichia coli CFT073
uuaacgcgggcuucuucu

SEQ ID NO: 2675390 - RNA, 19 nt, Escherichia coli CFT073
uuaacggcauuuuccagcu

SEQ ID NO: 2675391 - RNA, 20 nt, Escherichia coli CFT073
uuaacggcguuuccuucguu

SEQ ID NO: 2675392 - RNA, 16 nt, Escherichia coli CFT073
uuaacgguuucaacca

SEQ ID NO: 2675393 - RNA, 17 nt, Escherichia coli CFT073
uuaacgucaaccacuca

SEQ ID NO: 2675394 - RNA, 14 nt, Escherichia coli CFT073
uuaacuccaguagc

SEQ ID NO: 2675395 - RNA, 22 nt, Escherichia coli CFT073
uuaacugggcgucaaagugaaa

SEQ ID NO: 2675396 - RNA, 17 nt, Escherichia coli CFT073
uuaacugugccagcguu

SEQ ID NO: 2675397 - RNA, 11 nt, Escherichia coli CFT073
uuaagaaaacg

SEQ ID NO: 2675398 - RNA, 20 nt, Escherichia coli CFT073
uuaagaaaacggaagcucag

SEQ ID NO: 2675399 - RNA, 23 nt, Escherichia coli CFT073
uuaagaaaacugcgcccgcuuuu

SEQ ID NO: 2675400 - RNA, 13 nt, Escherichia coli CFT073
uuaagaucgugca

SEQ ID NO: 2675401 - RNA, 16 nt, Escherichia coli CFT073
uuaagaugaagaaaau

SEQ ID NO: 2675402 - RNA, 17 nt, Escherichia coli CFT073
uuaagaugaagaaaaua

SEQ ID NO: 2675403 - RNA, 13 nt, Escherichia coli CFT073
uuaagcaaauaau

SEQ ID NO: 2675404 - RNA, 18 nt, Escherichia coli CFT073
uuaagcacguuacccaau

SEQ ID NO: 2675405 - RNA, 13 nt, Escherichia coli CFT073
uuaagcacuuuau

SEQ ID NO: 2675406 - RNA, 22 nt, Escherichia coli CFT073
uuaagccaaagcgccguagcug

SEQ ID NO: 2675407 - RNA, 18 nt, Escherichia coli CFT073
uuaagccugcaucacgag

SEQ ID NO: 2675408 - RNA, 22 nt, Escherichia coli CFT073
uuaagcgcaucgacgccaucau

SEQ ID NO: 2675409 - RNA, 17 nt, Escherichia coli CFT073
uuaaggcauauaugaau

SEQ ID NO: 2675410 - RNA, 16 nt, Escherichia coli CFT073
uuaaggccaaacacca

SEQ ID NO: 2675411 - RNA, 17 nt, Escherichia coli CFT073
uuaaggucguuuugccc

SEQ ID NO: 2675412 - RNA, 12 nt, Escherichia coli CFT073
uuaagguuuuuu

SEQ ID NO: 2675413 - RNA, 14 nt, Escherichia coli CFT073
uuaagucaacacca

SEQ ID NO: 2675414 - RNA, 22 nt, Escherichia coli CFT073
uuaaguucauuuuuagugauca

SEQ ID NO: 2675415 - RNA, 16 nt, Escherichia coli CFT073
uuaauaaaauuaucca

SEQ ID NO: 2675416 - RNA, 19 nt, Escherichia coli CFT073
uuaauaaagugcgcuuugu

SEQ ID NO: 2675417 - RNA, 20 nt, Escherichia coli CFT073
uuaauaaagugcgcuuugug

SEQ ID NO: 2675418 - RNA, 13 nt, Escherichia coli CFT073
uuaauaaaucacg

SEQ ID NO: 2675419 - RNA, 19 nt, Escherichia coli CFT073
uuaauaaccauuaaauagu

SEQ ID NO: 2675420 - RNA, 16 nt, Escherichia coli CFT073
uuaauaagcaggccau

SEQ ID NO: 2675421 - RNA, 23 nt, Escherichia coli CFT073
uuaauaagcaggccauuugcucu

SEQ ID NO: 2675422 - RNA, 21 nt, Escherichia coli CFT073
uuaauaaggcguacauccggc

SEQ ID NO: 2675423 - RNA, 22 nt, Escherichia coli CFT073
uuaauaaugccgcaacgccaua

SEQ ID NO: 2675424 - RNA, 16 nt, Escherichia coli CFT073
uuaauaccagaauaag

SEQ ID NO: 2675425 - RNA, 22 nt, Escherichia coli CFT073
uuaauaccaucggcagcgccaa

SEQ ID NO: 2675426 - RNA, 18 nt, Escherichia coli CFT073
uuaauaccgagcguucaa

SEQ ID NO: 2675427 - RNA, 14 nt, Escherichia coli CFT073
uuaauaccggcauc

SEQ ID NO: 2675428 - RNA, 14 nt, Escherichia coli CFT073
uuaauaccugcacc

SEQ ID NO: 2675429 - RNA, 15 nt, Escherichia coli CFT073
uuaauaccugccugg

SEQ ID NO: 2675430 - RNA, 19 nt, Escherichia coli CFT073
uuaauacucacgacguggc

SEQ ID NO: 2675431 - RNA, 13 nt, Escherichia coli CFT073
uuaauauauauua

SEQ ID NO: 2675432 - RNA, 14 nt, Escherichia coli CFT073
uuaauaugcucaac

SEQ ID NO: 2675433 - RNA, 17 nt, Escherichia coli CFT073
uuaauauuaaaccaccc

SEQ ID NO: 2675434 - RNA, 20 nt, Escherichia coli CFT073
uuaauauuaaaccacccgcg

SEQ ID NO: 2675435 - RNA, 22 nt, Escherichia coli CFT073
uuaaucagauaaucaaccccca

SEQ ID NO: 2675436 - RNA, 23 nt, Escherichia coli CFT073
uuaaucagauaaucaacccccac

SEQ ID NO: 2675437 - RNA, 17 nt, Escherichia coli CFT073
uuaaucaucaugcuuaa

SEQ ID NO: 2675438 - RNA, 19 nt, Escherichia coli CFT073
uuaaucaucgacuccagcg

SEQ ID NO: 2675439 - RNA, 22 nt, Escherichia coli CFT073
uuaauccagacugcgcauuaaa

SEQ ID NO: 2675440 - RNA, 23 nt, Escherichia coli CFT073
uuaauccgcaaauaacguaaaaa

SEQ ID NO: 2675441 - RNA, 18 nt, Escherichia coli CFT073
uuaauccugauuuauacc

SEQ ID NO: 2675442 - RNA, 22 nt, Escherichia coli CFT073
uuaaucgccgcauaauaucuuu

SEQ ID NO: 2675443 - RNA, 18 nt, Escherichia coli CFT073
uuaaucggaugaucaucc

SEQ ID NO: 2675444 - RNA, 14 nt, Escherichia coli CFT073
uuaaucuaggcucu

SEQ ID NO: 2675445 - RNA, 14 nt, Escherichia coli CFT073
uuaaucuauauaug

SEQ ID NO: 2675446 - RNA, 22 nt, Escherichia coli CFT073
uuaaucucgacagccucuucca

SEQ ID NO: 2675447 - RNA, 12 nt, Escherichia coli CFT073
uuaaucuucacu

SEQ ID NO: 2675448 - RNA, 15 nt, Escherichia coli CFT073
uuaaugacaauuaca

SEQ ID NO: 2675449 - RNA, 11 nt, Escherichia coli CFT073
uuaaugcaaua

SEQ ID NO: 2675450 - RNA, 13 nt, Escherichia coli CFT073
uuaaugcaauaaa

SEQ ID NO: 2675451 - RNA, 23 nt, Escherichia coli CFT073
uuaaugcacggcagauaaacaac

SEQ ID NO: 2675452 - RNA, 11 nt, Escherichia coli CFT073
uuaaugccagu

SEQ ID NO: 2675453 - RNA, 16 nt, Escherichia coli CFT073
uuaaugcccaucaguu

SEQ ID NO: 2675454 - RNA, 19 nt, Escherichia coli CFT073
uuaaugccggacuccagca

SEQ ID NO: 2675455 - RNA, 16 nt, Escherichia coli CFT073
uuaaugcuacccggcg

SEQ ID NO: 2675456 - RNA, 19 nt, Escherichia coli CFT073
uuaaugcuccccuuucuua

SEQ ID NO: 2675457 - RNA, 21 nt, Escherichia coli CFT073
uuaaugcuccccuuucuuauu

SEQ ID NO: 2675458 - RNA, 21 nt, Escherichia coli CFT073
uuaaugggaagcaaguucccg

SEQ ID NO: 2675459 - RNA, 14 nt, Escherichia coli CFT073
uuaaugguuugccc

SEQ ID NO: 2675460 - RNA, 14 nt, Escherichia coli CFT073
uuaauguaaauauu

SEQ ID NO: 2675461 - RNA, 17 nt, Escherichia coli CFT073
uuaauguaugugcgaaa

SEQ ID NO: 2675462 - RNA, 21 nt, Escherichia coli CFT073
uuaauguccuuuuccggcguc

SEQ ID NO: 2675463 - RNA, 15 nt, Escherichia coli CFT073
uuaaugucggaugcg

SEQ ID NO: 2675464 - RNA, 17 nt, Escherichia coli CFT073
uuaauuaaacaaauaaa

SEQ ID NO: 2675465 - RNA, 15 nt, Escherichia coli CFT073
uuaauucuuaacacc

SEQ ID NO: 2675466 - RNA, 21 nt, Escherichia coli CFT073
uuaauugcccaaagccaaucu

SEQ ID NO: 2675467 - RNA, 17 nt, Escherichia coli CFT073
uuaauuucaggcuguca

SEQ ID NO: 2675468 - RNA, 18 nt, Escherichia coli CFT073
uuaauuucaugcucacca

SEQ ID NO: 2675469 - RNA, 20 nt, Escherichia coli CFT073
uuaauuuccucuucccgcuc

SEQ ID NO: 2675470 - RNA, 16 nt, Escherichia coli CFT073
uuaauuuucgcccguu

SEQ ID NO: 2675471 - RNA, 14 nt, Escherichia coli CFT073
uuaauuuuuuaaua

SEQ ID NO: 2675472 - RNA, 21 nt, Escherichia coli CFT073
uuacaaaaaguaguuccagca

SEQ ID NO: 2675473 - RNA, 13 nt, Escherichia coli CFT073
uuacaaaaugaca

SEQ ID NO: 2675474 - RNA, 22 nt, Escherichia coli CFT073
uuacaaaauuacagccggguga

SEQ ID NO: 2675475 - RNA, 13 nt, Escherichia coli CFT073
uuacaagaaucau

SEQ ID NO: 2675476 - RNA, 19 nt, Escherichia coli CFT073
uuacacaaguccagcaccg

SEQ ID NO: 2675477 - RNA, 14 nt, Escherichia coli CFT073
uuacacaaugcaag

SEQ ID NO: 2675478 - RNA, 17 nt, Escherichia coli CFT073
uuacacagaguuugccg

SEQ ID NO: 2675479 - RNA, 15 nt, Escherichia coli CFT073
uuacaccaugccacu

SEQ ID NO: 2675480 - RNA, 17 nt, Escherichia coli CFT073
uuacacgugagccacgg

SEQ ID NO: 2675481 - RNA, 15 nt, Escherichia coli CFT073
uuacacugaaaaaaa

SEQ ID NO: 2675482 - RNA, 19 nt, Escherichia coli CFT073
uuacacugaaaaaaagugc

SEQ ID NO: 2675483 - RNA, 16 nt, Escherichia coli CFT073
uuacagcaucggcuug

SEQ ID NO: 2675484 - RNA, 18 nt, Escherichia coli CFT073
uuacagccagccgcuaac

SEQ ID NO: 2675485 - RNA, 19 nt, Escherichia coli CFT073
uuacaggcaucuuccagcg

SEQ ID NO: 2675486 - RNA, 20 nt, Escherichia coli CFT073
uuacaggugaaucuuacuuc

SEQ ID NO: 2675487 - RNA, 21 nt, Escherichia coli CFT073
uuacauaccagcagcaucacg

SEQ ID NO: 2675488 - RNA, 15 nt, Escherichia coli CFT073
uuacauacgcucuac

SEQ ID NO: 2675489 - RNA, 19 nt, Escherichia coli CFT073
uuacauauauuacucauua

SEQ ID NO: 2675490 - RNA, 20 nt, Escherichia coli CFT073
uuacaucagaguacagauuc

SEQ ID NO: 2675491 - RNA, 11 nt, Escherichia coli CFT073
uuacaucauca

SEQ ID NO: 2675492 - RNA, 16 nt, Escherichia coli CFT073
uuacaucaucagaaau

SEQ ID NO: 2675493 - RNA, 16 nt, Escherichia coli CFT073
uuacaucauucaaugc

SEQ ID NO: 2675494 - RNA, 23 nt, Escherichia coli CFT073
uuacauugauagcccaacgaucc

SEQ ID NO: 2675495 - RNA, 16 nt, Escherichia coli CFT073
uuaccaaacuggaacu

SEQ ID NO: 2675496 - RNA, 20 nt, Escherichia coli CFT073
uuaccaaaggugacuggcag

SEQ ID NO: 2675497 - RNA, 19 nt, Escherichia coli CFT073
uuaccacaccggcaauaau

SEQ ID NO: 2675498 - RNA, 12 nt, Escherichia coli CFT073
uuaccaccagcg

SEQ ID NO: 2675499 - RNA, 19 nt, Escherichia coli CFT073
uuaccaccgucaauaaaaa

SEQ ID NO: 2675500 - RNA, 17 nt, Escherichia coli CFT073
uuaccagacagaacgau

SEQ ID NO: 2675501 - RNA, 14 nt, Escherichia coli CFT073
uuaccagcaucacc

SEQ ID NO: 2675502 - RNA, 16 nt, Escherichia coli CFT073
uuaccagcgcaggaac

SEQ ID NO: 2675503 - RNA, 21 nt, Escherichia coli CFT073
uuaccaucaaccacuacguga

SEQ ID NO: 2675504 - RNA, 18 nt, Escherichia coli CFT073
uuaccaucgcgaucauca

SEQ ID NO: 2675505 - RNA, 13 nt, Escherichia coli CFT073
uuacccaacucuu

SEQ ID NO: 2675506 - RNA, 13 nt, Escherichia coli CFT073
uuacccagcagca

SEQ ID NO: 2675507 - RNA, 23 nt, Escherichia coli CFT073
uuacccagcggauaaagcagggc

SEQ ID NO: 2675508 - RNA, 13 nt, Escherichia coli CFT073
uuacccagugaau

SEQ ID NO: 2675509 - RNA, 13 nt, Escherichia coli CFT073
uuaccccauccau

SEQ ID NO: 2675510 - RNA, 17 nt, Escherichia coli CFT073
uuacccccguguuuuug

SEQ ID NO: 2675511 - RNA, 23 nt, Escherichia coli CFT073
uuacccccguguuuuugugccag

SEQ ID NO: 2675512 - RNA, 19 nt, Escherichia coli CFT073
uuaccccgcccgauaaaac

SEQ ID NO: 2675513 - RNA, 12 nt, Escherichia coli CFT073
uuacccggcaca

SEQ ID NO: 2675514 - RNA, 14 nt, Escherichia coli CFT073
uuacccuggcgcga

SEQ ID NO: 2675515 - RNA, 15 nt, Escherichia coli CFT073
uuaccgaucgccagc

SEQ ID NO: 2675516 - RNA, 17 nt, Escherichia coli CFT073
uuaccgcaaucgaucug

SEQ ID NO: 2675517 - RNA, 17 nt, Escherichia coli CFT073
uuaccgcaccaccagca

SEQ ID NO: 2675518 - RNA, 21 nt, Escherichia coli CFT073
uuaccgcccaugccaguaaua

SEQ ID NO: 2675519 - RNA, 21 nt, Escherichia coli CFT073
uuaccgcgccauguugccugg

SEQ ID NO: 2675520 - RNA, 22 nt, Escherichia coli CFT073
uuaccgcgccauguugccuggg

SEQ ID NO: 2675521 - RNA, 23 nt, Escherichia coli CFT073
uuaccgcuuggcgauaccccaac

SEQ ID NO: 2675522 - RNA, 19 nt, Escherichia coli CFT073
uuaccggagcugcagccag

SEQ ID NO: 2675523 - RNA, 16 nt, Escherichia coli CFT073
uuaccguaacagguga

SEQ ID NO: 2675524 - RNA, 13 nt, Escherichia coli CFT073
uuaccgucuuucg

SEQ ID NO: 2675525 - RNA, 15 nt, Escherichia coli CFT073
uuaccguucuacuau

SEQ ID NO: 2675526 - RNA, 18 nt, Escherichia coli CFT073
uuaccuucagacucgaag

SEQ ID NO: 2675527 - RNA, 19 nt, Escherichia coli CFT073
uuaccuuccugccagaucc

SEQ ID NO: 2675528 - RNA, 15 nt, Escherichia coli CFT073
uuaccuuuaaucuua

SEQ ID NO: 2675529 - RNA, 17 nt, Escherichia coli CFT073
uuaccuuuugacugaag

SEQ ID NO: 2675530 - RNA, 16 nt, Escherichia coli CFT073
uuaccuuuugcugucu

SEQ ID NO: 2675531 - RNA, 22 nt, Escherichia coli CFT073
uuacgaaaaggauaaauaaaau

SEQ ID NO: 2675532 - RNA, 18 nt, Escherichia coli CFT073
uuacgaaaucggcaccgc

SEQ ID NO: 2675533 - RNA, 14 nt, Escherichia coli CFT073
uuacgaagcagcau

SEQ ID NO: 2675534 - RNA, 18 nt, Escherichia coli CFT073
uuacgaagcagcaucagc

SEQ ID NO: 2675535 - RNA, 17 nt, Escherichia coli CFT073
uuacgaugaacaugcag

SEQ ID NO: 2675536 - RNA, 21 nt, Escherichia coli CFT073
uuacgauggcagggcagcaug

SEQ ID NO: 2675537 - RNA, 16 nt, Escherichia coli CFT073
uuacgcaaaauaucga

SEQ ID NO: 2675538 - RNA, 21 nt, Escherichia coli CFT073
uuacgcaguuguucggcgcug

SEQ ID NO: 2675539 - RNA, 19 nt, Escherichia coli CFT073
uuacgcaucgguacaauaa

SEQ ID NO: 2675540 - RNA, 20 nt, Escherichia coli CFT073
uuacgcaucgguacaauaaa

SEQ ID NO: 2675541 - RNA, 20 nt, Escherichia coli CFT073
uuacgccccgguuucucuuc

SEQ ID NO: 2675542 - RNA, 22 nt, Escherichia coli CFT073
uuacgcccggacuagcgcuuuu

SEQ ID NO: 2675543 - RNA, 23 nt, Escherichia coli CFT073
uuacgccgagcgccagccauuca

SEQ ID NO: 2675544 - RNA, 12 nt, Escherichia coli CFT073
uuacgccucagc

SEQ ID NO: 2675545 - RNA, 17 nt, Escherichia coli CFT073
uuacgcgcgcaggcaac

SEQ ID NO: 2675546 - RNA, 13 nt, Escherichia coli CFT073
uuacgcggcuuca

SEQ ID NO: 2675547 - RNA, 14 nt, Escherichia coli CFT073
uuacgcguuuuuca

SEQ ID NO: 2675548 - RNA, 17 nt, Escherichia coli CFT073
uuacgcugauuggcccc

SEQ ID NO: 2675549 - RNA, 13 nt, Escherichia coli CFT073
uuacgcuguaagc

SEQ ID NO: 2675550 - RNA, 19 nt, Escherichia coli CFT073
uuacggaaaucaugcuccg

SEQ ID NO: 2675551 - RNA, 23 nt, Escherichia coli CFT073
uuacggauguacucauccaucuc

SEQ ID NO: 2675552 - RNA, 18 nt, Escherichia coli CFT073
uuacggcggucuggcgau

SEQ ID NO: 2675553 - RNA, 16 nt, Escherichia coli CFT073
uuacgggcaaucuccu

SEQ ID NO: 2675554 - RNA, 23 nt, Escherichia coli CFT073
uuacgggcgaaguucgccaucaa

SEQ ID NO: 2675555 - RNA, 17 nt, Escherichia coli CFT073
uuacgggcguauucaau

SEQ ID NO: 2675556 - RNA, 18 nt, Escherichia coli CFT073
uuacgggcguauucaaua

SEQ ID NO: 2675557 - RNA, 14 nt, Escherichia coli CFT073
uuacgggucacaaa

SEQ ID NO: 2675558 - RNA, 17 nt, Escherichia coli CFT073
uuacgggucacaaacau

SEQ ID NO: 2675559 - RNA, 22 nt, Escherichia coli CFT073
uuacgguaagccgcaaccaccu

SEQ ID NO: 2675560 - RNA, 16 nt, Escherichia coli CFT073
uuacgguauaacccag

SEQ ID NO: 2675561 - RNA, 15 nt, Escherichia coli CFT073
uuacgucgccaguuu

SEQ ID NO: 2675562 - RNA, 15 nt, Escherichia coli CFT073
uuacguuacccagca

SEQ ID NO: 2675563 - RNA, 16 nt, Escherichia coli CFT073
uuacguucgacugcgc

SEQ ID NO: 2675564 - RNA, 17 nt, Escherichia coli CFT073
uuacuaaaaguaaauaa

SEQ ID NO: 2675565 - RNA, 22 nt, Escherichia coli CFT073
uuacuaauagcaaaauauaaac

SEQ ID NO: 2675566 - RNA, 14 nt, Escherichia coli CFT073
uuacuaauuaauaa

SEQ ID NO: 2675567 - RNA, 13 nt, Escherichia coli CFT073
uuacuacaaacaa

SEQ ID NO: 2675568 - RNA, 13 nt, Escherichia coli CFT073
uuacuaucuucaa

SEQ ID NO: 2675569 - RNA, 16 nt, Escherichia coli CFT073
uuacucacaucugaca

SEQ ID NO: 2675570 - RNA, 21 nt, Escherichia coli CFT073
uuacucauccccugacugucg

SEQ ID NO: 2675571 - RNA, 16 nt, Escherichia coli CFT073
uuacuccacuuccugc

SEQ ID NO: 2675572 - RNA, 14 nt, Escherichia coli CFT073
uuacucccuugccu

SEQ ID NO: 2675573 - RNA, 16 nt, Escherichia coli CFT073
uuacucuaacuuauug

SEQ ID NO: 2675574 - RNA, 21 nt, Escherichia coli CFT073
uuacucuucuuuaauuaauca

SEQ ID NO: 2675575 - RNA, 19 nt, Escherichia coli CFT073
uuacugacaucaaacccuu

SEQ ID NO: 2675576 - RNA, 14 nt, Escherichia coli CFT073
uuacugacaucgcu

SEQ ID NO: 2675577 - RNA, 13 nt, Escherichia coli CFT073
uuacugacaugca

SEQ ID NO: 2675578 - RNA, 14 nt, Escherichia coli CFT073
uuacugacaugcac

SEQ ID NO: 2675579 - RNA, 24 nt, Escherichia coli CFT073
uuacugauuaacuugcgacagcca

SEQ ID NO: 2675580 - RNA, 15 nt, Escherichia coli CFT073
uuacugcagccagcg

SEQ ID NO: 2675581 - RNA, 16 nt, Escherichia coli CFT073
uuacugcagccagcgu

SEQ ID NO: 2675582 - RNA, 18 nt, Escherichia coli CFT073
uuacugccagcucaccuc

SEQ ID NO: 2675583 - RNA, 12 nt, Escherichia coli CFT073
uuacugccgcga

SEQ ID NO: 2675584 - RNA, 22 nt, Escherichia coli CFT073
uuacugcgaauuuccugccaga

SEQ ID NO: 2675585 - RNA, 16 nt, Escherichia coli CFT073
uuacuggcuguauaua

SEQ ID NO: 2675586 - RNA, 13 nt, Escherichia coli CFT073
uuacuucgcaucc

SEQ ID NO: 2675587 - RNA, 14 nt, Escherichia coli CFT073
uuacuugcugcucu

SEQ ID NO: 2675588 - RNA, 19 nt, Escherichia coli CFT073
uuagaaaauuauuuuaaau

SEQ ID NO: 2675589 - RNA, 12 nt, Escherichia coli CFT073
uuagaauuauua

SEQ ID NO: 2675590 - RNA, 16 nt, Escherichia coli CFT073
uuagacacaucagcaa

SEQ ID NO: 2675591 - RNA, 14 nt, Escherichia coli CFT073
uuagacaucaaaau

SEQ ID NO: 2675592 - RNA, 16 nt, Escherichia coli CFT073
uuagacaucaaaauua

SEQ ID NO: 2675593 - RNA, 14 nt, Escherichia coli CFT073
uuagagcacagaua

SEQ ID NO: 2675594 - RNA, 22 nt, Escherichia coli CFT073
uuagauagccucaaauuccuua

SEQ ID NO: 2675595 - RNA, 13 nt, Escherichia coli CFT073
uuagcaagacuuu

SEQ ID NO: 2675596 - RNA, 13 nt, Escherichia coli CFT073
uuagcaguucuua

SEQ ID NO: 2675597 - RNA, 17 nt, Escherichia coli CFT073
uuagcaucaagaaaaau

SEQ ID NO: 2675598 - RNA, 16 nt, Escherichia coli CFT073
uuagcauggguauccu

SEQ ID NO: 2675599 - RNA, 17 nt, Escherichia coli CFT073
uuagcauggguauccug

SEQ ID NO: 2675600 - RNA, 20 nt, Escherichia coli CFT073
uuagccaggcaccaaaaauc

SEQ ID NO: 2675601 - RNA, 21 nt, Escherichia coli CFT073
uuagccauauggcugcaucca

SEQ ID NO: 2675602 - RNA, 23 nt, Escherichia coli CFT073
uuagccggauaaugcgccagauc

SEQ ID NO: 2675603 - RNA, 19 nt, Escherichia coli CFT073
uuagccuguaaugucaucu

SEQ ID NO: 2675604 - RNA, 13 nt, Escherichia coli CFT073
uuagccuguauua

SEQ ID NO: 2675605 - RNA, 18 nt, Escherichia coli CFT073
uuagcgauaaaacgccgc

SEQ ID NO: 2675606 - RNA, 22 nt, Escherichia coli CFT073
uuagcgauaaaacgccgcuggu

SEQ ID NO: 2675607 - RNA, 16 nt, Escherichia coli CFT073
uuagcgaucuguucau

SEQ ID NO: 2675608 - RNA, 15 nt, Escherichia coli CFT073
uuagcgccagccaga

SEQ ID NO: 2675609 - RNA, 14 nt, Escherichia coli CFT073
uuagcggcuucaaa

SEQ ID NO: 2675610 - RNA, 22 nt, Escherichia coli CFT073
uuagcgucaaggggucaaugcc

SEQ ID NO: 2675611 - RNA, 16 nt, Escherichia coli CFT073
uuagcguguuccagcg

SEQ ID NO: 2675612 - RNA, 13 nt, Escherichia coli CFT073
uuagcguuugccc

SEQ ID NO: 2675613 - RNA, 12 nt, Escherichia coli CFT073
uuagcuaaucaa

SEQ ID NO: 2675614 - RNA, 17 nt, Escherichia coli CFT073
uuaggaccgguuucaaa

SEQ ID NO: 2675615 - RNA, 18 nt, Escherichia coli CFT073
uuaggaugcugcaauaaa

SEQ ID NO: 2675616 - RNA, 13 nt, Escherichia coli CFT073
uuaggggacauuu

SEQ ID NO: 2675617 - RNA, 22 nt, Escherichia coli CFT073
uuagguacaaagccaacagcag

SEQ ID NO: 2675618 - RNA, 12 nt, Escherichia coli CFT073
uuaguaaccacu

SEQ ID NO: 2675619 - RNA, 15 nt, Escherichia coli CFT073
uuaguaggccggaua

SEQ ID NO: 2675620 - RNA, 22 nt, Escherichia coli CFT073
uuaguauggucgugaucaaugu

SEQ ID NO: 2675621 - RNA, 18 nt, Escherichia coli CFT073
uuagucccaaacagcaga

SEQ ID NO: 2675622 - RNA, 18 nt, Escherichia coli CFT073
uuagucuuauuuaaugua

SEQ ID NO: 2675623 - RNA, 23 nt, Escherichia coli CFT073
uuagugcugcuggaaaagguaag

SEQ ID NO: 2675624 - RNA, 15 nt, Escherichia coli CFT073
uuaguuagaguuaau

SEQ ID NO: 2675625 - RNA, 14 nt, Escherichia coli CFT073
uuauaaaguaaaac

SEQ ID NO: 2675626 - RNA, 17 nt, Escherichia coli CFT073
uuauaaccagacgauuu

SEQ ID NO: 2675627 - RNA, 23 nt, Escherichia coli CFT073
uuauaaccagacgauuuucccug

SEQ ID NO: 2675628 - RNA, 12 nt, Escherichia coli CFT073
uuauaagccaua

SEQ ID NO: 2675629 - RNA, 19 nt, Escherichia coli CFT073
uuauaaguucaaguaaaac

SEQ ID NO: 2675630 - RNA, 17 nt, Escherichia coli CFT073
uuauaauaaauauuauu

SEQ ID NO: 2675631 - RNA, 17 nt, Escherichia coli CFT073
uuauaaucaucuguauc

SEQ ID NO: 2675632 - RNA, 22 nt, Escherichia coli CFT073
uuauacaucgucgcaaauauga

SEQ ID NO: 2675633 - RNA, 20 nt, Escherichia coli CFT073
uuauacauugagcaaagacg

SEQ ID NO: 2675634 - RNA, 19 nt, Escherichia coli CFT073
uuauacgguuggauuucgc

SEQ ID NO: 2675635 - RNA, 23 nt, Escherichia coli CFT073
uuauacugcgcuuuuaauucacu

SEQ ID NO: 2675636 - RNA, 18 nt, Escherichia coli CFT073
uuauagaucaggaaaaac

SEQ ID NO: 2675637 - RNA, 17 nt, Escherichia coli CFT073
uuauagcgauuuuucau

SEQ ID NO: 2675638 - RNA, 19 nt, Escherichia coli CFT073
uuauagcgauuuuucauca

SEQ ID NO: 2675639 - RNA, 13 nt, Escherichia coli CFT073
uuauaguucggcu

SEQ ID NO: 2675640 - RNA, 12 nt, Escherichia coli CFT073
uuauauaaaaca

SEQ ID NO: 2675641 - RNA, 14 nt, Escherichia coli CFT073
uuauaucucagaua

SEQ ID NO: 2675642 - RNA, 18 nt, Escherichia coli CFT073
uuauaucuguacaguuaa

SEQ ID NO: 2675643 - RNA, 21 nt, Escherichia coli CFT073
uuauaucuguacaguuaagcc

SEQ ID NO: 2675644 - RNA, 19 nt, Escherichia coli CFT073
uuauaucuucacgauuauu

SEQ ID NO: 2675645 - RNA, 15 nt, Escherichia coli CFT073
uuauauuauuauucc

SEQ ID NO: 2675646 - RNA, 13 nt, Escherichia coli CFT073
uuauauucaugaa

SEQ ID NO: 2675647 - RNA, 20 nt, Escherichia coli CFT073
uuauauucaugaauaaaaaa

SEQ ID NO: 2675648 - RNA, 16 nt, Escherichia coli CFT073
uuauauuugaacaucg

SEQ ID NO: 2675649 - RNA, 13 nt, Escherichia coli CFT073
uuaucaacaauaa

SEQ ID NO: 2675650 - RNA, 14 nt, Escherichia coli CFT073
uuaucaacacauug

SEQ ID NO: 2675651 - RNA, 22 nt, Escherichia coli CFT073
uuaucaacguagaauaaaagca

SEQ ID NO: 2675652 - RNA, 15 nt, Escherichia coli CFT073
uuaucaagcaccaac

SEQ ID NO: 2675653 - RNA, 23 nt, Escherichia coli CFT073
uuaucaaucuccgccucgcucag

SEQ ID NO: 2675654 - RNA, 21 nt, Escherichia coli CFT073
uuaucaauuaacugugccagc

SEQ ID NO: 2675655 - RNA, 19 nt, Escherichia coli CFT073
uuaucaauuccuauuuugu

SEQ ID NO: 2675656 - RNA, 18 nt, Escherichia coli CFT073
uuaucaccaaugauaagu

SEQ ID NO: 2675657 - RNA, 13 nt, Escherichia coli CFT073
uuaucacgaaaca

SEQ ID NO: 2675658 - RNA, 23 nt, Escherichia coli CFT073
uuaucacgcaucugcuguaaagu

SEQ ID NO: 2675659 - RNA, 19 nt, Escherichia coli CFT073
uuaucacgguaaugauuaa

SEQ ID NO: 2675660 - RNA, 21 nt, Escherichia coli CFT073
uuaucagacaccgauugcccc

SEQ ID NO: 2675661 - RNA, 14 nt, Escherichia coli CFT073
uuaucagauuuuca

SEQ ID NO: 2675662 - RNA, 18 nt, Escherichia coli CFT073
uuaucaggccuacaaguc

SEQ ID NO: 2675663 - RNA, 20 nt, Escherichia coli CFT073
uuaucaggccuacgacuuuc

SEQ ID NO: 2675664 - RNA, 18 nt, Escherichia coli CFT073
uuaucaggccugcaaaau

SEQ ID NO: 2675665 - RNA, 14 nt, Escherichia coli CFT073
uuaucaugcccuuu

SEQ ID NO: 2675666 - RNA, 18 nt, Escherichia coli CFT073
uuaucauugcucuuaauc

SEQ ID NO: 2675667 - RNA, 17 nt, Escherichia coli CFT073
uuauccagccuacagaa

SEQ ID NO: 2675668 - RNA, 22 nt, Escherichia coli CFT073
uuauccauauuuuuugaaaaau

SEQ ID NO: 2675669 - RNA, 17 nt, Escherichia coli CFT073
uuauccaucaaagguuu

SEQ ID NO: 2675670 - RNA, 12 nt, Escherichia coli CFT073
uuauccgaccua

SEQ ID NO: 2675671 - RNA, 12 nt, Escherichia coli CFT073
uuauccgaccug

SEQ ID NO: 2675672 - RNA, 14 nt, Escherichia coli CFT073
uuauccgacuuguc

SEQ ID NO: 2675673 - RNA, 23 nt, Escherichia coli CFT073
uuauccgccagcgccaaagccag

SEQ ID NO: 2675674 - RNA, 18 nt, Escherichia coli CFT073
uuauccggcauauaagug

SEQ ID NO: 2675675 - RNA, 20 nt, Escherichia coli CFT073
uuauccggccaacaaaaaau

SEQ ID NO: 2675676 - RNA, 21 nt, Escherichia coli CFT073
uuauccggccuacauuagucc

SEQ ID NO: 2675677 - RNA, 19 nt, Escherichia coli CFT073
uuauccggccuacggguga

SEQ ID NO: 2675678 - RNA, 22 nt, Escherichia coli CFT073
uuauccggccuacguagaucac

SEQ ID NO: 2675679 - RNA, 19 nt, Escherichia coli CFT073
uuauccggccuacugguga

SEQ ID NO: 2675680 - RNA, 13 nt, Escherichia coli CFT073
uuauccggcuaua

SEQ ID NO: 2675681 - RNA, 17 nt, Escherichia coli CFT073
uuauccgguaaugccau

SEQ ID NO: 2675682 - RNA, 20 nt, Escherichia coli CFT073
uuauccguucuggacuuccc

SEQ ID NO: 2675683 - RNA, 22 nt, Escherichia coli CFT073
uuauccguucuggacuuccccu

SEQ ID NO: 2675684 - RNA, 16 nt, Escherichia coli CFT073
uuauccucuguaaacu

SEQ ID NO: 2675685 - RNA, 12 nt, Escherichia coli CFT073
uuauccugcaaa

SEQ ID NO: 2675686 - RNA, 15 nt, Escherichia coli CFT073
uuauccugcaaauaa

SEQ ID NO: 2675687 - RNA, 17 nt, Escherichia coli CFT073
uuauccugcaaauaacg

SEQ ID NO: 2675688 - RNA, 11 nt, Escherichia coli CFT073
uuaucgagcug

SEQ ID NO: 2675689 - RNA, 18 nt, Escherichia coli CFT073
uuaucgauuuucaaaaua

SEQ ID NO: 2675690 - RNA, 19 nt, Escherichia coli CFT073
uuaucgauuuucaaaauau

SEQ ID NO: 2675691 - RNA, 23 nt, Escherichia coli CFT073
uuaucgauuuucaaaauaucgac

SEQ ID NO: 2675692 - RNA, 16 nt, Escherichia coli CFT073
uuaucgcagccuuacc

SEQ ID NO: 2675693 - RNA, 20 nt, Escherichia coli CFT073
uuaucgcauuaucaaagaug

SEQ ID NO: 2675694 - RNA, 15 nt, Escherichia coli CFT073
uuaucgcccacgcac

SEQ ID NO: 2675695 - RNA, 20 nt, Escherichia coli CFT073
uuaucgcccugcuccagcag

SEQ ID NO: 2675696 - RNA, 16 nt, Escherichia coli CFT073
uuaucgcuauccaguu

SEQ ID NO: 2675697 - RNA, 17 nt, Escherichia coli CFT073
uuaucggaaaagaguac

SEQ ID NO: 2675698 - RNA, 23 nt, Escherichia coli CFT073
uuaucggauaggccauaaucaaa

SEQ ID NO: 2675699 - RNA, 21 nt, Escherichia coli CFT073
uuaucggguccgggcaucaac

SEQ ID NO: 2675700 - RNA, 17 nt, Escherichia coli CFT073
uuaucguaaugcucgac

SEQ ID NO: 2675701 - RNA, 17 nt, Escherichia coli CFT073
uuaucuaauaaacauug

SEQ ID NO: 2675702 - RNA, 20 nt, Escherichia coli CFT073
uuaucuauauuuauucauca

SEQ ID NO: 2675703 - RNA, 15 nt, Escherichia coli CFT073
uuaucucaacacacg

SEQ ID NO: 2675704 - RNA, 15 nt, Escherichia coli CFT073
uuaucugauuuaaaa

SEQ ID NO: 2675705 - RNA, 17 nt, Escherichia coli CFT073
uuaucugccagccaguc

SEQ ID NO: 2675706 - RNA, 17 nt, Escherichia coli CFT073
uuaucuggcauuugcac

SEQ ID NO: 2675707 - RNA, 21 nt, Escherichia coli CFT073
uuaucuggcuaaaacugauaa

SEQ ID NO: 2675708 - RNA, 22 nt, Escherichia coli CFT073
uuaucuggucaguuaacaauaa

SEQ ID NO: 2675709 - RNA, 20 nt, Escherichia coli CFT073
uuaucuguucuuuuauauuc

SEQ ID NO: 2675710 - RNA, 13 nt, Escherichia coli CFT073
uuaucuuauuccc

SEQ ID NO: 2675711 - RNA, 11 nt, Escherichia coli CFT073
uuaucuucaca

SEQ ID NO: 2675712 - RNA, 18 nt, Escherichia coli CFT073
uuaucuucaccaaaugcc

SEQ ID NO: 2675713 - RNA, 15 nt, Escherichia coli CFT073
uuaucuucccagccc

SEQ ID NO: 2675714 - RNA, 17 nt, Escherichia coli CFT073
uuaucuucgcacuuacc

SEQ ID NO: 2675715 - RNA, 12 nt, Escherichia coli CFT073
uuaucuuucagc

SEQ ID NO: 2675716 - RNA, 19 nt, Escherichia coli CFT073
uuaugaccgauaaugaucc

SEQ ID NO: 2675717 - RNA, 12 nt, Escherichia coli CFT073
uuaugaucagca

SEQ ID NO: 2675718 - RNA, 19 nt, Escherichia coli CFT073
uuaugaucagcaacgccgg

SEQ ID NO: 2675719 - RNA, 21 nt, Escherichia coli CFT073
uuaugcacaccccgcgccgcu

SEQ ID NO: 2675720 - RNA, 19 nt, Escherichia coli CFT073
uuaugcagcagguccauca

SEQ ID NO: 2675721 - RNA, 22 nt, Escherichia coli CFT073
uuaugcagccuucauucaggua

SEQ ID NO: 2675722 - RNA, 18 nt, Escherichia coli CFT073
uuaugcccucagccuucu

SEQ ID NO: 2675723 - RNA, 22 nt, Escherichia coli CFT073
uuaugccgaucaucauccagca

SEQ ID NO: 2675724 - RNA, 22 nt, Escherichia coli CFT073
uuaugccggaugguaugccauc

SEQ ID NO: 2675725 - RNA, 15 nt, Escherichia coli CFT073
uuaugcgaaauagcg

SEQ ID NO: 2675726 - RNA, 18 nt, Escherichia coli CFT073
uuaugcguuuugaucuua

SEQ ID NO: 2675727 - RNA, 23 nt, Escherichia coli CFT073
uuaugcucaacggugaccucagg

SEQ ID NO: 2675728 - RNA, 18 nt, Escherichia coli CFT073
uuaugcugcuucauugcu

SEQ ID NO: 2675729 - RNA, 15 nt, Escherichia coli CFT073
uuauggugugcaucc

SEQ ID NO: 2675730 - RNA, 16 nt, Escherichia coli CFT073
uuauguaauaaaccug

SEQ ID NO: 2675731 - RNA, 15 nt, Escherichia coli CFT073
uuaugugcaauuuca

SEQ ID NO: 2675732 - RNA, 21 nt, Escherichia coli CFT073
uuaugugcuucuagcaugaug

SEQ ID NO: 2675733 - RNA, 16 nt, Escherichia coli CFT073
uuauguugauucauuu

SEQ ID NO: 2675734 - RNA, 18 nt, Escherichia coli CFT073
uuauuaaaccaggaacag

SEQ ID NO: 2675735 - RNA, 22 nt, Escherichia coli CFT073
uuauuacagccgggagugaauu

SEQ ID NO: 2675736 - RNA, 17 nt, Escherichia coli CFT073
uuauuaccgucagaaau

SEQ ID NO: 2675737 - RNA, 15 nt, Escherichia coli CFT073
uuauuacuauggaua

SEQ ID NO: 2675738 - RNA, 23 nt, Escherichia coli CFT073
uuauuacugcgaauuuccugcca

SEQ ID NO: 2675739 - RNA, 20 nt, Escherichia coli CFT073
uuauuacuggcgauugucau

SEQ ID NO: 2675740 - RNA, 23 nt, Escherichia coli CFT073
uuauuagcccgggauuugguucu

SEQ ID NO: 2675741 - RNA, 18 nt, Escherichia coli CFT073
uuauuauaaguucaagua

SEQ ID NO: 2675742 - RNA, 16 nt, Escherichia coli CFT073
uuauucacagagauaa

SEQ ID NO: 2675743 - RNA, 18 nt, Escherichia coli CFT073
uuauucaccaccaucaaa

SEQ ID NO: 2675744 - RNA, 15 nt, Escherichia coli CFT073
uuauucagaaaacgu

SEQ ID NO: 2675745 - RNA, 18 nt, Escherichia coli CFT073
uuauucagaguauauauu

SEQ ID NO: 2675746 - RNA, 20 nt, Escherichia coli CFT073
uuauucagaguauauauucg

SEQ ID NO: 2675747 - RNA, 15 nt, Escherichia coli CFT073
uuauucagcagacca

SEQ ID NO: 2675748 - RNA, 12 nt, Escherichia coli CFT073
uuauucauaucu

SEQ ID NO: 2675749 - RNA, 15 nt, Escherichia coli CFT073
uuauucaucagcguu

SEQ ID NO: 2675750 - RNA, 21 nt, Escherichia coli CFT073
uuauucuuuuuugauuccagu

SEQ ID NO: 2675751 - RNA, 22 nt, Escherichia coli CFT073
uuauucuuuuuugauuccagua

SEQ ID NO: 2675752 - RNA, 12 nt, Escherichia coli CFT073
uuauugauaacc

SEQ ID NO: 2675753 - RNA, 22 nt, Escherichia coli CFT073
uuauugaucagugcacugacgc

SEQ ID NO: 2675754 - RNA, 12 nt, Escherichia coli CFT073
uuauugccuguu

SEQ ID NO: 2675755 - RNA, 16 nt, Escherichia coli CFT073
uuauuggguugcagua

SEQ ID NO: 2675756 - RNA, 20 nt, Escherichia coli CFT073
uuauugucauuguuauaaug

SEQ ID NO: 2675757 - RNA, 17 nt, Escherichia coli CFT073
uuauuguuuagcguuau

SEQ ID NO: 2675758 - RNA, 16 nt, Escherichia coli CFT073
uuauuuaaacugaaga

SEQ ID NO: 2675759 - RNA, 16 nt, Escherichia coli CFT073
uuauuuaauguaaaua

SEQ ID NO: 2675760 - RNA, 23 nt, Escherichia coli CFT073
uuauuuccggcaauuguuagcca

SEQ ID NO: 2675761 - RNA, 14 nt, Escherichia coli CFT073
uuauuucucacuuu

SEQ ID NO: 2675762 - RNA, 14 nt, Escherichia coli CFT073
uuauuugacauuuu

SEQ ID NO: 2675763 - RNA, 12 nt, Escherichia coli CFT073
uuauuugcuauc

SEQ ID NO: 2675764 - RNA, 16 nt, Escherichia coli CFT073
uuauuuucgucagcuc

SEQ ID NO: 2675765 - RNA, 16 nt, Escherichia coli CFT073
uuauuuuuauaacuau

SEQ ID NO: 2675766 - RNA, 14 nt, Escherichia coli CFT073
uuauuuuucuaucu

SEQ ID NO: 2675767 - RNA, 19 nt, Escherichia coli CFT073
uucaaaacggucacggcug

SEQ ID NO: 2675768 - RNA, 18 nt, Escherichia coli CFT073
uucaaaagccccugaauu

SEQ ID NO: 2675769 - RNA, 16 nt, Escherichia coli CFT073
uucaaaccuucaucca

SEQ ID NO: 2675770 - RNA, 14 nt, Escherichia coli CFT073
uucaaacgccaacu

SEQ ID NO: 2675771 - RNA, 22 nt, Escherichia coli CFT073
uucaaacugaagauugaacagc

SEQ ID NO: 2675772 - RNA, 16 nt, Escherichia coli CFT073
uucaaacuucgccaca

SEQ ID NO: 2675773 - RNA, 14 nt, Escherichia coli CFT073
uucaaaucaccaaa

SEQ ID NO: 2675774 - RNA, 16 nt, Escherichia coli CFT073
uucaaauccagucuuu

SEQ ID NO: 2675775 - RNA, 23 nt, Escherichia coli CFT073
uucaaaugugggagcuauuuacc

SEQ ID NO: 2675776 - RNA, 19 nt, Escherichia coli CFT073
uucaacaauugaagaauau

SEQ ID NO: 2675777 - RNA, 21 nt, Escherichia coli CFT073
uucaacacacugaauaaaagu

SEQ ID NO: 2675778 - RNA, 16 nt, Escherichia coli CFT073
uucaacagauuuugca

SEQ ID NO: 2675779 - RNA, 17 nt, Escherichia coli CFT073
uucaacagcgugaacug

SEQ ID NO: 2675780 - RNA, 22 nt, Escherichia coli CFT073
uucaacaguaaacucgacuuuc

SEQ ID NO: 2675781 - RNA, 16 nt, Escherichia coli CFT073
uucaacauuuccagcg

SEQ ID NO: 2675782 - RNA, 23 nt, Escherichia coli CFT073
uucaaccgcagugauuucaaccg

SEQ ID NO: 2675783 - RNA, 19 nt, Escherichia coli CFT073
uucaaccucaagcacagcc

SEQ ID NO: 2675784 - RNA, 14 nt, Escherichia coli CFT073
uucaacguagccug

SEQ ID NO: 2675785 - RNA, 19 nt, Escherichia coli CFT073
uucaacgugagauaguaaa

SEQ ID NO: 2675786 - RNA, 18 nt, Escherichia coli CFT073
uucaacuacggcuuuuuu

SEQ ID NO: 2675787 - RNA, 12 nt, Escherichia coli CFT073
uucaagcggacg

SEQ ID NO: 2675788 - RNA, 16 nt, Escherichia coli CFT073
uucaagcuggugcuuu

SEQ ID NO: 2675789 - RNA, 23 nt, Escherichia coli CFT073
uucaaggugauauccaccgcguu

SEQ ID NO: 2675790 - RNA, 17 nt, Escherichia coli CFT073
uucaaguaaaacagccu

SEQ ID NO: 2675791 - RNA, 18 nt, Escherichia coli CFT073
uucaaguguggccgccag

SEQ ID NO: 2675792 - RNA, 20 nt, Escherichia coli CFT073
uucaauaaccgcugccaggc

SEQ ID NO: 2675793 - RNA, 18 nt, Escherichia coli CFT073
uucaauaccgccugcaaa

SEQ ID NO: 2675794 - RNA, 21 nt, Escherichia coli CFT073
uucaauaccgccugcaaauaa

SEQ ID NO: 2675795 - RNA, 22 nt, Escherichia coli CFT073
uucaauaccgccugcaaauaaa

SEQ ID NO: 2675796 - RNA, 23 nt, Escherichia coli CFT073
uucaauaccgccugcaaauaaau

SEQ ID NO: 2675797 - RNA, 22 nt, Escherichia coli CFT073
uucaauacgcuccaguaccugc

SEQ ID NO: 2675798 - RNA, 22 nt, Escherichia coli CFT073
uucaauaucuuccuggcguugg

SEQ ID NO: 2675799 - RNA, 23 nt, Escherichia coli CFT073
uucaauauggaacgcuugcggcu

SEQ ID NO: 2675800 - RNA, 20 nt, Escherichia coli CFT073
uucaauccacugcaucagua

SEQ ID NO: 2675801 - RNA, 22 nt, Escherichia coli CFT073
uucaaugaaugcuucgcucucu

SEQ ID NO: 2675802 - RNA, 15 nt, Escherichia coli CFT073
uucaaugaucgucau

SEQ ID NO: 2675803 - RNA, 21 nt, Escherichia coli CFT073
uucaaugaucgucauaucauc

SEQ ID NO: 2675804 - RNA, 11 nt, Escherichia coli CFT073
uucaaugcaau

SEQ ID NO: 2675805 - RNA, 19 nt, Escherichia coli CFT073
uucaaugcauaucauugcg

SEQ ID NO: 2675806 - RNA, 20 nt, Escherichia coli CFT073
uucaaugcguuguagcuuuu

SEQ ID NO: 2675807 - RNA, 23 nt, Escherichia coli CFT073
uucaauuacgcggcuucaacuuu

SEQ ID NO: 2675808 - RNA, 19 nt, Escherichia coli CFT073
uucaauucuagaaacuguu

SEQ ID NO: 2675809 - RNA, 12 nt, Escherichia coli CFT073
uucacaaaaaca

SEQ ID NO: 2675810 - RNA, 16 nt, Escherichia coli CFT073
uucacaaacagcgccu

SEQ ID NO: 2675811 - RNA, 15 nt, Escherichia coli CFT073
uucacaaccgccauc

SEQ ID NO: 2675812 - RNA, 22 nt, Escherichia coli CFT073
uucacaaccgccauccagguag

SEQ ID NO: 2675813 - RNA, 14 nt, Escherichia coli CFT073
uucacacucugcca

SEQ ID NO: 2675814 - RNA, 15 nt, Escherichia coli CFT073
uucacacucugccag

SEQ ID NO: 2675815 - RNA, 20 nt, Escherichia coli CFT073
uucacacugaugacaggcua

SEQ ID NO: 2675816 - RNA, 23 nt, Escherichia coli CFT073
uucacaggccgccaggcagagcu

SEQ ID NO: 2675817 - RNA, 12 nt, Escherichia coli CFT073
uucacauacuca

SEQ ID NO: 2675818 - RNA, 17 nt, Escherichia coli CFT073
uucacauauugcagcuu

SEQ ID NO: 2675819 - RNA, 11 nt, Escherichia coli CFT073
uucacaucaga

SEQ ID NO: 2675820 - RNA, 12 nt, Escherichia coli CFT073
uucacaucauca

SEQ ID NO: 2675821 - RNA, 23 nt, Escherichia coli CFT073
uucacauccacacacagauaaau

SEQ ID NO: 2675822 - RNA, 18 nt, Escherichia coli CFT073
uucacaugauaauaaaaa

SEQ ID NO: 2675823 - RNA, 13 nt, Escherichia coli CFT073
uucaccaaaugcc

SEQ ID NO: 2675824 - RNA, 19 nt, Escherichia coli CFT073
uucaccacauuaccgauga

SEQ ID NO: 2675825 - RNA, 16 nt, Escherichia coli CFT073
uucaccaccaucaaau

SEQ ID NO: 2675826 - RNA, 18 nt, Escherichia coli CFT073
uucaccacugaauaacau

SEQ ID NO: 2675827 - RNA, 20 nt, Escherichia coli CFT073
uucaccacugccuuuaucaa

SEQ ID NO: 2675828 - RNA, 14 nt, Escherichia coli CFT073
uucaccagcgcacg

SEQ ID NO: 2675829 - RNA, 15 nt, Escherichia coli CFT073
uucaccagguuuuug

SEQ ID NO: 2675830 - RNA, 21 nt, Escherichia coli CFT073
uucaccagguuuuuggguuaa

SEQ ID NO: 2675831 - RNA, 16 nt, Escherichia coli CFT073
uucaccaucgcaaaca

SEQ ID NO: 2675832 - RNA, 13 nt, Escherichia coli CFT073
uucacccaacucu

SEQ ID NO: 2675833 - RNA, 16 nt, Escherichia coli CFT073
uucacccaucgccaga

SEQ ID NO: 2675834 - RNA, 24 nt, Escherichia coli CFT073
uucaccccguugcuucgccgcauc

SEQ ID NO: 2675835 - RNA, 19 nt, Escherichia coli CFT073
uucaccgacaucuuucugc

SEQ ID NO: 2675836 - RNA, 21 nt, Escherichia coli CFT073
uucaccgcacgacgaaucuga

SEQ ID NO: 2675837 - RNA, 15 nt, Escherichia coli CFT073
uucaccgccugcuga

SEQ ID NO: 2675838 - RNA, 15 nt, Escherichia coli CFT073
uucaccguccaucca

SEQ ID NO: 2675839 - RNA, 17 nt, Escherichia coli CFT073
uucaccguucaauuccg

SEQ ID NO: 2675840 - RNA, 15 nt, Escherichia coli CFT073
uucaccucagugacc

SEQ ID NO: 2675841 - RNA, 22 nt, Escherichia coli CFT073
uucaccucagugaccgucaugc

SEQ ID NO: 2675842 - RNA, 16 nt, Escherichia coli CFT073
uucaccucuucauuaa

SEQ ID NO: 2675843 - RNA, 20 nt, Escherichia coli CFT073
uucaccucuucauuaaacca

SEQ ID NO: 2675844 - RNA, 18 nt, Escherichia coli CFT073
uucaccugccugcagcug

SEQ ID NO: 2675845 - RNA, 22 nt, Escherichia coli CFT073
uucacgaagauauucaucagca

SEQ ID NO: 2675846 - RNA, 21 nt, Escherichia coli CFT073
uucacgacccggcguuuucag

SEQ ID NO: 2675847 - RNA, 13 nt, Escherichia coli CFT073
uucacgagagcgg

SEQ ID NO: 2675848 - RNA, 15 nt, Escherichia coli CFT073
uucacgaucuucacg

SEQ ID NO: 2675849 - RNA, 20 nt, Escherichia coli CFT073
uucacgauuugcguaaaacc

SEQ ID NO: 2675850 - RNA, 16 nt, Escherichia coli CFT073
uucacgcaccauaaua

SEQ ID NO: 2675851 - RNA, 15 nt, Escherichia coli CFT073
uucacgcagugcugc

SEQ ID NO: 2675852 - RNA, 18 nt, Escherichia coli CFT073
uucacgccaaaagcgauu

SEQ ID NO: 2675853 - RNA, 16 nt, Escherichia coli CFT073
uucacgcccagaucca

SEQ ID NO: 2675854 - RNA, 18 nt, Escherichia coli CFT073
uucacgccgcaucuggca

SEQ ID NO: 2675855 - RNA, 15 nt, Escherichia coli CFT073
uucacgcucacccau

SEQ ID NO: 2675856 - RNA, 16 nt, Escherichia coli CFT073
uucacggccccaaaua

SEQ ID NO: 2675857 - RNA, 15 nt, Escherichia coli CFT073
uucacggcgauacca

SEQ ID NO: 2675858 - RNA, 16 nt, Escherichia coli CFT073
uucacggcgauaccag

SEQ ID NO: 2675859 - RNA, 15 nt, Escherichia coli CFT073
uucacggucggccag

SEQ ID NO: 2675860 - RNA, 21 nt, Escherichia coli CFT073
uucacggucggccaguauuug

SEQ ID NO: 2675861 - RNA, 20 nt, Escherichia coli CFT073
uucacguccggcagcagaaa

SEQ ID NO: 2675862 - RNA, 15 nt, Escherichia coli CFT073
uucacuacugguugc

SEQ ID NO: 2675863 - RNA, 12 nt, Escherichia coli CFT073
uucacugaaaca

SEQ ID NO: 2675864 - RNA, 14 nt, Escherichia coli CFT073
uucacugaaacaga

SEQ ID NO: 2675865 - RNA, 16 nt, Escherichia coli CFT073
uucacugaaacagaua

SEQ ID NO: 2675866 - RNA, 16 nt, Escherichia coli CFT073
uucacugacgcccguu

SEQ ID NO: 2675867 - RNA, 17 nt, Escherichia coli CFT073
uucacugccguacaggc

SEQ ID NO: 2675868 - RNA, 16 nt, Escherichia coli CFT073
uucacugcgaccagca

SEQ ID NO: 2675869 - RNA, 22 nt, Escherichia coli CFT073
uucacugcgaccagcagcguuu

SEQ ID NO: 2675870 - RNA, 20 nt, Escherichia coli CFT073
uucacugggcgauuaauaaa

SEQ ID NO: 2675871 - RNA, 20 nt, Escherichia coli CFT073
uucacuguaggcauauuugg

SEQ ID NO: 2675872 - RNA, 15 nt, Escherichia coli CFT073
uucacugucaucgac

SEQ ID NO: 2675873 - RNA, 21 nt, Escherichia coli CFT073
uucacuguucgccgcagguag

SEQ ID NO: 2675874 - RNA, 18 nt, Escherichia coli CFT073
uucacuucaguaaauacu

SEQ ID NO: 2675875 - RNA, 21 nt, Escherichia coli CFT073
uucacuuucaaauccagccag

SEQ ID NO: 2675876 - RNA, 14 nt, Escherichia coli CFT073
uucacuuucugacc

SEQ ID NO: 2675877 - RNA, 19 nt, Escherichia coli CFT073
uucacuuucugaccaugca

SEQ ID NO: 2675878 - RNA, 17 nt, Escherichia coli CFT073
uucacuuuguuccugaa

SEQ ID NO: 2675879 - RNA, 17 nt, Escherichia coli CFT073
uucacuuuucuucugaa

SEQ ID NO: 2675880 - RNA, 18 nt, Escherichia coli CFT073
uucagaacacaaaaccga

SEQ ID NO: 2675881 - RNA, 23 nt, Escherichia coli CFT073
uucagaacacuucuucuguuucu

SEQ ID NO: 2675882 - RNA, 12 nt, Escherichia coli CFT073
uucagaauaaug

SEQ ID NO: 2675883 - RNA, 15 nt, Escherichia coli CFT073
uucagaauugccgcc

SEQ ID NO: 2675884 - RNA, 15 nt, Escherichia coli CFT073
uucagaccgccgaua

SEQ ID NO: 2675885 - RNA, 12 nt, Escherichia coli CFT073
uucagacgcugc

SEQ ID NO: 2675886 - RNA, 23 nt, Escherichia coli CFT073
uucagagugcccacguugcauca

SEQ ID NO: 2675887 - RNA, 17 nt, Escherichia coli CFT073
uucagaguuguaccacc

SEQ ID NO: 2675888 - RNA, 16 nt, Escherichia coli CFT073
uucagauaauagguaa

SEQ ID NO: 2675889 - RNA, 14 nt, Escherichia coli CFT073
uucagaucaucaaa

SEQ ID NO: 2675890 - RNA, 13 nt, Escherichia coli CFT073
uucagaugaccaa

SEQ ID NO: 2675891 - RNA, 17 nt, Escherichia coli CFT073
uucagaugccauuuugc

SEQ ID NO: 2675892 - RNA, 21 nt, Escherichia coli CFT073
uucagcaaaccacugauaagc

SEQ ID NO: 2675893 - RNA, 18 nt, Escherichia coli CFT073
uucagcaacggaaaagca

SEQ ID NO: 2675894 - RNA, 22 nt, Escherichia coli CFT073
uucagcaacgugcuucgcgcug

SEQ ID NO: 2675895 - RNA, 22 nt, Escherichia coli CFT073
uucagcaagaguuuuaaaacca

SEQ ID NO: 2675896 - RNA, 17 nt, Escherichia coli CFT073
uucagcaaucucuucaa

SEQ ID NO: 2675897 - RNA, 14 nt, Escherichia coli CFT073
uucagcaauuuguu

SEQ ID NO: 2675898 - RNA, 22 nt, Escherichia coli CFT073
uucagcacgaucccuucgauau

SEQ ID NO: 2675899 - RNA, 21 nt, Escherichia coli CFT073
uucagcacuggcggcagcagg

SEQ ID NO: 2675900 - RNA, 18 nt, Escherichia coli CFT073
uucagcacuucggcauca

SEQ ID NO: 2675901 - RNA, 12 nt, Escherichia coli CFT073
uucagcagagca

SEQ ID NO: 2675902 - RNA, 17 nt, Escherichia coli CFT073
uucagcaguucugccag

SEQ ID NO: 2675903 - RNA, 21 nt, Escherichia coli CFT073
uucagccauacguugcauaaa

SEQ ID NO: 2675904 - RNA, 19 nt, Escherichia coli CFT073
uucagcccggcaacguugc

SEQ ID NO: 2675905 - RNA, 16 nt, Escherichia coli CFT073
uucagcgaaaaagucc

SEQ ID NO: 2675906 - RNA, 15 nt, Escherichia coli CFT073
uucagcgacaucguc

SEQ ID NO: 2675907 - RNA, 13 nt, Escherichia coli CFT073
uucagcgcaucgu

SEQ ID NO: 2675908 - RNA, 14 nt, Escherichia coli CFT073
uucagcgccagaaa

SEQ ID NO: 2675909 - RNA, 16 nt, Escherichia coli CFT073
uucagcgccauaauca

SEQ ID NO: 2675910 - RNA, 18 nt, Escherichia coli CFT073
uucagcgcccugccgauc

SEQ ID NO: 2675911 - RNA, 20 nt, Escherichia coli CFT073
uucagcgcccugccgaucuc

SEQ ID NO: 2675912 - RNA, 21 nt, Escherichia coli CFT073
uucagcggcgcaacccccaca

SEQ ID NO: 2675913 - RNA, 20 nt, Escherichia coli CFT073
uucagcggugucugccaguc

SEQ ID NO: 2675914 - RNA, 17 nt, Escherichia coli CFT073
uucagcgucaucaagca

SEQ ID NO: 2675915 - RNA, 16 nt, Escherichia coli CFT073
uucagcgugccgaaga

SEQ ID NO: 2675916 - RNA, 17 nt, Escherichia coli CFT073
uucagcguuucgucggu

SEQ ID NO: 2675917 - RNA, 14 nt, Escherichia coli CFT073
uucagcucaagaau

SEQ ID NO: 2675918 - RNA, 17 nt, Escherichia coli CFT073
uucagcucagucgcaau

SEQ ID NO: 2675919 - RNA, 20 nt, Escherichia coli CFT073
uucagcuuuuuagcgaucuc

SEQ ID NO: 2675920 - RNA, 14 nt, Escherichia coli CFT073
uucaggaaauaaau

SEQ ID NO: 2675921 - RNA, 16 nt, Escherichia coli CFT073
uucaggaaauaaauaa

SEQ ID NO: 2675922 - RNA, 12 nt, Escherichia coli CFT073
uucaggaacugc

SEQ ID NO: 2675923 - RNA, 18 nt, Escherichia coli CFT073
uucaggaacugcauacuc

SEQ ID NO: 2675924 - RNA, 21 nt, Escherichia coli CFT073
uucaggauauuuauauuuugc

SEQ ID NO: 2675925 - RNA, 17 nt, Escherichia coli CFT073
uucaggaugugagcugg

SEQ ID NO: 2675926 - RNA, 14 nt, Escherichia coli CFT073
uucaggauugguaa

SEQ ID NO: 2675927 - RNA, 17 nt, Escherichia coli CFT073
uucaggcaacaaaaaac

SEQ ID NO: 2675928 - RNA, 17 nt, Escherichia coli CFT073
uucaggccgcgcaguuc

SEQ ID NO: 2675929 - RNA, 13 nt, Escherichia coli CFT073
uucaggcugucag

SEQ ID NO: 2675930 - RNA, 22 nt, Escherichia coli CFT073
uucagggcagcaauagcaaagc

SEQ ID NO: 2675931 - RNA, 23 nt, Escherichia coli CFT073
uucagggcagcaauagcaaagcc

SEQ ID NO: 2675932 - RNA, 15 nt, Escherichia coli CFT073
uucagggcagugcca

SEQ ID NO: 2675933 - RNA, 22 nt, Escherichia coli CFT073
uucagguaauauugcguaccug

SEQ ID NO: 2675934 - RNA, 17 nt, Escherichia coli CFT073
uucaggucguucaguuu

SEQ ID NO: 2675935 - RNA, 14 nt, Escherichia coli CFT073
uucaggugaccaaa

SEQ ID NO: 2675936 - RNA, 22 nt, Escherichia coli CFT073
uucagguggccaaauucagugu

SEQ ID NO: 2675937 - RNA, 22 nt, Escherichia coli CFT073
uucaguaaaaccauuaccaauc

SEQ ID NO: 2675938 - RNA, 17 nt, Escherichia coli CFT073
uucaguauauugcagaa

SEQ ID NO: 2675939 - RNA, 17 nt, Escherichia coli CFT073
uucaguaugaucuugcc

SEQ ID NO: 2675940 - RNA, 15 nt, Escherichia coli CFT073
uucaguauugagcaa

SEQ ID NO: 2675941 - RNA, 14 nt, Escherichia coli CFT073
uucagugagcuguc

SEQ ID NO: 2675942 - RNA, 16 nt, Escherichia coli CFT073
uucagugcauaagucc

SEQ ID NO: 2675943 - RNA, 18 nt, Escherichia coli CFT073
uucaguggguuaugaaac

SEQ ID NO: 2675944 - RNA, 21 nt, Escherichia coli CFT073
uucaguguuuccccacuauug

SEQ ID NO: 2675945 - RNA, 20 nt, Escherichia coli CFT073
uucaguugauuacguacugc

SEQ ID NO: 2675946 - RNA, 17 nt, Escherichia coli CFT073
uucaguuugcccagguc

SEQ ID NO: 2675947 - RNA, 15 nt, Escherichia coli CFT073
uucauaaacaauaca

SEQ ID NO: 2675948 - RNA, 23 nt, Escherichia coli CFT073
uucauaaacacgguuuuucauug

SEQ ID NO: 2675949 - RNA, 16 nt, Escherichia coli CFT073
uucauaaacacucaca

SEQ ID NO: 2675950 - RNA, 15 nt, Escherichia coli CFT073
uucauaaagauauug

SEQ ID NO: 2675951 - RNA, 15 nt, Escherichia coli CFT073
uucauaaagcuauua

SEQ ID NO: 2675952 - RNA, 20 nt, Escherichia coli CFT073
uucauaaauuaccaccagcg

SEQ ID NO: 2675953 - RNA, 19 nt, Escherichia coli CFT073
uucauaaucaagaccucau

SEQ ID NO: 2675954 - RNA, 21 nt, Escherichia coli CFT073
uucauacgcaaugugcagcag

SEQ ID NO: 2675955 - RNA, 12 nt, Escherichia coli CFT073
uucauacugccg

SEQ ID NO: 2675956 - RNA, 21 nt, Escherichia coli CFT073
uucauacugccgaccaucugu

SEQ ID NO: 2675957 - RNA, 17 nt, Escherichia coli CFT073
uucauagauagccagca

SEQ ID NO: 2675958 - RNA, 18 nt, Escherichia coli CFT073
uucauaggcuuccacuuc

SEQ ID NO: 2675959 - RNA, 17 nt, Escherichia coli CFT073
uucauagguaaacauca

SEQ ID NO: 2675960 - RNA, 16 nt, Escherichia coli CFT073
uucauauaccgcauca

SEQ ID NO: 2675961 - RNA, 13 nt, Escherichia coli CFT073
uucauauccggca

SEQ ID NO: 2675962 - RNA, 19 nt, Escherichia coli CFT073
uucauauccggcauuuuuu

SEQ ID NO: 2675963 - RNA, 19 nt, Escherichia coli CFT073
uucauaugcuuguuugccc

SEQ ID NO: 2675964 - RNA, 22 nt, Escherichia coli CFT073
uucauauggcacuuucaucgcg

SEQ ID NO: 2675965 - RNA, 18 nt, Escherichia coli CFT073
uucauauuaaccucucag

SEQ ID NO: 2675966 - RNA, 23 nt, Escherichia coli CFT073
uucaucaacgguuuuacaauguc

SEQ ID NO: 2675967 - RNA, 14 nt, Escherichia coli CFT073
uucaucaccagcuc

SEQ ID NO: 2675968 - RNA, 16 nt, Escherichia coli CFT073
uucaucaccagcucca

SEQ ID NO: 2675969 - RNA, 17 nt, Escherichia coli CFT073
uucaucacgcacugcaa

SEQ ID NO: 2675970 - RNA, 12 nt, Escherichia coli CFT073
uucaucacgcca

SEQ ID NO: 2675971 - RNA, 15 nt, Escherichia coli CFT073
uucaucagaagggaa

SEQ ID NO: 2675972 - RNA, 16 nt, Escherichia coli CFT073
uucaucauacugauaa

SEQ ID NO: 2675973 - RNA, 19 nt, Escherichia coli CFT073
uucaucaucaguccguugu

SEQ ID NO: 2675974 - RNA, 22 nt, Escherichia coli CFT073
uucaucauccgugaauaaugca

SEQ ID NO: 2675975 - RNA, 20 nt, Escherichia coli CFT073
uucaucaucgcuuucaaauc

SEQ ID NO: 2675976 - RNA, 17 nt, Escherichia coli CFT073
uucauccaggcacuggc

SEQ ID NO: 2675977 - RNA, 21 nt, Escherichia coli CFT073
uucauccaguagaauaaugau

SEQ ID NO: 2675978 - RNA, 22 nt, Escherichia coli CFT073
uucauccccgcgcggaacauga

SEQ ID NO: 2675979 - RNA, 20 nt, Escherichia coli CFT073
uucaucccgguuauuaaaac

SEQ ID NO: 2675980 - RNA, 17 nt, Escherichia coli CFT073
uucaucccucucaucca

SEQ ID NO: 2675981 - RNA, 17 nt, Escherichia coli CFT073
uucauccuggcacagca

SEQ ID NO: 2675982 - RNA, 23 nt, Escherichia coli CFT073
uucauccuguaugacaaaagaau

SEQ ID NO: 2675983 - RNA, 15 nt, Escherichia coli CFT073
uucaucgagcagcau

SEQ ID NO: 2675984 - RNA, 14 nt, Escherichia coli CFT073
uucaucgccaaaau

SEQ ID NO: 2675985 - RNA, 19 nt, Escherichia coli CFT073
uucaucgccauuaccacca

SEQ ID NO: 2675986 - RNA, 13 nt, Escherichia coli CFT073
uucaucgcccaca

SEQ ID NO: 2675987 - RNA, 16 nt, Escherichia coli CFT073
uucaucgcuuaaccca

SEQ ID NO: 2675988 - RNA, 15 nt, Escherichia coli CFT073
uucaucggauaaggu

SEQ ID NO: 2675989 - RNA, 19 nt, Escherichia coli CFT073
uucaucggauaggcaccgc

SEQ ID NO: 2675990 - RNA, 21 nt, Escherichia coli CFT073
uucaucggcaguuugagauug

SEQ ID NO: 2675991 - RNA, 17 nt, Escherichia coli CFT073
uucaucggcguuuucug

SEQ ID NO: 2675992 - RNA, 15 nt, Escherichia coli CFT073
uucaucguaaucucu

SEQ ID NO: 2675993 - RNA, 17 nt, Escherichia coli CFT073
uucaucgugcucgcuuu

SEQ ID NO: 2675994 - RNA, 20 nt, Escherichia coli CFT073
uucaucuacuacuggagaca

SEQ ID NO: 2675995 - RNA, 14 nt, Escherichia coli CFT073
uucaucucaucaau

SEQ ID NO: 2675996 - RNA, 21 nt, Escherichia coli CFT073
uucaucucgaauacgccgaua

SEQ ID NO: 2675997 - RNA, 17 nt, Escherichia coli CFT073
uucaucuguuugccgga

SEQ ID NO: 2675998 - RNA, 13 nt, Escherichia coli CFT073
uucaucuucaucc

SEQ ID NO: 2675999 - RNA, 14 nt, Escherichia coli CFT073
uucaucuuccagcu

SEQ ID NO: 2676000 - RNA, 14 nt, Escherichia coli CFT073
uucaucuucgucaa

SEQ ID NO: 2676001 - RNA, 15 nt, Escherichia coli CFT073
uucaucuucgucaaa

SEQ ID NO: 2676002 - RNA, 19 nt, Escherichia coli CFT073
uucaucuucgucaaagaua

SEQ ID NO: 2676003 - RNA, 15 nt, Escherichia coli CFT073
uucaugcaaggaaaa

SEQ ID NO: 2676004 - RNA, 14 nt, Escherichia coli CFT073
uucaugcuauuccu

SEQ ID NO: 2676005 - RNA, 17 nt, Escherichia coli CFT073
uucaugcuauuccuuga

SEQ ID NO: 2676006 - RNA, 20 nt, Escherichia coli CFT073
uucauggcgugacauggcga

SEQ ID NO: 2676007 - RNA, 21 nt, Escherichia coli CFT073
uucaugguacgggacagcagg

SEQ ID NO: 2676008 - RNA, 15 nt, Escherichia coli CFT073
uucauggucagaaca

SEQ ID NO: 2676009 - RNA, 21 nt, Escherichia coli CFT073
uucaugguggaacucuucaca

SEQ ID NO: 2676010 - RNA, 15 nt, Escherichia coli CFT073
uucaugguuagccug

SEQ ID NO: 2676011 - RNA, 15 nt, Escherichia coli CFT073
uucauguaacgcugc

SEQ ID NO: 2676012 - RNA, 20 nt, Escherichia coli CFT073
uucauuaagaacuccugaaa

SEQ ID NO: 2676013 - RNA, 14 nt, Escherichia coli CFT073
uucauuaauaacca

SEQ ID NO: 2676014 - RNA, 18 nt, Escherichia coli CFT073
uucauuacuauaacccac

SEQ ID NO: 2676015 - RNA, 13 nt, Escherichia coli CFT073
uucauuacuuauc

SEQ ID NO: 2676016 - RNA, 14 nt, Escherichia coli CFT073
uucauucaccaguu

SEQ ID NO: 2676017 - RNA, 17 nt, Escherichia coli CFT073
uucauucacgauuugcg

SEQ ID NO: 2676018 - RNA, 14 nt, Escherichia coli CFT073
uucauucagaaaaa

SEQ ID NO: 2676019 - RNA, 15 nt, Escherichia coli CFT073
uucauucagaacacu

SEQ ID NO: 2676020 - RNA, 20 nt, Escherichia coli CFT073
ucgugauaaguaaucauaau

SEQ ID NO: 2676021 - RNA, 17 nt, Escherichia coli CFT073
ucgugcaccgccuguug

SEQ ID NO: 2676022 - RNA, 20 nt, Escherichia coli CFT073
ucgugccagaaaaucacggc

SEQ ID NO: 2676023 - RNA, 11 nt, Escherichia coli CFT073
ucgugccagag

SEQ ID NO: 2676024 - RNA, 14 nt, Escherichia coli CFT073
ucgugcccaacugc

SEQ ID NO: 2676025 - RNA, 20 nt, Escherichia coli CFT073
ucgugccgcuacugcuugcc

SEQ ID NO: 2676026 - RNA, 16 nt, Escherichia coli CFT073
ucgugcgggaccagca

SEQ ID NO: 2676027 - RNA, 19 nt, Escherichia coli CFT073
ucgugcgguaacuucgcug

SEQ ID NO: 2676028 - RNA, 19 nt, Escherichia coli CFT073
ucgugcgucgcauccggca

SEQ ID NO: 2676029 - RNA, 21 nt, Escherichia coli CFT073
ucguggcaaucguaacccaac

SEQ ID NO: 2676030 - RNA, 14 nt, Escherichia coli CFT073
ucguggccaugacc

SEQ ID NO: 2676031 - RNA, 14 nt, Escherichia coli CFT073
ucguggcugaguga

SEQ ID NO: 2676032 - RNA, 23 nt, Escherichia coli CFT073
ucguggugagggcaaacagacgc

SEQ ID NO: 2676033 - RNA, 13 nt, Escherichia coli CFT073
ucgugguugguaa

SEQ ID NO: 2676034 - RNA, 14 nt, Escherichia coli CFT073
ucguguauuuugca

SEQ ID NO: 2676035 - RNA, 24 nt, Escherichia coli CFT073
ucguguuuugcaaucaucgcagca

SEQ ID NO: 2676036 - RNA, 17 nt, Escherichia coli CFT073
ucguuaacaaauacgcu

SEQ ID NO: 2676037 - RNA, 19 nt, Escherichia coli CFT073
ucguuaacaacaacuucua

SEQ ID NO: 2676038 - RNA, 21 nt, Escherichia coli CFT073
ucguuaacggcauuuuccagc

SEQ ID NO: 2676039 - RNA, 20 nt, Escherichia coli CFT073
ucguuaaggccgcuuucaga

SEQ ID NO: 2676040 - RNA, 15 nt, Escherichia coli CFT073
ucguuaccacuuugg

SEQ ID NO: 2676041 - RNA, 22 nt, Escherichia coli CFT073
ucguuaccacuuuggugaaugc

SEQ ID NO: 2676042 - RNA, 12 nt, Escherichia coli CFT073
ucguuaccgugu

SEQ ID NO: 2676043 - RNA, 14 nt, Escherichia coli CFT073
ucguuaguaaccac

SEQ ID NO: 2676044 - RNA, 22 nt, Escherichia coli CFT073
ucguuauaacaggcuaccgcag

SEQ ID NO: 2676045 - RNA, 19 nt, Escherichia coli CFT073
ucguuaucggaaaagagua

SEQ ID NO: 2676046 - RNA, 17 nt, Escherichia coli CFT073
ucguucaacaagccacg

SEQ ID NO: 2676047 - RNA, 12 nt, Escherichia coli CFT073
ucguucgcacca

SEQ ID NO: 2676048 - RNA, 18 nt, Escherichia coli CFT073
ucguucgcaccaaaucca

SEQ ID NO: 2676049 - RNA, 13 nt, Escherichia coli CFT073
ucguucgccgcau

SEQ ID NO: 2676050 - RNA, 23 nt, Escherichia coli CFT073
ucguucucgcgauaaaacuucug

SEQ ID NO: 2676051 - RNA, 16 nt, Escherichia coli CFT073
ucguugaaaaaauuuu

SEQ ID NO: 2676052 - RNA, 17 nt, Escherichia coli CFT073
ucguugaauacauucau

SEQ ID NO: 2676053 - RNA, 19 nt, Escherichia coli CFT073
ucguugaccuguacaagca

SEQ ID NO: 2676054 - RNA, 17 nt, Escherichia coli CFT073
ucguugacgaccagucc

SEQ ID NO: 2676055 - RNA, 14 nt, Escherichia coli CFT073
ucguugagcggauc

SEQ ID NO: 2676056 - RNA, 19 nt, Escherichia coli CFT073
ucguugauaauaaagcuac

SEQ ID NO: 2676057 - RNA, 14 nt, Escherichia coli CFT073
ucguugugucgcca

SEQ ID NO: 2676058 - RNA, 22 nt, Escherichia coli CFT073
ucguuucgcccguucuuccuca

SEQ ID NO: 2676059 - RNA, 18 nt, Escherichia coli CFT073
ucguuugcauccaguucg

SEQ ID NO: 2676060 - RNA, 18 nt, Escherichia coli CFT073
ucguuugcauccggcacg

SEQ ID NO: 2676061 - RNA, 21 nt, Escherichia coli CFT073
ucguuuuaaugcgauccugag

SEQ ID NO: 2676062 - RNA, 17 nt, Escherichia coli CFT073
ucguuuucgccggaacc

SEQ ID NO: 2676063 - RNA, 19 nt, Escherichia coli CFT073
ucguuuugccgccaucauc

SEQ ID NO: 2676064 - RNA, 18 nt, Escherichia coli CFT073
ucuaaaaacaauucuucg

SEQ ID NO: 2676065 - RNA, 16 nt, Escherichia coli CFT073
ucuaaaccccaaccac

SEQ ID NO: 2676066 - RNA, 15 nt, Escherichia coli CFT073
ucuaacgaugccagc

SEQ ID NO: 2676067 - RNA, 18 nt, Escherichia coli CFT073
ucuaacgaugccagcgcu

SEQ ID NO: 2676068 - RNA, 17 nt, Escherichia coli CFT073
ucuaaugccauuaacau

SEQ ID NO: 2676069 - RNA, 22 nt, Escherichia coli CFT073
ucuaaugccauuaacaucccuu

SEQ ID NO: 2676070 - RNA, 23 nt, Escherichia coli CFT073
ucuaaugccauuaacaucccuuc

SEQ ID NO: 2676071 - RNA, 12 nt, Escherichia coli CFT073
ucuaaugcuccu

SEQ ID NO: 2676072 - RNA, 12 nt, Escherichia coli CFT073
ucuaaugcuuuu

SEQ ID NO: 2676073 - RNA, 21 nt, Escherichia coli CFT073
ucuacaaccaguuuaugccug

SEQ ID NO: 2676074 - RNA, 21 nt, Escherichia coli CFT073
ucuacaauugguaaauaagcg

SEQ ID NO: 2676075 - RNA, 17 nt, Escherichia coli CFT073
ucuacauguguucugca

SEQ ID NO: 2676076 - RNA, 15 nt, Escherichia coli CFT073
ucuaccaccaucguc

SEQ ID NO: 2676077 - RNA, 13 nt, Escherichia coli CFT073
ucuaccagcaccu

SEQ ID NO: 2676078 - RNA, 16 nt, Escherichia coli CFT073
ucuaccaguuccagcg

SEQ ID NO: 2676079 - RNA, 16 nt, Escherichia coli CFT073
ucuacccgcucgaagu

SEQ ID NO: 2676080 - RNA, 18 nt, Escherichia coli CFT073
ucuaccgggcugaguccc

SEQ ID NO: 2676081 - RNA, 19 nt, Escherichia coli CFT073
ucuaccgucuguaaccaga

SEQ ID NO: 2676082 - RNA, 16 nt, Escherichia coli CFT073
ucuaccuggucaccga

SEQ ID NO: 2676083 - RNA, 20 nt, Escherichia coli CFT073
ucuacggaagaguuuuucag

SEQ ID NO: 2676084 - RNA, 20 nt, Escherichia coli CFT073
ucuacugaaggcgcauugcu

SEQ ID NO: 2676085 - RNA, 12 nt, Escherichia coli CFT073
ucuacuucuuuc

SEQ ID NO: 2676086 - RNA, 22 nt, Escherichia coli CFT073
ucuagaaacuguuaagcccauu

SEQ ID NO: 2676087 - RNA, 22 nt, Escherichia coli CFT073
ucuagcaugaugauaucacugg

SEQ ID NO: 2676088 - RNA, 16 nt, Escherichia coli CFT073
ucuaggcucuuucucu

SEQ ID NO: 2676089 - RNA, 21 nt, Escherichia coli CFT073
ucuauauauguuuuuuuuauc

SEQ ID NO: 2676090 - RNA, 14 nt, Escherichia coli CFT073
ucuauauuuauuca

SEQ ID NO: 2676091 - RNA, 14 nt, Escherichia coli CFT073
ucuaucacuauaaa

SEQ ID NO: 2676092 - RNA, 18 nt, Escherichia coli CFT073
ucuauccacauuagucau

SEQ ID NO: 2676093 - RNA, 15 nt, Escherichia coli CFT073
ucuaucgaaucuguu

SEQ ID NO: 2676094 - RNA, 17 nt, Escherichia coli CFT073
ucuaucgcauuauccuu

SEQ ID NO: 2676095 - RNA, 16 nt, Escherichia coli CFT073
ucuaucuugauuugcu

SEQ ID NO: 2676096 - RNA, 20 nt, Escherichia coli CFT073
ucuaugagagccguuaaaac

SEQ ID NO: 2676097 - RNA, 20 nt, Escherichia coli CFT073
ucuaugagaucguuaugcaa

SEQ ID NO: 2676098 - RNA, 18 nt, Escherichia coli CFT073
ucuaugucgcauccggca

SEQ ID NO: 2676099 - RNA, 20 nt, Escherichia coli CFT073
ucuauuccgcgugaaaugcc

SEQ ID NO: 2676100 - RNA, 13 nt, Escherichia coli CFT073
ucucaaaacugaa

SEQ ID NO: 2676101 - RNA, 14 nt, Escherichia coli CFT073
ucucaaaacugaaa

SEQ ID NO: 2676102 - RNA, 15 nt, Escherichia coli CFT073
ucucaaaucuucuca

SEQ ID NO: 2676103 - RNA, 22 nt, Escherichia coli CFT073
ucucaaccgcuucuuucucaau

SEQ ID NO: 2676104 - RNA, 21 nt, Escherichia coli CFT073
ucucaacgcccuguaaaaaag

SEQ ID NO: 2676105 - RNA, 14 nt, Escherichia coli CFT073
ucucaagagugaac

SEQ ID NO: 2676106 - RNA, 18 nt, Escherichia coli CFT073
ucucaauauacgaaaauu

SEQ ID NO: 2676107 - RNA, 13 nt, Escherichia coli CFT073
ucucaaucaccac

SEQ ID NO: 2676108 - RNA, 12 nt, Escherichia coli CFT073
ucucaaucccuu

SEQ ID NO: 2676109 - RNA, 17 nt, Escherichia coli CFT073
ucucaaucccuuucucc

SEQ ID NO: 2676110 - RNA, 14 nt, Escherichia coli CFT073
ucucaauuuucacu

SEQ ID NO: 2676111 - RNA, 15 nt, Escherichia coli CFT073
ucucaauuuucacuu

SEQ ID NO: 2676112 - RNA, 16 nt, Escherichia coli CFT073
ucucaccgcaggcggc

SEQ ID NO: 2676113 - RNA, 16 nt, Escherichia coli CFT073
ucucaccuacaugacc

SEQ ID NO: 2676114 - RNA, 17 nt, Escherichia coli CFT073
ucucaccuacaugaccg

SEQ ID NO: 2676115 - RNA, 13 nt, Escherichia coli CFT073
ucucacucuuucc

SEQ ID NO: 2676116 - RNA, 15 nt, Escherichia coli CFT073
ucucacucuuucccu

SEQ ID NO: 2676117 - RNA, 20 nt, Escherichia coli CFT073
ucucacugauuacccuucgc

SEQ ID NO: 2676118 - RNA, 11 nt, Escherichia coli CFT073
ucucacuuuga

SEQ ID NO: 2676119 - RNA, 18 nt, Escherichia coli CFT073
ucucagacucauuaaaac

SEQ ID NO: 2676120 - RNA, 17 nt, Escherichia coli CFT073
ucucagcacauugaugg

SEQ ID NO: 2676121 - RNA, 13 nt, Escherichia coli CFT073
ucucagccaaauc

SEQ ID NO: 2676122 - RNA, 11 nt, Escherichia coli CFT073
ucucaggcaaa

SEQ ID NO: 2676123 - RNA, 13 nt, Escherichia coli CFT073
ucucaucagauau

SEQ ID NO: 2676124 - RNA, 18 nt, Escherichia coli CFT073
ucucauccaauaacguga

SEQ ID NO: 2676125 - RNA, 13 nt, Escherichia coli CFT073
ucucaugcuucau

SEQ ID NO: 2676126 - RNA, 17 nt, Escherichia coli CFT073
ucucauggguauaaccg

SEQ ID NO: 2676127 - RNA, 21 nt, Escherichia coli CFT073
ucucauuucggcccacaacga

SEQ ID NO: 2676128 - RNA, 19 nt, Escherichia coli CFT073
ucucauuuugauuaauauu

SEQ ID NO: 2676129 - RNA, 12 nt, Escherichia coli CFT073
ucucauuuuuca

SEQ ID NO: 2676130 - RNA, 10 nt, Escherichia coli CFT073
ucuccacacg

SEQ ID NO: 2676131 - RNA, 16 nt, Escherichia coli CFT073
ucuccaccugcggcac

SEQ ID NO: 2676132 - RNA, 19 nt, Escherichia coli CFT073
ucuccacgcaggcguuuca

SEQ ID NO: 2676133 - RNA, 18 nt, Escherichia coli CFT073
ucuccacucugccaggca

SEQ ID NO: 2676134 - RNA, 17 nt, Escherichia coli CFT073
ucuccagaugacuggcu

SEQ ID NO: 2676135 - RNA, 23 nt, Escherichia coli CFT073
ucuccagaugacuggcuaacccu

SEQ ID NO: 2676136 - RNA, 17 nt, Escherichia coli CFT073
ucuccagcgcaucgauc

SEQ ID NO: 2676137 - RNA, 18 nt, Escherichia coli CFT073
ucuccagcgcaucgaucu

SEQ ID NO: 2676138 - RNA, 17 nt, Escherichia coli CFT073
ucuccauacagaacagg

SEQ ID NO: 2676139 - RNA, 13 nt, Escherichia coli CFT073
ucuccauuucaau

SEQ ID NO: 2676140 - RNA, 18 nt, Escherichia coli CFT073
ucuccauuuuuuugcauu

SEQ ID NO: 2676141 - RNA, 14 nt, Escherichia coli CFT073
ucuccccggcgcag

SEQ ID NO: 2676142 - RNA, 20 nt, Escherichia coli CFT073
ucuccgagcauuuucagcgu

SEQ ID NO: 2676143 - RNA, 23 nt, Escherichia coli CFT073
ucuccgcccagcguacguaacuu

SEQ ID NO: 2676144 - RNA, 18 nt, Escherichia coli CFT073
ucuccggccuacaaaaca

SEQ ID NO: 2676145 - RNA, 20 nt, Escherichia coli CFT073
ucuccggcgcauccaugaua

SEQ ID NO: 2676146 - RNA, 15 nt, Escherichia coli CFT073
ucuccggcguuuugg

SEQ ID NO: 2676147 - RNA, 20 nt, Escherichia coli CFT073
ucuccgggggcgauuucaga

SEQ ID NO: 2676148 - RNA, 21 nt, Escherichia coli CFT073
ucuccggugguuaacgcugcc

SEQ ID NO: 2676149 - RNA, 15 nt, Escherichia coli CFT073
ucuccguucaguuua

SEQ ID NO: 2676150 - RNA, 22 nt, Escherichia coli CFT073
ucuccguuggcauuucgaccau

SEQ ID NO: 2676151 - RNA, 12 nt, Escherichia coli CFT073
ucuccuccaggu

SEQ ID NO: 2676152 - RNA, 12 nt, Escherichia coli CFT073
ucuccugcgcac

SEQ ID NO: 2676153 - RNA, 15 nt, Escherichia coli CFT073
ucuccugcgccuguc

SEQ ID NO: 2676154 - RNA, 20 nt, Escherichia coli CFT073
ucuccugcggcgacaaaugu

SEQ ID NO: 2676155 - RNA, 17 nt, Escherichia coli CFT073
ucuccuguucucacuaa

SEQ ID NO: 2676156 - RNA, 17 nt, Escherichia coli CFT073
ucuccuguugugaugca

SEQ ID NO: 2676157 - RNA, 23 nt, Escherichia coli CFT073
ucuccuguugugaugcaacuguu

SEQ ID NO: 2676158 - RNA, 15 nt, Escherichia coli CFT073
ucuccuguuucacuu

SEQ ID NO: 2676159 - RNA, 17 nt, Escherichia coli CFT073
ucuccuuacugcccccg

SEQ ID NO: 2676160 - RNA, 23 nt, Escherichia coli CFT073
ucucgaaaaaccugacgcugcuc

SEQ ID NO: 2676161 - RNA, 17 nt, Escherichia coli CFT073
ucucgaauugucaccgu

SEQ ID NO: 2676162 - RNA, 18 nt, Escherichia coli CFT073
ucucgacagccucuucca

SEQ ID NO: 2676163 - RNA, 14 nt, Escherichia coli CFT073
ucucgacuuuuucc

SEQ ID NO: 2676164 - RNA, 13 nt, Escherichia coli CFT073
ucucgccagcacu

SEQ ID NO: 2676165 - RNA, 19 nt, Escherichia coli CFT073
ucucgcgcccaaccagcag

SEQ ID NO: 2676166 - RNA, 20 nt, Escherichia coli CFT073
ucucgcgcccaaccagcagg

SEQ ID NO: 2676167 - RNA, 21 nt, Escherichia coli CFT073
ucucgcgguucaguucgcuua

SEQ ID NO: 2676168 - RNA, 23 nt, Escherichia coli CFT073
ucucgcugacaucaacaauucgu

SEQ ID NO: 2676169 - RNA, 15 nt, Escherichia coli CFT073
ucucggcuuugguau

SEQ ID NO: 2676170 - RNA, 22 nt, Escherichia coli CFT073
ucucgggaaggcccuuucccuu

SEQ ID NO: 2676171 - RNA, 18 nt, Escherichia coli CFT073
ucucgucacuuuucuuaa

SEQ ID NO: 2676172 - RNA, 18 nt, Escherichia coli CFT073
ucucguccagcuugccuu

SEQ ID NO: 2676173 - RNA, 13 nt, Escherichia coli CFT073
ucucgucuugcgu

SEQ ID NO: 2676174 - RNA, 14 nt, Escherichia coli CFT073
ucucgugccgccag

SEQ ID NO: 2676175 - RNA, 16 nt, Escherichia coli CFT073
ucucguuaccagcgcc

SEQ ID NO: 2676176 - RNA, 20 nt, Escherichia coli CFT073
ucucguuggguugccagcga

SEQ ID NO: 2676177 - RNA, 16 nt, Escherichia coli CFT073
ucucguuuaaaugccg

SEQ ID NO: 2676178 - RNA, 14 nt, Escherichia coli CFT073
ucucuccuuucggc

SEQ ID NO: 2676179 - RNA, 20 nt, Escherichia coli CFT073
ucucugagacgguauucagg

SEQ ID NO: 2676180 - RNA, 18 nt, Escherichia coli CFT073
ucucugcgcuauccagcg

SEQ ID NO: 2676181 - RNA, 18 nt, Escherichia coli CFT073
ucucuggcuguuucgcuu

SEQ ID NO: 2676182 - RNA, 21 nt, Escherichia coli CFT073
ucucuggcuguuucgcuucuu

SEQ ID NO: 2676183 - RNA, 16 nt, Escherichia coli CFT073
ucucuuauauuucauu

SEQ ID NO: 2676184 - RNA, 24 nt, Escherichia coli CFT073
ucucuucaacacgacgcauugcca

SEQ ID NO: 2676185 - RNA, 20 nt, Escherichia coli CFT073
ucucuucacagacauccuga

SEQ ID NO: 2676186 - RNA, 17 nt, Escherichia coli CFT073
ucucuucaccugccugc

SEQ ID NO: 2676187 - RNA, 19 nt, Escherichia coli CFT073
ucucuucaccugccugcag

SEQ ID NO: 2676188 - RNA, 11 nt, Escherichia coli CFT073
ucucuucccac

SEQ ID NO: 2676189 - RNA, 15 nt, Escherichia coli CFT073
ucucuucguuuucaa

SEQ ID NO: 2676190 - RNA, 13 nt, Escherichia coli CFT073
ucucuucuccuug

SEQ ID NO: 2676191 - RNA, 23 nt, Escherichia coli CFT073
ucucuugcuggcauuacaagaau

SEQ ID NO: 2676192 - RNA, 18 nt, Escherichia coli CFT073
ucucuuuauaaaguaaaa

SEQ ID NO: 2676193 - RNA, 13 nt, Escherichia coli CFT073
ucucuuuauguaa

SEQ ID NO: 2676194 - RNA, 17 nt, Escherichia coli CFT073
ucucuuucacuccauug

SEQ ID NO: 2676195 - RNA, 15 nt, Escherichia coli CFT073
ucucuuucuuugaau

SEQ ID NO: 2676196 - RNA, 20 nt, Escherichia coli CFT073
ucugaaaacuaaccuuacaa

SEQ ID NO: 2676197 - RNA, 16 nt, Escherichia coli CFT073
ucugaacguucugcug

SEQ ID NO: 2676198 - RNA, 13 nt, Escherichia coli CFT073
ucugaagacgccu

SEQ ID NO: 2676199 - RNA, 15 nt, Escherichia coli CFT073
ucugaaguaaagaaa

SEQ ID NO: 2676200 - RNA, 17 nt, Escherichia coli CFT073
ucugaaguaaagaaacu

SEQ ID NO: 2676201 - RNA, 23 nt, Escherichia coli CFT073
ucugaaguaaagaaacugguugc

SEQ ID NO: 2676202 - RNA, 20 nt, Escherichia coli CFT073
ucugaaguuuguuaaccacc

SEQ ID NO: 2676203 - RNA, 11 nt, Escherichia coli CFT073
ucugaauaaac

SEQ ID NO: 2676204 - RNA, 17 nt, Escherichia coli CFT073
ucugaauaacacccaua

SEQ ID NO: 2676205 - RNA, 20 nt, Escherichia coli CFT073
ucugaauaucaucacccugc

SEQ ID NO: 2676206 - RNA, 15 nt, Escherichia coli CFT073
ucugaauauguuugg

SEQ ID NO: 2676207 - RNA, 14 nt, Escherichia coli CFT073
ucugaaucaguccc

SEQ ID NO: 2676208 - RNA, 22 nt, Escherichia coli CFT073
ucugaaucagucccugaaucgc

SEQ ID NO: 2676209 - RNA, 23 nt, Escherichia coli CFT073
ucugacaaaaucaauauaaacag

SEQ ID NO: 2676210 - RNA, 21 nt, Escherichia coli CFT073
ucugaccaauagauauucauc

SEQ ID NO: 2676211 - RNA, 20 nt, Escherichia coli CFT073
ucugaccacggccauaucca

SEQ ID NO: 2676212 - RNA, 23 nt, Escherichia coli CFT073
ucugaccacggccauauccagcc

SEQ ID NO: 2676213 - RNA, 15 nt, Escherichia coli CFT073
ucugaccauaaguag

SEQ ID NO: 2676214 - RNA, 19 nt, Escherichia coli CFT073
ucugacccagaagacgagc

SEQ ID NO: 2676215 - RNA, 22 nt, Escherichia coli CFT073
ucugaccgggaauauaaguacu

SEQ ID NO: 2676216 - RNA, 15 nt, Escherichia coli CFT073
ucugacgcacugugg

SEQ ID NO: 2676217 - RNA, 21 nt, Escherichia coli CFT073
ucugacgcguaccuaacaguu

SEQ ID NO: 2676218 - RNA, 22 nt, Escherichia coli CFT073
ucugacgugcacaaacuucuuc

SEQ ID NO: 2676219 - RNA, 21 nt, Escherichia coli CFT073
ucugacguucagccgcuuuau

SEQ ID NO: 2676220 - RNA, 19 nt, Escherichia coli CFT073
ucugacuggucaguugcgg

SEQ ID NO: 2676221 - RNA, 22 nt, Escherichia coli CFT073
ucugagcccacuguuugaucug

SEQ ID NO: 2676222 - RNA, 16 nt, Escherichia coli CFT073
ucugagcgaagcgcau

SEQ ID NO: 2676223 - RNA, 19 nt, Escherichia coli CFT073
ucugauaaaugaagaaaaa

SEQ ID NO: 2676224 - RNA, 12 nt, Escherichia coli CFT073
ucugauauucag

SEQ ID NO: 2676225 - RNA, 21 nt, Escherichia coli CFT073
ucugauauuuagccagcagcu

SEQ ID NO: 2676226 - RNA, 15 nt, Escherichia coli CFT073
ucugauauuuuauug

SEQ ID NO: 2676227 - RNA, 14 nt, Escherichia coli CFT073
ucugaucggcaauc

SEQ ID NO: 2676228 - RNA, 13 nt, Escherichia coli CFT073
ucugaugaaagca

SEQ ID NO: 2676229 - RNA, 14 nt, Escherichia coli CFT073
ucugaugauauuuu

SEQ ID NO: 2676230 - RNA, 17 nt, Escherichia coli CFT073
ucugaugauauuuuucc

SEQ ID NO: 2676231 - RNA, 21 nt, Escherichia coli CFT073
ucugaugauauuuuucccuga

SEQ ID NO: 2676232 - RNA, 18 nt, Escherichia coli CFT073
ucugauucccugccugac

SEQ ID NO: 2676233 - RNA, 19 nt, Escherichia coli CFT073
ucugauuccgggccaccau

SEQ ID NO: 2676234 - RNA, 16 nt, Escherichia coli CFT073
ucugauuuacaaggaa

SEQ ID NO: 2676235 - RNA, 15 nt, Escherichia coli CFT073
ucugauuuucuucca

SEQ ID NO: 2676236 - RNA, 12 nt, Escherichia coli CFT073
ucugcaaaaaua

SEQ ID NO: 2676237 - RNA, 16 nt, Escherichia coli CFT073
ucugcaaaauaccaau

SEQ ID NO: 2676238 - RNA, 16 nt, Escherichia coli CFT073
ucugcaaccagaaagu

SEQ ID NO: 2676239 - RNA, 19 nt, Escherichia coli CFT073
ucugcaacgucuucccgag

SEQ ID NO: 2676240 - RNA, 12 nt, Escherichia coli CFT073
ucugcaaggcga

SEQ ID NO: 2676241 - RNA, 17 nt, Escherichia coli CFT073
ucugcaaggcgagcaau

SEQ ID NO: 2676242 - RNA, 17 nt, Escherichia coli CFT073
ucugcaagucuugcugc

SEQ ID NO: 2676243 - RNA, 18 nt, Escherichia coli CFT073
ucugcaaucgucugcuga

SEQ ID NO: 2676244 - RNA, 13 nt, Escherichia coli CFT073
ucugcaauuugcg

SEQ ID NO: 2676245 - RNA, 14 nt, Escherichia coli CFT073
ucugcaauuugugc

SEQ ID NO: 2676246 - RNA, 15 nt, Escherichia coli CFT073
ucugcacagcauuca

SEQ ID NO: 2676247 - RNA, 16 nt, Escherichia coli CFT073
ucugcaccagaacucc

SEQ ID NO: 2676248 - RNA, 12 nt, Escherichia coli CFT073
ucugcagcuuua

SEQ ID NO: 2676249 - RNA, 14 nt, Escherichia coli CFT073
ucugcaucaaccag

SEQ ID NO: 2676250 - RNA, 23 nt, Escherichia coli CFT073
ucugcauccugaauauccuguuc

SEQ ID NO: 2676251 - RNA, 18 nt, Escherichia coli CFT073
ucugccaaacgcucccag

SEQ ID NO: 2676252 - RNA, 20 nt, Escherichia coli CFT073
ucugccaccguguauuucug

SEQ ID NO: 2676253 - RNA, 15 nt, Escherichia coli CFT073
ucugccacggcagaa

SEQ ID NO: 2676254 - RNA, 19 nt, Escherichia coli CFT073
ucugccagccagucagucu

SEQ ID NO: 2676255 - RNA, 18 nt, Escherichia coli CFT073
ucugccagcguaccauga

SEQ ID NO: 2676256 - RNA, 17 nt, Escherichia coli CFT073
ucugccagcugcucaua

SEQ ID NO: 2676257 - RNA, 23 nt, Escherichia coli CFT073
ucugccaggcagcgauuaacugc

SEQ ID NO: 2676258 - RNA, 16 nt, Escherichia coli CFT073
ucugccauauccagcc

SEQ ID NO: 2676259 - RNA, 21 nt, Escherichia coli CFT073
ucugccaucauggcauccugu

SEQ ID NO: 2676260 - RNA, 23 nt, Escherichia coli CFT073
ucugccauccguaauuauuacuc

SEQ ID NO: 2676261 - RNA, 23 nt, Escherichia coli CFT073
ucugcccaaaauugacuaucuga

SEQ ID NO: 2676262 - RNA, 15 nt, Escherichia coli CFT073
ucugcccaaucaaac

SEQ ID NO: 2676263 - RNA, 20 nt, Escherichia coli CFT073
ucugccccgccaacagugcc

SEQ ID NO: 2676264 - RNA, 20 nt, Escherichia coli CFT073
ucugcccugccaucacuauu

SEQ ID NO: 2676265 - RNA, 14 nt, Escherichia coli CFT073
ucugccgcaauggc

SEQ ID NO: 2676266 - RNA, 22 nt, Escherichia coli CFT073
ucugccgcauggaaccaguuca

SEQ ID NO: 2676267 - RNA, 24 nt, Escherichia coli CFT073
ucugccgcauggaaccaguucacu

SEQ ID NO: 2676268 - RNA, 19 nt, Escherichia coli CFT073
ucugccgcuuaaauuggcg

SEQ ID NO: 2676269 - RNA, 15 nt, Escherichia coli CFT073
ucugccggaauaauc

SEQ ID NO: 2676270 - RNA, 17 nt, Escherichia coli CFT073
ucugccggauuuuacga

SEQ ID NO: 2676271 - RNA, 17 nt, Escherichia coli CFT073
ucugccgggaagcucuc

SEQ ID NO: 2676272 - RNA, 22 nt, Escherichia coli CFT073
ucugccgggaagcucucuucca

SEQ ID NO: 2676273 - RNA, 16 nt, Escherichia coli CFT073
ucugccuggucaaaga

SEQ ID NO: 2676274 - RNA, 16 nt, Escherichia coli CFT073
ucugccugguuucucu

SEQ ID NO: 2676275 - RNA, 22 nt, Escherichia coli CFT073
ucugcgaauugagaugacgcca

SEQ ID NO: 2676276 - RNA, 21 nt, Escherichia coli CFT073
ucugcgacuguucgccaaaag

SEQ ID NO: 2676277 - RNA, 15 nt, Escherichia coli CFT073
ucugcgagacuccgc

SEQ ID NO: 2676278 - RNA, 21 nt, Escherichia coli CFT073
ucugcgcauuucccagcaaga

SEQ ID NO: 2676279 - RNA, 13 nt, Escherichia coli CFT073
ucugcgccagcga

SEQ ID NO: 2676280 - RNA, 23 nt, Escherichia coli CFT073
ucugcgcccacaucacgccgcug

SEQ ID NO: 2676281 - RNA, 18 nt, Escherichia coli CFT073
ucugcgcccgcccgcugu

SEQ ID NO: 2676282 - RNA, 23 nt, Escherichia coli CFT073
ucugcgcuauccagcgcauagcu

SEQ ID NO: 2676283 - RNA, 13 nt, Escherichia coli CFT073
ucugcggcaaugc

SEQ ID NO: 2676284 - RNA, 14 nt, Escherichia coli CFT073
ucugcggcaucaua

SEQ ID NO: 2676285 - RNA, 15 nt, Escherichia coli CFT073
ucugcucccggcaau

SEQ ID NO: 2676286 - RNA, 14 nt, Escherichia coli CFT073
ucugcuuuacggaa

SEQ ID NO: 2676287 - RNA, 20 nt, Escherichia coli CFT073
ucuggaaauagauuuucaga

SEQ ID NO: 2676288 - RNA, 16 nt, Escherichia coli CFT073
ucuggaacggcagauc

SEQ ID NO: 2676289 - RNA, 21 nt, Escherichia coli CFT073
ucuggagaugggugugcugac

SEQ ID NO: 2676290 - RNA, 19 nt, Escherichia coli CFT073
ucuggauggcgcuccagca

SEQ ID NO: 2676291 - RNA, 17 nt, Escherichia coli CFT073
ucuggauuggcaauacg

SEQ ID NO: 2676292 - RNA, 16 nt, Escherichia coli CFT073
ucuggauuuacugcau

SEQ ID NO: 2676293 - RNA, 14 nt, Escherichia coli CFT073
ucuggcaaaaauaa

SEQ ID NO: 2676294 - RNA, 22 nt, Escherichia coli CFT073
ucuggcaccgguacacaaccgc

SEQ ID NO: 2676295 - RNA, 20 nt, Escherichia coli CFT073
ucuggcagauccugaaauuc

SEQ ID NO: 2676296 - RNA, 22 nt, Escherichia coli CFT073
ucuggcauaaaagggcagcagg

SEQ ID NO: 2676297 - RNA, 22 nt, Escherichia coli CFT073
ucuggcaucggcgcacaaccgc

SEQ ID NO: 2676298 - RNA, 22 nt, Escherichia coli CFT073
ucuggcaugacaggcaaccggu

SEQ ID NO: 2676299 - RNA, 14 nt, Escherichia coli CFT073
ucuggcauucagaa

SEQ ID NO: 2676300 - RNA, 23 nt, Escherichia coli CFT073
ucuggccucgcuuugccaguaau

SEQ ID NO: 2676301 - RNA, 20 nt, Escherichia coli CFT073
ucuggcgcaacacccugaug

SEQ ID NO: 2676302 - RNA, 14 nt, Escherichia coli CFT073
ucuggcgcgugaug

SEQ ID NO: 2676303 - RNA, 14 nt, Escherichia coli CFT073
ucuggcggcggcaa

SEQ ID NO: 2676304 - RNA, 15 nt, Escherichia coli CFT073
ucuggcggcgugaug

SEQ ID NO: 2676305 - RNA, 17 nt, Escherichia coli CFT073
ucuggcguacagagggc

SEQ ID NO: 2676306 - RNA, 18 nt, Escherichia coli CFT073
ucuggcucauuaguuaau

SEQ ID NO: 2676307 - RNA, 23 nt, Escherichia coli CFT073
ucuggcugacauaaacaccagca

SEQ ID NO: 2676308 - RNA, 21 nt, Escherichia coli CFT073
ucuggcugccagcccgcuggu

SEQ ID NO: 2676309 - RNA, 16 nt, Escherichia coli CFT073
ucuggcuguuucgcuu

SEQ ID NO: 2676310 - RNA, 16 nt, Escherichia coli CFT073
ucuggguugccugaug

SEQ ID NO: 2676311 - RNA, 16 nt, Escherichia coli CFT073
ucugguaggccugaua

SEQ ID NO: 2676312 - RNA, 16 nt, Escherichia coli CFT073
ucuggucaacaaccag

SEQ ID NO: 2676313 - RNA, 16 nt, Escherichia coli CFT073
ucuggucuggcccacg

SEQ ID NO: 2676314 - RNA, 17 nt, Escherichia coli CFT073
ucuggugaugcauaaaa

SEQ ID NO: 2676315 - RNA, 17 nt, Escherichia coli CFT073
ucuggugccagcgccag

SEQ ID NO: 2676316 - RNA, 19 nt, Escherichia coli CFT073
ucuggugccagcgccagca

SEQ ID NO: 2676317 - RNA, 21 nt, Escherichia coli CFT073
ucuggugugcguugcagcaaa

SEQ ID NO: 2676318 - RNA, 19 nt, Escherichia coli CFT073
ucugguguggagugcagca

SEQ ID NO: 2676319 - RNA, 15 nt, Escherichia coli CFT073
ucugguguuaucgga

SEQ ID NO: 2676320 - RNA, 16 nt, Escherichia coli CFT073
ucugguguucuuuuac

SEQ ID NO: 2676321 - RNA, 21 nt, Escherichia coli CFT073
ucugguuaaaaaaagaacaac

SEQ ID NO: 2676322 - RNA, 21 nt, Escherichia coli CFT073
ucugguugacgcguaaaucca

SEQ ID NO: 2676323 - RNA, 23 nt, Escherichia coli CFT073
ucugguugacgcguaaauccagc

SEQ ID NO: 2676324 - RNA, 13 nt, Escherichia coli CFT073
ucugguugagcag

SEQ ID NO: 2676325 - RNA, 20 nt, Escherichia coli CFT073
ucuguaagcaauuauucaua

SEQ ID NO: 2676326 - RNA, 12 nt, Escherichia coli CFT073
ucuguaauccau

SEQ ID NO: 2676327 - RNA, 14 nt, Escherichia coli CFT073
ucuguaugucagua

SEQ ID NO: 2676328 - RNA, 15 nt, Escherichia coli CFT073
ucuguauuuggcugc

SEQ ID NO: 2676329 - RNA, 14 nt, Escherichia coli CFT073
ucugucaaaagcgg

SEQ ID NO: 2676330 - RNA, 18 nt, Escherichia coli CFT073
ucugucagacuaucuuug

SEQ ID NO: 2676331 - RNA, 16 nt, Escherichia coli CFT073
ucugucaguuggcugu

SEQ ID NO: 2676332 - RNA, 14 nt, Escherichia coli CFT073
ucugucgcucugcu

SEQ ID NO: 2676333 - RNA, 15 nt, Escherichia coli CFT073
ucugucguuaucagg

SEQ ID NO: 2676334 - RNA, 15 nt, Escherichia coli CFT073
ucugucucaacucug

SEQ ID NO: 2676335 - RNA, 18 nt, Escherichia coli CFT073
ucugucugauaaaaaacc

SEQ ID NO: 2676336 - RNA, 21 nt, Escherichia coli CFT073
ucugucuuccgggaacggcau

SEQ ID NO: 2676337 - RNA, 22 nt, Escherichia coli CFT073
ucugucuuccgggaacggcauc

SEQ ID NO: 2676338 - RNA, 14 nt, Escherichia coli CFT073
ucugugaacuucag

SEQ ID NO: 2676339 - RNA, 18 nt, Escherichia coli CFT073
ucugugcgucugcuuuua

SEQ ID NO: 2676340 - RNA, 15 nt, Escherichia coli CFT073
ucugugcuuguaaaa

SEQ ID NO: 2676341 - RNA, 18 nt, Escherichia coli CFT073
ucugugucgcuuucacgc

SEQ ID NO: 2676342 - RNA, 15 nt, Escherichia coli CFT073
ucugugugguuuugu

SEQ ID NO: 2676343 - RNA, 18 nt, Escherichia coli CFT073
ucuguuauauauuacccu

SEQ ID NO: 2676344 - RNA, 17 nt, Escherichia coli CFT073
ucuguuaugguacuuuc

SEQ ID NO: 2676345 - RNA, 16 nt, Escherichia coli CFT073
ucuguucuggaaaaaa

SEQ ID NO: 2676346 - RNA, 14 nt, Escherichia coli CFT073
ucuguugauaaaac

SEQ ID NO: 2676347 - RNA, 20 nt, Escherichia coli CFT073
ucuguugugaaguucaugca

SEQ ID NO: 2676348 - RNA, 14 nt, Escherichia coli CFT073
ucuguugugccaca

SEQ ID NO: 2676349 - RNA, 19 nt, Escherichia coli CFT073
ucuguuugcgucaugguau

SEQ ID NO: 2676350 - RNA, 15 nt, Escherichia coli CFT073
ucuguuuuaucaauu

SEQ ID NO: 2676351 - RNA, 15 nt, Escherichia coli CFT073
ucuguuuucaauguc

SEQ ID NO: 2676352 - RNA, 15 nt, Escherichia coli CFT073
ucuuaacgucgcaag

SEQ ID NO: 2676353 - RNA, 13 nt, Escherichia coli CFT073
ucuuaauaaacgu

SEQ ID NO: 2676354 - RNA, 17 nt, Escherichia coli CFT073
ucuuaauagcugccagc

SEQ ID NO: 2676355 - RNA, 20 nt, Escherichia coli CFT073
ucuuacagggcguauaacac

SEQ ID NO: 2676356 - RNA, 16 nt, Escherichia coli CFT073
ucuuacauucugucuc

SEQ ID NO: 2676357 - RNA, 16 nt, Escherichia coli CFT073
ucuuaccuaccugcuc

SEQ ID NO: 2676358 - RNA, 18 nt, Escherichia coli CFT073
ucuuacgcuuaagaucaa

SEQ ID NO: 2676359 - RNA, 13 nt, Escherichia coli CFT073
ucuuacuucaaca

SEQ ID NO: 2676360 - RNA, 20 nt, Escherichia coli CFT073
ucuuacuucaacacauaacc

SEQ ID NO: 2676361 - RNA, 18 nt, Escherichia coli CFT073
ucuuagugggaagagggc

SEQ ID NO: 2676362 - RNA, 14 nt, Escherichia coli CFT073
ucuuauauuucauu

SEQ ID NO: 2676363 - RNA, 15 nt, Escherichia coli CFT073
ucuuaucagcauacg

SEQ ID NO: 2676364 - RNA, 19 nt, Escherichia coli CFT073
ucuuaucagcauacgccac

SEQ ID NO: 2676365 - RNA, 13 nt, Escherichia coli CFT073
ucuuaucaggccu

SEQ ID NO: 2676366 - RNA, 12 nt, Escherichia coli CFT073
ucuuauccgacc

SEQ ID NO: 2676367 - RNA, 20 nt, Escherichia coli CFT073
ucuuauccugcguuuguccg

SEQ ID NO: 2676368 - RNA, 16 nt, Escherichia coli CFT073
ucuuaugcaguuuugg

SEQ ID NO: 2676369 - RNA, 19 nt, Escherichia coli CFT073
ucuuauugaguaaauucau

SEQ ID NO: 2676370 - RNA, 15 nt, Escherichia coli CFT073
ucuuauuuaauguaa

SEQ ID NO: 2676371 - RNA, 17 nt, Escherichia coli CFT073
ucuucaaaaaagucaga

SEQ ID NO: 2676372 - RNA, 21 nt, Escherichia coli CFT073
ucuucaaaaaagucagaucgu

SEQ ID NO: 2676373 - RNA, 18 nt, Escherichia coli CFT073
ucuucaacaauugaagaa

SEQ ID NO: 2676374 - RNA, 13 nt, Escherichia coli CFT073
ucuucaacacacu

SEQ ID NO: 2676375 - RNA, 22 nt, Escherichia coli CFT073
ucuucaaccgcagugauuucaa

SEQ ID NO: 2676376 - RNA, 13 nt, Escherichia coli CFT073
ucuucaacuucag

SEQ ID NO: 2676377 - RNA, 17 nt, Escherichia coli CFT073
ucuucaacuucagcagc

SEQ ID NO: 2676378 - RNA, 18 nt, Escherichia coli CFT073
ucuucaacuucagcagca

SEQ ID NO: 2676379 - RNA, 16 nt, Escherichia coli CFT073
ucuucacacacaucaa

SEQ ID NO: 2676380 - RNA, 16 nt, Escherichia coli CFT073
ucuucaccaaaugccu

SEQ ID NO: 2676381 - RNA, 18 nt, Escherichia coli CFT073
ucuucacccguugaucuu

SEQ ID NO: 2676382 - RNA, 12 nt, Escherichia coli CFT073
ucuucacccuuu

SEQ ID NO: 2676383 - RNA, 24 nt, Escherichia coli CFT073
ucuucaccgguaguaagcguuuuc

SEQ ID NO: 2676384 - RNA, 12 nt, Escherichia coli CFT073
ucuucaccgucc

SEQ ID NO: 2676385 - RNA, 16 nt, Escherichia coli CFT073
ucuucaccugccugca

SEQ ID NO: 2676386 - RNA, 17 nt, Escherichia coli CFT073
ucuucaccugccugcag

SEQ ID NO: 2676387 - RNA, 22 nt, Escherichia coli CFT073
ucuucacggaugauuaccggag

SEQ ID NO: 2676388 - RNA, 13 nt, Escherichia coli CFT073
ucuucagcaguuc

SEQ ID NO: 2676389 - RNA, 14 nt, Escherichia coli CFT073
ucuucagcaguuca

SEQ ID NO: 2676390 - RNA, 14 nt, Escherichia coli CFT073
ucuucagcaucaau

SEQ ID NO: 2676391 - RNA, 23 nt, Escherichia coli CFT073
ucuucagcguccgggaaauccuc

SEQ ID NO: 2676392 - RNA, 13 nt, Escherichia coli CFT073
ucuucagcuuuca

SEQ ID NO: 2676393 - RNA, 22 nt, Escherichia coli CFT073
ucuucaggaggagauauuuaac

SEQ ID NO: 2676394 - RNA, 23 nt, Escherichia coli CFT073
ucuucaggaggagauauuuaaca

SEQ ID NO: 2676395 - RNA, 13 nt, Escherichia coli CFT073
ucuucaggaguag

SEQ ID NO: 2676396 - RNA, 22 nt, Escherichia coli CFT073
ucuucauaacuuugaucgcguu

SEQ ID NO: 2676397 - RNA, 21 nt, Escherichia coli CFT073
ucuucauacguggcagaaugg

SEQ ID NO: 2676398 - RNA, 18 nt, Escherichia coli CFT073
ucuucaucgcgcaaaauu

SEQ ID NO: 2676399 - RNA, 14 nt, Escherichia coli CFT073
ucuucaucguccag

SEQ ID NO: 2676400 - RNA, 13 nt, Escherichia coli CFT073
ucuucauuaccuu

SEQ ID NO: 2676401 - RNA, 22 nt, Escherichia coli CFT073
ucuucauucccggaaauugcca

SEQ ID NO: 2676402 - RNA, 19 nt, Escherichia coli CFT073
ucuucauuguguaucaggu

SEQ ID NO: 2676403 - RNA, 21 nt, Escherichia coli CFT073
ucuuccaccguauccagugug

SEQ ID NO: 2676404 - RNA, 13 nt, Escherichia coli CFT073
ucuuccacuuugu

SEQ ID NO: 2676405 - RNA, 14 nt, Escherichia coli CFT073
ucuuccacuuuguc

SEQ ID NO: 2676406 - RNA, 13 nt, Escherichia coli CFT073
ucuuccagagagg

SEQ ID NO: 2676407 - RNA, 21 nt, Escherichia coli CFT073
ucuuccagaucaccgcagaag

SEQ ID NO: 2676408 - RNA, 14 nt, Escherichia coli CFT073
ucuuccagcauuuc

SEQ ID NO: 2676409 - RNA, 16 nt, Escherichia coli CFT073
ucuuccagccacugcg

SEQ ID NO: 2676410 - RNA, 16 nt, Escherichia coli CFT073
ucuuccagcgacaccu

SEQ ID NO: 2676411 - RNA, 13 nt, Escherichia coli CFT073
ucuuccagcgcau

SEQ ID NO: 2676412 - RNA, 17 nt, Escherichia coli CFT073
ucuuccagggugacaaa

SEQ ID NO: 2676413 - RNA, 19 nt, Escherichia coli CFT073
ucuuccaggucccagcgau

SEQ ID NO: 2676414 - RNA, 20 nt, Escherichia coli CFT073
ucuuccauuucaucgccagc

SEQ ID NO: 2676415 - RNA, 24 nt, Escherichia coli CFT073
ucuuccauuucaucgccagcgaau

SEQ ID NO: 2676416 - RNA, 11 nt, Escherichia coli CFT073
ucuucccagcc

SEQ ID NO: 2676417 - RNA, 17 nt, Escherichia coli CFT073
ucuucccauacccacca

SEQ ID NO: 2676418 - RNA, 19 nt, Escherichia coli CFT073
ucuucccgagacaucccuu

SEQ ID NO: 2676419 - RNA, 20 nt, Escherichia coli CFT073
ucuucccgaggcauuccuuu

SEQ ID NO: 2676420 - RNA, 24 nt, Escherichia coli CFT073
ucuucccgaggcauuccuuuacuu

SEQ ID NO: 2676421 - RNA, 13 nt, Escherichia coli CFT073
ucuucccgcucaa

SEQ ID NO: 2676422 - RNA, 21 nt, Escherichia coli CFT073
ucuucccggcucaguaaaauc

SEQ ID NO: 2676423 - RNA, 18 nt, Escherichia coli CFT073
uacgguacugaaaccuga

SEQ ID NO: 2676424 - RNA, 21 nt, Escherichia coli CFT073
uacggucaguuuucgccccca

SEQ ID NO: 2676425 - RNA, 21 nt, Escherichia coli CFT073
uacggucgccguaaacaucau

SEQ ID NO: 2676426 - RNA, 20 nt, Escherichia coli CFT073
uacgguuuucucgccaccgg

SEQ ID NO: 2676427 - RNA, 17 nt, Escherichia coli CFT073
uacgguuuuuugaacag

SEQ ID NO: 2676428 - RNA, 13 nt, Escherichia coli CFT073
uacguaauucacc

SEQ ID NO: 2676429 - RNA, 20 nt, Escherichia coli CFT073
uacguacugcaacguuaucc

SEQ ID NO: 2676430 - RNA, 22 nt, Escherichia coli CFT073
uacguagaucacugaaauugua

SEQ ID NO: 2676431 - RNA, 20 nt, Escherichia coli CFT073
uacguagcaccaacaucgac

SEQ ID NO: 2676432 - RNA, 13 nt, Escherichia coli CFT073
uacguagcucauc

SEQ ID NO: 2676433 - RNA, 17 nt, Escherichia coli CFT073
uacguccaucacaauca

SEQ ID NO: 2676434 - RNA, 21 nt, Escherichia coli CFT073
uacgucggugcagcaugauuu

SEQ ID NO: 2676435 - RNA, 15 nt, Escherichia coli CFT073
uacgugaaauccccu

SEQ ID NO: 2676436 - RNA, 15 nt, Escherichia coli CFT073
uacguguuguuccag

SEQ ID NO: 2676437 - RNA, 21 nt, Escherichia coli CFT073
uacguuaucgcgccaucaaau

SEQ ID NO: 2676438 - RNA, 16 nt, Escherichia coli CFT073
uacguuauugucgguc

SEQ ID NO: 2676439 - RNA, 22 nt, Escherichia coli CFT073
uacguuauuugcggauuaacga

SEQ ID NO: 2676440 - RNA, 16 nt, Escherichia coli CFT073
uacguucacuuuucuu

SEQ ID NO: 2676441 - RNA, 22 nt, Escherichia coli CFT073
uacguucauggcgugacauggc

SEQ ID NO: 2676442 - RNA, 22 nt, Escherichia coli CFT073
uacguucucacuuggguaacag

SEQ ID NO: 2676443 - RNA, 16 nt, Escherichia coli CFT073
uacguugcaaauauuc

SEQ ID NO: 2676444 - RNA, 20 nt, Escherichia coli CFT073
uacguugcaaauauuccauc

SEQ ID NO: 2676445 - RNA, 18 nt, Escherichia coli CFT073
uacguuucgccugcaaau

SEQ ID NO: 2676446 - RNA, 20 nt, Escherichia coli CFT073
uacguuuuaaugauuuccag

SEQ ID NO: 2676447 - RNA, 11 nt, Escherichia coli CFT073
uacuaaacauu

SEQ ID NO: 2676448 - RNA, 14 nt, Escherichia coli CFT073
uacuaaauaugaaa

SEQ ID NO: 2676449 - RNA, 12 nt, Escherichia coli CFT073
uacuaauaucau

SEQ ID NO: 2676450 - RNA, 16 nt, Escherichia coli CFT073
uacuacaucugcauca

SEQ ID NO: 2676451 - RNA, 16 nt, Escherichia coli CFT073
uacuauccacagccug

SEQ ID NO: 2676452 - RNA, 16 nt, Escherichia coli CFT073
uacuauccugaaagcu

SEQ ID NO: 2676453 - RNA, 18 nt, Escherichia coli CFT073
uacuaugaggaccgaauc

SEQ ID NO: 2676454 - RNA, 17 nt, Escherichia coli CFT073
uacuauggauauaauuu

SEQ ID NO: 2676455 - RNA, 19 nt, Escherichia coli CFT073
uacuauucaccacuaccgu

SEQ ID NO: 2676456 - RNA, 14 nt, Escherichia coli CFT073
uacucaagcaacca

SEQ ID NO: 2676457 - RNA, 21 nt, Escherichia coli CFT073
uacucaauaguguugccgcca

SEQ ID NO: 2676458 - RNA, 21 nt, Escherichia coli CFT073
uacucacaucugacaaaauca

SEQ ID NO: 2676459 - RNA, 14 nt, Escherichia coli CFT073
uacucaccaacgca

SEQ ID NO: 2676460 - RNA, 18 nt, Escherichia coli CFT073
uacucaccaacgcagacg

SEQ ID NO: 2676461 - RNA, 15 nt, Escherichia coli CFT073
uacucagcaacuucc

SEQ ID NO: 2676462 - RNA, 20 nt, Escherichia coli CFT073
uacucagcaacuuccugcuu

SEQ ID NO: 2676463 - RNA, 18 nt, Escherichia coli CFT073
uacucagcgccugcugca

SEQ ID NO: 2676464 - RNA, 21 nt, Escherichia coli CFT073
uacucauccaucucgguuuuc

SEQ ID NO: 2676465 - RNA, 16 nt, Escherichia coli CFT073
uacucaucgcccgcaa

SEQ ID NO: 2676466 - RNA, 17 nt, Escherichia coli CFT073
uacucaucuuccauucu

SEQ ID NO: 2676467 - RNA, 12 nt, Escherichia coli CFT073
uacucauuaaug

SEQ ID NO: 2676468 - RNA, 14 nt, Escherichia coli CFT073
uacucauuaaugua

SEQ ID NO: 2676469 - RNA, 14 nt, Escherichia coli CFT073
uacucauuauguca

SEQ ID NO: 2676470 - RNA, 14 nt, Escherichia coli CFT073
uacucccugcugau

SEQ ID NO: 2676471 - RNA, 15 nt, Escherichia coli CFT073
uacucccuugccugc

SEQ ID NO: 2676472 - RNA, 21 nt, Escherichia coli CFT073
uacucgcauaauucuggauca

SEQ ID NO: 2676473 - RNA, 23 nt, Escherichia coli CFT073
uacucgcugauugccccuccgca

SEQ ID NO: 2676474 - RNA, 18 nt, Escherichia coli CFT073
uacucuaacuuauuguuu

SEQ ID NO: 2676475 - RNA, 22 nt, Escherichia coli CFT073
uacucuaacuuauuguuuucau

SEQ ID NO: 2676476 - RNA, 16 nt, Escherichia coli CFT073
uacucuccugcggcga

SEQ ID NO: 2676477 - RNA, 23 nt, Escherichia coli CFT073
uacucuccugcggcgacaaaugu

SEQ ID NO: 2676478 - RNA, 17 nt, Escherichia coli CFT073
uacucucuuucgcuuga

SEQ ID NO: 2676479 - RNA, 21 nt, Escherichia coli CFT073
uacucuggcuggucauugccg

SEQ ID NO: 2676480 - RNA, 19 nt, Escherichia coli CFT073
uacucuucuuuaauuaauc

SEQ ID NO: 2676481 - RNA, 13 nt, Escherichia coli CFT073
uacugaaaccuga

SEQ ID NO: 2676482 - RNA, 15 nt, Escherichia coli CFT073
uacugaacaggcgca

SEQ ID NO: 2676483 - RNA, 13 nt, Escherichia coli CFT073
uacugaacuuauc

SEQ ID NO: 2676484 - RNA, 18 nt, Escherichia coli CFT073
uacugaaggcgcauugcu

SEQ ID NO: 2676485 - RNA, 12 nt, Escherichia coli CFT073
uacugacaucgc

SEQ ID NO: 2676486 - RNA, 14 nt, Escherichia coli CFT073
uacugagcaaggca

SEQ ID NO: 2676487 - RNA, 13 nt, Escherichia coli CFT073
uacugaucaucau

SEQ ID NO: 2676488 - RNA, 14 nt, Escherichia coli CFT073
uacugaucaucauu

SEQ ID NO: 2676489 - RNA, 20 nt, Escherichia coli CFT073
uacugauuguacuguuacuc

SEQ ID NO: 2676490 - RNA, 14 nt, Escherichia coli CFT073
uacugcaaauauug

SEQ ID NO: 2676491 - RNA, 13 nt, Escherichia coli CFT073
uacugcagccagc

SEQ ID NO: 2676492 - RNA, 18 nt, Escherichia coli CFT073
uacugcauggccagacau

SEQ ID NO: 2676493 - RNA, 20 nt, Escherichia coli CFT073
uacugcauggccagacauua

SEQ ID NO: 2676494 - RNA, 17 nt, Escherichia coli CFT073
uacugccagcucaccuc

SEQ ID NO: 2676495 - RNA, 15 nt, Escherichia coli CFT073
uacugcccuuucgcc

SEQ ID NO: 2676496 - RNA, 14 nt, Escherichia coli CFT073
uacugccgggugga

SEQ ID NO: 2676497 - RNA, 16 nt, Escherichia coli CFT073
uacugccucuuuuacc

SEQ ID NO: 2676498 - RNA, 23 nt, Escherichia coli CFT073
uacugccugcggcuugucguauu

SEQ ID NO: 2676499 - RNA, 19 nt, Escherichia coli CFT073
uacugccuuucccuuaccc

SEQ ID NO: 2676500 - RNA, 20 nt, Escherichia coli CFT073
uacugcgaauuuccugccag

SEQ ID NO: 2676501 - RNA, 16 nt, Escherichia coli CFT073
uacuggaagaaaacau

SEQ ID NO: 2676502 - RNA, 13 nt, Escherichia coli CFT073
uacuggaagugau

SEQ ID NO: 2676503 - RNA, 20 nt, Escherichia coli CFT073
uacuggacacugaauaaaca

SEQ ID NO: 2676504 - RNA, 15 nt, Escherichia coli CFT073
uacuggagacagauu

SEQ ID NO: 2676505 - RNA, 23 nt, Escherichia coli CFT073
uacuggagacagauuuauaaaau

SEQ ID NO: 2676506 - RNA, 19 nt, Escherichia coli CFT073
uacuggcauacaucaacgc

SEQ ID NO: 2676507 - RNA, 20 nt, Escherichia coli CFT073
uacuggccuuuauuuuccag

SEQ ID NO: 2676508 - RNA, 16 nt, Escherichia coli CFT073
uagcaucagcgcuacc

SEQ ID NO: 2676509 - RNA, 15 nt, Escherichia coli CFT073
uagcaucugguaacc

SEQ ID NO: 2676510 - RNA, 19 nt, Escherichia coli CFT073
uagcaugaacauugcugcu

SEQ ID NO: 2676511 - RNA, 20 nt, Escherichia coli CFT073
uagcaugaaguaacagaaga

SEQ ID NO: 2676512 - RNA, 20 nt, Escherichia coli CFT073
uagcaugaugauaucacugg

SEQ ID NO: 2676513 - RNA, 23 nt, Escherichia coli CFT073
uagcaugaugauaucacugguga

SEQ ID NO: 2676514 - RNA, 21 nt, Escherichia coli CFT073
uagcaugcaggcuggccccug

SEQ ID NO: 2676515 - RNA, 18 nt, Escherichia coli CFT073
uagccaaagcaccacucc

SEQ ID NO: 2676516 - RNA, 22 nt, Escherichia coli CFT073
uagccaaagcaccacuccucaa

SEQ ID NO: 2676517 - RNA, 20 nt, Escherichia coli CFT073
uagccaaccucaaaaagaaa

SEQ ID NO: 2676518 - RNA, 16 nt, Escherichia coli CFT073
uagccacauccaugcu

SEQ ID NO: 2676519 - RNA, 20 nt, Escherichia coli CFT073
uagccacauccaugcuuguu

SEQ ID NO: 2676520 - RNA, 17 nt, Escherichia coli CFT073
uagccacggaucacacg

SEQ ID NO: 2676521 - RNA, 23 nt, Escherichia coli CFT073
uagccagccucauccaugcggca

SEQ ID NO: 2676522 - RNA, 22 nt, Escherichia coli CFT073
uagccagcgaccgcgccauaaa

SEQ ID NO: 2676523 - RNA, 16 nt, Escherichia coli CFT073
uagccauuaccagguc

SEQ ID NO: 2676524 - RNA, 20 nt, Escherichia coli CFT073
uagcccaacgaucccaacug

SEQ ID NO: 2676525 - RNA, 13 nt, Escherichia coli CFT073
uagcccaucagcu

SEQ ID NO: 2676526 - RNA, 12 nt, Escherichia coli CFT073
uagccccagucu

SEQ ID NO: 2676527 - RNA, 22 nt, Escherichia coli CFT073
uagccccagucuuccugcggca

SEQ ID NO: 2676528 - RNA, 21 nt, Escherichia coli CFT073
uagccccggacggcaauuccg

SEQ ID NO: 2676529 - RNA, 20 nt, Escherichia coli CFT073
uagcccugucgaggccaauu

SEQ ID NO: 2676530 - RNA, 18 nt, Escherichia coli CFT073
uagcccuucaugcacucg

SEQ ID NO: 2676531 - RNA, 22 nt, Escherichia coli CFT073
uagccgaccgcaaggaagccug

SEQ ID NO: 2676532 - RNA, 17 nt, Escherichia coli CFT073
uagccgcauaguccagu

SEQ ID NO: 2676533 - RNA, 19 nt, Escherichia coli CFT073
uagccgccaucguugagca

SEQ ID NO: 2676534 - RNA, 16 nt, Escherichia coli CFT073
uagccgccccagacuc

SEQ ID NO: 2676535 - RNA, 22 nt, Escherichia coli CFT073
uagccgccugcgaguuuuaccu

SEQ ID NO: 2676536 - RNA, 23 nt, Escherichia coli CFT073
uagccgcguacauugcugacaug

SEQ ID NO: 2676537 - RNA, 15 nt, Escherichia coli CFT073
uagccgcuucugcag

SEQ ID NO: 2676538 - RNA, 17 nt, Escherichia coli CFT073
uagccgcuucugcagcu

SEQ ID NO: 2676539 - RNA, 19 nt, Escherichia coli CFT073
uagccgguaaaucaccauc

SEQ ID NO: 2676540 - RNA, 18 nt, Escherichia coli CFT073
uagccguagcuggcaaug

SEQ ID NO: 2676541 - RNA, 16 nt, Escherichia coli CFT073
uagccucccugccucc

SEQ ID NO: 2676542 - RNA, 20 nt, Escherichia coli CFT073
uagccucccugccuccauga

SEQ ID NO: 2676543 - RNA, 15 nt, Escherichia coli CFT073
uagccuccggccacg

SEQ ID NO: 2676544 - RNA, 19 nt, Escherichia coli CFT073
uagccucuuuauuuccugc

SEQ ID NO: 2676545 - RNA, 19 nt, Escherichia coli CFT073
uagccugaugcgaugcugg

SEQ ID NO: 2676546 - RNA, 11 nt, Escherichia coli CFT073
uagccugccag

SEQ ID NO: 2676547 - RNA, 12 nt, Escherichia coli CFT073
uagccugccagu

SEQ ID NO: 2676548 - RNA, 14 nt, Escherichia coli CFT073
uagccuucaucaga

SEQ ID NO: 2676549 - RNA, 19 nt, Escherichia coli CFT073
uagccuucaucagaugaag

SEQ ID NO: 2676550 - RNA, 21 nt, Escherichia coli CFT073
uagcgaauaaucccggcacca

SEQ ID NO: 2676551 - RNA, 14 nt, Escherichia coli CFT073
uagcgaauuuuucg

SEQ ID NO: 2676552 - RNA, 16 nt, Escherichia coli CFT073
uagcgacgcgcuggca

SEQ ID NO: 2676553 - RNA, 20 nt, Escherichia coli CFT073
uagcgauaaaacgccgcugg

SEQ ID NO: 2676554 - RNA, 14 nt, Escherichia coli CFT073
uagcgaucgucaaa

SEQ ID NO: 2676555 - RNA, 11 nt, Escherichia coli CFT073
uagcgauggcc

SEQ ID NO: 2676556 - RNA, 22 nt, Escherichia coli CFT073
uagcgcaaagacggaugauguu

SEQ ID NO: 2676557 - RNA, 23 nt, Escherichia coli CFT073
uagcgcagcagauaaaagaccac

SEQ ID NO: 2676558 - RNA, 20 nt, Escherichia coli CFT073
uagcgcaggggcaaucagca

SEQ ID NO: 2676559 - RNA, 16 nt, Escherichia coli CFT073
uagcgcaucacuucca

SEQ ID NO: 2676560 - RNA, 23 nt, Escherichia coli CFT073
uagcgccacgccaaccaccggaa

SEQ ID NO: 2676561 - RNA, 15 nt, Escherichia coli CFT073
uagcgccguuuuuau

SEQ ID NO: 2676562 - RNA, 15 nt, Escherichia coli CFT073
uagcgccucuuccau

SEQ ID NO: 2676563 - RNA, 18 nt, Escherichia coli CFT073
uagcgccucuuuauaaau

SEQ ID NO: 2676564 - RNA, 19 nt, Escherichia coli CFT073
uagcggaaagcguuucauu

SEQ ID NO: 2676565 - RNA, 21 nt, Escherichia coli CFT073
uagcggacucaccgagcagca

SEQ ID NO: 2676566 - RNA, 16 nt, Escherichia coli CFT073
uagcggcaagagaauu

SEQ ID NO: 2676567 - RNA, 14 nt, Escherichia coli CFT073
uagcggcuuaagaa

SEQ ID NO: 2676568 - RNA, 16 nt, Escherichia coli CFT073
uagcgggcgcaaugcc

SEQ ID NO: 2676569 - RNA, 18 nt, Escherichia coli CFT073
uagcguaacuuaucaauu

SEQ ID NO: 2676570 - RNA, 18 nt, Escherichia coli CFT073
uagcguccggcugccagc

SEQ ID NO: 2676571 - RNA, 20 nt, Escherichia coli CFT073
uagcgucgcaucaggcaaug

SEQ ID NO: 2676572 - RNA, 17 nt, Escherichia coli CFT073
uagcgucgccagcaguu

SEQ ID NO: 2676573 - RNA, 13 nt, Escherichia coli CFT073
uagcgugauuuug

SEQ ID NO: 2676574 - RNA, 17 nt, Escherichia coli CFT073
uagcgugauuuuguagg

SEQ ID NO: 2676575 - RNA, 18 nt, Escherichia coli CFT073
uagcgugauuuuuguagg

SEQ ID NO: 2676576 - RNA, 17 nt, Escherichia coli CFT073
uagcguuauauuauuau

SEQ ID NO: 2676577 - RNA, 16 nt, Escherichia coli CFT073
uagcguuucaccucuu

SEQ ID NO: 2676578 - RNA, 22 nt, Escherichia coli CFT073
uagcguuucaccucuuucacca

SEQ ID NO: 2676579 - RNA, 14 nt, Escherichia coli CFT073
uagcuaaaaauaau

SEQ ID NO: 2676580 - RNA, 15 nt, Escherichia coli CFT073
uagcuauauuuugcc

SEQ ID NO: 2676581 - RNA, 16 nt, Escherichia coli CFT073
uagcucaaacuggcug

SEQ ID NO: 2676582 - RNA, 20 nt, Escherichia coli CFT073
uagcucaacaguaaggccug

SEQ ID NO: 2676583 - RNA, 18 nt, Escherichia coli CFT073
uagcucaagcaaucaagc

SEQ ID NO: 2676584 - RNA, 22 nt, Escherichia coli CFT073
uagcucaguugguagagcacga

SEQ ID NO: 2676585 - RNA, 19 nt, Escherichia coli CFT073
uagcucauaaccuguuccu

SEQ ID NO: 2676586 - RNA, 16 nt, Escherichia coli CFT073
uagcucaucugacguu

SEQ ID NO: 2676587 - RNA, 20 nt, Escherichia coli CFT073
uagcugaaaaucagauccgc

SEQ ID NO: 2676588 - RNA, 12 nt, Escherichia coli CFT073
uagcugauauca

SEQ ID NO: 2676589 - RNA, 16 nt, Escherichia coli CFT073
uagcugauaucaccug

SEQ ID NO: 2676590 - RNA, 19 nt, Escherichia coli CFT073
uagcuguggugcaauccac

SEQ ID NO: 2676591 - RNA, 15 nt, Escherichia coli CFT073
uagcuuaacggcagc

SEQ ID NO: 2676592 - RNA, 21 nt, Escherichia coli CFT073
uagcuuaauaagaaaaaaggu

SEQ ID NO: 2676593 - RNA, 22 nt, Escherichia coli CFT073
uagcuuaucaaucucugcaaga

SEQ ID NO: 2676594 - RNA, 15 nt, Escherichia coli CFT073
uagcuuccacggcgu

SEQ ID NO: 2676595 - RNA, 12 nt, Escherichia coli CFT073
uagcuuccugcu

SEQ ID NO: 2676596 - RNA, 17 nt, Escherichia coli CFT073
uagcuuggcagagcgac

SEQ ID NO: 2676597 - RNA, 11 nt, Escherichia coli CFT073
uaggaaaucag

SEQ ID NO: 2676598 - RNA, 20 nt, Escherichia coli CFT073
uaggaauccgggucuguaaa

SEQ ID NO: 2676599 - RNA, 21 nt, Escherichia coli CFT073
uaggagguuuccgggucggca

SEQ ID NO: 2676600 - RNA, 16 nt, Escherichia coli CFT073
uaggauuauuuauuca

SEQ ID NO: 2676601 - RNA, 18 nt, Escherichia coli CFT073
uaggcaccgccaaagaua

SEQ ID NO: 2676602 - RNA, 17 nt, Escherichia coli CFT073
uaggcacgaaagguucc

SEQ ID NO: 2676603 - RNA, 16 nt, Escherichia coli CFT073
uaggcauacacaucac

SEQ ID NO: 2676604 - RNA, 14 nt, Escherichia coli CFT073
uaggcaucagcaau

SEQ ID NO: 2676605 - RNA, 15 nt, Escherichia coli CFT073
uaggcaucagcaauu

SEQ ID NO: 2676606 - RNA, 20 nt, Escherichia coli CFT073
uaggccagauaaggcguuca

SEQ ID NO: 2676607 - RNA, 20 nt, Escherichia coli CFT073
uaggccagauaaggcguuua

SEQ ID NO: 2676608 - RNA, 19 nt, Escherichia coli CFT073
uaggccaucgcuuuucguc

SEQ ID NO: 2676609 - RNA, 13 nt, Escherichia coli CFT073
uaggccugauaag

SEQ ID NO: 2676610 - RNA, 20 nt, Escherichia coli CFT073
uaggccugauaagacgcaac

SEQ ID NO: 2676611 - RNA, 18 nt, Escherichia coli CFT073
uaggccuuaaccgccgcc

SEQ ID NO: 2676612 - RNA, 22 nt, Escherichia coli CFT073
uaggcgacucguugugugaguu

SEQ ID NO: 2676613 - RNA, 15 nt, Escherichia coli CFT073
uaggcugagaaccgc

SEQ ID NO: 2676614 - RNA, 21 nt, Escherichia coli CFT073
uagggaaguagccuucaucag

SEQ ID NO: 2676615 - RNA, 19 nt, Escherichia coli CFT073
uagggaaucgauaacugcu

SEQ ID NO: 2676616 - RNA, 15 nt, Escherichia coli CFT073
uauagauucuacgaa

SEQ ID NO: 2676617 - RNA, 17 nt, Escherichia coli CFT073
uauagauucuacgaacu

SEQ ID NO: 2676618 - RNA, 21 nt, Escherichia coli CFT073
uauagccccaugcuggcuguu

SEQ ID NO: 2676619 - RNA, 19 nt, Escherichia coli CFT073
uauagccgccuuuuuguug

SEQ ID NO: 2676620 - RNA, 20 nt, Escherichia coli CFT073
uauagcgcaucacuuccagu

SEQ ID NO: 2676621 - RNA, 19 nt, Escherichia coli CFT073
uauagcgcauggcagccag

SEQ ID NO: 2676622 - RNA, 22 nt, Escherichia coli CFT073
uauagcguugcccgauugguuc

SEQ ID NO: 2676623 - RNA, 14 nt, Escherichia coli CFT073
uauagcugaacgcu

SEQ ID NO: 2676624 - RNA, 13 nt, Escherichia coli CFT073
uauaggcaaugcg

SEQ ID NO: 2676625 - RNA, 19 nt, Escherichia coli CFT073
uauagguggcaaagaaauc

SEQ ID NO: 2676626 - RNA, 23 nt, Escherichia coli CFT073
uauagguuccccauccuguauuu

SEQ ID NO: 2676627 - RNA, 15 nt, Escherichia coli CFT073
uauauaaaacacuga

SEQ ID NO: 2676628 - RNA, 14 nt, Escherichia coli CFT073
uauauaaaccuucu

SEQ ID NO: 2676629 - RNA, 12 nt, Escherichia coli CFT073
uauauaacagaa

SEQ ID NO: 2676630 - RNA, 14 nt, Escherichia coli CFT073
uauauacucuaaau

SEQ ID NO: 2676631 - RNA, 18 nt, Escherichia coli CFT073
uauauacucuaaauaauu

SEQ ID NO: 2676632 - RNA, 21 nt, Escherichia coli CFT073
uauaucccucacgcuucugaa

SEQ ID NO: 2676633 - RNA, 11 nt, Escherichia coli CFT073
uauauccugaa

SEQ ID NO: 2676634 - RNA, 16 nt, Escherichia coli CFT073
uauaucuucuuuauau

SEQ ID NO: 2676635 - RNA, 12 nt, Escherichia coli CFT073
uauaugaauacg

SEQ ID NO: 2676636 - RNA, 23 nt, Escherichia coli CFT073
uauaugacucauaaaaauauauu

SEQ ID NO: 2676637 - RNA, 21 nt, Escherichia coli CFT073
uauaugccaucgccagcagcc

SEQ ID NO: 2676638 - RNA, 18 nt, Escherichia coli CFT073
uauaugcuuguauuagcg

SEQ ID NO: 2676639 - RNA, 19 nt, Escherichia coli CFT073
uauauuacucauuaaugua

SEQ ID NO: 2676640 - RNA, 13 nt, Escherichia coli CFT073
uauauuauuauuc

SEQ ID NO: 2676641 - RNA, 17 nt, Escherichia coli CFT073
uauauuccuauauauuu

SEQ ID NO: 2676642 - RNA, 18 nt, Escherichia coli CFT073
uauauuuauucaucagcg

SEQ ID NO: 2676643 - RNA, 19 nt, Escherichia coli CFT073
uauauuucauuuuauucga

SEQ ID NO: 2676644 - RNA, 15 nt, Escherichia coli CFT073
uaucaaaaccuaacu

SEQ ID NO: 2676645 - RNA, 17 nt, Escherichia coli CFT073
uaucaaaaccuaacucu

SEQ ID NO: 2676646 - RNA, 13 nt, Escherichia coli CFT073
uaucaaacagaaa

SEQ ID NO: 2676647 - RNA, 20 nt, Escherichia coli CFT073
uaucaaacgugacauucuga

SEQ ID NO: 2676648 - RNA, 15 nt, Escherichia coli CFT073
uaucaaacugaccuu

SEQ ID NO: 2676649 - RNA, 16 nt, Escherichia coli CFT073
uaucaaauucauugcg

SEQ ID NO: 2676650 - RNA, 21 nt, Escherichia coli CFT073
uaucaacaauaaacugcgacc

SEQ ID NO: 2676651 - RNA, 14 nt, Escherichia coli CFT073
uaucaaccacggca

SEQ ID NO: 2676652 - RNA, 20 nt, Escherichia coli CFT073
uaucaacccgagcgccagcg

SEQ ID NO: 2676653 - RNA, 13 nt, Escherichia coli CFT073
uaucaagcaccaa

SEQ ID NO: 2676654 - RNA, 14 nt, Escherichia coli CFT073
uaucaagcccgccg

SEQ ID NO: 2676655 - RNA, 15 nt, Escherichia coli CFT073
uaucaauaacauacc

SEQ ID NO: 2676656 - RNA, 17 nt, Escherichia coli CFT073
uaucaaucucagcaaga

SEQ ID NO: 2676657 - RNA, 17 nt, Escherichia coli CFT073
uaucaaucuucucuucc

SEQ ID NO: 2676658 - RNA, 17 nt, Escherichia coli CFT073
uaucaauucuuuuucug

SEQ ID NO: 2676659 - RNA, 23 nt, Escherichia coli CFT073
uaucaauucuuuuucugaagacg

SEQ ID NO: 2676660 - RNA, 17 nt, Escherichia coli CFT073
uaucaauuuugauuucc

SEQ ID NO: 2676661 - RNA, 13 nt, Escherichia coli CFT073
uaucaccaaacca

SEQ ID NO: 2676662 - RNA, 14 nt, Escherichia coli CFT073
uaucaccaaucaca

SEQ ID NO: 2676663 - RNA, 15 nt, Escherichia coli CFT073
uaucaccaaugauaa

SEQ ID NO: 2676664 - RNA, 23 nt, Escherichia coli CFT073
uaucaccaaugauaaguuucacu

SEQ ID NO: 2676665 - RNA, 13 nt, Escherichia coli CFT073
uaucaccacacaa

SEQ ID NO: 2676666 - RNA, 19 nt, Escherichia coli CFT073
uaucaccacugaugccacu

SEQ ID NO: 2676667 - RNA, 23 nt, Escherichia coli CFT073
uaucaccaggagccaguuggcgu

SEQ ID NO: 2676668 - RNA, 18 nt, Escherichia coli CFT073
uaucacgcaucugcugua

SEQ ID NO: 2676669 - RNA, 21 nt, Escherichia coli CFT073
uaucacgguaaugauuaacag

SEQ ID NO: 2676670 - RNA, 17 nt, Escherichia coli CFT073
uaucacuauaaauauac

SEQ ID NO: 2676671 - RNA, 21 nt, Escherichia coli CFT073
uaucacucggggcuuuucucu

SEQ ID NO: 2676672 - RNA, 13 nt, Escherichia coli CFT073
uaucacucugccg

SEQ ID NO: 2676673 - RNA, 16 nt, Escherichia coli CFT073
uaucacuuuuauauaa

SEQ ID NO: 2676674 - RNA, 19 nt, Escherichia coli CFT073
uaucagacaaucugugugg

SEQ ID NO: 2676675 - RNA, 23 nt, Escherichia coli CFT073
uaucagacuaaaccgcacuggca

SEQ ID NO: 2676676 - RNA, 22 nt, Escherichia coli CFT073
uaucagcaauaaaaaaaugagu

SEQ ID NO: 2676677 - RNA, 15 nt, Escherichia coli CFT073
uaucagcagcacaaa

SEQ ID NO: 2676678 - RNA, 20 nt, Escherichia coli CFT073
uaucagcauggccgcaagag

SEQ ID NO: 2676679 - RNA, 14 nt, Escherichia coli CFT073
uaucagcccaaaaa

SEQ ID NO: 2676680 - RNA, 23 nt, Escherichia coli CFT073
uaucagcccaaaaauugccccca

SEQ ID NO: 2676681 - RNA, 19 nt, Escherichia coli CFT073
uaucagcgccaccacaaaa

SEQ ID NO: 2676682 - RNA, 22 nt, Escherichia coli CFT073
uaucaggcauggugcuggcuua

SEQ ID NO: 2676683 - RNA, 14 nt, Escherichia coli CFT073
uaucaggccuacaa

SEQ ID NO: 2676684 - RNA, 15 nt, Escherichia coli CFT073
uaucaggccuacaaa

SEQ ID NO: 2676685 - RNA, 15 nt, Escherichia coli CFT073
uaucaggccuacaag

SEQ ID NO: 2676686 - RNA, 16 nt, Escherichia coli CFT073
uaucaggccuacgcca

SEQ ID NO: 2676687 - RNA, 18 nt, Escherichia coli CFT073
uaucaggccugcaaaauc

SEQ ID NO: 2676688 - RNA, 20 nt, Escherichia coli CFT073
uaucaggucaauugaacucu

SEQ ID NO: 2676689 - RNA, 17 nt, Escherichia coli CFT073
uaucaggucgaaaauaa

SEQ ID NO: 2676690 - RNA, 15 nt, Escherichia coli CFT073
uaucaggucuuucug

SEQ ID NO: 2676691 - RNA, 15 nt, Escherichia coli CFT073
uaucaucacccugcg

SEQ ID NO: 2676692 - RNA, 19 nt, Escherichia coli CFT073
uaucaucaucggucaguuu

SEQ ID NO: 2676693 - RNA, 23 nt, Escherichia coli CFT073
uaucaucaucggucaguuugccc

SEQ ID NO: 2676694 - RNA, 21 nt, Escherichia coli CFT073
uaucaucgcggcacacagcac

SEQ ID NO: 2676695 - RNA, 14 nt, Escherichia coli CFT073
uaucaugcccggau

SEQ ID NO: 2676696 - RNA, 23 nt, Escherichia coli CFT073
uaucaugccuacgaguucgaugc

SEQ ID NO: 2676697 - RNA, 20 nt, Escherichia coli CFT073
uaucauucgguugccagcgc

SEQ ID NO: 2676698 - RNA, 19 nt, Escherichia coli CFT073
uaucauugccgguuggcga

SEQ ID NO: 2676699 - RNA, 15 nt, Escherichia coli CFT073
uaucauuuugcugcc

SEQ ID NO: 2676700 - RNA, 19 nt, Escherichia coli CFT073
uaucauuuuuaguuuugug

SEQ ID NO: 2676701 - RNA, 15 nt, Escherichia coli CFT073
uauccaacugugaau

SEQ ID NO: 2676702 - RNA, 22 nt, Escherichia coli CFT073
uauccaacugugaauccugcau

SEQ ID NO: 2676703 - RNA, 20 nt, Escherichia coli CFT073
uauccaccgacacuacaaau

SEQ ID NO: 2676704 - RNA, 17 nt, Escherichia coli CFT073
uauccagcaaagcguca

SEQ ID NO: 2676705 - RNA, 13 nt, Escherichia coli CFT073
uauccagcaccac

SEQ ID NO: 2676706 - RNA, 21 nt, Escherichia coli CFT073
uauccagcaucggguaaggga

SEQ ID NO: 2676707 - RNA, 21 nt, Escherichia coli CFT073
uauccagcgccugagcagcga

SEQ ID NO: 2676708 - RNA, 16 nt, Escherichia coli CFT073
uauccagcggcagcca

SEQ ID NO: 2676709 - RNA, 23 nt, Escherichia coli CFT073
uauccagcguuauaaaacacauu

SEQ ID NO: 2676710 - RNA, 22 nt, Escherichia coli CFT073
uauccagguguauuguucuggu

SEQ ID NO: 2676711 - RNA, 21 nt, Escherichia coli CFT073
uauccagucggcguaauccug

SEQ ID NO: 2676712 - RNA, 13 nt, Escherichia coli CFT073
uauccaguugguu

SEQ ID NO: 2676713 - RNA, 15 nt, Escherichia coli CFT073
uauccauauacagcg

SEQ ID NO: 2676714 - RNA, 13 nt, Escherichia coli CFT073
uauccauauuuuu

SEQ ID NO: 2676715 - RNA, 22 nt, Escherichia coli CFT073
uauccauguaccagacugacau

SEQ ID NO: 2676716 - RNA, 20 nt, Escherichia coli CFT073
uauccauuugugacauuaac

SEQ ID NO: 2676717 - RNA, 20 nt, Escherichia coli CFT073
uaucccaacgcaaaaccaag

SEQ ID NO: 2676718 - RNA, 21 nt, Escherichia coli CFT073
uaucccaccagcgccgcccac

SEQ ID NO: 2676719 - RNA, 21 nt, Escherichia coli CFT073
uaucccaggcaaaauccuucc

SEQ ID NO: 2676720 - RNA, 22 nt, Escherichia coli CFT073
uaucccaucagcggguuuuucc

SEQ ID NO: 2676721 - RNA, 10 nt, Escherichia coli CFT073
uaucccauuu

SEQ ID NO: 2676722 - RNA, 20 nt, Escherichia coli CFT073
uaucccccgauaaaacauua

SEQ ID NO: 2676723 - RNA, 19 nt, Escherichia coli CFT073
uaucccgccagcaccagca

SEQ ID NO: 2676724 - RNA, 13 nt, Escherichia coli CFT073
uaugccaucgcca

SEQ ID NO: 2676725 - RNA, 14 nt, Escherichia coli CFT073
uaugcccagcgcag

SEQ ID NO: 2676726 - RNA, 13 nt, Escherichia coli CFT073
uaugcccagggca

SEQ ID NO: 2676727 - RNA, 16 nt, Escherichia coli CFT073
uaugccgaucaucauc

SEQ ID NO: 2676728 - RNA, 11 nt, Escherichia coli CFT073
uaugccggaug

SEQ ID NO: 2676729 - RNA, 19 nt, Escherichia coli CFT073
uaugccggguuauccaacc

SEQ ID NO: 2676730 - RNA, 17 nt, Escherichia coli CFT073
uaugccuguccucuuca

SEQ ID NO: 2676731 - RNA, 17 nt, Escherichia coli CFT073
uaugcgcgucagagauu

SEQ ID NO: 2676732 - RNA, 21 nt, Escherichia coli CFT073
uaugcgcugucauucauucag

SEQ ID NO: 2676733 - RNA, 21 nt, Escherichia coli CFT073
uaugcggugccauuaaaccaa

SEQ ID NO: 2676734 - RNA, 19 nt, Escherichia coli CFT073
uaugcgucaacgccgcguc

SEQ ID NO: 2676735 - RNA, 13 nt, Escherichia coli CFT073
uaugcugcuuaca

SEQ ID NO: 2676736 - RNA, 17 nt, Escherichia coli CFT073
uaugcuguaaacaacau

SEQ ID NO: 2676737 - RNA, 15 nt, Escherichia coli CFT073
uaugcuuguuugccc

SEQ ID NO: 2676738 - RNA, 22 nt, Escherichia coli CFT073
uauggaacaacaccacuugcug

SEQ ID NO: 2676739 - RNA, 12 nt, Escherichia coli CFT073
uauggagaaaac

SEQ ID NO: 2676740 - RNA, 15 nt, Escherichia coli CFT073
uauggagcaggaaua

SEQ ID NO: 2676741 - RNA, 14 nt, Escherichia coli CFT073
uauggaucaccauc

SEQ ID NO: 2676742 - RNA, 21 nt, Escherichia coli CFT073
uauggcaaucuuccucgccag

SEQ ID NO: 2676743 - RNA, 16 nt, Escherichia coli CFT073
uauggcuugaagcaau

SEQ ID NO: 2676744 - RNA, 16 nt, Escherichia coli CFT073
uaugguacuuucugau

SEQ ID NO: 2676745 - RNA, 13 nt, Escherichia coli CFT073
uauggugaagaag

SEQ ID NO: 2676746 - RNA, 21 nt, Escherichia coli CFT073
uaugguuuuguaggccggaua

SEQ ID NO: 2676747 - RNA, 12 nt, Escherichia coli CFT073
uauguaauuaaa

SEQ ID NO: 2676748 - RNA, 13 nt, Escherichia coli CFT073
uaugucaccagca

SEQ ID NO: 2676749 - RNA, 15 nt, Escherichia coli CFT073
uaugucagugguggc

SEQ ID NO: 2676750 - RNA, 14 nt, Escherichia coli CFT073
uaugucauaaaaau

SEQ ID NO: 2676751 - RNA, 22 nt, Escherichia coli CFT073
uaugucauugccugauguugau

SEQ ID NO: 2676752 - RNA, 14 nt, Escherichia coli CFT073
uaugugcaauuuca

SEQ ID NO: 2676753 - RNA, 18 nt, Escherichia coli CFT073
uaugugguauugcagcuc

SEQ ID NO: 2676754 - RNA, 14 nt, Escherichia coli CFT073
uauguguaagaaag

SEQ ID NO: 2676755 - RNA, 17 nt, Escherichia coli CFT073
uauguucagaaagcgcc

SEQ ID NO: 2676756 - RNA, 22 nt, Escherichia coli CFT073
uauguucagaaagcgccagcaa

SEQ ID NO: 2676757 - RNA, 12 nt, Escherichia coli CFT073
uauguucccuua

SEQ ID NO: 2676758 - RNA, 19 nt, Escherichia coli CFT073
uauguucccuuaauuaucu

SEQ ID NO: 2676759 - RNA, 13 nt, Escherichia coli CFT073
uauguugaaaagc

SEQ ID NO: 2676760 - RNA, 13 nt, Escherichia coli CFT073
uauguuuaauguu

SEQ ID NO: 2676761 - RNA, 14 nt, Escherichia coli CFT073
uauguuuuuaaacc

SEQ ID NO: 2676762 - RNA, 23 nt, Escherichia coli CFT073
uauguuuuugaauuaacuccagu

SEQ ID NO: 2676763 - RNA, 12 nt, Escherichia coli CFT073
uauuaaauauua

SEQ ID NO: 2676764 - RNA, 13 nt, Escherichia coli CFT073
uauuaaauauuau

SEQ ID NO: 2676765 - RNA, 14 nt, Escherichia coli CFT073
uauuaacaagaugu

SEQ ID NO: 2676766 - RNA, 21 nt, Escherichia coli CFT073
uauuaacccgcaacagcaaua

SEQ ID NO: 2676767 - RNA, 15 nt, Escherichia coli CFT073
uauuaaccucucaga

SEQ ID NO: 2676768 - RNA, 14 nt, Escherichia coli CFT073
uauuaacgcagcaa

SEQ ID NO: 2676769 - RNA, 14 nt, Escherichia coli CFT073
uauuaauauauauu

SEQ ID NO: 2676770 - RNA, 22 nt, Escherichia coli CFT073
uauuaauccagggaucaacauu

SEQ ID NO: 2676771 - RNA, 20 nt, Escherichia coli CFT073
uauuacagccgggagugaau

SEQ ID NO: 2676772 - RNA, 23 nt, Escherichia coli CFT073
uauuacauaccagcagcaucacg

SEQ ID NO: 2676773 - RNA, 15 nt, Escherichia coli CFT073
uauuacccuuuauuu

SEQ ID NO: 2676774 - RNA, 20 nt, Escherichia coli CFT073
uauuacgguaaggauauuca

SEQ ID NO: 2676775 - RNA, 21 nt, Escherichia coli CFT073
uauuacgguaaggauauucau

SEQ ID NO: 2676776 - RNA, 17 nt, Escherichia coli CFT073
uauuacuauggauauaa

SEQ ID NO: 2676777 - RNA, 24 nt, Escherichia coli CFT073
uauuacucuccagacugcugcgca

SEQ ID NO: 2676778 - RNA, 21 nt, Escherichia coli CFT073
uauuacugaccuccaguccca

SEQ ID NO: 2676779 - RNA, 13 nt, Escherichia coli CFT073
uauuacuggcgau

SEQ ID NO: 2676780 - RNA, 20 nt, Escherichia coli CFT073
uauuagcaacgauauccaua

SEQ ID NO: 2676781 - RNA, 12 nt, Escherichia coli CFT073
uauuagcccguu

SEQ ID NO: 2676782 - RNA, 15 nt, Escherichia coli CFT073
uauuauauaccauau

SEQ ID NO: 2676783 - RNA, 23 nt, Escherichia coli CFT073
uauuauaucuucacgauuauuaa

SEQ ID NO: 2676784 - RNA, 21 nt, Escherichia coli CFT073
uauuaucccccgauaaaacau

SEQ ID NO: 2676785 - RNA, 22 nt, Escherichia coli CFT073
uauuaucccccgauaaaacauu

SEQ ID NO: 2676786 - RNA, 20 nt, Escherichia coli CFT073
uauuauggugacaaacacag

SEQ ID NO: 2676787 - RNA, 15 nt, Escherichia coli CFT073
uauuauuauuccugc

SEQ ID NO: 2676788 - RNA, 13 nt, Escherichia coli CFT073
uauuauuauuuuu

SEQ ID NO: 2676789 - RNA, 18 nt, Escherichia coli CFT073
uauuauucauaaugccca

SEQ ID NO: 2676790 - RNA, 14 nt, Escherichia coli CFT073
uauuauuccauccu

SEQ ID NO: 2676791 - RNA, 13 nt, Escherichia coli CFT073
uauucaaaaacag

SEQ ID NO: 2676792 - RNA, 15 nt, Escherichia coli CFT073
uauucaacgugagau

SEQ ID NO: 2676793 - RNA, 13 nt, Escherichia coli CFT073
uauucaccacuac

SEQ ID NO: 2676794 - RNA, 19 nt, Escherichia coli CFT073
uauucagaauuuuuaaccg

SEQ ID NO: 2676795 - RNA, 20 nt, Escherichia coli CFT073
uauucagaguauauauucgu

SEQ ID NO: 2676796 - RNA, 21 nt, Escherichia coli CFT073
uauucagaucuugcucuacca

SEQ ID NO: 2676797 - RNA, 11 nt, Escherichia coli CFT073
uauucagcaga

SEQ ID NO: 2676798 - RNA, 19 nt, Escherichia coli CFT073
uauucagccugacuggugg

SEQ ID NO: 2676799 - RNA, 22 nt, Escherichia coli CFT073
uauucagcguuugcugaaaauc

SEQ ID NO: 2676800 - RNA, 16 nt, Escherichia coli CFT073
uauucaguucaucuac

SEQ ID NO: 2676801 - RNA, 14 nt, Escherichia coli CFT073
uauucauaaaugcu

SEQ ID NO: 2676802 - RNA, 24 nt, Escherichia coli CFT073
uauucaucgccggaguacgccauu

SEQ ID NO: 2676803 - RNA, 12 nt, Escherichia coli CFT073
uauucaugcccu

SEQ ID NO: 2676804 - RNA, 13 nt, Escherichia coli CFT073
uauucauuaauaa

SEQ ID NO: 2676805 - RNA, 18 nt, Escherichia coli CFT073
uauucauugcuauuuccc

SEQ ID NO: 2676806 - RNA, 12 nt, Escherichia coli CFT073
uauuccaguuca

SEQ ID NO: 2676807 - RNA, 17 nt, Escherichia coli CFT073
uauuccauccugcucaa

SEQ ID NO: 2676808 - RNA, 11 nt, Escherichia coli CFT073
uauuccccaga

SEQ ID NO: 2676809 - RNA, 15 nt, Escherichia coli CFT073
uauucccccaccgcc

SEQ ID NO: 2676810 - RNA, 21 nt, Escherichia coli CFT073
uauuccccggucagcagcacc

SEQ ID NO: 2676811 - RNA, 20 nt, Escherichia coli CFT073
uauucccguauuacugagau

SEQ ID NO: 2676812 - RNA, 14 nt, Escherichia coli CFT073
uauucccuugcucu

SEQ ID NO: 2676813 - RNA, 19 nt, Escherichia coli CFT073
uauuccgcaacgccgccaa

SEQ ID NO: 2676814 - RNA, 16 nt, Escherichia coli CFT073
uauuccgcaccugcca

SEQ ID NO: 2676815 - RNA, 17 nt, Escherichia coli CFT073
uauuccgcaccugccag

SEQ ID NO: 2676816 - RNA, 18 nt, Escherichia coli CFT073
uauuccgcaccugccagc

SEQ ID NO: 2676817 - RNA, 20 nt, Escherichia coli CFT073
uauuccgcaccugccagcgc

SEQ ID NO: 2676818 - RNA, 16 nt, Escherichia coli CFT073
uauuccugaaucagcc

SEQ ID NO: 2676819 - RNA, 21 nt, Escherichia coli CFT073
uauucgcuuccuccaccacuu

SEQ ID NO: 2676820 - RNA, 15 nt, Escherichia coli CFT073
uauucucacguugca

SEQ ID NO: 2676821 - RNA, 16 nt, Escherichia coli CFT073
uauucucggcugccug

SEQ ID NO: 2676822 - RNA, 22 nt, Escherichia coli CFT073
uauucugccgcuuaaauuggcg

SEQ ID NO: 2676823 - RNA, 17 nt, Escherichia coli CFT073
uauucuggcuaaccaaa

SEQ ID NO: 2676824 - RNA, 22 nt, Escherichia coli CFT073
uauucugguaaucgcaaagcug

SEQ ID NO: 2676825 - RNA, 13 nt, Escherichia coli CFT073
uauucuguaccaa

SEQ ID NO: 2676826 - RNA, 17 nt, Escherichia coli CFT073
uauucuuacuucaacac

SEQ ID NO: 2676827 - RNA, 14 nt, Escherichia coli CFT073
uauucuuccggcuu

SEQ ID NO: 2676828 - RNA, 23 nt, Escherichia coli CFT073
uauucuugcugauacuauucauu

SEQ ID NO: 2676829 - RNA, 14 nt, Escherichia coli CFT073
uauucuuuuuugau

SEQ ID NO: 2676830 - RNA, 12 nt, Escherichia coli CFT073
uauugaagccca

SEQ ID NO: 2676831 - RNA, 20 nt, Escherichia coli CFT073
uauugaccguuucgccagac

SEQ ID NO: 2676832 - RNA, 23 nt, Escherichia coli CFT073
uauugagcgaccgcuucaaaguu

SEQ ID NO: 2676833 - RNA, 16 nt, Escherichia coli CFT073
ucaaaucacuaaaccc

SEQ ID NO: 2676834 - RNA, 18 nt, Escherichia coli CFT073
ucaaaugcgccugcauaa

SEQ ID NO: 2676835 - RNA, 23 nt, Escherichia coli CFT073
ucaaauggaccaucuccgaaguu

SEQ ID NO: 2676836 - RNA, 23 nt, Escherichia coli CFT073
ucaaauggcauccuugcuaacca

SEQ ID NO: 2676837 - RNA, 19 nt, Escherichia coli CFT073
ucaaauuacgauccaccac

SEQ ID NO: 2676838 - RNA, 13 nt, Escherichia coli CFT073
ucaaauucauugu

SEQ ID NO: 2676839 - RNA, 18 nt, Escherichia coli CFT073
ucaaauugcucuuugguu

SEQ ID NO: 2676840 - RNA, 18 nt, Escherichia coli CFT073
ucaaauuucauaaucuga

SEQ ID NO: 2676841 - RNA, 18 nt, Escherichia coli CFT073
ucaaauuugccagcgauc

SEQ ID NO: 2676842 - RNA, 17 nt, Escherichia coli CFT073
ucaaauuugucgccaac

SEQ ID NO: 2676843 - RNA, 22 nt, Escherichia coli CFT073
ucaaauuugucgccaacuucau

SEQ ID NO: 2676844 - RNA, 17 nt, Escherichia coli CFT073
ucaacaaaaccacacuu

SEQ ID NO: 2676845 - RNA, 23 nt, Escherichia coli CFT073
ucaacaaaaguggacauguuuuu

SEQ ID NO: 2676846 - RNA, 16 nt, Escherichia coli CFT073
ucaacaaacgccagau

SEQ ID NO: 2676847 - RNA, 20 nt, Escherichia coli CFT073
ucaacaaacguucauacgca

SEQ ID NO: 2676848 - RNA, 20 nt, Escherichia coli CFT073
ucaacaaauagauaaaauau

SEQ ID NO: 2676849 - RNA, 16 nt, Escherichia coli CFT073
ucaacaacaauuucac

SEQ ID NO: 2676850 - RNA, 13 nt, Escherichia coli CFT073
ucaacaaccaggc

SEQ ID NO: 2676851 - RNA, 19 nt, Escherichia coli CFT073
ucaacaaccaggccagcgc

SEQ ID NO: 2676852 - RNA, 16 nt, Escherichia coli CFT073
ucaacaaccuugcguu

SEQ ID NO: 2676853 - RNA, 16 nt, Escherichia coli CFT073
ucaacaacuggcguuu

SEQ ID NO: 2676854 - RNA, 21 nt, Escherichia coli CFT073
ucaacaagcagcuugagaaaa

SEQ ID NO: 2676855 - RNA, 22 nt, Escherichia coli CFT073
ucaacaagcagcuugagaaaau

SEQ ID NO: 2676856 - RNA, 14 nt, Escherichia coli CFT073
ucaacaauccauuc

SEQ ID NO: 2676857 - RNA, 22 nt, Escherichia coli CFT073
ucaacaauugcgggccaaagac

SEQ ID NO: 2676858 - RNA, 21 nt, Escherichia coli CFT073
ucaacacaccgcccugcugua

SEQ ID NO: 2676859 - RNA, 17 nt, Escherichia coli CFT073
ucaacaccgugacaaau

SEQ ID NO: 2676860 - RNA, 14 nt, Escherichia coli CFT073
ucaacacgccugca

SEQ ID NO: 2676861 - RNA, 16 nt, Escherichia coli CFT073
ucaacagaaugauauu

SEQ ID NO: 2676862 - RNA, 20 nt, Escherichia coli CFT073
ucaacagauaaauggcacag

SEQ ID NO: 2676863 - RNA, 22 nt, Escherichia coli CFT073
ucaacagauuuugcaggccuga

SEQ ID NO: 2676864 - RNA, 14 nt, Escherichia coli CFT073
ucaacagccagaag

SEQ ID NO: 2676865 - RNA, 13 nt, Escherichia coli CFT073
ucaacaggaacau

SEQ ID NO: 2676866 - RNA, 20 nt, Escherichia coli CFT073
ucaacaggaauguuguccag

SEQ ID NO: 2676867 - RNA, 13 nt, Escherichia coli CFT073
ucaacaguaaacu

SEQ ID NO: 2676868 - RNA, 19 nt, Escherichia coli CFT073
ucaaccaccggcaccacuu

SEQ ID NO: 2676869 - RNA, 20 nt, Escherichia coli CFT073
ucaaccacuacgugaucguc

SEQ ID NO: 2676870 - RNA, 22 nt, Escherichia coli CFT073
ucaaccacuacgugaucgucuu

SEQ ID NO: 2676871 - RNA, 20 nt, Escherichia coli CFT073
ucaaccagcaccuuuuccag

SEQ ID NO: 2676872 - RNA, 12 nt, Escherichia coli CFT073
ucaacccaguug

SEQ ID NO: 2676873 - RNA, 13 nt, Escherichia coli CFT073
ucaacccgcccag

SEQ ID NO: 2676874 - RNA, 23 nt, Escherichia coli CFT073
ucaacccgcgcgcuaacggagaa

SEQ ID NO: 2676875 - RNA, 17 nt, Escherichia coli CFT073
ucaaccgcagugauuuc

SEQ ID NO: 2676876 - RNA, 18 nt, Escherichia coli CFT073
ucaaccgcgacauacuua

SEQ ID NO: 2676877 - RNA, 21 nt, Escherichia coli CFT073
ucaaccgcgacauacuuaaau

SEQ ID NO: 2676878 - RNA, 18 nt, Escherichia coli CFT073
ucaaccucuuuuucugcc

SEQ ID NO: 2676879 - RNA, 19 nt, Escherichia coli CFT073
ucaaccucuuuuucugccu

SEQ ID NO: 2676880 - RNA, 13 nt, Escherichia coli CFT073
ucaaccugaggcc

SEQ ID NO: 2676881 - RNA, 20 nt, Escherichia coli CFT073
ucaacgacauaugcguagca

SEQ ID NO: 2676882 - RNA, 23 nt, Escherichia coli CFT073
ucaacgacgcugaagucagcaca

SEQ ID NO: 2676883 - RNA, 21 nt, Escherichia coli CFT073
ucaacgaugcgaccgccgcuc

SEQ ID NO: 2676884 - RNA, 14 nt, Escherichia coli CFT073
ucaacgaugucaau

SEQ ID NO: 2676885 - RNA, 21 nt, Escherichia coli CFT073
ucaacgccagauaaauucgac

SEQ ID NO: 2676886 - RNA, 22 nt, Escherichia coli CFT073
ucaacgccgcgugccaccauuc

SEQ ID NO: 2676887 - RNA, 21 nt, Escherichia coli CFT073
ucaacgccgcuaucagauucg

SEQ ID NO: 2676888 - RNA, 14 nt, Escherichia coli CFT073
ucaacgccgggccu

SEQ ID NO: 2676889 - RNA, 22 nt, Escherichia coli CFT073
ucaacgcgccgacgaauuucau

SEQ ID NO: 2676890 - RNA, 18 nt, Escherichia coli CFT073
ucaacgcgcuaauuucag

SEQ ID NO: 2676891 - RNA, 15 nt, Escherichia coli CFT073
ucaacgcugccauga

SEQ ID NO: 2676892 - RNA, 18 nt, Escherichia coli CFT073
ucaacggaccaauaaacg

SEQ ID NO: 2676893 - RNA, 16 nt, Escherichia coli CFT073
ucaacggugccaucac

SEQ ID NO: 2676894 - RNA, 14 nt, Escherichia coli CFT073
ucaacggugcuuua

SEQ ID NO: 2676895 - RNA, 22 nt, Escherichia coli CFT073
ucaacggugcuuuaauuucaug

SEQ ID NO: 2676896 - RNA, 19 nt, Escherichia coli CFT073
ucaacguacucugccacua

SEQ ID NO: 2676897 - RNA, 15 nt, Escherichia coli CFT073
ucaacguagaauaaa

SEQ ID NO: 2676898 - RNA, 17 nt, Escherichia coli CFT073
ucaacgucugcgccuuu

SEQ ID NO: 2676899 - RNA, 22 nt, Escherichia coli CFT073
ucaacguguaggccugauaaga

SEQ ID NO: 2676900 - RNA, 17 nt, Escherichia coli CFT073
ucaacguuaccaagaaa

SEQ ID NO: 2676901 - RNA, 16 nt, Escherichia coli CFT073
ucaacguuaggcggaa

SEQ ID NO: 2676902 - RNA, 15 nt, Escherichia coli CFT073
ucaacguuauucgcu

SEQ ID NO: 2676903 - RNA, 19 nt, Escherichia coli CFT073
ucaacguuauucgcuuccu

SEQ ID NO: 2676904 - RNA, 22 nt, Escherichia coli CFT073
ucaacguuuacccaauccccca

SEQ ID NO: 2676905 - RNA, 23 nt, Escherichia coli CFT073
ucaacguuuacccaaucccccac

SEQ ID NO: 2676906 - RNA, 19 nt, Escherichia coli CFT073
ucaacuaaaaucaauguaa

SEQ ID NO: 2676907 - RNA, 20 nt, Escherichia coli CFT073
ucaacuacggcuuuuuucau

SEQ ID NO: 2676908 - RNA, 13 nt, Escherichia coli CFT073
ucaacucaucaaa

SEQ ID NO: 2676909 - RNA, 14 nt, Escherichia coli CFT073
ucaacugacggucg

SEQ ID NO: 2676910 - RNA, 15 nt, Escherichia coli CFT073
ucaacuuaagucucc

SEQ ID NO: 2676911 - RNA, 19 nt, Escherichia coli CFT073
ucaacuuaagucuccauuu

SEQ ID NO: 2676912 - RNA, 15 nt, Escherichia coli CFT073
ucaacuuccugaauc

SEQ ID NO: 2676913 - RNA, 21 nt, Escherichia coli CFT073
ucaacuucgaguacauccacu

SEQ ID NO: 2676914 - RNA, 23 nt, Escherichia coli CFT073
ucaacuuuaaaaucuuugaaaua

SEQ ID NO: 2676915 - RNA, 23 nt, Escherichia coli CFT073
ucaagaaaacugguuauaugaau

SEQ ID NO: 2676916 - RNA, 23 nt, Escherichia coli CFT073
ucaagaaagcuuugcguuucuuc

SEQ ID NO: 2676917 - RNA, 15 nt, Escherichia coli CFT073
ucaagaaggauauaa

SEQ ID NO: 2676918 - RNA, 17 nt, Escherichia coli CFT073
ucaagaauaguuuccag

SEQ ID NO: 2676919 - RNA, 20 nt, Escherichia coli CFT073
ucaagaaucucuucuucgcu

SEQ ID NO: 2676920 - RNA, 23 nt, Escherichia coli CFT073
ucaagacaugauguuuuaacaca

SEQ ID NO: 2676921 - RNA, 16 nt, Escherichia coli CFT073
ucaagaccucaucguu

SEQ ID NO: 2676922 - RNA, 21 nt, Escherichia coli CFT073
ucaagacgaauaccuucuucc

SEQ ID NO: 2676923 - RNA, 17 nt, Escherichia coli CFT073
ucaagauggcucucauc

SEQ ID NO: 2676924 - RNA, 20 nt, Escherichia coli CFT073
ucaagauggcucucauccaa

SEQ ID NO: 2676925 - RNA, 14 nt, Escherichia coli CFT073
ucaagauuaaagca

SEQ ID NO: 2676926 - RNA, 12 nt, Escherichia coli CFT073
ucaagcaaccag

SEQ ID NO: 2676927 - RNA, 16 nt, Escherichia coli CFT073
ucaagcaaggccaggu

SEQ ID NO: 2676928 - RNA, 23 nt, Escherichia coli CFT073
ucaagcacagccgcauuuuguug

SEQ ID NO: 2676929 - RNA, 19 nt, Escherichia coli CFT073
ucaagcacccgccgcuauu

SEQ ID NO: 2676930 - RNA, 15 nt, Escherichia coli CFT073
ucaagcaccgccaua

SEQ ID NO: 2676931 - RNA, 16 nt, Escherichia coli CFT073
ucaagcauugauuuua

SEQ ID NO: 2676932 - RNA, 12 nt, Escherichia coli CFT073
ucaagcauuuuc

SEQ ID NO: 2676933 - RNA, 15 nt, Escherichia coli CFT073
ucaagccacuuccuu

SEQ ID NO: 2676934 - RNA, 21 nt, Escherichia coli CFT073
ucaagccagauauuaagcggc

SEQ ID NO: 2676935 - RNA, 15 nt, Escherichia coli CFT073
ucaagcccugguaac

SEQ ID NO: 2676936 - RNA, 20 nt, Escherichia coli CFT073
ucaagcccugguaacugcca

SEQ ID NO: 2676937 - RNA, 24 nt, Escherichia coli CFT073
ucaagcgaaaucaacacgccugca

SEQ ID NO: 2676938 - RNA, 22 nt, Escherichia coli CFT073
ucaagcgccgaguaaaaaaaca

SEQ ID NO: 2676939 - RNA, 13 nt, Escherichia coli CFT073
ucaagcgccgcca

SEQ ID NO: 2676940 - RNA, 21 nt, Escherichia coli CFT073
ucacaccuuguggaaauucca

SEQ ID NO: 2676941 - RNA, 17 nt, Escherichia coli CFT073
ucacacggccaucacgg

SEQ ID NO: 2676942 - RNA, 21 nt, Escherichia coli CFT073
ucacacuccagucccaguuca

SEQ ID NO: 2676943 - RNA, 18 nt, Escherichia coli CFT073
ucacacugacgcgcagug

SEQ ID NO: 2676944 - RNA, 20 nt, Escherichia coli CFT073
ucacacugacuuuaccugcc

SEQ ID NO: 2676945 - RNA, 19 nt, Escherichia coli CFT073
ucacacugaugauccugga

SEQ ID NO: 2676946 - RNA, 16 nt, Escherichia coli CFT073
ucacagaagugaagca

SEQ ID NO: 2676947 - RNA, 18 nt, Escherichia coli CFT073
ucacagagcgcuuauaca

SEQ ID NO: 2676948 - RNA, 20 nt, Escherichia coli CFT073
ucacagagcgcuuauacacc

SEQ ID NO: 2676949 - RNA, 17 nt, Escherichia coli CFT073
ucacagaguauuuccag

SEQ ID NO: 2676950 - RNA, 19 nt, Escherichia coli CFT073
ucacagaguauuuccagcu

SEQ ID NO: 2676951 - RNA, 17 nt, Escherichia coli CFT073
ucacaggcacaccgccg

SEQ ID NO: 2676952 - RNA, 18 nt, Escherichia coli CFT073
ucacagguggucacaguc

SEQ ID NO: 2676953 - RNA, 17 nt, Escherichia coli CFT073
ucacaguaauuuccugc

SEQ ID NO: 2676954 - RNA, 22 nt, Escherichia coli CFT073
ucacaguuaaccaguuuuagug

SEQ ID NO: 2676955 - RNA, 15 nt, Escherichia coli CFT073
ucacauaauacguuu

SEQ ID NO: 2676956 - RNA, 11 nt, Escherichia coli CFT073
ucacauacgcg

SEQ ID NO: 2676957 - RNA, 15 nt, Escherichia coli CFT073
ucacaucagcgcauu

SEQ ID NO: 2676958 - RNA, 15 nt, Escherichia coli CFT073
ucacaucaggccauc

SEQ ID NO: 2676959 - RNA, 15 nt, Escherichia coli CFT073
ucacauccaccagcg

SEQ ID NO: 2676960 - RNA, 19 nt, Escherichia coli CFT073
ucacauccaccagcgccuc

SEQ ID NO: 2676961 - RNA, 13 nt, Escherichia coli CFT073
ucacaucccagca

SEQ ID NO: 2676962 - RNA, 13 nt, Escherichia coli CFT073
ucacauccugcca

SEQ ID NO: 2676963 - RNA, 14 nt, Escherichia coli CFT073
ucacauccugccag

SEQ ID NO: 2676964 - RNA, 16 nt, Escherichia coli CFT073
ucacaucugacaaaau

SEQ ID NO: 2676965 - RNA, 21 nt, Escherichia coli CFT073
ucacaucugacaaaaucaaua

SEQ ID NO: 2676966 - RNA, 15 nt, Escherichia coli CFT073
ucacauucuccgccg

SEQ ID NO: 2676967 - RNA, 19 nt, Escherichia coli CFT073
ucacauucuguccugaaaa

SEQ ID NO: 2676968 - RNA, 20 nt, Escherichia coli CFT073
ucacauucuguccugaaaau

SEQ ID NO: 2676969 - RNA, 23 nt, Escherichia coli CFT073
ucacauucuguccugaaaauuca

SEQ ID NO: 2676970 - RNA, 14 nt, Escherichia coli CFT073
ucaccaaacugcuc

SEQ ID NO: 2676971 - RNA, 14 nt, Escherichia coli CFT073
ucaccaaaggcaca

SEQ ID NO: 2676972 - RNA, 20 nt, Escherichia coli CFT073
ucaccaaaggcacaacugcg

SEQ ID NO: 2676973 - RNA, 21 nt, Escherichia coli CFT073
ucaccaaaugccugcuguugc

SEQ ID NO: 2676974 - RNA, 12 nt, Escherichia coli CFT073
ucaccaacuggc

SEQ ID NO: 2676975 - RNA, 14 nt, Escherichia coli CFT073
ucaccaacuggcgc

SEQ ID NO: 2676976 - RNA, 21 nt, Escherichia coli CFT073
ucaccaacugugccgcgacca

SEQ ID NO: 2676977 - RNA, 16 nt, Escherichia coli CFT073
ucaccaaucagguaag

SEQ ID NO: 2676978 - RNA, 20 nt, Escherichia coli CFT073
ucaccuucggugaauuucac

SEQ ID NO: 2676979 - RNA, 18 nt, Escherichia coli CFT073
ucaccuugcucgaucaga

SEQ ID NO: 2676980 - RNA, 20 nt, Escherichia coli CFT073
ucaccuuguuucagcgcauc

SEQ ID NO: 2676981 - RNA, 16 nt, Escherichia coli CFT073
ucaccuuucagccacu

SEQ ID NO: 2676982 - RNA, 20 nt, Escherichia coli CFT073
ucaccuuucagccacuucau

SEQ ID NO: 2676983 - RNA, 13 nt, Escherichia coli CFT073
ucaccuuuucgau

SEQ ID NO: 2676984 - RNA, 15 nt, Escherichia coli CFT073
ucacgaauauuuccc

SEQ ID NO: 2676985 - RNA, 14 nt, Escherichia coli CFT073
ucacgaauccgcac

SEQ ID NO: 2676986 - RNA, 16 nt, Escherichia coli CFT073
ucacgaauccgcacca

SEQ ID NO: 2676987 - RNA, 16 nt, Escherichia coli CFT073
ucacgaaucgccucac

SEQ ID NO: 2676988 - RNA, 15 nt, Escherichia coli CFT073
ucacgaauuccgccu

SEQ ID NO: 2676989 - RNA, 21 nt, Escherichia coli CFT073
ucacgacaaccgggaucaccg

SEQ ID NO: 2676990 - RNA, 17 nt, Escherichia coli CFT073
ucacgacccauuacgua

SEQ ID NO: 2676991 - RNA, 21 nt, Escherichia coli CFT073
ucacgacccggcguuuucaga

SEQ ID NO: 2676992 - RNA, 18 nt, Escherichia coli CFT073
ucacgacuuguaccuuca

SEQ ID NO: 2676993 - RNA, 22 nt, Escherichia coli CFT073
ucacgaugcagcgucugcuguu

SEQ ID NO: 2676994 - RNA, 13 nt, Escherichia coli CFT073
ucacgaugccgcc

SEQ ID NO: 2676995 - RNA, 17 nt, Escherichia coli CFT073
ucacgauuguuaaucac

SEQ ID NO: 2676996 - RNA, 18 nt, Escherichia coli CFT073
ucacgauuguuaaucaca

SEQ ID NO: 2676997 - RNA, 21 nt, Escherichia coli CFT073
ucacgauuguuaaucacaucg

SEQ ID NO: 2676998 - RNA, 21 nt, Escherichia coli CFT073
ucacgauuugcguaaaaccug

SEQ ID NO: 2676999 - RNA, 19 nt, Escherichia coli CFT073
ucacgcaacauuccggcgc

SEQ ID NO: 2677000 - RNA, 21 nt, Escherichia coli CFT073
ucacgcaaggcacaaagucgc

SEQ ID NO: 2677001 - RNA, 15 nt, Escherichia coli CFT073
ucacgcaauugcugc

SEQ ID NO: 2677002 - RNA, 22 nt, Escherichia coli CFT073
ucacgcaccauaauauaaggau

SEQ ID NO: 2677003 - RNA, 17 nt, Escherichia coli CFT073
ucacgcacucgacgcag

SEQ ID NO: 2677004 - RNA, 13 nt, Escherichia coli CFT073
ucacgcacuuccg

SEQ ID NO: 2677005 - RNA, 14 nt, Escherichia coli CFT073
ucacgcagcagggc

SEQ ID NO: 2677006 - RNA, 18 nt, Escherichia coli CFT073
ucacgcagcuucucguga

SEQ ID NO: 2677007 - RNA, 17 nt, Escherichia coli CFT073
ucacgcagguuggaaua

SEQ ID NO: 2677008 - RNA, 15 nt, Escherichia coli CFT073
ucacgcagugcugca

SEQ ID NO: 2677009 - RNA, 13 nt, Escherichia coli CFT073
ucacgcaucugcu

SEQ ID NO: 2677010 - RNA, 22 nt, Escherichia coli CFT073
ucacgcauuuacacucgccccu

SEQ ID NO: 2677011 - RNA, 20 nt, Escherichia coli CFT073
ucacgcauuugcagcaaaua

SEQ ID NO: 2677012 - RNA, 21 nt, Escherichia coli CFT073
ucacgcauuugcagcaaauag

SEQ ID NO: 2677013 - RNA, 12 nt, Escherichia coli CFT073
ucacgccagcgu

SEQ ID NO: 2677014 - RNA, 13 nt, Escherichia coli CFT073
ucacgcccagucc

SEQ ID NO: 2677015 - RNA, 18 nt, Escherichia coli CFT073
ucacgcccauaacgcgcg

SEQ ID NO: 2677016 - RNA, 14 nt, Escherichia coli CFT073
ucacgccccaaugc

SEQ ID NO: 2677017 - RNA, 19 nt, Escherichia coli CFT073
ucacgccccaaugcgcgcc

SEQ ID NO: 2677018 - RNA, 12 nt, Escherichia coli CFT073
ucacgcccgcgu

SEQ ID NO: 2677019 - RNA, 17 nt, Escherichia coli CFT073
ucacgccgaagugcgca

SEQ ID NO: 2677020 - RNA, 14 nt, Escherichia coli CFT073
ucacgccgaccaga

SEQ ID NO: 2677021 - RNA, 14 nt, Escherichia coli CFT073
ucacgccgcaucag

SEQ ID NO: 2677022 - RNA, 21 nt, Escherichia coli CFT073
ucacgccgcauccggcauaaa

SEQ ID NO: 2677023 - RNA, 20 nt, Escherichia coli CFT073
ucacgccgcauccggccauc

SEQ ID NO: 2677024 - RNA, 23 nt, Escherichia coli CFT073
ucacgccgcauccggccaucagu

SEQ ID NO: 2677025 - RNA, 15 nt, Escherichia coli CFT073
ucacgccgcuggcau

SEQ ID NO: 2677026 - RNA, 19 nt, Escherichia coli CFT073
ucacgcgauuuuucaucga

SEQ ID NO: 2677027 - RNA, 17 nt, Escherichia coli CFT073
ucacgcugacaacuccu

SEQ ID NO: 2677028 - RNA, 23 nt, Escherichia coli CFT073
ucacgcugccaauaaugcccgca

SEQ ID NO: 2677029 - RNA, 13 nt, Escherichia coli CFT073
ucacgcuggcaga

SEQ ID NO: 2677030 - RNA, 15 nt, Escherichia coli CFT073
ucacgcugucggcac

SEQ ID NO: 2677031 - RNA, 23 nt, Escherichia coli CFT073
ucacgcuuaucgcccugaauuuc

SEQ ID NO: 2677032 - RNA, 15 nt, Escherichia coli CFT073
ucacggcaccagcca

SEQ ID NO: 2677033 - RNA, 22 nt, Escherichia coli CFT073
ucacggcgaaagcgucagcuuu

SEQ ID NO: 2677034 - RNA, 14 nt, Escherichia coli CFT073
ucacggcggcagua

SEQ ID NO: 2677035 - RNA, 17 nt, Escherichia coli CFT073
ucacggcuguagccagc

SEQ ID NO: 2677036 - RNA, 20 nt, Escherichia coli CFT073
ucacggcuguagccagcucg

SEQ ID NO: 2677037 - RNA, 15 nt, Escherichia coli CFT073
ucacgggcaaccaca

SEQ ID NO: 2677038 - RNA, 12 nt, Escherichia coli CFT073
ucacguagccac

SEQ ID NO: 2677039 - RNA, 14 nt, Escherichia coli CFT073
ucacguagccacgg

SEQ ID NO: 2677040 - RNA, 21 nt, Escherichia coli CFT073
ucacgucauauucgccaucag

SEQ ID NO: 2677041 - RNA, 20 nt, Escherichia coli CFT073
ucacguccggcagcagaaag

SEQ ID NO: 2677042 - RNA, 13 nt, Escherichia coli CFT073
ucacgucgcccac

SEQ ID NO: 2677043 - RNA, 16 nt, Escherichia coli CFT073
ucacguugacgcauac

SEQ ID NO: 2677044 - RNA, 13 nt, Escherichia coli CFT073
ucacguuuuccuu

SEQ ID NO: 2677045 - RNA, 16 nt, Escherichia coli CFT073
ucacguuuuccuucaa

SEQ ID NO: 2677046 - RNA, 15 nt, Escherichia coli CFT073
ucacuaaauucagcu

SEQ ID NO: 2677047 - RNA, 19 nt, Escherichia coli CFT073
ucacuaaggguaaaacgac

SEQ ID NO: 2677048 - RNA, 13 nt, Escherichia coli CFT073
ucacuacaaucag

SEQ ID NO: 2677049 - RNA, 23 nt, Escherichia coli CFT073
ucacuacguagucuuuaccgcug

SEQ ID NO: 2677050 - RNA, 14 nt, Escherichia coli CFT073
ucacuauuaaagaa

SEQ ID NO: 2677051 - RNA, 13 nt, Escherichia coli CFT073
ucacuauucagau

SEQ ID NO: 2677052 - RNA, 14 nt, Escherichia coli CFT073
ucacucacgcugcg

SEQ ID NO: 2677053 - RNA, 13 nt, Escherichia coli CFT073
ucacuccagucca

SEQ ID NO: 2677054 - RNA, 19 nt, Escherichia coli CFT073
ucacuccccgcaacaguga

SEQ ID NO: 2677055 - RNA, 18 nt, Escherichia coli CFT073
ucacucggggcuuuucuc

SEQ ID NO: 2677056 - RNA, 19 nt, Escherichia coli CFT073
ucacucuguuuuaacgcag

SEQ ID NO: 2677057 - RNA, 16 nt, Escherichia coli CFT073
ucacugacaccagcau

SEQ ID NO: 2677058 - RNA, 17 nt, Escherichia coli CFT073
ucacugacgacuucagu

SEQ ID NO: 2677059 - RNA, 21 nt, Escherichia coli CFT073
ucacugcaaauacccaaaaaa

SEQ ID NO: 2677060 - RNA, 21 nt, Escherichia coli CFT073
ucacugccagaauagccgcag

SEQ ID NO: 2677061 - RNA, 20 nt, Escherichia coli CFT073
ucacugccagcaucagaccc

SEQ ID NO: 2677062 - RNA, 21 nt, Escherichia coli CFT073
ucacugcgguguaaaccagcu

SEQ ID NO: 2677063 - RNA, 14 nt, Escherichia coli CFT073
ucacuggcgucaca

SEQ ID NO: 2677064 - RNA, 14 nt, Escherichia coli CFT073
ucacuggcgucaug

SEQ ID NO: 2677065 - RNA, 20 nt, Escherichia coli CFT073
ucacuggcgucauggcgcuc

SEQ ID NO: 2677066 - RNA, 22 nt, Escherichia coli CFT073
ucacugggcgauuaauaaaauu

SEQ ID NO: 2677067 - RNA, 15 nt, Escherichia coli CFT073
ucacuguccgccaga

SEQ ID NO: 2677068 - RNA, 16 nt, Escherichia coli CFT073
ucacuguucgccgcag

SEQ ID NO: 2677069 - RNA, 19 nt, Escherichia coli CFT073
ucacuuacgauuuuaauag

SEQ ID NO: 2677070 - RNA, 21 nt, Escherichia coli CFT073
ucacuuacgauuuuaauagcu

SEQ ID NO: 2677071 - RNA, 23 nt, Escherichia coli CFT073
ucacuucaucccugaaaugugcg

SEQ ID NO: 2677072 - RNA, 16 nt, Escherichia coli CFT073
ucacuuccggcaaggc

SEQ ID NO: 2677073 - RNA, 14 nt, Escherichia coli CFT073
ucacuuccugaucc

SEQ ID NO: 2677074 - RNA, 16 nt, Escherichia coli CFT073
ucacuuccuucgccgc

SEQ ID NO: 2677075 - RNA, 23 nt, Escherichia coli CFT073
ucacuucugaguucggcaugggg

SEQ ID NO: 2677076 - RNA, 20 nt, Escherichia coli CFT073
ucacuucuggagguuuuaug

SEQ ID NO: 2677077 - RNA, 16 nt, Escherichia coli CFT073
ucacuugccugcugug

SEQ ID NO: 2677078 - RNA, 18 nt, Escherichia coli CFT073
ucacuuuaccuuuaaacu

SEQ ID NO: 2677079 - RNA, 16 nt, Escherichia coli CFT073
ucacuuuccaguucaa

SEQ ID NO: 2677080 - RNA, 11 nt, Escherichia coli CFT073
ucacuuucgcc

SEQ ID NO: 2677081 - RNA, 12 nt, Escherichia coli CFT073
ucacuuucgcca

SEQ ID NO: 2677082 - RNA, 17 nt, Escherichia coli CFT073
ucacuuucgccaguucu

SEQ ID NO: 2677083 - RNA, 23 nt, Escherichia coli CFT073
ucacuuucugaccaugcauauaa

SEQ ID NO: 2677084 - RNA, 17 nt, Escherichia coli CFT073
ucacuuugauuuauagu

SEQ ID NO: 2677085 - RNA, 15 nt, Escherichia coli CFT073
ucacuuugcagaaaa

SEQ ID NO: 2677086 - RNA, 13 nt, Escherichia coli CFT073
ucacuuugcuguc

SEQ ID NO: 2677087 - RNA, 16 nt, Escherichia coli CFT073
ucacuuugcugucgau

SEQ ID NO: 2677088 - RNA, 16 nt, Escherichia coli CFT073
ucacuuuguaggccug

SEQ ID NO: 2677089 - RNA, 22 nt, Escherichia coli CFT073
ucacuuuguaggccugauaaga

SEQ ID NO: 2677090 - RNA, 20 nt, Escherichia coli CFT073
ucacuuuguuccugaauuaa

SEQ ID NO: 2677091 - RNA, 22 nt, Escherichia coli CFT073
ucacuuuuauauaaugaaaacu

SEQ ID NO: 2677092 - RNA, 11 nt, Escherichia coli CFT073
ucacuuuuccg

SEQ ID NO: 2677093 - RNA, 14 nt, Escherichia coli CFT073
ucacuuuuuuuccg

SEQ ID NO: 2677094 - RNA, 14 nt, Escherichia coli CFT073
ucagaaacgcucau

SEQ ID NO: 2677095 - RNA, 13 nt, Escherichia coli CFT073
ucagaaagaaauu

SEQ ID NO: 2677096 - RNA, 15 nt, Escherichia coli CFT073
ucagaaagaaauuuc

SEQ ID NO: 2677097 - RNA, 18 nt, Escherichia coli CFT073
ucagaaagcgccagcaag

SEQ ID NO: 2677098 - RNA, 19 nt, Escherichia coli CFT073
ucagaaaggcguuguccuu

SEQ ID NO: 2677099 - RNA, 17 nt, Escherichia coli CFT073
ucagaaaguaauaugug

SEQ ID NO: 2677100 - RNA, 16 nt, Escherichia coli CFT073
ucagaaagugccacgc

SEQ ID NO: 2677101 - RNA, 17 nt, Escherichia coli CFT073
ucagaaauaaucaccug

SEQ ID NO: 2677102 - RNA, 18 nt, Escherichia coli CFT073
ucagaacacuucuucugu

SEQ ID NO: 2677103 - RNA, 13 nt, Escherichia coli CFT073
ucagaacuucgcu

SEQ ID NO: 2677104 - RNA, 15 nt, Escherichia coli CFT073
ucagaaguugcaccc

SEQ ID NO: 2677105 - RNA, 16 nt, Escherichia coli CFT073
ucagaauaucgccaag

SEQ ID NO: 2677106 - RNA, 21 nt, Escherichia coli CFT073
ucagaaucacgccaacaaaua

SEQ ID NO: 2677107 - RNA, 16 nt, Escherichia coli CFT073
ucagaaucgcgcccca

SEQ ID NO: 2677108 - RNA, 23 nt, Escherichia coli CFT073
ucagaaugcagaauccggcgcuc

SEQ ID NO: 2677109 - RNA, 17 nt, Escherichia coli CFT073
ucagacacgccgccaga

SEQ ID NO: 2677110 - RNA, 17 nt, Escherichia coli CFT073
ucagaccaaaaccacau

SEQ ID NO: 2677111 - RNA, 17 nt, Escherichia coli CFT073
ucagaccaaaacgcgcc

SEQ ID NO: 2677112 - RNA, 16 nt, Escherichia coli CFT073
ucagacccagaaccau

SEQ ID NO: 2677113 - RNA, 19 nt, Escherichia coli CFT073
ucagaccggcaaccagcac

SEQ ID NO: 2677114 - RNA, 12 nt, Escherichia coli CFT073
ucagaccuccgu

SEQ ID NO: 2677115 - RNA, 18 nt, Escherichia coli CFT073
ucagacgacugucuuccu

SEQ ID NO: 2677116 - RNA, 19 nt, Escherichia coli CFT073
ucagacgacugucuuccug

SEQ ID NO: 2677117 - RNA, 18 nt, Escherichia coli CFT073
ucagacgcaggcgcgcug

SEQ ID NO: 2677118 - RNA, 15 nt, Escherichia coli CFT073
ucagacgcucugguu

SEQ ID NO: 2677119 - RNA, 21 nt, Escherichia coli CFT073
ucagacgcucuuucaccagug

SEQ ID NO: 2677120 - RNA, 22 nt, Escherichia coli CFT073
ucagacggccccgcgccagcgg

SEQ ID NO: 2677121 - RNA, 16 nt, Escherichia coli CFT073
ucagacgguccgcgag

SEQ ID NO: 2677122 - RNA, 20 nt, Escherichia coli CFT073
ucagacucauuaaaacggau

SEQ ID NO: 2677123 - RNA, 17 nt, Escherichia coli CFT073
ucagacugcuuuucccu

SEQ ID NO: 2677124 - RNA, 22 nt, Escherichia coli CFT073
ucagacuggcguuaggcacauc

SEQ ID NO: 2677125 - RNA, 17 nt, Escherichia coli CFT073
ucagagaaucaugucag

SEQ ID NO: 2677126 - RNA, 22 nt, Escherichia coli CFT073
ucagagagccagccccacagca

SEQ ID NO: 2677127 - RNA, 21 nt, Escherichia coli CFT073
ucagagccugccaauggcagg

SEQ ID NO: 2677128 - RNA, 22 nt, Escherichia coli CFT073
ucagagccugccaauggcagga

SEQ ID NO: 2677129 - RNA, 14 nt, Escherichia coli CFT073
ucagaguacagauu

SEQ ID NO: 2677130 - RNA, 16 nt, Escherichia coli CFT073
ucagaguugcaccagc

SEQ ID NO: 2677131 - RNA, 16 nt, Escherichia coli CFT073
ucagaguuugccacca

SEQ ID NO: 2677132 - RNA, 18 nt, Escherichia coli CFT073
ucagauaccaauuuauuu

SEQ ID NO: 2677133 - RNA, 14 nt, Escherichia coli CFT073
ucagauauaaacgg

SEQ ID NO: 2677134 - RNA, 21 nt, Escherichia coli CFT073
ucagauauacguucgcccauc

SEQ ID NO: 2677135 - RNA, 15 nt, Escherichia coli CFT073
ucagaucacgcauca

SEQ ID NO: 2677136 - RNA, 19 nt, Escherichia coli CFT073
ucagaucacgcaucacccg

SEQ ID NO: 2677137 - RNA, 17 nt, Escherichia coli CFT073
ucagaucagccacuucc

SEQ ID NO: 2677138 - RNA, 20 nt, Escherichia coli CFT073
ucagaucagccacuuccugc

SEQ ID NO: 2677139 - RNA, 17 nt, Escherichia coli CFT073
ucagauccagugcuuua

SEQ ID NO: 2677140 - RNA, 21 nt, Escherichia coli CFT073
ucagaucgaaaucuuuuuacu

SEQ ID NO: 2677141 - RNA, 22 nt, Escherichia coli CFT073
ucagaucgccccggucaucaaa

SEQ ID NO: 2677142 - RNA, 18 nt, Escherichia coli CFT073
ucagaucgcgaccgccuu

SEQ ID NO: 2677143 - RNA, 19 nt, Escherichia coli CFT073
ucagaucgguuuuuuucga

SEQ ID NO: 2677144 - RNA, 22 nt, Escherichia coli CFT073
ucagaucguucgcaccaaaucc

SEQ ID NO: 2677145 - RNA, 20 nt, Escherichia coli CFT073
ucagaucguugaccuggaug

SEQ ID NO: 2677146 - RNA, 23 nt, Escherichia coli CFT073
ucagaugcggcaugaacgccuga

SEQ ID NO: 2677147 - RNA, 21 nt, Escherichia coli CFT073
ucagaugcggcgugaacgccu

SEQ ID NO: 2677148 - RNA, 17 nt, Escherichia coli CFT073
ucagaugcugugcaauc

SEQ ID NO: 2677149 - RNA, 15 nt, Escherichia coli CFT073
ucagauggggauggc

SEQ ID NO: 2677150 - RNA, 18 nt, Escherichia coli CFT073
ucaguaaucgcgccagcc

SEQ ID NO: 2677151 - RNA, 15 nt, Escherichia coli CFT073
ucaguaccagcaccu

SEQ ID NO: 2677152 - RNA, 16 nt, Escherichia coli CFT073
ucaguaccagcccgcc

SEQ ID NO: 2677153 - RNA, 18 nt, Escherichia coli CFT073
ucaguacguuaucaccga

SEQ ID NO: 2677154 - RNA, 15 nt, Escherichia coli CFT073
ucaguagaauaaucu

SEQ ID NO: 2677155 - RNA, 15 nt, Escherichia coli CFT073
ucaguagcaguaauu

SEQ ID NO: 2677156 - RNA, 16 nt, Escherichia coli CFT073
ucaguagcaugaacau

SEQ ID NO: 2677157 - RNA, 22 nt, Escherichia coli CFT073
ucaguagcgcaauaaccaccac

SEQ ID NO: 2677158 - RNA, 16 nt, Escherichia coli CFT073
ucaguauuuucccuga

SEQ ID NO: 2677159 - RNA, 12 nt, Escherichia coli CFT073
ucagucagcagu

SEQ ID NO: 2677160 - RNA, 13 nt, Escherichia coli CFT073
ucagucagcagug

SEQ ID NO: 2677161 - RNA, 18 nt, Escherichia coli CFT073
ucagucgguucaaccauc

SEQ ID NO: 2677162 - RNA, 20 nt, Escherichia coli CFT073
ucagucgguucaaccaucag

SEQ ID NO: 2677163 - RNA, 17 nt, Escherichia coli CFT073
ucagucuuaagcggcua

SEQ ID NO: 2677164 - RNA, 17 nt, Escherichia coli CFT073
ucagugaaucucaggca

SEQ ID NO: 2677165 - RNA, 21 nt, Escherichia coli CFT073
ucagugaaucucaggcaaaua

SEQ ID NO: 2677166 - RNA, 15 nt, Escherichia coli CFT073
ucagugaccgaaccu

SEQ ID NO: 2677167 - RNA, 11 nt, Escherichia coli CFT073
ucagugcugac

SEQ ID NO: 2677168 - RNA, 21 nt, Escherichia coli CFT073
ucaguggguuaugaaacucca

SEQ ID NO: 2677169 - RNA, 19 nt, Escherichia coli CFT073
ucaguguccagaugcugua

SEQ ID NO: 2677170 - RNA, 23 nt, Escherichia coli CFT073
ucaguguguuauugccuggcaug

SEQ ID NO: 2677171 - RNA, 17 nt, Escherichia coli CFT073
ucaguuaacaauaacaa

SEQ ID NO: 2677172 - RNA, 15 nt, Escherichia coli CFT073
ucaguuacucugcaa

SEQ ID NO: 2677173 - RNA, 21 nt, Escherichia coli CFT073
ucaguuauugacgccguaaac

SEQ ID NO: 2677174 - RNA, 14 nt, Escherichia coli CFT073
ucaguucagcugcc

SEQ ID NO: 2677175 - RNA, 20 nt, Escherichia coli CFT073
ucaguucaucuacuacugga

SEQ ID NO: 2677176 - RNA, 20 nt, Escherichia coli CFT073
ucaguucgcuuaacaguucc

SEQ ID NO: 2677177 - RNA, 13 nt, Escherichia coli CFT073
ucaguucuuucag

SEQ ID NO: 2677178 - RNA, 17 nt, Escherichia coli CFT073
ucaguugcaccugaucc

SEQ ID NO: 2677179 - RNA, 21 nt, Escherichia coli CFT073
ucaguugcaccugauccagcu

SEQ ID NO: 2677180 - RNA, 17 nt, Escherichia coli CFT073
ucaguugccgaauaccg

SEQ ID NO: 2677181 - RNA, 17 nt, Escherichia coli CFT073
ucaguugguagagcacg

SEQ ID NO: 2677182 - RNA, 12 nt, Escherichia coli CFT073
ucaguuguuccg

SEQ ID NO: 2677183 - RNA, 15 nt, Escherichia coli CFT073
ucaguuuaucaaucu

SEQ ID NO: 2677184 - RNA, 13 nt, Escherichia coli CFT073
ucaguuuccagca

SEQ ID NO: 2677185 - RNA, 17 nt, Escherichia coli CFT073
ucaguuucgaucagcaa

SEQ ID NO: 2677186 - RNA, 13 nt, Escherichia coli CFT073
ucaguuugcccca

SEQ ID NO: 2677187 - RNA, 15 nt, Escherichia coli CFT073
ucaguuugccgcuca

SEQ ID NO: 2677188 - RNA, 15 nt, Escherichia coli CFT073
ucaguuugcgggaca

SEQ ID NO: 2677189 - RNA, 21 nt, Escherichia coli CFT073
ucauaaacacgguuuuucauu

SEQ ID NO: 2677190 - RNA, 14 nt, Escherichia coli CFT073
ucauaaauacagag

SEQ ID NO: 2677191 - RNA, 16 nt, Escherichia coli CFT073
ucauaaauuaccacca

SEQ ID NO: 2677192 - RNA, 15 nt, Escherichia coli CFT073
ucauaaccaaugugg

SEQ ID NO: 2677193 - RNA, 17 nt, Escherichia coli CFT073
ucauaaccuguuccuua

SEQ ID NO: 2677194 - RNA, 23 nt, Escherichia coli CFT073
ucauaagcgauaccgguacggaa

SEQ ID NO: 2677195 - RNA, 13 nt, Escherichia coli CFT073
ucauaauaugacc

SEQ ID NO: 2677196 - RNA, 17 nt, Escherichia coli CFT073
ucauaauaugaccugac

SEQ ID NO: 2677197 - RNA, 23 nt, Escherichia coli CFT073
ucauaaugauggggucacagguu

SEQ ID NO: 2677198 - RNA, 18 nt, Escherichia coli CFT073
ucauaauuauaauaaaua

SEQ ID NO: 2677199 - RNA, 17 nt, Escherichia coli CFT073
ucauacggcccuucgau

SEQ ID NO: 2677200 - RNA, 14 nt, Escherichia coli CFT073
ucauacucccagcg

SEQ ID NO: 2677201 - RNA, 19 nt, Escherichia coli CFT073
ucauacugagcaaggcaua

SEQ ID NO: 2677202 - RNA, 13 nt, Escherichia coli CFT073
ucauagaccauug

SEQ ID NO: 2677203 - RNA, 19 nt, Escherichia coli CFT073
ucauagcaauaaaugccug

SEQ ID NO: 2677204 - RNA, 15 nt, Escherichia coli CFT073
ucauagcacauccug

SEQ ID NO: 2677205 - RNA, 16 nt, Escherichia coli CFT073
ucauagcacauccuga

SEQ ID NO: 2677206 - RNA, 21 nt, Escherichia coli CFT073
ucauagccucugccccgccaa

SEQ ID NO: 2677207 - RNA, 19 nt, Escherichia coli CFT073
ucauagcgacuaccacgua

SEQ ID NO: 2677208 - RNA, 16 nt, Escherichia coli CFT073
ucauagcggcaacaau

SEQ ID NO: 2677209 - RNA, 18 nt, Escherichia coli CFT073
ucauaggucauuggcgua

SEQ ID NO: 2677210 - RNA, 16 nt, Escherichia coli CFT073
ucauagucucgcccac

SEQ ID NO: 2677211 - RNA, 15 nt, Escherichia coli CFT073
ucauaguuuuaccuu

SEQ ID NO: 2677212 - RNA, 18 nt, Escherichia coli CFT073
ucauauaauguaucugaa

SEQ ID NO: 2677213 - RNA, 18 nt, Escherichia coli CFT073
ucauauacccugccagaa

SEQ ID NO: 2677214 - RNA, 15 nt, Escherichia coli CFT073
ucauauaucccuucc

SEQ ID NO: 2677215 - RNA, 13 nt, Escherichia coli CFT073
ucauaucaucauc

SEQ ID NO: 2677216 - RNA, 16 nt, Escherichia coli CFT073
ucauaucguagacaac

SEQ ID NO: 2677217 - RNA, 20 nt, Escherichia coli CFT073
ucauaugcuuuuuuaaaaac

SEQ ID NO: 2677218 - RNA, 15 nt, Escherichia coli CFT073
ucauauggaagaaac

SEQ ID NO: 2677219 - RNA, 18 nt, Escherichia coli CFT073
ucauauugccgugcccca

SEQ ID NO: 2677220 - RNA, 22 nt, Escherichia coli CFT073
ucauauugccgugccccauaug

SEQ ID NO: 2677221 - RNA, 13 nt, Escherichia coli CFT073
ucauauuuuuucc

SEQ ID NO: 2677222 - RNA, 14 nt, Escherichia coli CFT073
ucauauuuuuuccc

SEQ ID NO: 2677223 - RNA, 17 nt, Escherichia coli CFT073
ucaucaaaaucaucauu

SEQ ID NO: 2677224 - RNA, 23 nt, Escherichia coli CFT073
ucaucaaacaacggcacuucaau

SEQ ID NO: 2677225 - RNA, 13 nt, Escherichia coli CFT073
ucaucaaagccaa

SEQ ID NO: 2677226 - RNA, 22 nt, Escherichia coli CFT073
ucaucaacguuaauacuacgca

SEQ ID NO: 2677227 - RNA, 18 nt, Escherichia coli CFT073
ucaucaagcugugccuga

SEQ ID NO: 2677228 - RNA, 21 nt, Escherichia coli CFT073
ucaucaaguuacgauaaucag

SEQ ID NO: 2677229 - RNA, 20 nt, Escherichia coli CFT073
ucaucaauccugcagcaggu

SEQ ID NO: 2677230 - RNA, 16 nt, Escherichia coli CFT073
ucaucaaugccagcau

SEQ ID NO: 2677231 - RNA, 16 nt, Escherichia coli CFT073
ucaucaauuaaugccu

SEQ ID NO: 2677232 - RNA, 21 nt, Escherichia coli CFT073
ucaucaauugcgcaccagcuu

SEQ ID NO: 2677233 - RNA, 22 nt, Escherichia coli CFT073
ucaucacaaaauuuauccagcg

SEQ ID NO: 2677234 - RNA, 16 nt, Escherichia coli CFT073
ucaucacaucccagca

SEQ ID NO: 2677235 - RNA, 17 nt, Escherichia coli CFT073
ucaucacaucccagcag

SEQ ID NO: 2677236 - RNA, 21 nt, Escherichia coli CFT073
ucaucaccugcgcuggcaggc

SEQ ID NO: 2677237 - RNA, 20 nt, Escherichia coli CFT073
ucaucaccuugcucgaucag

SEQ ID NO: 2677238 - RNA, 16 nt, Escherichia coli CFT073
ucaucacgacauaauu

SEQ ID NO: 2677239 - RNA, 22 nt, Escherichia coli CFT073
ucaucacgcacugcaauauuau

SEQ ID NO: 2677240 - RNA, 17 nt, Escherichia coli CFT073
ucaucacgcaggcugua

SEQ ID NO: 2677241 - RNA, 21 nt, Escherichia coli CFT073
ucaucacgcgguuacgcaccg

SEQ ID NO: 2677242 - RNA, 23 nt, Escherichia coli CFT073
ucaucacuccccgcaacagugaa

SEQ ID NO: 2677243 - RNA, 15 nt, Escherichia coli CFT073
ucaucacuuuuuccg

SEQ ID NO: 2677244 - RNA, 15 nt, Escherichia coli CFT073
ucaucagaagggaau

SEQ ID NO: 2677245 - RNA, 15 nt, Escherichia coli CFT073
ucaucagcgccaacc

SEQ ID NO: 2677246 - RNA, 16 nt, Escherichia coli CFT073
ucaucagcguuuccgc

SEQ ID NO: 2677247 - RNA, 17 nt, Escherichia coli CFT073
ucaucaggccugcauac

SEQ ID NO: 2677248 - RNA, 22 nt, Escherichia coli CFT073
ucaucagguauugcuaagcucu

SEQ ID NO: 2677249 - RNA, 15 nt, Escherichia coli CFT073
ucaucaguaccaguc

SEQ ID NO: 2677250 - RNA, 17 nt, Escherichia coli CFT073
ucaucaguacgccuuua

SEQ ID NO: 2677251 - RNA, 18 nt, Escherichia coli CFT073
ucaucagucuuaagcggc

SEQ ID NO: 2677252 - RNA, 14 nt, Escherichia coli CFT073
ucaucauauugucu

SEQ ID NO: 2677253 - RNA, 11 nt, Escherichia coli CFT073
ucaucaucagg

SEQ ID NO: 2677254 - RNA, 15 nt, Escherichia coli CFT073
ucaucaucauuaacu

SEQ ID NO: 2677255 - RNA, 13 nt, Escherichia coli CFT073
ucaucauccagca

SEQ ID NO: 2677256 - RNA, 14 nt, Escherichia coli CFT073
ucaucauccagcac

SEQ ID NO: 2677257 - RNA, 22 nt, Escherichia coli CFT073
ucaucaucgcagauuucuucug

SEQ ID NO: 2677258 - RNA, 23 nt, Escherichia coli CFT073
ucaucaucggcaccgccagcagg

SEQ ID NO: 2677259 - RNA, 14 nt, Escherichia coli CFT073
ucauguuuauucac

SEQ ID NO: 2677260 - RNA, 17 nt, Escherichia coli CFT073
ucauguuuuucaccuug

SEQ ID NO: 2677261 - RNA, 18 nt, Escherichia coli CFT073
ucauuaaaccaucagcca

SEQ ID NO: 2677262 - RNA, 16 nt, Escherichia coli CFT073
ucauuaaaugcguagg

SEQ ID NO: 2677263 - RNA, 19 nt, Escherichia coli CFT073
ucauuaacccguuuacaua

SEQ ID NO: 2677264 - RNA, 16 nt, Escherichia coli CFT073
ucauuaacgcagaauc

SEQ ID NO: 2677265 - RNA, 23 nt, Escherichia coli CFT073
ucauuaacgcagaaucuucuucu

SEQ ID NO: 2677266 - RNA, 20 nt, Escherichia coli CFT073
ucauuaacgccccaaucaga

SEQ ID NO: 2677267 - RNA, 16 nt, Escherichia coli CFT073
ucauuaagaacuccug

SEQ ID NO: 2677268 - RNA, 19 nt, Escherichia coli CFT073
ucauuaagaacuccugaaa

SEQ ID NO: 2677269 - RNA, 11 nt, Escherichia coli CFT073
ucauuaauaac

SEQ ID NO: 2677270 - RNA, 15 nt, Escherichia coli CFT073
ucauuaauaaccauu

SEQ ID NO: 2677271 - RNA, 17 nt, Escherichia coli CFT073
ucauuaaucaccaguca

SEQ ID NO: 2677272 - RNA, 14 nt, Escherichia coli CFT073
ucauuaauguaugu

SEQ ID NO: 2677273 - RNA, 16 nt, Escherichia coli CFT073
ucauuaauuucaggcu

SEQ ID NO: 2677274 - RNA, 13 nt, Escherichia coli CFT073
ucauuacaacgca

SEQ ID NO: 2677275 - RNA, 16 nt, Escherichia coli CFT073
ucauuaccacaacaaa

SEQ ID NO: 2677276 - RNA, 18 nt, Escherichia coli CFT073
ucauuaccggcacuggaa

SEQ ID NO: 2677277 - RNA, 12 nt, Escherichia coli CFT073
ucauuaccuuca

SEQ ID NO: 2677278 - RNA, 13 nt, Escherichia coli CFT073
ucauuaccuucaa

SEQ ID NO: 2677279 - RNA, 19 nt, Escherichia coli CFT073
ucauuacgaaguuuaauuc

SEQ ID NO: 2677280 - RNA, 13 nt, Escherichia coli CFT073
ucauuacucaucc

SEQ ID NO: 2677281 - RNA, 16 nt, Escherichia coli CFT073
ucauuaguuaauucau

SEQ ID NO: 2677282 - RNA, 22 nt, Escherichia coli CFT073
ucauuaugagugaugugcucua

SEQ ID NO: 2677283 - RNA, 16 nt, Escherichia coli CFT073
ucauuauuaauauuca

SEQ ID NO: 2677284 - RNA, 13 nt, Escherichia coli CFT073
ucauuauuaauuu

SEQ ID NO: 2677285 - RNA, 21 nt, Escherichia coli CFT073
ucauuauucauuguucuccca

SEQ ID NO: 2677286 - RNA, 15 nt, Escherichia coli CFT073
ucauuauucauuuuu

SEQ ID NO: 2677287 - RNA, 18 nt, Escherichia coli CFT073
ucauuauucccccggcuu

SEQ ID NO: 2677288 - RNA, 20 nt, Escherichia coli CFT073
ucauuauucccccggcuuca

SEQ ID NO: 2677289 - RNA, 18 nt, Escherichia coli CFT073
ucauucaacuuaagucuc

SEQ ID NO: 2677290 - RNA, 22 nt, Escherichia coli CFT073
ucauucaggccaaagccgccga

SEQ ID NO: 2677291 - RNA, 18 nt, Escherichia coli CFT073
ucauucagguauuguguu

SEQ ID NO: 2677292 - RNA, 21 nt, Escherichia coli CFT073
ucauucccauaccuuucgcaa

SEQ ID NO: 2677293 - RNA, 23 nt, Escherichia coli CFT073
ucauuccguagcguuuuuucauu

SEQ ID NO: 2677294 - RNA, 18 nt, Escherichia coli CFT073
ucauuccuuaugcugcuu

SEQ ID NO: 2677295 - RNA, 21 nt, Escherichia coli CFT073
ucauucgacgcgcgcacacaa

SEQ ID NO: 2677296 - RNA, 20 nt, Escherichia coli CFT073
ucauucugcaaggcaaaaua

SEQ ID NO: 2677297 - RNA, 22 nt, Escherichia coli CFT073
ucauugaagcgccguccaguaa

SEQ ID NO: 2677298 - RNA, 14 nt, Escherichia coli CFT073
ucauugacgccaag

SEQ ID NO: 2677299 - RNA, 18 nt, Escherichia coli CFT073
ucauugauauagcgaucu

SEQ ID NO: 2677300 - RNA, 21 nt, Escherichia coli CFT073
ucauugaugcugccaucaucu

SEQ ID NO: 2677301 - RNA, 12 nt, Escherichia coli CFT073
ucauugauuuuc

SEQ ID NO: 2677302 - RNA, 19 nt, Escherichia coli CFT073
ucauugccagcccuaaaaa

SEQ ID NO: 2677303 - RNA, 15 nt, Escherichia coli CFT073
ucauugcguaaccaa

SEQ ID NO: 2677304 - RNA, 15 nt, Escherichia coli CFT073
ucauuguaaauaauu

SEQ ID NO: 2677305 - RNA, 22 nt, Escherichia coli CFT073
ucauuguguacauccuaaaggc

SEQ ID NO: 2677306 - RNA, 16 nt, Escherichia coli CFT073
ucauuguuauaauguu

SEQ ID NO: 2677307 - RNA, 23 nt, Escherichia coli CFT073
ucauuguugguuaaauaauauuu

SEQ ID NO: 2677308 - RNA, 14 nt, Escherichia coli CFT073
ucauuuaagccacu

SEQ ID NO: 2677309 - RNA, 23 nt, Escherichia coli CFT073
ucauuuacaucacgcagcugcgc

SEQ ID NO: 2677310 - RNA, 12 nt, Escherichia coli CFT073
ucauuucauuug

SEQ ID NO: 2677311 - RNA, 21 nt, Escherichia coli CFT073
ucauuucauuuggauggaaaa

SEQ ID NO: 2677312 - RNA, 18 nt, Escherichia coli CFT073
ucauuucgucgaacucau

SEQ ID NO: 2677313 - RNA, 20 nt, Escherichia coli CFT073
ucauuugcaccaggccgcgc

SEQ ID NO: 2677314 - RNA, 17 nt, Escherichia coli CFT073
ucauuuggucggagauu

SEQ ID NO: 2677315 - RNA, 23 nt, Escherichia coli CFT073
ucauuuggucggagauuugaaug

SEQ ID NO: 2677316 - RNA, 12 nt, Escherichia coli CFT073
ucauuuucaggg

SEQ ID NO: 2677317 - RNA, 14 nt, Escherichia coli CFT073
ucauuuucaugcug

SEQ ID NO: 2677318 - RNA, 21 nt, Escherichia coli CFT073
ucauuuucuucagcaguucag

SEQ ID NO: 2677319 - RNA, 16 nt, Escherichia coli CFT073
ucauuuuguaggccug

SEQ ID NO: 2677320 - RNA, 22 nt, Escherichia coli CFT073
ucauuuuguaggccugauaaga

SEQ ID NO: 2677321 - RNA, 19 nt, Escherichia coli CFT073
ucauuuuguaugcggcgaa

SEQ ID NO: 2677322 - RNA, 22 nt, Escherichia coli CFT073
ucauuuugucgacaucaagaaa

SEQ ID NO: 2677323 - RNA, 15 nt, Escherichia coli CFT073
ucauuuuucucaacg

SEQ ID NO: 2677324 - RNA, 15 nt, Escherichia coli CFT073
uccaaaaaacaaacc

SEQ ID NO: 2677325 - RNA, 18 nt, Escherichia coli CFT073
uccaaauagcucaaugaa

SEQ ID NO: 2677326 - RNA, 19 nt, Escherichia coli CFT073
uccaaauagcucaaugaaa

SEQ ID NO: 2677327 - RNA, 19 nt, Escherichia coli CFT073
uccaacaguuccagcagcu

SEQ ID NO: 2677328 - RNA, 20 nt, Escherichia coli CFT073
uccaacauagcuaaaaauaa

SEQ ID NO: 2677329 - RNA, 23 nt, Escherichia coli CFT073
uccaacauagcuaaaaauaauca

SEQ ID NO: 2677330 - RNA, 23 nt, Escherichia coli CFT073
uccaacugauuuucaucuucuuc

SEQ ID NO: 2677331 - RNA, 16 nt, Escherichia coli CFT073
uccaauaaaucccaga

SEQ ID NO: 2677332 - RNA, 22 nt, Escherichia coli CFT073
uccaaucagcacacauaacagc

SEQ ID NO: 2677333 - RNA, 14 nt, Escherichia coli CFT073
uccaaucaggcgaa

SEQ ID NO: 2677334 - RNA, 20 nt, Escherichia coli CFT073
uccaaucaggcgaauaaauu

SEQ ID NO: 2677335 - RNA, 11 nt, Escherichia coli CFT073
uccaaugguca

SEQ ID NO: 2677336 - RNA, 11 nt, Escherichia coli CFT073
uccacaaaccg

SEQ ID NO: 2677337 - RNA, 17 nt, Escherichia coli CFT073
uccacaacgugggccag

SEQ ID NO: 2677338 - RNA, 18 nt, Escherichia coli CFT073
uccacaagaaugccugcc

SEQ ID NO: 2677339 - RNA, 22 nt, Escherichia coli CFT073
uccacaagaaugccugccagcu

SEQ ID NO: 2677340 - RNA, 17 nt, Escherichia coli CFT073
uccacaccaaaauaacg

SEQ ID NO: 2677341 - RNA, 17 nt, Escherichia coli CFT073
uccacacgcgcccagcc

SEQ ID NO: 2677342 - RNA, 18 nt, Escherichia coli CFT073
uccacacggcauaagccg

SEQ ID NO: 2677343 - RNA, 19 nt, Escherichia coli CFT073
uccacagaguguauucaug

SEQ ID NO: 2677344 - RNA, 15 nt, Escherichia coli CFT073
uccacauaaaguagc

SEQ ID NO: 2677345 - RNA, 20 nt, Escherichia coli CFT073
uccacaucaaccagaucgcu

SEQ ID NO: 2677346 - RNA, 13 nt, Escherichia coli CFT073
uccacauccagau

SEQ ID NO: 2677347 - RNA, 17 nt, Escherichia coli CFT073
uccacauccagaugucu

SEQ ID NO: 2677348 - RNA, 19 nt, Escherichia coli CFT073
uccacaucggcaucaggcc

SEQ ID NO: 2677349 - RNA, 21 nt, Escherichia coli CFT073
uccacaugguuuucaauuauc

SEQ ID NO: 2677350 - RNA, 19 nt, Escherichia coli CFT073
uccacauuuucagccaggg

SEQ ID NO: 2677351 - RNA, 17 nt, Escherichia coli CFT073
uccaccacaaaagcaaa

SEQ ID NO: 2677352 - RNA, 18 nt, Escherichia coli CFT073
uccaccaccgcaaaauag

SEQ ID NO: 2677353 - RNA, 22 nt, Escherichia coli CFT073
uccaccaccgcaaaauagguau

SEQ ID NO: 2677354 - RNA, 20 nt, Escherichia coli CFT073
uccaccacuuuaucgagaau

SEQ ID NO: 2677355 - RNA, 20 nt, Escherichia coli CFT073
uccaccagaccuuccgcagg

SEQ ID NO: 2677356 - RNA, 19 nt, Escherichia coli CFT073
uccaccagacgauggcucc

SEQ ID NO: 2677357 - RNA, 13 nt, Escherichia coli CFT073
uccaccagcgccu

SEQ ID NO: 2677358 - RNA, 13 nt, Escherichia coli CFT073
uccaccagcggcu

SEQ ID NO: 2677359 - RNA, 19 nt, Escherichia coli CFT073
uccaccauauacuccgcac

SEQ ID NO: 2677360 - RNA, 14 nt, Escherichia coli CFT073
uccacccgcagcca

SEQ ID NO: 2677361 - RNA, 20 nt, Escherichia coli CFT073
uccaccgaaagcacuguucg

SEQ ID NO: 2677362 - RNA, 23 nt, Escherichia coli CFT073
uccaccgagccaaacucauccac

SEQ ID NO: 2677363 - RNA, 18 nt, Escherichia coli CFT073
uccaccguugugaaaaua

SEQ ID NO: 2677364 - RNA, 17 nt, Escherichia coli CFT073
uccacgcccagcgcagg

SEQ ID NO: 2677365 - RNA, 23 nt, Escherichia coli CFT073
uccacgcggguuuaccacggcuu

SEQ ID NO: 2677366 - RNA, 20 nt, Escherichia coli CFT073
uccacgcuauacagcagcca

SEQ ID NO: 2677367 - RNA, 17 nt, Escherichia coli CFT073
uccaggagggguuuuug

SEQ ID NO: 2677368 - RNA, 19 nt, Escherichia coli CFT073
uccaggauuuucuacgcug

SEQ ID NO: 2677369 - RNA, 15 nt, Escherichia coli CFT073
uccaggccaaaagcu

SEQ ID NO: 2677370 - RNA, 14 nt, Escherichia coli CFT073
uccaggcuggucgc

SEQ ID NO: 2677371 - RNA, 21 nt, Escherichia coli CFT073
uccagggaucaacauucagau

SEQ ID NO: 2677372 - RNA, 16 nt, Escherichia coli CFT073
uccagggccaguacac

SEQ ID NO: 2677373 - RNA, 23 nt, Escherichia coli CFT073
uccagggcgaaaagcuucuuccu

SEQ ID NO: 2677374 - RNA, 13 nt, Escherichia coli CFT073
uccaggggcuggu

SEQ ID NO: 2677375 - RNA, 16 nt, Escherichia coli CFT073
uccaggggcuggugcc

SEQ ID NO: 2677376 - RNA, 24 nt, Escherichia coli CFT073
uccaggggcuggugccugcacugg

SEQ ID NO: 2677377 - RNA, 20 nt, Escherichia coli CFT073
uccagggguuguuauuuccg

SEQ ID NO: 2677378 - RNA, 15 nt, Escherichia coli CFT073
uccaggguaaacauc

SEQ ID NO: 2677379 - RNA, 16 nt, Escherichia coli CFT073
uccagguagcaaacaa

SEQ ID NO: 2677380 - RNA, 19 nt, Escherichia coli CFT073
uccaggugaaaaauaaaag

SEQ ID NO: 2677381 - RNA, 16 nt, Escherichia coli CFT073
uccagguuaacccaca

SEQ ID NO: 2677382 - RNA, 15 nt, Escherichia coli CFT073
uccaguaccugcaaa

SEQ ID NO: 2677383 - RNA, 13 nt, Escherichia coli CFT073
uccaguacgccuu

SEQ ID NO: 2677384 - RNA, 22 nt, Escherichia coli CFT073
uccaguacgcggacacuuuccu

SEQ ID NO: 2677385 - RNA, 17 nt, Escherichia coli CFT073
uccaguagaauaaugau

SEQ ID NO: 2677386 - RNA, 14 nt, Escherichia coli CFT073
uccaguauauugcu

SEQ ID NO: 2677387 - RNA, 15 nt, Escherichia coli CFT073
uccaguccaccccca

SEQ ID NO: 2677388 - RNA, 15 nt, Escherichia coli CFT073
uccagucgcugcuga

SEQ ID NO: 2677389 - RNA, 22 nt, Escherichia coli CFT073
uccagucggcguaauccugaaa

SEQ ID NO: 2677390 - RNA, 20 nt, Escherichia coli CFT073
uccagucuuucgccauccac

SEQ ID NO: 2677391 - RNA, 14 nt, Escherichia coli CFT073
uccagugauuccag

SEQ ID NO: 2677392 - RNA, 17 nt, Escherichia coli CFT073
uccagugauuccagucg

SEQ ID NO: 2677393 - RNA, 15 nt, Escherichia coli CFT073
uccagugauuguccu

SEQ ID NO: 2677394 - RNA, 21 nt, Escherichia coli CFT073
uccagugcaacuuuacuaaaa

SEQ ID NO: 2677395 - RNA, 21 nt, Escherichia coli CFT073
uccagugccgccguuaaaugg

SEQ ID NO: 2677396 - RNA, 20 nt, Escherichia coli CFT073
uccagugccggaugauucac

SEQ ID NO: 2677397 - RNA, 21 nt, Escherichia coli CFT073
uccagugcgcuuuauucagau

SEQ ID NO: 2677398 - RNA, 18 nt, Escherichia coli CFT073
uccagugcggaagcgagu

SEQ ID NO: 2677399 - RNA, 21 nt, Escherichia coli CFT073
uccagugcguacccagcgugu

SEQ ID NO: 2677400 - RNA, 20 nt, Escherichia coli CFT073
uccaguuaucacgauacacc

SEQ ID NO: 2677401 - RNA, 16 nt, Escherichia coli CFT073
uccaguuccaguuuau

SEQ ID NO: 2677402 - RNA, 21 nt, Escherichia coli CFT073
uccaguuccuucaagccauca

SEQ ID NO: 2677403 - RNA, 23 nt, Escherichia coli CFT073
uccaguuccuucaagccaucaag

SEQ ID NO: 2677404 - RNA, 16 nt, Escherichia coli CFT073
uccaguucgcuggcau

SEQ ID NO: 2677405 - RNA, 18 nt, Escherichia coli CFT073
uccaguucuuccgccaga

SEQ ID NO: 2677406 - RNA, 14 nt, Escherichia coli CFT073
uccaguugauacag

SEQ ID NO: 2677407 - RNA, 14 nt, Escherichia coli CFT073
uccaguugguugau

SEQ ID NO: 2677408 - RNA, 13 nt, Escherichia coli CFT073
uccaguuguuuuu

SEQ ID NO: 2677409 - RNA, 15 nt, Escherichia coli CFT073
uccaguuuauaucuu

SEQ ID NO: 2677410 - RNA, 17 nt, Escherichia coli CFT073
uccaguuuauaucuuuc

SEQ ID NO: 2677411 - RNA, 17 nt, Escherichia coli CFT073
uccaguuugcucaaauc

SEQ ID NO: 2677412 - RNA, 16 nt, Escherichia coli CFT073
uccaguuuuuaucaua

SEQ ID NO: 2677413 - RNA, 15 nt, Escherichia coli CFT073
uccauaaccauaauu

SEQ ID NO: 2677414 - RNA, 24 nt, Escherichia coli CFT073
uccauaaucgacucccgcgccgca

SEQ ID NO: 2677415 - RNA, 19 nt, Escherichia coli CFT073
uccauaauugccagcuugc

SEQ ID NO: 2677416 - RNA, 18 nt, Escherichia coli CFT073
uccauaccagcacauaac

SEQ ID NO: 2677417 - RNA, 13 nt, Escherichia coli CFT073
uccauaccggacu

SEQ ID NO: 2677418 - RNA, 15 nt, Escherichia coli CFT073
uccauacgaauugcc

SEQ ID NO: 2677419 - RNA, 23 nt, Escherichia coli CFT073
uccauacucguugacgaccaguc

SEQ ID NO: 2677420 - RNA, 18 nt, Escherichia coli CFT073
uccauauauaaaaucaua

SEQ ID NO: 2677421 - RNA, 16 nt, Escherichia coli CFT073
uccauauguucccuua

SEQ ID NO: 2677422 - RNA, 16 nt, Escherichia coli CFT073
uccauauucagcgcca

SEQ ID NO: 2677423 - RNA, 17 nt, Escherichia coli CFT073
uccauauuucgucgcau

SEQ ID NO: 2677424 - RNA, 19 nt, Escherichia coli CFT073
uccauauuucgucgcauca

SEQ ID NO: 2677425 - RNA, 21 nt, Escherichia coli CFT073
uccauauuuugaaucgguggc

SEQ ID NO: 2677426 - RNA, 18 nt, Escherichia coli CFT073
uccauauuuuuugaaaaa

SEQ ID NO: 2677427 - RNA, 24 nt, Escherichia coli CFT073
uccaucacuaaggguaaaacgacu

SEQ ID NO: 2677428 - RNA, 13 nt, Escherichia coli CFT073
uccaucagacguu

SEQ ID NO: 2677429 - RNA, 19 nt, Escherichia coli CFT073
uccaucagauucagcagcg

SEQ ID NO: 2677430 - RNA, 18 nt, Escherichia coli CFT073
uccaucaucucuggcggc

SEQ ID NO: 2677431 - RNA, 11 nt, Escherichia coli CFT073
uccauccauac

SEQ ID NO: 2677432 - RNA, 18 nt, Escherichia coli CFT073
uccauccauacgggcaug

SEQ ID NO: 2677433 - RNA, 17 nt, Escherichia coli CFT073
uccauccggcaacauca

SEQ ID NO: 2677434 - RNA, 21 nt, Escherichia coli CFT073
uccauccggcaacaucaaauc

SEQ ID NO: 2677435 - RNA, 16 nt, Escherichia coli CFT073
uccauccgguacuuuc

SEQ ID NO: 2677436 - RNA, 23 nt, Escherichia coli CFT073
uccaucgacucgcgaaucgccgu

SEQ ID NO: 2677437 - RNA, 20 nt, Escherichia coli CFT073
uccaucgcaucuucgcccac

SEQ ID NO: 2677438 - RNA, 22 nt, Escherichia coli CFT073
uccaucgcgcuuagcaaagaac

SEQ ID NO: 2677439 - RNA, 19 nt, Escherichia coli CFT073
uccaucgcuacaggcuauc

SEQ ID NO: 2677440 - RNA, 18 nt, Escherichia coli CFT073
uccaucguugaauacauu

SEQ ID NO: 2677441 - RNA, 21 nt, Escherichia coli CFT073
uccaucucgccauccuuaugc

SEQ ID NO: 2677442 - RNA, 22 nt, Escherichia coli CFT073
uccaucucguccaacaguucca

SEQ ID NO: 2677443 - RNA, 14 nt, Escherichia coli CFT073
uccaugaaaauaga

SEQ ID NO: 2677444 - RNA, 14 nt, Escherichia coli CFT073
uccaugacgaugca

SEQ ID NO: 2677445 - RNA, 12 nt, Escherichia coli CFT073
uccaugauauug

SEQ ID NO: 2677446 - RNA, 21 nt, Escherichia coli CFT073
uccaugcgcauaagaccguga

SEQ ID NO: 2677447 - RNA, 17 nt, Escherichia coli CFT073
uccauggcagaugauca

SEQ ID NO: 2677448 - RNA, 23 nt, Escherichia coli CFT073
uccauguagcucaucugacguuc

SEQ ID NO: 2677449 - RNA, 15 nt, Escherichia coli CFT073
uccauuacaucacga

SEQ ID NO: 2677450 - RNA, 16 nt, Escherichia coli CFT073
uccauucaaggacaaa

SEQ ID NO: 2677451 - RNA, 18 nt, Escherichia coli CFT073
uccauucaucacgcacug

SEQ ID NO: 2677452 - RNA, 19 nt, Escherichia coli CFT073
uccauucccuggcacuguu

SEQ ID NO: 2677453 - RNA, 14 nt, Escherichia coli CFT073
uccauucgaugaga

SEQ ID NO: 2677454 - RNA, 21 nt, Escherichia coli CFT073
uccauucuugcgcggauggcc

SEQ ID NO: 2677455 - RNA, 14 nt, Escherichia coli CFT073
uccauugccugcaa

SEQ ID NO: 2677456 - RNA, 16 nt, Escherichia coli CFT073
uccauugcgaauaaga

SEQ ID NO: 2677457 - RNA, 22 nt, Escherichia coli CFT073
uccauugcuuugguaaauggcu

SEQ ID NO: 2677458 - RNA, 18 nt, Escherichia coli CFT073
uccauugucuccagggcg

SEQ ID NO: 2677459 - RNA, 20 nt, Escherichia coli CFT073
ucccaaaccgcccagcagcg

SEQ ID NO: 2677460 - RNA, 17 nt, Escherichia coli CFT073
ucccaacaacagcgcgc

SEQ ID NO: 2677461 - RNA, 18 nt, Escherichia coli CFT073
ucccaacaacagcgcgcu

SEQ ID NO: 2677462 - RNA, 20 nt, Escherichia coli CFT073
ucccaacaguuuguugagau

SEQ ID NO: 2677463 - RNA, 17 nt, Escherichia coli CFT073
ucccacaucacauccag

SEQ ID NO: 2677464 - RNA, 14 nt, Escherichia coli CFT073
ucccaccagcgccg

SEQ ID NO: 2677465 - RNA, 17 nt, Escherichia coli CFT073
ucccaccagcgccgccc

SEQ ID NO: 2677466 - RNA, 17 nt, Escherichia coli CFT073
ucccaccaucagaccag

SEQ ID NO: 2677467 - RNA, 16 nt, Escherichia coli CFT073
ucccaccucgugcacc

SEQ ID NO: 2677468 - RNA, 22 nt, Escherichia coli CFT073
ucccacgagagaaccagccgua

SEQ ID NO: 2677469 - RNA, 19 nt, Escherichia coli CFT073
ucccacgcggcaacggcuu

SEQ ID NO: 2677470 - RNA, 18 nt, Escherichia coli CFT073
ucccacggauuaccguga

SEQ ID NO: 2677471 - RNA, 20 nt, Escherichia coli CFT073
ucccacggcggugucgccag

SEQ ID NO: 2677472 - RNA, 18 nt, Escherichia coli CFT073
ucccacgguauagcucaa

SEQ ID NO: 2677473 - RNA, 23 nt, Escherichia coli CFT073
ucccacgguauagcucaacagua

SEQ ID NO: 2677474 - RNA, 16 nt, Escherichia coli CFT073
ucccacgguuugagag

SEQ ID NO: 2677475 - RNA, 14 nt, Escherichia coli CFT073
ucccggaagccacc

SEQ ID NO: 2677476 - RNA, 16 nt, Escherichia coli CFT073
ucccggaugcaccauc

SEQ ID NO: 2677477 - RNA, 13 nt, Escherichia coli CFT073
ucccggcaaaaaa

SEQ ID NO: 2677478 - RNA, 14 nt, Escherichia coli CFT073
ucccggcaaucacc

SEQ ID NO: 2677479 - RNA, 23 nt, Escherichia coli CFT073
ucccggcagagaaaaugccgcac

SEQ ID NO: 2677480 - RNA, 12 nt, Escherichia coli CFT073
ucccggcaggaa

SEQ ID NO: 2677481 - RNA, 13 nt, Escherichia coli CFT073
ucccggcucaucc

SEQ ID NO: 2677482 - RNA, 17 nt, Escherichia coli CFT073
ucccggucaguagaaua

SEQ ID NO: 2677483 - RNA, 16 nt, Escherichia coli CFT073
ucccgguuaacugcau

SEQ ID NO: 2677484 - RNA, 17 nt, Escherichia coli CFT073
ucccgguuucaggauga

SEQ ID NO: 2677485 - RNA, 17 nt, Escherichia coli CFT073
ucccguagcaggaaaua

SEQ ID NO: 2677486 - RNA, 19 nt, Escherichia coli CFT073
ucccguccuucaucuucau

SEQ ID NO: 2677487 - RNA, 14 nt, Escherichia coli CFT073
ucccgugccugcuu

SEQ ID NO: 2677488 - RNA, 17 nt, Escherichia coli CFT073
ucccguugaaaaugcug

SEQ ID NO: 2677489 - RNA, 21 nt, Escherichia coli CFT073
ucccguugccacucaggcaaa

SEQ ID NO: 2677490 - RNA, 23 nt, Escherichia coli CFT073
ucccguuuuuagauuguuuucaa

SEQ ID NO: 2677491 - RNA, 20 nt, Escherichia coli CFT073
ucccuacugcuccuaacgau

SEQ ID NO: 2677492 - RNA, 17 nt, Escherichia coli CFT073
ucccucacgcuucugaa

SEQ ID NO: 2677493 - RNA, 18 nt, Escherichia coli CFT073
ucccucuucaauuaacaa

SEQ ID NO: 2677494 - RNA, 20 nt, Escherichia coli CFT073
ucccugcaacacccgguacc

SEQ ID NO: 2677495 - RNA, 19 nt, Escherichia coli CFT073
ucccugcagggcuuuuuaa

SEQ ID NO: 2677496 - RNA, 20 nt, Escherichia coli CFT073
ucccugcagggcuuuuuaau

SEQ ID NO: 2677497 - RNA, 23 nt, Escherichia coli CFT073
ucccugcagggcuuuuuaaugca

SEQ ID NO: 2677498 - RNA, 20 nt, Escherichia coli CFT073
ucccugcgcaaggcauugag

SEQ ID NO: 2677499 - RNA, 15 nt, Escherichia coli CFT073
ucccugcucuuucag

SEQ ID NO: 2677500 - RNA, 16 nt, Escherichia coli CFT073
ucccugcucuuucagc

SEQ ID NO: 2677501 - RNA, 16 nt, Escherichia coli CFT073
ucccugcuguccugag

SEQ ID NO: 2677502 - RNA, 13 nt, Escherichia coli CFT073
ucccuggcaugau

SEQ ID NO: 2677503 - RNA, 15 nt, Escherichia coli CFT073
ucccuguaggucgga

SEQ ID NO: 2677504 - RNA, 21 nt, Escherichia coli CFT073
ucccugugccagcggcaguaa

SEQ ID NO: 2677505 - RNA, 21 nt, Escherichia coli CFT073
ucccuuccgcaauacagccag

SEQ ID NO: 2677506 - RNA, 22 nt, Escherichia coli CFT073
ucccuuccgccaucaaucgacc

SEQ ID NO: 2677507 - RNA, 20 nt, Escherichia coli CFT073
ucccuuccggugcgaucagu

SEQ ID NO: 2677508 - RNA, 20 nt, Escherichia coli CFT073
ucccuuccugcccuuuuaau

SEQ ID NO: 2677509 - RNA, 16 nt, Escherichia coli CFT073
ucccuucgacuuucag

SEQ ID NO: 2677510 - RNA, 15 nt, Escherichia coli CFT073
ucccuucgagcgggg

SEQ ID NO: 2677511 - RNA, 12 nt, Escherichia coli CFT073
ucccuucuccac

SEQ ID NO: 2677512 - RNA, 14 nt, Escherichia coli CFT073
ucccuucucuucaa

SEQ ID NO: 2677513 - RNA, 14 nt, Escherichia coli CFT073
ucccuucugccacc

SEQ ID NO: 2677514 - RNA, 17 nt, Escherichia coli CFT073
ucccuucugccaccagg

SEQ ID NO: 2677515 - RNA, 18 nt, Escherichia coli CFT073
ucccuucugccaccaggu

SEQ ID NO: 2677516 - RNA, 21 nt, Escherichia coli CFT073
ucccuucugccaccagguuca

SEQ ID NO: 2677517 - RNA, 16 nt, Escherichia coli CFT073
ucccuugcucugguuc

SEQ ID NO: 2677518 - RNA, 15 nt, Escherichia coli CFT073
ucccuugucgcagca

SEQ ID NO: 2677519 - RNA, 18 nt, Escherichia coli CFT073
ucccuuguugugccagac

SEQ ID NO: 2677520 - RNA, 18 nt, Escherichia coli CFT073
ucccuuucagauauccca

SEQ ID NO: 2677521 - RNA, 14 nt, Escherichia coli CFT073
ucccuuucagcaaa

SEQ ID NO: 2677522 - RNA, 14 nt, Escherichia coli CFT073
ucccuuucuccauu

SEQ ID NO: 2677523 - RNA, 13 nt, Escherichia coli CFT073
ucccuuucugcag

SEQ ID NO: 2677524 - RNA, 14 nt, Escherichia coli CFT073
ucccuuuguaagca

SEQ ID NO: 2677525 - RNA, 13 nt, Escherichia coli CFT073
uccgaaaaccgau

SEQ ID NO: 2677526 - RNA, 22 nt, Escherichia coli CFT073
uccgaaacgcggguaaucaguu

SEQ ID NO: 2677527 - RNA, 16 nt, Escherichia coli CFT073
uccgaaguucauccau

SEQ ID NO: 2677528 - RNA, 23 nt, Escherichia coli CFT073
uccgacaaaaugaugucaaccau

SEQ ID NO: 2677529 - RNA, 20 nt, Escherichia coli CFT073
uccgacaucaacgccugaug

SEQ ID NO: 2677530 - RNA, 18 nt, Escherichia coli CFT073
uccgacauuucugcugcc

SEQ ID NO: 2677531 - RNA, 22 nt, Escherichia coli CFT073
uccgacauuuugggacagugca

SEQ ID NO: 2677532 - RNA, 23 nt, Escherichia coli CFT073
uccgaccuacaaaaucaugcaaa

SEQ ID NO: 2677533 - RNA, 21 nt, Escherichia coli CFT073
uccgaccuacacucggcaccc

SEQ ID NO: 2677534 - RNA, 23 nt, Escherichia coli CFT073
uccgaccuacagggaacacaugu

SEQ ID NO: 2677535 - RNA, 21 nt, Escherichia coli CFT073
uccgaccuacguucggcacua

SEQ ID NO: 2677536 - RNA, 17 nt, Escherichia coli CFT073
uccgacguuacgcgcca

SEQ ID NO: 2677537 - RNA, 21 nt, Escherichia coli CFT073
uccgacuuauucuucaacaau

SEQ ID NO: 2677538 - RNA, 21 nt, Escherichia coli CFT073
uccgacuucaguggaaucauc

SEQ ID NO: 2677539 - RNA, 21 nt, Escherichia coli CFT073
uccgagaaucgacaccaguuc

SEQ ID NO: 2677540 - RNA, 22 nt, Escherichia coli CFT073
uccgagaaucgacaccaguuca

SEQ ID NO: 2677541 - RNA, 15 nt, Escherichia coli CFT073
uccgagcggcaccac

SEQ ID NO: 2677542 - RNA, 13 nt, Escherichia coli CFT073
uccgaucccugca

SEQ ID NO: 2677543 - RNA, 13 nt, Escherichia coli CFT073
uccgaugcaaaaa

SEQ ID NO: 2677544 - RNA, 14 nt, Escherichia coli CFT073
uccgauuaccggca

SEQ ID NO: 2677545 - RNA, 16 nt, Escherichia coli CFT073
uccgauuaccggcaac

SEQ ID NO: 2677546 - RNA, 22 nt, Escherichia coli CFT073
uccgauuguacuuuaaaauaag

SEQ ID NO: 2677547 - RNA, 15 nt, Escherichia coli CFT073
uccgcaacgccgcca

SEQ ID NO: 2677548 - RNA, 15 nt, Escherichia coli CFT073
uccgcacaaacgcca

SEQ ID NO: 2677549 - RNA, 22 nt, Escherichia coli CFT073
uccgcaccaacuccacuucacc

SEQ ID NO: 2677550 - RNA, 18 nt, Escherichia coli CFT073
uccgcaccugccagcgcc

SEQ ID NO: 2677551 - RNA, 16 nt, Escherichia coli CFT073
uccgcacucaacuuau

SEQ ID NO: 2677552 - RNA, 19 nt, Escherichia coli CFT073
uccgcagccaugaguaauu

SEQ ID NO: 2677553 - RNA, 12 nt, Escherichia coli CFT073
uccgcagcgcgg

SEQ ID NO: 2677554 - RNA, 15 nt, Escherichia coli CFT073
uccgcagcuccagcc

SEQ ID NO: 2677555 - RNA, 16 nt, Escherichia coli CFT073
uccgcaggggauggau

SEQ ID NO: 2677556 - RNA, 18 nt, Escherichia coli CFT073
uccgcaugaguacgcggu

SEQ ID NO: 2677557 - RNA, 21 nt, Escherichia coli CFT073
uccgcauuuguaggcaggaua

SEQ ID NO: 2677558 - RNA, 19 nt, Escherichia coli CFT073
uccgccaaaacaucuucgg

SEQ ID NO: 2677559 - RNA, 20 nt, Escherichia coli CFT073
uccgccaaccgcugauugcu

SEQ ID NO: 2677560 - RNA, 17 nt, Escherichia coli CFT073
uccgccaauucccgaca

SEQ ID NO: 2677561 - RNA, 14 nt, Escherichia coli CFT073
uccgccaauuucau

SEQ ID NO: 2677562 - RNA, 18 nt, Escherichia coli CFT073
uccgccacgucaucagca

SEQ ID NO: 2677563 - RNA, 12 nt, Escherichia coli CFT073
uccgccagaaua

SEQ ID NO: 2677564 - RNA, 15 nt, Escherichia coli CFT073
uccgccagcaacuga

SEQ ID NO: 2677565 - RNA, 17 nt, Escherichia coli CFT073
uccgccagcaucauaaa

SEQ ID NO: 2677566 - RNA, 17 nt, Escherichia coli CFT073
uccgccagcgccaaagc

SEQ ID NO: 2677567 - RNA, 20 nt, Escherichia coli CFT073
uccgccagcgccucuucuaa

SEQ ID NO: 2677568 - RNA, 18 nt, Escherichia coli CFT073
uccgccauaucaccaccg

SEQ ID NO: 2677569 - RNA, 14 nt, Escherichia coli CFT073
uccgccaucaaucg

SEQ ID NO: 2677570 - RNA, 22 nt, Escherichia coli CFT073
uccgccaugcugguuacuggaa

SEQ ID NO: 2677571 - RNA, 20 nt, Escherichia coli CFT073
uccgccauuuccagcgucug

SEQ ID NO: 2677572 - RNA, 20 nt, Escherichia coli CFT073
uccgcccagaccgugcgcag

SEQ ID NO: 2677573 - RNA, 14 nt, Escherichia coli CFT073
uccgccccggcaau

SEQ ID NO: 2677574 - RNA, 21 nt, Escherichia coli CFT073
uccgcccucgauaugccagac

SEQ ID NO: 2677575 - RNA, 20 nt, Escherichia coli CFT073
uccgccgcacaagucagcaa

SEQ ID NO: 2677576 - RNA, 21 nt, Escherichia coli CFT073
uccgccgccauugacguuccc

SEQ ID NO: 2677577 - RNA, 19 nt, Escherichia coli CFT073
uccgccgcuguggcaggua

SEQ ID NO: 2677578 - RNA, 17 nt, Escherichia coli CFT073
uccgccguggaugcgau

SEQ ID NO: 2677579 - RNA, 20 nt, Escherichia coli CFT073
uccgccguugcgcccgacaa

SEQ ID NO: 2677580 - RNA, 14 nt, Escherichia coli CFT073
uccgccucgcucag

SEQ ID NO: 2677581 - RNA, 18 nt, Escherichia coli CFT073
uccgccucuaacagauca

SEQ ID NO: 2677582 - RNA, 17 nt, Escherichia coli CFT073
uccgcgaacagccgcgg

SEQ ID NO: 2677583 - RNA, 22 nt, Escherichia coli CFT073
uccgguuuguaagauuacgcua

SEQ ID NO: 2677584 - RNA, 21 nt, Escherichia coli CFT073
uccgguuuuuuauuauccgcu

SEQ ID NO: 2677585 - RNA, 17 nt, Escherichia coli CFT073
uccguacgcuuuuccac

SEQ ID NO: 2677586 - RNA, 16 nt, Escherichia coli CFT073
uccguacucaaugcca

SEQ ID NO: 2677587 - RNA, 18 nt, Escherichia coli CFT073
uccguagcguuuuuucau

SEQ ID NO: 2677588 - RNA, 23 nt, Escherichia coli CFT073
uccguagcguuuuuucauuucuc

SEQ ID NO: 2677589 - RNA, 16 nt, Escherichia coli CFT073
uccguauagaucagcg

SEQ ID NO: 2677590 - RNA, 15 nt, Escherichia coli CFT073
uccguauuugucucg

SEQ ID NO: 2677591 - RNA, 19 nt, Escherichia coli CFT073
uccgucaccggaauaauaa

SEQ ID NO: 2677592 - RNA, 12 nt, Escherichia coli CFT073
uccgucagcaaa

SEQ ID NO: 2677593 - RNA, 14 nt, Escherichia coli CFT073
uccgucagcggcag

SEQ ID NO: 2677594 - RNA, 22 nt, Escherichia coli CFT073
uccgucagcggcagcucuuucu

SEQ ID NO: 2677595 - RNA, 22 nt, Escherichia coli CFT073
uccgucaucgacgucagcagau

SEQ ID NO: 2677596 - RNA, 16 nt, Escherichia coli CFT073
uccguccagccaccgc

SEQ ID NO: 2677597 - RNA, 16 nt, Escherichia coli CFT073
uccgucgcgccaggcg

SEQ ID NO: 2677598 - RNA, 17 nt, Escherichia coli CFT073
uccgucgcgccaggcgc

SEQ ID NO: 2677599 - RNA, 22 nt, Escherichia coli CFT073
uccgucgggcgguauuuaaacu

SEQ ID NO: 2677600 - RNA, 20 nt, Escherichia coli CFT073
uccgugaagcucacuucgcu

SEQ ID NO: 2677601 - RNA, 16 nt, Escherichia coli CFT073
uccgugccagcaccaa

SEQ ID NO: 2677602 - RNA, 15 nt, Escherichia coli CFT073
uccgugggcuaacac

SEQ ID NO: 2677603 - RNA, 20 nt, Escherichia coli CFT073
uccguggucgcguagccagg

SEQ ID NO: 2677604 - RNA, 19 nt, Escherichia coli CFT073
uccgugucuuuauuuccau

SEQ ID NO: 2677605 - RNA, 23 nt, Escherichia coli CFT073
uccguuaaccgagggaagcaaua

SEQ ID NO: 2677606 - RNA, 19 nt, Escherichia coli CFT073
uccguuauguuucauccag

SEQ ID NO: 2677607 - RNA, 14 nt, Escherichia coli CFT073
uccguucucaccaa

SEQ ID NO: 2677608 - RNA, 14 nt, Escherichia coli CFT073
uccguugccagaug

SEQ ID NO: 2677609 - RNA, 20 nt, Escherichia coli CFT073
uccguugucuguaaugucca

SEQ ID NO: 2677610 - RNA, 14 nt, Escherichia coli CFT073
uccguuuuccagcc

SEQ ID NO: 2677611 - RNA, 19 nt, Escherichia coli CFT073
uccuaaaggcaaaaugcca

SEQ ID NO: 2677612 - RNA, 15 nt, Escherichia coli CFT073
uccuaacaaccaucc

SEQ ID NO: 2677613 - RNA, 13 nt, Escherichia coli CFT073
uccuacaccccag

SEQ ID NO: 2677614 - RNA, 20 nt, Escherichia coli CFT073
uccuauuggagaauauguuu

SEQ ID NO: 2677615 - RNA, 21 nt, Escherichia coli CFT073
uccucaaacgugcggcaggca

SEQ ID NO: 2677616 - RNA, 17 nt, Escherichia coli CFT073
uccucaacaucuucacc

SEQ ID NO: 2677617 - RNA, 12 nt, Escherichia coli CFT073
uccucaauaaua

SEQ ID NO: 2677618 - RNA, 18 nt, Escherichia coli CFT073
uccucaaucggaaaacaa

SEQ ID NO: 2677619 - RNA, 22 nt, Escherichia coli CFT073
uccucaaugaaucgcagucucu

SEQ ID NO: 2677620 - RNA, 18 nt, Escherichia coli CFT073
uccucacuuaaagcaaca

SEQ ID NO: 2677621 - RNA, 13 nt, Escherichia coli CFT073
uccucaucauccu

SEQ ID NO: 2677622 - RNA, 12 nt, Escherichia coli CFT073
uccucccgagcg

SEQ ID NO: 2677623 - RNA, 13 nt, Escherichia coli CFT073
uccuccgcagcca

SEQ ID NO: 2677624 - RNA, 20 nt, Escherichia coli CFT073
uccuccggcaucuuuaacgu

SEQ ID NO: 2677625 - RNA, 22 nt, Escherichia coli CFT073
uccuccggcuuuaucaugucac

SEQ ID NO: 2677626 - RNA, 22 nt, Escherichia coli CFT073
uccucgauacagaccccggcau

SEQ ID NO: 2677627 - RNA, 23 nt, Escherichia coli CFT073
uccucgauacagaccccggcauu

SEQ ID NO: 2677628 - RNA, 16 nt, Escherichia coli CFT073
uccucgccguuaauga

SEQ ID NO: 2677629 - RNA, 14 nt, Escherichia coli CFT073
uccugaaacgcggc

SEQ ID NO: 2677630 - RNA, 22 nt, Escherichia coli CFT073
uccugaaacgcggcguaaccac

SEQ ID NO: 2677631 - RNA, 17 nt, Escherichia coli CFT073
uccugaaauuccugaga

SEQ ID NO: 2677632 - RNA, 16 nt, Escherichia coli CFT073
uccugaagaugcugca

SEQ ID NO: 2677633 - RNA, 18 nt, Escherichia coli CFT073
uccugaaucacaauccgc

SEQ ID NO: 2677634 - RNA, 19 nt, Escherichia coli CFT073
uccugaaucacaauccgcu

SEQ ID NO: 2677635 - RNA, 16 nt, Escherichia coli CFT073
uccugaaucaccugau

SEQ ID NO: 2677636 - RNA, 17 nt, Escherichia coli CFT073
uccugaauggugaccug

SEQ ID NO: 2677637 - RNA, 13 nt, Escherichia coli CFT073
uccugaauuaacu

SEQ ID NO: 2677638 - RNA, 18 nt, Escherichia coli CFT073
uccugacccucucggcau

SEQ ID NO: 2677639 - RNA, 18 nt, Escherichia coli CFT073
uccugacuuaccuccugu

SEQ ID NO: 2677640 - RNA, 19 nt, Escherichia coli CFT073
uccugacuuacuuccuguc

SEQ ID NO: 2677641 - RNA, 20 nt, Escherichia coli CFT073
uccugacuuuguaccagcgg

SEQ ID NO: 2677642 - RNA, 13 nt, Escherichia coli CFT073
uccugagcagcaa

SEQ ID NO: 2677643 - RNA, 23 nt, Escherichia coli CFT073
uccugagucggaacuuugcugca

SEQ ID NO: 2677644 - RNA, 20 nt, Escherichia coli CFT073
uccugauaaccuuccagcuu

SEQ ID NO: 2677645 - RNA, 23 nt, Escherichia coli CFT073
uccugauaaccuuccagcuucgc

SEQ ID NO: 2677646 - RNA, 14 nt, Escherichia coli CFT073
uccugaucaagcug

SEQ ID NO: 2677647 - RNA, 22 nt, Escherichia coli CFT073
uccugauccgcuuuacgcaguu

SEQ ID NO: 2677648 - RNA, 13 nt, Escherichia coli CFT073
uccugaugcuuca

SEQ ID NO: 2677649 - RNA, 21 nt, Escherichia coli CFT073
uccugcaaacaguaacccagc

SEQ ID NO: 2677650 - RNA, 17 nt, Escherichia coli CFT073
uccugcaauaccgccgu

SEQ ID NO: 2677651 - RNA, 16 nt, Escherichia coli CFT073
uccugcaaucuuuccu

SEQ ID NO: 2677652 - RNA, 20 nt, Escherichia coli CFT073
uccugcacaaauuugccguc

SEQ ID NO: 2677653 - RNA, 14 nt, Escherichia coli CFT073
uccugcacuguccc

SEQ ID NO: 2677654 - RNA, 16 nt, Escherichia coli CFT073
uccugcacugucccaa

SEQ ID NO: 2677655 - RNA, 21 nt, Escherichia coli CFT073
uccugcacugucccaaaaugu

SEQ ID NO: 2677656 - RNA, 23 nt, Escherichia coli CFT073
uccugcacugucccaaaaugucg

SEQ ID NO: 2677657 - RNA, 23 nt, Escherichia coli CFT073
uccugcacuucaaauuucauaau

SEQ ID NO: 2677658 - RNA, 16 nt, Escherichia coli CFT073
uccugcagaaaaucca

SEQ ID NO: 2677659 - RNA, 18 nt, Escherichia coli CFT073
uccugcauaucggcauaa

SEQ ID NO: 2677660 - RNA, 12 nt, Escherichia coli CFT073
uccugcauugcu

SEQ ID NO: 2677661 - RNA, 21 nt, Escherichia coli CFT073
uccugccaacgcaccguaacc

SEQ ID NO: 2677662 - RNA, 11 nt, Escherichia coli CFT073
uccugccagaa

SEQ ID NO: 2677663 - RNA, 17 nt, Escherichia coli CFT073
uccugccaggaccgcug

SEQ ID NO: 2677664 - RNA, 16 nt, Escherichia coli CFT073
uccugccaguuuuucc

SEQ ID NO: 2677665 - RNA, 17 nt, Escherichia coli CFT073
uccugccaguuuuuccg

SEQ ID NO: 2677666 - RNA, 13 nt, Escherichia coli CFT073
uccugccugauuc

SEQ ID NO: 2677667 - RNA, 17 nt, Escherichia coli CFT073
uccugccugauucagca

SEQ ID NO: 2677668 - RNA, 16 nt, Escherichia coli CFT073
uccugcgcacaaccug

SEQ ID NO: 2677669 - RNA, 23 nt, Escherichia coli CFT073
uccugcgccucuccacacggaga

SEQ ID NO: 2677670 - RNA, 20 nt, Escherichia coli CFT073
uccugcgcuuccaguuccau

SEQ ID NO: 2677671 - RNA, 18 nt, Escherichia coli CFT073
uccugcggagcaaccugc

SEQ ID NO: 2677672 - RNA, 16 nt, Escherichia coli CFT073
uccugcggcuucaacu

SEQ ID NO: 2677673 - RNA, 22 nt, Escherichia coli CFT073
uccugcgggagcgcuuuuuccu

SEQ ID NO: 2677674 - RNA, 16 nt, Escherichia coli CFT073
uccugcuacaccauug

SEQ ID NO: 2677675 - RNA, 18 nt, Escherichia coli CFT073
uccugcucggcaaacugc

SEQ ID NO: 2677676 - RNA, 19 nt, Escherichia coli CFT073
uccugcugcacgcccugau

SEQ ID NO: 2677677 - RNA, 22 nt, Escherichia coli CFT073
uccugcugcacgcccugauaaa

SEQ ID NO: 2677678 - RNA, 16 nt, Escherichia coli CFT073
uccuggaacacgcgca

SEQ ID NO: 2677679 - RNA, 12 nt, Escherichia coli CFT073
uccuggcaccau

SEQ ID NO: 2677680 - RNA, 14 nt, Escherichia coli CFT073
uccuggcaccauca

SEQ ID NO: 2677681 - RNA, 22 nt, Escherichia coli CFT073
uccuggcgaucgggcauuucca

SEQ ID NO: 2677682 - RNA, 21 nt, Escherichia coli CFT073
uccuggcgggaauaaaagcca

SEQ ID NO: 2677683 - RNA, 22 nt, Escherichia coli CFT073
uccuggcuaugguuaccuguuc

SEQ ID NO: 2677684 - RNA, 22 nt, Escherichia coli CFT073
uccuggggauucaucaccacug

SEQ ID NO: 2677685 - RNA, 18 nt, Escherichia coli CFT073
uccuggguauaaaacuca

SEQ ID NO: 2677686 - RNA, 17 nt, Escherichia coli CFT073
uccuguaaccaccguuu

SEQ ID NO: 2677687 - RNA, 14 nt, Escherichia coli CFT073
uccuguaauggcug

SEQ ID NO: 2677688 - RNA, 16 nt, Escherichia coli CFT073
uccuguagcggaaaau

SEQ ID NO: 2677689 - RNA, 22 nt, Escherichia coli CFT073
uccuguaugacaaaagaauggc

SEQ ID NO: 2677690 - RNA, 22 nt, Escherichia coli CFT073
uccuguucaccgauuuugccuu

SEQ ID NO: 2677691 - RNA, 11 nt, Escherichia coli CFT073
ucgauaccaga

SEQ ID NO: 2677692 - RNA, 16 nt, Escherichia coli CFT073
ucgauacugccuuucc

SEQ ID NO: 2677693 - RNA, 17 nt, Escherichia coli CFT073
ucgauagagaacgcgug

SEQ ID NO: 2677694 - RNA, 12 nt, Escherichia coli CFT073
ucgauauacaaa

SEQ ID NO: 2677695 - RNA, 15 nt, Escherichia coli CFT073
ucgauauacaccggc

SEQ ID NO: 2677696 - RNA, 13 nt, Escherichia coli CFT073
ucgauaucaccaa

SEQ ID NO: 2677697 - RNA, 15 nt, Escherichia coli CFT073
ucgauaucaggcaaa

SEQ ID NO: 2677698 - RNA, 20 nt, Escherichia coli CFT073
ucgauaucuuuuaaaucauc

SEQ ID NO: 2677699 - RNA, 15 nt, Escherichia coli CFT073
ucgauaugaccauug

SEQ ID NO: 2677700 - RNA, 13 nt, Escherichia coli CFT073
ucgauauuaucgu

SEQ ID NO: 2677701 - RNA, 16 nt, Escherichia coli CFT073
ucgauauugacgaucu

SEQ ID NO: 2677702 - RNA, 14 nt, Escherichia coli CFT073
ucgaucaccgcaga

SEQ ID NO: 2677703 - RNA, 15 nt, Escherichia coli CFT073
ucgaucaguucagca

SEQ ID NO: 2677704 - RNA, 19 nt, Escherichia coli CFT073
ucgaucaguuggcagagau

SEQ ID NO: 2677705 - RNA, 16 nt, Escherichia coli CFT073
ucgaucaucaggcccg

SEQ ID NO: 2677706 - RNA, 16 nt, Escherichia coli CFT073
ucgaucauguagucgg

SEQ ID NO: 2677707 - RNA, 14 nt, Escherichia coli CFT073
ucgauccccugccc

SEQ ID NO: 2677708 - RNA, 15 nt, Escherichia coli CFT073
ucgauccccugcccg

SEQ ID NO: 2677709 - RNA, 15 nt, Escherichia coli CFT073
ucgauccuuaccaga

SEQ ID NO: 2677710 - RNA, 13 nt, Escherichia coli CFT073
ucgaucgccgcac

SEQ ID NO: 2677711 - RNA, 19 nt, Escherichia coli CFT073
ucgaucgccgcacccgcca

SEQ ID NO: 2677712 - RNA, 18 nt, Escherichia coli CFT073
ucgaugauuuccgccagc

SEQ ID NO: 2677713 - RNA, 15 nt, Escherichia coli CFT073
ucgaugccaaagugu

SEQ ID NO: 2677714 - RNA, 19 nt, Escherichia coli CFT073
ucgaugccuugugggccug

SEQ ID NO: 2677715 - RNA, 17 nt, Escherichia coli CFT073
ucgaugcgcaacgcaau

SEQ ID NO: 2677716 - RNA, 15 nt, Escherichia coli CFT073
ucgaugcguaccauu

SEQ ID NO: 2677717 - RNA, 22 nt, Escherichia coli CFT073
ucgaugcguaccauuucuucug

SEQ ID NO: 2677718 - RNA, 20 nt, Escherichia coli CFT073
ucgauggccgggugauuuuu

SEQ ID NO: 2677719 - RNA, 14 nt, Escherichia coli CFT073
ucgauguagcgauu

SEQ ID NO: 2677720 - RNA, 17 nt, Escherichia coli CFT073
ucgauuaacuaaaugaa

SEQ ID NO: 2677721 - RNA, 15 nt, Escherichia coli CFT073
ucgauuaccgccagc

SEQ ID NO: 2677722 - RNA, 19 nt, Escherichia coli CFT073
ucgauugcacaaagguuuc

SEQ ID NO: 2677723 - RNA, 20 nt, Escherichia coli CFT073
ucgauuucauucagcguauc

SEQ ID NO: 2677724 - RNA, 16 nt, Escherichia coli CFT073
ucgauuuuauaaaggg

SEQ ID NO: 2677725 - RNA, 15 nt, Escherichia coli CFT073
ucgauuuucaaaaua

SEQ ID NO: 2677726 - RNA, 15 nt, Escherichia coli CFT073
ucgauuuuuuccagc

SEQ ID NO: 2677727 - RNA, 19 nt, Escherichia coli CFT073
ucgauuuuuuccagcgcau

SEQ ID NO: 2677728 - RNA, 20 nt, Escherichia coli CFT073
ucgauuuuuuccagcgcaug

SEQ ID NO: 2677729 - RNA, 15 nt, Escherichia coli CFT073
ucgcaaaauaaaaac

SEQ ID NO: 2677730 - RNA, 15 nt, Escherichia coli CFT073
ucgcaaacauaccca

SEQ ID NO: 2677731 - RNA, 17 nt, Escherichia coli CFT073
ucgcaaaccaaaccaaa

SEQ ID NO: 2677732 - RNA, 17 nt, Escherichia coli CFT073
ucgcaaaccagacgcgc

SEQ ID NO: 2677733 - RNA, 21 nt, Escherichia coli CFT073
ucgcaaaggacaucccggcag

SEQ ID NO: 2677734 - RNA, 21 nt, Escherichia coli CFT073
ucgcaaaggccagccaggcac

SEQ ID NO: 2677735 - RNA, 13 nt, Escherichia coli CFT073
ucgcaacaauguc

SEQ ID NO: 2677736 - RNA, 23 nt, Escherichia coli CFT073
ucgcaacgcaucuuuuucaaucc

SEQ ID NO: 2677737 - RNA, 19 nt, Escherichia coli CFT073
ucgcaagacgaaaaaugaa

SEQ ID NO: 2677738 - RNA, 17 nt, Escherichia coli CFT073
ucgcaagccgaauaacg

SEQ ID NO: 2677739 - RNA, 18 nt, Escherichia coli CFT073
ucgcaauacccugaccca

SEQ ID NO: 2677740 - RNA, 21 nt, Escherichia coli CFT073
ucgcaauacugccgagaauga

SEQ ID NO: 2677741 - RNA, 14 nt, Escherichia coli CFT073
ucgcacaggcaaug

SEQ ID NO: 2677742 - RNA, 13 nt, Escherichia coli CFT073
ucgcacaugucag

SEQ ID NO: 2677743 - RNA, 16 nt, Escherichia coli CFT073
ucgcacgccuggcagc

SEQ ID NO: 2677744 - RNA, 19 nt, Escherichia coli CFT073
ucgcacguugccagcaacu

SEQ ID NO: 2677745 - RNA, 19 nt, Escherichia coli CFT073
ucgcacuuuucccacuaac

SEQ ID NO: 2677746 - RNA, 16 nt, Escherichia coli CFT073
ucgcagaaacgacacc

SEQ ID NO: 2677747 - RNA, 20 nt, Escherichia coli CFT073
ucgcagauuucuucuggcua

SEQ ID NO: 2677748 - RNA, 13 nt, Escherichia coli CFT073
ucgcagccagcgc

SEQ ID NO: 2677749 - RNA, 18 nt, Escherichia coli CFT073
ucgcagcccguggcgcga

SEQ ID NO: 2677750 - RNA, 16 nt, Escherichia coli CFT073
ucgcagcgaucugccc

SEQ ID NO: 2677751 - RNA, 16 nt, Escherichia coli CFT073
ucgcaucaggcaugau

SEQ ID NO: 2677752 - RNA, 19 nt, Escherichia coli CFT073
ucgcaucaggccuacaugc

SEQ ID NO: 2677753 - RNA, 23 nt, Escherichia coli CFT073
ucgcaucccgguaucaaagcgcc

SEQ ID NO: 2677754 - RNA, 20 nt, Escherichia coli CFT073
ucgcauccggcaauucucac

SEQ ID NO: 2677755 - RNA, 18 nt, Escherichia coli CFT073
ucgcauuucgcaucaaug

SEQ ID NO: 2677756 - RNA, 20 nt, Escherichia coli CFT073
ucgcauuuugcagcuguugc

SEQ ID NO: 2677757 - RNA, 17 nt, Escherichia coli CFT073
ucgccaaacaggcgauc

SEQ ID NO: 2677758 - RNA, 23 nt, Escherichia coli CFT073
ucgccaaauacuuuuuccagcag

SEQ ID NO: 2677759 - RNA, 16 nt, Escherichia coli CFT073
ucgccaaucagaaagg

SEQ ID NO: 2677760 - RNA, 19 nt, Escherichia coli CFT073
ucgccaauggcugccgcca

SEQ ID NO: 2677761 - RNA, 21 nt, Escherichia coli CFT073
ucgccaauggcugccgccagg

SEQ ID NO: 2677762 - RNA, 15 nt, Escherichia coli CFT073
ucgccacauugcugc

SEQ ID NO: 2677763 - RNA, 15 nt, Escherichia coli CFT073
ucgccaccaacuuau

SEQ ID NO: 2677764 - RNA, 23 nt, Escherichia coli CFT073
ucgccaccgcuucgcucacauca

SEQ ID NO: 2677765 - RNA, 13 nt, Escherichia coli CFT073
ucgccacgccaaa

SEQ ID NO: 2677766 - RNA, 19 nt, Escherichia coli CFT073
ucgccacgcgggaagucac

SEQ ID NO: 2677767 - RNA, 16 nt, Escherichia coli CFT073
ucgccacggcaugaaa

SEQ ID NO: 2677768 - RNA, 19 nt, Escherichia coli CFT073
ucgccacggcaugaaagcg

SEQ ID NO: 2677769 - RNA, 17 nt, Escherichia coli CFT073
ucgccacugccagcaaa

SEQ ID NO: 2677770 - RNA, 21 nt, Escherichia coli CFT073
ucgccacugcgacaccagcau

SEQ ID NO: 2677771 - RNA, 22 nt, Escherichia coli CFT073
ucgccacugcgacaccagcaug

SEQ ID NO: 2677772 - RNA, 14 nt, Escherichia coli CFT073
ucgccacuuuauga

SEQ ID NO: 2677773 - RNA, 19 nt, Escherichia coli CFT073
ucgccagaaaguggcacac

SEQ ID NO: 2677774 - RNA, 14 nt, Escherichia coli CFT073
ucgccagaauaacg

SEQ ID NO: 2677775 - RNA, 14 nt, Escherichia coli CFT073
ucgccagaauagcg

SEQ ID NO: 2677776 - RNA, 19 nt, Escherichia coli CFT073
ucgccagaauauugccauu

SEQ ID NO: 2677777 - RNA, 17 nt, Escherichia coli CFT073
ucgccagacagugucug

SEQ ID NO: 2677778 - RNA, 20 nt, Escherichia coli CFT073
ucgccagacgcagcaaggcu

SEQ ID NO: 2677779 - RNA, 19 nt, Escherichia coli CFT073
ucgccagacguugauaacc

SEQ ID NO: 2677780 - RNA, 16 nt, Escherichia coli CFT073
ucgccagacucaccag

SEQ ID NO: 2677781 - RNA, 13 nt, Escherichia coli CFT073
ucgccagacucuu

SEQ ID NO: 2677782 - RNA, 11 nt, Escherichia coli CFT073
ucgccagcaaa

SEQ ID NO: 2677783 - RNA, 21 nt, Escherichia coli CFT073
ucgccagcaaauucuaagcug

SEQ ID NO: 2677784 - RNA, 11 nt, Escherichia coli CFT073
ucgccagcaau

SEQ ID NO: 2677785 - RNA, 16 nt, Escherichia coli CFT073
ucgccagcaauacaaa

SEQ ID NO: 2677786 - RNA, 20 nt, Escherichia coli CFT073
ucgccagcacuaccgcccga

SEQ ID NO: 2677787 - RNA, 18 nt, Escherichia coli CFT073
ucgccagcagcucacgca

SEQ ID NO: 2677788 - RNA, 22 nt, Escherichia coli CFT073
ucgccagccuaugcagguuggc

SEQ ID NO: 2677789 - RNA, 12 nt, Escherichia coli CFT073
ucgccagcggca

SEQ ID NO: 2677790 - RNA, 12 nt, Escherichia coli CFT073
ucgccagcucaa

SEQ ID NO: 2677791 - RNA, 13 nt, Escherichia coli CFT073
ucgccagcucaag

SEQ ID NO: 2677792 - RNA, 17 nt, Escherichia coli CFT073
ucgccagcuccagcgcu

SEQ ID NO: 2677793 - RNA, 14 nt, Escherichia coli CFT073
ucgccagcucugcg

SEQ ID NO: 2677794 - RNA, 18 nt, Escherichia coli CFT073
ucgccaguaccagcagcg

SEQ ID NO: 2677795 - RNA, 18 nt, Escherichia coli CFT073
ucgccauaaaacagcagu

SEQ ID NO: 2677796 - RNA, 21 nt, Escherichia coli CFT073
ucgccauaaacaccagcagca

SEQ ID NO: 2677797 - RNA, 22 nt, Escherichia coli CFT073
ucgccauaaacaccagcagcag

SEQ ID NO: 2677798 - RNA, 20 nt, Escherichia coli CFT073
ucgccauauuggggaugacg

SEQ ID NO: 2677799 - RNA, 15 nt, Escherichia coli CFT073
ucgccaucaaaggcu

SEQ ID NO: 2677800 - RNA, 19 nt, Escherichia coli CFT073
ucgcuaagcacgauaucaa

SEQ ID NO: 2677801 - RNA, 14 nt, Escherichia coli CFT073
ucgcuaaggaaauc

SEQ ID NO: 2677802 - RNA, 20 nt, Escherichia coli CFT073
ucgcuaaggaaaucgauaaa

SEQ ID NO: 2677803 - RNA, 17 nt, Escherichia coli CFT073
ucgcuacauaacgcagc

SEQ ID NO: 2677804 - RNA, 21 nt, Escherichia coli CFT073
ucgcuaccuaaugaauccagc

SEQ ID NO: 2677805 - RNA, 16 nt, Escherichia coli CFT073
ucgcuacgccuuccgu

SEQ ID NO: 2677806 - RNA, 16 nt, Escherichia coli CFT073
ucgcuaucagcgccac

SEQ ID NO: 2677807 - RNA, 21 nt, Escherichia coli CFT073
ucgcuaucaguccauggcaga

SEQ ID NO: 2677808 - RNA, 17 nt, Escherichia coli CFT073
ucgcucaauauccugac

SEQ ID NO: 2677809 - RNA, 13 nt, Escherichia coli CFT073
ucgcucacaucau

SEQ ID NO: 2677810 - RNA, 16 nt, Escherichia coli CFT073
ucgcucacggcggcag

SEQ ID NO: 2677811 - RNA, 16 nt, Escherichia coli CFT073
ucgcucaucugcugcg

SEQ ID NO: 2677812 - RNA, 13 nt, Escherichia coli CFT073
ucgcuccggcacg

SEQ ID NO: 2677813 - RNA, 22 nt, Escherichia coli CFT073
ucgcucgagagagaaaauaauc

SEQ ID NO: 2677814 - RNA, 15 nt, Escherichia coli CFT073
ucgcucguccgcgag

SEQ ID NO: 2677815 - RNA, 17 nt, Escherichia coli CFT073
ucgcucucuuucucgcu

SEQ ID NO: 2677816 - RNA, 22 nt, Escherichia coli CFT073
ucgcugaacgggccauccauca

SEQ ID NO: 2677817 - RNA, 17 nt, Escherichia coli CFT073
ucgcugacaucaacaau

SEQ ID NO: 2677818 - RNA, 15 nt, Escherichia coli CFT073
ucgcugacauuaccu

SEQ ID NO: 2677819 - RNA, 20 nt, Escherichia coli CFT073
ucgcugacgaucauuccgcc

SEQ ID NO: 2677820 - RNA, 22 nt, Escherichia coli CFT073
ucgcugacgaucauuccgccca

SEQ ID NO: 2677821 - RNA, 12 nt, Escherichia coli CFT073
ucgcugauauca

SEQ ID NO: 2677822 - RNA, 19 nt, Escherichia coli CFT073
ucgcugauauugcuccaga

SEQ ID NO: 2677823 - RNA, 19 nt, Escherichia coli CFT073
ucgcugcgaaguuuuuccg

SEQ ID NO: 2677824 - RNA, 15 nt, Escherichia coli CFT073
ucgcuggaauaaucg

SEQ ID NO: 2677825 - RNA, 12 nt, Escherichia coli CFT073
ucgcuggcagac

SEQ ID NO: 2677826 - RNA, 19 nt, Escherichia coli CFT073
ucgcuggccuccagcacuu

SEQ ID NO: 2677827 - RNA, 14 nt, Escherichia coli CFT073
ucgcuguaauucuu

SEQ ID NO: 2677828 - RNA, 16 nt, Escherichia coli CFT073
ucgcugugacauccag

SEQ ID NO: 2677829 - RNA, 18 nt, Escherichia coli CFT073
ucgcugugacauccagau

SEQ ID NO: 2677830 - RNA, 15 nt, Escherichia coli CFT073
ucgcugugcugcuga

SEQ ID NO: 2677831 - RNA, 15 nt, Escherichia coli CFT073
ucgcuguguucuggg

SEQ ID NO: 2677832 - RNA, 20 nt, Escherichia coli CFT073
ucgcuguucaucuggcggua

SEQ ID NO: 2677833 - RNA, 16 nt, Escherichia coli CFT073
ucgcuuaacaguucca

SEQ ID NO: 2677834 - RNA, 17 nt, Escherichia coli CFT073
ucgcuuaagccaucauc

SEQ ID NO: 2677835 - RNA, 20 nt, Escherichia coli CFT073
ucgcuuaauggaaaacuguu

SEQ ID NO: 2677836 - RNA, 11 nt, Escherichia coli CFT073
ucgcuucaacc

SEQ ID NO: 2677837 - RNA, 21 nt, Escherichia coli CFT073
ucgcuucacgcagguuuugcu

SEQ ID NO: 2677838 - RNA, 15 nt, Escherichia coli CFT073
ucgcuuccauugccu

SEQ ID NO: 2677839 - RNA, 18 nt, Escherichia coli CFT073
ucgcuucccaacgcagca

SEQ ID NO: 2677840 - RNA, 18 nt, Escherichia coli CFT073
ucgcuucgauucccagcu

SEQ ID NO: 2677841 - RNA, 22 nt, Escherichia coli CFT073
ucgcuucgcgaaucgccacaac

SEQ ID NO: 2677842 - RNA, 20 nt, Escherichia coli CFT073
ucgcuucuacgccaucaguu

SEQ ID NO: 2677843 - RNA, 13 nt, Escherichia coli CFT073
ucgcuucugguga

SEQ ID NO: 2677844 - RNA, 18 nt, Escherichia coli CFT073
ucgcuugcaggaucagcu

SEQ ID NO: 2677845 - RNA, 14 nt, Escherichia coli CFT073
ucgcuugccgccag

SEQ ID NO: 2677846 - RNA, 15 nt, Escherichia coli CFT073
ucgcuuucagauucg

SEQ ID NO: 2677847 - RNA, 21 nt, Escherichia coli CFT073
ucgcuuuccagucguuaugca

SEQ ID NO: 2677848 - RNA, 18 nt, Escherichia coli CFT073
ucgcuuucgcuuucucuu

SEQ ID NO: 2677849 - RNA, 12 nt, Escherichia coli CFT073
ucgcuuucucuu

SEQ ID NO: 2677850 - RNA, 19 nt, Escherichia coli CFT073
ucgcuuugacagcuuuuac

SEQ ID NO: 2677851 - RNA, 17 nt, Escherichia coli CFT073
ucgcuuugccaguaaua

SEQ ID NO: 2677852 - RNA, 20 nt, Escherichia coli CFT073
ucgcuuugccaguaauaacc

SEQ ID NO: 2677853 - RNA, 16 nt, Escherichia coli CFT073
ucgcuuugugcucuuc

SEQ ID NO: 2677854 - RNA, 18 nt, Escherichia coli CFT073
ucgcuuugugcucuuccu

SEQ ID NO: 2677855 - RNA, 18 nt, Escherichia coli CFT073
ucgcuuuuauuucugcuu

SEQ ID NO: 2677856 - RNA, 20 nt, Escherichia coli CFT073
ucgcuuuuucugcaucaacc

SEQ ID NO: 2677857 - RNA, 19 nt, Escherichia coli CFT073
ucggaaaacaaccgccaug

SEQ ID NO: 2677858 - RNA, 22 nt, Escherichia coli CFT073
ucggaacaguaaagcgcaaaau

SEQ ID NO: 2677859 - RNA, 20 nt, Escherichia coli CFT073
ucggaacaucgaugccgccu

SEQ ID NO: 2677860 - RNA, 20 nt, Escherichia coli CFT073
ucggaaucagcaguucacag

SEQ ID NO: 2677861 - RNA, 15 nt, Escherichia coli CFT073
ucggaaugcacagcc

SEQ ID NO: 2677862 - RNA, 18 nt, Escherichia coli CFT073
ucggacaaacacgcaauc

SEQ ID NO: 2677863 - RNA, 20 nt, Escherichia coli CFT073
ucggacaauaguuucaaugc

SEQ ID NO: 2677864 - RNA, 22 nt, Escherichia coli CFT073
ucggacggaagacguucaguuc

SEQ ID NO: 2677865 - RNA, 20 nt, Escherichia coli CFT073
ucggacguuugccaugcaua

SEQ ID NO: 2677866 - RNA, 20 nt, Escherichia coli CFT073
ucggacguuuucucguccag

SEQ ID NO: 2677867 - RNA, 18 nt, Escherichia coli CFT073
ucggauaaccaaucacgu

SEQ ID NO: 2677868 - RNA, 21 nt, Escherichia coli CFT073
ucggauaagacgcgccagcgu

SEQ ID NO: 2677869 - RNA, 15 nt, Escherichia coli CFT073
ucggauaaggcguuu

SEQ ID NO: 2677870 - RNA, 17 nt, Escherichia coli CFT073
ucggauaggcaccgcca

SEQ ID NO: 2677871 - RNA, 19 nt, Escherichia coli CFT073
ucggauaggcaccgccaaa

SEQ ID NO: 2677872 - RNA, 18 nt, Escherichia coli CFT073
ucggaucgaggcgauacg

SEQ ID NO: 2677873 - RNA, 17 nt, Escherichia coli CFT073
ucggaugcggcgcgagc

SEQ ID NO: 2677874 - RNA, 14 nt, Escherichia coli CFT073
ucggauguuagucu

SEQ ID NO: 2677875 - RNA, 14 nt, Escherichia coli CFT073
ucggcaaaaauaau

SEQ ID NO: 2677876 - RNA, 16 nt, Escherichia coli CFT073
ucggcaaaaauaaucu

SEQ ID NO: 2677877 - RNA, 14 nt, Escherichia coli CFT073
ucggcaaagcgcug

SEQ ID NO: 2677878 - RNA, 19 nt, Escherichia coli CFT073
ucggcaaagcgcugaagaa

SEQ ID NO: 2677879 - RNA, 18 nt, Escherichia coli CFT073
ucggcaacaccucagcca

SEQ ID NO: 2677880 - RNA, 16 nt, Escherichia coli CFT073
ucggcaacaucaaaua

SEQ ID NO: 2677881 - RNA, 17 nt, Escherichia coli CFT073
ucggcaacgccagcgaa

SEQ ID NO: 2677882 - RNA, 19 nt, Escherichia coli CFT073
ucggcaaggccaauacccg

SEQ ID NO: 2677883 - RNA, 17 nt, Escherichia coli CFT073
ucggcaauacuucaaca

SEQ ID NO: 2677884 - RNA, 14 nt, Escherichia coli CFT073
ucggcaaucacaac

SEQ ID NO: 2677885 - RNA, 18 nt, Escherichia coli CFT073
ucggcaauuuaccgccga

SEQ ID NO: 2677886 - RNA, 23 nt, Escherichia coli CFT073
ucggcacccaucgccagcacuuc

SEQ ID NO: 2677887 - RNA, 14 nt, Escherichia coli CFT073
ucggcaccgccagc

SEQ ID NO: 2677888 - RNA, 12 nt, Escherichia coli CFT073
ucggcaccgccg

SEQ ID NO: 2677889 - RNA, 16 nt, Escherichia coli CFT073
ucggcaccgccgccaa

SEQ ID NO: 2677890 - RNA, 16 nt, Escherichia coli CFT073
ucggcacgaccaggaa

SEQ ID NO: 2677891 - RNA, 20 nt, Escherichia coli CFT073
ucggcagaguugagcagucc

SEQ ID NO: 2677892 - RNA, 16 nt, Escherichia coli CFT073
ucggcagauaccacca

SEQ ID NO: 2677893 - RNA, 19 nt, Escherichia coli CFT073
ucggcagccugcgucgcca

SEQ ID NO: 2677894 - RNA, 17 nt, Escherichia coli CFT073
ucggcagcgccaaucgc

SEQ ID NO: 2677895 - RNA, 22 nt, Escherichia coli CFT073
ucggcaggaacagauacuggaa

SEQ ID NO: 2677896 - RNA, 19 nt, Escherichia coli CFT073
ucggcaggguauugcgcgc

SEQ ID NO: 2677897 - RNA, 15 nt, Escherichia coli CFT073
ucggcaguaaugguu

SEQ ID NO: 2677898 - RNA, 22 nt, Escherichia coli CFT073
ucggcaguaucggagauaacca

SEQ ID NO: 2677899 - RNA, 18 nt, Escherichia coli CFT073
ucggcauacagcgacaga

SEQ ID NO: 2677900 - RNA, 16 nt, Escherichia coli CFT073
ucggcauauaccguca

SEQ ID NO: 2677901 - RNA, 15 nt, Escherichia coli CFT073
ucggcauauuuaaaa

SEQ ID NO: 2677902 - RNA, 14 nt, Escherichia coli CFT073
ucggcaugaaucau

SEQ ID NO: 2677903 - RNA, 12 nt, Escherichia coli CFT073
ucggccaugggc

SEQ ID NO: 2677904 - RNA, 20 nt, Escherichia coli CFT073
ucggccaugugcuuuuccuc

SEQ ID NO: 2677905 - RNA, 18 nt, Escherichia coli CFT073
ucggcgaaacaauccagc

SEQ ID NO: 2677906 - RNA, 15 nt, Escherichia coli CFT073
ucggcgaccaguucg

SEQ ID NO: 2677907 - RNA, 13 nt, Escherichia coli CFT073
ucggcgcaaucgc

SEQ ID NO: 2677908 - RNA, 13 nt, Escherichia coli CFT073
aaaaaaacucauu

SEQ ID NO: 2677909 - RNA, 16 nt, Escherichia coli CFT073
aaaaaaauuaauuuuu

SEQ ID NO: 2677910 - RNA, 10 nt, Escherichia coli CFT073
aaaaaacagu

SEQ ID NO: 2677911 - RNA, 13 nt, Escherichia coli CFT073
aaaaaacgccaga

SEQ ID NO: 2677912 - RNA, 13 nt, Escherichia coli CFT073
aaaaaagccacgg

SEQ ID NO: 2677913 - RNA, 17 nt, Escherichia coli CFT073
aaaaaagccccgcagcc

SEQ ID NO: 2677914 - RNA, 12 nt, Escherichia coli CFT073
aaaaaagcuaua

SEQ ID NO: 2677915 - RNA, 10 nt, Escherichia coli CFT073
aaaaaaugca

SEQ ID NO: 2677916 - RNA, 23 nt, Escherichia coli CFT073
aaaaacaccccauugccccaugu

SEQ ID NO: 2677917 - RNA, 15 nt, Escherichia coli CFT073
aaaaacacucuucaa

SEQ ID NO: 2677918 - RNA, 12 nt, Escherichia coli CFT073
aaaaacagccag

SEQ ID NO: 2677919 - RNA, 16 nt, Escherichia coli CFT073
aaaaacagccagcagc

SEQ ID NO: 2677920 - RNA, 12 nt, Escherichia coli CFT073
aaaaacaucaua

SEQ ID NO: 2677921 - RNA, 12 nt, Escherichia coli CFT073
aaaaaccagaga

SEQ ID NO: 2677922 - RNA, 22 nt, Escherichia coli CFT073
aaaaaccagggugcguugaaga

SEQ ID NO: 2677923 - RNA, 17 nt, Escherichia coli CFT073
aaaaacccaucaaccuu

SEQ ID NO: 2677924 - RNA, 12 nt, Escherichia coli CFT073
aaaaacccugcc

SEQ ID NO: 2677925 - RNA, 13 nt, Escherichia coli CFT073
aaaaacccuucuu

SEQ ID NO: 2677926 - RNA, 22 nt, Escherichia coli CFT073
aaaaaccuaauacucuggcugg

SEQ ID NO: 2677927 - RNA, 19 nt, Escherichia coli CFT073
aaaaacgaaaguuaaucca

SEQ ID NO: 2677928 - RNA, 14 nt, Escherichia coli CFT073
aaaaacggaaagca

SEQ ID NO: 2677929 - RNA, 13 nt, Escherichia coli CFT073
aaaaacggaauuu

SEQ ID NO: 2677930 - RNA, 23 nt, Escherichia coli CFT073
aaaaacggcaacggcguuaagca

SEQ ID NO: 2677931 - RNA, 13 nt, Escherichia coli CFT073
aaaaacucaaaaa

SEQ ID NO: 2677932 - RNA, 19 nt, Escherichia coli CFT073
aaaaacucauuuuauaucu

SEQ ID NO: 2677933 - RNA, 19 nt, Escherichia coli CFT073
aaaaagccaauuacaaaaa

SEQ ID NO: 2677934 - RNA, 21 nt, Escherichia coli CFT073
aaaaagccaccaccucuucca

SEQ ID NO: 2677935 - RNA, 20 nt, Escherichia coli CFT073
aaaaagcggcagggaucuuc

SEQ ID NO: 2677936 - RNA, 22 nt, Escherichia coli CFT073
aaaaagcgucgccgucaaaagg

SEQ ID NO: 2677937 - RNA, 10 nt, Escherichia coli CFT073
aaaaagcuca

SEQ ID NO: 2677938 - RNA, 24 nt, Escherichia coli CFT073
aaaaagcuugucauuaccacaaca

SEQ ID NO: 2677939 - RNA, 16 nt, Escherichia coli CFT073
aaaaaggggaaaaauu

SEQ ID NO: 2677940 - RNA, 19 nt, Escherichia coli CFT073
aaaaaggggaaaaauucag

SEQ ID NO: 2677941 - RNA, 16 nt, Escherichia coli CFT073
aaaaagggugacagca

SEQ ID NO: 2677942 - RNA, 19 nt, Escherichia coli CFT073
aaaaaggugauuuauuucu

SEQ ID NO: 2677943 - RNA, 21 nt, Escherichia coli CFT073
aaaaagugcauauacaaccaa

SEQ ID NO: 2677944 - RNA, 11 nt, Escherichia coli CFT073
aaaaauaaaag

SEQ ID NO: 2677945 - RNA, 14 nt, Escherichia coli CFT073
aaaaauaaucaucu

SEQ ID NO: 2677946 - RNA, 14 nt, Escherichia coli CFT073
aaaaauaaugccac

SEQ ID NO: 2677947 - RNA, 16 nt, Escherichia coli CFT073
aaaaauaaugccacca

SEQ ID NO: 2677948 - RNA, 21 nt, Escherichia coli CFT073
aaaaauaccaccaauguggaa

SEQ ID NO: 2677949 - RNA, 16 nt, Escherichia coli CFT073
aaaaauaccgagcagc

SEQ ID NO: 2677950 - RNA, 17 nt, Escherichia coli CFT073
aaaaauacgcaucauau

SEQ ID NO: 2677951 - RNA, 21 nt, Escherichia coli CFT073
aaaaauaguuacuaucuucaa

SEQ ID NO: 2677952 - RNA, 13 nt, Escherichia coli CFT073
aaaaauauauucc

SEQ ID NO: 2677953 - RNA, 12 nt, Escherichia coli CFT073
aaaaaucaacag

SEQ ID NO: 2677954 - RNA, 21 nt, Escherichia coli CFT073
aaaaaucaccguacuccugug

SEQ ID NO: 2677955 - RNA, 12 nt, Escherichia coli CFT073
aaaaaucccagc

SEQ ID NO: 2677956 - RNA, 19 nt, Escherichia coli CFT073
aaaaaucgacaaaaucaga

SEQ ID NO: 2677957 - RNA, 19 nt, Escherichia coli CFT073
aaaaaugaugauugaccau

SEQ ID NO: 2677958 - RNA, 13 nt, Escherichia coli CFT073
aaaaaugcaagca

SEQ ID NO: 2677959 - RNA, 21 nt, Escherichia coli CFT073
aaaaaugcgcggucagaaaau

SEQ ID NO: 2677960 - RNA, 13 nt, Escherichia coli CFT073
aaaaaugguuugc

SEQ ID NO: 2677961 - RNA, 23 nt, Escherichia coli CFT073
aaaaauuaauuuuuuaauaaaaa

SEQ ID NO: 2677962 - RNA, 14 nt, Escherichia coli CFT073
aaaaauucagggga

SEQ ID NO: 2677963 - RNA, 23 nt, Escherichia coli CFT073
aaaaauugcgcaacuuuuucuug

SEQ ID NO: 2677964 - RNA, 21 nt, Escherichia coli CFT073
aaaacaaagaaugccauaaaa

SEQ ID NO: 2677965 - RNA, 16 nt, Escherichia coli CFT073
aaaacaagcagcugcc

SEQ ID NO: 2677966 - RNA, 23 nt, Escherichia coli CFT073
aaaacacaacgcuuucaacaacc

SEQ ID NO: 2677967 - RNA, 21 nt, Escherichia coli CFT073
aaaacacauuaaacuuaagau

SEQ ID NO: 2677968 - RNA, 16 nt, Escherichia coli CFT073
aaaacagaaacccauu

SEQ ID NO: 2677969 - RNA, 19 nt, Escherichia coli CFT073
aaaacagccagcagcgaau

SEQ ID NO: 2677970 - RNA, 14 nt, Escherichia coli CFT073
aaaacaguaccaga

SEQ ID NO: 2677971 - RNA, 18 nt, Escherichia coli CFT073
aaaacagugcuucuaaca

SEQ ID NO: 2677972 - RNA, 16 nt, Escherichia coli CFT073
aaaacauacuuucuca

SEQ ID NO: 2677973 - RNA, 22 nt, Escherichia coli CFT073
aaaacauguggauuaaauugcg

SEQ ID NO: 2677974 - RNA, 11 nt, Escherichia coli CFT073
aaaacauuacu

SEQ ID NO: 2677975 - RNA, 23 nt, Escherichia coli CFT073
aaaacauuacuaauuaauaauau

SEQ ID NO: 2677976 - RNA, 17 nt, Escherichia coli CFT073
aaaaccaaaaccggcuc

SEQ ID NO: 2677977 - RNA, 21 nt, Escherichia coli CFT073
aaaaccaaaccagccgccaac

SEQ ID NO: 2677978 - RNA, 11 nt, Escherichia coli CFT073
aaaaccaaugg

SEQ ID NO: 2677979 - RNA, 21 nt, Escherichia coli CFT073
aaaaccagaaagggaagaaca

SEQ ID NO: 2677980 - RNA, 22 nt, Escherichia coli CFT073
aaaaccagaaagggaagaacau

SEQ ID NO: 2677981 - RNA, 13 nt, Escherichia coli CFT073
aaaaccagagaau

SEQ ID NO: 2677982 - RNA, 14 nt, Escherichia coli CFT073
aaaaccauuagucu

SEQ ID NO: 2677983 - RNA, 23 nt, Escherichia coli CFT073
aaaacccaggcuuaauugcgcag

SEQ ID NO: 2677984 - RNA, 13 nt, Escherichia coli CFT073
aaaaccgaggagc

SEQ ID NO: 2677985 - RNA, 16 nt, Escherichia coli CFT073
aaaaccgaggagcaac

SEQ ID NO: 2677986 - RNA, 18 nt, Escherichia coli CFT073
aaaaccgguuuugguuaa

SEQ ID NO: 2677987 - RNA, 15 nt, Escherichia coli CFT073
aaaaccuaauacucu

SEQ ID NO: 2677988 - RNA, 21 nt, Escherichia coli CFT073
aaaaccugaccuagcaaacua

SEQ ID NO: 2677989 - RNA, 14 nt, Escherichia coli CFT073
aaaaccugucugga

SEQ ID NO: 2677990 - RNA, 21 nt, Escherichia coli CFT073
aaaacgaccaccuucaacguu

SEQ ID NO: 2677991 - RNA, 18 nt, Escherichia coli CFT073
aaaacgcauaccccauca

SEQ ID NO: 2677992 - RNA, 19 nt, Escherichia coli CFT073
aaaacgcccaaugcccaga

SEQ ID NO: 2677993 - RNA, 17 nt, Escherichia coli CFT073
aaaacgccgccagcuca

SEQ ID NO: 2677994 - RNA, 22 nt, Escherichia coli CFT073
aaaacgccggagagaaaaaucu

SEQ ID NO: 2677995 - RNA, 21 nt, Escherichia coli CFT073
aaaacgccucauccggccuac

SEQ ID NO: 2677996 - RNA, 13 nt, Escherichia coli CFT073
aaaacgccuuuca

SEQ ID NO: 2677997 - RNA, 19 nt, Escherichia coli CFT073
aaaacgcgagccuuuacga

SEQ ID NO: 2677998 - RNA, 16 nt, Escherichia coli CFT073
aaaacggaaagcaaca

SEQ ID NO: 2677999 - RNA, 22 nt, Escherichia coli CFT073
aaaacggauugcuuguucgaug

SEQ ID NO: 2678000 - RNA, 15 nt, Escherichia coli CFT073
aaaacggguacgaug

SEQ ID NO: 2678001 - RNA, 18 nt, Escherichia coli CFT073
aaaacgggucaccuucug

SEQ ID NO: 2678002 - RNA, 13 nt, Escherichia coli CFT073
aaaacggucauau

SEQ ID NO: 2678003 - RNA, 16 nt, Escherichia coli CFT073
aaaacgguccggcauc

SEQ ID NO: 2678004 - RNA, 18 nt, Escherichia coli CFT073
aaaacgguggccacagca

SEQ ID NO: 2678005 - RNA, 20 nt, Escherichia coli CFT073
aaaacgguggccacagcaag

SEQ ID NO: 2678006 - RNA, 23 nt, Escherichia coli CFT073
aaaacgguggccacagcaagcag

SEQ ID NO: 2678007 - RNA, 17 nt, Escherichia coli CFT073
aaaacguagcuuauugu

SEQ ID NO: 2678008 - RNA, 19 nt, Escherichia coli CFT073
aaaacguagcuuauuguac

SEQ ID NO: 2678009 - RNA, 13 nt, Escherichia coli CFT073
aaaacgugcagcu

SEQ ID NO: 2678010 - RNA, 16 nt, Escherichia coli CFT073
aaaacucaaaaaaaau

SEQ ID NO: 2678011 - RNA, 19 nt, Escherichia coli CFT073
aaaacucgccuuugucuuu

SEQ ID NO: 2678012 - RNA, 22 nt, Escherichia coli CFT073
aaaacucgucugauuucuuauu

SEQ ID NO: 2678013 - RNA, 20 nt, Escherichia coli CFT073
aaaacugggugaagacggcc

SEQ ID NO: 2678014 - RNA, 22 nt, Escherichia coli CFT073
aaaacuucauuugucucaaaac

SEQ ID NO: 2678015 - RNA, 20 nt, Escherichia coli CFT073
aaaagaaauaucccugaaua

SEQ ID NO: 2678016 - RNA, 12 nt, Escherichia coli CFT073
aaaagaacacaa

SEQ ID NO: 2678017 - RNA, 15 nt, Escherichia coli CFT073
aaaagaauaaauauc

SEQ ID NO: 2678018 - RNA, 17 nt, Escherichia coli CFT073
aaaagaaugacccauuu

SEQ ID NO: 2678019 - RNA, 22 nt, Escherichia coli CFT073
aaaagaaugcgcucaauauaac

SEQ ID NO: 2678020 - RNA, 17 nt, Escherichia coli CFT073
aaaagacuauauuaaag

SEQ ID NO: 2678021 - RNA, 16 nt, Escherichia coli CFT073
aaaagcacgccagaca

SEQ ID NO: 2678022 - RNA, 17 nt, Escherichia coli CFT073
aaaagcauagccccagc

SEQ ID NO: 2678023 - RNA, 22 nt, Escherichia coli CFT073
aaaagccaccaaccacaaccca

SEQ ID NO: 2678024 - RNA, 14 nt, Escherichia coli CFT073
aaaagcccuggcag

SEQ ID NO: 2678025 - RNA, 14 nt, Escherichia coli CFT073
aaaagccuaagaag

SEQ ID NO: 2678026 - RNA, 17 nt, Escherichia coli CFT073
aaaagccuaagaaguca

SEQ ID NO: 2678027 - RNA, 15 nt, Escherichia coli CFT073
aaaagcgaagcggca

SEQ ID NO: 2678028 - RNA, 19 nt, Escherichia coli CFT073
aaaagcgauauccgggcaa

SEQ ID NO: 2678029 - RNA, 22 nt, Escherichia coli CFT073
aaaagcgggcaguguuuagugg

SEQ ID NO: 2678030 - RNA, 22 nt, Escherichia coli CFT073
aaaagcuguaaggugaaagcaa

SEQ ID NO: 2678031 - RNA, 22 nt, Escherichia coli CFT073
aaaagcuugucauuaccacaac

SEQ ID NO: 2678032 - RNA, 17 nt, Escherichia coli CFT073
aaaaggaguuuuuccuu

SEQ ID NO: 2678033 - RNA, 14 nt, Escherichia coli CFT073
aaaagggaacccga

SEQ ID NO: 2678034 - RNA, 13 nt, Escherichia coli CFT073
aaaaggggaaaaa

SEQ ID NO: 2678035 - RNA, 15 nt, Escherichia coli CFT073
aaaagggugcaggag

SEQ ID NO: 2678036 - RNA, 17 nt, Escherichia coli CFT073
aaaaggucgccugucuu

SEQ ID NO: 2678037 - RNA, 14 nt, Escherichia coli CFT073
aaaaggugauuuau

SEQ ID NO: 2678038 - RNA, 15 nt, Escherichia coli CFT073
aaaaguaaucaaugc

SEQ ID NO: 2678039 - RNA, 16 nt, Escherichia coli CFT073
aaaaguagcgcagcag

SEQ ID NO: 2678040 - RNA, 17 nt, Escherichia coli CFT073
aaaaguaguuccagcau

SEQ ID NO: 2678041 - RNA, 21 nt, Escherichia coli CFT073
aaaaguauggacgugcucugg

SEQ ID NO: 2678042 - RNA, 19 nt, Escherichia coli CFT073
aaaagugaaugucggcggc

SEQ ID NO: 2678043 - RNA, 14 nt, Escherichia coli CFT073
aaaaguuauuaaaa

SEQ ID NO: 2678044 - RNA, 21 nt, Escherichia coli CFT073
aaaaguuuauuacucagcgca

SEQ ID NO: 2678045 - RNA, 21 nt, Escherichia coli CFT073
aaaaguuuccuguuucucauu

SEQ ID NO: 2678046 - RNA, 24 nt, Escherichia coli CFT073
aaaaguuugaucggagaacaggaa

SEQ ID NO: 2678047 - RNA, 13 nt, Escherichia coli CFT073
aaaauaacguagu

SEQ ID NO: 2678048 - RNA, 13 nt, Escherichia coli CFT073
aaaauaaucucac

SEQ ID NO: 2678049 - RNA, 18 nt, Escherichia coli CFT073
aaaauaaucuguugauuu

SEQ ID NO: 2678050 - RNA, 15 nt, Escherichia coli CFT073
aaaauacaaacgcca

SEQ ID NO: 2678051 - RNA, 12 nt, Escherichia coli CFT073
aaaauacaugac

SEQ ID NO: 2678052 - RNA, 12 nt, Escherichia coli CFT073
aaaauaccaaua

SEQ ID NO: 2678053 - RNA, 15 nt, Escherichia coli CFT073
aaaauaccagcaauu

SEQ ID NO: 2678054 - RNA, 14 nt, Escherichia coli CFT073
aaaauaccgagcag

SEQ ID NO: 2678055 - RNA, 16 nt, Escherichia coli CFT073
aaaauaccgagcagcc

SEQ ID NO: 2678056 - RNA, 19 nt, Escherichia coli CFT073
aaaauaccgagcagccacu

SEQ ID NO: 2678057 - RNA, 18 nt, Escherichia coli CFT073
aaaauacguuuucaccuc

SEQ ID NO: 2678058 - RNA, 23 nt, Escherichia coli CFT073
aaaauacguuuucaccucugucg

SEQ ID NO: 2678059 - RNA, 15 nt, Escherichia coli CFT073
aaaauacucagcacc

SEQ ID NO: 2678060 - RNA, 11 nt, Escherichia coli CFT073
aaaauacuggc

SEQ ID NO: 2678061 - RNA, 12 nt, Escherichia coli CFT073
aaaauagaaauu

SEQ ID NO: 2678062 - RNA, 17 nt, Escherichia coli CFT073
aaaauagaaauuuagua

SEQ ID NO: 2678063 - RNA, 16 nt, Escherichia coli CFT073
aaaauagcaaaguagu

SEQ ID NO: 2678064 - RNA, 13 nt, Escherichia coli CFT073
aaaauagcauaau

SEQ ID NO: 2678065 - RNA, 20 nt, Escherichia coli CFT073
aaaauauaagguucuuuagc

SEQ ID NO: 2678066 - RNA, 22 nt, Escherichia coli CFT073
aaaauaucguaggccugcucaa

SEQ ID NO: 2678067 - RNA, 13 nt, Escherichia coli CFT073
aaaauauggggca

SEQ ID NO: 2678068 - RNA, 14 nt, Escherichia coli CFT073
aaaauauucccguc

SEQ ID NO: 2678069 - RNA, 15 nt, Escherichia coli CFT073
aaaaucaaaaacucu

SEQ ID NO: 2678070 - RNA, 15 nt, Escherichia coli CFT073
aaaaucaaacagaau

SEQ ID NO: 2678071 - RNA, 15 nt, Escherichia coli CFT073
aaaaucaaaguuagu

SEQ ID NO: 2678072 - RNA, 19 nt, Escherichia coli CFT073
aaaaucaaaguuaguaaaa

SEQ ID NO: 2678073 - RNA, 13 nt, Escherichia coli CFT073
aaaaucaacgaca

SEQ ID NO: 2678074 - RNA, 15 nt, Escherichia coli CFT073
aaaaucaacgccgca

SEQ ID NO: 2678075 - RNA, 14 nt, Escherichia coli CFT073
aaaaucaauguaac

SEQ ID NO: 2678076 - RNA, 18 nt, Escherichia coli CFT073
aaaaucaccgcgaccaga

SEQ ID NO: 2678077 - RNA, 13 nt, Escherichia coli CFT073
aaaaucacucgcc

SEQ ID NO: 2678078 - RNA, 20 nt, Escherichia coli CFT073
aaaaucagaaucgcgcccca

SEQ ID NO: 2678079 - RNA, 13 nt, Escherichia coli CFT073
aaaaucagcauca

SEQ ID NO: 2678080 - RNA, 20 nt, Escherichia coli CFT073
aaaaucagccauacggucug

SEQ ID NO: 2678081 - RNA, 17 nt, Escherichia coli CFT073
aaaaucagcuuccuugc

SEQ ID NO: 2678082 - RNA, 22 nt, Escherichia coli CFT073
aaaaucaucugccgguuccagc

SEQ ID NO: 2678083 - RNA, 17 nt, Escherichia coli CFT073
aaaaucaugcaaauuca

SEQ ID NO: 2678084 - RNA, 21 nt, Escherichia coli CFT073
aaaauccacuuaagaagguag

SEQ ID NO: 2678085 - RNA, 14 nt, Escherichia coli CFT073
aaaauccagcagaa

SEQ ID NO: 2678086 - RNA, 22 nt, Escherichia coli CFT073
aaaaucccauaagugcgucauu

SEQ ID NO: 2678087 - RNA, 14 nt, Escherichia coli CFT073
aaaaucccggcaac

SEQ ID NO: 2678088 - RNA, 18 nt, Escherichia coli CFT073
aaaaucccggugaccguc

SEQ ID NO: 2678089 - RNA, 21 nt, Escherichia coli CFT073
aaaauccucaacgccgcacag

SEQ ID NO: 2678090 - RNA, 23 nt, Escherichia coli CFT073
aaaauccucaaucggaaaacaac

SEQ ID NO: 2678091 - RNA, 17 nt, Escherichia coli CFT073
aaaauccugccagcgug

SEQ ID NO: 2678092 - RNA, 16 nt, Escherichia coli CFT073
aaaaucgacagcagga

SEQ ID NO: 2678093 - RNA, 17 nt, Escherichia coli CFT073
aaaaucgacaucugcaa

SEQ ID NO: 2678094 - RNA, 20 nt, Escherichia coli CFT073
aaaaucgccugaacaccaga

SEQ ID NO: 2678095 - RNA, 21 nt, Escherichia coli CFT073
aaaaucgccugaacaccagaa

SEQ ID NO: 2678096 - RNA, 12 nt, Escherichia coli CFT073
aaaaucggcaac

SEQ ID NO: 2678097 - RNA, 15 nt, Escherichia coli CFT073
aaaaucggcuuucaa

SEQ ID NO: 2678098 - RNA, 16 nt, Escherichia coli CFT073
aaaaucguaagcagga

SEQ ID NO: 2678099 - RNA, 17 nt, Escherichia coli CFT073
aaaaucucucguauuuc

SEQ ID NO: 2678100 - RNA, 22 nt, Escherichia coli CFT073
aaaaucugcgggaacauaugca

SEQ ID NO: 2678101 - RNA, 22 nt, Escherichia coli CFT073
aaaaucuguacaggacgcaaug

SEQ ID NO: 2678102 - RNA, 21 nt, Escherichia coli CFT073
aaaaucuucguuaucccaggc

SEQ ID NO: 2678103 - RNA, 20 nt, Escherichia coli CFT073
aaaaucuuucagaguuguac

SEQ ID NO: 2678104 - RNA, 16 nt, Escherichia coli CFT073
aaaaucuuugaaauaa

SEQ ID NO: 2678105 - RNA, 13 nt, Escherichia coli CFT073
aaaaugcaagcau

SEQ ID NO: 2678106 - RNA, 13 nt, Escherichia coli CFT073
aaaaugccacugc

SEQ ID NO: 2678107 - RNA, 16 nt, Escherichia coli CFT073
aaaaugccagcaacug

SEQ ID NO: 2678108 - RNA, 19 nt, Escherichia coli CFT073
aaaaugccagcaacuggcu

SEQ ID NO: 2678109 - RNA, 14 nt, Escherichia coli CFT073
aaaaugccagccuu

SEQ ID NO: 2678110 - RNA, 16 nt, Escherichia coli CFT073
aaaaugccgcacauca

SEQ ID NO: 2678111 - RNA, 16 nt, Escherichia coli CFT073
aaaaugcgaaaaaaac

SEQ ID NO: 2678112 - RNA, 14 nt, Escherichia coli CFT073
aaaaugcgcaugau

SEQ ID NO: 2678113 - RNA, 16 nt, Escherichia coli CFT073
aaaaugcugcaauugc

SEQ ID NO: 2678114 - RNA, 22 nt, Escherichia coli CFT073
aaaauggagagaaccagcgcac

SEQ ID NO: 2678115 - RNA, 24 nt, Escherichia coli CFT073
aaaauggcguuuccuuccagaaac

SEQ ID NO: 2678116 - RNA, 17 nt, Escherichia coli CFT073
aaaauggggacaucaaa

SEQ ID NO: 2678117 - RNA, 22 nt, Escherichia coli CFT073
aaaauggggacaucaaagaaaa

SEQ ID NO: 2678118 - RNA, 23 nt, Escherichia coli CFT073
aaaauggggacaucaaagaaaag

SEQ ID NO: 2678119 - RNA, 23 nt, Escherichia coli CFT073
aaaaugguacucggcacguuacu

SEQ ID NO: 2678120 - RNA, 19 nt, Escherichia coli CFT073
aaaaugguuugccagcaga

SEQ ID NO: 2678121 - RNA, 20 nt, Escherichia coli CFT073
aaaauguauuucaucaucag

SEQ ID NO: 2678122 - RNA, 21 nt, Escherichia coli CFT073
aaaaugucaccuaauuuaaaa

SEQ ID NO: 2678123 - RNA, 12 nt, Escherichia coli CFT073
aaaauguugcgc

SEQ ID NO: 2678124 - RNA, 23 nt, Escherichia coli CFT073
aaaauguuuacgccugguugagu

SEQ ID NO: 2678125 - RNA, 18 nt, Escherichia coli CFT073
aaaauuacgaaagcaaaa

SEQ ID NO: 2678126 - RNA, 15 nt, Escherichia coli CFT073
aaaauuacgaauucc

SEQ ID NO: 2678127 - RNA, 22 nt, Escherichia coli CFT073
aaaauuacucucgugccagagc

SEQ ID NO: 2678128 - RNA, 19 nt, Escherichia coli CFT073
aaaauuacuuuccgccauu

SEQ ID NO: 2678129 - RNA, 18 nt, Escherichia coli CFT073
aaaauucauaaagcuauu

SEQ ID NO: 2678130 - RNA, 13 nt, Escherichia coli CFT073
aaaauucaucaaa

SEQ ID NO: 2678131 - RNA, 13 nt, Escherichia coli CFT073
aaaauucgcgcag

SEQ ID NO: 2678132 - RNA, 14 nt, Escherichia coli CFT073
aaaauugccgcuau

SEQ ID NO: 2678133 - RNA, 19 nt, Escherichia coli CFT073
aaaauuguaguguugcagu

SEQ ID NO: 2678134 - RNA, 16 nt, Escherichia coli CFT073
aaaauuuaacauuacu

SEQ ID NO: 2678135 - RNA, 10 nt, Escherichia coli CFT073
aaaauuucau

SEQ ID NO: 2678136 - RNA, 20 nt, Escherichia coli CFT073
aaaauuucccccacagcucu

SEQ ID NO: 2678137 - RNA, 16 nt, Escherichia coli CFT073
aaaauuucuaucauca

SEQ ID NO: 2678138 - RNA, 22 nt, Escherichia coli CFT073
aaaauuucucccgcuaacugau

SEQ ID NO: 2678139 - RNA, 13 nt, Escherichia coli CFT073
aaaauuuggauuu

SEQ ID NO: 2678140 - RNA, 17 nt, Escherichia coli CFT073
aaaauuuggauuuuugc

SEQ ID NO: 2678141 - RNA, 22 nt, Escherichia coli CFT073
aaaauuuuauccgcaaagauuu

SEQ ID NO: 2678142 - RNA, 14 nt, Escherichia coli CFT073
aaacaaaaaaccua

SEQ ID NO: 2678143 - RNA, 15 nt, Escherichia coli CFT073
aaacaaagcgcacgu

SEQ ID NO: 2678144 - RNA, 15 nt, Escherichia coli CFT073
aaacaaaugaaauau

SEQ ID NO: 2678145 - RNA, 23 nt, Escherichia coli CFT073
aaacaaauuuugaacagaacugg

SEQ ID NO: 2678146 - RNA, 13 nt, Escherichia coli CFT073
aaacaacgccaca

SEQ ID NO: 2678147 - RNA, 22 nt, Escherichia coli CFT073
aaacaaguucuucgaagcacuc

SEQ ID NO: 2678148 - RNA, 12 nt, Escherichia coli CFT073
aaacaauaauug

SEQ ID NO: 2678149 - RNA, 13 nt, Escherichia coli CFT073
aaacaauacgauc

SEQ ID NO: 2678150 - RNA, 17 nt, Escherichia coli CFT073
aaacaauggcauaaccg

SEQ ID NO: 2678151 - RNA, 13 nt, Escherichia coli CFT073
aaacaauuacgcc

SEQ ID NO: 2678152 - RNA, 17 nt, Escherichia coli CFT073
aaacaauugcauaucaa

SEQ ID NO: 2678153 - RNA, 13 nt, Escherichia coli CFT073
aaacaccagcagc

SEQ ID NO: 2678154 - RNA, 14 nt, Escherichia coli CFT073
aaacaccagcagca

SEQ ID NO: 2678155 - RNA, 13 nt, Escherichia coli CFT073
aaacaccagcagu

SEQ ID NO: 2678156 - RNA, 13 nt, Escherichia coli CFT073
aaacaccaggcua

SEQ ID NO: 2678157 - RNA, 13 nt, Escherichia coli CFT073
aaacaccgaaccg

SEQ ID NO: 2678158 - RNA, 19 nt, Escherichia coli CFT073
aaacaccgcuucaacagcg

SEQ ID NO: 2678159 - RNA, 16 nt, Escherichia coli CFT073
aaacaccguaccauca

SEQ ID NO: 2678160 - RNA, 17 nt, Escherichia coli CFT073
aaacaccguaccaucau

SEQ ID NO: 2678161 - RNA, 15 nt, Escherichia coli CFT073
aaacacgacaugacc

SEQ ID NO: 2678162 - RNA, 19 nt, Escherichia coli CFT073
aaacacgaucuucugccaa

SEQ ID NO: 2678163 - RNA, 23 nt, Escherichia coli CFT073
aaacacgauucguauaauuuauu

SEQ ID NO: 2678164 - RNA, 13 nt, Escherichia coli CFT073
aaacacgcucagg

SEQ ID NO: 2678165 - RNA, 23 nt, Escherichia coli CFT073
aaacacggcgaacauucccgguu

SEQ ID NO: 2678166 - RNA, 23 nt, Escherichia coli CFT073
aaacacucuucaacacacugaau

SEQ ID NO: 2678167 - RNA, 20 nt, Escherichia coli CFT073
aaacacugcuuuuaaaugcc

SEQ ID NO: 2678168 - RNA, 21 nt, Escherichia coli CFT073
aaacacugcuuuuaaaugccc

SEQ ID NO: 2678169 - RNA, 14 nt, Escherichia coli CFT073
aaacacuugcggca

SEQ ID NO: 2678170 - RNA, 17 nt, Escherichia coli CFT073
aaacacuugcggcaccc

SEQ ID NO: 2678171 - RNA, 18 nt, Escherichia coli CFT073
aaacagaaauagagaaag

SEQ ID NO: 2678172 - RNA, 18 nt, Escherichia coli CFT073
aaacagagauucgcuggc

SEQ ID NO: 2678173 - RNA, 23 nt, Escherichia coli CFT073
aaacagagcugcaaaaguaccau

SEQ ID NO: 2678174 - RNA, 13 nt, Escherichia coli CFT073
aaacagaguagaa

SEQ ID NO: 2678175 - RNA, 17 nt, Escherichia coli CFT073
aaacagaguagaaauau

SEQ ID NO: 2678176 - RNA, 16 nt, Escherichia coli CFT073
aaacagaguauaaaaa

SEQ ID NO: 2678177 - RNA, 17 nt, Escherichia coli CFT073
aaacagaguauaaaaaa

SEQ ID NO: 2678178 - RNA, 17 nt, Escherichia coli CFT073
aaacagcacaucuccca

SEQ ID NO: 2678179 - RNA, 15 nt, Escherichia coli CFT073
aaacagcagauggca

SEQ ID NO: 2678180 - RNA, 13 nt, Escherichia coli CFT073
aaacagcaggcag

SEQ ID NO: 2678181 - RNA, 13 nt, Escherichia coli CFT073
aaacagccagcag

SEQ ID NO: 2678182 - RNA, 15 nt, Escherichia coli CFT073
aaacagccagcagcg

SEQ ID NO: 2678183 - RNA, 20 nt, Escherichia coli CFT073
aaacagccagcagcgaauca

SEQ ID NO: 2678184 - RNA, 23 nt, Escherichia coli CFT073
aaacagccuuguauuaauaccag

SEQ ID NO: 2678185 - RNA, 18 nt, Escherichia coli CFT073
aaacagcgacaccagcca

SEQ ID NO: 2678186 - RNA, 19 nt, Escherichia coli CFT073
aaacagcgagaacaccgaa

SEQ ID NO: 2678187 - RNA, 21 nt, Escherichia coli CFT073
aaacagcgccugcaaaauaau

SEQ ID NO: 2678188 - RNA, 16 nt, Escherichia coli CFT073
aaacagcguauaaacc

SEQ ID NO: 2678189 - RNA, 21 nt, Escherichia coli CFT073
aaacaggaauucggcaucgcg

SEQ ID NO: 2678190 - RNA, 21 nt, Escherichia coli CFT073
aaacaggcggcgcguccgguu

SEQ ID NO: 2678191 - RNA, 22 nt, Escherichia coli CFT073
aaacagguggcguuugccaccu

SEQ ID NO: 2678192 - RNA, 17 nt, Escherichia coli CFT073
aaacagguuauugaccg

SEQ ID NO: 2678193 - RNA, 11 nt, Escherichia coli CFT073
aaacaguaagu

SEQ ID NO: 2678194 - RNA, 22 nt, Escherichia coli CFT073
aaacagucacuuucgagcaauu

SEQ ID NO: 2678195 - RNA, 22 nt, Escherichia coli CFT073
aaacagugaccaucuuccagca

SEQ ID NO: 2678196 - RNA, 21 nt, Escherichia coli CFT073
aaacagugcccauacccgaug

SEQ ID NO: 2678197 - RNA, 15 nt, Escherichia coli CFT073
aaacaguucugcagc

SEQ ID NO: 2678198 - RNA, 17 nt, Escherichia coli CFT073
aaacauaaagccugaua

SEQ ID NO: 2678199 - RNA, 11 nt, Escherichia coli CFT073
aaacauacaca

SEQ ID NO: 2678200 - RNA, 20 nt, Escherichia coli CFT073
aaacauacccacgaaaucuu

SEQ ID NO: 2678201 - RNA, 14 nt, Escherichia coli CFT073
aaacauacuuucuc

SEQ ID NO: 2678202 - RNA, 16 nt, Escherichia coli CFT073
aaacauacuuucucau

SEQ ID NO: 2678203 - RNA, 19 nt, Escherichia coli CFT073
aaacauaucacuuuuauau

SEQ ID NO: 2678204 - RNA, 14 nt, Escherichia coli CFT073
aaacaucaaaaggu

SEQ ID NO: 2678205 - RNA, 15 nt, Escherichia coli CFT073
aaacaucccugaacc

SEQ ID NO: 2678206 - RNA, 21 nt, Escherichia coli CFT073
aaacauccgguuucaucagcc

SEQ ID NO: 2678207 - RNA, 18 nt, Escherichia coli CFT073
aaacaucgccauaaacac

SEQ ID NO: 2678208 - RNA, 23 nt, Escherichia coli CFT073
aaacaucggcuuauucauaucaa

SEQ ID NO: 2678209 - RNA, 17 nt, Escherichia coli CFT073
aaacaucgggacaugau

SEQ ID NO: 2678210 - RNA, 18 nt, Escherichia coli CFT073
aaacaucgggauaucgcc

SEQ ID NO: 2678211 - RNA, 23 nt, Escherichia coli CFT073
aaacaucguugauuucaccaucu

SEQ ID NO: 2678212 - RNA, 16 nt, Escherichia coli CFT073
aaacaucuuccacaug

SEQ ID NO: 2678213 - RNA, 23 nt, Escherichia coli CFT073
aaacaucuucuuaggcauugccg

SEQ ID NO: 2678214 - RNA, 20 nt, Escherichia coli CFT073
aaacauggagaguuuucaug

SEQ ID NO: 2678215 - RNA, 22 nt, Escherichia coli CFT073
aaacauggcacugcgaucccgg

SEQ ID NO: 2678216 - RNA, 19 nt, Escherichia coli CFT073
aaacauuauugagaaacag

SEQ ID NO: 2678217 - RNA, 22 nt, Escherichia coli CFT073
aaacauuauugagaaacagaaa

SEQ ID NO: 2678218 - RNA, 15 nt, Escherichia coli CFT073
aaacauugcugccag

SEQ ID NO: 2678219 - RNA, 21 nt, Escherichia coli CFT073
aaacauuucacguucacguaa

SEQ ID NO: 2678220 - RNA, 20 nt, Escherichia coli CFT073
aaaccaaaaccgcucgcgcu

SEQ ID NO: 2678221 - RNA, 18 nt, Escherichia coli CFT073
aaaccaaaaccggcucua

SEQ ID NO: 2678222 - RNA, 20 nt, Escherichia coli CFT073
aaaccaaacuuaugcagcug

SEQ ID NO: 2678223 - RNA, 21 nt, Escherichia coli CFT073
aaaccaacuccaguggcgcau

SEQ ID NO: 2678224 - RNA, 15 nt, Escherichia coli CFT073
aaaccaauaaagaac

SEQ ID NO: 2678225 - RNA, 19 nt, Escherichia coli CFT073
aaaccaauggucgugguaa

SEQ ID NO: 2678226 - RNA, 21 nt, Escherichia coli CFT073
aaaccacaccgccuaccgcca

SEQ ID NO: 2678227 - RNA, 22 nt, Escherichia coli CFT073
aaaccacacuucuucagccagu

SEQ ID NO: 2678228 - RNA, 14 nt, Escherichia coli CFT073
aaaccacaucagcg

SEQ ID NO: 2678229 - RNA, 17 nt, Escherichia coli CFT073
aaaccacaucagcgaac

SEQ ID NO: 2678230 - RNA, 18 nt, Escherichia coli CFT073
aaaccaccagucagaaug

SEQ ID NO: 2678231 - RNA, 16 nt, Escherichia coli CFT073
aaaccacccaccagcg

SEQ ID NO: 2678232 - RNA, 18 nt, Escherichia coli CFT073
aaaccacccaccagcgcc

SEQ ID NO: 2678233 - RNA, 14 nt, Escherichia coli CFT073
aaaccacugacaca

SEQ ID NO: 2678234 - RNA, 19 nt, Escherichia coli CFT073
aaaccacugauaagcugag

SEQ ID NO: 2678235 - RNA, 18 nt, Escherichia coli CFT073
aaaccacuuaacguuacc

SEQ ID NO: 2678236 - RNA, 15 nt, Escherichia coli CFT073
aaaccagaaagggaa

SEQ ID NO: 2678237 - RNA, 21 nt, Escherichia coli CFT073
aaaccagaaagggaagaacau

SEQ ID NO: 2678238 - RNA, 22 nt, Escherichia coli CFT073
aaaccagauaauaaaaaaggca

SEQ ID NO: 2678239 - RNA, 11 nt, Escherichia coli CFT073
aaaccagcagc

SEQ ID NO: 2678240 - RNA, 19 nt, Escherichia coli CFT073
aaaccagccgccaacucca

SEQ ID NO: 2678241 - RNA, 12 nt, Escherichia coli CFT073
aaaccagcgcau

SEQ ID NO: 2678242 - RNA, 13 nt, Escherichia coli CFT073
aaaccaguacuga

SEQ ID NO: 2678243 - RNA, 19 nt, Escherichia coli CFT073
aaaccauagaauacgccac

SEQ ID NO: 2678244 - RNA, 20 nt, Escherichia coli CFT073
aaaccauagaauacgccacg

SEQ ID NO: 2678245 - RNA, 20 nt, Escherichia coli CFT073
aaaccaucaccuaaagcuau

SEQ ID NO: 2678246 - RNA, 14 nt, Escherichia coli CFT073
aaaccauuuugcug

SEQ ID NO: 2678247 - RNA, 11 nt, Escherichia coli CFT073
aaacccagccg

SEQ ID NO: 2678248 - RNA, 14 nt, Escherichia coli CFT073
aaaccccgacaucg

SEQ ID NO: 2678249 - RNA, 23 nt, Escherichia coli CFT073
aaaccccgguuguuacugauuaa

SEQ ID NO: 2678250 - RNA, 14 nt, Escherichia coli CFT073
aaacccgcugauua

SEQ ID NO: 2678251 - RNA, 16 nt, Escherichia coli CFT073
aaacccggccacagcg

SEQ ID NO: 2678252 - RNA, 22 nt, Escherichia coli CFT073
aaacccuauuuuuggaggugaa

SEQ ID NO: 2678253 - RNA, 13 nt, Escherichia coli CFT073
aaacccugcgcau

SEQ ID NO: 2678254 - RNA, 18 nt, Escherichia coli CFT073
aaacccuuucugcugcuu

SEQ ID NO: 2678255 - RNA, 13 nt, Escherichia coli CFT073
aaaccgacugccu

SEQ ID NO: 2678256 - RNA, 14 nt, Escherichia coli CFT073
aaaccgacuuaaaa

SEQ ID NO: 2678257 - RNA, 17 nt, Escherichia coli CFT073
aaaccgagauaaaugcc

SEQ ID NO: 2678258 - RNA, 17 nt, Escherichia coli CFT073
aaaccgagccaaacgcc

SEQ ID NO: 2678259 - RNA, 13 nt, Escherichia coli CFT073
aaaccgcacucac

SEQ ID NO: 2678260 - RNA, 16 nt, Escherichia coli CFT073
aaaccgcaucauguaa

SEQ ID NO: 2678261 - RNA, 20 nt, Escherichia coli CFT073
aaaccgcaucauguaaauca

SEQ ID NO: 2678262 - RNA, 17 nt, Escherichia coli CFT073
aaaccgcccagcagcgc

SEQ ID NO: 2678263 - RNA, 20 nt, Escherichia coli CFT073
aaaccgcgccaugucugcau

SEQ ID NO: 2678264 - RNA, 23 nt, Escherichia coli CFT073
aaaccgguuuguaggccggauaa

SEQ ID NO: 2678265 - RNA, 18 nt, Escherichia coli CFT073
aaaccgguuuugguuaac

SEQ ID NO: 2678266 - RNA, 18 nt, Escherichia coli CFT073
aaaccguaaagcacuggu

SEQ ID NO: 2678267 - RNA, 22 nt, Escherichia coli CFT073
aaaccguaaagcacugguggaa

SEQ ID NO: 2678268 - RNA, 14 nt, Escherichia coli CFT073
aaaccguauucauc

SEQ ID NO: 2678269 - RNA, 20 nt, Escherichia coli CFT073
aaaccguauucaucgccauu

SEQ ID NO: 2678270 - RNA, 17 nt, Escherichia coli CFT073
aaaccguggcaaaaucc

SEQ ID NO: 2678271 - RNA, 19 nt, Escherichia coli CFT073
aaaccguguuuaugaaagu

SEQ ID NO: 2678272 - RNA, 16 nt, Escherichia coli CFT073
aaaccguuaucaccag

SEQ ID NO: 2678273 - RNA, 14 nt, Escherichia coli CFT073
aaaccuaacaaggc

SEQ ID NO: 2678274 - RNA, 17 nt, Escherichia coli CFT073
aaaccuccagcaucaga

SEQ ID NO: 2678275 - RNA, 19 nt, Escherichia coli CFT073
aaaccugacgcugcucagg

SEQ ID NO: 2678276 - RNA, 16 nt, Escherichia coli CFT073
aaaccugccaacgaac

SEQ ID NO: 2678277 - RNA, 15 nt, Escherichia coli CFT073
aaaccuuacgccauc

SEQ ID NO: 2678278 - RNA, 15 nt, Escherichia coli CFT073
aaaccuuucgccacc

SEQ ID NO: 2678279 - RNA, 15 nt, Escherichia coli CFT073
aaacgaaaguuaauc

SEQ ID NO: 2678280 - RNA, 15 nt, Escherichia coli CFT073
aaacgaagcggcugc

SEQ ID NO: 2678281 - RNA, 13 nt, Escherichia coli CFT073
aaacgaaucugca

SEQ ID NO: 2678282 - RNA, 23 nt, Escherichia coli CFT073
aaacgacccugccacaguuuuuc

SEQ ID NO: 2678283 - RNA, 21 nt, Escherichia coli CFT073
aaacgaccgcgggacaaauaa

SEQ ID NO: 2678284 - RNA, 18 nt, Escherichia coli CFT073
aaacgagccauaaaauca

SEQ ID NO: 2678285 - RNA, 14 nt, Escherichia coli CFT073
aaacgauaaauaac

SEQ ID NO: 2678286 - RNA, 14 nt, Escherichia coli CFT073
aaacgauaauacgu

SEQ ID NO: 2678287 - RNA, 19 nt, Escherichia coli CFT073
aaacgauauccugcugaga

SEQ ID NO: 2678288 - RNA, 18 nt, Escherichia coli CFT073
aaacgauuaucaacacau

SEQ ID NO: 2678289 - RNA, 12 nt, Escherichia coli CFT073
aaacgauucggc

SEQ ID NO: 2678290 - RNA, 14 nt, Escherichia coli CFT073
aaacgcaaaacugc

SEQ ID NO: 2678291 - RNA, 15 nt, Escherichia coli CFT073
aaacgcaaaacugcc

SEQ ID NO: 2678292 - RNA, 15 nt, Escherichia coli CFT073
aaacgcaaaauugcc

SEQ ID NO: 2678293 - RNA, 15 nt, Escherichia coli CFT073
aaacgcauaucuucu

SEQ ID NO: 2678294 - RNA, 18 nt, Escherichia coli CFT073
aaacgccaccuguuucuu

SEQ ID NO: 2678295 - RNA, 21 nt, Escherichia coli CFT073
aaacgccagaaucaaacugcc

SEQ ID NO: 2678296 - RNA, 13 nt, Escherichia coli CFT073
aaacgccagcagc

SEQ ID NO: 2678297 - RNA, 15 nt, Escherichia coli CFT073
aaacgcccccaaaau

SEQ ID NO: 2678298 - RNA, 19 nt, Escherichia coli CFT073
aaacgccccuaaauaaaca

SEQ ID NO: 2678299 - RNA, 23 nt, Escherichia coli CFT073
aaacgccggagagaaaaaucucc

SEQ ID NO: 2678300 - RNA, 15 nt, Escherichia coli CFT073
aaacgccucauccgg

SEQ ID NO: 2678301 - RNA, 17 nt, Escherichia coli CFT073
aaacgcgacaauaccgg

SEQ ID NO: 2678302 - RNA, 20 nt, Escherichia coli CFT073
aaacgcgcagcgucgcauca

SEQ ID NO: 2678303 - RNA, 14 nt, Escherichia coli CFT073
aaacgcgccaggua

SEQ ID NO: 2678304 - RNA, 20 nt, Escherichia coli CFT073
aaacgcgcgauagucaugau

SEQ ID NO: 2678305 - RNA, 21 nt, Escherichia coli CFT073
aaacgcgcggcaaugggguuu

SEQ ID NO: 2678306 - RNA, 18 nt, Escherichia coli CFT073
aaacgcucccagccaguc

SEQ ID NO: 2678307 - RNA, 19 nt, Escherichia coli CFT073
aaacgcucccagccagucc

SEQ ID NO: 2678308 - RNA, 23 nt, Escherichia coli CFT073
aaacgcuccugcuacaccauugc

SEQ ID NO: 2678309 - RNA, 15 nt, Escherichia coli CFT073
aaacgcucggcaaca

SEQ ID NO: 2678310 - RNA, 14 nt, Escherichia coli CFT073
aaacgcuucucaag

SEQ ID NO: 2678311 - RNA, 18 nt, Escherichia coli CFT073
aaacggaaagcaacaagu

SEQ ID NO: 2678312 - RNA, 17 nt, Escherichia coli CFT073
aaacggaauauccccaa

SEQ ID NO: 2678313 - RNA, 14 nt, Escherichia coli CFT073
aaacggaauuuaaa

SEQ ID NO: 2678314 - RNA, 17 nt, Escherichia coli CFT073
aaacggaauuuaaauga

SEQ ID NO: 2678315 - RNA, 20 nt, Escherichia coli CFT073
aaacggaauuuaaaugacaa

SEQ ID NO: 2678316 - RNA, 21 nt, Escherichia coli CFT073
aaacggaccgcaugcagcaug

SEQ ID NO: 2678317 - RNA, 23 nt, Escherichia coli CFT073
aaacggcguuuuuucaucacugc

SEQ ID NO: 2678318 - RNA, 15 nt, Escherichia coli CFT073
aaacggucuuggcuu

SEQ ID NO: 2678319 - RNA, 13 nt, Escherichia coli CFT073
aaacgguugauag

SEQ ID NO: 2678320 - RNA, 16 nt, Escherichia coli CFT073
aaacgguuucagcagu

SEQ ID NO: 2678321 - RNA, 15 nt, Escherichia coli CFT073
aaacguaaaugccag

SEQ ID NO: 2678322 - RNA, 17 nt, Escherichia coli CFT073
aaacguaaaugccagcc

SEQ ID NO: 2678323 - RNA, 18 nt, Escherichia coli CFT073
aaacguagcggaaaucac

SEQ ID NO: 2678324 - RNA, 22 nt, Escherichia coli CFT073
aaacguauuaugugaucaacac

SEQ ID NO: 2678325 - RNA, 23 nt, Escherichia coli CFT073
aaacguauuaugugaucaacaca

SEQ ID NO: 2678326 - RNA, 23 nt, Escherichia coli CFT073
aaacgucgcaacuccaccagcac

SEQ ID NO: 2678327 - RNA, 13 nt, Escherichia coli CFT073
aaacgugaauuuu

SEQ ID NO: 2678328 - RNA, 15 nt, Escherichia coli CFT073
aaacguggugccauu

SEQ ID NO: 2678329 - RNA, 15 nt, Escherichia coli CFT073
aaacguuaacgcccc

SEQ ID NO: 2678330 - RNA, 16 nt, Escherichia coli CFT073
aaacguuaacgcccca

SEQ ID NO: 2678331 - RNA, 17 nt, Escherichia coli CFT073
aaacguuauccguuaac

SEQ ID NO: 2678332 - RNA, 16 nt, Escherichia coli CFT073
aaacguuaugcaccga

SEQ ID NO: 2678333 - RNA, 18 nt, Escherichia coli CFT073
aaacguuauuuugcuaau

SEQ ID NO: 2678334 - RNA, 21 nt, Escherichia coli CFT073
aaacguugcgcggugagcguu

SEQ ID NO: 2678335 - RNA, 21 nt, Escherichia coli CFT073
aaacguuggccagugcggcug

SEQ ID NO: 2678336 - RNA, 12 nt, Escherichia coli CFT073
aaacuaucugaa

SEQ ID NO: 2678337 - RNA, 22 nt, Escherichia coli CFT073
aaacucaacgguccaaugguca

SEQ ID NO: 2678338 - RNA, 14 nt, Escherichia coli CFT073
aaacucaaucaggc

SEQ ID NO: 2678339 - RNA, 16 nt, Escherichia coli CFT073
aaacucaccauccuga

SEQ ID NO: 2678340 - RNA, 15 nt, Escherichia coli CFT073
aaacucaccgcucug

SEQ ID NO: 2678341 - RNA, 12 nt, Escherichia coli CFT073
aaacucauccac

SEQ ID NO: 2678342 - RNA, 22 nt, Escherichia coli CFT073
aaacucauccaccacaaaagca

SEQ ID NO: 2678343 - RNA, 14 nt, Escherichia coli CFT073
aaacuccccgcaaa

SEQ ID NO: 2678344 - RNA, 15 nt, Escherichia coli CFT073
aaacucgaugacaac

SEQ ID NO: 2678345 - RNA, 19 nt, Escherichia coli CFT073
aaacucgccaaaccauugc

SEQ ID NO: 2678346 - RNA, 17 nt, Escherichia coli CFT073
aaacucgccuuugucuu

SEQ ID NO: 2678347 - RNA, 19 nt, Escherichia coli CFT073
aaacucgcggcuaacacuu

SEQ ID NO: 2678348 - RNA, 18 nt, Escherichia coli CFT073
aaacucgcuaaccacugu

SEQ ID NO: 2678349 - RNA, 19 nt, Escherichia coli CFT073
aaacucgugauaguccagc

SEQ ID NO: 2678350 - RNA, 20 nt, Escherichia coli CFT073
aaacugauuuagcaucagcg

SEQ ID NO: 2678351 - RNA, 17 nt, Escherichia coli CFT073
aaacuggaaaaccgcac

SEQ ID NO: 2678352 - RNA, 20 nt, Escherichia coli CFT073
aaacuggggcauuuuuucca

SEQ ID NO: 2678353 - RNA, 16 nt, Escherichia coli CFT073
aaacugguuauaugaa

SEQ ID NO: 2678354 - RNA, 16 nt, Escherichia coli CFT073
aaacugguugaaauaa

SEQ ID NO: 2678355 - RNA, 20 nt, Escherichia coli CFT073
aaacugguugcaacaucaaa

SEQ ID NO: 2678356 - RNA, 22 nt, Escherichia coli CFT073
aaacuguaucccagcccagcgg

SEQ ID NO: 2678357 - RNA, 16 nt, Escherichia coli CFT073
aaacugugcaaugaaa

SEQ ID NO: 2678358 - RNA, 16 nt, Escherichia coli CFT073
aaacuguuuacgcagc

SEQ ID NO: 2678359 - RNA, 20 nt, Escherichia coli CFT073
aaacuuaucuuauucccacu

SEQ ID NO: 2678360 - RNA, 18 nt, Escherichia coli CFT073
aaacuuaugcagcugcuc

SEQ ID NO: 2678361 - RNA, 19 nt, Escherichia coli CFT073
aaacuuauuuaaacccuuu

SEQ ID NO: 2678362 - RNA, 12 nt, Escherichia coli CFT073
aaacuucgccac

SEQ ID NO: 2678363 - RNA, 13 nt, Escherichia coli CFT073
aaacuucugcaac

SEQ ID NO: 2678364 - RNA, 20 nt, Escherichia coli CFT073
aaacuugaacuuaucaucag

SEQ ID NO: 2678365 - RNA, 16 nt, Escherichia coli CFT073
aaacuugguuacgcac

SEQ ID NO: 2678366 - RNA, 17 nt, Escherichia coli CFT073
aaacuugguuacgcacc

SEQ ID NO: 2678367 - RNA, 18 nt, Escherichia coli CFT073
aaacuugguuacgcaccg

SEQ ID NO: 2678368 - RNA, 13 nt, Escherichia coli CFT073
aaacuuuuaaauu

SEQ ID NO: 2678369 - RNA, 19 nt, Escherichia coli CFT073
aaacuuuuaaauugaagag

SEQ ID NO: 2678370 - RNA, 12 nt, Escherichia coli CFT073
aaacuuuuauca

SEQ ID NO: 2678371 - RNA, 15 nt, Escherichia coli CFT073
aaacuuuucaccagc

SEQ ID NO: 2678372 - RNA, 14 nt, Escherichia coli CFT073
aaacuuuugucauu

SEQ ID NO: 2678373 - RNA, 13 nt, Escherichia coli CFT073
aaagaaaauaccg

SEQ ID NO: 2678374 - RNA, 18 nt, Escherichia coli CFT073
aaagaaaauaccgaacau

SEQ ID NO: 2678375 - RNA, 11 nt, Escherichia coli CFT073
aaagaaacugu

SEQ ID NO: 2678376 - RNA, 14 nt, Escherichia coli CFT073
aaagaaauuuccca

SEQ ID NO: 2678377 - RNA, 12 nt, Escherichia coli CFT073
aaagaacacaac

SEQ ID NO: 2678378 - RNA, 12 nt, Escherichia coli CFT073
aaagaacaccag

SEQ ID NO: 2678379 - RNA, 14 nt, Escherichia coli CFT073
aaagaacaccagca

SEQ ID NO: 2678380 - RNA, 18 nt, Escherichia coli CFT073
aaagaacccggcaauggu

SEQ ID NO: 2678381 - RNA, 15 nt, Escherichia coli CFT073
aaagaaggaaaauac

SEQ ID NO: 2678382 - RNA, 12 nt, Escherichia coli CFT073
aaagaauauagg

SEQ ID NO: 2678383 - RNA, 14 nt, Escherichia coli CFT073
aaagaauccgcccu

SEQ ID NO: 2678384 - RNA, 20 nt, Escherichia coli CFT073
aaagaaucuauuaaccaaua

SEQ ID NO: 2678385 - RNA, 16 nt, Escherichia coli CFT073
aaagaaugcagucagu

SEQ ID NO: 2678386 - RNA, 23 nt, Escherichia coli CFT073
aaagacaucgcccgauucacaua

SEQ ID NO: 2678387 - RNA, 18 nt, Escherichia coli CFT073
aaagacaucgcuggaggc

SEQ ID NO: 2678388 - RNA, 17 nt, Escherichia coli CFT073
aaagacgacgaacuuca

SEQ ID NO: 2678389 - RNA, 15 nt, Escherichia coli CFT073
aaagacgccaucaau

SEQ ID NO: 2678390 - RNA, 18 nt, Escherichia coli CFT073
aaagacgguuaacgccag

SEQ ID NO: 2678391 - RNA, 13 nt, Escherichia coli CFT073
aaagacuauauua

SEQ ID NO: 2678392 - RNA, 20 nt, Escherichia coli CFT073
aaagacuauauuaaagaugu

SEQ ID NO: 2678393 - RNA, 16 nt, Escherichia coli CFT073
aaagacuauccgccau

SEQ ID NO: 2678394 - RNA, 18 nt, Escherichia coli CFT073
aaagagaugaaugaauuu

SEQ ID NO: 2678395 - RNA, 22 nt, Escherichia coli CFT073
aaagagaugaaugaauuuccgg

SEQ ID NO: 2678396 - RNA, 17 nt, Escherichia coli CFT073
aaagagcaagaacccca

SEQ ID NO: 2678397 - RNA, 18 nt, Escherichia coli CFT073
aaagaguacaucucuccg

SEQ ID NO: 2678398 - RNA, 19 nt, Escherichia coli CFT073
aaagaguuccugaugaaaa

SEQ ID NO: 2678399 - RNA, 22 nt, Escherichia coli CFT073
aaagaguugccccucuaacucu

SEQ ID NO: 2678400 - RNA, 18 nt, Escherichia coli CFT073
aaagaguuguaauuuaaa

SEQ ID NO: 2678401 - RNA, 15 nt, Escherichia coli CFT073
aaagauaaccucauu

SEQ ID NO: 2678402 - RNA, 21 nt, Escherichia coli CFT073
aaagauaagcgaacauccggc

SEQ ID NO: 2678403 - RNA, 23 nt, Escherichia coli CFT073
aaagauauuggggguaauucccu

SEQ ID NO: 2678404 - RNA, 18 nt, Escherichia coli CFT073
aaagaucaacugccgccu

SEQ ID NO: 2678405 - RNA, 21 nt, Escherichia coli CFT073
aaagaucacaauguaaaucau

SEQ ID NO: 2678406 - RNA, 22 nt, Escherichia coli CFT073
aaagaucugcgugaguuuuugu

SEQ ID NO: 2678407 - RNA, 24 nt, Escherichia coli CFT073
aaagauguuuugccugaaaaauga

SEQ ID NO: 2678408 - RNA, 13 nt, Escherichia coli CFT073
aaagauuuuacca

SEQ ID NO: 2678409 - RNA, 12 nt, Escherichia coli CFT073
aaagcaaaaaag

SEQ ID NO: 2678410 - RNA, 21 nt, Escherichia coli CFT073
aaagcaaaaaagaaggaaaau

SEQ ID NO: 2678411 - RNA, 22 nt, Escherichia coli CFT073
aaagcaaaaaagaaggaaaaua

SEQ ID NO: 2678412 - RNA, 13 nt, Escherichia coli CFT073
aaagcaacaccau

SEQ ID NO: 2678413 - RNA, 16 nt, Escherichia coli CFT073
aaagcaagaccaacac

SEQ ID NO: 2678414 - RNA, 13 nt, Escherichia coli CFT073
aaagcaagauuaa

SEQ ID NO: 2678415 - RNA, 21 nt, Escherichia coli CFT073
aaagcaagauuaaaauauaag

SEQ ID NO: 2678416 - RNA, 14 nt, Escherichia coli CFT073
aaagcaauaaacca

SEQ ID NO: 2678417 - RNA, 17 nt, Escherichia coli CFT073
aaagcaauagccgccau

SEQ ID NO: 2678418 - RNA, 14 nt, Escherichia coli CFT073
aaagcaauaucuuu

SEQ ID NO: 2678419 - RNA, 17 nt, Escherichia coli CFT073
aaagcaauuccagcgcc

SEQ ID NO: 2678420 - RNA, 19 nt, Escherichia coli CFT073
aaagcacagaaucuaagau

SEQ ID NO: 2678421 - RNA, 17 nt, Escherichia coli CFT073
aaagcaccacuuaaucu

SEQ ID NO: 2678422 - RNA, 14 nt, Escherichia coli CFT073
aaagcacccagcaa

SEQ ID NO: 2678423 - RNA, 22 nt, Escherichia coli CFT073
aaagcacgccagacaucaccag

SEQ ID NO: 2678424 - RNA, 19 nt, Escherichia coli CFT073
aaagcacuguucgccgcag

SEQ ID NO: 2678425 - RNA, 20 nt, Escherichia coli CFT073
aaagcacuguucgccgcagc

SEQ ID NO: 2678426 - RNA, 19 nt, Escherichia coli CFT073
aaagcagacaacccacgca

SEQ ID NO: 2678427 - RNA, 19 nt, Escherichia coli CFT073
aaagcagauaacccagcag

SEQ ID NO: 2678428 - RNA, 20 nt, Escherichia coli CFT073
aaagcagauaacccagcagc

SEQ ID NO: 2678429 - RNA, 19 nt, Escherichia coli CFT073
aaagcagcaagaacuuccg

SEQ ID NO: 2678430 - RNA, 16 nt, Escherichia coli CFT073
aaagcagcagcuguuu

SEQ ID NO: 2678431 - RNA, 15 nt, Escherichia coli CFT073
aaagcaggagcaauu

SEQ ID NO: 2678432 - RNA, 18 nt, Escherichia coli CFT073
aaagcauacaaugcaaua

SEQ ID NO: 2678433 - RNA, 18 nt, Escherichia coli CFT073
aaagcauagccccagcgc

SEQ ID NO: 2678434 - RNA, 13 nt, Escherichia coli CFT073
aaagccaacagca

SEQ ID NO: 2678435 - RNA, 14 nt, Escherichia coli CFT073
aaagccaacagcag

SEQ ID NO: 2678436 - RNA, 14 nt, Escherichia coli CFT073
aaagccaaccugca

SEQ ID NO: 2678437 - RNA, 20 nt, Escherichia coli CFT073
aaagccaaccugcagguugg

SEQ ID NO: 2678438 - RNA, 20 nt, Escherichia coli CFT073
aaagccacccacaccgcaga

SEQ ID NO: 2678439 - RNA, 16 nt, Escherichia coli CFT073
aaagccagcggcaccg

SEQ ID NO: 2678440 - RNA, 19 nt, Escherichia coli CFT073
aaagccauucuggcgcaac

SEQ ID NO: 2678441 - RNA, 14 nt, Escherichia coli CFT073
aaagcccaucaucc

SEQ ID NO: 2678442 - RNA, 17 nt, Escherichia coli CFT073
aaagcccaucauccgcg

SEQ ID NO: 2678443 - RNA, 18 nt, Escherichia coli CFT073
aaagcccaucgccagcgc

SEQ ID NO: 2678444 - RNA, 18 nt, Escherichia coli CFT073
aaagcccccacaacauug

SEQ ID NO: 2678445 - RNA, 21 nt, Escherichia coli CFT073
aaagcccgcagcguccagcgc

SEQ ID NO: 2678446 - RNA, 22 nt, Escherichia coli CFT073
aaagcccgccgccacaaucacc

SEQ ID NO: 2678447 - RNA, 21 nt, Escherichia coli CFT073
aaagcccgcguaacgccagaa

SEQ ID NO: 2678448 - RNA, 23 nt, Escherichia coli CFT073
aaagcccggcgucaugccgggca

SEQ ID NO: 2678449 - RNA, 15 nt, Escherichia coli CFT073
aaagcccucaccgaa

SEQ ID NO: 2678450 - RNA, 15 nt, Escherichia coli CFT073
aaagccgccagagau

SEQ ID NO: 2678451 - RNA, 15 nt, Escherichia coli CFT073
aaagccgcgaaacug

SEQ ID NO: 2678452 - RNA, 22 nt, Escherichia coli CFT073
aaagccggagcgacaaacuccg

SEQ ID NO: 2678453 - RNA, 22 nt, Escherichia coli CFT073
aaagccugggucagcgccguau

SEQ ID NO: 2678454 - RNA, 21 nt, Escherichia coli CFT073
aaagccuguaccaaaaucauc

SEQ ID NO: 2678455 - RNA, 20 nt, Escherichia coli CFT073
aaagcgaaacagcgccccau

SEQ ID NO: 2678456 - RNA, 13 nt, Escherichia coli CFT073
aaagcgaagcgaa

SEQ ID NO: 2678457 - RNA, 16 nt, Escherichia coli CFT073
aaagcgaccaaccauc

SEQ ID NO: 2678458 - RNA, 22 nt, Escherichia coli CFT073
aaagcgacgguuguuuaagacg

SEQ ID NO: 2678459 - RNA, 23 nt, Escherichia coli CFT073
aaagcgacgugcaguagcagcag

SEQ ID NO: 2678460 - RNA, 15 nt, Escherichia coli CFT073
aaagcgacuuugccu

SEQ ID NO: 2678461 - RNA, 13 nt, Escherichia coli CFT073
aaagcgagcagua

SEQ ID NO: 2678462 - RNA, 23 nt, Escherichia coli CFT073
aaagcgcaauauuucucucuccg

SEQ ID NO: 2678463 - RNA, 23 nt, Escherichia coli CFT073
aaagcgcacuuuauuaacaagcg

SEQ ID NO: 2678464 - RNA, 22 nt, Escherichia coli CFT073
aaagcgcauccaggcaaaguac

SEQ ID NO: 2678465 - RNA, 14 nt, Escherichia coli CFT073
aaagcgccaaaucu

SEQ ID NO: 2678466 - RNA, 11 nt, Escherichia coli CFT073
aaagcggcagu

SEQ ID NO: 2678467 - RNA, 19 nt, Escherichia coli CFT073
aaagcgggcaguguuuagu

SEQ ID NO: 2678468 - RNA, 14 nt, Escherichia coli CFT073
aaagcggguuuuuu

SEQ ID NO: 2678469 - RNA, 20 nt, Escherichia coli CFT073
aaagcggugauaaacccaac

SEQ ID NO: 2678470 - RNA, 20 nt, Escherichia coli CFT073
aaagcguacccgccugauag

SEQ ID NO: 2678471 - RNA, 16 nt, Escherichia coli CFT073
aaagcguauccaucac

SEQ ID NO: 2678472 - RNA, 22 nt, Escherichia coli CFT073
aaagcgucucgccagaguugau

SEQ ID NO: 2678473 - RNA, 16 nt, Escherichia coli CFT073
aaagcguuccagcagc

SEQ ID NO: 2678474 - RNA, 21 nt, Escherichia coli CFT073
aaagcguuuaucaauuaacug

SEQ ID NO: 2678475 - RNA, 20 nt, Escherichia coli CFT073
aaagcguuucaggucaccca

SEQ ID NO: 2678476 - RNA, 17 nt, Escherichia coli CFT073
aaagcguuucauuagcc

SEQ ID NO: 2678477 - RNA, 20 nt, Escherichia coli CFT073
aaagcuaacagcgccgcgau

SEQ ID NO: 2678478 - RNA, 15 nt, Escherichia coli CFT073
aaagcuaucccuugu

SEQ ID NO: 2678479 - RNA, 21 nt, Escherichia coli CFT073
aaagcucacuuugucugcaau

SEQ ID NO: 2678480 - RNA, 14 nt, Escherichia coli CFT073
aaagcugagaaaau

SEQ ID NO: 2678481 - RNA, 21 nt, Escherichia coli CFT073
aaagcugcugaccaccagcac

SEQ ID NO: 2678482 - RNA, 15 nt, Escherichia coli CFT073
aaagcuguaagguga

SEQ ID NO: 2678483 - RNA, 19 nt, Escherichia coli CFT073
aaagcuguaaggugaaagc

SEQ ID NO: 2678484 - RNA, 20 nt, Escherichia coli CFT073
aaagcuguaaggugaaagca

SEQ ID NO: 2678485 - RNA, 16 nt, Escherichia coli CFT073
aaagcuguacaucgcg

SEQ ID NO: 2678486 - RNA, 15 nt, Escherichia coli CFT073
aaagcugucaccaau

SEQ ID NO: 2678487 - RNA, 21 nt, Escherichia coli CFT073
aaagcugucaccucugcaacg

SEQ ID NO: 2678488 - RNA, 20 nt, Escherichia coli CFT073
aaagcuuuaauauccggugc

SEQ ID NO: 2678489 - RNA, 22 nt, Escherichia coli CFT073
aaagcuuuaauauccggugcau

SEQ ID NO: 2678490 - RNA, 18 nt, Escherichia coli CFT073
aaagcuuuaauuucaggc

SEQ ID NO: 2678491 - RNA, 19 nt, Escherichia coli CFT073
aaagcuuuccggaaaaauc

SEQ ID NO: 2678492 - RNA, 12 nt, Escherichia coli CFT073
aaagcuuuuuau

SEQ ID NO: 2678493 - RNA, 15 nt, Escherichia coli CFT073
aaaggauuuacuaaa

SEQ ID NO: 2678494 - RNA, 17 nt, Escherichia coli CFT073
aaaggcaacaucuguau

SEQ ID NO: 2678495 - RNA, 15 nt, Escherichia coli CFT073
aaaggcaccuggaaa

SEQ ID NO: 2678496 - RNA, 17 nt, Escherichia coli CFT073
aaaggcacucauuuucu

SEQ ID NO: 2678497 - RNA, 12 nt, Escherichia coli CFT073
aaaggcagaaac

SEQ ID NO: 2678498 - RNA, 17 nt, Escherichia coli CFT073
aaaggcagaaacggcuu

SEQ ID NO: 2678499 - RNA, 17 nt, Escherichia coli CFT073
aaaggccagcaaucccc

SEQ ID NO: 2678500 - RNA, 18 nt, Escherichia coli CFT073
aaaggccagcaaucccca

SEQ ID NO: 2678501 - RNA, 16 nt, Escherichia coli CFT073
aaaggccagccaggca

SEQ ID NO: 2678502 - RNA, 12 nt, Escherichia coli CFT073
aaaggccauccc

SEQ ID NO: 2678503 - RNA, 22 nt, Escherichia coli CFT073
aaaggccggauggguaauacca

SEQ ID NO: 2678504 - RNA, 21 nt, Escherichia coli CFT073
aaaggcguuguccuugccgca

SEQ ID NO: 2678505 - RNA, 11 nt, Escherichia coli CFT073
aaagggaugcc

SEQ ID NO: 2678506 - RNA, 16 nt, Escherichia coli CFT073
aaagggggcgacauuu

SEQ ID NO: 2678507 - RNA, 12 nt, Escherichia coli CFT073
aaagguaccgac

SEQ ID NO: 2678508 - RNA, 21 nt, Escherichia coli CFT073
aaaggucaauuccuucugggc

SEQ ID NO: 2678509 - RNA, 19 nt, Escherichia coli CFT073
aaaggucaucaucacuuuu

SEQ ID NO: 2678510 - RNA, 19 nt, Escherichia coli CFT073
aaaggugacguccagaacc

SEQ ID NO: 2678511 - RNA, 18 nt, Escherichia coli CFT073
aaaggugauuuauuucuc

SEQ ID NO: 2678512 - RNA, 17 nt, Escherichia coli CFT073
aaagguuaaaccgccag

SEQ ID NO: 2678513 - RNA, 22 nt, Escherichia coli CFT073
aaagguuuguaacucaggaacu

SEQ ID NO: 2678514 - RNA, 14 nt, Escherichia coli CFT073
aaaguaaacaauaa

SEQ ID NO: 2678515 - RNA, 16 nt, Escherichia coli CFT073
aaaguaaauaagaaaa

SEQ ID NO: 2678516 - RNA, 21 nt, Escherichia coli CFT073
aaaguaaccuuugaacagcca

SEQ ID NO: 2678517 - RNA, 15 nt, Escherichia coli CFT073
aaaguacacauugcc

SEQ ID NO: 2678518 - RNA, 20 nt, Escherichia coli CFT073
aaaguacacauugccauugu

SEQ ID NO: 2678519 - RNA, 18 nt, Escherichia coli CFT073
aaaguaccaucguccagc

SEQ ID NO: 2678520 - RNA, 23 nt, Escherichia coli CFT073
aaaguaggccguacagcccagga

SEQ ID NO: 2678521 - RNA, 14 nt, Escherichia coli CFT073
aaaguauaugagaa

SEQ ID NO: 2678522 - RNA, 20 nt, Escherichia coli CFT073
aaaguauaugagaagacugu

SEQ ID NO: 2678523 - RNA, 17 nt, Escherichia coli CFT073
aaaguaucaaacagaaa

SEQ ID NO: 2678524 - RNA, 20 nt, Escherichia coli CFT073
aaaguaucaaacagaaaaac

SEQ ID NO: 2678525 - RNA, 12 nt, Escherichia coli CFT073
aaagucaccagu

SEQ ID NO: 2678526 - RNA, 13 nt, Escherichia coli CFT073
aaagucagcguau

SEQ ID NO: 2678527 - RNA, 21 nt, Escherichia coli CFT073
aaagucaucgggcguuuucuu

SEQ ID NO: 2678528 - RNA, 17 nt, Escherichia coli CFT073
aaagucccuucccagcc

SEQ ID NO: 2678529 - RNA, 19 nt, Escherichia coli CFT073
aaagucgcggaauauccag

SEQ ID NO: 2678530 - RNA, 19 nt, Escherichia coli CFT073
aaagucgcguuauuuuuga

SEQ ID NO: 2678531 - RNA, 20 nt, Escherichia coli CFT073
aaagucggggagaaaguuuc

SEQ ID NO: 2678532 - RNA, 16 nt, Escherichia coli CFT073
aaagucguaggccuga

SEQ ID NO: 2678533 - RNA, 19 nt, Escherichia coli CFT073
aaagucguaggccugauaa

SEQ ID NO: 2678534 - RNA, 13 nt, Escherichia coli CFT073
aaagugaaaaaca

SEQ ID NO: 2678535 - RNA, 18 nt, Escherichia coli CFT073
aaagugaaauauuucuuu

SEQ ID NO: 2678536 - RNA, 22 nt, Escherichia coli CFT073
aaagugaucccacaucacaucc

SEQ ID NO: 2678537 - RNA, 20 nt, Escherichia coli CFT073
aaaguggcggggaucacucc

SEQ ID NO: 2678538 - RNA, 19 nt, Escherichia coli CFT073
aaaguguaaaaaaucccag

SEQ ID NO: 2678539 - RNA, 13 nt, Escherichia coli CFT073
aaaguguaggaaa

SEQ ID NO: 2678540 - RNA, 20 nt, Escherichia coli CFT073
aaaguguucgaccaccgguu

SEQ ID NO: 2678541 - RNA, 20 nt, Escherichia coli CFT073
aaaguuagccacagccuggg

SEQ ID NO: 2678542 - RNA, 22 nt, Escherichia coli CFT073
aaaguuaguaccgaacagccag

SEQ ID NO: 2678543 - RNA, 22 nt, Escherichia coli CFT073
aaaguugccagauaaauauuau

SEQ ID NO: 2678544 - RNA, 19 nt, Escherichia coli CFT073
aaaguuggcgauaaaguug

SEQ ID NO: 2678545 - RNA, 15 nt, Escherichia coli CFT073
aaaguuggcgcugaa

SEQ ID NO: 2678546 - RNA, 12 nt, Escherichia coli CFT073
aaaguuucaaag

SEQ ID NO: 2678547 - RNA, 14 nt, Escherichia coli CFT073
aaaguuugcaacuu

SEQ ID NO: 2678548 - RNA, 20 nt, Escherichia coli CFT073
aaaguuugcaacuuucgcuu

SEQ ID NO: 2678549 - RNA, 14 nt, Escherichia coli CFT073
aaaguuuuuaaaua

SEQ ID NO: 2678550 - RNA, 13 nt, Escherichia coli CFT073
aaauaaacaauga

SEQ ID NO: 2678551 - RNA, 13 nt, Escherichia coli CFT073
aaauaaacaccag

SEQ ID NO: 2678552 - RNA, 18 nt, Escherichia coli CFT073
aaauaaacuuacugacau

SEQ ID NO: 2678553 - RNA, 14 nt, Escherichia coli CFT073
aaauaaaggguaau

SEQ ID NO: 2678554 - RNA, 19 nt, Escherichia coli CFT073
aaauaaauaccguucauua

SEQ ID NO: 2678555 - RNA, 18 nt, Escherichia coli CFT073
aaauaacccgccaugccg

SEQ ID NO: 2678556 - RNA, 17 nt, Escherichia coli CFT073
aaauaacgaaaguaucu

SEQ ID NO: 2678557 - RNA, 15 nt, Escherichia coli CFT073
aaauaacgaucauca

SEQ ID NO: 2678558 - RNA, 16 nt, Escherichia coli CFT073
aaauaacguaaaaacc

SEQ ID NO: 2678559 - RNA, 17 nt, Escherichia coli CFT073
aaauaacugaauaauac

SEQ ID NO: 2678560 - RNA, 17 nt, Escherichia coli CFT073
aaauaacugguuagcuu

SEQ ID NO: 2678561 - RNA, 16 nt, Escherichia coli CFT073
aaauaagaaaaugccu

SEQ ID NO: 2678562 - RNA, 17 nt, Escherichia coli CFT073
aaauaagcacaaagcaa

SEQ ID NO: 2678563 - RNA, 23 nt, Escherichia coli CFT073
aaauaagcacaaagcaauauuau

SEQ ID NO: 2678564 - RNA, 12 nt, Escherichia coli CFT073
aaauaauauccc

SEQ ID NO: 2678565 - RNA, 16 nt, Escherichia coli CFT073
aaauaauauuucccca

SEQ ID NO: 2678566 - RNA, 14 nt, Escherichia coli CFT073
aaauaaucaccaga

SEQ ID NO: 2678567 - RNA, 16 nt, Escherichia coli CFT073
aaauaaucccguucag

SEQ ID NO: 2678568 - RNA, 14 nt, Escherichia coli CFT073
aaauaauccgcugu

SEQ ID NO: 2678569 - RNA, 13 nt, Escherichia coli CFT073
aaauaaugcagcg

SEQ ID NO: 2678570 - RNA, 23 nt, Escherichia coli CFT073
aaauaauuccccaccugaacuuc

SEQ ID NO: 2678571 - RNA, 15 nt, Escherichia coli CFT073
aaauacaggaaauaa

SEQ ID NO: 2678572 - RNA, 22 nt, Escherichia coli CFT073
aaauacauauaagcguuaaugg

SEQ ID NO: 2678573 - RNA, 11 nt, Escherichia coli CFT073
aaauacaugac

SEQ ID NO: 2678574 - RNA, 14 nt, Escherichia coli CFT073
aaauaccacucagc

SEQ ID NO: 2678575 - RNA, 21 nt, Escherichia coli CFT073
aaauaccagcccuggcuaaag

SEQ ID NO: 2678576 - RNA, 14 nt, Escherichia coli CFT073
aaauacccaaaaaa

SEQ ID NO: 2678577 - RNA, 15 nt, Escherichia coli CFT073
aaauacccaaaaaau

SEQ ID NO: 2678578 - RNA, 17 nt, Escherichia coli CFT073
aaauacccaaaaaauag

SEQ ID NO: 2678579 - RNA, 22 nt, Escherichia coli CFT073
aaauaccccgccagcagaauga

SEQ ID NO: 2678580 - RNA, 22 nt, Escherichia coli CFT073
aaauaccgaagaguaaccaaac

SEQ ID NO: 2678581 - RNA, 14 nt, Escherichia coli CFT073
aaauaccguucauu

SEQ ID NO: 2678582 - RNA, 14 nt, Escherichia coli CFT073
aaauacgcaucaua

SEQ ID NO: 2678583 - RNA, 22 nt, Escherichia coli CFT073
aaauacgcgugguauuaguaga

SEQ ID NO: 2678584 - RNA, 16 nt, Escherichia coli CFT073
aaauacguuuucaccu

SEQ ID NO: 2678585 - RNA, 13 nt, Escherichia coli CFT073
aaauacuaaauau

SEQ ID NO: 2678586 - RNA, 23 nt, Escherichia coli CFT073
aaauacuguuuaccggugccagc

SEQ ID NO: 2678587 - RNA, 15 nt, Escherichia coli CFT073
aaauagaaagugacu

SEQ ID NO: 2678588 - RNA, 20 nt, Escherichia coli CFT073
aaauagaccggagaaaagac

SEQ ID NO: 2678589 - RNA, 13 nt, Escherichia coli CFT073
aaauagaucgcca

SEQ ID NO: 2678590 - RNA, 12 nt, Escherichia coli CFT073
aaauagcaaagu

SEQ ID NO: 2678591 - RNA, 18 nt, Escherichia coli CFT073
aaauagccagcagagcaa

SEQ ID NO: 2678592 - RNA, 14 nt, Escherichia coli CFT073
aaauagccugccag

SEQ ID NO: 2678593 - RNA, 18 nt, Escherichia coli CFT073
aaauagcggguuuguuau

SEQ ID NO: 2678594 - RNA, 14 nt, Escherichia coli CFT073
aaauagcuuaacgg

SEQ ID NO: 2678595 - RNA, 19 nt, Escherichia coli CFT073
aaauaguaagaaccacagc

SEQ ID NO: 2678596 - RNA, 20 nt, Escherichia coli CFT073
aaauaguuuuuuacgaugca

SEQ ID NO: 2678597 - RNA, 13 nt, Escherichia coli CFT073
aaauauaaaccgu

SEQ ID NO: 2678598 - RNA, 15 nt, Escherichia coli CFT073
aaauauacacgaaau

SEQ ID NO: 2678599 - RNA, 13 nt, Escherichia coli CFT073
aaauauagcugaa

SEQ ID NO: 2678600 - RNA, 12 nt, Escherichia coli CFT073
aaauaucaaaaa

SEQ ID NO: 2678601 - RNA, 17 nt, Escherichia coli CFT073
aaauaucaaaaacaaau

SEQ ID NO: 2678602 - RNA, 20 nt, Escherichia coli CFT073
aaauaucaaaaacaaauuuu

SEQ ID NO: 2678603 - RNA, 14 nt, Escherichia coli CFT073
aaauaucagcagca

SEQ ID NO: 2678604 - RNA, 14 nt, Escherichia coli CFT073
aaauaucuucuacu

SEQ ID NO: 2678605 - RNA, 17 nt, Escherichia coli CFT073
aaauaugaaaucucuug

SEQ ID NO: 2678606 - RNA, 20 nt, Escherichia coli CFT073
aaauaugaugaaggacaaug

SEQ ID NO: 2678607 - RNA, 17 nt, Escherichia coli CFT073
aaauaugcuuuuauuca

SEQ ID NO: 2678608 - RNA, 18 nt, Escherichia coli CFT073
aaauauuaagaaaggcag

SEQ ID NO: 2678609 - RNA, 19 nt, Escherichia coli CFT073
aaauauuauauguguuggu

SEQ ID NO: 2678610 - RNA, 15 nt, Escherichia coli CFT073
aaauauuaucuaacc

SEQ ID NO: 2678611 - RNA, 17 nt, Escherichia coli CFT073
aaauauuauuggcaucg

SEQ ID NO: 2678612 - RNA, 15 nt, Escherichia coli CFT073
aaauauugcuaacug

SEQ ID NO: 2678613 - RNA, 21 nt, Escherichia coli CFT073
aaauauuguuuuuauugucau

SEQ ID NO: 2678614 - RNA, 19 nt, Escherichia coli CFT073
aaauauuucuuuaucacca

SEQ ID NO: 2678615 - RNA, 16 nt, Escherichia coli CFT073
aaauauuuucagggga

SEQ ID NO: 2678616 - RNA, 16 nt, Escherichia coli CFT073
aaaucaaacagaauau

SEQ ID NO: 2678617 - RNA, 16 nt, Escherichia coli CFT073
aaaucaaaguuaguaa

SEQ ID NO: 2678618 - RNA, 14 nt, Escherichia coli CFT073
aaaucaacaaauuc

SEQ ID NO: 2678619 - RNA, 13 nt, Escherichia coli CFT073
aaaucaacauguu

SEQ ID NO: 2678620 - RNA, 12 nt, Escherichia coli CFT073
aaaucaaccagg

SEQ ID NO: 2678621 - RNA, 21 nt, Escherichia coli CFT073
aaaucaaucugaugacugaua

SEQ ID NO: 2678622 - RNA, 18 nt, Escherichia coli CFT073
aaaucaauuaauccagac

SEQ ID NO: 2678623 - RNA, 10 nt, Escherichia coli CFT073
aaaucaccac

SEQ ID NO: 2678624 - RNA, 18 nt, Escherichia coli CFT073
aaaucaccaccagcaccg

SEQ ID NO: 2678625 - RNA, 23 nt, Escherichia coli CFT073
aaaucaccauauucagcagcaga

SEQ ID NO: 2678626 - RNA, 17 nt, Escherichia coli CFT073
aaaucaccaucacaauu

SEQ ID NO: 2678627 - RNA, 13 nt, Escherichia coli CFT073
aaaucaccaucgu

SEQ ID NO: 2678628 - RNA, 20 nt, Escherichia coli CFT073
aaaucaccgaugacagaauc

SEQ ID NO: 2678629 - RNA, 13 nt, Escherichia coli CFT073
aaaucacgcgccu

SEQ ID NO: 2678630 - RNA, 22 nt, Escherichia coli CFT073
aaaucacgcugccaauaaugcc

SEQ ID NO: 2678631 - RNA, 12 nt, Escherichia coli CFT073
aaaucacggcaa

SEQ ID NO: 2678632 - RNA, 18 nt, Escherichia coli CFT073
aaaucacuauuaaagaaa

SEQ ID NO: 2678633 - RNA, 20 nt, Escherichia coli CFT073
aaaucacuauuaaagaaagu

SEQ ID NO: 2678634 - RNA, 22 nt, Escherichia coli CFT073
aaaucagacuuugaauaaagcc

SEQ ID NO: 2678635 - RNA, 14 nt, Escherichia coli CFT073
aaaucagauaaaac

SEQ ID NO: 2678636 - RNA, 15 nt, Escherichia coli CFT073
aaaucagauaaaaca

SEQ ID NO: 2678637 - RNA, 23 nt, Escherichia coli CFT073
aaaucagauaugcgcugucauuc

SEQ ID NO: 2678638 - RNA, 19 nt, Escherichia coli CFT073
aaaucagcacagagauaaa

SEQ ID NO: 2678639 - RNA, 14 nt, Escherichia coli CFT073
aaaucagccuuaau

SEQ ID NO: 2678640 - RNA, 18 nt, Escherichia coli CFT073
aaaucagccuuaaucuuc

SEQ ID NO: 2678641 - RNA, 17 nt, Escherichia coli CFT073
aaaucaguccacggcug

SEQ ID NO: 2678642 - RNA, 22 nt, Escherichia coli CFT073
aaaucaguccacggcugcggcc

SEQ ID NO: 2678643 - RNA, 17 nt, Escherichia coli CFT073
aaaucauauucuuuuug

SEQ ID NO: 2678644 - RNA, 15 nt, Escherichia coli CFT073
aaaucaucaguacca

SEQ ID NO: 2678645 - RNA, 19 nt, Escherichia coli CFT073
aaaucaucauugcuguuuu

SEQ ID NO: 2678646 - RNA, 16 nt, Escherichia coli CFT073
aaaucauccugcugca

SEQ ID NO: 2678647 - RNA, 16 nt, Escherichia coli CFT073
aaaucauccuguucau

SEQ ID NO: 2678648 - RNA, 22 nt, Escherichia coli CFT073
aaaucaucugccgguuccagcu

SEQ ID NO: 2678649 - RNA, 23 nt, Escherichia coli CFT073
aaaucaucugguuccuaaauaac

SEQ ID NO: 2678650 - RNA, 20 nt, Escherichia coli CFT073
aaaucauggcagcuuuuuca

SEQ ID NO: 2678651 - RNA, 16 nt, Escherichia coli CFT073
aaauccagaaaaaaag

SEQ ID NO: 2678652 - RNA, 15 nt, Escherichia coli CFT073
aaauccagcaccgcu

SEQ ID NO: 2678653 - RNA, 17 nt, Escherichia coli CFT073
aaauccaggucagaacu

SEQ ID NO: 2678654 - RNA, 23 nt, Escherichia coli CFT073
aaaucccagcguuuaucaauauc

SEQ ID NO: 2678655 - RNA, 23 nt, Escherichia coli CFT073
aaaucccgccgauggcgggauuu

SEQ ID NO: 2678656 - RNA, 20 nt, Escherichia coli CFT073
aaaucccgcugaauuccccu

SEQ ID NO: 2678657 - RNA, 23 nt, Escherichia coli CFT073
aaaucccgucuggcgaauaaugg

SEQ ID NO: 2678658 - RNA, 14 nt, Escherichia coli CFT073
aaauccggggcaau

SEQ ID NO: 2678659 - RNA, 23 nt, Escherichia coli CFT073
aaauccucuuuuaccaucagcgu

SEQ ID NO: 2678660 - RNA, 16 nt, Escherichia coli CFT073
aaauccuggugaaagu

SEQ ID NO: 2678661 - RNA, 22 nt, Escherichia coli CFT073
aaaucgaagcguacugucugcu

SEQ ID NO: 2678662 - RNA, 16 nt, Escherichia coli CFT073
aaaucgagaagacaau

SEQ ID NO: 2678663 - RNA, 19 nt, Escherichia coli CFT073
aaaucgcaacgguucugcu

SEQ ID NO: 2678664 - RNA, 22 nt, Escherichia coli CFT073
aaaucgcaacgguucugcugcc

SEQ ID NO: 2678665 - RNA, 20 nt, Escherichia coli CFT073
aaaucgcacguugccagcaa

SEQ ID NO: 2678666 - RNA, 13 nt, Escherichia coli CFT073
aaaucgcacuggu

SEQ ID NO: 2678667 - RNA, 14 nt, Escherichia coli CFT073
aaaucgccaagauu

SEQ ID NO: 2678668 - RNA, 24 nt, Escherichia coli CFT073
aaaucgcccgucaguucauccauu

SEQ ID NO: 2678669 - RNA, 20 nt, Escherichia coli CFT073
aaaucgccgacaaucucuuc

SEQ ID NO: 2678670 - RNA, 16 nt, Escherichia coli CFT073
aaaucgccgcaucauc

SEQ ID NO: 2678671 - RNA, 20 nt, Escherichia coli CFT073
aaaucgccgggauauauguc

SEQ ID NO: 2678672 - RNA, 12 nt, Escherichia coli CFT073
aaaucgccugaa

SEQ ID NO: 2678673 - RNA, 13 nt, Escherichia coli CFT073
aaaucgcucccuc

SEQ ID NO: 2678674 - RNA, 15 nt, Escherichia coli CFT073
aaaucggcaccgccg

SEQ ID NO: 2678675 - RNA, 13 nt, Escherichia coli CFT073
aaaucgggcgaca

SEQ ID NO: 2678676 - RNA, 19 nt, Escherichia coli CFT073
aaaucggggaucauuaacc

SEQ ID NO: 2678677 - RNA, 18 nt, Escherichia coli CFT073
aaaucggugggcugacau

SEQ ID NO: 2678678 - RNA, 14 nt, Escherichia coli CFT073
aaaucguaagcagg

SEQ ID NO: 2678679 - RNA, 23 nt, Escherichia coli CFT073
aaaucgugacagcauaccuucac

SEQ ID NO: 2678680 - RNA, 17 nt, Escherichia coli CFT073
aaaucuauuauuauuuu

SEQ ID NO: 2678681 - RNA, 14 nt, Escherichia coli CFT073
aaaucuccauuuca

SEQ ID NO: 2678682 - RNA, 15 nt, Escherichia coli CFT073
aaaucucccgcuggc

SEQ ID NO: 2678683 - RNA, 13 nt, Escherichia coli CFT073
aaaucucuuccag

SEQ ID NO: 2678684 - RNA, 19 nt, Escherichia coli CFT073
aaaucugcccguuaaccau

SEQ ID NO: 2678685 - RNA, 16 nt, Escherichia coli CFT073
aaaucuguugaaauua

SEQ ID NO: 2678686 - RNA, 21 nt, Escherichia coli CFT073
aaaucuucacugaauaccgua

SEQ ID NO: 2678687 - RNA, 13 nt, Escherichia coli CFT073
aaaucuucguuau

SEQ ID NO: 2678688 - RNA, 17 nt, Escherichia coli CFT073
aaaucuucucacugccc

SEQ ID NO: 2678689 - RNA, 19 nt, Escherichia coli CFT073
aaaucuuucacuuuugcca

SEQ ID NO: 2678690 - RNA, 22 nt, Escherichia coli CFT073
aaaucuuucacuuuugccagac

SEQ ID NO: 2678691 - RNA, 14 nt, Escherichia coli CFT073
aaaucuuucagagu

SEQ ID NO: 2678692 - RNA, 14 nt, Escherichia coli CFT073
aaaugaacugggca

SEQ ID NO: 2678693 - RNA, 16 nt, Escherichia coli CFT073
aaaugacauuaaguaa

SEQ ID NO: 2678694 - RNA, 16 nt, Escherichia coli CFT073
aaaugaccauaaaagg

SEQ ID NO: 2678695 - RNA, 19 nt, Escherichia coli CFT073
aaaugaccauaaaaggcac

SEQ ID NO: 2678696 - RNA, 13 nt, Escherichia coli CFT073
aaaugacgaugca

SEQ ID NO: 2678697 - RNA, 17 nt, Escherichia coli CFT073
aaaugacgcuuuauuca

SEQ ID NO: 2678698 - RNA, 19 nt, Escherichia coli CFT073
aaaugacgggccaagcagg

SEQ ID NO: 2678699 - RNA, 23 nt, Escherichia coli CFT073
aaaugacucacguuacuuaacac

SEQ ID NO: 2678700 - RNA, 14 nt, Escherichia coli CFT073
aaaugacucguuau

SEQ ID NO: 2678701 - RNA, 23 nt, Escherichia coli CFT073
aaaugagcguauagagcagcggc

SEQ ID NO: 2678702 - RNA, 13 nt, Escherichia coli CFT073
aaaugaguaugug

SEQ ID NO: 2678703 - RNA, 21 nt, Escherichia coli CFT073
aaaugagucaguaaauugugc

SEQ ID NO: 2678704 - RNA, 17 nt, Escherichia coli CFT073
aaaugaucaauaauuaa

SEQ ID NO: 2678705 - RNA, 21 nt, Escherichia coli CFT073
aaaugauuacucccuugccug

SEQ ID NO: 2678706 - RNA, 14 nt, Escherichia coli CFT073
aaaugcaacauuau

SEQ ID NO: 2678707 - RNA, 19 nt, Escherichia coli CFT073
aaaugcacaauaauauuau

SEQ ID NO: 2678708 - RNA, 17 nt, Escherichia coli CFT073
aaaugcacgcugccugg

SEQ ID NO: 2678709 - RNA, 17 nt, Escherichia coli CFT073
aaaugcagcaaccagag

SEQ ID NO: 2678710 - RNA, 20 nt, Escherichia coli CFT073
aaaugccaaauauuucuuua

SEQ ID NO: 2678711 - RNA, 22 nt, Escherichia coli CFT073
aaaugccaaauguauccaucac

SEQ ID NO: 2678712 - RNA, 22 nt, Escherichia coli CFT073
aaaugccacugcgccgggcaga

SEQ ID NO: 2678713 - RNA, 12 nt, Escherichia coli CFT073
aaaugccagccc

SEQ ID NO: 2678714 - RNA, 21 nt, Escherichia coli CFT073
aaaugccagcccauacuuaau

SEQ ID NO: 2678715 - RNA, 16 nt, Escherichia coli CFT073
aaaugccaucugaacu

SEQ ID NO: 2678716 - RNA, 19 nt, Escherichia coli CFT073
aaaugcccgacaaaaauua

SEQ ID NO: 2678717 - RNA, 20 nt, Escherichia coli CFT073
aaaugcccgacaaaaauuau

SEQ ID NO: 2678718 - RNA, 23 nt, Escherichia coli CFT073
aaaugcccuuuuuuuaugucagu

SEQ ID NO: 2678719 - RNA, 13 nt, Escherichia coli CFT073
aaaugccgcacau

SEQ ID NO: 2678720 - RNA, 18 nt, Escherichia coli CFT073
aaaugccguacagcagaa

SEQ ID NO: 2678721 - RNA, 16 nt, Escherichia coli CFT073
aaaugcgaaaaaaacu

SEQ ID NO: 2678722 - RNA, 13 nt, Escherichia coli CFT073
aaaugcgccgcca

SEQ ID NO: 2678723 - RNA, 15 nt, Escherichia coli CFT073
aaaugcgcucagagu

SEQ ID NO: 2678724 - RNA, 22 nt, Escherichia coli CFT073
aaaugcggacgucgacacuaca

SEQ ID NO: 2678725 - RNA, 20 nt, Escherichia coli CFT073
aaaugcguagguuaacccag

SEQ ID NO: 2678726 - RNA, 19 nt, Escherichia coli CFT073
aaaugcugcaauugcggca

SEQ ID NO: 2678727 - RNA, 22 nt, Escherichia coli CFT073
aaaugcugcgggucaaucggcg

SEQ ID NO: 2678728 - RNA, 12 nt, Escherichia coli CFT073
aaauggccaucc

SEQ ID NO: 2678729 - RNA, 18 nt, Escherichia coli CFT073
aaauggcgaacgggauaa

SEQ ID NO: 2678730 - RNA, 19 nt, Escherichia coli CFT073
aaauggggacaucaaagaa

SEQ ID NO: 2678731 - RNA, 15 nt, Escherichia coli CFT073
aaaugggggagagcc

SEQ ID NO: 2678732 - RNA, 18 nt, Escherichia coli CFT073
aaaugguacaauggagcu

SEQ ID NO: 2678733 - RNA, 16 nt, Escherichia coli CFT073
aaauggucauuuuuca

SEQ ID NO: 2678734 - RNA, 16 nt, Escherichia coli CFT073
aaaugucaaacaguuc

SEQ ID NO: 2678735 - RNA, 14 nt, Escherichia coli CFT073
aaaugucaucccuu

SEQ ID NO: 2678736 - RNA, 17 nt, Escherichia coli CFT073
aaaugucaucccuuccu

SEQ ID NO: 2678737 - RNA, 18 nt, Escherichia coli CFT073
aaaugucaugacauucau

SEQ ID NO: 2678738 - RNA, 22 nt, Escherichia coli CFT073
aaaugucauuacgaucaagaau

SEQ ID NO: 2678739 - RNA, 16 nt, Escherichia coli CFT073
aaaugucgauuaucga

SEQ ID NO: 2678740 - RNA, 21 nt, Escherichia coli CFT073
aaaugugccggaugcaucaca

SEQ ID NO: 2678741 - RNA, 18 nt, Escherichia coli CFT073
aaauguugccggauggca

SEQ ID NO: 2678742 - RNA, 15 nt, Escherichia coli CFT073
aaauguugcgccuca

SEQ ID NO: 2678743 - RNA, 14 nt, Escherichia coli CFT073
aaauuaccaccagc

SEQ ID NO: 2678744 - RNA, 13 nt, Escherichia coli CFT073
aaauuaccuuuac

SEQ ID NO: 2678745 - RNA, 14 nt, Escherichia coli CFT073
aaauuaccuuuaca

SEQ ID NO: 2678746 - RNA, 20 nt, Escherichia coli CFT073
aaauuaccuuuacaugaaaa

SEQ ID NO: 2678747 - RNA, 18 nt, Escherichia coli CFT073
aaauuacgaaagcaaaau

SEQ ID NO: 2678748 - RNA, 20 nt, Escherichia coli CFT073
aaauuacgaaagcaaaauua

SEQ ID NO: 2678749 - RNA, 12 nt, Escherichia coli CFT073
aaauuacgaucc

SEQ ID NO: 2678750 - RNA, 23 nt, Escherichia coli CFT073
aaauuacucucgugccagagcau

SEQ ID NO: 2678751 - RNA, 16 nt, Escherichia coli CFT073
aaauuacuggcggcga

SEQ ID NO: 2678752 - RNA, 16 nt, Escherichia coli CFT073
aaauuaggucaaagaa

SEQ ID NO: 2678753 - RNA, 20 nt, Escherichia coli CFT073
aaauuaggucaaagaaucaa

SEQ ID NO: 2678754 - RNA, 19 nt, Escherichia coli CFT073
aaauuaucaacguagaaua

SEQ ID NO: 2678755 - RNA, 20 nt, Escherichia coli CFT073
aaauuauccaacuuuuccca

SEQ ID NO: 2678756 - RNA, 17 nt, Escherichia coli CFT073
aaauuaucccccagcac

SEQ ID NO: 2678757 - RNA, 22 nt, Escherichia coli CFT073
aaauuauuaauuaaacaaauaa

SEQ ID NO: 2678758 - RNA, 14 nt, Escherichia coli CFT073
aaauuauuaccauc

SEQ ID NO: 2678759 - RNA, 22 nt, Escherichia coli CFT073
aaauuauucagcguuugcugaa

SEQ ID NO: 2678760 - RNA, 20 nt, Escherichia coli CFT073
aaauuauugccuugaugaaa

SEQ ID NO: 2678761 - RNA, 21 nt, Escherichia coli CFT073
aaauuauugccuugaugaaaa

SEQ ID NO: 2678762 - RNA, 22 nt, Escherichia coli CFT073
aaauuauugccuugaugaaaaa

SEQ ID NO: 2678763 - RNA, 13 nt, Escherichia coli CFT073
aaauuauuuuaaa

SEQ ID NO: 2678764 - RNA, 17 nt, Escherichia coli CFT073
aaauucaaccucuguuc

SEQ ID NO: 2678765 - RNA, 12 nt, Escherichia coli CFT073
aaauucaccacc

SEQ ID NO: 2678766 - RNA, 20 nt, Escherichia coli CFT073
aaauucacgccuucuuccag

SEQ ID NO: 2678767 - RNA, 14 nt, Escherichia coli CFT073
aaauucagcaaauu

SEQ ID NO: 2678768 - RNA, 15 nt, Escherichia coli CFT073
aaauucagcauuacc

SEQ ID NO: 2678769 - RNA, 21 nt, Escherichia coli CFT073
aaauucagugugccacuucaa

SEQ ID NO: 2678770 - RNA, 21 nt, Escherichia coli CFT073
aaauucaguucgucacaguua

SEQ ID NO: 2678771 - RNA, 14 nt, Escherichia coli CFT073
aaauuccagcggca

SEQ ID NO: 2678772 - RNA, 15 nt, Escherichia coli CFT073
aaauuccccacccca

SEQ ID NO: 2678773 - RNA, 19 nt, Escherichia coli CFT073
aaauuccgcucuguaaccc

SEQ ID NO: 2678774 - RNA, 23 nt, Escherichia coli CFT073
aaauucgagagaauuaaccagaa

SEQ ID NO: 2678775 - RNA, 22 nt, Escherichia coli CFT073
aaauucucccgcccccgccagc

SEQ ID NO: 2678776 - RNA, 22 nt, Escherichia coli CFT073
aaauucuccgcggucagcgcaa

SEQ ID NO: 2678777 - RNA, 15 nt, Escherichia coli CFT073
aaauucuguuucauu

SEQ ID NO: 2678778 - RNA, 17 nt, Escherichia coli CFT073
aaauugagcugcgcgac

SEQ ID NO: 2678779 - RNA, 16 nt, Escherichia coli CFT073
aaauugcaauuuuuau

SEQ ID NO: 2678780 - RNA, 23 nt, Escherichia coli CFT073
aaauugccccagacacaguucuu

SEQ ID NO: 2678781 - RNA, 14 nt, Escherichia coli CFT073
aaauugcccccagu

SEQ ID NO: 2678782 - RNA, 13 nt, Escherichia coli CFT073
aaauugccugaug

SEQ ID NO: 2678783 - RNA, 14 nt, Escherichia coli CFT073
aaauugccugaugc

SEQ ID NO: 2678784 - RNA, 21 nt, Escherichia coli CFT073
aaauugcggguaggcaccuga

SEQ ID NO: 2678785 - RNA, 17 nt, Escherichia coli CFT073
aaauugcguaaagccug

SEQ ID NO: 2678786 - RNA, 15 nt, Escherichia coli CFT073
aaauugcugaugacg

SEQ ID NO: 2678787 - RNA, 16 nt, Escherichia coli CFT073
aaauugcugguuuugu

SEQ ID NO: 2678788 - RNA, 21 nt, Escherichia coli CFT073
aaauugcugugauuaagcagc

SEQ ID NO: 2678789 - RNA, 22 nt, Escherichia coli CFT073
aaauugcugugauuaagcagcg

SEQ ID NO: 2678790 - RNA, 16 nt, Escherichia coli CFT073
aaauuggcagaccaga

SEQ ID NO: 2678791 - RNA, 23 nt, Escherichia coli CFT073
aaauuguaguguugcaguaaauu

SEQ ID NO: 2678792 - RNA, 17 nt, Escherichia coli CFT073
aaauugucguuauugau

SEQ ID NO: 2678793 - RNA, 14 nt, Escherichia coli CFT073
aaauuguuuugcua

SEQ ID NO: 2678794 - RNA, 18 nt, Escherichia coli CFT073
aaauuuagcaaauuuuua

SEQ ID NO: 2678795 - RNA, 13 nt, Escherichia coli CFT073
aaauuuauccagc

SEQ ID NO: 2678796 - RNA, 12 nt, Escherichia coli CFT073
aaauuucaggca

SEQ ID NO: 2678797 - RNA, 18 nt, Escherichia coli CFT073
aaauuucaggcaacaaaa

SEQ ID NO: 2678798 - RNA, 20 nt, Escherichia coli CFT073
aaauuucaggcaacaaaaaa

SEQ ID NO: 2678799 - RNA, 19 nt, Escherichia coli CFT073
aaauuucauuuucagggca

SEQ ID NO: 2678800 - RNA, 19 nt, Escherichia coli CFT073
aaauuucggauauuuucca

SEQ ID NO: 2678801 - RNA, 16 nt, Escherichia coli CFT073
aaauuucuaucaucau

SEQ ID NO: 2678802 - RNA, 12 nt, Escherichia coli CFT073
aaauuucuuccc

SEQ ID NO: 2678803 - RNA, 18 nt, Escherichia coli CFT073
aaauuucuucccuuucug

SEQ ID NO: 2678804 - RNA, 21 nt, Escherichia coli CFT073
aaauuuucagcgugcccacgu

SEQ ID NO: 2678805 - RNA, 18 nt, Escherichia coli CFT073
aaauuuuuccguuuucca

SEQ ID NO: 2678806 - RNA, 12 nt, Escherichia coli CFT073
aaauuuuugcca

SEQ ID NO: 2678807 - RNA, 22 nt, Escherichia coli CFT073
aaauuuuuucagauaaaagcuu

SEQ ID NO: 2678808 - RNA, 19 nt, Escherichia coli CFT073
aacaaaaaacccaucaacc

SEQ ID NO: 2678809 - RNA, 12 nt, Escherichia coli CFT073
aacaaaaaauug

SEQ ID NO: 2678810 - RNA, 13 nt, Escherichia coli CFT073
aacaaaacauacu

SEQ ID NO: 2678811 - RNA, 18 nt, Escherichia coli CFT073
aacaaaacauacuuucuc

SEQ ID NO: 2678812 - RNA, 13 nt, Escherichia coli CFT073
aacaaaaccacac

SEQ ID NO: 2678813 - RNA, 21 nt, Escherichia coli CFT073
aacaaaacucaacgguccaau

SEQ ID NO: 2678814 - RNA, 15 nt, Escherichia coli CFT073
aacaaacgcaaacac

SEQ ID NO: 2678815 - RNA, 16 nt, Escherichia coli CFT073
aacaaacucauuaauc

SEQ ID NO: 2678816 - RNA, 22 nt, Escherichia coli CFT073
aacaaacuccccgcaaaccaga

SEQ ID NO: 2678817 - RNA, 14 nt, Escherichia coli CFT073
aacaaagaaauguu

SEQ ID NO: 2678818 - RNA, 17 nt, Escherichia coli CFT073
aacaaagccgcuuaaua

SEQ ID NO: 2678819 - RNA, 17 nt, Escherichia coli CFT073
aacaaaguuugcaacuu

SEQ ID NO: 2678820 - RNA, 17 nt, Escherichia coli CFT073
aacaaauagauaaaaua

SEQ ID NO: 2678821 - RNA, 20 nt, Escherichia coli CFT073
aacaaauaucuuucuaccau

SEQ ID NO: 2678822 - RNA, 19 nt, Escherichia coli CFT073
aacaaaugaaagcagcagc

SEQ ID NO: 2678823 - RNA, 13 nt, Escherichia coli CFT073
aacaaauucacgc

SEQ ID NO: 2678824 - RNA, 13 nt, Escherichia coli CFT073
aacaaauuuugaa

SEQ ID NO: 2678825 - RNA, 12 nt, Escherichia coli CFT073
aacaacaacacg

SEQ ID NO: 2678826 - RNA, 16 nt, Escherichia coli CFT073
aacaacacaccaccac

SEQ ID NO: 2678827 - RNA, 13 nt, Escherichia coli CFT073
aacaacaccagca

SEQ ID NO: 2678828 - RNA, 21 nt, Escherichia coli CFT073
aacaacaccagcaggugauac

SEQ ID NO: 2678829 - RNA, 12 nt, Escherichia coli CFT073
aacaacaccggu

SEQ ID NO: 2678830 - RNA, 21 nt, Escherichia coli CFT073
aacaacacgccgauaaucaac

SEQ ID NO: 2678831 - RNA, 19 nt, Escherichia coli CFT073
aacaacaguuuuaucucca

SEQ ID NO: 2678832 - RNA, 18 nt, Escherichia coli CFT073
aacaacccugcaucagaa

SEQ ID NO: 2678833 - RNA, 18 nt, Escherichia coli CFT073
aacaacgcaacuccagcu

SEQ ID NO: 2678834 - RNA, 21 nt, Escherichia coli CFT073
aacaacuuucgggcgcaaaaa

SEQ ID NO: 2678835 - RNA, 13 nt, Escherichia coli CFT073
aacaagaaacaga

SEQ ID NO: 2678836 - RNA, 15 nt, Escherichia coli CFT073
aacaagaaacagaua

SEQ ID NO: 2678837 - RNA, 16 nt, Escherichia coli CFT073
aacaagaaacagauaa

SEQ ID NO: 2678838 - RNA, 13 nt, Escherichia coli CFT073
aacaagacaucac

SEQ ID NO: 2678839 - RNA, 13 nt, Escherichia coli CFT073
aacaagaucgccc

SEQ ID NO: 2678840 - RNA, 11 nt, Escherichia coli CFT073
aacaagccacg

SEQ ID NO: 2678841 - RNA, 20 nt, Escherichia coli CFT073
aacaagcggacuucauugac

SEQ ID NO: 2678842 - RNA, 20 nt, Escherichia coli CFT073
aacaaggaucgcgacaaaau

SEQ ID NO: 2678843 - RNA, 22 nt, Escherichia coli CFT073
aacaagucagcgcgaaaucgcc

SEQ ID NO: 2678844 - RNA, 13 nt, Escherichia coli CFT073
aacaauaaaaagc

SEQ ID NO: 2678845 - RNA, 19 nt, Escherichia coli CFT073
aacaauaaaaagcggcagg

SEQ ID NO: 2678846 - RNA, 13 nt, Escherichia coli CFT073
aacaauaaacugc

SEQ ID NO: 2678847 - RNA, 13 nt, Escherichia coli CFT073
aacaauaaaguuu

SEQ ID NO: 2678848 - RNA, 21 nt, Escherichia coli CFT073
aacaauaaauucgccagacag

SEQ ID NO: 2678849 - RNA, 16 nt, Escherichia coli CFT073
aacaauaucuaaaaug

SEQ ID NO: 2678850 - RNA, 19 nt, Escherichia coli CFT073
aacaauauuggguuguugc

SEQ ID NO: 2678851 - RNA, 15 nt, Escherichia coli CFT073
aacaaucaccaaacc

SEQ ID NO: 2678852 - RNA, 14 nt, Escherichia coli CFT073
aacaaucaucaacc

SEQ ID NO: 2678853 - RNA, 19 nt, Escherichia coli CFT073
aacaaugccucgcuaaucu

SEQ ID NO: 2678854 - RNA, 14 nt, Escherichia coli CFT073
aacaauggcauaac

SEQ ID NO: 2678855 - RNA, 19 nt, Escherichia coli CFT073
aacaauguugucgccagua

SEQ ID NO: 2678856 - RNA, 15 nt, Escherichia coli CFT073
aacaauuaauacaau

SEQ ID NO: 2678857 - RNA, 18 nt, Escherichia coli CFT073
aacaauucacacucugcc

SEQ ID NO: 2678858 - RNA, 22 nt, Escherichia coli CFT073
aacaauucgugugguaaaaccu

SEQ ID NO: 2678859 - RNA, 20 nt, Escherichia coli CFT073
aacaauucguugauuuuguu

SEQ ID NO: 2678860 - RNA, 23 nt, Escherichia coli CFT073
aacaauugcgggccaaagaccag

SEQ ID NO: 2678861 - RNA, 15 nt, Escherichia coli CFT073
aacaauuugccaggc

SEQ ID NO: 2678862 - RNA, 20 nt, Escherichia coli CFT073
aacacaacguacaccgcagc

SEQ ID NO: 2678863 - RNA, 18 nt, Escherichia coli CFT073
aacacaccguaauugcca

SEQ ID NO: 2678864 - RNA, 13 nt, Escherichia coli CFT073
aacacacuuucca

SEQ ID NO: 2678865 - RNA, 22 nt, Escherichia coli CFT073
aacacacuuuccaguuccggca

SEQ ID NO: 2678866 - RNA, 16 nt, Escherichia coli CFT073
aacacagcaauaauaa

SEQ ID NO: 2678867 - RNA, 18 nt, Escherichia coli CFT073
aacacaguuguaauaaga

SEQ ID NO: 2678868 - RNA, 13 nt, Escherichia coli CFT073
aacacauaacgcc

SEQ ID NO: 2678869 - RNA, 13 nt, Escherichia coli CFT073
aacacaugcacau

SEQ ID NO: 2678870 - RNA, 16 nt, Escherichia coli CFT073
aacacaugcacaucca

SEQ ID NO: 2678871 - RNA, 18 nt, Escherichia coli CFT073
aacacauguguucccugu

SEQ ID NO: 2678872 - RNA, 18 nt, Escherichia coli CFT073
aacacauguguugaucac

SEQ ID NO: 2678873 - RNA, 20 nt, Escherichia coli CFT073
aacacauuacuuguuucgca

SEQ ID NO: 2678874 - RNA, 14 nt, Escherichia coli CFT073
aacaccaacugccu

SEQ ID NO: 2678875 - RNA, 13 nt, Escherichia coli CFT073
aacaccaccgaaa

SEQ ID NO: 2678876 - RNA, 14 nt, Escherichia coli CFT073
aacaccacgccagc

SEQ ID NO: 2678877 - RNA, 23 nt, Escherichia coli CFT073
aacaccacgucgccgggauaaug

SEQ ID NO: 2678878 - RNA, 18 nt, Escherichia coli CFT073
aacaccagaaccagcaac

SEQ ID NO: 2678879 - RNA, 12 nt, Escherichia coli CFT073
aacaccagcagc

SEQ ID NO: 2678880 - RNA, 20 nt, Escherichia coli CFT073
aacaccagcaggugauacau

SEQ ID NO: 2678881 - RNA, 12 nt, Escherichia coli CFT073
aacaccagcagu

SEQ ID NO: 2678882 - RNA, 13 nt, Escherichia coli CFT073
aacaccagcagua

SEQ ID NO: 2678883 - RNA, 20 nt, Escherichia coli CFT073
aacaccaggcuaaauugcau

SEQ ID NO: 2678884 - RNA, 12 nt, Escherichia coli CFT073
aacaccagggaa

SEQ ID NO: 2678885 - RNA, 20 nt, Escherichia coli CFT073
aacacccccugcaaaacugg

SEQ ID NO: 2678886 - RNA, 21 nt, Escherichia coli CFT073
aacacccugaugugcagauca

SEQ ID NO: 2678887 - RNA, 22 nt, Escherichia coli CFT073
aacaccgauagaaccaaaguuu

SEQ ID NO: 2678888 - RNA, 21 nt, Escherichia coli CFT073
aacaccgcuguugccagcagc

SEQ ID NO: 2678889 - RNA, 22 nt, Escherichia coli CFT073
aacaccgcuguugccagcagca

SEQ ID NO: 2678890 - RNA, 15 nt, Escherichia coli CFT073
aacaccggcgcacug

SEQ ID NO: 2678891 - RNA, 20 nt, Escherichia coli CFT073
aacaccggugaccaucagca

SEQ ID NO: 2678892 - RNA, 23 nt, Escherichia coli CFT073
aacaccguaccaucauaagcgcc

SEQ ID NO: 2678893 - RNA, 21 nt, Escherichia coli CFT073
aacaccuaccggcuggcgcau

SEQ ID NO: 2678894 - RNA, 17 nt, Escherichia coli CFT073
aacaccugcggcggcau

SEQ ID NO: 2678895 - RNA, 17 nt, Escherichia coli CFT073
aacaccuggcaccagug

SEQ ID NO: 2678896 - RNA, 19 nt, Escherichia coli CFT073
aacacgaauaccaagcaga

SEQ ID NO: 2678897 - RNA, 21 nt, Escherichia coli CFT073
aacacgaaucaggcggcucac

SEQ ID NO: 2678898 - RNA, 20 nt, Escherichia coli CFT073
aacacgaggaauaucagccc

SEQ ID NO: 2678899 - RNA, 14 nt, Escherichia coli CFT073
aacacgaucagcca

SEQ ID NO: 2678900 - RNA, 21 nt, Escherichia coli CFT073
aacacgcaaucccguugccac

SEQ ID NO: 2678901 - RNA, 15 nt, Escherichia coli CFT073
aacacgccgauaauc

SEQ ID NO: 2678902 - RNA, 18 nt, Escherichia coli CFT073
aacacgcucccagcagug

SEQ ID NO: 2678903 - RNA, 18 nt, Escherichia coli CFT073
aacacgcugcucauccag

SEQ ID NO: 2678904 - RNA, 16 nt, Escherichia coli CFT073
aacacggcuuucugca

SEQ ID NO: 2678905 - RNA, 19 nt, Escherichia coli CFT073
aacacgggguuaaauugau

SEQ ID NO: 2678906 - RNA, 15 nt, Escherichia coli CFT073
aacacggugccagua

SEQ ID NO: 2678907 - RNA, 15 nt, Escherichia coli CFT073
aacacucguccaguc

SEQ ID NO: 2678908 - RNA, 19 nt, Escherichia coli CFT073
aacacucguccagucgccu

SEQ ID NO: 2678909 - RNA, 13 nt, Escherichia coli CFT073
aacacucuaucca

SEQ ID NO: 2678910 - RNA, 14 nt, Escherichia coli CFT073
aacacucugcgccu

SEQ ID NO: 2678911 - RNA, 22 nt, Escherichia coli CFT073
aacacugcuuuuaaaugcccga

SEQ ID NO: 2678912 - RNA, 19 nt, Escherichia coli CFT073
aacacuucuuugaugccuu

SEQ ID NO: 2678913 - RNA, 12 nt, Escherichia coli CFT073
aacacuugcggc

SEQ ID NO: 2678914 - RNA, 17 nt, Escherichia coli CFT073
aacacuuuaucugccau

SEQ ID NO: 2678915 - RNA, 21 nt, Escherichia coli CFT073
aacacuuucgccugcggcgca

SEQ ID NO: 2678916 - RNA, 13 nt, Escherichia coli CFT073
aacagaagaucau

SEQ ID NO: 2678917 - RNA, 21 nt, Escherichia coli CFT073
aacagaagguuuauauaguaa

SEQ ID NO: 2678918 - RNA, 19 nt, Escherichia coli CFT073
aacagaauacccagcaaug

SEQ ID NO: 2678919 - RNA, 20 nt, Escherichia coli CFT073
aacagaaugauauugauaau

SEQ ID NO: 2678920 - RNA, 17 nt, Escherichia coli CFT073
aacagaauggugccgac

SEQ ID NO: 2678921 - RNA, 18 nt, Escherichia coli CFT073
aacagaauggugccgaca

SEQ ID NO: 2678922 - RNA, 14 nt, Escherichia coli CFT073
aacagaguagaaau

SEQ ID NO: 2678923 - RNA, 14 nt, Escherichia coli CFT073
aacagauaauaaaa

SEQ ID NO: 2678924 - RNA, 21 nt, Escherichia coli CFT073
aacagauugcguaacgugaca

SEQ ID NO: 2678925 - RNA, 13 nt, Escherichia coli CFT073
aacagcaccaucc

SEQ ID NO: 2678926 - RNA, 23 nt, Escherichia coli CFT073
aacagcagccacggcagcaacuu

SEQ ID NO: 2678927 - RNA, 16 nt, Escherichia coli CFT073
aacagcaggcagaucc

SEQ ID NO: 2678928 - RNA, 17 nt, Escherichia coli CFT073
aacagcaggcagaucca

SEQ ID NO: 2678929 - RNA, 16 nt, Escherichia coli CFT073
aacagccacucuuaac

SEQ ID NO: 2678930 - RNA, 19 nt, Escherichia coli CFT073
aacagccacucuuaacgcc

SEQ ID NO: 2678931 - RNA, 16 nt, Escherichia coli CFT073
aacagccagaagcccg

SEQ ID NO: 2678932 - RNA, 14 nt, Escherichia coli CFT073
aacagcccgccaau

SEQ ID NO: 2678933 - RNA, 18 nt, Escherichia coli CFT073
aacagccuuguauuaaua

SEQ ID NO: 2678934 - RNA, 14 nt, Escherichia coli CFT073
aacagcgacaccag

SEQ ID NO: 2678935 - RNA, 15 nt, Escherichia coli CFT073
aacagcgacaccagc

SEQ ID NO: 2678936 - RNA, 18 nt, Escherichia coli CFT073
aacagcgacaccagccau

SEQ ID NO: 2678937 - RNA, 20 nt, Escherichia coli CFT073
aacagcgacaccagccaucu

SEQ ID NO: 2678938 - RNA, 14 nt, Escherichia coli CFT073
aacagcgaccgcag

SEQ ID NO: 2678939 - RNA, 22 nt, Escherichia coli CFT073
aacagcgaguucagacgcugca

SEQ ID NO: 2678940 - RNA, 19 nt, Escherichia coli CFT073
aacagcgcaccagaaacaa

SEQ ID NO: 2678941 - RNA, 19 nt, Escherichia coli CFT073
aacagcgccugcaaaauaa

SEQ ID NO: 2678942 - RNA, 14 nt, Escherichia coli CFT073
aacagcgcgucagc

SEQ ID NO: 2678943 - RNA, 14 nt, Escherichia coli CFT073
aacagcggcauuac

SEQ ID NO: 2678944 - RNA, 19 nt, Escherichia coli CFT073
aacagcggugcaccugcca

SEQ ID NO: 2678945 - RNA, 16 nt, Escherichia coli CFT073
aacagcguaaauaugc

SEQ ID NO: 2678946 - RNA, 15 nt, Escherichia coli CFT073
aacagcguaaugcca

SEQ ID NO: 2678947 - RNA, 20 nt, Escherichia coli CFT073
aacagcguccacagccaaca

SEQ ID NO: 2678948 - RNA, 15 nt, Escherichia coli CFT073
aacagcgucgagcca

SEQ ID NO: 2678949 - RNA, 22 nt, Escherichia coli CFT073
aacagcgugccgcgaucccaga

SEQ ID NO: 2678950 - RNA, 14 nt, Escherichia coli CFT073
aacagcucaacgcc

SEQ ID NO: 2678951 - RNA, 15 nt, Escherichia coli CFT073
aacagcuuuuuccug

SEQ ID NO: 2678952 - RNA, 12 nt, Escherichia coli CFT073
aacaggaaacag

SEQ ID NO: 2678953 - RNA, 12 nt, Escherichia coli CFT073
aacaggagcacg

SEQ ID NO: 2678954 - RNA, 14 nt, Escherichia coli CFT073
aacaggagccaucu

SEQ ID NO: 2678955 - RNA, 16 nt, Escherichia coli CFT073
aacaggaguagcucug

SEQ ID NO: 2678956 - RNA, 19 nt, Escherichia coli CFT073
aacaggauaucugaaaguu

SEQ ID NO: 2678957 - RNA, 17 nt, Escherichia coli CFT073
aacaggcgaucuucccg

SEQ ID NO: 2678958 - RNA, 17 nt, Escherichia coli CFT073
aacaggcgauuucaaau

SEQ ID NO: 2678959 - RNA, 23 nt, Escherichia coli CFT073
aacaggcgcagaacuucacucuc

SEQ ID NO: 2678960 - RNA, 19 nt, Escherichia coli CFT073
aacaggcggcuaugcugga

SEQ ID NO: 2678961 - RNA, 15 nt, Escherichia coli CFT073
aacaggcugcugccg

SEQ ID NO: 2678962 - RNA, 14 nt, Escherichia coli CFT073
aacagguaucauua

SEQ ID NO: 2678963 - RNA, 18 nt, Escherichia coli CFT073
aacagguaucauuaaggc

SEQ ID NO: 2678964 - RNA, 11 nt, Escherichia coli CFT073
aacagguugau

SEQ ID NO: 2678965 - RNA, 11 nt, Escherichia coli CFT073
aacagguugcg

SEQ ID NO: 2678966 - RNA, 20 nt, Escherichia coli CFT073
aacagguugcggacgcgcag

SEQ ID NO: 2678967 - RNA, 19 nt, Escherichia coli CFT073
aacaguaaacucgacuuuc

SEQ ID NO: 2678968 - RNA, 15 nt, Escherichia coli CFT073
aacaguaauaaugcc

SEQ ID NO: 2678969 - RNA, 19 nt, Escherichia coli CFT073
aacaguaauaaugcccauc

SEQ ID NO: 2678970 - RNA, 22 nt, Escherichia coli CFT073
aacaguaaugccguggcaaagu

SEQ ID NO: 2678971 - RNA, 19 nt, Escherichia coli CFT073
aacagucaguuaucgcauu

SEQ ID NO: 2678972 - RNA, 18 nt, Escherichia coli CFT073
aacagucgcucggcgaca

SEQ ID NO: 2678973 - RNA, 22 nt, Escherichia coli CFT073
aacagucgcucggcgacacguu

SEQ ID NO: 2678974 - RNA, 15 nt, Escherichia coli CFT073
aacagucucaagcac

SEQ ID NO: 2678975 - RNA, 20 nt, Escherichia coli CFT073
aacagugccagacaaaccac

SEQ ID NO: 2678976 - RNA, 21 nt, Escherichia coli CFT073
aacagugccagacaaaccacg

SEQ ID NO: 2678977 - RNA, 15 nt, Escherichia coli CFT073
aacagugccgaugcc

SEQ ID NO: 2678978 - RNA, 15 nt, Escherichia coli CFT073
aacagugccgcgcau

SEQ ID NO: 2678979 - RNA, 14 nt, Escherichia coli CFT073
aacaguggcgacaa

SEQ ID NO: 2678980 - RNA, 17 nt, Escherichia coli CFT073
aacaguggcgacaagca

SEQ ID NO: 2678981 - RNA, 23 nt, Escherichia coli CFT073
aacaguucacccgguccgcgaau

SEQ ID NO: 2678982 - RNA, 23 nt, Escherichia coli CFT073
aacaguuccgcaaagcccaucac

SEQ ID NO: 2678983 - RNA, 19 nt, Escherichia coli CFT073
aacaguuugccaaaccagc

SEQ ID NO: 2678984 - RNA, 19 nt, Escherichia coli CFT073
aacaguuuucgcaccgcgu

SEQ ID NO: 2678985 - RNA, 19 nt, Escherichia coli CFT073
aacauaauccagccuucua

SEQ ID NO: 2678986 - RNA, 13 nt, Escherichia coli CFT073
aacauaaugccga

SEQ ID NO: 2678987 - RNA, 21 nt, Escherichia coli CFT073
aacauaaugccgacaucaaac

SEQ ID NO: 2678988 - RNA, 23 nt, Escherichia coli CFT073
aacauaaugccgacaucaaacag

SEQ ID NO: 2678989 - RNA, 13 nt, Escherichia coli CFT073
aacauaauguaaa

SEQ ID NO: 2678990 - RNA, 20 nt, Escherichia coli CFT073
aacauaccuaaaagcacgcc

SEQ ID NO: 2678991 - RNA, 20 nt, Escherichia coli CFT073
aacauacgacuuugcgcagg

SEQ ID NO: 2678992 - RNA, 24 nt, Escherichia coli CFT073
aacauacgacuuugcgcaggcaag

SEQ ID NO: 2678993 - RNA, 16 nt, Escherichia coli CFT073
aacauacggcauaaua

SEQ ID NO: 2678994 - RNA, 13 nt, Escherichia coli CFT073
aacauacuuucuc

SEQ ID NO: 2678995 - RNA, 16 nt, Escherichia coli CFT073
aacauagcccgguaua

SEQ ID NO: 2678996 - RNA, 18 nt, Escherichia coli CFT073
aacauagcuuggcagagc

SEQ ID NO: 2678997 - RNA, 10 nt, Escherichia coli CFT073
aacauauaag

SEQ ID NO: 2678998 - RNA, 22 nt, Escherichia coli CFT073
aacauauaaguggagcccucaa

SEQ ID NO: 2678999 - RNA, 14 nt, Escherichia coli CFT073
aacauaucacuuuu

SEQ ID NO: 2679000 - RNA, 19 nt, Escherichia coli CFT073
aacauaucacuuuuauaua

SEQ ID NO: 2679001 - RNA, 15 nt, Escherichia coli CFT073
aacauaucagcgcaa

SEQ ID NO: 2679002 - RNA, 18 nt, Escherichia coli CFT073
aacauaucagcgcaaaga

SEQ ID NO: 2679003 - RNA, 16 nt, Escherichia coli CFT073
aacauaucccaccagc

SEQ ID NO: 2679004 - RNA, 22 nt, Escherichia coli CFT073
aacauauuccgcaccugccagc

SEQ ID NO: 2679005 - RNA, 19 nt, Escherichia coli CFT073
aacauauuccggugccgga

SEQ ID NO: 2679006 - RNA, 11 nt, Escherichia coli CFT073
aacauauugcu

SEQ ID NO: 2679007 - RNA, 22 nt, Escherichia coli CFT073
aacauauugcuccauaauugcc

SEQ ID NO: 2679008 - RNA, 17 nt, Escherichia coli CFT073
aacaucaaacuguucgg

SEQ ID NO: 2679009 - RNA, 14 nt, Escherichia coli CFT073
aacaucaaaucaca

SEQ ID NO: 2679010 - RNA, 16 nt, Escherichia coli CFT073
aacaucaaaucacagc

SEQ ID NO: 2679011 - RNA, 20 nt, Escherichia coli CFT073
aacaucaagcggcgcaugca

SEQ ID NO: 2679012 - RNA, 15 nt, Escherichia coli CFT073
aacaucaauccaaac

SEQ ID NO: 2679013 - RNA, 20 nt, Escherichia coli CFT073
aacaucacaccauauccagc

SEQ ID NO: 2679014 - RNA, 22 nt, Escherichia coli CFT073
aacaucacaccauauccagcgc

SEQ ID NO: 2679015 - RNA, 12 nt, Escherichia coli CFT073
aacaucacaugc

SEQ ID NO: 2679016 - RNA, 22 nt, Escherichia coli CFT073
aacaucaccaaugacagcccca

SEQ ID NO: 2679017 - RNA, 19 nt, Escherichia coli CFT073
aacaucacgccuucaauau

SEQ ID NO: 2679018 - RNA, 14 nt, Escherichia coli CFT073
aacaucacgcugac

SEQ ID NO: 2679019 - RNA, 13 nt, Escherichia coli CFT073
aacaucacugcaa

SEQ ID NO: 2679020 - RNA, 18 nt, Escherichia coli CFT073
aacaucagcauucgucau

SEQ ID NO: 2679021 - RNA, 20 nt, Escherichia coli CFT073
aacaucauaauaauugcggc

SEQ ID NO: 2679022 - RNA, 22 nt, Escherichia coli CFT073
aacaucauaauaauugcggcgg

SEQ ID NO: 2679023 - RNA, 15 nt, Escherichia coli CFT073
aacaucaucacgcag

SEQ ID NO: 2679024 - RNA, 20 nt, Escherichia coli CFT073
aacaucaucacgcagagcau

SEQ ID NO: 2679025 - RNA, 21 nt, Escherichia coli CFT073
aacaucauugccgccugggug

SEQ ID NO: 2679026 - RNA, 22 nt, Escherichia coli CFT073
aacauccagcucgcguucuguc

SEQ ID NO: 2679027 - RNA, 21 nt, Escherichia coli CFT073
aacauccccagcgucagcagc

SEQ ID NO: 2679028 - RNA, 15 nt, Escherichia coli CFT073
aacauccccauaucc

SEQ ID NO: 2679029 - RNA, 19 nt, Escherichia coli CFT073
aacauccccauaucccgga

SEQ ID NO: 2679030 - RNA, 21 nt, Escherichia coli CFT073
aacauccgcuuuugguuuuuc

SEQ ID NO: 2679031 - RNA, 13 nt, Escherichia coli CFT073
aacauccggcaac

SEQ ID NO: 2679032 - RNA, 19 nt, Escherichia coli CFT073
aacauccggcacuuucgga

SEQ ID NO: 2679033 - RNA, 21 nt, Escherichia coli CFT073
aacaucgagugcggcgagcau

SEQ ID NO: 2679034 - RNA, 23 nt, Escherichia coli CFT073
aacaucgccagagaagaaaaccg

SEQ ID NO: 2679035 - RNA, 11 nt, Escherichia coli CFT073
aacaucgccau

SEQ ID NO: 2679036 - RNA, 15 nt, Escherichia coli CFT073
aacaucggcaguaau

SEQ ID NO: 2679037 - RNA, 17 nt, Escherichia coli CFT073
aacaucgggauaucgcc

SEQ ID NO: 2679038 - RNA, 16 nt, Escherichia coli CFT073
aacaucgguacacaaa

SEQ ID NO: 2679039 - RNA, 16 nt, Escherichia coli CFT073
aacaucucaauauccg

SEQ ID NO: 2679040 - RNA, 21 nt, Escherichia coli CFT073
aacaucuuaauagcugccagc

SEQ ID NO: 2679041 - RNA, 17 nt, Escherichia coli CFT073
aacaucuuccacaugcc

SEQ ID NO: 2679042 - RNA, 14 nt, Escherichia coli CFT073
aacaucuuuacuca

SEQ ID NO: 2679043 - RNA, 15 nt, Escherichia coli CFT073
aacaugagaacaguu

SEQ ID NO: 2679044 - RNA, 15 nt, Escherichia coli CFT073
aacaugccacuggcu

SEQ ID NO: 2679045 - RNA, 19 nt, Escherichia coli CFT073
aacaugccacuggcuccac

SEQ ID NO: 2679046 - RNA, 17 nt, Escherichia coli CFT073
aacaugcgcagaagcau

SEQ ID NO: 2679047 - RNA, 23 nt, Escherichia coli CFT073
aacaugcgggucuuacuggggaa

SEQ ID NO: 2679048 - RNA, 15 nt, Escherichia coli CFT073
aacaugcuauuacgc

SEQ ID NO: 2679049 - RNA, 21 nt, Escherichia coli CFT073
aacaugcuauuacgccagccu

SEQ ID NO: 2679050 - RNA, 22 nt, Escherichia coli CFT073
aacauggcacugcgaucccggc

SEQ ID NO: 2679051 - RNA, 16 nt, Escherichia coli CFT073
aacauggcgcggcaca

SEQ ID NO: 2679052 - RNA, 15 nt, Escherichia coli CFT073
aacauggucaucauc

SEQ ID NO: 2679053 - RNA, 18 nt, Escherichia coli CFT073
aacaugguuaaaaucucc

SEQ ID NO: 2679054 - RNA, 18 nt, Escherichia coli CFT073
aacauguuccugccaguc

SEQ ID NO: 2679055 - RNA, 18 nt, Escherichia coli CFT073
aacauuaucugaugcgcu

SEQ ID NO: 2679056 - RNA, 19 nt, Escherichia coli CFT073
aacauucaucauuucauuu

SEQ ID NO: 2679057 - RNA, 19 nt, Escherichia coli CFT073
aacauucccaucaguagca

SEQ ID NO: 2679058 - RNA, 22 nt, Escherichia coli CFT073
aacauucccgguuucaggauga

SEQ ID NO: 2679059 - RNA, 13 nt, Escherichia coli CFT073
aacauucgagaau

SEQ ID NO: 2679060 - RNA, 15 nt, Escherichia coli CFT073
aacauucggcaaugg

SEQ ID NO: 2679061 - RNA, 21 nt, Escherichia coli CFT073
aacauucguugcaguaaaauu

SEQ ID NO: 2679062 - RNA, 22 nt, Escherichia coli CFT073
aacauucguugcaguaaaauuu

SEQ ID NO: 2679063 - RNA, 17 nt, Escherichia coli CFT073
aacauugauaagcaagu

SEQ ID NO: 2679064 - RNA, 12 nt, Escherichia coli CFT073
aacauugcugcu

SEQ ID NO: 2679065 - RNA, 13 nt, Escherichia coli CFT073
aacauugcugcug

SEQ ID NO: 2679066 - RNA, 12 nt, Escherichia coli CFT073
aacauuggcuca

SEQ ID NO: 2679067 - RNA, 19 nt, Escherichia coli CFT073
aacauuuagcguuaaaauu

SEQ ID NO: 2679068 - RNA, 20 nt, Escherichia coli CFT073
aacauuuagcguuaaaauuu

SEQ ID NO: 2679069 - RNA, 14 nt, Escherichia coli CFT073
aacauuuccagcgc

SEQ ID NO: 2679070 - RNA, 13 nt, Escherichia coli CFT073
aacauuugggcug

SEQ ID NO: 2679071 - RNA, 19 nt, Escherichia coli CFT073
aacauuuucuucugccagg

SEQ ID NO: 2679072 - RNA, 14 nt, Escherichia coli CFT073
aaccaaacagcgcc

SEQ ID NO: 2679073 - RNA, 15 nt, Escherichia coli CFT073
aaccaaaccagccgc

SEQ ID NO: 2679074 - RNA, 18 nt, Escherichia coli CFT073
aaccaaaccagccgccaa

SEQ ID NO: 2679075 - RNA, 20 nt, Escherichia coli CFT073
aaccaaaguuugcaaaccca

SEQ ID NO: 2679076 - RNA, 12 nt, Escherichia coli CFT073
aaccaaaugccg

SEQ ID NO: 2679077 - RNA, 14 nt, Escherichia coli CFT073
aaccaacaaaacau

SEQ ID NO: 2679078 - RNA, 15 nt, Escherichia coli CFT073
aaccaacaagcaccg

SEQ ID NO: 2679079 - RNA, 19 nt, Escherichia coli CFT073
aaccaacaagcaccggcac

SEQ ID NO: 2679080 - RNA, 13 nt, Escherichia coli CFT073
aaccaacaauaca

SEQ ID NO: 2679081 - RNA, 15 nt, Escherichia coli CFT073
aaccaaccagcgugu

SEQ ID NO: 2679082 - RNA, 13 nt, Escherichia coli CFT073
aaccaaccgcaau

SEQ ID NO: 2679083 - RNA, 20 nt, Escherichia coli CFT073
aaccaacgcauagacagcca

SEQ ID NO: 2679084 - RNA, 21 nt, Escherichia coli CFT073
aaccaacgcauagacagccac

SEQ ID NO: 2679085 - RNA, 16 nt, Escherichia coli CFT073
aaccaacgcuagcagc

SEQ ID NO: 2679086 - RNA, 18 nt, Escherichia coli CFT073
aaccaacgcuagcagcag

SEQ ID NO: 2679087 - RNA, 18 nt, Escherichia coli CFT073
aaccaagacuauuaauau

SEQ ID NO: 2679088 - RNA, 13 nt, Escherichia coli CFT073
aaccaauauugcg

SEQ ID NO: 2679089 - RNA, 21 nt, Escherichia coli CFT073
aaccaaucaucgacauugacc

SEQ ID NO: 2679090 - RNA, 13 nt, Escherichia coli CFT073
aaccaaugccacc

SEQ ID NO: 2679091 - RNA, 15 nt, Escherichia coli CFT073
aaccacaaccacuuu

SEQ ID NO: 2679092 - RNA, 15 nt, Escherichia coli CFT073
aaccacaaccucagc

SEQ ID NO: 2679093 - RNA, 14 nt, Escherichia coli CFT073
aaccacacuucuuc

SEQ ID NO: 2679094 - RNA, 13 nt, Escherichia coli CFT073
aaccacagcgccg

SEQ ID NO: 2679095 - RNA, 21 nt, Escherichia coli CFT073
aaccacagugaggguuucuuc

SEQ ID NO: 2679096 - RNA, 12 nt, Escherichia coli CFT073
aaccacaucagc

SEQ ID NO: 2679097 - RNA, 22 nt, Escherichia coli CFT073
aaccacauggagcuuuaaacac

SEQ ID NO: 2679098 - RNA, 14 nt, Escherichia coli CFT073
aaccaccaaacugc

SEQ ID NO: 2679099 - RNA, 14 nt, Escherichia coli CFT073
aaccacccaccagc

SEQ ID NO: 2679100 - RNA, 19 nt, Escherichia coli CFT073
aaccaccgaagaucaccac

SEQ ID NO: 2679101 - RNA, 15 nt, Escherichia coli CFT073
aaccaccgaccacgg

SEQ ID NO: 2679102 - RNA, 20 nt, Escherichia coli CFT073
aaccaccgaccacggccagu

SEQ ID NO: 2679103 - RNA, 21 nt, Escherichia coli CFT073
aaccaccgccacuaccaucag

SEQ ID NO: 2679104 - RNA, 14 nt, Escherichia coli CFT073
aaccaccggcacca

SEQ ID NO: 2679105 - RNA, 15 nt, Escherichia coli CFT073
aaccaccggcaccac

SEQ ID NO: 2679106 - RNA, 14 nt, Escherichia coli CFT073
aaccaccuccacgc

SEQ ID NO: 2679107 - RNA, 10 nt, Escherichia coli CFT073
aaccacgcca

SEQ ID NO: 2679108 - RNA, 17 nt, Escherichia coli CFT073
aaccacggaaaggcagu

SEQ ID NO: 2679109 - RNA, 20 nt, Escherichia coli CFT073
aaccacggccaaaucgccau

SEQ ID NO: 2679110 - RNA, 16 nt, Escherichia coli CFT073
aaccacuaauuccugc

SEQ ID NO: 2679111 - RNA, 18 nt, Escherichia coli CFT073
aaccacuaccguaguaaa

SEQ ID NO: 2679112 - RNA, 19 nt, Escherichia coli CFT073
aaccacuaccguaguaaau

SEQ ID NO: 2679113 - RNA, 18 nt, Escherichia coli CFT073
aaccacucaccgcuggcg

SEQ ID NO: 2679114 - RNA, 23 nt, Escherichia coli CFT073
aaccacucccgcgcuucgcggac

SEQ ID NO: 2679115 - RNA, 21 nt, Escherichia coli CFT073
aaccacugacacaggcagcaa

SEQ ID NO: 2679116 - RNA, 23 nt, Escherichia coli CFT073
aaccacugacacaggcagcaauc

SEQ ID NO: 2679117 - RNA, 20 nt, Escherichia coli CFT073
aaccacuuaacguuaccuuu

SEQ ID NO: 2679118 - RNA, 23 nt, Escherichia coli CFT073
aaccacuuuacgcaaaauaucga

SEQ ID NO: 2679119 - RNA, 14 nt, Escherichia coli CFT073
aaccagaaaccgug

SEQ ID NO: 2679120 - RNA, 15 nt, Escherichia coli CFT073
aaccagaaagggaag

SEQ ID NO: 2679121 - RNA, 20 nt, Escherichia coli CFT073
aaccagaauuuccagaaagu

SEQ ID NO: 2679122 - RNA, 17 nt, Escherichia coli CFT073
aaccagacaacagucaa

SEQ ID NO: 2679123 - RNA, 15 nt, Escherichia coli CFT073
aaccagacgauuuuc

SEQ ID NO: 2679124 - RNA, 17 nt, Escherichia coli CFT073
aaccagacgauuuuccc

SEQ ID NO: 2679125 - RNA, 15 nt, Escherichia coli CFT073
aaccagagaauauua

SEQ ID NO: 2679126 - RNA, 13 nt, Escherichia coli CFT073
aaccagagacaga

SEQ ID NO: 2679127 - RNA, 16 nt, Escherichia coli CFT073
aaccagaucugacgau

SEQ ID NO: 2679128 - RNA, 12 nt, Escherichia coli CFT073
aaccagcaaugc

SEQ ID NO: 2679129 - RNA, 13 nt, Escherichia coli CFT073
aaccagcaaugcc

SEQ ID NO: 2679130 - RNA, 14 nt, Escherichia coli CFT073
aaccagcaaugcca

SEQ ID NO: 2679131 - RNA, 17 nt, Escherichia coli CFT073
aaccagcaaugccagcg

SEQ ID NO: 2679132 - RNA, 13 nt, Escherichia coli CFT073
aaccagcaccagc

SEQ ID NO: 2679133 - RNA, 19 nt, Escherichia coli CFT073
aaccagcaccuuuuccagu

SEQ ID NO: 2679134 - RNA, 22 nt, Escherichia coli CFT073
aaccagcaccuuuuccaguggc

SEQ ID NO: 2679135 - RNA, 16 nt, Escherichia coli CFT073
aaccagcagcaucacc

SEQ ID NO: 2679136 - RNA, 18 nt, Escherichia coli CFT073
aaccagcagcaucaccac

SEQ ID NO: 2679137 - RNA, 19 nt, Escherichia coli CFT073
aaccagcaggucgauaauu

SEQ ID NO: 2679138 - RNA, 18 nt, Escherichia coli CFT073
aaccagccacugcgccau

SEQ ID NO: 2679139 - RNA, 12 nt, Escherichia coli CFT073
aaccagcgcaca

SEQ ID NO: 2679140 - RNA, 17 nt, Escherichia coli CFT073
aaccagcgcagacacca

SEQ ID NO: 2679141 - RNA, 14 nt, Escherichia coli CFT073
aaccagcggcgcau

SEQ ID NO: 2679142 - RNA, 23 nt, Escherichia coli CFT073
aaccagcguguuaggaucacgcc

SEQ ID NO: 2679143 - RNA, 23 nt, Escherichia coli CFT073
aaccagcguuuccagcaccaguu

SEQ ID NO: 2679144 - RNA, 11 nt, Escherichia coli CFT073
aaccagcugcc

SEQ ID NO: 2679145 - RNA, 19 nt, Escherichia coli CFT073
aaccaggcaaguucuuuug

SEQ ID NO: 2679146 - RNA, 17 nt, Escherichia coli CFT073
aaccagggaaaaaagcc

SEQ ID NO: 2679147 - RNA, 19 nt, Escherichia coli CFT073
aaccaguacugacuaucca

SEQ ID NO: 2679148 - RNA, 18 nt, Escherichia coli CFT073
aaccaguagcaaaacuca

SEQ ID NO: 2679149 - RNA, 23 nt, Escherichia coli CFT073
aaccaguagcaaaacucaccauc

SEQ ID NO: 2679150 - RNA, 15 nt, Escherichia coli CFT073
aaccagucacgguua

SEQ ID NO: 2679151 - RNA, 14 nt, Escherichia coli CFT073
aaccaguucacuug

SEQ ID NO: 2679152 - RNA, 21 nt, Escherichia coli CFT073
aaccaguucauuuuucucaac

SEQ ID NO: 2679153 - RNA, 21 nt, Escherichia coli CFT073
aaccaguuuaugccuguccuc

SEQ ID NO: 2679154 - RNA, 21 nt, Escherichia coli CFT073
aaccaguuuuugcgcccauga

SEQ ID NO: 2679155 - RNA, 23 nt, Escherichia coli CFT073
aaccaguuuuugcgcccaugaug

SEQ ID NO: 2679156 - RNA, 17 nt, Escherichia coli CFT073
aaccauaaucucaucgg

SEQ ID NO: 2679157 - RNA, 15 nt, Escherichia coli CFT073
aaccauaaugaugcc

SEQ ID NO: 2679158 - RNA, 18 nt, Escherichia coli CFT073
aaccauagaauacgccac

SEQ ID NO: 2679159 - RNA, 15 nt, Escherichia coli CFT073
aaccauauuuaugca

SEQ ID NO: 2679160 - RNA, 22 nt, Escherichia coli CFT073
aaccauccacauuuucagccag

SEQ ID NO: 2679161 - RNA, 13 nt, Escherichia coli CFT073
aaccauccauauu

SEQ ID NO: 2679162 - RNA, 16 nt, Escherichia coli CFT073
aaccauccgagcagca

SEQ ID NO: 2679163 - RNA, 22 nt, Escherichia coli CFT073
aaccaucgccguaaagccggug

SEQ ID NO: 2679164 - RNA, 17 nt, Escherichia coli CFT073
aaccaucgguacgcuuu

SEQ ID NO: 2679165 - RNA, 16 nt, Escherichia coli CFT073
aaccaucugauucuuc

SEQ ID NO: 2679166 - RNA, 15 nt, Escherichia coli CFT073
aaccaugcaaucacu

SEQ ID NO: 2679167 - RNA, 21 nt, Escherichia coli CFT073
aaccaugcaaucacugccacc

SEQ ID NO: 2679168 - RNA, 19 nt, Escherichia coli CFT073
aaccaugcaggaucgcucc

SEQ ID NO: 2679169 - RNA, 23 nt, Escherichia coli CFT073
aaccauuagucuggauugcagag

SEQ ID NO: 2679170 - RNA, 17 nt, Escherichia coli CFT073
aacccaaauccgccauc

SEQ ID NO: 2679171 - RNA, 22 nt, Escherichia coli CFT073
aacccaaauccgccaucaacac

SEQ ID NO: 2679172 - RNA, 16 nt, Escherichia coli CFT073
aacccaaccugccaga

SEQ ID NO: 2679173 - RNA, 12 nt, Escherichia coli CFT073
aacccaacggca

SEQ ID NO: 2679174 - RNA, 22 nt, Escherichia coli CFT073
aacccaacguucguacugcccu

SEQ ID NO: 2679175 - RNA, 13 nt, Escherichia coli CFT073
aacccacaaaaac

SEQ ID NO: 2679176 - RNA, 18 nt, Escherichia coli CFT073
aacccacaaaaacaccgc

SEQ ID NO: 2679177 - RNA, 19 nt, Escherichia coli CFT073
aacccacagcgcaccaacg

SEQ ID NO: 2679178 - RNA, 23 nt, Escherichia coli CFT073
aacccaccaccgcuaacugcugc

SEQ ID NO: 2679179 - RNA, 13 nt, Escherichia coli CFT073
aacccaccaugcc

SEQ ID NO: 2679180 - RNA, 23 nt, Escherichia coli CFT073
aacccagaagaaagccggaugau

SEQ ID NO: 2679181 - RNA, 15 nt, Escherichia coli CFT073
aacccagacaaauaa

SEQ ID NO: 2679182 - RNA, 16 nt, Escherichia coli CFT073
aacccagacaaauaac

SEQ ID NO: 2679183 - RNA, 17 nt, Escherichia coli CFT073
aacccagcaccaacaaa

SEQ ID NO: 2679184 - RNA, 21 nt, Escherichia coli CFT073
aacccagcagcccgagcaaca

SEQ ID NO: 2679185 - RNA, 21 nt, Escherichia coli CFT073
aacccagcgauggacgcagac

SEQ ID NO: 2679186 - RNA, 22 nt, Escherichia coli CFT073
aacccagcggaugacccagcgc

SEQ ID NO: 2679187 - RNA, 13 nt, Escherichia coli CFT073
aacccauccagca

SEQ ID NO: 2679188 - RNA, 17 nt, Escherichia coli CFT073
aacccauccagcagaga

SEQ ID NO: 2679189 - RNA, 19 nt, Escherichia coli CFT073
aacccauuuucagccggca

SEQ ID NO: 2679190 - RNA, 13 nt, Escherichia coli CFT073
aaccccguaucca

SEQ ID NO: 2679191 - RNA, 16 nt, Escherichia coli CFT073
aaccccgucugucuug

SEQ ID NO: 2679192 - RNA, 19 nt, Escherichia coli CFT073
aacccgcgcgcuaacggag

SEQ ID NO: 2679193 - RNA, 17 nt, Escherichia coli CFT073
aacccgcuucuuccagc

SEQ ID NO: 2679194 - RNA, 19 nt, Escherichia coli CFT073
aacccggccugauauauca

SEQ ID NO: 2679195 - RNA, 14 nt, Escherichia coli CFT073
aacccguugcuuca

SEQ ID NO: 2679196 - RNA, 19 nt, Escherichia coli CFT073
aacccugaaaucagagaga

SEQ ID NO: 2679197 - RNA, 12 nt, Escherichia coli CFT073
aacccugcgcau

SEQ ID NO: 2679198 - RNA, 18 nt, Escherichia coli CFT073
aacccuggugcaauuacg

SEQ ID NO: 2679199 - RNA, 15 nt, Escherichia coli CFT073
aacccuuccgccgca

SEQ ID NO: 2679200 - RNA, 19 nt, Escherichia coli CFT073
aaccgacauugccaguuuu

SEQ ID NO: 2679201 - RNA, 19 nt, Escherichia coli CFT073
aaccgaccaaucacaucgc

SEQ ID NO: 2679202 - RNA, 20 nt, Escherichia coli CFT073
aaccgaccgguccacuuccu

SEQ ID NO: 2679203 - RNA, 17 nt, Escherichia coli CFT073
aaccgagauaaaugcca

SEQ ID NO: 2679204 - RNA, 18 nt, Escherichia coli CFT073
aaccgagauaaaugccaa

SEQ ID NO: 2679205 - RNA, 13 nt, Escherichia coli CFT073
aaccgauaccgac

SEQ ID NO: 2679206 - RNA, 15 nt, Escherichia coli CFT073
aaccgcaaaaccaac

SEQ ID NO: 2679207 - RNA, 16 nt, Escherichia coli CFT073
aaccgcaccaaaucca

SEQ ID NO: 2679208 - RNA, 18 nt, Escherichia coli CFT073
aaccgcaucauguaaauc

SEQ ID NO: 2679209 - RNA, 21 nt, Escherichia coli CFT073
aaccgcaucauguaaaucaau

SEQ ID NO: 2679210 - RNA, 17 nt, Escherichia coli CFT073
aaccgcauccggcgcaa

SEQ ID NO: 2679211 - RNA, 15 nt, Escherichia coli CFT073
aaccgccaacagcag

SEQ ID NO: 2679212 - RNA, 11 nt, Escherichia coli CFT073
aaccgccaccu

SEQ ID NO: 2679213 - RNA, 19 nt, Escherichia coli CFT073
aaccgccagcacagccagc

SEQ ID NO: 2679214 - RNA, 20 nt, Escherichia coli CFT073
aaccgccagcacagccagcc

SEQ ID NO: 2679215 - RNA, 21 nt, Escherichia coli CFT073
aaccgccaguucccccugcca

SEQ ID NO: 2679216 - RNA, 19 nt, Escherichia coli CFT073
aaccgcccaccgccaggca

SEQ ID NO: 2679217 - RNA, 20 nt, Escherichia coli CFT073
aaccgcccagaccugcguuc

SEQ ID NO: 2679218 - RNA, 14 nt, Escherichia coli CFT073
aaccgcccagcagc

SEQ ID NO: 2679219 - RNA, 18 nt, Escherichia coli CFT073
aaccgcccagugccagca

SEQ ID NO: 2679220 - RNA, 12 nt, Escherichia coli CFT073
aaccgcuauccu

SEQ ID NO: 2679221 - RNA, 19 nt, Escherichia coli CFT073
aaccggaaauccaggucag

SEQ ID NO: 2679222 - RNA, 15 nt, Escherichia coli CFT073
aaccggaaccagcgc

SEQ ID NO: 2679223 - RNA, 14 nt, Escherichia coli CFT073
aaccggauacccug

SEQ ID NO: 2679224 - RNA, 16 nt, Escherichia coli CFT073
aaccggauuuucacca

SEQ ID NO: 2679225 - RNA, 13 nt, Escherichia coli CFT073
aaccggcaagcaa

SEQ ID NO: 2679226 - RNA, 16 nt, Escherichia coli CFT073
aaccggcacuucaacu

SEQ ID NO: 2679227 - RNA, 20 nt, Escherichia coli CFT073
aaccggccuguaaggaauaa

SEQ ID NO: 2679228 - RNA, 22 nt, Escherichia coli CFT073
aaccggccuugcggaaagccag

SEQ ID NO: 2679229 - RNA, 15 nt, Escherichia coli CFT073
aaccgggaagaucca

SEQ ID NO: 2679230 - RNA, 14 nt, Escherichia coli CFT073
aaccgguaccggac

SEQ ID NO: 2679231 - RNA, 14 nt, Escherichia coli CFT073
aaccgguacgccgc

SEQ ID NO: 2679232 - RNA, 14 nt, Escherichia coli CFT073
aaccggugcgcgau

SEQ ID NO: 2679233 - RNA, 21 nt, Escherichia coli CFT073
aaccggugcgcgaucuuccuc

SEQ ID NO: 2679234 - RNA, 22 nt, Escherichia coli CFT073
aaccggugcgcgaucuuccucu

SEQ ID NO: 2679235 - RNA, 18 nt, Escherichia coli CFT073
aaccgguuuagaaaagag

SEQ ID NO: 2679236 - RNA, 22 nt, Escherichia coli CFT073
aaccguacuucaccucauguaa

SEQ ID NO: 2679237 - RNA, 21 nt, Escherichia coli CFT073
aaccguaguggccacagauaa

SEQ ID NO: 2679238 - RNA, 22 nt, Escherichia coli CFT073
aaccguaguggccacagauaau

SEQ ID NO: 2679239 - RNA, 15 nt, Escherichia coli CFT073
aaccgucgagauaca

SEQ ID NO: 2679240 - RNA, 14 nt, Escherichia coli CFT073
aaccgucgcgccgg

SEQ ID NO: 2679241 - RNA, 16 nt, Escherichia coli CFT073
aaccgugcuucagcca

SEQ ID NO: 2679242 - RNA, 14 nt, Escherichia coli CFT073
aaccguggcaaaau

SEQ ID NO: 2679243 - RNA, 17 nt, Escherichia coli CFT073
aaccguguuuauuuuuc

SEQ ID NO: 2679244 - RNA, 22 nt, Escherichia coli CFT073
aaccguuauuauuacguccacc

SEQ ID NO: 2679245 - RNA, 13 nt, Escherichia coli CFT073
aaccguucauuuc

SEQ ID NO: 2679246 - RNA, 20 nt, Escherichia coli CFT073
aaccguuggcaucaagaaaa

SEQ ID NO: 2679247 - RNA, 16 nt, Escherichia coli CFT073
aaccuaacgcugucgg

SEQ ID NO: 2679248 - RNA, 22 nt, Escherichia coli CFT073
aaccucacagaggucuuuucuc

SEQ ID NO: 2679249 - RNA, 18 nt, Escherichia coli CFT073
aaccucauuaaucaccag

SEQ ID NO: 2679250 - RNA, 19 nt, Escherichia coli CFT073
aaccucauuaaucaccagu

SEQ ID NO: 2679251 - RNA, 11 nt, Escherichia coli CFT073
aaccuccagca

SEQ ID NO: 2679252 - RNA, 15 nt, Escherichia coli CFT073
aaccuccuccggcau

SEQ ID NO: 2679253 - RNA, 20 nt, Escherichia coli CFT073
aaccuccuccggcaucuuua

SEQ ID NO: 2679254 - RNA, 13 nt, Escherichia coli CFT073
aaccucuguucag

SEQ ID NO: 2679255 - RNA, 18 nt, Escherichia coli CFT073
aaccucuguuggcgacgu

SEQ ID NO: 2679256 - RNA, 19 nt, Escherichia coli CFT073
aaccugcaggaaagcaaga

SEQ ID NO: 2679257 - RNA, 18 nt, Escherichia coli CFT073
aaccugcagguuggcuuu

SEQ ID NO: 2679258 - RNA, 21 nt, Escherichia coli CFT073
aaccugccgcgucgggcauca

SEQ ID NO: 2679259 - RNA, 23 nt, Escherichia coli CFT073
aaccugcuguguaauuugcguuu

SEQ ID NO: 2679260 - RNA, 14 nt, Escherichia coli CFT073
aaccuguuaaugcg

SEQ ID NO: 2679261 - RNA, 21 nt, Escherichia coli CFT073
aaccuguuaaugcgaaugaaa

SEQ ID NO: 2679262 - RNA, 13 nt, Escherichia coli CFT073
aaccuguuuucac

SEQ ID NO: 2679263 - RNA, 14 nt, Escherichia coli CFT073
aaccuuacaaguaa

SEQ ID NO: 2679264 - RNA, 13 nt, Escherichia coli CFT073
aaccuuccagcuu

SEQ ID NO: 2679265 - RNA, 22 nt, Escherichia coli CFT073
aaccuucggaaauggucacaca

SEQ ID NO: 2679266 - RNA, 22 nt, Escherichia coli CFT073
aaccuucuucauuaugaauagc

SEQ ID NO: 2679267 - RNA, 20 nt, Escherichia coli CFT073
aaccuugcaggccauaugac

SEQ ID NO: 2679268 - RNA, 21 nt, Escherichia coli CFT073
aaccuugcaggccauaugaca

SEQ ID NO: 2679269 - RNA, 16 nt, Escherichia coli CFT073
aaccuugcuggcgauu

SEQ ID NO: 2679270 - RNA, 16 nt, Escherichia coli CFT073
aaccuuuaugcagcuc

SEQ ID NO: 2679271 - RNA, 15 nt, Escherichia coli CFT073
aaccuuucgccacca

SEQ ID NO: 2679272 - RNA, 16 nt, Escherichia coli CFT073
aaccuuuuagcugugg

SEQ ID NO: 2679273 - RNA, 11 nt, Escherichia coli CFT073
aaccuuuucca

SEQ ID NO: 2679274 - RNA, 15 nt, Escherichia coli CFT073
aacgaaaaugauuau

SEQ ID NO: 2679275 - RNA, 19 nt, Escherichia coli CFT073
aacgaagauggcauacaac

SEQ ID NO: 2679276 - RNA, 15 nt, Escherichia coli CFT073
aacgaaucgggcaac

SEQ ID NO: 2679277 - RNA, 20 nt, Escherichia coli CFT073
aacgaaucgggcaacguuga

SEQ ID NO: 2679278 - RNA, 14 nt, Escherichia coli CFT073
aacgaaucugcaaa

SEQ ID NO: 2679279 - RNA, 18 nt, Escherichia coli CFT073
aacgaaucugcaaaucug

SEQ ID NO: 2679280 - RNA, 22 nt, Escherichia coli CFT073
aacgaaucuuuaaccaggcaag

SEQ ID NO: 2679281 - RNA, 19 nt, Escherichia coli CFT073
aacgacaaaguuugucccu

SEQ ID NO: 2679282 - RNA, 12 nt, Escherichia coli CFT073
aacgacaccacg

SEQ ID NO: 2679283 - RNA, 15 nt, Escherichia coli CFT073
aacgacacugcucgc

SEQ ID NO: 2679284 - RNA, 16 nt, Escherichia coli CFT073
aacgacacugcucgca

SEQ ID NO: 2679285 - RNA, 22 nt, Escherichia coli CFT073
aacgacacugcucgcagaaaua

SEQ ID NO: 2679286 - RNA, 19 nt, Escherichia coli CFT073
aacgacaguaucgugacaa

SEQ ID NO: 2679287 - RNA, 18 nt, Escherichia coli CFT073
aacgacccacaauagcga

SEQ ID NO: 2679288 - RNA, 21 nt, Escherichia coli CFT073
aacgacccucagcugccaggg

SEQ ID NO: 2679289 - RNA, 18 nt, Escherichia coli CFT073
aacgaccgcgagcaaaau

SEQ ID NO: 2679290 - RNA, 21 nt, Escherichia coli CFT073
aacgacgaccgccgcucaccu

SEQ ID NO: 2679291 - RNA, 22 nt, Escherichia coli CFT073
aacgacgaccgccgcucaccug

SEQ ID NO: 2679292 - RNA, 16 nt, Escherichia coli CFT073
aacgacguaccgucac

SEQ ID NO: 2679293 - RNA, 19 nt, Escherichia coli CFT073
aacgacgucgauuucugga

SEQ ID NO: 2679294 - RNA, 16 nt, Escherichia coli CFT073
aacgacuacgccagaa

SEQ ID NO: 2679295 - RNA, 14 nt, Escherichia coli CFT073
aacgagaaaagcca

SEQ ID NO: 2679296 - RNA, 21 nt, Escherichia coli CFT073
aacgagauaauggcaaugguc

SEQ ID NO: 2679297 - RNA, 21 nt, Escherichia coli CFT073
aacgagcaugauacucagcac

SEQ ID NO: 2679298 - RNA, 20 nt, Escherichia coli CFT073
aacgagcgauccaacuaaau

SEQ ID NO: 2679299 - RNA, 15 nt, Escherichia coli CFT073
aacgagcguacugac

SEQ ID NO: 2679300 - RNA, 23 nt, Escherichia coli CFT073
aacgaggaggacuauuuacagau

SEQ ID NO: 2679301 - RNA, 20 nt, Escherichia coli CFT073
aacgagucgccuaccaucaa

SEQ ID NO: 2679302 - RNA, 15 nt, Escherichia coli CFT073
aacgauaaauaacgu

SEQ ID NO: 2679303 - RNA, 16 nt, Escherichia coli CFT073
aacgauaaauaacgua

SEQ ID NO: 2679304 - RNA, 16 nt, Escherichia coli CFT073
aacgauaacaaucacc

SEQ ID NO: 2679305 - RNA, 21 nt, Escherichia coli CFT073
aacgauaacaaucaccaaacc

SEQ ID NO: 2679306 - RNA, 21 nt, Escherichia coli CFT073
aacgauaguggcucaggcucu

SEQ ID NO: 2679307 - RNA, 13 nt, Escherichia coli CFT073
aacgaucccaacu

SEQ ID NO: 2679308 - RNA, 20 nt, Escherichia coli CFT073
aacgaucgcccggcaccagc

SEQ ID NO: 2679309 - RNA, 17 nt, Escherichia coli CFT073
aacgaucgcuuucaacg

SEQ ID NO: 2679310 - RNA, 17 nt, Escherichia coli CFT073
aacgaucuggcgucagc

SEQ ID NO: 2679311 - RNA, 22 nt, Escherichia coli CFT073
aacgaugaagucgaucagaccg

SEQ ID NO: 2679312 - RNA, 23 nt, Escherichia coli CFT073
aacgaugcuuuacguauccguuc

SEQ ID NO: 2679313 - RNA, 19 nt, Escherichia coli CFT073
aacgauucggcaaucacaa

SEQ ID NO: 2679314 - RNA, 23 nt, Escherichia coli CFT073
aacgauuucaucgcccaggcaag

SEQ ID NO: 2679315 - RNA, 16 nt, Escherichia coli CFT073
aacgauuuuuuccgca

SEQ ID NO: 2679316 - RNA, 17 nt, Escherichia coli CFT073
aacgcaaaacccgcuuc

SEQ ID NO: 2679317 - RNA, 12 nt, Escherichia coli CFT073
aacgcaaaacug

SEQ ID NO: 2679318 - RNA, 14 nt, Escherichia coli CFT073
aacgcaaacaccag

SEQ ID NO: 2679319 - RNA, 14 nt, Escherichia coli CFT073
aacgcaaagagaga

SEQ ID NO: 2679320 - RNA, 20 nt, Escherichia coli CFT073
aacgcaaagagagaagccag

SEQ ID NO: 2679321 - RNA, 16 nt, Escherichia coli CFT073
aacgcaauauccgcca

SEQ ID NO: 2679322 - RNA, 20 nt, Escherichia coli CFT073
aacgcaaucaaauuugccag

SEQ ID NO: 2679323 - RNA, 13 nt, Escherichia coli CFT073
aacgcaccaggcg

SEQ ID NO: 2679324 - RNA, 13 nt, Escherichia coli CFT073
aacgcacuggcga

SEQ ID NO: 2679325 - RNA, 19 nt, Escherichia coli CFT073
aacgcacuuuuaacgccuc

SEQ ID NO: 2679326 - RNA, 21 nt, Escherichia coli CFT073
aacgcagaaucucugcgcuau

SEQ ID NO: 2679327 - RNA, 23 nt, Escherichia coli CFT073
aacgcagacgcauacugauuacc

SEQ ID NO: 2679328 - RNA, 20 nt, Escherichia coli CFT073
aacgcagcaacaccgcuuua

SEQ ID NO: 2679329 - RNA, 15 nt, Escherichia coli CFT073
aacgcagcaacaugc

SEQ ID NO: 2679330 - RNA, 14 nt, Escherichia coli CFT073
aacgcagcaucgcc

SEQ ID NO: 2679331 - RNA, 17 nt, Escherichia coli CFT073
aacgcagccccagcgca

SEQ ID NO: 2679332 - RNA, 17 nt, Escherichia coli CFT073
aacgcaggccgcccaaa

SEQ ID NO: 2679333 - RNA, 17 nt, Escherichia coli CFT073
aacgcaguaaacgccag

SEQ ID NO: 2679334 - RNA, 15 nt, Escherichia coli CFT073
aacgcaguuugcgag

SEQ ID NO: 2679335 - RNA, 21 nt, Escherichia coli CFT073
aacgcaguuugcgaguggcgc

SEQ ID NO: 2679336 - RNA, 13 nt, Escherichia coli CFT073
aacgcauaaaccg

SEQ ID NO: 2679337 - RNA, 21 nt, Escherichia coli CFT073
aacgccaaacucuucgcgaua

SEQ ID NO: 2679338 - RNA, 20 nt, Escherichia coli CFT073
aacgccaauaaucugcccgg

SEQ ID NO: 2679339 - RNA, 14 nt, Escherichia coli CFT073
aacgccaccaucac

SEQ ID NO: 2679340 - RNA, 19 nt, Escherichia coli CFT073
aacgccaccccacaccagu

SEQ ID NO: 2679341 - RNA, 21 nt, Escherichia coli CFT073
aacgccacgacguuuuccauc

SEQ ID NO: 2679342 - RNA, 23 nt, Escherichia coli CFT073
aacgccacgauacguuccacguc

SEQ ID NO: 2679343 - RNA, 17 nt, Escherichia coli CFT073
aacgccacgccaccagc

SEQ ID NO: 2679344 - RNA, 15 nt, Escherichia coli CFT073
aacgccagaaucaaa

SEQ ID NO: 2679345 - RNA, 13 nt, Escherichia coli CFT073
aacgccagauaaa

SEQ ID NO: 2679346 - RNA, 18 nt, Escherichia coli CFT073
aacgccagauccgggcua

SEQ ID NO: 2679347 - RNA, 19 nt, Escherichia coli CFT073
aacgccagccacaaaccau

SEQ ID NO: 2679348 - RNA, 15 nt, Escherichia coli CFT073
aacgcccauacucau

SEQ ID NO: 2679349 - RNA, 21 nt, Escherichia coli CFT073
aacgcccauacucaucuucca

SEQ ID NO: 2679350 - RNA, 22 nt, Escherichia coli CFT073
aacgcccauacucaucuuccau

SEQ ID NO: 2679351 - RNA, 20 nt, Escherichia coli CFT073
aacgccccacaagcccgcca

SEQ ID NO: 2679352 - RNA, 22 nt, Escherichia coli CFT073
aacgccccacaagcccgccaga

SEQ ID NO: 2679353 - RNA, 22 nt, Escherichia coli CFT073
aacgccccuaaauaaacaccag

SEQ ID NO: 2679354 - RNA, 19 nt, Escherichia coli CFT073
aacgcccgauagcgaaagu

SEQ ID NO: 2679355 - RNA, 14 nt, Escherichia coli CFT073
aacgcccugcaacu

SEQ ID NO: 2679356 - RNA, 15 nt, Escherichia coli CFT073
aacgcccugcaacug

SEQ ID NO: 2679357 - RNA, 19 nt, Escherichia coli CFT073
aacgccgaauaacgcgcag

SEQ ID NO: 2679358 - RNA, 18 nt, Escherichia coli CFT073
aacgccgcauggucgaac

SEQ ID NO: 2679359 - RNA, 18 nt, Escherichia coli CFT073
aacgccgcuggugauuca

SEQ ID NO: 2679360 - RNA, 13 nt, Escherichia coli CFT073
aacgccgggaaau

SEQ ID NO: 2679361 - RNA, 20 nt, Escherichia coli CFT073
aacgccgguuccugcaucgc

SEQ ID NO: 2679362 - RNA, 13 nt, Escherichia coli CFT073
aacgccucauccg

SEQ ID NO: 2679363 - RNA, 18 nt, Escherichia coli CFT073
aacgccucguuugcggca

SEQ ID NO: 2679364 - RNA, 20 nt, Escherichia coli CFT073
aacgccugauagcccgcaca

SEQ ID NO: 2679365 - RNA, 20 nt, Escherichia coli CFT073
aacgccugauucggccuaca

SEQ ID NO: 2679366 - RNA, 14 nt, Escherichia coli CFT073
aacgccugcaccag

SEQ ID NO: 2679367 - RNA, 18 nt, Escherichia coli CFT073
aacgccugcggcugauaa

SEQ ID NO: 2679368 - RNA, 12 nt, Escherichia coli CFT073
aacgccugcucc

SEQ ID NO: 2679369 - RNA, 16 nt, Escherichia coli CFT073
aacgccuuauccggcc

SEQ ID NO: 2679370 - RNA, 18 nt, Escherichia coli CFT073
aacgccuuauccggccua

SEQ ID NO: 2679371 - RNA, 20 nt, Escherichia coli CFT073
aacgccuuauccggccuacc

SEQ ID NO: 2679372 - RNA, 20 nt, Escherichia coli CFT073
aacgccuuauccggccuacu

SEQ ID NO: 2679373 - RNA, 18 nt, Escherichia coli CFT073
aacgccuuauucggccua

SEQ ID NO: 2679374 - RNA, 20 nt, Escherichia coli CFT073
aacgccuuauucggccuacc

SEQ ID NO: 2679375 - RNA, 16 nt, Escherichia coli CFT073
aacgccuuguucgccc

SEQ ID NO: 2679376 - RNA, 18 nt, Escherichia coli CFT073
aacgccuuguucgcccug

SEQ ID NO: 2679377 - RNA, 17 nt, Escherichia coli CFT073
aacgcgaaggccagcac

SEQ ID NO: 2679378 - RNA, 14 nt, Escherichia coli CFT073
aacgcgaucgccaa

SEQ ID NO: 2679379 - RNA, 18 nt, Escherichia coli CFT073
aacgcgauucccagucgc

SEQ ID NO: 2679380 - RNA, 18 nt, Escherichia coli CFT073
aacgcgcagcgucgcauc

SEQ ID NO: 2679381 - RNA, 23 nt, Escherichia coli CFT073
aacgcgccaagauagaaccacgc

SEQ ID NO: 2679382 - RNA, 12 nt, Escherichia coli CFT073
aacgcgccagcg

SEQ ID NO: 2679383 - RNA, 19 nt, Escherichia coli CFT073
aacgcgccagcgucgcauc

SEQ ID NO: 2679384 - RNA, 15 nt, Escherichia coli CFT073
aacgcgccgacgaau

SEQ ID NO: 2679385 - RNA, 12 nt, Escherichia coli CFT073
aacgcgccgcaa

SEQ ID NO: 2679386 - RNA, 22 nt, Escherichia coli CFT073
aacgcgccgcaacaauaacccc

SEQ ID NO: 2679387 - RNA, 19 nt, Escherichia coli CFT073
aacgcgccuuaaaaaccag

SEQ ID NO: 2679388 - RNA, 13 nt, Escherichia coli CFT073
aacgcgcugccag

SEQ ID NO: 2679389 - RNA, 17 nt, Escherichia coli CFT073
aacgcgcuuucuucgca

SEQ ID NO: 2679390 - RNA, 15 nt, Escherichia coli CFT073
aacgcggcaaaaccc

SEQ ID NO: 2679391 - RNA, 14 nt, Escherichia coli CFT073
aacgcggcaauaaa

SEQ ID NO: 2679392 - RNA, 21 nt, Escherichia coli CFT073
aacgcguagcgcaaaucaacu

SEQ ID NO: 2679393 - RNA, 17 nt, Escherichia coli CFT073
aacgcgugugcgagugc

SEQ ID NO: 2679394 - RNA, 17 nt, Escherichia coli CFT073
aacgcguucucgccaaa

SEQ ID NO: 2679395 - RNA, 17 nt, Escherichia coli CFT073
aacgcguuuuguagcgu

SEQ ID NO: 2679396 - RNA, 21 nt, Escherichia coli CFT073
aacgcguuuuguagcgugcgg

SEQ ID NO: 2679397 - RNA, 16 nt, Escherichia coli CFT073
aacgcuagcagcagcg

SEQ ID NO: 2679398 - RNA, 18 nt, Escherichia coli CFT073
aacgcucaagaacggcaa

SEQ ID NO: 2679399 - RNA, 14 nt, Escherichia coli CFT073
aacgcuccaugcug

SEQ ID NO: 2679400 - RNA, 16 nt, Escherichia coli CFT073
aacgcuccaugcugcg

SEQ ID NO: 2679401 - RNA, 21 nt, Escherichia coli CFT073
aacgcucccagccaguccugu

SEQ ID NO: 2679402 - RNA, 19 nt, Escherichia coli CFT073
aacgcuccugcuacaccau

SEQ ID NO: 2679403 - RNA, 21 nt, Escherichia coli CFT073
aacgcucgcagcccguggcgc

SEQ ID NO: 2679404 - RNA, 16 nt, Escherichia coli CFT073
aacgcugacauauuuu

SEQ ID NO: 2679405 - RNA, 18 nt, Escherichia coli CFT073
aacgcugacggugccagg

SEQ ID NO: 2679406 - RNA, 22 nt, Escherichia coli CFT073
aacgcugauuucucuggagaaa

SEQ ID NO: 2679407 - RNA, 12 nt, Escherichia coli CFT073
aacgcugccaug

SEQ ID NO: 2679408 - RNA, 17 nt, Escherichia coli CFT073
aacgcugcccgccgcga

SEQ ID NO: 2679409 - RNA, 18 nt, Escherichia coli CFT073
aacgcugccuugcucuuc

SEQ ID NO: 2679410 - RNA, 20 nt, Escherichia coli CFT073
aacgcugcgugcgugcgggu

SEQ ID NO: 2679411 - RNA, 20 nt, Escherichia coli CFT073
aacgcuggggccaucgccgc

SEQ ID NO: 2679412 - RNA, 15 nt, Escherichia coli CFT073
aacgcuggugaaauc

SEQ ID NO: 2679413 - RNA, 21 nt, Escherichia coli CFT073
aacgcuucagcguaucccagu

SEQ ID NO: 2679414 - RNA, 22 nt, Escherichia coli CFT073
aacgcuucugucgcuucacgca

SEQ ID NO: 2679415 - RNA, 20 nt, Escherichia coli CFT073
aacgcuuguaaaugaacuca

SEQ ID NO: 2679416 - RNA, 23 nt, Escherichia coli CFT073
aacgcuuguacggcuccgcccca

SEQ ID NO: 2679417 - RNA, 16 nt, Escherichia coli CFT073
aacgcuuucucaccau

SEQ ID NO: 2679418 - RNA, 19 nt, Escherichia coli CFT073
aacgcuuucucaccaugac

SEQ ID NO: 2679419 - RNA, 22 nt, Escherichia coli CFT073
aacgcuuucucaccaugaccga

SEQ ID NO: 2679420 - RNA, 17 nt, Escherichia coli CFT073
aacgcuuugcugauugc

SEQ ID NO: 2679421 - RNA, 20 nt, Escherichia coli CFT073
aacggaaaagcaacaaccac

SEQ ID NO: 2679422 - RNA, 12 nt, Escherichia coli CFT073
aacggaaagcag

SEQ ID NO: 2679423 - RNA, 12 nt, Escherichia coli CFT073
aacggaccgcau

SEQ ID NO: 2679424 - RNA, 14 nt, Escherichia coli CFT073
aacggaucgcguaa

SEQ ID NO: 2679425 - RNA, 18 nt, Escherichia coli CFT073
aacggaugacuucgcuac

SEQ ID NO: 2679426 - RNA, 16 nt, Escherichia coli CFT073
aacggcaacaauuucc

SEQ ID NO: 2679427 - RNA, 16 nt, Escherichia coli CFT073
aacggcacgaucaaga

SEQ ID NO: 2679428 - RNA, 17 nt, Escherichia coli CFT073
aacggcacggaaagcag

SEQ ID NO: 2679429 - RNA, 16 nt, Escherichia coli CFT073
aacggcagaagcagca

SEQ ID NO: 2679430 - RNA, 12 nt, Escherichia coli CFT073
aacggcagagaa

SEQ ID NO: 2679431 - RNA, 14 nt, Escherichia coli CFT073
aacggccaaaagca

SEQ ID NO: 2679432 - RNA, 17 nt, Escherichia coli CFT073
aacggccaaaagcacaa

SEQ ID NO: 2679433 - RNA, 20 nt, Escherichia coli CFT073
aacggccacgaugcacagcu

SEQ ID NO: 2679434 - RNA, 17 nt, Escherichia coli CFT073
aacggccugaccauuac

SEQ ID NO: 2679435 - RNA, 23 nt, Escherichia coli CFT073
aacggcgcgacgggcacaccaac

SEQ ID NO: 2679436 - RNA, 14 nt, Escherichia coli CFT073
aacggcgcuugaac

SEQ ID NO: 2679437 - RNA, 12 nt, Escherichia coli CFT073
aacggcggauga

SEQ ID NO: 2679438 - RNA, 21 nt, Escherichia coli CFT073
aacggcgguuucgcaaaccaa

SEQ ID NO: 2679439 - RNA, 22 nt, Escherichia coli CFT073
aacggcgucgauugcucaacac

SEQ ID NO: 2679440 - RNA, 20 nt, Escherichia coli CFT073
aacggcgugagaaccgcacc

SEQ ID NO: 2679441 - RNA, 18 nt, Escherichia coli CFT073
aacggcguuaagcaagcu

SEQ ID NO: 2679442 - RNA, 18 nt, Escherichia coli CFT073
aacggcugcuucggucag

SEQ ID NO: 2679443 - RNA, 17 nt, Escherichia coli CFT073
aacggcugggaaaucac

SEQ ID NO: 2679444 - RNA, 18 nt, Escherichia coli CFT073
aacggcugggaaaucacc

SEQ ID NO: 2679445 - RNA, 20 nt, Escherichia coli CFT073
aacggcuggugauuucgucc

SEQ ID NO: 2679446 - RNA, 18 nt, Escherichia coli CFT073
aacgggauuccugcgcuu

SEQ ID NO: 2679447 - RNA, 18 nt, Escherichia coli CFT073
aacgggcaaucucauacc

SEQ ID NO: 2679448 - RNA, 21 nt, Escherichia coli CFT073
aacgggcaggguggugacacc

SEQ ID NO: 2679449 - RNA, 21 nt, Escherichia coli CFT073
aacgggcauggugucaccacc

SEQ ID NO: 2679450 - RNA, 23 nt, Escherichia coli CFT073
aacggggguuuuacuuuuuaacu

SEQ ID NO: 2679451 - RNA, 16 nt, Escherichia coli CFT073
aacgggucgagaacga

SEQ ID NO: 2679452 - RNA, 16 nt, Escherichia coli CFT073
aacgguaaaaccgugc

SEQ ID NO: 2679453 - RNA, 23 nt, Escherichia coli CFT073
aacgguaaagcccucaccgaagc

SEQ ID NO: 2679454 - RNA, 19 nt, Escherichia coli CFT073
aacgguacuugcggucagg

SEQ ID NO: 2679455 - RNA, 13 nt, Escherichia coli CFT073
aacggucgauucg

SEQ ID NO: 2679456 - RNA, 13 nt, Escherichia coli CFT073
aacggugccagcc

SEQ ID NO: 2679457 - RNA, 18 nt, Escherichia coli CFT073
aacggugcgaccaaacug

SEQ ID NO: 2679458 - RNA, 14 nt, Escherichia coli CFT073
aacggugcugcaca

SEQ ID NO: 2679459 - RNA, 14 nt, Escherichia coli CFT073
aacgguuaacaguu

SEQ ID NO: 2679460 - RNA, 20 nt, Escherichia coli CFT073
aacgguuaugaauaacuccg

SEQ ID NO: 2679461 - RNA, 16 nt, Escherichia coli CFT073
aacgguucugcugccg

SEQ ID NO: 2679462 - RNA, 14 nt, Escherichia coli CFT073
aacgguugcaauau

SEQ ID NO: 2679463 - RNA, 21 nt, Escherichia coli CFT073
aacgguugcaaugcaucagcu

SEQ ID NO: 2679464 - RNA, 14 nt, Escherichia coli CFT073
aacgguugcggcuu

SEQ ID NO: 2679465 - RNA, 17 nt, Escherichia coli CFT073
aacgguuucaaccagca

SEQ ID NO: 2679466 - RNA, 18 nt, Escherichia coli CFT073
aacgguuucaaccagcag

SEQ ID NO: 2679467 - RNA, 23 nt, Escherichia coli CFT073
aacgguuuucaagacgccgucca

SEQ ID NO: 2679468 - RNA, 15 nt, Escherichia coli CFT073
aacguaaaacaaagg

SEQ ID NO: 2679469 - RNA, 16 nt, Escherichia coli CFT073
aacguaaaugccagcc

SEQ ID NO: 2679470 - RNA, 14 nt, Escherichia coli CFT073
aacguaaugucugu

SEQ ID NO: 2679471 - RNA, 19 nt, Escherichia coli CFT073
aacguaccgcgucgccggu

SEQ ID NO: 2679472 - RNA, 21 nt, Escherichia coli CFT073
aacguauuaugugaucaacac

SEQ ID NO: 2679473 - RNA, 19 nt, Escherichia coli CFT073
aacgucaccucaggaaaag

SEQ ID NO: 2679474 - RNA, 20 nt, Escherichia coli CFT073
aacgucaggugagcgucauu

SEQ ID NO: 2679475 - RNA, 17 nt, Escherichia coli CFT073
aacguccaguugaagcu

SEQ ID NO: 2679476 - RNA, 17 nt, Escherichia coli CFT073
aacguccgguuaaaucg

SEQ ID NO: 2679477 - RNA, 13 nt, Escherichia coli CFT073
aacguccuuucau

SEQ ID NO: 2679478 - RNA, 22 nt, Escherichia coli CFT073
aacgucgcaagacgaaaaauga

SEQ ID NO: 2679479 - RNA, 15 nt, Escherichia coli CFT073
aacgucgcaucugac

SEQ ID NO: 2679480 - RNA, 18 nt, Escherichia coli CFT073
aacgucgcaucuggucag

SEQ ID NO: 2679481 - RNA, 13 nt, Escherichia coli CFT073
aacgucgccagcg

SEQ ID NO: 2679482 - RNA, 22 nt, Escherichia coli CFT073
aacgucgccaguccuucaauau

SEQ ID NO: 2679483 - RNA, 16 nt, Escherichia coli CFT073
aacgucgcgccuguca

SEQ ID NO: 2679484 - RNA, 23 nt, Escherichia coli CFT073
aacgucggcauauuuaaaaacga

SEQ ID NO: 2679485 - RNA, 18 nt, Escherichia coli CFT073
aacgucucuauuucaccc

SEQ ID NO: 2679486 - RNA, 12 nt, Escherichia coli CFT073
aacgucuucccg

SEQ ID NO: 2679487 - RNA, 16 nt, Escherichia coli CFT073
aacgucuucgccaaau

SEQ ID NO: 2679488 - RNA, 17 nt, Escherichia coli CFT073
aacgugaaaugucauua

SEQ ID NO: 2679489 - RNA, 15 nt, Escherichia coli CFT073
aacgugaauuuuuac

SEQ ID NO: 2679490 - RNA, 20 nt, Escherichia coli CFT073
aacgugacauagagauaacu

SEQ ID NO: 2679491 - RNA, 14 nt, Escherichia coli CFT073
aacgugacauucug

SEQ ID NO: 2679492 - RNA, 17 nt, Escherichia coli CFT073
aacgugaccaugagcca

SEQ ID NO: 2679493 - RNA, 20 nt, Escherichia coli CFT073
aacgugaccgcuuuuugaua

SEQ ID NO: 2679494 - RNA, 15 nt, Escherichia coli CFT073
aacgugccacugaca

SEQ ID NO: 2679495 - RNA, 20 nt, Escherichia coli CFT073
aacgugccauagcgggcaau

SEQ ID NO: 2679496 - RNA, 15 nt, Escherichia coli CFT073
aacgugcggcaggca

SEQ ID NO: 2679497 - RNA, 17 nt, Escherichia coli CFT073
aacgugcggcaggcaca

SEQ ID NO: 2679498 - RNA, 18 nt, Escherichia coli CFT073
aacgugcggcugugcggu

SEQ ID NO: 2679499 - RNA, 20 nt, Escherichia coli CFT073
aacgugcggggguuuucucu

SEQ ID NO: 2679500 - RNA, 23 nt, Escherichia coli CFT073
aacguggcagcaggaucuccagu

SEQ ID NO: 2679501 - RNA, 14 nt, Escherichia coli CFT073
aacgugggccaggc

SEQ ID NO: 2679502 - RNA, 15 nt, Escherichia coli CFT073
aacgugggccaggcg

SEQ ID NO: 2679503 - RNA, 15 nt, Escherichia coli CFT073
aacguggucgaaucc

SEQ ID NO: 2679504 - RNA, 23 nt, Escherichia coli CFT073
aacgugguuuaccaccagcggaa

SEQ ID NO: 2679505 - RNA, 22 nt, Escherichia coli CFT073
aacguguguuucgauauaacca

SEQ ID NO: 2679506 - RNA, 20 nt, Escherichia coli CFT073
aacguguuuauauuugaaca

SEQ ID NO: 2679507 - RNA, 18 nt, Escherichia coli CFT073
aacguuaacgccccacuc

SEQ ID NO: 2679508 - RNA, 13 nt, Escherichia coli CFT073
aacguuaccuuua

SEQ ID NO: 2679509 - RNA, 21 nt, Escherichia coli CFT073
aacguucagcacguuaaguuc

SEQ ID NO: 2679510 - RNA, 12 nt, Escherichia coli CFT073
aacguuccagca

SEQ ID NO: 2679511 - RNA, 13 nt, Escherichia coli CFT073
aacguuccagcaa

SEQ ID NO: 2679512 - RNA, 16 nt, Escherichia coli CFT073
aacguucgaucacccg

SEQ ID NO: 2679513 - RNA, 17 nt, Escherichia coli CFT073
aacguugaaccgcccca

SEQ ID NO: 2679514 - RNA, 17 nt, Escherichia coli CFT073
aacguugaauuucaggu

SEQ ID NO: 2679515 - RNA, 18 nt, Escherichia coli CFT073
aacguugcggguaaucau

SEQ ID NO: 2679516 - RNA, 17 nt, Escherichia coli CFT073
aacguugggugcaauca

SEQ ID NO: 2679517 - RNA, 17 nt, Escherichia coli CFT073
aacguuuaccuuugcug

SEQ ID NO: 2679518 - RNA, 14 nt, Escherichia coli CFT073
aacguuuaucugcc

SEQ ID NO: 2679519 - RNA, 17 nt, Escherichia coli CFT073
aacguuugauuaacgcc

SEQ ID NO: 2679520 - RNA, 21 nt, Escherichia coli CFT073
aacguuugauuaacgccagau

SEQ ID NO: 2679521 - RNA, 20 nt, Escherichia coli CFT073
aacguuugccagccacacca

SEQ ID NO: 2679522 - RNA, 15 nt, Escherichia coli CFT073
aacguuuucaacaau

SEQ ID NO: 2679523 - RNA, 11 nt, Escherichia coli CFT073
aacguuuucac

SEQ ID NO: 2679524 - RNA, 12 nt, Escherichia coli CFT073
aacuaaacaacg

SEQ ID NO: 2679525 - RNA, 13 nt, Escherichia coli CFT073
aacuaaaggcugu

SEQ ID NO: 2679526 - RNA, 15 nt, Escherichia coli CFT073
aacuaaccagacgcc

SEQ ID NO: 2679527 - RNA, 16 nt, Escherichia coli CFT073
aacuacagaugaaaua

SEQ ID NO: 2679528 - RNA, 12 nt, Escherichia coli CFT073
aacuacccgguu

SEQ ID NO: 2679529 - RNA, 17 nt, Escherichia coli CFT073
aacuacggcuuuuuuca

SEQ ID NO: 2679530 - RNA, 19 nt, Escherichia coli CFT073
aacuacggcuuuuuucauu

SEQ ID NO: 2679531 - RNA, 20 nt, Escherichia coli CFT073
aacuacggcuuuuuucauuu

SEQ ID NO: 2679532 - RNA, 15 nt, Escherichia coli CFT073
aacuagaagaggagg

SEQ ID NO: 2679533 - RNA, 17 nt, Escherichia coli CFT073
aacuagcaacaaaaaaa

SEQ ID NO: 2679534 - RNA, 14 nt, Escherichia coli CFT073
aacuaguagcauga

SEQ ID NO: 2679535 - RNA, 21 nt, Escherichia coli CFT073
aacuauaugacucauaaaaau

SEQ ID NO: 2679536 - RNA, 17 nt, Escherichia coli CFT073
aacuaucaaccucuuuu

SEQ ID NO: 2679537 - RNA, 16 nt, Escherichia coli CFT073
aacucaaaaauaauca

SEQ ID NO: 2679538 - RNA, 22 nt, Escherichia coli CFT073
aacucaacgccugcuuuuacca

SEQ ID NO: 2679539 - RNA, 21 nt, Escherichia coli CFT073
aacucaacgguccaaugguca

SEQ ID NO: 2679540 - RNA, 17 nt, Escherichia coli CFT073
aacucaagcuaaaccaa

SEQ ID NO: 2679541 - RNA, 19 nt, Escherichia coli CFT073
aacucaagcuaaaccaaua

SEQ ID NO: 2679542 - RNA, 13 nt, Escherichia coli CFT073
aacucaccaucaa

SEQ ID NO: 2679543 - RNA, 19 nt, Escherichia coli CFT073
aacucaccauccugaucgc

SEQ ID NO: 2679544 - RNA, 23 nt, Escherichia coli CFT073
aacucaccauccugaucgccauc

SEQ ID NO: 2679545 - RNA, 22 nt, Escherichia coli CFT073
aacucacccugaugcccaaaaa

SEQ ID NO: 2679546 - RNA, 20 nt, Escherichia coli CFT073
aacucaccuggcugauggaa

SEQ ID NO: 2679547 - RNA, 17 nt, Escherichia coli CFT073
aacucaggaacuuagua

SEQ ID NO: 2679548 - RNA, 16 nt, Escherichia coli CFT073
aacucaucgccgccaa

SEQ ID NO: 2679549 - RNA, 14 nt, Escherichia coli CFT073
aacucauugccagc

SEQ ID NO: 2679550 - RNA, 13 nt, Escherichia coli CFT073
aacuccaccaaua

SEQ ID NO: 2679551 - RNA, 18 nt, Escherichia coli CFT073
aacuccaccaauaaugcc

SEQ ID NO: 2679552 - RNA, 13 nt, Escherichia coli CFT073
aacuccagaauac

SEQ ID NO: 2679553 - RNA, 19 nt, Escherichia coli CFT073
aacuccaguagcgagccgu

SEQ ID NO: 2679554 - RNA, 20 nt, Escherichia coli CFT073
aacuccaguggcgcaucagc

SEQ ID NO: 2679555 - RNA, 13 nt, Escherichia coli CFT073
aacuccauaccac

SEQ ID NO: 2679556 - RNA, 19 nt, Escherichia coli CFT073
aacuccauaccacguucuc

SEQ ID NO: 2679557 - RNA, 17 nt, Escherichia coli CFT073
aacuccccgcaaaccag

SEQ ID NO: 2679558 - RNA, 19 nt, Escherichia coli CFT073
aacuccccgcaaaccagac

SEQ ID NO: 2679559 - RNA, 23 nt, Escherichia coli CFT073
aacuccgaaauggucauuuuuca

SEQ ID NO: 2679560 - RNA, 23 nt, Escherichia coli CFT073
aacuccgccagcaacugauacac

SEQ ID NO: 2679561 - RNA, 19 nt, Escherichia coli CFT073
aacuccgccgcuaaauacc

SEQ ID NO: 2679562 - RNA, 15 nt, Escherichia coli CFT073
aacuccggcgaaaau

SEQ ID NO: 2679563 - RNA, 21 nt, Escherichia coli CFT073
aacuccugaaagcgaaccaua

SEQ ID NO: 2679564 - RNA, 15 nt, Escherichia coli CFT073
aacucgaccaguagc

SEQ ID NO: 2679565 - RNA, 16 nt, Escherichia coli CFT073
aacucgcggcuaacac

SEQ ID NO: 2679566 - RNA, 16 nt, Escherichia coli CFT073
aacucgcuuaagccau

SEQ ID NO: 2679567 - RNA, 13 nt, Escherichia coli CFT073
aacucgucgcuga

SEQ ID NO: 2679568 - RNA, 20 nt, Escherichia coli CFT073
aacucgucgcugauauugcu

SEQ ID NO: 2679569 - RNA, 14 nt, Escherichia coli CFT073
aacucuaaugccuu

SEQ ID NO: 2679570 - RNA, 21 nt, Escherichia coli CFT073
aacucuauccacauuagucau

SEQ ID NO: 2679571 - RNA, 16 nt, Escherichia coli CFT073
aacucucccaugcgcu

SEQ ID NO: 2679572 - RNA, 20 nt, Escherichia coli CFT073
aacucugacgauucucccac

SEQ ID NO: 2679573 - RNA, 19 nt, Escherichia coli CFT073
aacucuggggaaaugccau

SEQ ID NO: 2679574 - RNA, 13 nt, Escherichia coli CFT073
aacucuucaagau

SEQ ID NO: 2679575 - RNA, 13 nt, Escherichia coli CFT073
aacucuucacacu

SEQ ID NO: 2679576 - RNA, 19 nt, Escherichia coli CFT073
aacucuuccgggaaaacau

SEQ ID NO: 2679577 - RNA, 21 nt, Escherichia coli CFT073
aacucuuccgggaaaacaucg

SEQ ID NO: 2679578 - RNA, 22 nt, Escherichia coli CFT073
aacucuugccagauuuucuuca

SEQ ID NO: 2679579 - RNA, 19 nt, Escherichia coli CFT073
aacucuuugggcagaaaau

SEQ ID NO: 2679580 - RNA, 19 nt, Escherichia coli CFT073
aacugaaagaacaccagca

SEQ ID NO: 2679581 - RNA, 19 nt, Escherichia coli CFT073
aacugaagauucgcccauu

SEQ ID NO: 2679582 - RNA, 21 nt, Escherichia coli CFT073
aacugaauaauacacacagua

SEQ ID NO: 2679583 - RNA, 21 nt, Escherichia coli CFT073
aacugacgcccaguuucgaca

SEQ ID NO: 2679584 - RNA, 18 nt, Escherichia coli CFT073
aacugacuuccacuuccu

SEQ ID NO: 2679585 - RNA, 17 nt, Escherichia coli CFT073
aacugacuuucuuuucc

SEQ ID NO: 2679586 - RNA, 18 nt, Escherichia coli CFT073
aacugacuuucuuuuccc

SEQ ID NO: 2679587 - RNA, 15 nt, Escherichia coli CFT073
aacugagcgcgggag

SEQ ID NO: 2679588 - RNA, 14 nt, Escherichia coli CFT073
aacugaguucauau

SEQ ID NO: 2679589 - RNA, 16 nt, Escherichia coli CFT073
aacugauaaaccagac

SEQ ID NO: 2679590 - RNA, 23 nt, Escherichia coli CFT073
aacugauacccggcuaacagucu

SEQ ID NO: 2679591 - RNA, 19 nt, Escherichia coli CFT073
aacugaucacguuuuccuu

SEQ ID NO: 2679592 - RNA, 15 nt, Escherichia coli CFT073
aacugauccugacaa

SEQ ID NO: 2679593 - RNA, 19 nt, Escherichia coli CFT073
aacugauccugacaaggug

SEQ ID NO: 2679594 - RNA, 18 nt, Escherichia coli CFT073
aacugaucgacaguugcu

SEQ ID NO: 2679595 - RNA, 15 nt, Escherichia coli CFT073
aacugaucuuuauca

SEQ ID NO: 2679596 - RNA, 20 nt, Escherichia coli CFT073
aacugauuuagcaucagcgc

SEQ ID NO: 2679597 - RNA, 16 nt, Escherichia coli CFT073
aacugauuuucaucuu

SEQ ID NO: 2679598 - RNA, 20 nt, Escherichia coli CFT073
aacugcaaggagagccagua

SEQ ID NO: 2679599 - RNA, 15 nt, Escherichia coli CFT073
aacugcacaccgcgg

SEQ ID NO: 2679600 - RNA, 21 nt, Escherichia coli CFT073
aacugcauacucgcgucuggc

SEQ ID NO: 2679601 - RNA, 15 nt, Escherichia coli CFT073
aacugcaugucaggc

SEQ ID NO: 2679602 - RNA, 15 nt, Escherichia coli CFT073
aacugccagaagcgg

SEQ ID NO: 2679603 - RNA, 21 nt, Escherichia coli CFT073
aacugcccaggcaaaaaggcc

SEQ ID NO: 2679604 - RNA, 23 nt, Escherichia coli CFT073
aacugcccaggcaaaaaggccua

SEQ ID NO: 2679605 - RNA, 19 nt, Escherichia coli CFT073
aacugccgucagggccugc

SEQ ID NO: 2679606 - RNA, 17 nt, Escherichia coli CFT073
aacugccuccugcaaau

SEQ ID NO: 2679607 - RNA, 20 nt, Escherichia coli CFT073
aacugccuuucccuuucuua

SEQ ID NO: 2679608 - RNA, 21 nt, Escherichia coli CFT073
aacugcgaccguacaaccaaa

SEQ ID NO: 2679609 - RNA, 20 nt, Escherichia coli CFT073
aacugcguagaguccagcgc

SEQ ID NO: 2679610 - RNA, 15 nt, Escherichia coli CFT073
aacugcgugugacaa

SEQ ID NO: 2679611 - RNA, 23 nt, Escherichia coli CFT073
aacugcucguucagcacuucacc

SEQ ID NO: 2679612 - RNA, 23 nt, Escherichia coli CFT073
aacugcugcauuucuggaaugcg

SEQ ID NO: 2679613 - RNA, 15 nt, Escherichia coli CFT073
aacugcuguugcugc

SEQ ID NO: 2679614 - RNA, 18 nt, Escherichia coli CFT073
aacuggacccgaugauca

SEQ ID NO: 2679615 - RNA, 18 nt, Escherichia coli CFT073
aacuggcgcgaagauucg

SEQ ID NO: 2679616 - RNA, 15 nt, Escherichia coli CFT073
aacuggcugaugcug

SEQ ID NO: 2679617 - RNA, 16 nt, Escherichia coli CFT073
aacuggcugaugcugg

SEQ ID NO: 2679618 - RNA, 21 nt, Escherichia coli CFT073
aacuggcugccguugaucugc

SEQ ID NO: 2679619 - RNA, 17 nt, Escherichia coli CFT073
aacugggagauaaaauc

SEQ ID NO: 2679620 - RNA, 14 nt, Escherichia coli CFT073
aacuggguuaacgu

SEQ ID NO: 2679621 - RNA, 18 nt, Escherichia coli CFT073
aacuggugauccacgguu

SEQ ID NO: 2679622 - RNA, 21 nt, Escherichia coli CFT073
aacuguaacgcagaagguuau

SEQ ID NO: 2679623 - RNA, 18 nt, Escherichia coli CFT073
aacugucaacaccaggga

SEQ ID NO: 2679624 - RNA, 19 nt, Escherichia coli CFT073
aacugucaacaccagggaa

SEQ ID NO: 2679625 - RNA, 22 nt, Escherichia coli CFT073
aacugucccauuccagccaugc

SEQ ID NO: 2679626 - RNA, 17 nt, Escherichia coli CFT073
aacugucuucaccauag

SEQ ID NO: 2679627 - RNA, 24 nt, Escherichia coli CFT073
aacugugaauccugcauaccauug

SEQ ID NO: 2679628 - RNA, 20 nt, Escherichia coli CFT073
aacugugaguacccuuucac

SEQ ID NO: 2679629 - RNA, 17 nt, Escherichia coli CFT073
aacugugcaccgcccug

SEQ ID NO: 2679630 - RNA, 20 nt, Escherichia coli CFT073
aacugugcaccgcccugcau

SEQ ID NO: 2679631 - RNA, 17 nt, Escherichia coli CFT073
aacugugccaaaucuac

SEQ ID NO: 2679632 - RNA, 15 nt, Escherichia coli CFT073
aacugugccagacgc

SEQ ID NO: 2679633 - RNA, 22 nt, Escherichia coli CFT073
aacugugccagacgcguuaaua

SEQ ID NO: 2679634 - RNA, 20 nt, Escherichia coli CFT073
aacuguggaauaugcgccac

SEQ ID NO: 2679635 - RNA, 13 nt, Escherichia coli CFT073
aauucuuaacacc

SEQ ID NO: 2679636 - RNA, 23 nt, Escherichia coli CFT073
aauucuucaaguguggccgccag

SEQ ID NO: 2679637 - RNA, 13 nt, Escherichia coli CFT073
aauucuucauucc

SEQ ID NO: 2679638 - RNA, 19 nt, Escherichia coli CFT073
aauucuuccuucacaucca

SEQ ID NO: 2679639 - RNA, 13 nt, Escherichia coli CFT073
aauucuugcugac

SEQ ID NO: 2679640 - RNA, 17 nt, Escherichia coli CFT073
aauugaaauuugcauaa

SEQ ID NO: 2679641 - RNA, 23 nt, Escherichia coli CFT073
aauugaaguucguccccaccagu

SEQ ID NO: 2679642 - RNA, 16 nt, Escherichia coli CFT073
aauugacuaucugacu

SEQ ID NO: 2679643 - RNA, 17 nt, Escherichia coli CFT073
aauugagaugacgccac

SEQ ID NO: 2679644 - RNA, 16 nt, Escherichia coli CFT073
aauugagcagcaaaau

SEQ ID NO: 2679645 - RNA, 18 nt, Escherichia coli CFT073
aauugaguuuauagcaag

SEQ ID NO: 2679646 - RNA, 13 nt, Escherichia coli CFT073
aauugauaaccaa

SEQ ID NO: 2679647 - RNA, 23 nt, Escherichia coli CFT073
aauugaugaguaucuuauugaaa

SEQ ID NO: 2679648 - RNA, 16 nt, Escherichia coli CFT073
aauugaugcuuuuugc

SEQ ID NO: 2679649 - RNA, 17 nt, Escherichia coli CFT073
aauugaugcuuuuugcc

SEQ ID NO: 2679650 - RNA, 14 nt, Escherichia coli CFT073
aauugcaauuuuua

SEQ ID NO: 2679651 - RNA, 15 nt, Escherichia coli CFT073
aauugcaauuuuuau

SEQ ID NO: 2679652 - RNA, 17 nt, Escherichia coli CFT073
aauugcaccucagcaua

SEQ ID NO: 2679653 - RNA, 21 nt, Escherichia coli CFT073
aauugcaccucagcauaugcu

SEQ ID NO: 2679654 - RNA, 21 nt, Escherichia coli CFT073
aauugcaguacgauaauggcu

SEQ ID NO: 2679655 - RNA, 19 nt, Escherichia coli CFT073
aauugcauuugaacuggaa

SEQ ID NO: 2679656 - RNA, 18 nt, Escherichia coli CFT073
aauugccaaguccugcca

SEQ ID NO: 2679657 - RNA, 14 nt, Escherichia coli CFT073
aauugccagacaac

SEQ ID NO: 2679658 - RNA, 11 nt, Escherichia coli CFT073
aauugccagcu

SEQ ID NO: 2679659 - RNA, 18 nt, Escherichia coli CFT073
aauugcccaaagccaauc

SEQ ID NO: 2679660 - RNA, 16 nt, Escherichia coli CFT073
aauugccccagacaca

SEQ ID NO: 2679661 - RNA, 20 nt, Escherichia coli CFT073
aauugccgcacuuaaaaugc

SEQ ID NO: 2679662 - RNA, 12 nt, Escherichia coli CFT073
aauugccgccag

SEQ ID NO: 2679663 - RNA, 16 nt, Escherichia coli CFT073
aauugccugaugcgcu

SEQ ID NO: 2679664 - RNA, 20 nt, Escherichia coli CFT073
aauugccuggugcccaucac

SEQ ID NO: 2679665 - RNA, 18 nt, Escherichia coli CFT073
aauugccuguucaaccuc

SEQ ID NO: 2679666 - RNA, 16 nt, Escherichia coli CFT073
aauugcgaccuucuuc

SEQ ID NO: 2679667 - RNA, 18 nt, Escherichia coli CFT073
aauugcgacugaaccagc

SEQ ID NO: 2679668 - RNA, 19 nt, Escherichia coli CFT073
aauugcggguaggcaccug

SEQ ID NO: 2679669 - RNA, 16 nt, Escherichia coli CFT073
aauugcguaaagccug

SEQ ID NO: 2679670 - RNA, 19 nt, Escherichia coli CFT073
aauugcguuaaaaucagcg

SEQ ID NO: 2679671 - RNA, 21 nt, Escherichia coli CFT073
aauugcucgacuagauacuga

SEQ ID NO: 2679672 - RNA, 18 nt, Escherichia coli CFT073
aauuggcagaccagagcu

SEQ ID NO: 2679673 - RNA, 17 nt, Escherichia coli CFT073
aauuggcgcaaaggcgg

SEQ ID NO: 2679674 - RNA, 14 nt, Escherichia coli CFT073
aauuggggccgucc

SEQ ID NO: 2679675 - RNA, 20 nt, Escherichia coli CFT073
aauugucccauuugccagcg

SEQ ID NO: 2679676 - RNA, 22 nt, Escherichia coli CFT073
aauuguuccgucagccgcccgc

SEQ ID NO: 2679677 - RNA, 21 nt, Escherichia coli CFT073
aauuguuuacuaaaaguuauu

SEQ ID NO: 2679678 - RNA, 19 nt, Escherichia coli CFT073
aauuguuucaucgucagcu

SEQ ID NO: 2679679 - RNA, 22 nt, Escherichia coli CFT073
aauuguuugacuuauaagucuc

SEQ ID NO: 2679680 - RNA, 14 nt, Escherichia coli CFT073
aauuuaaaugacaa

SEQ ID NO: 2679681 - RNA, 17 nt, Escherichia coli CFT073
aauuuaaaugacaaugu

SEQ ID NO: 2679682 - RNA, 14 nt, Escherichia coli CFT073
aauuuaacauuacu

SEQ ID NO: 2679683 - RNA, 13 nt, Escherichia coli CFT073
aauuuacccgcca

SEQ ID NO: 2679684 - RNA, 23 nt, Escherichia coli CFT073
aauuuaccgaccucaacaaaaua

SEQ ID NO: 2679685 - RNA, 14 nt, Escherichia coli CFT073
aauuuaucagacaa

SEQ ID NO: 2679686 - RNA, 22 nt, Escherichia coli CFT073
aauuuaucgcagguaagauaau

SEQ ID NO: 2679687 - RNA, 23 nt, Escherichia coli CFT073
aauuuaucggcguuauuacuggu

SEQ ID NO: 2679688 - RNA, 14 nt, Escherichia coli CFT073
aauuuaucuuucag

SEQ ID NO: 2679689 - RNA, 16 nt, Escherichia coli CFT073
aauuucacgcucaccc

SEQ ID NO: 2679690 - RNA, 16 nt, Escherichia coli CFT073
aauuucacuuucugac

SEQ ID NO: 2679691 - RNA, 14 nt, Escherichia coli CFT073
aauuucagcaucgc

SEQ ID NO: 2679692 - RNA, 21 nt, Escherichia coli CFT073
aauuucaggcaacaaaaaacc

SEQ ID NO: 2679693 - RNA, 23 nt, Escherichia coli CFT073
aauuucaggccccaucgaaucaa

SEQ ID NO: 2679694 - RNA, 11 nt, Escherichia coli CFT073
aauuucaggcu

SEQ ID NO: 2679695 - RNA, 13 nt, Escherichia coli CFT073
aauuucaguuacu

SEQ ID NO: 2679696 - RNA, 18 nt, Escherichia coli CFT073
aauuucaucgcuacacca

SEQ ID NO: 2679697 - RNA, 21 nt, Escherichia coli CFT073
aauuucaucgcuacaccaauc

SEQ ID NO: 2679698 - RNA, 17 nt, Escherichia coli CFT073
aauuucaugcucaccaa

SEQ ID NO: 2679699 - RNA, 21 nt, Escherichia coli CFT073
aauuuccgcagcuccagcccg

SEQ ID NO: 2679700 - RNA, 18 nt, Escherichia coli CFT073
aauuuccgcgaccugauc

SEQ ID NO: 2679701 - RNA, 20 nt, Escherichia coli CFT073
aauuuccugcgcuuucugcu

SEQ ID NO: 2679702 - RNA, 12 nt, Escherichia coli CFT073
aauuucgccgca

SEQ ID NO: 2679703 - RNA, 23 nt, Escherichia coli CFT073
aauuucgcguaguuaugaaaaua

SEQ ID NO: 2679704 - RNA, 23 nt, Escherichia coli CFT073
aauuucgucguaaucauaaaaca

SEQ ID NO: 2679705 - RNA, 14 nt, Escherichia coli CFT073
aauuucuccgccgg

SEQ ID NO: 2679706 - RNA, 15 nt, Escherichia coli CFT073
aauuucuucguucgc

SEQ ID NO: 2679707 - RNA, 14 nt, Escherichia coli CFT073
aauuucuuuucaua

SEQ ID NO: 2679708 - RNA, 23 nt, Escherichia coli CFT073
aauuugaaaccgucuucccgcag

SEQ ID NO: 2679709 - RNA, 13 nt, Escherichia coli CFT073
aauuugaggaagc

SEQ ID NO: 2679710 - RNA, 14 nt, Escherichia coli CFT073
aauuugaggaagcu

SEQ ID NO: 2679711 - RNA, 23 nt, Escherichia coli CFT073
aauuugcagccguuuguucugca

SEQ ID NO: 2679712 - RNA, 12 nt, Escherichia coli CFT073
aauuugccagcg

SEQ ID NO: 2679713 - RNA, 20 nt, Escherichia coli CFT073
aauuugccagcguaaauccu

SEQ ID NO: 2679714 - RNA, 16 nt, Escherichia coli CFT073
aauuugcgccgccgac

SEQ ID NO: 2679715 - RNA, 19 nt, Escherichia coli CFT073
aauuugcguuuucaccacu

SEQ ID NO: 2679716 - RNA, 14 nt, Escherichia coli CFT073
aauuugcuccgcca

SEQ ID NO: 2679717 - RNA, 21 nt, Escherichia coli CFT073
aauuugcuugccggaagcaaa

SEQ ID NO: 2679718 - RNA, 20 nt, Escherichia coli CFT073
aauuugggugcaaugagaau

SEQ ID NO: 2679719 - RNA, 15 nt, Escherichia coli CFT073
aauuuguaacgauuc

SEQ ID NO: 2679720 - RNA, 15 nt, Escherichia coli CFT073
aauuugucgccaacu

SEQ ID NO: 2679721 - RNA, 15 nt, Escherichia coli CFT073
aauuuuaggaugcug

SEQ ID NO: 2679722 - RNA, 20 nt, Escherichia coli CFT073
aauuuuauccgcaaagauuu

SEQ ID NO: 2679723 - RNA, 13 nt, Escherichia coli CFT073
aauuuucagacca

SEQ ID NO: 2679724 - RNA, 11 nt, Escherichia coli CFT073
aauuuucccuu

SEQ ID NO: 2679725 - RNA, 18 nt, Escherichia coli CFT073
aauuuucccuucccgcaa

SEQ ID NO: 2679726 - RNA, 16 nt, Escherichia coli CFT073
aauuuuccuugaaaaa

SEQ ID NO: 2679727 - RNA, 13 nt, Escherichia coli CFT073
aauuuucgacagc

SEQ ID NO: 2679728 - RNA, 19 nt, Escherichia coli CFT073
aauuuucgccaucucaaaa

SEQ ID NO: 2679729 - RNA, 18 nt, Escherichia coli CFT073
aauuuucggggugcuccg

SEQ ID NO: 2679730 - RNA, 18 nt, Escherichia coli CFT073
aauuuugaacagaacugg

SEQ ID NO: 2679731 - RNA, 21 nt, Escherichia coli CFT073
aauuuugcagcauucaucaca

SEQ ID NO: 2679732 - RNA, 22 nt, Escherichia coli CFT073
aauuuugcagucccaucuucug

SEQ ID NO: 2679733 - RNA, 15 nt, Escherichia coli CFT073
aauuuugcugugcuu

SEQ ID NO: 2679734 - RNA, 14 nt, Escherichia coli CFT073
aauuuugugcagca

SEQ ID NO: 2679735 - RNA, 21 nt, Escherichia coli CFT073
aauuuuuccagcauuucuucc

SEQ ID NO: 2679736 - RNA, 23 nt, Escherichia coli CFT073
aauuuuucgcucuuucgcaucgc

SEQ ID NO: 2679737 - RNA, 19 nt, Escherichia coli CFT073
aauuuuuuaauaaaaaggu

SEQ ID NO: 2679738 - RNA, 22 nt, Escherichia coli CFT073
acaaaaaacggccccagaaggg

SEQ ID NO: 2679739 - RNA, 22 nt, Escherichia coli CFT073
acaaaaaauugaaaauucaaua

SEQ ID NO: 2679740 - RNA, 21 nt, Escherichia coli CFT073
acaaaaaguaguuccagcaug

SEQ ID NO: 2679741 - RNA, 16 nt, Escherichia coli CFT073
acaaaaauaccaccaa

SEQ ID NO: 2679742 - RNA, 23 nt, Escherichia coli CFT073
acaaaaauaccauuagucacauu

SEQ ID NO: 2679743 - RNA, 13 nt, Escherichia coli CFT073
acaagcuaccagc

SEQ ID NO: 2679744 - RNA, 13 nt, Escherichia coli CFT073
acaagcucauuuc

SEQ ID NO: 2679745 - RNA, 18 nt, Escherichia coli CFT073
acaaggcaauuaaaaauu

SEQ ID NO: 2679746 - RNA, 17 nt, Escherichia coli CFT073
acaaggcgggagaaaug

SEQ ID NO: 2679747 - RNA, 17 nt, Escherichia coli CFT073
acaaggcuauccucuaa

SEQ ID NO: 2679748 - RNA, 22 nt, Escherichia coli CFT073
acaagggaaauaagaaaagcga

SEQ ID NO: 2679749 - RNA, 20 nt, Escherichia coli CFT073
acaagguaguagaaaucagc

SEQ ID NO: 2679750 - RNA, 16 nt, Escherichia coli CFT073
acaaggugcgaaaaaa

SEQ ID NO: 2679751 - RNA, 22 nt, Escherichia coli CFT073
acaaggugcgaaaaaaauuacu

SEQ ID NO: 2679752 - RNA, 23 nt, Escherichia coli CFT073
acaaguccccgcuucgcccgcca

SEQ ID NO: 2679753 - RNA, 20 nt, Escherichia coli CFT073
acaaguccguugaaauugcu

SEQ ID NO: 2679754 - RNA, 19 nt, Escherichia coli CFT073
acaaguucgaaccaacaau

SEQ ID NO: 2679755 - RNA, 17 nt, Escherichia coli CFT073
acaaguucgcuccagcc

SEQ ID NO: 2679756 - RNA, 12 nt, Escherichia coli CFT073
acaauaaaaagc

SEQ ID NO: 2679757 - RNA, 16 nt, Escherichia coli CFT073
acaauaaacugcgacc

SEQ ID NO: 2679758 - RNA, 11 nt, Escherichia coli CFT073
acaauaacgcc

SEQ ID NO: 2679759 - RNA, 15 nt, Escherichia coli CFT073
acaauaauaucuuuc

SEQ ID NO: 2679760 - RNA, 17 nt, Escherichia coli CFT073
acaauaaucaccacaca

SEQ ID NO: 2679761 - RNA, 21 nt, Escherichia coli CFT073
acaauacaaaauaggcaaaaa

SEQ ID NO: 2679762 - RNA, 13 nt, Escherichia coli CFT073
acaauaccaaucg

SEQ ID NO: 2679763 - RNA, 20 nt, Escherichia coli CFT073
acaauacgcccacgcuucac

SEQ ID NO: 2679764 - RNA, 14 nt, Escherichia coli CFT073
acaauacgcccggu

SEQ ID NO: 2679765 - RNA, 15 nt, Escherichia coli CFT073
acaauacgcccggug

SEQ ID NO: 2679766 - RNA, 16 nt, Escherichia coli CFT073
acaauacugaucauca

SEQ ID NO: 2679767 - RNA, 19 nt, Escherichia coli CFT073
acaauagcgaacagacaaa

SEQ ID NO: 2679768 - RNA, 12 nt, Escherichia coli CFT073
acaauaucaaau

SEQ ID NO: 2679769 - RNA, 14 nt, Escherichia coli CFT073
acaauaucaucauu

SEQ ID NO: 2679770 - RNA, 15 nt, Escherichia coli CFT073
acaauaucaucauua

SEQ ID NO: 2679771 - RNA, 21 nt, Escherichia coli CFT073
acaauaucaucauuauuaaua

SEQ ID NO: 2679772 - RNA, 23 nt, Escherichia coli CFT073
acaauauccagcgcgcgcagcac

SEQ ID NO: 2679773 - RNA, 16 nt, Escherichia coli CFT073
acaauaucuaaaaugu

SEQ ID NO: 2679774 - RNA, 20 nt, Escherichia coli CFT073
acaauaugaauuaccccugg

SEQ ID NO: 2679775 - RNA, 20 nt, Escherichia coli CFT073
acaauauuaacaacauuacc

SEQ ID NO: 2679776 - RNA, 16 nt, Escherichia coli CFT073
acaauauuaauuacuu

SEQ ID NO: 2679777 - RNA, 13 nt, Escherichia coli CFT073
acaaucaaauccu

SEQ ID NO: 2679778 - RNA, 16 nt, Escherichia coli CFT073
acaaucaacgccacca

SEQ ID NO: 2679779 - RNA, 20 nt, Escherichia coli CFT073
acaaucaacgccaccaucac

SEQ ID NO: 2679780 - RNA, 11 nt, Escherichia coli CFT073
acaaucaccag

SEQ ID NO: 2679781 - RNA, 20 nt, Escherichia coli CFT073
acaaucaccaggucaccaga

SEQ ID NO: 2679782 - RNA, 15 nt, Escherichia coli CFT073
acaaucacuucauuc

SEQ ID NO: 2679783 - RNA, 15 nt, Escherichia coli CFT073
acaauccaaaugccu

SEQ ID NO: 2679784 - RNA, 14 nt, Escherichia coli CFT073
acaauccagucagc

SEQ ID NO: 2679785 - RNA, 14 nt, Escherichia coli CFT073
acaauccccgccag

SEQ ID NO: 2679786 - RNA, 19 nt, Escherichia coli CFT073
acaauccccgcgccaacca

SEQ ID NO: 2679787 - RNA, 16 nt, Escherichia coli CFT073
acaaucccuuccaccg

SEQ ID NO: 2679788 - RNA, 15 nt, Escherichia coli CFT073
acaauccgccaggac

SEQ ID NO: 2679789 - RNA, 18 nt, Escherichia coli CFT073
acaaucgcccccaucacc

SEQ ID NO: 2679790 - RNA, 14 nt, Escherichia coli CFT073
acaaucgcucacaa

SEQ ID NO: 2679791 - RNA, 23 nt, Escherichia coli CFT073
acaaucgcucacaacaauaucaa

SEQ ID NO: 2679792 - RNA, 14 nt, Escherichia coli CFT073
acaaucgcuuaauc

SEQ ID NO: 2679793 - RNA, 23 nt, Escherichia coli CFT073
acaaucgcuucaucgcccacauc

SEQ ID NO: 2679794 - RNA, 17 nt, Escherichia coli CFT073
acaaucggcgggaaaaa

SEQ ID NO: 2679795 - RNA, 16 nt, Escherichia coli CFT073
acaaucgggaaaaucu

SEQ ID NO: 2679796 - RNA, 18 nt, Escherichia coli CFT073
acaaucgggaaaaucugc

SEQ ID NO: 2679797 - RNA, 17 nt, Escherichia coli CFT073
acaaucgucagcucgcu

SEQ ID NO: 2679798 - RNA, 15 nt, Escherichia coli CFT073
acaaucuuaggggac

SEQ ID NO: 2679799 - RNA, 17 nt, Escherichia coli CFT073
acaaugcaaacggcgcg

SEQ ID NO: 2679800 - RNA, 19 nt, Escherichia coli CFT073
acaaugcaauauuuugaau

SEQ ID NO: 2679801 - RNA, 21 nt, Escherichia coli CFT073
acaaugccauauaacgggcuu

SEQ ID NO: 2679802 - RNA, 16 nt, Escherichia coli CFT073
acaaugcccggaaugu

SEQ ID NO: 2679803 - RNA, 12 nt, Escherichia coli CFT073
acaaugccgcca

SEQ ID NO: 2679804 - RNA, 20 nt, Escherichia coli CFT073
acaaugccucgcuaaucucu

SEQ ID NO: 2679805 - RNA, 22 nt, Escherichia coli CFT073
acaaugcggugugcggguuuuc

SEQ ID NO: 2679806 - RNA, 19 nt, Escherichia coli CFT073
acaauggcauaaccgauac

SEQ ID NO: 2679807 - RNA, 19 nt, Escherichia coli CFT073
acaauggcauauuccgcca

SEQ ID NO: 2679808 - RNA, 16 nt, Escherichia coli CFT073
acaauggcccgccgca

SEQ ID NO: 2679809 - RNA, 17 nt, Escherichia coli CFT073
acaaugggcgugaaagg

SEQ ID NO: 2679810 - RNA, 20 nt, Escherichia coli CFT073
acaaugggcgugaaaggugc

SEQ ID NO: 2679811 - RNA, 20 nt, Escherichia coli CFT073
acaauggucaacauucccug

SEQ ID NO: 2679812 - RNA, 16 nt, Escherichia coli CFT073
acaauguaccagucaa

SEQ ID NO: 2679813 - RNA, 14 nt, Escherichia coli CFT073
acaauguaucuuuc

SEQ ID NO: 2679814 - RNA, 22 nt, Escherichia coli CFT073
acaauguccguaacauaacagc

SEQ ID NO: 2679815 - RNA, 17 nt, Escherichia coli CFT073
acaaugucguccgguac

SEQ ID NO: 2679816 - RNA, 22 nt, Escherichia coli CFT073
acaaugucuucacaaccgccau

SEQ ID NO: 2679817 - RNA, 15 nt, Escherichia coli CFT073
acaaugugaaaaccc

SEQ ID NO: 2679818 - RNA, 18 nt, Escherichia coli CFT073
acaauguugucgccagua

SEQ ID NO: 2679819 - RNA, 12 nt, Escherichia coli CFT073
acaauuaauaca

SEQ ID NO: 2679820 - RNA, 14 nt, Escherichia coli CFT073
acaauuacaaaaug

SEQ ID NO: 2679821 - RNA, 15 nt, Escherichia coli CFT073
acaauuacaaaauga

SEQ ID NO: 2679822 - RNA, 23 nt, Escherichia coli CFT073
acaauuacgccgagcgccagcca

SEQ ID NO: 2679823 - RNA, 22 nt, Escherichia coli CFT073
acaauucacacucugccagcga

SEQ ID NO: 2679824 - RNA, 19 nt, Escherichia coli CFT073
acaauuccgccugcagagg

SEQ ID NO: 2679825 - RNA, 14 nt, Escherichia coli CFT073
acaauugcauauca

SEQ ID NO: 2679826 - RNA, 20 nt, Escherichia coli CFT073
acaauugcgggccaaagacc

SEQ ID NO: 2679827 - RNA, 20 nt, Escherichia coli CFT073
acaauuuaccgaccucaaca

SEQ ID NO: 2679828 - RNA, 16 nt, Escherichia coli CFT073
acaauuucagcaauaa

SEQ ID NO: 2679829 - RNA, 24 nt, Escherichia coli CFT073
acaauuugcgguccauauaaucga

SEQ ID NO: 2679830 - RNA, 13 nt, Escherichia coli CFT073
acacaaacggcgc

SEQ ID NO: 2679831 - RNA, 17 nt, Escherichia coli CFT073
acacaaccgaggcucaa

SEQ ID NO: 2679832 - RNA, 21 nt, Escherichia coli CFT073
acacaagcguaagagaacaga

SEQ ID NO: 2679833 - RNA, 22 nt, Escherichia coli CFT073
acacaagguauccagacggcgc

SEQ ID NO: 2679834 - RNA, 15 nt, Escherichia coli CFT073
acacaaguccagcac

SEQ ID NO: 2679835 - RNA, 15 nt, Escherichia coli CFT073
acacaaucaaauccu

SEQ ID NO: 2679836 - RNA, 15 nt, Escherichia coli CFT073
acacaauccaugcca

SEQ ID NO: 2679837 - RNA, 17 nt, Escherichia coli CFT073
acacaauccaugccaaa

SEQ ID NO: 2679838 - RNA, 13 nt, Escherichia coli CFT073
acacaauccgcug

SEQ ID NO: 2679839 - RNA, 18 nt, Escherichia coli CFT073
acacaccagauccagcaa

SEQ ID NO: 2679840 - RNA, 15 nt, Escherichia coli CFT073
acacacuaccgccga

SEQ ID NO: 2679841 - RNA, 21 nt, Escherichia coli CFT073
acacacuaccgccgagcacaa

SEQ ID NO: 2679842 - RNA, 15 nt, Escherichia coli CFT073
acacacugcgccgcc

SEQ ID NO: 2679843 - RNA, 23 nt, Escherichia coli CFT073
acacacugcgccgccagugugaa

SEQ ID NO: 2679844 - RNA, 13 nt, Escherichia coli CFT073
acacacuuuccag

SEQ ID NO: 2679845 - RNA, 16 nt, Escherichia coli CFT073
acacagauaaaucaau

SEQ ID NO: 2679846 - RNA, 22 nt, Escherichia coli CFT073
acacagauaaaucaauacguug

SEQ ID NO: 2679847 - RNA, 20 nt, Escherichia coli CFT073
acacagcggcagcaucucgc

SEQ ID NO: 2679848 - RNA, 23 nt, Escherichia coli CFT073
acacagcuuucucaaaauacugc

SEQ ID NO: 2679849 - RNA, 18 nt, Escherichia coli CFT073
acacaguaaaauauucga

SEQ ID NO: 2679850 - RNA, 20 nt, Escherichia coli CFT073
acacaguucuucaaaaauaa

SEQ ID NO: 2679851 - RNA, 14 nt, Escherichia coli CFT073
acacucuauccagc

SEQ ID NO: 2679852 - RNA, 13 nt, Escherichia coli CFT073
acacucugaccug

SEQ ID NO: 2679853 - RNA, 13 nt, Escherichia coli CFT073
acacucugcgccu

SEQ ID NO: 2679854 - RNA, 19 nt, Escherichia coli CFT073
acacucuucaacacacuga

SEQ ID NO: 2679855 - RNA, 13 nt, Escherichia coli CFT073
acacugaaaaaaa

SEQ ID NO: 2679856 - RNA, 20 nt, Escherichia coli CFT073
acacugagcgugagugcgaa

SEQ ID NO: 2679857 - RNA, 14 nt, Escherichia coli CFT073
acacugaugacagg

SEQ ID NO: 2679858 - RNA, 17 nt, Escherichia coli CFT073
acacugccagcccggca

SEQ ID NO: 2679859 - RNA, 15 nt, Escherichia coli CFT073
acacugcucgcagaa

SEQ ID NO: 2679860 - RNA, 19 nt, Escherichia coli CFT073
acacugcuuuuaaaugccc

SEQ ID NO: 2679861 - RNA, 13 nt, Escherichia coli CFT073
acacuggcagugu

SEQ ID NO: 2679862 - RNA, 18 nt, Escherichia coli CFT073
acacuggcagugugccug

SEQ ID NO: 2679863 - RNA, 17 nt, Escherichia coli CFT073
acacugguucccaacaa

SEQ ID NO: 2679864 - RNA, 19 nt, Escherichia coli CFT073
acacugguucccaacaaca

SEQ ID NO: 2679865 - RNA, 21 nt, Escherichia coli CFT073
acacugguucccaacaacagc

SEQ ID NO: 2679866 - RNA, 15 nt, Escherichia coli CFT073
acacuguaccugguc

SEQ ID NO: 2679867 - RNA, 18 nt, Escherichia coli CFT073
acacuguuaccgcugcug

SEQ ID NO: 2679868 - RNA, 13 nt, Escherichia coli CFT073
acacuguucauua

SEQ ID NO: 2679869 - RNA, 18 nt, Escherichia coli CFT073
acacuguugagaggacaa

SEQ ID NO: 2679870 - RNA, 22 nt, Escherichia coli CFT073
acacuguugagaggacaaauaa

SEQ ID NO: 2679871 - RNA, 19 nt, Escherichia coli CFT073
acacuucaauauuaaugcu

SEQ ID NO: 2679872 - RNA, 21 nt, Escherichia coli CFT073
acacuuccgcguaguugcgcu

SEQ ID NO: 2679873 - RNA, 15 nt, Escherichia coli CFT073
acacuucuucagcca

SEQ ID NO: 2679874 - RNA, 18 nt, Escherichia coli CFT073
acacuucuucagccaguu

SEQ ID NO: 2679875 - RNA, 21 nt, Escherichia coli CFT073
acacuucuucuguuucugucg

SEQ ID NO: 2679876 - RNA, 22 nt, Escherichia coli CFT073
acacuuuccaguuccggcauua

SEQ ID NO: 2679877 - RNA, 13 nt, Escherichia coli CFT073
acacuuuccugcu

SEQ ID NO: 2679878 - RNA, 20 nt, Escherichia coli CFT073
acacuuuccugcucggcaaa

SEQ ID NO: 2679879 - RNA, 18 nt, Escherichia coli CFT073
acacuuucugcaaacaag

SEQ ID NO: 2679880 - RNA, 13 nt, Escherichia coli CFT073
acagaaaagcaga

SEQ ID NO: 2679881 - RNA, 14 nt, Escherichia coli CFT073
acagaaaagcagag

SEQ ID NO: 2679882 - RNA, 18 nt, Escherichia coli CFT073
acagaaacgccauccagc

SEQ ID NO: 2679883 - RNA, 22 nt, Escherichia coli CFT073
acagaaacgccauccagccggg

SEQ ID NO: 2679884 - RNA, 14 nt, Escherichia coli CFT073
acagaaaguagcgg

SEQ ID NO: 2679885 - RNA, 14 nt, Escherichia coli CFT073
acagaaaucagagu

SEQ ID NO: 2679886 - RNA, 17 nt, Escherichia coli CFT073
acagaaaucugaucgug

SEQ ID NO: 2679887 - RNA, 23 nt, Escherichia coli CFT073
acagaacgcgccuuaaaaaccag

SEQ ID NO: 2679888 - RNA, 12 nt, Escherichia coli CFT073
acagaacgcugc

SEQ ID NO: 2679889 - RNA, 21 nt, Escherichia coli CFT073
acagaacuuuacuggcucgcc

SEQ ID NO: 2679890 - RNA, 13 nt, Escherichia coli CFT073
acagaagaggaga

SEQ ID NO: 2679891 - RNA, 23 nt, Escherichia coli CFT073
acagaauacccagcaaugccagg

SEQ ID NO: 2679892 - RNA, 13 nt, Escherichia coli CFT073
acagaauaucugc

SEQ ID NO: 2679893 - RNA, 12 nt, Escherichia coli CFT073
acagaaucagca

SEQ ID NO: 2679894 - RNA, 21 nt, Escherichia coli CFT073
acagaaugcgcgcgaaaacau

SEQ ID NO: 2679895 - RNA, 14 nt, Escherichia coli CFT073
acagaaugugaugc

SEQ ID NO: 2679896 - RNA, 20 nt, Escherichia coli CFT073
acagaaugugaugccagcac

SEQ ID NO: 2679897 - RNA, 22 nt, Escherichia coli CFT073
acagaaugugaugccagcacuc

SEQ ID NO: 2679898 - RNA, 22 nt, Escherichia coli CFT073
acagaauuauccccgaugguga

SEQ ID NO: 2679899 - RNA, 12 nt, Escherichia coli CFT073
acagccgacaau

SEQ ID NO: 2679900 - RNA, 14 nt, Escherichia coli CFT073
acagccgcauuuug

SEQ ID NO: 2679901 - RNA, 22 nt, Escherichia coli CFT073
acagccgcauuuuguuggacau

SEQ ID NO: 2679902 - RNA, 21 nt, Escherichia coli CFT073
acagccgccagacaauugccg

SEQ ID NO: 2679903 - RNA, 21 nt, Escherichia coli CFT073
acagccgggagugaauucauc

SEQ ID NO: 2679904 - RNA, 22 nt, Escherichia coli CFT073
acagccuaccagaccgcacacc

SEQ ID NO: 2679905 - RNA, 13 nt, Escherichia coli CFT073
acagccucaagca

SEQ ID NO: 2679906 - RNA, 15 nt, Escherichia coli CFT073
acagccucaagcacc

SEQ ID NO: 2679907 - RNA, 22 nt, Escherichia coli CFT073
acagccucaagcacccaaugcc

SEQ ID NO: 2679908 - RNA, 15 nt, Escherichia coli CFT073
acagccugggaaggu

SEQ ID NO: 2679909 - RNA, 14 nt, Escherichia coli CFT073
acagccuuaacaag

SEQ ID NO: 2679910 - RNA, 18 nt, Escherichia coli CFT073
acagccuuauugucuuua

SEQ ID NO: 2679911 - RNA, 17 nt, Escherichia coli CFT073
acagccuuguauuaaua

SEQ ID NO: 2679912 - RNA, 22 nt, Escherichia coli CFT073
acagcgaaaacgacgagccacc

SEQ ID NO: 2679913 - RNA, 23 nt, Escherichia coli CFT073
acagcgaauaguggaguaugagg

SEQ ID NO: 2679914 - RNA, 14 nt, Escherichia coli CFT073
acagcgacagauuc

SEQ ID NO: 2679915 - RNA, 13 nt, Escherichia coli CFT073
acagcgacaucaa

SEQ ID NO: 2679916 - RNA, 14 nt, Escherichia coli CFT073
acagcgaccgcaga

SEQ ID NO: 2679917 - RNA, 15 nt, Escherichia coli CFT073
acagcgauuccaguu

SEQ ID NO: 2679918 - RNA, 15 nt, Escherichia coli CFT073
acagcgcaauacgaa

SEQ ID NO: 2679919 - RNA, 14 nt, Escherichia coli CFT073
acagcgcaaucacc

SEQ ID NO: 2679920 - RNA, 19 nt, Escherichia coli CFT073
acagcgcccagacaauuaa

SEQ ID NO: 2679921 - RNA, 21 nt, Escherichia coli CFT073
acagcgccgcgauaaaauccc

SEQ ID NO: 2679922 - RNA, 19 nt, Escherichia coli CFT073
acagcgccugcaaaauaau

SEQ ID NO: 2679923 - RNA, 20 nt, Escherichia coli CFT073
acagcgccugcacaaagcgc

SEQ ID NO: 2679924 - RNA, 18 nt, Escherichia coli CFT073
acagcgcgccagcuacca

SEQ ID NO: 2679925 - RNA, 15 nt, Escherichia coli CFT073
acagcgcgcugacau

SEQ ID NO: 2679926 - RNA, 19 nt, Escherichia coli CFT073
acagcggcguuuuaucacg

SEQ ID NO: 2679927 - RNA, 18 nt, Escherichia coli CFT073
acagcgggguaaucgcca

SEQ ID NO: 2679928 - RNA, 19 nt, Escherichia coli CFT073
acagcguaauagccugaug

SEQ ID NO: 2679929 - RNA, 20 nt, Escherichia coli CFT073
acagcguauaaaccauauca

SEQ ID NO: 2679930 - RNA, 14 nt, Escherichia coli CFT073
acagcgucacauca

SEQ ID NO: 2679931 - RNA, 17 nt, Escherichia coli CFT073
acagcgucgcaucaggc

SEQ ID NO: 2679932 - RNA, 14 nt, Escherichia coli CFT073
acagcgugccgcga

SEQ ID NO: 2679933 - RNA, 21 nt, Escherichia coli CFT073
acagcguguuaaugcccauca

SEQ ID NO: 2679934 - RNA, 17 nt, Escherichia coli CFT073
acagcguuucauuacua

SEQ ID NO: 2679935 - RNA, 15 nt, Escherichia coli CFT073
acagcguuucuucga

SEQ ID NO: 2679936 - RNA, 16 nt, Escherichia coli CFT073
acagcguuuugccauc

SEQ ID NO: 2679937 - RNA, 12 nt, Escherichia coli CFT073
acagcucacgcg

SEQ ID NO: 2679938 - RNA, 18 nt, Escherichia coli CFT073
acagcucgacaccaaaca

SEQ ID NO: 2679939 - RNA, 17 nt, Escherichia coli CFT073
acagcugcgaccagugg

SEQ ID NO: 2679940 - RNA, 18 nt, Escherichia coli CFT073
acagcuggaguagauaau

SEQ ID NO: 2679941 - RNA, 15 nt, Escherichia coli CFT073
acagcuuaaaaugcu

SEQ ID NO: 2679942 - RNA, 19 nt, Escherichia coli CFT073
acagcuuaaucaccagcgc

SEQ ID NO: 2679943 - RNA, 17 nt, Escherichia coli CFT073
acagcuuuuacagccaa

SEQ ID NO: 2679944 - RNA, 14 nt, Escherichia coli CFT073
acagcuuuuuccug

SEQ ID NO: 2679945 - RNA, 17 nt, Escherichia coli CFT073
acaggaaacagcuugcu

SEQ ID NO: 2679946 - RNA, 13 nt, Escherichia coli CFT073
acaggaaccaaau

SEQ ID NO: 2679947 - RNA, 20 nt, Escherichia coli CFT073
acaggaaccaaaugccggaa

SEQ ID NO: 2679948 - RNA, 22 nt, Escherichia coli CFT073
acaggauggcauuugcaacacc

SEQ ID NO: 2679949 - RNA, 18 nt, Escherichia coli CFT073
acaggauggcccaaaugg

SEQ ID NO: 2679950 - RNA, 18 nt, Escherichia coli CFT073
acaggcaauuuugcguuu

SEQ ID NO: 2679951 - RNA, 17 nt, Escherichia coli CFT073
acaggcacaccgccgcc

SEQ ID NO: 2679952 - RNA, 18 nt, Escherichia coli CFT073
acaggcacaccgccgccg

SEQ ID NO: 2679953 - RNA, 20 nt, Escherichia coli CFT073
acaggcacuacguucucacu

SEQ ID NO: 2679954 - RNA, 17 nt, Escherichia coli CFT073
acaggcacuugucacca

SEQ ID NO: 2679955 - RNA, 20 nt, Escherichia coli CFT073
acaggcagcaaucacugcca

SEQ ID NO: 2679956 - RNA, 16 nt, Escherichia coli CFT073
acaggcagcuuagaaa

SEQ ID NO: 2679957 - RNA, 13 nt, Escherichia coli CFT073
acaggcaguaaua

SEQ ID NO: 2679958 - RNA, 13 nt, Escherichia coli CFT073
acaggccaccagg

SEQ ID NO: 2679959 - RNA, 14 nt, Escherichia coli CFT073
acaggccaccaggc

SEQ ID NO: 2679960 - RNA, 18 nt, Escherichia coli CFT073
acaggccgcuguuuuuca

SEQ ID NO: 2679961 - RNA, 16 nt, Escherichia coli CFT073
acaggccggagccagu

SEQ ID NO: 2679962 - RNA, 18 nt, Escherichia coli CFT073
acaggcgaaaccagcagc

SEQ ID NO: 2679963 - RNA, 16 nt, Escherichia coli CFT073
acaggcgaucuucccg

SEQ ID NO: 2679964 - RNA, 21 nt, Escherichia coli CFT073
acaggcgaucuucccgcgcau

SEQ ID NO: 2679965 - RNA, 13 nt, Escherichia coli CFT073
acaggcgaugcca

SEQ ID NO: 2679966 - RNA, 12 nt, Escherichia coli CFT073
acaggcgcgacc

SEQ ID NO: 2679967 - RNA, 12 nt, Escherichia coli CFT073
acaggcggcgcg

SEQ ID NO: 2679968 - RNA, 13 nt, Escherichia coli CFT073
acaggcgggaaga

SEQ ID NO: 2679969 - RNA, 12 nt, Escherichia coli CFT073
acaggcgugauu

SEQ ID NO: 2679970 - RNA, 23 nt, Escherichia coli CFT073
acaggcguuaugucuucccggcu

SEQ ID NO: 2679971 - RNA, 13 nt, Escherichia coli CFT073
acaggcuacugcc

SEQ ID NO: 2679972 - RNA, 12 nt, Escherichia coli CFT073
acaggcugcugc

SEQ ID NO: 2679973 - RNA, 18 nt, Escherichia coli CFT073
acaggcugcugccguagc

SEQ ID NO: 2679974 - RNA, 13 nt, Escherichia coli CFT073
acagggcaacggc

SEQ ID NO: 2679975 - RNA, 18 nt, Escherichia coli CFT073
acagggcgucaccgguca

SEQ ID NO: 2679976 - RNA, 15 nt, Escherichia coli CFT073
acaggggaucgacgc

SEQ ID NO: 2679977 - RNA, 19 nt, Escherichia coli CFT073
acaggggaugcuaugaaca

SEQ ID NO: 2679978 - RNA, 23 nt, Escherichia coli CFT073
acagguaaauuccuguagcggaa

SEQ ID NO: 2679979 - RNA, 13 nt, Escherichia coli CFT073
acagguaagcaca

SEQ ID NO: 2679980 - RNA, 22 nt, Escherichia coli CFT073
acagguaagguaaugcgcgagc

SEQ ID NO: 2679981 - RNA, 21 nt, Escherichia coli CFT073
acagguaauugaggaccccau

SEQ ID NO: 2679982 - RNA, 18 nt, Escherichia coli CFT073
acagguaucgacaauguc

SEQ ID NO: 2679983 - RNA, 13 nt, Escherichia coli CFT073
acagguccuggcu

SEQ ID NO: 2679984 - RNA, 15 nt, Escherichia coli CFT073
acaggucgcaaacgg

SEQ ID NO: 2679985 - RNA, 17 nt, Escherichia coli CFT073
acaggugcaccgcaucc

SEQ ID NO: 2679986 - RNA, 19 nt, Escherichia coli CFT073
acagguggcguuugccacc

SEQ ID NO: 2679987 - RNA, 15 nt, Escherichia coli CFT073
acagguucaugcugc

SEQ ID NO: 2679988 - RNA, 16 nt, Escherichia coli CFT073
acagguugaagaucau

SEQ ID NO: 2679989 - RNA, 13 nt, Escherichia coli CFT073
acaguaacccagc

SEQ ID NO: 2679990 - RNA, 15 nt, Escherichia coli CFT073
acaguaacccagcac

SEQ ID NO: 2679991 - RNA, 18 nt, Escherichia coli CFT073
acaguaacccagcaccaa

SEQ ID NO: 2679992 - RNA, 14 nt, Escherichia coli CFT073
acaguaagcaauca

SEQ ID NO: 2679993 - RNA, 16 nt, Escherichia coli CFT073
acaguaagcccaccac

SEQ ID NO: 2679994 - RNA, 22 nt, Escherichia coli CFT073
acaguacaauauuaauuacuuc

SEQ ID NO: 2679995 - RNA, 12 nt, Escherichia coli CFT073
acaguaccagca

SEQ ID NO: 2679996 - RNA, 16 nt, Escherichia coli CFT073
acaguacccagauuca

SEQ ID NO: 2679997 - RNA, 15 nt, Escherichia coli CFT073
acaguacugccggga

SEQ ID NO: 2679998 - RNA, 15 nt, Escherichia coli CFT073
acaguacugggauuc

SEQ ID NO: 2679999 - RNA, 16 nt, Escherichia coli CFT073
acaguauccgggcauc

SEQ ID NO: 2680000 - RNA, 20 nt, Escherichia coli CFT073
acaguauucagaucagcggc

SEQ ID NO: 2680001 - RNA, 15 nt, Escherichia coli CFT073
acagucaaccgccug

SEQ ID NO: 2680002 - RNA, 17 nt, Escherichia coli CFT073
acagucaaggaaugaaa

SEQ ID NO: 2680003 - RNA, 21 nt, Escherichia coli CFT073
acagucaaggaaugaaauauu

SEQ ID NO: 2680004 - RNA, 20 nt, Escherichia coli CFT073
acagucacccgcugcgaaca

SEQ ID NO: 2680005 - RNA, 20 nt, Escherichia coli CFT073
acagucaguuaucgcauuau

SEQ ID NO: 2680006 - RNA, 22 nt, Escherichia coli CFT073
acagucaguuuguaagucagaa

SEQ ID NO: 2680007 - RNA, 22 nt, Escherichia coli CFT073
acagucgcccgaccaucgccag

SEQ ID NO: 2680008 - RNA, 17 nt, Escherichia coli CFT073
acauccaguauauugcu

SEQ ID NO: 2680009 - RNA, 14 nt, Escherichia coli CFT073
acauccauauccag

SEQ ID NO: 2680010 - RNA, 20 nt, Escherichia coli CFT073
acauccaucgccaguucaaa

SEQ ID NO: 2680011 - RNA, 23 nt, Escherichia coli CFT073
acauccaugcacugcaacgccuu

SEQ ID NO: 2680012 - RNA, 22 nt, Escherichia coli CFT073
acaucccagcagagaucuuuca

SEQ ID NO: 2680013 - RNA, 12 nt, Escherichia coli CFT073
acauccccagcg

SEQ ID NO: 2680014 - RNA, 17 nt, Escherichia coli CFT073
acauccgaccaaagaau

SEQ ID NO: 2680015 - RNA, 23 nt, Escherichia coli CFT073
acauccggcaaaccaugccggau

SEQ ID NO: 2680016 - RNA, 18 nt, Escherichia coli CFT073
acauccggcaaugaaacu

SEQ ID NO: 2680017 - RNA, 21 nt, Escherichia coli CFT073
acauccggcacgucuucgaua

SEQ ID NO: 2680018 - RNA, 20 nt, Escherichia coli CFT073
acauccgggcaugaagaaag

SEQ ID NO: 2680019 - RNA, 21 nt, Escherichia coli CFT073
acauccgggcgagcuuauaua

SEQ ID NO: 2680020 - RNA, 18 nt, Escherichia coli CFT073
acauccgguuucaucagc

SEQ ID NO: 2680021 - RNA, 22 nt, Escherichia coli CFT073
acauccugaguuaaucgccgca

SEQ ID NO: 2680022 - RNA, 21 nt, Escherichia coli CFT073
acauccugccaguaagcaguc

SEQ ID NO: 2680023 - RNA, 19 nt, Escherichia coli CFT073
acauccuuuucaccuucaa

SEQ ID NO: 2680024 - RNA, 22 nt, Escherichia coli CFT073
acauccuuuucaccuucaaaau

SEQ ID NO: 2680025 - RNA, 19 nt, Escherichia coli CFT073
acaucgacucaagcguugc

SEQ ID NO: 2680026 - RNA, 14 nt, Escherichia coli CFT073
acaucgcaaaauac

SEQ ID NO: 2680027 - RNA, 18 nt, Escherichia coli CFT073
acaucgcagggaucaucc

SEQ ID NO: 2680028 - RNA, 23 nt, Escherichia coli CFT073
acaucgccauauuggggaugacg

SEQ ID NO: 2680029 - RNA, 20 nt, Escherichia coli CFT073
acaucgcccucuuucaccag

SEQ ID NO: 2680030 - RNA, 22 nt, Escherichia coli CFT073
acaucgcccucuuucaccagau

SEQ ID NO: 2680031 - RNA, 19 nt, Escherichia coli CFT073
acaucgcgccaacaaaagc

SEQ ID NO: 2680032 - RNA, 18 nt, Escherichia coli CFT073
acaucgcgcuggcgcagc

SEQ ID NO: 2680033 - RNA, 13 nt, Escherichia coli CFT073
acaucgcugugcu

SEQ ID NO: 2680034 - RNA, 16 nt, Escherichia coli CFT073
acaucgcugugcugcu

SEQ ID NO: 2680035 - RNA, 14 nt, Escherichia coli CFT073
acaucgcuuaguua

SEQ ID NO: 2680036 - RNA, 15 nt, Escherichia coli CFT073
acaucggcaggaaca

SEQ ID NO: 2680037 - RNA, 21 nt, Escherichia coli CFT073
acaucggcuuuuuuaucauua

SEQ ID NO: 2680038 - RNA, 21 nt, Escherichia coli CFT073
acaucgguauagauaaagucu

SEQ ID NO: 2680039 - RNA, 21 nt, Escherichia coli CFT073
acaucgucaggaagaagccca

SEQ ID NO: 2680040 - RNA, 22 nt, Escherichia coli CFT073
acaucgucaggaagaagcccau

SEQ ID NO: 2680041 - RNA, 14 nt, Escherichia coli CFT073
acaucgucgcaaau

SEQ ID NO: 2680042 - RNA, 13 nt, Escherichia coli CFT073
acaucgucgccag

SEQ ID NO: 2680043 - RNA, 14 nt, Escherichia coli CFT073
acaucgucgccaga

SEQ ID NO: 2680044 - RNA, 19 nt, Escherichia coli CFT073
acaucgucuccagcgaauc

SEQ ID NO: 2680045 - RNA, 14 nt, Escherichia coli CFT073
acaucgucugcggu

SEQ ID NO: 2680046 - RNA, 20 nt, Escherichia coli CFT073
acaucguugauauuuguuuu

SEQ ID NO: 2680047 - RNA, 19 nt, Escherichia coli CFT073
acaucguugauuucaccau

SEQ ID NO: 2680048 - RNA, 23 nt, Escherichia coli CFT073
acaucguugauuucaccaucuuc

SEQ ID NO: 2680049 - RNA, 13 nt, Escherichia coli CFT073
acaucucaaaucu

SEQ ID NO: 2680050 - RNA, 15 nt, Escherichia coli CFT073
acaucucaauauccg

SEQ ID NO: 2680051 - RNA, 14 nt, Escherichia coli CFT073
acaucucaauccgc

SEQ ID NO: 2680052 - RNA, 12 nt, Escherichia coli CFT073
acaucucuuccc

SEQ ID NO: 2680053 - RNA, 19 nt, Escherichia coli CFT073
acaucugccccauugcuga

SEQ ID NO: 2680054 - RNA, 20 nt, Escherichia coli CFT073
acaucugucugauaaaaaac

SEQ ID NO: 2680055 - RNA, 18 nt, Escherichia coli CFT073
acaucuuaauagcugcca

SEQ ID NO: 2680056 - RNA, 19 nt, Escherichia coli CFT073
acaucuuuacaucauucaa

SEQ ID NO: 2680057 - RNA, 22 nt, Escherichia coli CFT073
acaucuuucugcgcaucuuccc

SEQ ID NO: 2680058 - RNA, 14 nt, Escherichia coli CFT073
acaugaacaucaag

SEQ ID NO: 2680059 - RNA, 14 nt, Escherichia coli CFT073
acaugaagcacggc

SEQ ID NO: 2680060 - RNA, 15 nt, Escherichia coli CFT073
acaugacaccaagca

SEQ ID NO: 2680061 - RNA, 16 nt, Escherichia coli CFT073
acaugacgcgcaucac

SEQ ID NO: 2680062 - RNA, 19 nt, Escherichia coli CFT073
acaugacgcgcaucacgac

SEQ ID NO: 2680063 - RNA, 15 nt, Escherichia coli CFT073
acaugagaacaguuc

SEQ ID NO: 2680064 - RNA, 15 nt, Escherichia coli CFT073
acaugauaauaaaaa

SEQ ID NO: 2680065 - RNA, 21 nt, Escherichia coli CFT073
acaugauacgccugcuggcua

SEQ ID NO: 2680066 - RNA, 18 nt, Escherichia coli CFT073
acaugaucauucaccagc

SEQ ID NO: 2680067 - RNA, 20 nt, Escherichia coli CFT073
acaugauccggcaucuuguu

SEQ ID NO: 2680068 - RNA, 19 nt, Escherichia coli CFT073
acaugcagcuucgccauuu

SEQ ID NO: 2680069 - RNA, 14 nt, Escherichia coli CFT073
acaugcauaaagcg

SEQ ID NO: 2680070 - RNA, 14 nt, Escherichia coli CFT073
acaugccacuggcu

SEQ ID NO: 2680071 - RNA, 18 nt, Escherichia coli CFT073
acaugccgaauccgggaa

SEQ ID NO: 2680072 - RNA, 18 nt, Escherichia coli CFT073
acaugcgggucuuacugg

SEQ ID NO: 2680073 - RNA, 16 nt, Escherichia coli CFT073
acaugcggugauuuug

SEQ ID NO: 2680074 - RNA, 14 nt, Escherichia coli CFT073
acaugcuaaaaauc

SEQ ID NO: 2680075 - RNA, 14 nt, Escherichia coli CFT073
acaugcugacuacu

SEQ ID NO: 2680076 - RNA, 21 nt, Escherichia coli CFT073
acaugcuuuugcgccaucgac

SEQ ID NO: 2680077 - RNA, 13 nt, Escherichia coli CFT073
acauggcaucccc

SEQ ID NO: 2680078 - RNA, 21 nt, Escherichia coli CFT073
acauggcccaguguuuuaccg

SEQ ID NO: 2680079 - RNA, 17 nt, Escherichia coli CFT073
acauggcgaaaaaccua

SEQ ID NO: 2680080 - RNA, 22 nt, Escherichia coli CFT073
acauggcgcggcacaccagcca

SEQ ID NO: 2680081 - RNA, 20 nt, Escherichia coli CFT073
acauggucaucaucauuaac

SEQ ID NO: 2680082 - RNA, 19 nt, Escherichia coli CFT073
acauggugaaagcauggca

SEQ ID NO: 2680083 - RNA, 15 nt, Escherichia coli CFT073
acaugguuaaaaucu

SEQ ID NO: 2680084 - RNA, 19 nt, Escherichia coli CFT073
acaugguuaaaaucucccg

SEQ ID NO: 2680085 - RNA, 23 nt, Escherichia coli CFT073
acaugguuuucaauuaucaccgc

SEQ ID NO: 2680086 - RNA, 15 nt, Escherichia coli CFT073
acauguauaaaaaga

SEQ ID NO: 2680087 - RNA, 23 nt, Escherichia coli CFT073
acauguauaaaaagaagaucauc

SEQ ID NO: 2680088 - RNA, 21 nt, Escherichia coli CFT073
acaugucaguugcauaccauu

SEQ ID NO: 2680089 - RNA, 23 nt, Escherichia coli CFT073
acaugucauagcaauaaaugccu

SEQ ID NO: 2680090 - RNA, 13 nt, Escherichia coli CFT073
acauguccgagcu

SEQ ID NO: 2680091 - RNA, 16 nt, Escherichia coli CFT073
acauguccgagcuuaa

SEQ ID NO: 2680092 - RNA, 17 nt, Escherichia coli CFT073
acauguccgagcuuaau

SEQ ID NO: 2680093 - RNA, 22 nt, Escherichia coli CFT073
acaugugcgacaguugccgcuu

SEQ ID NO: 2680094 - RNA, 20 nt, Escherichia coli CFT073
acauguggauuaaauugcgc

SEQ ID NO: 2680095 - RNA, 23 nt, Escherichia coli CFT073
acauguguucccuguaggucgga

SEQ ID NO: 2680096 - RNA, 16 nt, Escherichia coli CFT073
acauguuuuccagcac

SEQ ID NO: 2680097 - RNA, 16 nt, Escherichia coli CFT073
acauguuuuuauuaaa

SEQ ID NO: 2680098 - RNA, 14 nt, Escherichia coli CFT073
acauuaaagcuuua

SEQ ID NO: 2680099 - RNA, 18 nt, Escherichia coli CFT073
acauuaagaggcauuuuu

SEQ ID NO: 2680100 - RNA, 16 nt, Escherichia coli CFT073
acauuaaguaacaaua

SEQ ID NO: 2680101 - RNA, 18 nt, Escherichia coli CFT073
acauuaaguaacaauauc

SEQ ID NO: 2680102 - RNA, 13 nt, Escherichia coli CFT073
acauuaauuuuca

SEQ ID NO: 2680103 - RNA, 21 nt, Escherichia coli CFT073
acauuacgcauuugagcguaa

SEQ ID NO: 2680104 - RNA, 16 nt, Escherichia coli CFT073
acauuacguccaucac

SEQ ID NO: 2680105 - RNA, 19 nt, Escherichia coli CFT073
acauuacguccaucacaau

SEQ ID NO: 2680106 - RNA, 17 nt, Escherichia coli CFT073
acauuacuaaacauuua

SEQ ID NO: 2680107 - RNA, 16 nt, Escherichia coli CFT073
acauuacuaauuaaua

SEQ ID NO: 2680108 - RNA, 18 nt, Escherichia coli CFT073
acauuacuaauuaauaau

SEQ ID NO: 2680109 - RNA, 19 nt, Escherichia coli CFT073
acauuacuaauuaauaaua

SEQ ID NO: 2680110 - RNA, 21 nt, Escherichia coli CFT073
acauuacuaauuaauaauaua

SEQ ID NO: 2680111 - RNA, 23 nt, Escherichia coli CFT073
acauuagcgcaugaccagugagg

SEQ ID NO: 2680112 - RNA, 21 nt, Escherichia coli CFT073
acauuaucaccgacaaacagc

SEQ ID NO: 2680113 - RNA, 12 nt, Escherichia coli CFT073
acauucaaugau

SEQ ID NO: 2680114 - RNA, 23 nt, Escherichia coli CFT073
acauucaaugauuuaagguuaug

SEQ ID NO: 2680115 - RNA, 22 nt, Escherichia coli CFT073
accaauugccgcaccaaccauc

SEQ ID NO: 2680116 - RNA, 13 nt, Escherichia coli CFT073
accacaaaccagc

SEQ ID NO: 2680117 - RNA, 15 nt, Escherichia coli CFT073
accacaaaccagccc

SEQ ID NO: 2680118 - RNA, 13 nt, Escherichia coli CFT073
accacaaacgccg

SEQ ID NO: 2680119 - RNA, 18 nt, Escherichia coli CFT073
accacaaagcagacaacc

SEQ ID NO: 2680120 - RNA, 13 nt, Escherichia coli CFT073
accacaacauucc

SEQ ID NO: 2680121 - RNA, 19 nt, Escherichia coli CFT073
accacaacauucccaucag

SEQ ID NO: 2680122 - RNA, 21 nt, Escherichia coli CFT073
accacaaugguauugcccuga

SEQ ID NO: 2680123 - RNA, 16 nt, Escherichia coli CFT073
accacacccgcaagac

SEQ ID NO: 2680124 - RNA, 20 nt, Escherichia coli CFT073
accacacccgcaagacgaac

SEQ ID NO: 2680125 - RNA, 20 nt, Escherichia coli CFT073
accacaccgccuaccgccag

SEQ ID NO: 2680126 - RNA, 19 nt, Escherichia coli CFT073
accacacgacgcgccagca

SEQ ID NO: 2680127 - RNA, 14 nt, Escherichia coli CFT073
accacacuucuuca

SEQ ID NO: 2680128 - RNA, 16 nt, Escherichia coli CFT073
accacagugacccgca

SEQ ID NO: 2680129 - RNA, 22 nt, Escherichia coli CFT073
accacagugaggguuucuucaa

SEQ ID NO: 2680130 - RNA, 12 nt, Escherichia coli CFT073
accacaguucaa

SEQ ID NO: 2680131 - RNA, 19 nt, Escherichia coli CFT073
accacauauuacgggcgau

SEQ ID NO: 2680132 - RNA, 20 nt, Escherichia coli CFT073
accacaucagcgaacgacau

SEQ ID NO: 2680133 - RNA, 15 nt, Escherichia coli CFT073
accacauucagccgu

SEQ ID NO: 2680134 - RNA, 21 nt, Escherichia coli CFT073
accacauugccgaauggcugc

SEQ ID NO: 2680135 - RNA, 19 nt, Escherichia coli CFT073
accaccaaaugcagcaacc

SEQ ID NO: 2680136 - RNA, 15 nt, Escherichia coli CFT073
accaccagcaccgcg

SEQ ID NO: 2680137 - RNA, 16 nt, Escherichia coli CFT073
accaccagcaccgcga

SEQ ID NO: 2680138 - RNA, 12 nt, Escherichia coli CFT073
accaccagcacg

SEQ ID NO: 2680139 - RNA, 13 nt, Escherichia coli CFT073
accaccagcacug

SEQ ID NO: 2680140 - RNA, 15 nt, Escherichia coli CFT073
accaccagcagcugc

SEQ ID NO: 2680141 - RNA, 22 nt, Escherichia coli CFT073
accaccagcgacagccagccca

SEQ ID NO: 2680142 - RNA, 16 nt, Escherichia coli CFT073
accaccagcgccacca

SEQ ID NO: 2680143 - RNA, 20 nt, Escherichia coli CFT073
accaccagcgccaccacgcc

SEQ ID NO: 2680144 - RNA, 14 nt, Escherichia coli CFT073
accaccagcgccau

SEQ ID NO: 2680145 - RNA, 12 nt, Escherichia coli CFT073
accaccagcgga

SEQ ID NO: 2680146 - RNA, 19 nt, Escherichia coli CFT073
accaccaguaaauuguugc

SEQ ID NO: 2680147 - RNA, 23 nt, Escherichia coli CFT073
accaccaucguccccgcgacaga

SEQ ID NO: 2680148 - RNA, 14 nt, Escherichia coli CFT073
accacccaccagcg

SEQ ID NO: 2680149 - RNA, 17 nt, Escherichia coli CFT073
accacccacuuuaaugu

SEQ ID NO: 2680150 - RNA, 18 nt, Escherichia coli CFT073
accacccagaacacgccg

SEQ ID NO: 2680151 - RNA, 12 nt, Escherichia coli CFT073
accacccagcgg

SEQ ID NO: 2680152 - RNA, 17 nt, Escherichia coli CFT073
accacccagcgguaaaa

SEQ ID NO: 2680153 - RNA, 18 nt, Escherichia coli CFT073
accacccuugcccaccag

SEQ ID NO: 2680154 - RNA, 20 nt, Escherichia coli CFT073
accaccgaagaucaccaccg

SEQ ID NO: 2680155 - RNA, 16 nt, Escherichia coli CFT073
accaccgauaaaauaa

SEQ ID NO: 2680156 - RNA, 14 nt, Escherichia coli CFT073
accaccgcaaagaa

SEQ ID NO: 2680157 - RNA, 17 nt, Escherichia coli CFT073
accaccgcaaccgccaa

SEQ ID NO: 2680158 - RNA, 20 nt, Escherichia coli CFT073
accaccgcaaucgcggcagc

SEQ ID NO: 2680159 - RNA, 17 nt, Escherichia coli CFT073
accaccgcagcaaccgu

SEQ ID NO: 2680160 - RNA, 20 nt, Escherichia coli CFT073
accaccgccacuaccaucag

SEQ ID NO: 2680161 - RNA, 14 nt, Escherichia coli CFT073
accaccgcccgguu

SEQ ID NO: 2680162 - RNA, 13 nt, Escherichia coli CFT073
accaccggcacca

SEQ ID NO: 2680163 - RNA, 15 nt, Escherichia coli CFT073
accaccuccacgccc

SEQ ID NO: 2680164 - RNA, 21 nt, Escherichia coli CFT073
accaccuccacgcccagcgca

SEQ ID NO: 2680165 - RNA, 21 nt, Escherichia coli CFT073
accaccugaagaaaauccuca

SEQ ID NO: 2680166 - RNA, 13 nt, Escherichia coli CFT073
accaccuuacaua

SEQ ID NO: 2680167 - RNA, 20 nt, Escherichia coli CFT073
accaccuuacuuacacauca

SEQ ID NO: 2680168 - RNA, 15 nt, Escherichia coli CFT073
accacgaacgagguu

SEQ ID NO: 2680169 - RNA, 14 nt, Escherichia coli CFT073
accacgaggaucga

SEQ ID NO: 2680170 - RNA, 18 nt, Escherichia coli CFT073
accacgauauguucagga

SEQ ID NO: 2680171 - RNA, 19 nt, Escherichia coli CFT073
accacgcaaaggcguuaug

SEQ ID NO: 2680172 - RNA, 21 nt, Escherichia coli CFT073
accacgcagaaaaaucccucu

SEQ ID NO: 2680173 - RNA, 15 nt, Escherichia coli CFT073
accacgccaaccauc

SEQ ID NO: 2680174 - RNA, 17 nt, Escherichia coli CFT073
accacgccccacgccau

SEQ ID NO: 2680175 - RNA, 21 nt, Escherichia coli CFT073
accacgccgauggcagaaauc

SEQ ID NO: 2680176 - RNA, 24 nt, Escherichia coli CFT073
accacgccuuguucuuguuuggca

SEQ ID NO: 2680177 - RNA, 16 nt, Escherichia coli CFT073
accacgcgcauuaccu

SEQ ID NO: 2680178 - RNA, 18 nt, Escherichia coli CFT073
accacggaucgaagacau

SEQ ID NO: 2680179 - RNA, 16 nt, Escherichia coli CFT073
accacggcaacgccgu

SEQ ID NO: 2680180 - RNA, 22 nt, Escherichia coli CFT073
accacggccauauccagccaac

SEQ ID NO: 2680181 - RNA, 16 nt, Escherichia coli CFT073
accacggccuuccucg

SEQ ID NO: 2680182 - RNA, 17 nt, Escherichia coli CFT073
accacggccuuccucgg

SEQ ID NO: 2680183 - RNA, 20 nt, Escherichia coli CFT073
accacgguuuuuugcagcaa

SEQ ID NO: 2680184 - RNA, 22 nt, Escherichia coli CFT073
accacgguuuuuugcagcaacc

SEQ ID NO: 2680185 - RNA, 22 nt, Escherichia coli CFT073
accacgucgccgggauaaugcg

SEQ ID NO: 2680186 - RNA, 11 nt, Escherichia coli CFT073
accacuaauuc

SEQ ID NO: 2680187 - RNA, 15 nt, Escherichia coli CFT073
accacuaauuccugc

SEQ ID NO: 2680188 - RNA, 17 nt, Escherichia coli CFT073
accacuacgugaucguc

SEQ ID NO: 2680189 - RNA, 20 nt, Escherichia coli CFT073
accacuaucgccuuucgcuu

SEQ ID NO: 2680190 - RNA, 14 nt, Escherichia coli CFT073
accacuccggcaug

SEQ ID NO: 2680191 - RNA, 12 nt, Escherichia coli CFT073
accacugauaag

SEQ ID NO: 2680192 - RNA, 23 nt, Escherichia coli CFT073
accacugauaucuaacagugccu

SEQ ID NO: 2680193 - RNA, 19 nt, Escherichia coli CFT073
accacugauggaauuucau

SEQ ID NO: 2680194 - RNA, 18 nt, Escherichia coli CFT073
accacugcgccaacgucu

SEQ ID NO: 2680195 - RNA, 14 nt, Escherichia coli CFT073
accacugcgccgcu

SEQ ID NO: 2680196 - RNA, 18 nt, Escherichia coli CFT073
accacuggcacaagacug

SEQ ID NO: 2680197 - RNA, 13 nt, Escherichia coli CFT073
accacuggcgacg

SEQ ID NO: 2680198 - RNA, 13 nt, Escherichia coli CFT073
accacuucaugcc

SEQ ID NO: 2680199 - RNA, 14 nt, Escherichia coli CFT073
accacuucauuggu

SEQ ID NO: 2680200 - RNA, 19 nt, Escherichia coli CFT073
accacuucauugguuuuca

SEQ ID NO: 2680201 - RNA, 20 nt, Escherichia coli CFT073
accacuuccacguuccccag

SEQ ID NO: 2680202 - RNA, 15 nt, Escherichia coli CFT073
accacuuccagcaga

SEQ ID NO: 2680203 - RNA, 18 nt, Escherichia coli CFT073
accacuucccaacgcugc

SEQ ID NO: 2680204 - RNA, 14 nt, Escherichia coli CFT073
accacuuccugcuc

SEQ ID NO: 2680205 - RNA, 18 nt, Escherichia coli CFT073
accacuuguagaccagga

SEQ ID NO: 2680206 - RNA, 21 nt, Escherichia coli CFT073
accacuuuacgggcaaucucc

SEQ ID NO: 2680207 - RNA, 22 nt, Escherichia coli CFT073
accacuuuaucggcacccaucg

SEQ ID NO: 2680208 - RNA, 16 nt, Escherichia coli CFT073
accagaaacgccacca

SEQ ID NO: 2680209 - RNA, 21 nt, Escherichia coli CFT073
accagaaagacugaauugcca

SEQ ID NO: 2680210 - RNA, 19 nt, Escherichia coli CFT073
accagaaagggaagaacau

SEQ ID NO: 2680211 - RNA, 13 nt, Escherichia coli CFT073
accagaaccgccg

SEQ ID NO: 2680212 - RNA, 22 nt, Escherichia coli CFT073
accagaaccgccgcugucugaa

SEQ ID NO: 2680213 - RNA, 15 nt, Escherichia coli CFT073
accagaacgcugccu

SEQ ID NO: 2680214 - RNA, 20 nt, Escherichia coli CFT073
accagaauagcggcuucauc

SEQ ID NO: 2680215 - RNA, 13 nt, Escherichia coli CFT073
accagaaucgcca

SEQ ID NO: 2680216 - RNA, 20 nt, Escherichia coli CFT073
accagaauugaccaguaaua

SEQ ID NO: 2680217 - RNA, 20 nt, Escherichia coli CFT073
accagaauuuccagaaagug

SEQ ID NO: 2680218 - RNA, 13 nt, Escherichia coli CFT073
accagacaacagu

SEQ ID NO: 2680219 - RNA, 15 nt, Escherichia coli CFT073
accagacaacaguca

SEQ ID NO: 2680220 - RNA, 20 nt, Escherichia coli CFT073
accagaccagcaauaaaaaa

SEQ ID NO: 2680221 - RNA, 21 nt, Escherichia coli CFT073
accagacccgguuuauuuauu

SEQ ID NO: 2680222 - RNA, 21 nt, Escherichia coli CFT073
accagaccggcaaucgcgcca

SEQ ID NO: 2680223 - RNA, 20 nt, Escherichia coli CFT073
accaggcucuuugaacaguu

SEQ ID NO: 2680224 - RNA, 18 nt, Escherichia coli CFT073
accaggcuuacacuuccu

SEQ ID NO: 2680225 - RNA, 22 nt, Escherichia coli CFT073
accagggaaauaaucgggaaua

SEQ ID NO: 2680226 - RNA, 12 nt, Escherichia coli CFT073
accagguaugcc

SEQ ID NO: 2680227 - RNA, 20 nt, Escherichia coli CFT073
accaggucaaugcaacccca

SEQ ID NO: 2680228 - RNA, 19 nt, Escherichia coli CFT073
accagguuucggaugggcu

SEQ ID NO: 2680229 - RNA, 22 nt, Escherichia coli CFT073
accagguuucggaugggcugau

SEQ ID NO: 2680230 - RNA, 14 nt, Escherichia coli CFT073
accaguaaaccaau

SEQ ID NO: 2680231 - RNA, 23 nt, Escherichia coli CFT073
accaguaaaccaauuucugugca

SEQ ID NO: 2680232 - RNA, 14 nt, Escherichia coli CFT073
accaguaauacggc

SEQ ID NO: 2680233 - RNA, 22 nt, Escherichia coli CFT073
accaguacacugguucccaaca

SEQ ID NO: 2680234 - RNA, 21 nt, Escherichia coli CFT073
accaguaccgccaccaccaga

SEQ ID NO: 2680235 - RNA, 13 nt, Escherichia coli CFT073
accaguaccgccg

SEQ ID NO: 2680236 - RNA, 17 nt, Escherichia coli CFT073
accaguaccgccgccau

SEQ ID NO: 2680237 - RNA, 18 nt, Escherichia coli CFT073
accaguaccgccgccaua

SEQ ID NO: 2680238 - RNA, 22 nt, Escherichia coli CFT073
accaguaccgccgccauaaaca

SEQ ID NO: 2680239 - RNA, 19 nt, Escherichia coli CFT073
accagucaaaacuuuucac

SEQ ID NO: 2680240 - RNA, 13 nt, Escherichia coli CFT073
accagucagaaug

SEQ ID NO: 2680241 - RNA, 22 nt, Escherichia coli CFT073
accagucagcgaacaccagcag

SEQ ID NO: 2680242 - RNA, 23 nt, Escherichia coli CFT073
accagucagcgaacaccagcagu

SEQ ID NO: 2680243 - RNA, 19 nt, Escherichia coli CFT073
accaguccacccacgugag

SEQ ID NO: 2680244 - RNA, 16 nt, Escherichia coli CFT073
accaguccaucggcau

SEQ ID NO: 2680245 - RNA, 14 nt, Escherichia coli CFT073
accaguccggcuua

SEQ ID NO: 2680246 - RNA, 20 nt, Escherichia coli CFT073
accaguccuacacacgccag

SEQ ID NO: 2680247 - RNA, 17 nt, Escherichia coli CFT073
accagucgggugcgaca

SEQ ID NO: 2680248 - RNA, 14 nt, Escherichia coli CFT073
accagugacgcagc

SEQ ID NO: 2680249 - RNA, 15 nt, Escherichia coli CFT073
accagugcagauacc

SEQ ID NO: 2680250 - RNA, 16 nt, Escherichia coli CFT073
accagugcagauacca

SEQ ID NO: 2680251 - RNA, 20 nt, Escherichia coli CFT073
accagugcagauaccaccag

SEQ ID NO: 2680252 - RNA, 18 nt, Escherichia coli CFT073
accagugcagaugcacaa

SEQ ID NO: 2680253 - RNA, 16 nt, Escherichia coli CFT073
accaguggcgggacag

SEQ ID NO: 2680254 - RNA, 22 nt, Escherichia coli CFT073
accaguggucuuuagacgccau

SEQ ID NO: 2680255 - RNA, 22 nt, Escherichia coli CFT073
accagugguuaccgaauccagc

SEQ ID NO: 2680256 - RNA, 19 nt, Escherichia coli CFT073
accaguuaaagcucuucuu

SEQ ID NO: 2680257 - RNA, 15 nt, Escherichia coli CFT073
accaguucacaccga

SEQ ID NO: 2680258 - RNA, 17 nt, Escherichia coli CFT073
accaguucgcuuugaau

SEQ ID NO: 2680259 - RNA, 14 nt, Escherichia coli CFT073
accaguugagcgga

SEQ ID NO: 2680260 - RNA, 22 nt, Escherichia coli CFT073
accaguugguagguccagccgc

SEQ ID NO: 2680261 - RNA, 21 nt, Escherichia coli CFT073
accaguuuaugccuguccucu

SEQ ID NO: 2680262 - RNA, 13 nt, Escherichia coli CFT073
accaguuugccuu

SEQ ID NO: 2680263 - RNA, 16 nt, Escherichia coli CFT073
accaguuuuaguggau

SEQ ID NO: 2680264 - RNA, 22 nt, Escherichia coli CFT073
accauaaaacgcgcuacugaau

SEQ ID NO: 2680265 - RNA, 14 nt, Escherichia coli CFT073
accauaaacaccgu

SEQ ID NO: 2680266 - RNA, 18 nt, Escherichia coli CFT073
accauaaugacggacagu

SEQ ID NO: 2680267 - RNA, 18 nt, Escherichia coli CFT073
accauaaugauggugaaa

SEQ ID NO: 2680268 - RNA, 22 nt, Escherichia coli CFT073
accauaaugauggugaaagcaa

SEQ ID NO: 2680269 - RNA, 23 nt, Escherichia coli CFT073
accauaaugauggugaaagcaaa

SEQ ID NO: 2680270 - RNA, 19 nt, Escherichia coli CFT073
accauacagaccgaauucu

SEQ ID NO: 2680271 - RNA, 23 nt, Escherichia coli CFT073
accauaguccggcaccagcgcug

SEQ ID NO: 2680272 - RNA, 14 nt, Escherichia coli CFT073
accauauaaacaua

SEQ ID NO: 2680273 - RNA, 21 nt, Escherichia coli CFT073
accauauagcgcacaugcagc

SEQ ID NO: 2680274 - RNA, 17 nt, Escherichia coli CFT073
accauauaucagcgcca

SEQ ID NO: 2680275 - RNA, 14 nt, Escherichia coli CFT073
accauauccagcgc

SEQ ID NO: 2680276 - RNA, 16 nt, Escherichia coli CFT073
accauauucagcagca

SEQ ID NO: 2680277 - RNA, 17 nt, Escherichia coli CFT073
accauauucagcagcag

SEQ ID NO: 2680278 - RNA, 14 nt, Escherichia coli CFT073
accauauucccgca

SEQ ID NO: 2680279 - RNA, 20 nt, Escherichia coli CFT073
accauauugauccauaaggg

SEQ ID NO: 2680280 - RNA, 16 nt, Escherichia coli CFT073
accaucaaacagcccc

SEQ ID NO: 2680281 - RNA, 14 nt, Escherichia coli CFT073
accaucaacaaacg

SEQ ID NO: 2680282 - RNA, 18 nt, Escherichia coli CFT073
accaucaccucucacgac

SEQ ID NO: 2680283 - RNA, 13 nt, Escherichia coli CFT073
accaucaccucuu

SEQ ID NO: 2680284 - RNA, 15 nt, Escherichia coli CFT073
accaucaccucuuca

SEQ ID NO: 2680285 - RNA, 23 nt, Escherichia coli CFT073
accaucacuccccuccugcaagc

SEQ ID NO: 2680286 - RNA, 13 nt, Escherichia coli CFT073
accaucagcagca

SEQ ID NO: 2680287 - RNA, 14 nt, Escherichia coli CFT073
accaucagcagcgg

SEQ ID NO: 2680288 - RNA, 18 nt, Escherichia coli CFT073
accaucagcagcggcacg

SEQ ID NO: 2680289 - RNA, 15 nt, Escherichia coli CFT073
accaucagcaguacg

SEQ ID NO: 2680290 - RNA, 17 nt, Escherichia coli CFT073
accaucaggcagaacac

SEQ ID NO: 2680291 - RNA, 17 nt, Escherichia coli CFT073
accaucaucccuaaugu

SEQ ID NO: 2680292 - RNA, 13 nt, Escherichia coli CFT073
accauccagcaac

SEQ ID NO: 2680293 - RNA, 14 nt, Escherichia coli CFT073
accauccaggagau

SEQ ID NO: 2680294 - RNA, 16 nt, Escherichia coli CFT073
accauccccuuuucac

SEQ ID NO: 2680295 - RNA, 20 nt, Escherichia coli CFT073
accaucccggugucaugcgg

SEQ ID NO: 2680296 - RNA, 23 nt, Escherichia coli CFT073
accaucccuucaccuacgcuggc

SEQ ID NO: 2680297 - RNA, 14 nt, Escherichia coli CFT073
accauccgcgcgcg

SEQ ID NO: 2680298 - RNA, 23 nt, Escherichia coli CFT073
accauccgcugaaaaacgaacau

SEQ ID NO: 2680299 - RNA, 17 nt, Escherichia coli CFT073
accauccugaucgccau

SEQ ID NO: 2680300 - RNA, 20 nt, Escherichia coli CFT073
accaucgacguccaaucagc

SEQ ID NO: 2680301 - RNA, 19 nt, Escherichia coli CFT073
accaucgcaaacagcacau

SEQ ID NO: 2680302 - RNA, 14 nt, Escherichia coli CFT073
accaucgccagccc

SEQ ID NO: 2680303 - RNA, 13 nt, Escherichia coli CFT073
accaucgccauuu

SEQ ID NO: 2680304 - RNA, 16 nt, Escherichia coli CFT073
accaucgccauuuaac

SEQ ID NO: 2680305 - RNA, 21 nt, Escherichia coli CFT073
accaucgcgccaaacucgguc

SEQ ID NO: 2680306 - RNA, 23 nt, Escherichia coli CFT073
accaucggcacgaccaggaacgc

SEQ ID NO: 2680307 - RNA, 16 nt, Escherichia coli CFT073
accaucggcagcgcca

SEQ ID NO: 2680308 - RNA, 18 nt, Escherichia coli CFT073
accaucgguacgcuuuca

SEQ ID NO: 2680309 - RNA, 20 nt, Escherichia coli CFT073
accaucguccagcagcaaug

SEQ ID NO: 2680310 - RNA, 23 nt, Escherichia coli CFT073
accaucugauucuucccauaccc

SEQ ID NO: 2680311 - RNA, 16 nt, Escherichia coli CFT073
accaucuuccagcugc

SEQ ID NO: 2680312 - RNA, 17 nt, Escherichia coli CFT073
accaucuuccagcugca

SEQ ID NO: 2680313 - RNA, 20 nt, Escherichia coli CFT073
accaucuuccagcugcacgc

SEQ ID NO: 2680314 - RNA, 14 nt, Escherichia coli CFT073
accaugaauuucac

SEQ ID NO: 2680315 - RNA, 18 nt, Escherichia coli CFT073
accaugaccgaucaaggc

SEQ ID NO: 2680316 - RNA, 17 nt, Escherichia coli CFT073
accaugagccaguucuu

SEQ ID NO: 2680317 - RNA, 18 nt, Escherichia coli CFT073
accaugauuccccagcca

SEQ ID NO: 2680318 - RNA, 19 nt, Escherichia coli CFT073
accaugauuccccagccac

SEQ ID NO: 2680319 - RNA, 16 nt, Escherichia coli CFT073
accaugcaaucacugc

SEQ ID NO: 2680320 - RNA, 18 nt, Escherichia coli CFT073
accaugccgcccagcagc

SEQ ID NO: 2680321 - RNA, 19 nt, Escherichia coli CFT073
accauuaccaaucugcucu

SEQ ID NO: 2680322 - RNA, 17 nt, Escherichia coli CFT073
accauuagcuaauugcc

SEQ ID NO: 2680323 - RNA, 14 nt, Escherichia coli CFT073
accauuaucaaaca

SEQ ID NO: 2680324 - RNA, 14 nt, Escherichia coli CFT073
accauuaucaccaa

SEQ ID NO: 2680325 - RNA, 13 nt, Escherichia coli CFT073
accauucccggcu

SEQ ID NO: 2680326 - RNA, 19 nt, Escherichia coli CFT073
accauugcaucaucgacau

SEQ ID NO: 2680327 - RNA, 23 nt, Escherichia coli CFT073
accauugcgccguacaaguccug

SEQ ID NO: 2680328 - RNA, 19 nt, Escherichia coli CFT073
accauugcgucauaaugcu

SEQ ID NO: 2680329 - RNA, 20 nt, Escherichia coli CFT073
accauuggcauugguaucgg

SEQ ID NO: 2680330 - RNA, 21 nt, Escherichia coli CFT073
accauuuaaacucaccgcucu

SEQ ID NO: 2680331 - RNA, 14 nt, Escherichia coli CFT073
acccucaauaauca

SEQ ID NO: 2680332 - RNA, 18 nt, Escherichia coli CFT073
acccucaauaaucauucg

SEQ ID NO: 2680333 - RNA, 19 nt, Escherichia coli CFT073
acccucacgcauucucuuu

SEQ ID NO: 2680334 - RNA, 16 nt, Escherichia coli CFT073
acccugacccagaccg

SEQ ID NO: 2680335 - RNA, 16 nt, Escherichia coli CFT073
acccugaccgucuuuu

SEQ ID NO: 2680336 - RNA, 17 nt, Escherichia coli CFT073
acccugaccgucuuuuu

SEQ ID NO: 2680337 - RNA, 22 nt, Escherichia coli CFT073
acccugacuguuuuuccagcuu

SEQ ID NO: 2680338 - RNA, 15 nt, Escherichia coli CFT073
acccugcaucagaac

SEQ ID NO: 2680339 - RNA, 14 nt, Escherichia coli CFT073
acccugccagaauc

SEQ ID NO: 2680340 - RNA, 14 nt, Escherichia coli CFT073
acccugcgccagcg

SEQ ID NO: 2680341 - RNA, 13 nt, Escherichia coli CFT073
acccuggcgcgaa

SEQ ID NO: 2680342 - RNA, 17 nt, Escherichia coli CFT073
acccuguggaucuuccc

SEQ ID NO: 2680343 - RNA, 20 nt, Escherichia coli CFT073
acccugugggacaaaguaau

SEQ ID NO: 2680344 - RNA, 13 nt, Escherichia coli CFT073
acccuuacucacu

SEQ ID NO: 2680345 - RNA, 21 nt, Escherichia coli CFT073
acccuuacucacuaaauuagg

SEQ ID NO: 2680346 - RNA, 17 nt, Escherichia coli CFT073
acccuucauauuccuga

SEQ ID NO: 2680347 - RNA, 23 nt, Escherichia coli CFT073
acccuucauauuccugacccagc

SEQ ID NO: 2680348 - RNA, 14 nt, Escherichia coli CFT073
acccuuguggauaa

SEQ ID NO: 2680349 - RNA, 15 nt, Escherichia coli CFT073
acccuuucacuuuac

SEQ ID NO: 2680350 - RNA, 13 nt, Escherichia coli CFT073
acccuuucugcug

SEQ ID NO: 2680351 - RNA, 15 nt, Escherichia coli CFT073
acccuuucugcugcu

SEQ ID NO: 2680352 - RNA, 16 nt, Escherichia coli CFT073
acccuuucugcugcuu

SEQ ID NO: 2680353 - RNA, 22 nt, Escherichia coli CFT073
accgaaaaucacgcugccaaua

SEQ ID NO: 2680354 - RNA, 21 nt, Escherichia coli CFT073
accgaaacuugcgugauauua

SEQ ID NO: 2680355 - RNA, 18 nt, Escherichia coli CFT073
accgaaauaaacaagcag

SEQ ID NO: 2680356 - RNA, 15 nt, Escherichia coli CFT073
accgaaauccuggug

SEQ ID NO: 2680357 - RNA, 14 nt, Escherichia coli CFT073
accgaaaucgccau

SEQ ID NO: 2680358 - RNA, 14 nt, Escherichia coli CFT073
accgaacaagaaac

SEQ ID NO: 2680359 - RNA, 17 nt, Escherichia coli CFT073
accgaacaagaaacaga

SEQ ID NO: 2680360 - RNA, 23 nt, Escherichia coli CFT073
accgaacaagaaacagauaacca

SEQ ID NO: 2680361 - RNA, 13 nt, Escherichia coli CFT073
accgaaccagggc

SEQ ID NO: 2680362 - RNA, 16 nt, Escherichia coli CFT073
accgaaccuguuuuca

SEQ ID NO: 2680363 - RNA, 15 nt, Escherichia coli CFT073
accgaagaagcuuuu

SEQ ID NO: 2680364 - RNA, 15 nt, Escherichia coli CFT073
accgaagaucaccac

SEQ ID NO: 2680365 - RNA, 16 nt, Escherichia coli CFT073
accgaagaucaccacc

SEQ ID NO: 2680366 - RNA, 23 nt, Escherichia coli CFT073
accgaaguggacgaacagcucaa

SEQ ID NO: 2680367 - RNA, 17 nt, Escherichia coli CFT073
accgaaguuaugccagu

SEQ ID NO: 2680368 - RNA, 15 nt, Escherichia coli CFT073
accgaauccagcaag

SEQ ID NO: 2680369 - RNA, 21 nt, Escherichia coli CFT073
accgaauccuuauauaaaaca

SEQ ID NO: 2680370 - RNA, 15 nt, Escherichia coli CFT073
accgaauccuuugga

SEQ ID NO: 2680371 - RNA, 13 nt, Escherichia coli CFT073
accgacaaacagc

SEQ ID NO: 2680372 - RNA, 13 nt, Escherichia coli CFT073
accgaccaaucac

SEQ ID NO: 2680373 - RNA, 16 nt, Escherichia coli CFT073
accgaccagacaauca

SEQ ID NO: 2680374 - RNA, 15 nt, Escherichia coli CFT073
accgaccaucggcac

SEQ ID NO: 2680375 - RNA, 17 nt, Escherichia coli CFT073
accgacccggcaucuau

SEQ ID NO: 2680376 - RNA, 14 nt, Escherichia coli CFT073
accgacgaucaaca

SEQ ID NO: 2680377 - RNA, 18 nt, Escherichia coli CFT073
accgacgaucaacagaau

SEQ ID NO: 2680378 - RNA, 17 nt, Escherichia coli CFT073
accgacugacgcucugc

SEQ ID NO: 2680379 - RNA, 15 nt, Escherichia coli CFT073
accgagaaaaucauc

SEQ ID NO: 2680380 - RNA, 18 nt, Escherichia coli CFT073
accgagaagccgaccagc

SEQ ID NO: 2680381 - RNA, 14 nt, Escherichia coli CFT073
accgagauaaaugc

SEQ ID NO: 2680382 - RNA, 22 nt, Escherichia coli CFT073
accgagauaaaugccaaagaau

SEQ ID NO: 2680383 - RNA, 17 nt, Escherichia coli CFT073
accgagauaaugguuuc

SEQ ID NO: 2680384 - RNA, 21 nt, Escherichia coli CFT073
accgagcacaccugcaacggc

SEQ ID NO: 2680385 - RNA, 12 nt, Escherichia coli CFT073
accgagcagcca

SEQ ID NO: 2680386 - RNA, 20 nt, Escherichia coli CFT073
accgagcagccacugcggca

SEQ ID NO: 2680387 - RNA, 13 nt, Escherichia coli CFT073
accgagcugguga

SEQ ID NO: 2680388 - RNA, 15 nt, Escherichia coli CFT073
accgaggaagaccuc

SEQ ID NO: 2680389 - RNA, 14 nt, Escherichia coli CFT073
accgaggagcaaca

SEQ ID NO: 2680390 - RNA, 20 nt, Escherichia coli CFT073
accgagucgccuuuuuccau

SEQ ID NO: 2680391 - RNA, 23 nt, Escherichia coli CFT073
accgauaaacgcgacgauuaagc

SEQ ID NO: 2680392 - RNA, 14 nt, Escherichia coli CFT073
accgauacacgaaa

SEQ ID NO: 2680393 - RNA, 21 nt, Escherichia coli CFT073
accgauaccuaacgccagcgc

SEQ ID NO: 2680394 - RNA, 16 nt, Escherichia coli CFT073
accgauagaaccaaag

SEQ ID NO: 2680395 - RNA, 16 nt, Escherichia coli CFT073
accgauaucaauaaca

SEQ ID NO: 2680396 - RNA, 12 nt, Escherichia coli CFT073
accgauccggca

SEQ ID NO: 2680397 - RNA, 15 nt, Escherichia coli CFT073
accgauccggcacca

SEQ ID NO: 2680398 - RNA, 12 nt, Escherichia coli CFT073
accgaucgccag

SEQ ID NO: 2680399 - RNA, 17 nt, Escherichia coli CFT073
accgaucgccagcaggg

SEQ ID NO: 2680400 - RNA, 15 nt, Escherichia coli CFT073
accgaugagcugcaa

SEQ ID NO: 2680401 - RNA, 15 nt, Escherichia coli CFT073
accgaugaucgccau

SEQ ID NO: 2680402 - RNA, 21 nt, Escherichia coli CFT073
accgaugccacccauuacacu

SEQ ID NO: 2680403 - RNA, 18 nt, Escherichia coli CFT073
accgaugcccucaauauc

SEQ ID NO: 2680404 - RNA, 14 nt, Escherichia coli CFT073
accgaugccgcggc

SEQ ID NO: 2680405 - RNA, 18 nt, Escherichia coli CFT073
accgaugccgugcggcug

SEQ ID NO: 2680406 - RNA, 14 nt, Escherichia coli CFT073
accgauucuuugac

SEQ ID NO: 2680407 - RNA, 15 nt, Escherichia coli CFT073
accgcaaaaccaacg

SEQ ID NO: 2680408 - RNA, 14 nt, Escherichia coli CFT073
accgcaaacugcug

SEQ ID NO: 2680409 - RNA, 21 nt, Escherichia coli CFT073
accgcaaacugcuguugcugc

SEQ ID NO: 2680410 - RNA, 14 nt, Escherichia coli CFT073
accgcaaaucacca

SEQ ID NO: 2680411 - RNA, 18 nt, Escherichia coli CFT073
accgcaaccgccaacagc

SEQ ID NO: 2680412 - RNA, 14 nt, Escherichia coli CFT073
accgcaaccgccgu

SEQ ID NO: 2680413 - RNA, 17 nt, Escherichia coli CFT073
accgcaauaaccaucag

SEQ ID NO: 2680414 - RNA, 17 nt, Escherichia coli CFT073
accgcaaucgcggcagc

SEQ ID NO: 2680415 - RNA, 13 nt, Escherichia coli CFT073
accgcaccaccag

SEQ ID NO: 2680416 - RNA, 14 nt, Escherichia coli CFT073
accgcaccaccagc

SEQ ID NO: 2680417 - RNA, 16 nt, Escherichia coli CFT073
accgcaccaccagcag

SEQ ID NO: 2680418 - RNA, 17 nt, Escherichia coli CFT073
accgcaccaccagcagc

SEQ ID NO: 2680419 - RNA, 17 nt, Escherichia coli CFT073
accgcacgacgaaucug

SEQ ID NO: 2680420 - RNA, 13 nt, Escherichia coli CFT073
accgcacucacgc

SEQ ID NO: 2680421 - RNA, 17 nt, Escherichia coli CFT073
accgcagagaucgcccc

SEQ ID NO: 2680422 - RNA, 17 nt, Escherichia coli CFT073
accgcagcaaccgucgu

SEQ ID NO: 2680423 - RNA, 19 nt, Escherichia coli CFT073
accgcagcaucgucaucag

SEQ ID NO: 2680424 - RNA, 15 nt, Escherichia coli CFT073
accgcagugaaauuu

SEQ ID NO: 2680425 - RNA, 16 nt, Escherichia coli CFT073
accgcagugaaauuuc

SEQ ID NO: 2680426 - RNA, 20 nt, Escherichia coli CFT073
accgcaucacgacagcacca

SEQ ID NO: 2680427 - RNA, 21 nt, Escherichia coli CFT073
accgcaucacgacagcaccac

SEQ ID NO: 2680428 - RNA, 10 nt, Escherichia coli CFT073
accgcaucag

SEQ ID NO: 2680429 - RNA, 20 nt, Escherichia coli CFT073
accgcaucauguaaaucaau

SEQ ID NO: 2680430 - RNA, 15 nt, Escherichia coli CFT073
accgcauccggcauc

SEQ ID NO: 2680431 - RNA, 14 nt, Escherichia coli CFT073
accgcaucggcauc

SEQ ID NO: 2680432 - RNA, 22 nt, Escherichia coli CFT073
accgcaucggcaucaaaccauu

SEQ ID NO: 2680433 - RNA, 19 nt, Escherichia coli CFT073
accgcauuaucaaggcagu

SEQ ID NO: 2680434 - RNA, 12 nt, Escherichia coli CFT073
accgcauuggac

SEQ ID NO: 2680435 - RNA, 16 nt, Escherichia coli CFT073
accgccaaagauaaaa

SEQ ID NO: 2680436 - RNA, 14 nt, Escherichia coli CFT073
accgccaacagcag

SEQ ID NO: 2680437 - RNA, 21 nt, Escherichia coli CFT073
accgccaacagcagccacggc

SEQ ID NO: 2680438 - RNA, 15 nt, Escherichia coli CFT073
accgccaacaugcgc

SEQ ID NO: 2680439 - RNA, 18 nt, Escherichia coli CFT073
accgccaaucgccacgcc

SEQ ID NO: 2680440 - RNA, 20 nt, Escherichia coli CFT073
accgccaauuaauugugcuc

SEQ ID NO: 2680441 - RNA, 14 nt, Escherichia coli CFT073
aacuguguaaugcg

SEQ ID NO: 2680442 - RNA, 22 nt, Escherichia coli CFT073
aacuguuaaauaacggccuggc

SEQ ID NO: 2680443 - RNA, 23 nt, Escherichia coli CFT073
aacuguucgagguaauccagcgu

SEQ ID NO: 2680444 - RNA, 22 nt, Escherichia coli CFT073
aacuguuuaacgguuucaacca

SEQ ID NO: 2680445 - RNA, 22 nt, Escherichia coli CFT073
aacuguuuuaccaaauugguaa

SEQ ID NO: 2680446 - RNA, 12 nt, Escherichia coli CFT073
aacuuaagcgcc

SEQ ID NO: 2680447 - RNA, 23 nt, Escherichia coli CFT073
aacuuaagcgccugauacagcca

SEQ ID NO: 2680448 - RNA, 15 nt, Escherichia coli CFT073
aacuuacgcgucagg

SEQ ID NO: 2680449 - RNA, 20 nt, Escherichia coli CFT073
aacuuacugacaucaaaccc

SEQ ID NO: 2680450 - RNA, 11 nt, Escherichia coli CFT073
aacuuaucaag

SEQ ID NO: 2680451 - RNA, 17 nt, Escherichia coli CFT073
aacuuaucggaacagua

SEQ ID NO: 2680452 - RNA, 14 nt, Escherichia coli CFT073
aacuuaucuguaau

SEQ ID NO: 2680453 - RNA, 21 nt, Escherichia coli CFT073
aacuuaucuuauucccacuuu

SEQ ID NO: 2680454 - RNA, 19 nt, Escherichia coli CFT073
aacuuaugcagcugcucga

SEQ ID NO: 2680455 - RNA, 18 nt, Escherichia coli CFT073
aacuuauggcguacugaa

SEQ ID NO: 2680456 - RNA, 20 nt, Escherichia coli CFT073
aacuucaccagcacuucgcu

SEQ ID NO: 2680457 - RNA, 23 nt, Escherichia coli CFT073
aacuucaccgguucaucacgaaa

SEQ ID NO: 2680458 - RNA, 15 nt, Escherichia coli CFT073
aacuucacucucuuu

SEQ ID NO: 2680459 - RNA, 17 nt, Escherichia coli CFT073
aacuuccagcuucagac

SEQ ID NO: 2680460 - RNA, 20 nt, Escherichia coli CFT073
aacuucccaaagaucaacug

SEQ ID NO: 2680461 - RNA, 14 nt, Escherichia coli CFT073
aacuuccccuuuca

SEQ ID NO: 2680462 - RNA, 15 nt, Escherichia coli CFT073
aacuuccccuuucac

SEQ ID NO: 2680463 - RNA, 14 nt, Escherichia coli CFT073
aacuuccugcuggc

SEQ ID NO: 2680464 - RNA, 23 nt, Escherichia coli CFT073
aacuucgccacagcggcaucaac

SEQ ID NO: 2680465 - RNA, 16 nt, Escherichia coli CFT073
aacuucgcguuguaua

SEQ ID NO: 2680466 - RNA, 16 nt, Escherichia coli CFT073
aacuucuauucaccag

SEQ ID NO: 2680467 - RNA, 20 nt, Escherichia coli CFT073
aacuucuauucaccagcaaa

SEQ ID NO: 2680468 - RNA, 18 nt, Escherichia coli CFT073
aacuucucuucuuccgcu

SEQ ID NO: 2680469 - RNA, 19 nt, Escherichia coli CFT073
aacuucucuucuuccgcuu

SEQ ID NO: 2680470 - RNA, 21 nt, Escherichia coli CFT073
aacuucugcugugacuucagc

SEQ ID NO: 2680471 - RNA, 22 nt, Escherichia coli CFT073
aacuucuuuacuggcuuucauu

SEQ ID NO: 2680472 - RNA, 22 nt, Escherichia coli CFT073
aacuucuuuaguugagcuuuuu

SEQ ID NO: 2680473 - RNA, 17 nt, Escherichia coli CFT073
aacuugaaguaugacga

SEQ ID NO: 2680474 - RNA, 18 nt, Escherichia coli CFT073
aacuugccuccggcauua

SEQ ID NO: 2680475 - RNA, 18 nt, Escherichia coli CFT073
aacuugcgacagccaucc

SEQ ID NO: 2680476 - RNA, 14 nt, Escherichia coli CFT073
aacuugguuacgca

SEQ ID NO: 2680477 - RNA, 19 nt, Escherichia coli CFT073
aacuugguuuucguuaauc

SEQ ID NO: 2680478 - RNA, 19 nt, Escherichia coli CFT073
aacuuuacuaaaaagugau

SEQ ID NO: 2680479 - RNA, 20 nt, Escherichia coli CFT073
aacuuuacuggcucgccgca

SEQ ID NO: 2680480 - RNA, 15 nt, Escherichia coli CFT073
aacuuucaauaaccg

SEQ ID NO: 2680481 - RNA, 20 nt, Escherichia coli CFT073
aacuuucgggcgcaaaaaca

SEQ ID NO: 2680482 - RNA, 16 nt, Escherichia coli CFT073
aacuuucucacaagcc

SEQ ID NO: 2680483 - RNA, 15 nt, Escherichia coli CFT073
aacuuuguugcgaac

SEQ ID NO: 2680484 - RNA, 23 nt, Escherichia coli CFT073
aacuuuuuauccgguaaugccau

SEQ ID NO: 2680485 - RNA, 18 nt, Escherichia coli CFT073
aagaaaaaaggugaguuu

SEQ ID NO: 2680486 - RNA, 19 nt, Escherichia coli CFT073
aagaaaaaccguauucauc

SEQ ID NO: 2680487 - RNA, 14 nt, Escherichia coli CFT073
aagaaaacauuuua

SEQ ID NO: 2680488 - RNA, 16 nt, Escherichia coli CFT073
aagaaaacauuuuaaa

SEQ ID NO: 2680489 - RNA, 13 nt, Escherichia coli CFT073
aagaaaagcagug

SEQ ID NO: 2680490 - RNA, 23 nt, Escherichia coli CFT073
aagaaaauccucaacgccgcaca

SEQ ID NO: 2680491 - RNA, 14 nt, Escherichia coli CFT073
aagaaaaugguuug

SEQ ID NO: 2680492 - RNA, 22 nt, Escherichia coli CFT073
aagaaaaugguuugccagcaga

SEQ ID NO: 2680493 - RNA, 23 nt, Escherichia coli CFT073
aagaaaaugguuugccagcagag

SEQ ID NO: 2680494 - RNA, 14 nt, Escherichia coli CFT073
aagaaacaccagaa

SEQ ID NO: 2680495 - RNA, 21 nt, Escherichia coli CFT073
aagaaacaccagaaugcccca

SEQ ID NO: 2680496 - RNA, 19 nt, Escherichia coli CFT073
aagaaacagauaaccacug

SEQ ID NO: 2680497 - RNA, 12 nt, Escherichia coli CFT073
aagaaaccauug

SEQ ID NO: 2680498 - RNA, 17 nt, Escherichia coli CFT073
aagaaacgccaucugaa

SEQ ID NO: 2680499 - RNA, 20 nt, Escherichia coli CFT073
aagaaacggagccuuucggc

SEQ ID NO: 2680500 - RNA, 13 nt, Escherichia coli CFT073
aagaaacucuauc

SEQ ID NO: 2680501 - RNA, 21 nt, Escherichia coli CFT073
aagaaagauacaaaacaugug

SEQ ID NO: 2680502 - RNA, 18 nt, Escherichia coli CFT073
aagaaaggcgggaauaau

SEQ ID NO: 2680503 - RNA, 19 nt, Escherichia coli CFT073
aagaaaggcgggaauaauu

SEQ ID NO: 2680504 - RNA, 14 nt, Escherichia coli CFT073
aagaaaguacugau

SEQ ID NO: 2680505 - RNA, 20 nt, Escherichia coli CFT073
aagaaaguucgacaacuuuu

SEQ ID NO: 2680506 - RNA, 16 nt, Escherichia coli CFT073
aagaaccaagccugcu

SEQ ID NO: 2680507 - RNA, 11 nt, Escherichia coli CFT073
aagaaccaugc

SEQ ID NO: 2680508 - RNA, 22 nt, Escherichia coli CFT073
aagaaccaugcaaucacugcca

SEQ ID NO: 2680509 - RNA, 18 nt, Escherichia coli CFT073
aagaaccccagccaggug

SEQ ID NO: 2680510 - RNA, 14 nt, Escherichia coli CFT073
aagaacccggcaau

SEQ ID NO: 2680511 - RNA, 12 nt, Escherichia coli CFT073
aagaaccgccac

SEQ ID NO: 2680512 - RNA, 15 nt, Escherichia coli CFT073
aagaaccugaacgcc

SEQ ID NO: 2680513 - RNA, 18 nt, Escherichia coli CFT073
aagaacuaguagcaugaa

SEQ ID NO: 2680514 - RNA, 23 nt, Escherichia coli CFT073
aagaacuauugaagcccaaaaac

SEQ ID NO: 2680515 - RNA, 14 nt, Escherichia coli CFT073
aagaacuccugaaa

SEQ ID NO: 2680516 - RNA, 23 nt, Escherichia coli CFT073
aagaacugacuuccacuuccugc

SEQ ID NO: 2680517 - RNA, 13 nt, Escherichia coli CFT073
aagaagaucauca

SEQ ID NO: 2680518 - RNA, 23 nt, Escherichia coli CFT073
aagaagcggcuauucuggccgcu

SEQ ID NO: 2680519 - RNA, 16 nt, Escherichia coli CFT073
aagaaggaaaauacag

SEQ ID NO: 2680520 - RNA, 20 nt, Escherichia coli CFT073
aagaaguaaaacagucgcuc

SEQ ID NO: 2680521 - RNA, 14 nt, Escherichia coli CFT073
aagaaguuagagcc

SEQ ID NO: 2680522 - RNA, 24 nt, Escherichia coli CFT073
aagaauaaaaaaugcgcggucaga

SEQ ID NO: 2680523 - RNA, 17 nt, Escherichia coli CFT073
aagaauaaaacgccuga

SEQ ID NO: 2680524 - RNA, 13 nt, Escherichia coli CFT073
aagaauagccugg

SEQ ID NO: 2680525 - RNA, 16 nt, Escherichia coli CFT073
aagaauaucuucuguu

SEQ ID NO: 2680526 - RNA, 18 nt, Escherichia coli CFT073
aagaaucacuucaucgcc

SEQ ID NO: 2680527 - RNA, 22 nt, Escherichia coli CFT073
aagaaugacacuuucagcgcag

SEQ ID NO: 2680528 - RNA, 16 nt, Escherichia coli CFT073
aagaaugcgaaaacga

SEQ ID NO: 2680529 - RNA, 20 nt, Escherichia coli CFT073
aagaaugcuccccagaccaa

SEQ ID NO: 2680530 - RNA, 12 nt, Escherichia coli CFT073
aagaaugcucgc

SEQ ID NO: 2680531 - RNA, 13 nt, Escherichia coli CFT073
aagaauuaaaaua

SEQ ID NO: 2680532 - RNA, 21 nt, Escherichia coli CFT073
aagaauuaaaauaucaggcug

SEQ ID NO: 2680533 - RNA, 22 nt, Escherichia coli CFT073
aagaauugcagauaccacauca

SEQ ID NO: 2680534 - RNA, 12 nt, Escherichia coli CFT073
aagaauuggcuu

SEQ ID NO: 2680535 - RNA, 17 nt, Escherichia coli CFT073
aagaauuuucgcuggaa

SEQ ID NO: 2680536 - RNA, 12 nt, Escherichia coli CFT073
aagacaaacaug

SEQ ID NO: 2680537 - RNA, 19 nt, Escherichia coli CFT073
aagacaauacuugccggag

SEQ ID NO: 2680538 - RNA, 17 nt, Escherichia coli CFT073
aagacaauauaauaaga

SEQ ID NO: 2680539 - RNA, 16 nt, Escherichia coli CFT073
aagacagcgaaaacga

SEQ ID NO: 2680540 - RNA, 17 nt, Escherichia coli CFT073
aagacagcgucacauca

SEQ ID NO: 2680541 - RNA, 21 nt, Escherichia coli CFT073
aagacauagcacauaaaaugg

SEQ ID NO: 2680542 - RNA, 21 nt, Escherichia coli CFT073
aagacaucgcccgauucacau

SEQ ID NO: 2680543 - RNA, 17 nt, Escherichia coli CFT073
aagaccaauccagccgg

SEQ ID NO: 2680544 - RNA, 16 nt, Escherichia coli CFT073
aagaccauugaugcuc

SEQ ID NO: 2680545 - RNA, 12 nt, Escherichia coli CFT073
aagacccggcgc

SEQ ID NO: 2680546 - RNA, 20 nt, Escherichia coli CFT073
aagaccgcgaccacuggguu

SEQ ID NO: 2680547 - RNA, 17 nt, Escherichia coli CFT073
aagaccugucucuuaua

SEQ ID NO: 2680548 - RNA, 14 nt, Escherichia coli CFT073
aagaccuuccagaa

SEQ ID NO: 2680549 - RNA, 22 nt, Escherichia coli CFT073
aagacgaaccggcacccaaucc

SEQ ID NO: 2680550 - RNA, 14 nt, Escherichia coli CFT073
aagacgagccgucc

SEQ ID NO: 2680551 - RNA, 22 nt, Escherichia coli CFT073
aagacgcagauuuuuauuaaua

SEQ ID NO: 2680552 - RNA, 16 nt, Escherichia coli CFT073
aagacgcauaauccag

SEQ ID NO: 2680553 - RNA, 22 nt, Escherichia coli CFT073
aagacgcaucaggcaaaagaug

SEQ ID NO: 2680554 - RNA, 15 nt, Escherichia coli CFT073
aagacgcauccacca

SEQ ID NO: 2680555 - RNA, 18 nt, Escherichia coli CFT073
aagacgccucgcauuuuu

SEQ ID NO: 2680556 - RNA, 23 nt, Escherichia coli CFT073
aagacgcgccagcaucgcaucag

SEQ ID NO: 2680557 - RNA, 14 nt, Escherichia coli CFT073
aagacgcgccagcg

SEQ ID NO: 2680558 - RNA, 21 nt, Escherichia coli CFT073
aagacgcggcaagcgucgcau

SEQ ID NO: 2680559 - RNA, 20 nt, Escherichia coli CFT073
aagacgcggcagcgucgcau

SEQ ID NO: 2680560 - RNA, 23 nt, Escherichia coli CFT073
aagacgcggcagcgucgcaucag

SEQ ID NO: 2680561 - RNA, 21 nt, Escherichia coli CFT073
aagacgcggcaggcgucgcau

SEQ ID NO: 2680562 - RNA, 21 nt, Escherichia coli CFT073
aagacgcggcccgcgucgcau

SEQ ID NO: 2680563 - RNA, 21 nt, Escherichia coli CFT073
aagacgcggcuagcgucgcau

SEQ ID NO: 2680564 - RNA, 21 nt, Escherichia coli CFT073
aagacgcguaaagcgucgcau

SEQ ID NO: 2680565 - RNA, 21 nt, Escherichia coli CFT073
aagacgcgucaagcgucgcau

SEQ ID NO: 2680566 - RNA, 20 nt, Escherichia coli CFT073
aagacgcgucagcgccgcau

SEQ ID NO: 2680567 - RNA, 20 nt, Escherichia coli CFT073
aagacgcgucagcgucgcau

SEQ ID NO: 2680568 - RNA, 21 nt, Escherichia coli CFT073
aagacgcguuaagcgucgcau

SEQ ID NO: 2680569 - RNA, 20 nt, Escherichia coli CFT073
aagacgcguuagcgucgcau

SEQ ID NO: 2680570 - RNA, 23 nt, Escherichia coli CFT073
aagacgcugauucacuuucugaa

SEQ ID NO: 2680571 - RNA, 18 nt, Escherichia coli CFT073
aagacgguuaacgccagc

SEQ ID NO: 2680572 - RNA, 21 nt, Escherichia coli CFT073
aagacgguuaacgccagccac

SEQ ID NO: 2680573 - RNA, 15 nt, Escherichia coli CFT073
aagacguagcaagca

SEQ ID NO: 2680574 - RNA, 17 nt, Escherichia coli CFT073
aagacuauauuaaagau

SEQ ID NO: 2680575 - RNA, 14 nt, Escherichia coli CFT073
aagacugcgacgau

SEQ ID NO: 2680576 - RNA, 14 nt, Escherichia coli CFT073
aagacuucaucggu

SEQ ID NO: 2680577 - RNA, 18 nt, Escherichia coli CFT073
aagagacuaacauccgaa

SEQ ID NO: 2680578 - RNA, 12 nt, Escherichia coli CFT073
aagagagcaaca

SEQ ID NO: 2680579 - RNA, 17 nt, Escherichia coli CFT073
aagagagcaguccaaga

SEQ ID NO: 2680580 - RNA, 19 nt, Escherichia coli CFT073
aagagauaaacgaccacuc

SEQ ID NO: 2680581 - RNA, 21 nt, Escherichia coli CFT073
aagagauaaacgaccacucuu

SEQ ID NO: 2680582 - RNA, 17 nt, Escherichia coli CFT073
aagagauaaacucacuc

SEQ ID NO: 2680583 - RNA, 17 nt, Escherichia coli CFT073
aagagauccgcacucaa

SEQ ID NO: 2680584 - RNA, 15 nt, Escherichia coli CFT073
aagagaugaaugaau

SEQ ID NO: 2680585 - RNA, 19 nt, Escherichia coli CFT073
aagagaugaaugaauuucc

SEQ ID NO: 2680586 - RNA, 13 nt, Escherichia coli CFT073
aagagcaaauaaa

SEQ ID NO: 2680587 - RNA, 19 nt, Escherichia coli CFT073
aagagcaaauaaaacauca

SEQ ID NO: 2680588 - RNA, 16 nt, Escherichia coli CFT073
aagagcggcucuggcg

SEQ ID NO: 2680589 - RNA, 21 nt, Escherichia coli CFT073
aagaggaggcuauagcaggua

SEQ ID NO: 2680590 - RNA, 13 nt, Escherichia coli CFT073
aagaggcgcgcgg

SEQ ID NO: 2680591 - RNA, 18 nt, Escherichia coli CFT073
aagagguguaauacguuu

SEQ ID NO: 2680592 - RNA, 16 nt, Escherichia coli CFT073
aagaguaaagcccgcc

SEQ ID NO: 2680593 - RNA, 15 nt, Escherichia coli CFT073
aagaguaaccaaacg

SEQ ID NO: 2680594 - RNA, 13 nt, Escherichia coli CFT073
aagagugcgccag

SEQ ID NO: 2680595 - RNA, 23 nt, Escherichia coli CFT073
aagagugguuagccggauaagca

SEQ ID NO: 2680596 - RNA, 20 nt, Escherichia coli CFT073
aagaguuccugaugaaaaau

SEQ ID NO: 2680597 - RNA, 23 nt, Escherichia coli CFT073
aagaguugccccucuaacucuuc

SEQ ID NO: 2680598 - RNA, 18 nt, Escherichia coli CFT073
aagaguuguaauuuaaau

SEQ ID NO: 2680599 - RNA, 20 nt, Escherichia coli CFT073
aagaguuuuaaaaccauuag

SEQ ID NO: 2680600 - RNA, 23 nt, Escherichia coli CFT073
aagaguuuucuuaagauaagaau

SEQ ID NO: 2680601 - RNA, 14 nt, Escherichia coli CFT073
aagauaaccucauu

SEQ ID NO: 2680602 - RNA, 22 nt, Escherichia coli CFT073
aagauaaugacuuccgccacca

SEQ ID NO: 2680603 - RNA, 14 nt, Escherichia coli CFT073
aagauaaugccagc

SEQ ID NO: 2680604 - RNA, 14 nt, Escherichia coli CFT073
aagauacgcaucgc

SEQ ID NO: 2680605 - RNA, 18 nt, Escherichia coli CFT073
aagauacggauucuuaac

SEQ ID NO: 2680606 - RNA, 23 nt, Escherichia coli CFT073
aagauacggauucuuaacgucgc

SEQ ID NO: 2680607 - RNA, 14 nt, Escherichia coli CFT073
aagauauuauuaaa

SEQ ID NO: 2680608 - RNA, 18 nt, Escherichia coli CFT073
aagauauuauuaaaugcu

SEQ ID NO: 2680609 - RNA, 17 nt, Escherichia coli CFT073
aagaucaacuucgcugc

SEQ ID NO: 2680610 - RNA, 17 nt, Escherichia coli CFT073
aagaucaauacaaccua

SEQ ID NO: 2680611 - RNA, 11 nt, Escherichia coli CFT073
aagaucaccac

SEQ ID NO: 2680612 - RNA, 11 nt, Escherichia coli CFT073
aagaucagcgg

SEQ ID NO: 2680613 - RNA, 19 nt, Escherichia coli CFT073
aagaucaugccgacaaaca

SEQ ID NO: 2680614 - RNA, 20 nt, Escherichia coli CFT073
aagaucaugccgacaaacag

SEQ ID NO: 2680615 - RNA, 22 nt, Escherichia coli CFT073
aagauccagauuacguaccaga

SEQ ID NO: 2680616 - RNA, 18 nt, Escherichia coli CFT073
aagauccaguugaccugc

SEQ ID NO: 2680617 - RNA, 21 nt, Escherichia coli CFT073
aagaucgcccuuuuuugcuuu

SEQ ID NO: 2680618 - RNA, 17 nt, Escherichia coli CFT073
aagaucggugccgccac

SEQ ID NO: 2680619 - RNA, 17 nt, Escherichia coli CFT073
aagaucuguuuauugag

SEQ ID NO: 2680620 - RNA, 20 nt, Escherichia coli CFT073
aagaucuguuuauugaggau

SEQ ID NO: 2680621 - RNA, 12 nt, Escherichia coli CFT073
aagaucuuugcg

SEQ ID NO: 2680622 - RNA, 19 nt, Escherichia coli CFT073
aagaucuuugcgcuuauac

SEQ ID NO: 2680623 - RNA, 19 nt, Escherichia coli CFT073
aagaugaaauaguugcauu

SEQ ID NO: 2680624 - RNA, 14 nt, Escherichia coli CFT073
aagaugaagaaaau

SEQ ID NO: 2680625 - RNA, 12 nt, Escherichia coli CFT073
aagaugaagagu

SEQ ID NO: 2680626 - RNA, 18 nt, Escherichia coli CFT073
aagaugccagaaucccca

SEQ ID NO: 2680627 - RNA, 14 nt, Escherichia coli CFT073
aagaugggccagca

SEQ ID NO: 2680628 - RNA, 21 nt, Escherichia coli CFT073
aagauggucuguaccaccaga

SEQ ID NO: 2680629 - RNA, 16 nt, Escherichia coli CFT073
aagauguuggcagcgg

SEQ ID NO: 2680630 - RNA, 19 nt, Escherichia coli CFT073
aagauguuggcagcggcaa

SEQ ID NO: 2680631 - RNA, 22 nt, Escherichia coli CFT073
aagauguuguuuuccguugugc

SEQ ID NO: 2680632 - RNA, 22 nt, Escherichia coli CFT073
aagauuaagagaaccagcugcc

SEQ ID NO: 2680633 - RNA, 16 nt, Escherichia coli CFT073
aagauucguauuuaaa

SEQ ID NO: 2680634 - RNA, 22 nt, Escherichia coli CFT073
aagauugucaauauccagcagg

SEQ ID NO: 2680635 - RNA, 15 nt, Escherichia coli CFT073
aagauuuaauucacc

SEQ ID NO: 2680636 - RNA, 15 nt, Escherichia coli CFT073
aagauuuuuugccag

SEQ ID NO: 2680637 - RNA, 17 nt, Escherichia coli CFT073
aagauuuuuugccagca

SEQ ID NO: 2680638 - RNA, 20 nt, Escherichia coli CFT073
aagcaaaaaaagaaucuauu

SEQ ID NO: 2680639 - RNA, 15 nt, Escherichia coli CFT073
aagcaaaaaagaagg

SEQ ID NO: 2680640 - RNA, 18 nt, Escherichia coli CFT073
aagcaaaaaagaaggaaa

SEQ ID NO: 2680641 - RNA, 14 nt, Escherichia coli CFT073
aagcaaaaauaaau

SEQ ID NO: 2680642 - RNA, 14 nt, Escherichia coli CFT073
aagcaaacugugca

SEQ ID NO: 2680643 - RNA, 19 nt, Escherichia coli CFT073
aagcaaacugugcaaugaa

SEQ ID NO: 2680644 - RNA, 12 nt, Escherichia coli CFT073
aagcaacaaacu

SEQ ID NO: 2680645 - RNA, 15 nt, Escherichia coli CFT073
aagcaacaaaguuug

SEQ ID NO: 2680646 - RNA, 20 nt, Escherichia coli CFT073
aagcaacaaccaccacaccu

SEQ ID NO: 2680647 - RNA, 20 nt, Escherichia coli CFT073
aagcaaccggugucaucauc

SEQ ID NO: 2680648 - RNA, 22 nt, Escherichia coli CFT073
aagcaagaccaacacccacagc

SEQ ID NO: 2680649 - RNA, 20 nt, Escherichia coli CFT073
aagcaaguugcgcaaucgaa

SEQ ID NO: 2680650 - RNA, 20 nt, Escherichia coli CFT073
aagcaauaagcacucuggcg

SEQ ID NO: 2680651 - RNA, 21 nt, Escherichia coli CFT073
aagcaauaagggcugacaguu

SEQ ID NO: 2680652 - RNA, 24 nt, Escherichia coli CFT073
aagcaauaauuucaacagauuuug

SEQ ID NO: 2680653 - RNA, 13 nt, Escherichia coli CFT073
aagcaauauuaug

SEQ ID NO: 2680654 - RNA, 14 nt, Escherichia coli CFT073
aagcaaucaagccc

SEQ ID NO: 2680655 - RNA, 21 nt, Escherichia coli CFT073
aagcaauccauaccagcacau

SEQ ID NO: 2680656 - RNA, 15 nt, Escherichia coli CFT073
aagcaauuaacagug

SEQ ID NO: 2680657 - RNA, 15 nt, Escherichia coli CFT073
aagcaauuauucaua

SEQ ID NO: 2680658 - RNA, 16 nt, Escherichia coli CFT073
aagcacaaagcaauau

SEQ ID NO: 2680659 - RNA, 13 nt, Escherichia coli CFT073
aagcacaauccgc

SEQ ID NO: 2680660 - RNA, 17 nt, Escherichia coli CFT073
aagcaccauaaacaccg

SEQ ID NO: 2680661 - RNA, 16 nt, Escherichia coli CFT073
aagcacccaaugccau

SEQ ID NO: 2680662 - RNA, 16 nt, Escherichia coli CFT073
aagcacccagcaaucc

SEQ ID NO: 2680663 - RNA, 16 nt, Escherichia coli CFT073
aagcacggcaucaaug

SEQ ID NO: 2680664 - RNA, 20 nt, Escherichia coli CFT073
aagcacggcgcgacucagcg

SEQ ID NO: 2680665 - RNA, 19 nt, Escherichia coli CFT073
aagcacucguaagaggcgu

SEQ ID NO: 2680666 - RNA, 19 nt, Escherichia coli CFT073
aagcacuugcaggaacaau

SEQ ID NO: 2680667 - RNA, 23 nt, Escherichia coli CFT073
aagcacuugcaggaacaaugccu

SEQ ID NO: 2680668 - RNA, 20 nt, Escherichia coli CFT073
aagcacuuuaucgaucacau

SEQ ID NO: 2680669 - RNA, 19 nt, Escherichia coli CFT073
aagcagaaggccaguggua

SEQ ID NO: 2680670 - RNA, 15 nt, Escherichia coli CFT073
aagcagauaacccag

SEQ ID NO: 2680671 - RNA, 18 nt, Escherichia coli CFT073
aagcagaucggcauucac

SEQ ID NO: 2680672 - RNA, 16 nt, Escherichia coli CFT073
aagcagauucuucgau

SEQ ID NO: 2680673 - RNA, 17 nt, Escherichia coli CFT073
aagcagcauacccaccg

SEQ ID NO: 2680674 - RNA, 15 nt, Escherichia coli CFT073
aagcagcgcuggaga

SEQ ID NO: 2680675 - RNA, 16 nt, Escherichia coli CFT073
aagcagcgcuggagag

SEQ ID NO: 2680676 - RNA, 15 nt, Escherichia coli CFT073
aagcagcuccagaau

SEQ ID NO: 2680677 - RNA, 16 nt, Escherichia coli CFT073
aagcagcuugagaaaa

SEQ ID NO: 2680678 - RNA, 15 nt, Escherichia coli CFT073
aagcaggcuucacgc

SEQ ID NO: 2680679 - RNA, 15 nt, Escherichia coli CFT073
aagcagggccaaaca

SEQ ID NO: 2680680 - RNA, 16 nt, Escherichia coli CFT073
aagcagggccaaacag

SEQ ID NO: 2680681 - RNA, 20 nt, Escherichia coli CFT073
aagcagguagcgccuuuacu

SEQ ID NO: 2680682 - RNA, 12 nt, Escherichia coli CFT073
aagcaguccagc

SEQ ID NO: 2680683 - RNA, 18 nt, Escherichia coli CFT073
aagcagugaauacccaga

SEQ ID NO: 2680684 - RNA, 15 nt, Escherichia coli CFT073
aagcaguuuauaaaa

SEQ ID NO: 2680685 - RNA, 15 nt, Escherichia coli CFT073
aagcaguuucaccag

SEQ ID NO: 2680686 - RNA, 16 nt, Escherichia coli CFT073
aagcauaaccgagcag

SEQ ID NO: 2680687 - RNA, 17 nt, Escherichia coli CFT073
aagcauaaccgagcaga

SEQ ID NO: 2680688 - RNA, 15 nt, Escherichia coli CFT073
aagcauaugacgaaa

SEQ ID NO: 2680689 - RNA, 20 nt, Escherichia coli CFT073
aagcaucauuuuguggguuu

SEQ ID NO: 2680690 - RNA, 12 nt, Escherichia coli CFT073
aagcaucccgcc

SEQ ID NO: 2680691 - RNA, 20 nt, Escherichia coli CFT073
aagcaugucauacaugguuu

SEQ ID NO: 2680692 - RNA, 21 nt, Escherichia coli CFT073
aagcauuacgucgccaucuuc

SEQ ID NO: 2680693 - RNA, 17 nt, Escherichia coli CFT073
aagcauucguaaugaau

SEQ ID NO: 2680694 - RNA, 16 nt, Escherichia coli CFT073
aagcauugauuuuaau

SEQ ID NO: 2680695 - RNA, 15 nt, Escherichia coli CFT073
aagccaaauccagca

SEQ ID NO: 2680696 - RNA, 17 nt, Escherichia coli CFT073
aagccaaauccagcacc

SEQ ID NO: 2680697 - RNA, 20 nt, Escherichia coli CFT073
aagccaaauccagcaccaca

SEQ ID NO: 2680698 - RNA, 18 nt, Escherichia coli CFT073
aagccaacagcagccaca

SEQ ID NO: 2680699 - RNA, 13 nt, Escherichia coli CFT073
aagccaagccaga

SEQ ID NO: 2680700 - RNA, 15 nt, Escherichia coli CFT073
aagccaagccagagc

SEQ ID NO: 2680701 - RNA, 15 nt, Escherichia coli CFT073
aagccaagcgccgcc

SEQ ID NO: 2680702 - RNA, 17 nt, Escherichia coli CFT073
aagccaauuacaaaaag

SEQ ID NO: 2680703 - RNA, 19 nt, Escherichia coli CFT073
aagccacaaucgcagcgca

SEQ ID NO: 2680704 - RNA, 15 nt, Escherichia coli CFT073
aagccacaucgccau

SEQ ID NO: 2680705 - RNA, 18 nt, Escherichia coli CFT073
aagccacccacaccgcag

SEQ ID NO: 2680706 - RNA, 22 nt, Escherichia coli CFT073
aagccacccacaccgcagaaca

SEQ ID NO: 2680707 - RNA, 21 nt, Escherichia coli CFT073
aagccagauauuaagcggcac

SEQ ID NO: 2680708 - RNA, 15 nt, Escherichia coli CFT073
aagccagcauacagc

SEQ ID NO: 2680709 - RNA, 23 nt, Escherichia coli CFT073
aagccagcggcaccgaggaugaa

SEQ ID NO: 2680710 - RNA, 13 nt, Escherichia coli CFT073
aagccaguucuca

SEQ ID NO: 2680711 - RNA, 18 nt, Escherichia coli CFT073
aagccaguucucaccaaa

SEQ ID NO: 2680712 - RNA, 20 nt, Escherichia coli CFT073
aagccauauuuaacuccuuc

SEQ ID NO: 2680713 - RNA, 18 nt, Escherichia coli CFT073
aagccaucaagcgaaaau

SEQ ID NO: 2680714 - RNA, 15 nt, Escherichia coli CFT073
aagccaucaccggca

SEQ ID NO: 2680715 - RNA, 24 nt, Escherichia coli CFT073
aagccaugacgcacuuucgcuuua

SEQ ID NO: 2680716 - RNA, 21 nt, Escherichia coli CFT073
aagccauucucgucuugcguu

SEQ ID NO: 2680717 - RNA, 15 nt, Escherichia coli CFT073
aagccauucuggcgc

SEQ ID NO: 2680718 - RNA, 20 nt, Escherichia coli CFT073
aagccauucuggcgcaacac

SEQ ID NO: 2680719 - RNA, 23 nt, Escherichia coli CFT073
aagcccacgguuucuacaagcag

SEQ ID NO: 2680720 - RNA, 20 nt, Escherichia coli CFT073
aagcccaggccaucgccacc

SEQ ID NO: 2680721 - RNA, 15 nt, Escherichia coli CFT073
aagcccauaccacag

SEQ ID NO: 2680722 - RNA, 18 nt, Escherichia coli CFT073
aagcccauaccacagcaa

SEQ ID NO: 2680723 - RNA, 20 nt, Escherichia coli CFT073
aagcccaucaccgccaggcc

SEQ ID NO: 2680724 - RNA, 20 nt, Escherichia coli CFT073
aagcccaucguugaaaaaau

SEQ ID NO: 2680725 - RNA, 13 nt, Escherichia coli CFT073
aagccccagccca

SEQ ID NO: 2680726 - RNA, 21 nt, Escherichia coli CFT073
aagcccccaguaaucgggcaa

SEQ ID NO: 2680727 - RNA, 22 nt, Escherichia coli CFT073
aagcccccaguaaucgggcaac

SEQ ID NO: 2680728 - RNA, 16 nt, Escherichia coli CFT073
aagccccuucgcggaa

SEQ ID NO: 2680729 - RNA, 16 nt, Escherichia coli CFT073
aagcccggaugcgcgu

SEQ ID NO: 2680730 - RNA, 17 nt, Escherichia coli CFT073
aagcccguguuucugau

SEQ ID NO: 2680731 - RNA, 15 nt, Escherichia coli CFT073
aagccgaacagucgc

SEQ ID NO: 2680732 - RNA, 21 nt, Escherichia coli CFT073
aagccgauaccuuccggcguu

SEQ ID NO: 2680733 - RNA, 22 nt, Escherichia coli CFT073
aagccgauggugcuaagccccu

SEQ ID NO: 2680734 - RNA, 17 nt, Escherichia coli CFT073
aagccgaugucugcaau

SEQ ID NO: 2680735 - RNA, 15 nt, Escherichia coli CFT073
aagccgcauccggcg

SEQ ID NO: 2680736 - RNA, 23 nt, Escherichia coli CFT073
aagccgcauccggcgacaggaac

SEQ ID NO: 2680737 - RNA, 14 nt, Escherichia coli CFT073
aagccgccagagau

SEQ ID NO: 2680738 - RNA, 15 nt, Escherichia coli CFT073
aagccgccgccaucu

SEQ ID NO: 2680739 - RNA, 20 nt, Escherichia coli CFT073
aagccgccgccaucuaccac

SEQ ID NO: 2680740 - RNA, 16 nt, Escherichia coli CFT073
aagccgcuaacagcag

SEQ ID NO: 2680741 - RNA, 18 nt, Escherichia coli CFT073
aagccgcuaacagcagca

SEQ ID NO: 2680742 - RNA, 23 nt, Escherichia coli CFT073
aagccgcuaacagcagcagcgca

SEQ ID NO: 2680743 - RNA, 18 nt, Escherichia coli CFT073
aagccgcuccggcagcag

SEQ ID NO: 2680744 - RNA, 22 nt, Escherichia coli CFT073
aagccgcuuaauaagaagaaaa

SEQ ID NO: 2680745 - RNA, 21 nt, Escherichia coli CFT073
aagccgcuuccgggcugccau

SEQ ID NO: 2680746 - RNA, 12 nt, Escherichia coli CFT073
aagccgcuugcg

SEQ ID NO: 2680747 - RNA, 21 nt, Escherichia coli CFT073
aagccggaugaucauccggcu

SEQ ID NO: 2680748 - RNA, 17 nt, Escherichia coli CFT073
aagccggaugcuuucgu

SEQ ID NO: 2680749 - RNA, 22 nt, Escherichia coli CFT073
aagccgggagcggcgucagcca

SEQ ID NO: 2680750 - RNA, 16 nt, Escherichia coli CFT073
aagccgggcaggugac

SEQ ID NO: 2680751 - RNA, 18 nt, Escherichia coli CFT073
aagccguaaacagguuga

SEQ ID NO: 2680752 - RNA, 12 nt, Escherichia coli CFT073
aagccgugaaaa

SEQ ID NO: 2680753 - RNA, 14 nt, Escherichia coli CFT073
aagccgugaaucac

SEQ ID NO: 2680754 - RNA, 19 nt, Escherichia coli CFT073
aagccgugccagauggcau

SEQ ID NO: 2680755 - RNA, 22 nt, Escherichia coli CFT073
aagccguuggucaucaucagga

SEQ ID NO: 2680756 - RNA, 19 nt, Escherichia coli CFT073
aagccucacgguucauuag

SEQ ID NO: 2680757 - RNA, 15 nt, Escherichia coli CFT073
aagccugauaagcgu

SEQ ID NO: 2680758 - RNA, 17 nt, Escherichia coli CFT073
aagccugaugcgacgcu

SEQ ID NO: 2680759 - RNA, 19 nt, Escherichia coli CFT073
aagccugcggauaaucgcg

SEQ ID NO: 2680760 - RNA, 18 nt, Escherichia coli CFT073
aagccuuacuucacauca

SEQ ID NO: 2680761 - RNA, 17 nt, Escherichia coli CFT073
aagccuugcugaaucaa

SEQ ID NO: 2680762 - RNA, 16 nt, Escherichia coli CFT073
aagcgaaaucaacacg

SEQ ID NO: 2680763 - RNA, 14 nt, Escherichia coli CFT073
aagcgaacccgcag

SEQ ID NO: 2680764 - RNA, 14 nt, Escherichia coli CFT073
aagcgaccaaccau

SEQ ID NO: 2680765 - RNA, 13 nt, Escherichia coli CFT073
aagcgacgggcga

SEQ ID NO: 2680766 - RNA, 18 nt, Escherichia coli CFT073
aagcgacgugcaguagca

SEQ ID NO: 2680767 - RNA, 21 nt, Escherichia coli CFT073
aagcgacgugcaguagcagca

SEQ ID NO: 2680768 - RNA, 18 nt, Escherichia coli CFT073
aagcgacuuugccuggcg

SEQ ID NO: 2680769 - RNA, 15 nt, Escherichia coli CFT073
aagcgagaacugccu

SEQ ID NO: 2680770 - RNA, 22 nt, Escherichia coli CFT073
aagcgagaguaauuaaacugau

SEQ ID NO: 2680771 - RNA, 17 nt, Escherichia coli CFT073
aagcgaguuauugauag

SEQ ID NO: 2680772 - RNA, 22 nt, Escherichia coli CFT073
aagcgauaaaaauaccgagcag

SEQ ID NO: 2680773 - RNA, 22 nt, Escherichia coli CFT073
aagcgauacgccagacucucgc

SEQ ID NO: 2680774 - RNA, 18 nt, Escherichia coli CFT073
aagcgauauccgggcaaa

SEQ ID NO: 2680775 - RNA, 19 nt, Escherichia coli CFT073
aagcgcaaaauaccagcaa

SEQ ID NO: 2680776 - RNA, 19 nt, Escherichia coli CFT073
aagcgcaucgacgccauca

SEQ ID NO: 2680777 - RNA, 16 nt, Escherichia coli CFT073
aagcgccaaaucugcc

SEQ ID NO: 2680778 - RNA, 15 nt, Escherichia coli CFT073
aagcgccacaaucgc

SEQ ID NO: 2680779 - RNA, 19 nt, Escherichia coli CFT073
aagcgccaucaaugugcug

SEQ ID NO: 2680780 - RNA, 22 nt, Escherichia coli CFT073
aagcgccauucacaauuuaaau

SEQ ID NO: 2680781 - RNA, 17 nt, Escherichia coli CFT073
aagcgccgaguaaaaaa

SEQ ID NO: 2680782 - RNA, 22 nt, Escherichia coli CFT073
aagcgcgaucaguugcucggca

SEQ ID NO: 2680783 - RNA, 23 nt, Escherichia coli CFT073
aagcgcgcagguaguuaucugcc

SEQ ID NO: 2680784 - RNA, 23 nt, Escherichia coli CFT073
aagcgcggauuuuauucagcaga

SEQ ID NO: 2680785 - RNA, 15 nt, Escherichia coli CFT073
aagcgcgucaccacc

SEQ ID NO: 2680786 - RNA, 16 nt, Escherichia coli CFT073
aagcgcucccgcagga

SEQ ID NO: 2680787 - RNA, 20 nt, Escherichia coli CFT073
aagcgcucccgcaggagcgc

SEQ ID NO: 2680788 - RNA, 13 nt, Escherichia coli CFT073
aagcgcugugaaa

SEQ ID NO: 2680789 - RNA, 17 nt, Escherichia coli CFT073
aagcgcugugaaacacc

SEQ ID NO: 2680790 - RNA, 21 nt, Escherichia coli CFT073
aagcggcaacuuuauuaaguu

SEQ ID NO: 2680791 - RNA, 21 nt, Escherichia coli CFT073
aagcggcacugcucuuuaaca

SEQ ID NO: 2680792 - RNA, 19 nt, Escherichia coli CFT073
aagcggccgucagaucgcc

SEQ ID NO: 2680793 - RNA, 15 nt, Escherichia coli CFT073
aagcgggaauagcuc

SEQ ID NO: 2680794 - RNA, 15 nt, Escherichia coli CFT073
aagcggguucaguga

SEQ ID NO: 2680795 - RNA, 22 nt, Escherichia coli CFT073
aagcgguaaaccguuaucacca

SEQ ID NO: 2680796 - RNA, 13 nt, Escherichia coli CFT073
aagcgguaaugcg

SEQ ID NO: 2680797 - RNA, 22 nt, Escherichia coli CFT073
aagcggugaucaaaacgggcaa

SEQ ID NO: 2680798 - RNA, 20 nt, Escherichia coli CFT073
aagcguaccgccaauuacca

SEQ ID NO: 2680799 - RNA, 14 nt, Escherichia coli CFT073
aagcguagcgcauc

SEQ ID NO: 2680800 - RNA, 17 nt, Escherichia coli CFT073
aagcguauccaucacua

SEQ ID NO: 2680801 - RNA, 13 nt, Escherichia coli CFT073
aagcgucagcuuu

SEQ ID NO: 2680802 - RNA, 14 nt, Escherichia coli CFT073
aagcgucgcaucag

SEQ ID NO: 2680803 - RNA, 16 nt, Escherichia coli CFT073
aagcgucgcaucaggc

SEQ ID NO: 2680804 - RNA, 23 nt, Escherichia coli CFT073
aagcgucgcauccggcaucaacc

SEQ ID NO: 2680805 - RNA, 16 nt, Escherichia coli CFT073
aagcgucgcgccauug

SEQ ID NO: 2680806 - RNA, 19 nt, Escherichia coli CFT073
aagcguuccacgucacagg

SEQ ID NO: 2680807 - RNA, 15 nt, Escherichia coli CFT073
aagcguuucaucuuc

SEQ ID NO: 2680808 - RNA, 15 nt, Escherichia coli CFT073
aagcguuugcggcug

SEQ ID NO: 2680809 - RNA, 18 nt, Escherichia coli CFT073
aagcguuuucugccagac

SEQ ID NO: 2680810 - RNA, 13 nt, Escherichia coli CFT073
aagcuaaaccaau

SEQ ID NO: 2680811 - RNA, 15 nt, Escherichia coli CFT073
aagcuaaaccaauaa

SEQ ID NO: 2680812 - RNA, 17 nt, Escherichia coli CFT073
aagcuaccggcaaacgg

SEQ ID NO: 2680813 - RNA, 18 nt, Escherichia coli CFT073
aagcuauaaaaaaacggc

SEQ ID NO: 2680814 - RNA, 12 nt, Escherichia coli CFT073
aagcuauaccuu

SEQ ID NO: 2680815 - RNA, 21 nt, Escherichia coli CFT073
aagcuauuaauccauaaccau

SEQ ID NO: 2680816 - RNA, 23 nt, Escherichia coli CFT073
aagcucacuuugucugcaaucug

SEQ ID NO: 2680817 - RNA, 13 nt, Escherichia coli CFT073
aagcucauaugca

SEQ ID NO: 2680818 - RNA, 13 nt, Escherichia coli CFT073
aagcucauuuccc

SEQ ID NO: 2680819 - RNA, 17 nt, Escherichia coli CFT073
aagcuccgcugaaacgu

SEQ ID NO: 2680820 - RNA, 18 nt, Escherichia coli CFT073
aagcucucuuccaguucg

SEQ ID NO: 2680821 - RNA, 23 nt, Escherichia coli CFT073
aagcucugguguggagugcagca

SEQ ID NO: 2680822 - RNA, 23 nt, Escherichia coli CFT073
aagcugaacagucgcugaucacc

SEQ ID NO: 2680823 - RNA, 14 nt, Escherichia coli CFT073
aagcugaacauuuu

SEQ ID NO: 2680824 - RNA, 22 nt, Escherichia coli CFT073
aagcugaauguucuucuucugc

SEQ ID NO: 2680825 - RNA, 13 nt, Escherichia coli CFT073
aagcugacaggcg

SEQ ID NO: 2680826 - RNA, 23 nt, Escherichia coli CFT073
aagcugagaaaauguauuucauc

SEQ ID NO: 2680827 - RNA, 14 nt, Escherichia coli CFT073
aagcugagcacaaa

SEQ ID NO: 2680828 - RNA, 22 nt, Escherichia coli CFT073
aagcugagcacaaaacaggucg

SEQ ID NO: 2680829 - RNA, 20 nt, Escherichia coli CFT073
aagcugauaacgccacgcca

SEQ ID NO: 2680830 - RNA, 19 nt, Escherichia coli CFT073
aagcugauuuuauuucaaa

SEQ ID NO: 2680831 - RNA, 16 nt, Escherichia coli CFT073
aagcugccugcuaaca

SEQ ID NO: 2680832 - RNA, 20 nt, Escherichia coli CFT073
aagcugcggauccugagcaa

SEQ ID NO: 2680833 - RNA, 21 nt, Escherichia coli CFT073
aagcugcggauccugagcaaa

SEQ ID NO: 2680834 - RNA, 22 nt, Escherichia coli CFT073
aagcugcugacggugauaauca

SEQ ID NO: 2680835 - RNA, 23 nt, Escherichia coli CFT073
aagcugguggcaaucgcgguggu

SEQ ID NO: 2680836 - RNA, 18 nt, Escherichia coli CFT073
aagcuguacacuucccag

SEQ ID NO: 2680837 - RNA, 16 nt, Escherichia coli CFT073
aagcugucaccaauca

SEQ ID NO: 2680838 - RNA, 17 nt, Escherichia coli CFT073
aagcugucaccaaucag

SEQ ID NO: 2680839 - RNA, 23 nt, Escherichia coli CFT073
aagcugucaccucugcaacgucu

SEQ ID NO: 2680840 - RNA, 16 nt, Escherichia coli CFT073
aagcugugccugaaua

SEQ ID NO: 2680841 - RNA, 15 nt, Escherichia coli CFT073
aagcuguucagauac

SEQ ID NO: 2680842 - RNA, 18 nt, Escherichia coli CFT073
aagcuuaucacagaggaa

SEQ ID NO: 2680843 - RNA, 23 nt, Escherichia coli CFT073
aagcuuuacaguaacguuuaaga

SEQ ID NO: 2680844 - RNA, 19 nt, Escherichia coli CFT073
aaggaagacguagcaagca

SEQ ID NO: 2680845 - RNA, 23 nt, Escherichia coli CFT073
aaggaagccugaaagggaaggga

SEQ ID NO: 2680846 - RNA, 14 nt, Escherichia coli CFT073
aaggaagcuuucgc

SEQ ID NO: 2680847 - RNA, 15 nt, Escherichia coli CFT073
aaggaaugaaauauu

SEQ ID NO: 2680848 - RNA, 13 nt, Escherichia coli CFT073
aaggacaaaccgg

SEQ ID NO: 2680849 - RNA, 21 nt, Escherichia coli CFT073
aaggacagaguguucgccauu

SEQ ID NO: 2680850 - RNA, 18 nt, Escherichia coli CFT073
aaggaccaaagaaugaca

SEQ ID NO: 2680851 - RNA, 16 nt, Escherichia coli CFT073
aaggagucagggagaa

SEQ ID NO: 2680852 - RNA, 14 nt, Escherichia coli CFT073
aaggauauaaaaau

SEQ ID NO: 2680853 - RNA, 19 nt, Escherichia coli CFT073
aaggauauaaaaauaacag

SEQ ID NO: 2680854 - RNA, 22 nt, Escherichia coli CFT073
aaggaucgcgacaaaauacagg

SEQ ID NO: 2680855 - RNA, 16 nt, Escherichia coli CFT073
aaggaugagaagcuuc

SEQ ID NO: 2680856 - RNA, 17 nt, Escherichia coli CFT073
aaggauugcagcacuga

SEQ ID NO: 2680857 - RNA, 18 nt, Escherichia coli CFT073
aaggauuggguuaagccg

SEQ ID NO: 2680858 - RNA, 18 nt, Escherichia coli CFT073
aaggcaaacaggauccgc

SEQ ID NO: 2680859 - RNA, 23 nt, Escherichia coli CFT073
aaggcaacgcagccccagcgcau

SEQ ID NO: 2680860 - RNA, 22 nt, Escherichia coli CFT073
aaggcaaucggaugacccgcau

SEQ ID NO: 2680861 - RNA, 14 nt, Escherichia coli CFT073
aaggcaauuaaaaa

SEQ ID NO: 2680862 - RNA, 21 nt, Escherichia coli CFT073
aaggcaauuaaaaauuucccc

SEQ ID NO: 2680863 - RNA, 21 nt, Escherichia coli CFT073
aaggcaauugcauuugaacug

SEQ ID NO: 2680864 - RNA, 18 nt, Escherichia coli CFT073
aaggcacucauuuucucu

SEQ ID NO: 2680865 - RNA, 12 nt, Escherichia coli CFT073
aaggcaguucag

SEQ ID NO: 2680866 - RNA, 13 nt, Escherichia coli CFT073
aaggcaucagcca

SEQ ID NO: 2680867 - RNA, 14 nt, Escherichia coli CFT073
aaggccaauacccg

SEQ ID NO: 2680868 - RNA, 18 nt, Escherichia coli CFT073
aaggccagcaauccccag

SEQ ID NO: 2680869 - RNA, 15 nt, Escherichia coli CFT073
aaggccagguuuucu

SEQ ID NO: 2680870 - RNA, 22 nt, Escherichia coli CFT073
aaggccgcgaaccagaccagca

SEQ ID NO: 2680871 - RNA, 17 nt, Escherichia coli CFT073
aaggccgcuuucagagc

SEQ ID NO: 2680872 - RNA, 13 nt, Escherichia coli CFT073
aaggccggagcau

SEQ ID NO: 2680873 - RNA, 15 nt, Escherichia coli CFT073
aaggcgacaauaaau

SEQ ID NO: 2680874 - RNA, 19 nt, Escherichia coli CFT073
aaggcgacaauaaauacaa

SEQ ID NO: 2680875 - RNA, 12 nt, Escherichia coli CFT073
aaggcgcaacau

SEQ ID NO: 2680876 - RNA, 23 nt, Escherichia coli CFT073
aaggcgcauugcuggcugcggga

SEQ ID NO: 2680877 - RNA, 19 nt, Escherichia coli CFT073
aaggcgcgagguuuuccuu

SEQ ID NO: 2680878 - RNA, 19 nt, Escherichia coli CFT073
aaggcguuaaacuggaaaa

SEQ ID NO: 2680879 - RNA, 22 nt, Escherichia coli CFT073
aaggcguuaaacuggaaaaccg

SEQ ID NO: 2680880 - RNA, 17 nt, Escherichia coli CFT073
aaggcguucaagccgca

SEQ ID NO: 2680881 - RNA, 20 nt, Escherichia coli CFT073
aaggcguucaagccgcaucc

SEQ ID NO: 2680882 - RNA, 14 nt, Escherichia coli CFT073
aaggcguucacgcc

SEQ ID NO: 2680883 - RNA, 20 nt, Escherichia coli CFT073
aaggcguugauuggcgcagg

SEQ ID NO: 2680884 - RNA, 20 nt, Escherichia coli CFT073
aaggcguuuacgccgcaucc

SEQ ID NO: 2680885 - RNA, 18 nt, Escherichia coli CFT073
aaggcguuugcgucgcau

SEQ ID NO: 2680886 - RNA, 22 nt, Escherichia coli CFT073
aaggcguuugcgucgcauccgg

SEQ ID NO: 2680887 - RNA, 17 nt, Escherichia coli CFT073
aaggcguuuuagccgca

SEQ ID NO: 2680888 - RNA, 14 nt, Escherichia coli CFT073
aaggcuacgccaca

SEQ ID NO: 2680889 - RNA, 20 nt, Escherichia coli CFT073
aaggcuaguacaggcggcaa

SEQ ID NO: 2680890 - RNA, 21 nt, Escherichia coli CFT073
aaggcucucuuaccagccgcg

SEQ ID NO: 2680891 - RNA, 17 nt, Escherichia coli CFT073
aaggcugauaacgucca

SEQ ID NO: 2680892 - RNA, 13 nt, Escherichia coli CFT073
aaggcuggcgugu

SEQ ID NO: 2680893 - RNA, 12 nt, Escherichia coli CFT073
aaggcuucaacg

SEQ ID NO: 2680894 - RNA, 13 nt, Escherichia coli CFT073
aaggcuucgcucu

SEQ ID NO: 2680895 - RNA, 12 nt, Escherichia coli CFT073
aagggaacagag

SEQ ID NO: 2680896 - RNA, 15 nt, Escherichia coli CFT073
aagggacggaacgaa

SEQ ID NO: 2680897 - RNA, 16 nt, Escherichia coli CFT073
aagggcagcaggauca

SEQ ID NO: 2680898 - RNA, 17 nt, Escherichia coli CFT073
aagggcggucggaagau

SEQ ID NO: 2680899 - RNA, 23 nt, Escherichia coli CFT073
aaggguauagaaaccauccagca

SEQ ID NO: 2680900 - RNA, 19 nt, Escherichia coli CFT073
aaggguaugcuguaaacaa

SEQ ID NO: 2680901 - RNA, 18 nt, Escherichia coli CFT073
aagggugacagcaggaaa

SEQ ID NO: 2680902 - RNA, 16 nt, Escherichia coli CFT073
aagguaacaccaguuu

SEQ ID NO: 2680903 - RNA, 18 nt, Escherichia coli CFT073
aagguaaggauaaaaaag

SEQ ID NO: 2680904 - RNA, 22 nt, Escherichia coli CFT073
aagguaccgacgaucaacagaa

SEQ ID NO: 2680905 - RNA, 20 nt, Escherichia coli CFT073
aagguauagucacaaaauaa

SEQ ID NO: 2680906 - RNA, 17 nt, Escherichia coli CFT073
aagguaucgcgaaaaaa

SEQ ID NO: 2680907 - RNA, 18 nt, Escherichia coli CFT073
aagguaucgcgaaaaaaa

SEQ ID NO: 2680908 - RNA, 19 nt, Escherichia coli CFT073
aaggucuuaauuuugguaa

SEQ ID NO: 2680909 - RNA, 20 nt, Escherichia coli CFT073
aaggugacguccagaaccgc

SEQ ID NO: 2680910 - RNA, 20 nt, Escherichia coli CFT073
aaggugacuggcagaaugaa

SEQ ID NO: 2680911 - RNA, 17 nt, Escherichia coli CFT073
aaggugauucccagcaa

SEQ ID NO: 2680912 - RNA, 17 nt, Escherichia coli CFT073
aaggugcaucggggaau

SEQ ID NO: 2680913 - RNA, 19 nt, Escherichia coli CFT073
aaggugcauugaaggcaau

SEQ ID NO: 2680914 - RNA, 13 nt, Escherichia coli CFT073
aaggugccacagc

SEQ ID NO: 2680915 - RNA, 22 nt, Escherichia coli CFT073
aaggugcgaccuacacaccuuc

SEQ ID NO: 2680916 - RNA, 20 nt, Escherichia coli CFT073
aaggugcguuaccagcuaag

SEQ ID NO: 2680917 - RNA, 22 nt, Escherichia coli CFT073
  misc_feature (6)..(6): n is a, c, g or u
aaggunauuuagcgaucuguuc

SEQ ID NO: 2680918 - RNA, 14 nt, Escherichia coli CFT073
aagguuaugcaagu

SEQ ID NO: 2680919 - RNA, 19 nt, Escherichia coli CFT073
aagguucacuuaaucucug

SEQ ID NO: 2680920 - RNA, 14 nt, Escherichia coli CFT073
aagguugccgggga

SEQ ID NO: 2680921 - RNA, 15 nt, Escherichia coli CFT073
aagguuuuaaucgcu

SEQ ID NO: 2680922 - RNA, 19 nt, Escherichia coli CFT073
aagguuuuuucuguauuca

SEQ ID NO: 2680923 - RNA, 21 nt, Escherichia coli CFT073
aagguuuuuucuguauucauc

SEQ ID NO: 2680924 - RNA, 14 nt, Escherichia coli CFT073
aaguaaacccggca

SEQ ID NO: 2680925 - RNA, 15 nt, Escherichia coli CFT073
aaguaaacccggcau

SEQ ID NO: 2680926 - RNA, 19 nt, Escherichia coli CFT073
aaguaaacccggcaucaug

SEQ ID NO: 2680927 - RNA, 16 nt, Escherichia coli CFT073
aaguaaauaagaaaau

SEQ ID NO: 2680928 - RNA, 21 nt, Escherichia coli CFT073
aaguaaccuuuaucacgcagc

SEQ ID NO: 2680929 - RNA, 23 nt, Escherichia coli CFT073
aaguaaggcagagccaaauaauc

SEQ ID NO: 2680930 - RNA, 13 nt, Escherichia coli CFT073
aaguaaucauaau

SEQ ID NO: 2680931 - RNA, 13 nt, Escherichia coli CFT073
aaguaaucuauau

SEQ ID NO: 2680932 - RNA, 15 nt, Escherichia coli CFT073
aaguaauggaaggcg

SEQ ID NO: 2680933 - RNA, 20 nt, Escherichia coli CFT073
aaguaccaucguccagcagc

SEQ ID NO: 2680934 - RNA, 14 nt, Escherichia coli CFT073
aaguaccgagaagc

SEQ ID NO: 2680935 - RNA, 23 nt, Escherichia coli CFT073
aaguacgccgccgccaaucgccc

SEQ ID NO: 2680936 - RNA, 14 nt, Escherichia coli CFT073
aaguacuaaauaau

SEQ ID NO: 2680937 - RNA, 16 nt, Escherichia coli CFT073
aaguacuccuguucac

SEQ ID NO: 2680938 - RNA, 19 nt, Escherichia coli CFT073
aaguacucuuugaacagcc

SEQ ID NO: 2680939 - RNA, 15 nt, Escherichia coli CFT073
aaguagauaaucgcu

SEQ ID NO: 2680940 - RNA, 14 nt, Escherichia coli CFT073
aaguagccuucauc

SEQ ID NO: 2680941 - RNA, 17 nt, Escherichia coli CFT073
aaguagccuucaucaga

SEQ ID NO: 2680942 - RNA, 20 nt, Escherichia coli CFT073
aaguagccuucaucagauga

SEQ ID NO: 2680943 - RNA, 15 nt, Escherichia coli CFT073
aaguagcgccagacu

SEQ ID NO: 2680944 - RNA, 15 nt, Escherichia coli CFT073
aaguagcugaaaauc

SEQ ID NO: 2680945 - RNA, 21 nt, Escherichia coli CFT073
aaguaggccguacagcccagg

SEQ ID NO: 2680946 - RNA, 18 nt, Escherichia coli CFT073
aaguaguuccagcaugau

SEQ ID NO: 2680947 - RNA, 18 nt, Escherichia coli CFT073
aaguaucaaacagaaaaa

SEQ ID NO: 2680948 - RNA, 22 nt, Escherichia coli CFT073
aaguaucaaacagaaaaacgaa

SEQ ID NO: 2680949 - RNA, 19 nt, Escherichia coli CFT073
aaguauccacgcagacaau

SEQ ID NO: 2680950 - RNA, 18 nt, Escherichia coli CFT073
aaguauggaaaucaccca

SEQ ID NO: 2680951 - RNA, 18 nt, Escherichia coli CFT073
aaguauuaaugucaggua

SEQ ID NO: 2680952 - RNA, 13 nt, Escherichia coli CFT073
aaguauucgucgc

SEQ ID NO: 2680953 - RNA, 14 nt, Escherichia coli CFT073
aagucaaacugaua

SEQ ID NO: 2680954 - RNA, 17 nt, Escherichia coli CFT073
aagucaacaccaucuuc

SEQ ID NO: 2680955 - RNA, 18 nt, Escherichia coli CFT073
aagucacaaaauucgcca

SEQ ID NO: 2680956 - RNA, 18 nt, Escherichia coli CFT073
aagucaccgcuuuuuuca

SEQ ID NO: 2680957 - RNA, 22 nt, Escherichia coli CFT073
aagucaccgcuuuuuucaucuc

SEQ ID NO: 2680958 - RNA, 15 nt, Escherichia coli CFT073
aagucacuaauugca

SEQ ID NO: 2680959 - RNA, 19 nt, Escherichia coli CFT073
aagucacuaauugcagcga

SEQ ID NO: 2680960 - RNA, 14 nt, Escherichia coli CFT073
aagucagauuagaa

SEQ ID NO: 2680961 - RNA, 19 nt, Escherichia coli CFT073
aagucagauuagaacugau

SEQ ID NO: 2680962 - RNA, 17 nt, Escherichia coli CFT073
aagucagcacauccagu

SEQ ID NO: 2680963 - RNA, 14 nt, Escherichia coli CFT073
aagucagcgcgaaa

SEQ ID NO: 2680964 - RNA, 21 nt, Escherichia coli CFT073
aagucagcgcgaaaucgcccu

SEQ ID NO: 2680965 - RNA, 15 nt, Escherichia coli CFT073
aagucaucaauugca

SEQ ID NO: 2680966 - RNA, 21 nt, Escherichia coli CFT073
aaguccccgcuucgcccgcca

SEQ ID NO: 2680967 - RNA, 22 nt, Escherichia coli CFT073
aaguccgaggaaggcacguaca

SEQ ID NO: 2680968 - RNA, 17 nt, Escherichia coli CFT073
aaguccgaugccguuaa

SEQ ID NO: 2680969 - RNA, 17 nt, Escherichia coli CFT073
aaguccgguaauggaga

SEQ ID NO: 2680970 - RNA, 14 nt, Escherichia coli CFT073
aaguccugccagaa

SEQ ID NO: 2680971 - RNA, 23 nt, Escherichia coli CFT073
aagucgaacgguaacaggaagaa

SEQ ID NO: 2680972 - RNA, 15 nt, Escherichia coli CFT073
aagucgaacuucucu

SEQ ID NO: 2680973 - RNA, 23 nt, Escherichia coli CFT073
aagucggcgugcaucucuucaaa

SEQ ID NO: 2680974 - RNA, 16 nt, Escherichia coli CFT073
aagucggucacagucu

SEQ ID NO: 2680975 - RNA, 14 nt, Escherichia coli CFT073
aagucguaggccug

SEQ ID NO: 2680976 - RNA, 14 nt, Escherichia coli CFT073
aagucuaaugacaa

SEQ ID NO: 2680977 - RNA, 15 nt, Escherichia coli CFT073
aagucuaaugacaaa

SEQ ID NO: 2680978 - RNA, 16 nt, Escherichia coli CFT073
aagucucaagagugaa

SEQ ID NO: 2680979 - RNA, 12 nt, Escherichia coli CFT073
aagucucagaaa

SEQ ID NO: 2680980 - RNA, 15 nt, Escherichia coli CFT073
aagucucagaaagua

SEQ ID NO: 2680981 - RNA, 18 nt, Escherichia coli CFT073
  misc_feature (9)..(9): n is a, c, g or u
aagucucangagugaaca

SEQ ID NO: 2680982 - RNA, 13 nt, Escherichia coli CFT073
aagucucauauau

SEQ ID NO: 2680983 - RNA, 12 nt, Escherichia coli CFT073
aagucuccauuu

SEQ ID NO: 2680984 - RNA, 19 nt, Escherichia coli CFT073
aagugaaaaacaccccauu

SEQ ID NO: 2680985 - RNA, 18 nt, Escherichia coli CFT073
aagugaaucggaucaauc

SEQ ID NO: 2680986 - RNA, 23 nt, Escherichia coli CFT073
aagugaaucggaucaauccccag

SEQ ID NO: 2680987 - RNA, 18 nt, Escherichia coli CFT073
aagugcacuuugucagca

SEQ ID NO: 2680988 - RNA, 13 nt, Escherichia coli CFT073
aagugcauauaca

SEQ ID NO: 2680989 - RNA, 16 nt, Escherichia coli CFT073
aagugcgccgaggaaa

SEQ ID NO: 2680990 - RNA, 12 nt, Escherichia coli CFT073
aagugcggcgca

SEQ ID NO: 2680991 - RNA, 15 nt, Escherichia coli CFT073
aagugcggcgcacca

SEQ ID NO: 2680992 - RNA, 20 nt, Escherichia coli CFT073
aaguggcgacaaaguggcgg

SEQ ID NO: 2680993 - RNA, 17 nt, Escherichia coli CFT073
aaguggcgauacagugc

SEQ ID NO: 2680994 - RNA, 23 nt, Escherichia coli CFT073
aaguggcgauucauaugcgccag

SEQ ID NO: 2680995 - RNA, 23 nt, Escherichia coli CFT073
aaguggcgcagagccugaauaaa

SEQ ID NO: 2680996 - RNA, 18 nt, Escherichia coli CFT073
aaguggguaaugucacac

SEQ ID NO: 2680997 - RNA, 23 nt, Escherichia coli CFT073
aaguggugaugauacuugcaccu

SEQ ID NO: 2680998 - RNA, 13 nt, Escherichia coli CFT073
aaguggugauuca

SEQ ID NO: 2680999 - RNA, 21 nt, Escherichia coli CFT073
aaguggugauugauugucauu

SEQ ID NO: 2681000 - RNA, 23 nt, Escherichia coli CFT073
aaguguagucagcaauuuggcuu

SEQ ID NO: 2681001 - RNA, 19 nt, Escherichia coli CFT073
aaguguccaguugagcucc

SEQ ID NO: 2681002 - RNA, 21 nt, Escherichia coli CFT073
aaguguccaguugagcuccag

SEQ ID NO: 2681003 - RNA, 17 nt, Escherichia coli CFT073
aagugugcaaacgauaa

SEQ ID NO: 2681004 - RNA, 16 nt, Escherichia coli CFT073
aaguguggccgccagu

SEQ ID NO: 2681005 - RNA, 13 nt, Escherichia coli CFT073
aaguuaaucagcg

SEQ ID NO: 2681006 - RNA, 17 nt, Escherichia coli CFT073
aaguuacugacaucgcu

SEQ ID NO: 2681007 - RNA, 17 nt, Escherichia coli CFT073
aaguuagacggaaaaga

SEQ ID NO: 2681008 - RNA, 22 nt, Escherichia coli CFT073
aaguuagaguagccaauaccaa

SEQ ID NO: 2681009 - RNA, 23 nt, Escherichia coli CFT073
aaguuagucgcuuucauucagaa

SEQ ID NO: 2681010 - RNA, 21 nt, Escherichia coli CFT073
aaguuauccugguacucgacu

SEQ ID NO: 2681011 - RNA, 16 nt, Escherichia coli CFT073
aaguuauuaaugacaa

SEQ ID NO: 2681012 - RNA, 20 nt, Escherichia coli CFT073
aaguuauuaaugacaauuac

SEQ ID NO: 2681013 - RNA, 13 nt, Escherichia coli CFT073
aaguucaaccuca

SEQ ID NO: 2681014 - RNA, 14 nt, Escherichia coli CFT073
aaguucauccauac

SEQ ID NO: 2681015 - RNA, 23 nt, Escherichia coli CFT073
aaguuccgggauauaaaccgccg

SEQ ID NO: 2681016 - RNA, 18 nt, Escherichia coli CFT073
aaguuccguuuccagcca

SEQ ID NO: 2681017 - RNA, 14 nt, Escherichia coli CFT073
aaguucuuccggca

SEQ ID NO: 2681018 - RNA, 21 nt, Escherichia coli CFT073
aaguugaaaaccauaaugaug

SEQ ID NO: 2681019 - RNA, 13 nt, Escherichia coli CFT073
aaguugaaaucac

SEQ ID NO: 2681020 - RNA, 23 nt, Escherichia coli CFT073
aaguugaagcugaacagucgcug

SEQ ID NO: 2681021 - RNA, 20 nt, Escherichia coli CFT073
aaguugaugguguagaaccg

SEQ ID NO: 2681022 - RNA, 17 nt, Escherichia coli CFT073
aaguugauugccagcag

SEQ ID NO: 2681023 - RNA, 19 nt, Escherichia coli CFT073
aaguugauuuuguaaucaa

SEQ ID NO: 2681024 - RNA, 18 nt, Escherichia coli CFT073
aaguugccggauguguug

SEQ ID NO: 2681025 - RNA, 18 nt, Escherichia coli CFT073
aaguugcgaaagcgagca

SEQ ID NO: 2681026 - RNA, 22 nt, Escherichia coli CFT073
aaguuggcgauaaaguugaagc

SEQ ID NO: 2681027 - RNA, 18 nt, Escherichia coli CFT073
aaguuggcguucacugcc

SEQ ID NO: 2681028 - RNA, 22 nt, Escherichia coli CFT073
aaguuggcguucacugccguac

SEQ ID NO: 2681029 - RNA, 16 nt, Escherichia coli CFT073
aaguuuaauucuuuga

SEQ ID NO: 2681030 - RNA, 19 nt, Escherichia coli CFT073
aaguuuauuacucagcgca

SEQ ID NO: 2681031 - RNA, 21 nt, Escherichia coli CFT073
aaguuucccagcuuauuaaca

SEQ ID NO: 2681032 - RNA, 18 nt, Escherichia coli CFT073
aaguuuccuccggcuuua

SEQ ID NO: 2681033 - RNA, 16 nt, Escherichia coli CFT073
aaguuugcaaacccac

SEQ ID NO: 2681034 - RNA, 20 nt, Escherichia coli CFT073
aaguuugcaaacccacagag

SEQ ID NO: 2681035 - RNA, 20 nt, Escherichia coli CFT073
aaguuugcaacuuucgcuuu

SEQ ID NO: 2681036 - RNA, 20 nt, Escherichia coli CFT073
aaguuugcccgucugcugcu

SEQ ID NO: 2681037 - RNA, 12 nt, Escherichia coli CFT073
aaguuuuccuca

SEQ ID NO: 2681038 - RNA, 13 nt, Escherichia coli CFT073
aaguuuuccucag

SEQ ID NO: 2681039 - RNA, 16 nt, Escherichia coli CFT073
aaguuuucgccggauc

SEQ ID NO: 2681040 - RNA, 20 nt, Escherichia coli CFT073
aauaaaaaccugucuggauu

SEQ ID NO: 2681041 - RNA, 14 nt, Escherichia coli CFT073
aauaaaaagaauga

SEQ ID NO: 2681042 - RNA, 13 nt, Escherichia coli CFT073
aauaaaaagcggc

SEQ ID NO: 2681043 - RNA, 15 nt, Escherichia coli CFT073
aauaaaacaagcagc

SEQ ID NO: 2681044 - RNA, 16 nt, Escherichia coli CFT073
aauaaaacaagcagcu

SEQ ID NO: 2681045 - RNA, 14 nt, Escherichia coli CFT073
aauaaaacgccuga

SEQ ID NO: 2681046 - RNA, 14 nt, Escherichia coli CFT073
aauaaaagccagga

SEQ ID NO: 2681047 - RNA, 12 nt, Escherichia coli CFT073
aauaaaauaacc

SEQ ID NO: 2681048 - RNA, 13 nt, Escherichia coli CFT073
aauaaaauaucuu

SEQ ID NO: 2681049 - RNA, 14 nt, Escherichia coli CFT073
aauaaaauaucuuc

SEQ ID NO: 2681050 - RNA, 13 nt, Escherichia coli CFT073
aauaaaaucagca

SEQ ID NO: 2681051 - RNA, 15 nt, Escherichia coli CFT073
aauaaaaucuauuau

SEQ ID NO: 2681052 - RNA, 14 nt, Escherichia coli CFT073
aauaaacaacaaaa

SEQ ID NO: 2681053 - RNA, 18 nt, Escherichia coli CFT073
aauaaaccaguaagguuu

SEQ ID NO: 2681054 - RNA, 18 nt, Escherichia coli CFT073
aauaaacgcgcagggugc

SEQ ID NO: 2681055 - RNA, 18 nt, Escherichia coli CFT073
aauaaagacacugcuguu

SEQ ID NO: 2681056 - RNA, 21 nt, Escherichia coli CFT073
aauaaaugccggaagcagcaa

SEQ ID NO: 2681057 - RNA, 15 nt, Escherichia coli CFT073
aauaaaugcuugacu

SEQ ID NO: 2681058 - RNA, 20 nt, Escherichia coli CFT073
aauaaaugcuugacucugug

SEQ ID NO: 2681059 - RNA, 20 nt, Escherichia coli CFT073
aauaaauuugggugcaauga

SEQ ID NO: 2681060 - RNA, 17 nt, Escherichia coli CFT073
aauaaauuuuuucugac

SEQ ID NO: 2681061 - RNA, 13 nt, Escherichia coli CFT073
aauaacacugagc

SEQ ID NO: 2681062 - RNA, 16 nt, Escherichia coli CFT073
aauaacagugauugcu

SEQ ID NO: 2681063 - RNA, 20 nt, Escherichia coli CFT073
aauaaccaacggcgagccag

SEQ ID NO: 2681064 - RNA, 15 nt, Escherichia coli CFT073
aauaaccacuucuuc

SEQ ID NO: 2681065 - RNA, 18 nt, Escherichia coli CFT073
aauaacccggacaaauaa

SEQ ID NO: 2681066 - RNA, 22 nt, Escherichia coli CFT073
aauaacccguuguaaaugcugc

SEQ ID NO: 2681067 - RNA, 23 nt, Escherichia coli CFT073
aauaaccgaaucguuuuuuucgc

SEQ ID NO: 2681068 - RNA, 22 nt, Escherichia coli CFT073
aauaaccucaugguuuuuaugg

SEQ ID NO: 2681069 - RNA, 21 nt, Escherichia coli CFT073
aauaacgagcgagaauacaua

SEQ ID NO: 2681070 - RNA, 21 nt, Escherichia coli CFT073
aauaacgaucaucacgacaua

SEQ ID NO: 2681071 - RNA, 22 nt, Escherichia coli CFT073
aauaacgcccacuuuugccgca

SEQ ID NO: 2681072 - RNA, 21 nt, Escherichia coli CFT073
aauaacgccccggcaaaacca

SEQ ID NO: 2681073 - RNA, 11 nt, Escherichia coli CFT073
aauaacgcuua

SEQ ID NO: 2681074 - RNA, 15 nt, Escherichia coli CFT073
aauaacggccuggca

SEQ ID NO: 2681075 - RNA, 19 nt, Escherichia coli CFT073
aauaacggccuggcacgua

SEQ ID NO: 2681076 - RNA, 22 nt, Escherichia coli CFT073
aauaacguaguguaaaugcaaa

SEQ ID NO: 2681077 - RNA, 19 nt, Escherichia coli CFT073
aauaacgugaucgaacauu

SEQ ID NO: 2681078 - RNA, 22 nt, Escherichia coli CFT073
aauaacucaaguuguaauuccu

SEQ ID NO: 2681079 - RNA, 12 nt, Escherichia coli CFT073
aauaagaaaagc

SEQ ID NO: 2681080 - RNA, 14 nt, Escherichia coli CFT073
aauaagaaaagcga

SEQ ID NO: 2681081 - RNA, 20 nt, Escherichia coli CFT073
aauaagagauccaggccaga

SEQ ID NO: 2681082 - RNA, 15 nt, Escherichia coli CFT073
aauaagaguaauggu

SEQ ID NO: 2681083 - RNA, 23 nt, Escherichia coli CFT073
aauaagcaucgcuagauauauau

SEQ ID NO: 2681084 - RNA, 22 nt, Escherichia coli CFT073
aauaagccccuuucgaaaucau

SEQ ID NO: 2681085 - RNA, 21 nt, Escherichia coli CFT073
aauaagcgcccagcucuuuac

SEQ ID NO: 2681086 - RNA, 19 nt, Escherichia coli CFT073
aauaagcgcccauaaagau

SEQ ID NO: 2681087 - RNA, 13 nt, Escherichia coli CFT073
aauaagcuuuuuc

SEQ ID NO: 2681088 - RNA, 22 nt, Escherichia coli CFT073
aauaaggcguacauccggcaau

SEQ ID NO: 2681089 - RNA, 21 nt, Escherichia coli CFT073
aauaaguacgauacaaaagca

SEQ ID NO: 2681090 - RNA, 17 nt, Escherichia coli CFT073
aauaagugcuaaacgcu

SEQ ID NO: 2681091 - RNA, 18 nt, Escherichia coli CFT073
aauaaguuuuuugcgaaa

SEQ ID NO: 2681092 - RNA, 22 nt, Escherichia coli CFT073
aauaaguuuuuugcgaaaaaua

SEQ ID NO: 2681093 - RNA, 23 nt, Escherichia coli CFT073
aauaaguuuuuugcgaaaaauaa

SEQ ID NO: 2681094 - RNA, 15 nt, Escherichia coli CFT073
aauaauaaccaaacc

SEQ ID NO: 2681095 - RNA, 16 nt, Escherichia coli CFT073
aauaauaacucgcagc

SEQ ID NO: 2681096 - RNA, 20 nt, Escherichia coli CFT073
aauaauaaguaaacaaacau

SEQ ID NO: 2681097 - RNA, 14 nt, Escherichia coli CFT073
aauaauaauaagua

SEQ ID NO: 2681098 - RNA, 20 nt, Escherichia coli CFT073
aauaauaccguucucuuuau

SEQ ID NO: 2681099 - RNA, 12 nt, Escherichia coli CFT073
aauaauaucuuu

SEQ ID NO: 2681100 - RNA, 12 nt, Escherichia coli CFT073
aauaauauuucc

SEQ ID NO: 2681101 - RNA, 13 nt, Escherichia coli CFT073
aauaauauuuccc

SEQ ID NO: 2681102 - RNA, 14 nt, Escherichia coli CFT073
aauaauauuucccc

SEQ ID NO: 2681103 - RNA, 16 nt, Escherichia coli CFT073
aauaaucaacgcgaaa

SEQ ID NO: 2681104 - RNA, 14 nt, Escherichia coli CFT073
aauaaucaccacac

SEQ ID NO: 2681105 - RNA, 12 nt, Escherichia coli CFT073
aauaaucaccag

SEQ ID NO: 2681106 - RNA, 23 nt, Escherichia coli CFT073
aauaaucagcacaauaaucagcc

SEQ ID NO: 2681107 - RNA, 12 nt, Escherichia coli CFT073
aauaaucagccc

SEQ ID NO: 2681108 - RNA, 18 nt, Escherichia coli CFT073
aauaaucaugcagcgcag

SEQ ID NO: 2681109 - RNA, 14 nt, Escherichia coli CFT073
aauaauccccacau

SEQ ID NO: 2681110 - RNA, 17 nt, Escherichia coli CFT073
aauaaucgacgaggaaa

SEQ ID NO: 2681111 - RNA, 17 nt, Escherichia coli CFT073
aauaaucgaucacguaa

SEQ ID NO: 2681112 - RNA, 21 nt, Escherichia coli CFT073
aauaaucggcgucauuuuguc

SEQ ID NO: 2681113 - RNA, 18 nt, Escherichia coli CFT073
aauaaucgggaauacaga

SEQ ID NO: 2681114 - RNA, 16 nt, Escherichia coli CFT073
aauaaucucaauaucc

SEQ ID NO: 2681115 - RNA, 14 nt, Escherichia coli CFT073
aauaaucucaccau

SEQ ID NO: 2681116 - RNA, 15 nt, Escherichia coli CFT073
aauaaucugaaaacc

SEQ ID NO: 2681117 - RNA, 20 nt, Escherichia coli CFT073
aauaaugaacgccaccccac

SEQ ID NO: 2681118 - RNA, 14 nt, Escherichia coli CFT073
aauaaugaccaucg

SEQ ID NO: 2681119 - RNA, 13 nt, Escherichia coli CFT073
aauaaugcaaaaa

SEQ ID NO: 2681120 - RNA, 22 nt, Escherichia coli CFT073
aauaaugccagucccgcgacaa

SEQ ID NO: 2681121 - RNA, 21 nt, Escherichia coli CFT073
aauaaugcccaucgugauaaa

SEQ ID NO: 2681122 - RNA, 22 nt, Escherichia coli CFT073
aauaaugccguugaucagcgca

SEQ ID NO: 2681123 - RNA, 24 nt, Escherichia coli CFT073
aauaaugccguugaucagcgcaau

SEQ ID NO: 2681124 - RNA, 20 nt, Escherichia coli CFT073
aauaaugcuucuguugcuuu

SEQ ID NO: 2681125 - RNA, 15 nt, Escherichia coli CFT073
aauaauggccuuuuc

SEQ ID NO: 2681126 - RNA, 23 nt, Escherichia coli CFT073
aauaaugucgacguuuuucaggc

SEQ ID NO: 2681127 - RNA, 17 nt, Escherichia coli CFT073
aauaaugucggcauaaa

SEQ ID NO: 2681128 - RNA, 18 nt, Escherichia coli CFT073
aauaauuacuuacaucug

SEQ ID NO: 2681129 - RNA, 19 nt, Escherichia coli CFT073
aauaauuacuucgccggaa

SEQ ID NO: 2681130 - RNA, 14 nt, Escherichia coli CFT073
aauaauucaucuuu

SEQ ID NO: 2681131 - RNA, 14 nt, Escherichia coli CFT073
aauaauugccaagu

SEQ ID NO: 2681132 - RNA, 17 nt, Escherichia coli CFT073
aauaauugucaacggca

SEQ ID NO: 2681133 - RNA, 18 nt, Escherichia coli CFT073
aauaauuucaacagauuu

SEQ ID NO: 2681134 - RNA, 18 nt, Escherichia coli CFT073
aauaauuuccaucgacuc

SEQ ID NO: 2681135 - RNA, 15 nt, Escherichia coli CFT073
aauacagcaauggaa

SEQ ID NO: 2681136 - RNA, 16 nt, Escherichia coli CFT073
aauacagcaauggaaa

SEQ ID NO: 2681137 - RNA, 18 nt, Escherichia coli CFT073
aauacagcaauggaaaaa

SEQ ID NO: 2681138 - RNA, 20 nt, Escherichia coli CFT073
aauacagcaauggaaaaagu

SEQ ID NO: 2681139 - RNA, 23 nt, Escherichia coli CFT073
aauacagcaauggaaaaaguuug

SEQ ID NO: 2681140 - RNA, 22 nt, Escherichia coli CFT073
aauacaggaaauaagaagccau

SEQ ID NO: 2681141 - RNA, 18 nt, Escherichia coli CFT073
aauacaggcuacucccag

SEQ ID NO: 2681142 - RNA, 16 nt, Escherichia coli CFT073
aauacauaagcaccga

SEQ ID NO: 2681143 - RNA, 23 nt, Escherichia coli CFT073
aauacaucaauuuucccuucuga

SEQ ID NO: 2681144 - RNA, 13 nt, Escherichia coli CFT073
aauaccaaaaaua

SEQ ID NO: 2681145 - RNA, 12 nt, Escherichia coli CFT073
aauaccaauaau

SEQ ID NO: 2681146 - RNA, 14 nt, Escherichia coli CFT073
aauaccaaugaauu

SEQ ID NO: 2681147 - RNA, 20 nt, Escherichia coli CFT073
aauaccacccuugcccacca

SEQ ID NO: 2681148 - RNA, 22 nt, Escherichia coli CFT073
aauaccacccuugcccaccagc

SEQ ID NO: 2681149 - RNA, 23 nt, Escherichia coli CFT073
aauaccacucagcuuaagaauua

SEQ ID NO: 2681150 - RNA, 22 nt, Escherichia coli CFT073
aauaccagcaucaggaugauac

SEQ ID NO: 2681151 - RNA, 17 nt, Escherichia coli CFT073
aauaccagccuucuuca

SEQ ID NO: 2681152 - RNA, 13 nt, Escherichia coli CFT073
aauaccaucggca

SEQ ID NO: 2681153 - RNA, 18 nt, Escherichia coli CFT073
aauaccaucggcagcgcc

SEQ ID NO: 2681154 - RNA, 19 nt, Escherichia coli CFT073
aauaccaucggcagcgcca

SEQ ID NO: 2681155 - RNA, 19 nt, Escherichia coli CFT073
aauacccagacuuuucaga

SEQ ID NO: 2681156 - RNA, 20 nt, Escherichia coli CFT073
aauacccagacuuuucagau

SEQ ID NO: 2681157 - RNA, 19 nt, Escherichia coli CFT073
aauacccagcaaugccagg

SEQ ID NO: 2681158 - RNA, 23 nt, Escherichia coli CFT073
aauaccccagcggcaaccagcag

SEQ ID NO: 2681159 - RNA, 14 nt, Escherichia coli CFT073
aauacccgccagaa

SEQ ID NO: 2681160 - RNA, 17 nt, Escherichia coli CFT073
aauacccgcgccggccc

SEQ ID NO: 2681161 - RNA, 15 nt, Escherichia coli CFT073
aauacccugacccag

SEQ ID NO: 2681162 - RNA, 15 nt, Escherichia coli CFT073
aauaccgacaucacg

SEQ ID NO: 2681163 - RNA, 14 nt, Escherichia coli CFT073
aauaccgauaagua

SEQ ID NO: 2681164 - RNA, 22 nt, Escherichia coli CFT073
aauaccgcgagauauccacauu

SEQ ID NO: 2681165 - RNA, 16 nt, Escherichia coli CFT073
aauaccggcauguuua

SEQ ID NO: 2681166 - RNA, 23 nt, Escherichia coli CFT073
aauaccggcauguuuaauucugc

SEQ ID NO: 2681167 - RNA, 17 nt, Escherichia coli CFT073
aauaccguaugauguau

SEQ ID NO: 2681168 - RNA, 21 nt, Escherichia coli CFT073
aauaccguuccaacgccacca

SEQ ID NO: 2681169 - RNA, 22 nt, Escherichia coli CFT073
aauaccguuccaacgccaccac

SEQ ID NO: 2681170 - RNA, 14 nt, Escherichia coli CFT073
aauaccugaaacuc

SEQ ID NO: 2681171 - RNA, 16 nt, Escherichia coli CFT073
aauaccugacgcaacu

SEQ ID NO: 2681172 - RNA, 17 nt, Escherichia coli CFT073
aauaccugacgcaacug

SEQ ID NO: 2681173 - RNA, 22 nt, Escherichia coli CFT073
aauaccugacgcaacugcgcuu

SEQ ID NO: 2681174 - RNA, 23 nt, Escherichia coli CFT073
aauaccuggagcaguauugauag

SEQ ID NO: 2681175 - RNA, 14 nt, Escherichia coli CFT073
aauaccuucuuccu

SEQ ID NO: 2681176 - RNA, 18 nt, Escherichia coli CFT073
aauacgacauaaucgccg

SEQ ID NO: 2681177 - RNA, 20 nt, Escherichia coli CFT073
aauacgacugauaucugccc

SEQ ID NO: 2681178 - RNA, 22 nt, Escherichia coli CFT073
aauacgagcgcguaguucagga

SEQ ID NO: 2681179 - RNA, 20 nt, Escherichia coli CFT073
aauacgauccugagcagcaa

SEQ ID NO: 2681180 - RNA, 20 nt, Escherichia coli CFT073
aauacgcaucauauucauag

SEQ ID NO: 2681181 - RNA, 22 nt, Escherichia coli CFT073
aauacgcaucauauucauagca

SEQ ID NO: 2681182 - RNA, 22 nt, Escherichia coli CFT073
aauacgccggguuaaugccgga

SEQ ID NO: 2681183 - RNA, 17 nt, Escherichia coli CFT073
aauacgcuaaauaaaca

SEQ ID NO: 2681184 - RNA, 18 nt, Escherichia coli CFT073
aauacgcucgaacagcug

SEQ ID NO: 2681185 - RNA, 21 nt, Escherichia coli CFT073
aauacgucuuuaggaacgcgc

SEQ ID NO: 2681186 - RNA, 20 nt, Escherichia coli CFT073
aauacguugcaaauauucca

SEQ ID NO: 2681187 - RNA, 19 nt, Escherichia coli CFT073
aauacguuucagccacgcg

SEQ ID NO: 2681188 - RNA, 19 nt, Escherichia coli CFT073
aauacuaaaaagcgcgucc

SEQ ID NO: 2681189 - RNA, 17 nt, Escherichia coli CFT073
aauacuaaauaugaaaa

SEQ ID NO: 2681190 - RNA, 17 nt, Escherichia coli CFT073
aauacucauuaauuuca

SEQ ID NO: 2681191 - RNA, 20 nt, Escherichia coli CFT073
aauacucauuaauuucaggc

SEQ ID NO: 2681192 - RNA, 21 nt, Escherichia coli CFT073
aauacucgucccguccuucau

SEQ ID NO: 2681193 - RNA, 14 nt, Escherichia coli CFT073
aauacugacuggcg

SEQ ID NO: 2681194 - RNA, 15 nt, Escherichia coli CFT073
aauacugaucaucau

SEQ ID NO: 2681195 - RNA, 20 nt, Escherichia coli CFT073
aauacugccgagaaugacga

SEQ ID NO: 2681196 - RNA, 21 nt, Escherichia coli CFT073
aauagaaaguugccagauaaa

SEQ ID NO: 2681197 - RNA, 13 nt, Escherichia coli CFT073
aauagaaauuuag

SEQ ID NO: 2681198 - RNA, 20 nt, Escherichia coli CFT073
aauagaaccuaagaaccaga

SEQ ID NO: 2681199 - RNA, 15 nt, Escherichia coli CFT073
aauagaacguuuauc

SEQ ID NO: 2681200 - RNA, 13 nt, Escherichia coli CFT073
aauagacugcacu

SEQ ID NO: 2681201 - RNA, 15 nt, Escherichia coli CFT073
aauagaguguuccuc

SEQ ID NO: 2681202 - RNA, 23 nt, Escherichia coli CFT073
aauagauaauuuugaaauaaaau

SEQ ID NO: 2681203 - RNA, 14 nt, Escherichia coli CFT073
aauagauauucauc

SEQ ID NO: 2681204 - RNA, 17 nt, Escherichia coli CFT073
aauagauuaugaaauuc

SEQ ID NO: 2681205 - RNA, 14 nt, Escherichia coli CFT073
aauagauuuucaga

SEQ ID NO: 2681206 - RNA, 17 nt, Escherichia coli CFT073
aauagauuuucagaaua

SEQ ID NO: 2681207 - RNA, 13 nt, Escherichia coli CFT073
aauagcaaaguag

SEQ ID NO: 2681208 - RNA, 14 nt, Escherichia coli CFT073
aauagcaauguuuu

SEQ ID NO: 2681209 - RNA, 21 nt, Escherichia coli CFT073
aauagccagcagagcaaaaau

SEQ ID NO: 2681210 - RNA, 15 nt, Escherichia coli CFT073
aauagccaggcagau

SEQ ID NO: 2681211 - RNA, 21 nt, Escherichia coli CFT073
aauagcccgauggcaucacca

SEQ ID NO: 2681212 - RNA, 22 nt, Escherichia coli CFT073
aauagcccgauggcaucaccau

SEQ ID NO: 2681213 - RNA, 22 nt, Escherichia coli CFT073
aauagccgccauacggaaaauc

SEQ ID NO: 2681214 - RNA, 16 nt, Escherichia coli CFT073
aauagcgaacagacaa

SEQ ID NO: 2681215 - RNA, 18 nt, Escherichia coli CFT073
aauagcgcagcggucgcu

SEQ ID NO: 2681216 - RNA, 18 nt, Escherichia coli CFT073
aauagcggaaaucuccag

SEQ ID NO: 2681217 - RNA, 20 nt, Escherichia coli CFT073
aauagcggaaaucuccagau

SEQ ID NO: 2681218 - RNA, 19 nt, Escherichia coli CFT073
aauagcgucuacuaacgcu

SEQ ID NO: 2681219 - RNA, 13 nt, Escherichia coli CFT073
aauagcucaauga

SEQ ID NO: 2681220 - RNA, 13 nt, Escherichia coli CFT073
aauagcucugcua

SEQ ID NO: 2681221 - RNA, 14 nt, Escherichia coli CFT073
aauagcugccagcc

SEQ ID NO: 2681222 - RNA, 19 nt, Escherichia coli CFT073
aauagcuuaacuacugcuu

SEQ ID NO: 2681223 - RNA, 13 nt, Escherichia coli CFT073
aauagcuuuaccc

SEQ ID NO: 2681224 - RNA, 18 nt, Escherichia coli CFT073
aauaguacacagacgaag

SEQ ID NO: 2681225 - RNA, 20 nt, Escherichia coli CFT073
aauaguagguuguacccaac

SEQ ID NO: 2681226 - RNA, 20 nt, Escherichia coli CFT073
aauaguauccaacugugaau

SEQ ID NO: 2681227 - RNA, 23 nt, Escherichia coli CFT073
aauagucaagccaccgccgcuac

SEQ ID NO: 2681228 - RNA, 14 nt, Escherichia coli CFT073
aauagucaucacuu

SEQ ID NO: 2681229 - RNA, 13 nt, Escherichia coli CFT073
aauagucgccagc

SEQ ID NO: 2681230 - RNA, 20 nt, Escherichia coli CFT073
aauagucgccagcucugcgc

SEQ ID NO: 2681231 - RNA, 19 nt, Escherichia coli CFT073
aauagucguccauuauuuu

SEQ ID NO: 2681232 - RNA, 14 nt, Escherichia coli CFT073
aauagucgugcggu

SEQ ID NO: 2681233 - RNA, 21 nt, Escherichia coli CFT073
aauagugacagauuugauuau

SEQ ID NO: 2681234 - RNA, 17 nt, Escherichia coli CFT073
aauagugccgcaccagc

SEQ ID NO: 2681235 - RNA, 22 nt, Escherichia coli CFT073
aauagugguaccaggaucagca

SEQ ID NO: 2681236 - RNA, 23 nt, Escherichia coli CFT073
aauagugguaccaggaucagcaa

SEQ ID NO: 2681237 - RNA, 20 nt, Escherichia coli CFT073
aauaguuacgaaaaggauaa

SEQ ID NO: 2681238 - RNA, 23 nt, Escherichia coli CFT073
aauaguucuggucuggcccacga

SEQ ID NO: 2681239 - RNA, 21 nt, Escherichia coli CFT073
aauaguuucaaugccuuucuu

SEQ ID NO: 2681240 - RNA, 18 nt, Escherichia coli CFT073
aauauaaagaaugaaauu

SEQ ID NO: 2681241 - RNA, 19 nt, Escherichia coli CFT073
aauauaaguacuaaauaau

SEQ ID NO: 2681242 - RNA, 13 nt, Escherichia coli CFT073
aauauacuucugg

SEQ ID NO: 2681243 - RNA, 14 nt, Escherichia coli CFT073
aauauagucgccca

SEQ ID NO: 2681244 - RNA, 22 nt, Escherichia coli CFT073
aauauauuccccggucagcagc

SEQ ID NO: 2681245 - RNA, 11 nt, Escherichia coli CFT073
aauaucaacaa

SEQ ID NO: 2681246 - RNA, 13 nt, Escherichia coli CFT073
aauaucaccaaua

SEQ ID NO: 2681247 - RNA, 21 nt, Escherichia coli CFT073
aauaucacucggggcuuuucu

SEQ ID NO: 2681248 - RNA, 11 nt, Escherichia coli CFT073
aauaucaucau

SEQ ID NO: 2681249 - RNA, 12 nt, Escherichia coli CFT073
aauaucaucauc

SEQ ID NO: 2681250 - RNA, 22 nt, Escherichia coli CFT073
aauauccagcagguuuugacga

SEQ ID NO: 2681251 - RNA, 17 nt, Escherichia coli CFT073
aauauccauguaccaga

SEQ ID NO: 2681252 - RNA, 20 nt, Escherichia coli CFT073
aauauccauguaccagacug

SEQ ID NO: 2681253 - RNA, 18 nt, Escherichia coli CFT073
aauaucccauuucuccac

SEQ ID NO: 2681254 - RNA, 16 nt, Escherichia coli CFT073
aauauccgguuucuga

SEQ ID NO: 2681255 - RNA, 14 nt, Escherichia coli CFT073
aauauccugaccuu

SEQ ID NO: 2681256 - RNA, 16 nt, Escherichia coli CFT073
aauauccuugcagaua

SEQ ID NO: 2681257 - RNA, 19 nt, Escherichia coli CFT073
aauaucgaauggcguuaac

SEQ ID NO: 2681258 - RNA, 14 nt, Escherichia coli CFT073
aauaucgacauuca

SEQ ID NO: 2681259 - RNA, 16 nt, Escherichia coli CFT073
aauaucgacauucaau

SEQ ID NO: 2681260 - RNA, 18 nt, Escherichia coli CFT073
aauaucgcggcacagaaa

SEQ ID NO: 2681261 - RNA, 19 nt, Escherichia coli CFT073
aauaucgcggcacagaaac

SEQ ID NO: 2681262 - RNA, 16 nt, Escherichia coli CFT073
aauaucggccugggcc

SEQ ID NO: 2681263 - RNA, 15 nt, Escherichia coli CFT073
aauaucggcgaagug

SEQ ID NO: 2681264 - RNA, 22 nt, Escherichia coli CFT073
aauaucguauccgguuuuccag

SEQ ID NO: 2681265 - RNA, 17 nt, Escherichia coli CFT073
aauaucguuguuggcuu

SEQ ID NO: 2681266 - RNA, 22 nt, Escherichia coli CFT073
aauaucguuguuggcuuccugc

SEQ ID NO: 2681267 - RNA, 19 nt, Escherichia coli CFT073
aauaucugccggaagacac

SEQ ID NO: 2681268 - RNA, 16 nt, Escherichia coli CFT073
aauaucuuccuggcgu

SEQ ID NO: 2681269 - RNA, 19 nt, Escherichia coli CFT073
aauaucuuucuaccauccg

SEQ ID NO: 2681270 - RNA, 16 nt, Escherichia coli CFT073
aauaucuuucuugcgc

SEQ ID NO: 2681271 - RNA, 21 nt, Escherichia coli CFT073
aauaugacccacgccuuuuuc

SEQ ID NO: 2681272 - RNA, 23 nt, Escherichia coli CFT073
aauaugacccacgccuuuuucuc

SEQ ID NO: 2681273 - RNA, 21 nt, Escherichia coli CFT073
aauaugcaauucacacaguga

SEQ ID NO: 2681274 - RNA, 15 nt, Escherichia coli CFT073
aauaugcauaaaccg

SEQ ID NO: 2681275 - RNA, 19 nt, Escherichia coli CFT073
aauaugcgccacuccacug

SEQ ID NO: 2681276 - RNA, 23 nt, Escherichia coli CFT073
aauaugcggugccauuaaaccaa

SEQ ID NO: 2681277 - RNA, 16 nt, Escherichia coli CFT073
aauaugcuuuuauuca

SEQ ID NO: 2681278 - RNA, 17 nt, Escherichia coli CFT073
aauaugguuauuaccaa

SEQ ID NO: 2681279 - RNA, 14 nt, Escherichia coli CFT073
aauaugucaguggu

SEQ ID NO: 2681280 - RNA, 14 nt, Escherichia coli CFT073
aauaugugcgccac

SEQ ID NO: 2681281 - RNA, 19 nt, Escherichia coli CFT073
aauauguugauaaucaaca

SEQ ID NO: 2681282 - RNA, 14 nt, Escherichia coli CFT073
aauauguuuuuaaa

SEQ ID NO: 2681283 - RNA, 22 nt, Escherichia coli CFT073
aauauuaaaccacccgcggcga

SEQ ID NO: 2681284 - RNA, 18 nt, Escherichia coli CFT073
aauauuauggcugucaug

SEQ ID NO: 2681285 - RNA, 15 nt, Escherichia coli CFT073
aauauucagccacug

SEQ ID NO: 2681286 - RNA, 19 nt, Escherichia coli CFT073
aauauuccagucagcacca

SEQ ID NO: 2681287 - RNA, 23 nt, Escherichia coli CFT073
aauauucuuuugcagcagcguga

SEQ ID NO: 2681288 - RNA, 19 nt, Escherichia coli CFT073
aauauugagcaggaugaca

SEQ ID NO: 2681289 - RNA, 21 nt, Escherichia coli CFT073
aauauugagcaggaugacaua

SEQ ID NO: 2681290 - RNA, 19 nt, Escherichia coli CFT073
aauauugaugcacaccauc

SEQ ID NO: 2681291 - RNA, 12 nt, Escherichia coli CFT073
aauauugcugcu

SEQ ID NO: 2681292 - RNA, 17 nt, Escherichia coli CFT073
aauauugucucccgacu

SEQ ID NO: 2681293 - RNA, 17 nt, Escherichia coli CFT073
aauauuuaucuucccag

SEQ ID NO: 2681294 - RNA, 12 nt, Escherichia coli CFT073
aauauuucauuc

SEQ ID NO: 2681295 - RNA, 22 nt, Escherichia coli CFT073
aauauuucauucuccauuucaa

SEQ ID NO: 2681296 - RNA, 22 nt, Escherichia coli CFT073
aauauuucuuuaucaccaauga

SEQ ID NO: 2681297 - RNA, 23 nt, Escherichia coli CFT073
aauauuucuuuaugggcauuucu

SEQ ID NO: 2681298 - RNA, 17 nt, Escherichia coli CFT073
aauauuuuucgucaguu

SEQ ID NO: 2681299 - RNA, 14 nt, Escherichia coli CFT073
aaucaaagucagau

SEQ ID NO: 2681300 - RNA, 15 nt, Escherichia coli CFT073
aaucaaauaaauaau

SEQ ID NO: 2681301 - RNA, 14 nt, Escherichia coli CFT073
aaucaaaucacgau

SEQ ID NO: 2681302 - RNA, 15 nt, Escherichia coli CFT073
aaucaacaaaagugg

SEQ ID NO: 2681303 - RNA, 14 nt, Escherichia coli CFT073
aaucaacaaaccaa

SEQ ID NO: 2681304 - RNA, 20 nt, Escherichia coli CFT073
aaucaacacaccgcccugcu

SEQ ID NO: 2681305 - RNA, 15 nt, Escherichia coli CFT073
aaucaacagauaaau

SEQ ID NO: 2681306 - RNA, 21 nt, Escherichia coli CFT073
aaucaacagauaaauggcaca

SEQ ID NO: 2681307 - RNA, 12 nt, Escherichia coli CFT073
aaucaacaggaa

SEQ ID NO: 2681308 - RNA, 13 nt, Escherichia coli CFT073
aaucaacaggaac

SEQ ID NO: 2681309 - RNA, 14 nt, Escherichia coli CFT073
aaucaacaggaaca

SEQ ID NO: 2681310 - RNA, 17 nt, Escherichia coli CFT073
aaucaacauaaugccga

SEQ ID NO: 2681311 - RNA, 14 nt, Escherichia coli CFT073
aaucaaccauuaaa

SEQ ID NO: 2681312 - RNA, 19 nt, Escherichia coli CFT073
aaucaacgccaccaucacu

SEQ ID NO: 2681313 - RNA, 21 nt, Escherichia coli CFT073
aaucaacgccaccaucacuau

SEQ ID NO: 2681314 - RNA, 21 nt, Escherichia coli CFT073
aaucaacgcgaaaaugcccca

SEQ ID NO: 2681315 - RNA, 19 nt, Escherichia coli CFT073
aaucaacgcgccgacgaau

SEQ ID NO: 2681316 - RNA, 19 nt, Escherichia coli CFT073
aaucaacgguugcaaugca

SEQ ID NO: 2681317 - RNA, 17 nt, Escherichia coli CFT073
aaucaagaccucaucgu

SEQ ID NO: 2681318 - RNA, 22 nt, Escherichia coli CFT073
aaucaagcgccgaguaaaaaaa

SEQ ID NO: 2681319 - RNA, 15 nt, Escherichia coli CFT073
aaucaagcgccgcca

SEQ ID NO: 2681320 - RNA, 22 nt, Escherichia coli CFT073
aaucaagguaauugcuuucuuc

SEQ ID NO: 2681321 - RNA, 19 nt, Escherichia coli CFT073
aaucaagguugcacaacca

SEQ ID NO: 2681322 - RNA, 15 nt, Escherichia coli CFT073
aaucaauauccacug

SEQ ID NO: 2681323 - RNA, 12 nt, Escherichia coli CFT073
aaucaaugccac

SEQ ID NO: 2681324 - RNA, 17 nt, Escherichia coli CFT073
aaucaaugccaccagaa

SEQ ID NO: 2681325 - RNA, 15 nt, Escherichia coli CFT073
aaucaauggcccauu

SEQ ID NO: 2681326 - RNA, 21 nt, Escherichia coli CFT073
aaucaauggcccauucagcau

SEQ ID NO: 2681327 - RNA, 12 nt, Escherichia coli CFT073
aaucaauucucg

SEQ ID NO: 2681328 - RNA, 20 nt, Escherichia coli CFT073
aaucacaacacgaauaccaa

SEQ ID NO: 2681329 - RNA, 15 nt, Escherichia coli CFT073
aaucacaauccgcuc

SEQ ID NO: 2681330 - RNA, 11 nt, Escherichia coli CFT073
aaucacacuga

SEQ ID NO: 2681331 - RNA, 22 nt, Escherichia coli CFT073
aaucacaggcgcgaugcuacua

SEQ ID NO: 2681332 - RNA, 17 nt, Escherichia coli CFT073
aaucacagggcauugcu

SEQ ID NO: 2681333 - RNA, 16 nt, Escherichia coli CFT073
aaucacaucaccauaa

SEQ ID NO: 2681334 - RNA, 17 nt, Escherichia coli CFT073
aaucaccaaaccaacaa

SEQ ID NO: 2681335 - RNA, 18 nt, Escherichia coli CFT073
aaucaccaaaccaacaag

SEQ ID NO: 2681336 - RNA, 20 nt, Escherichia coli CFT073
aaucaccaaaccaacaagca

SEQ ID NO: 2681337 - RNA, 23 nt, Escherichia coli CFT073
aaucaccaccagcggaauaucag

SEQ ID NO: 2681338 - RNA, 16 nt, Escherichia coli CFT073
aaucaccagaggaugc

SEQ ID NO: 2681339 - RNA, 14 nt, Escherichia coli CFT073
aaucaccaucagca

SEQ ID NO: 2681340 - RNA, 18 nt, Escherichia coli CFT073
aaucaccaucagcagcaa

SEQ ID NO: 2681341 - RNA, 22 nt, Escherichia coli CFT073
aaucaccccgagcgaauaaacc

SEQ ID NO: 2681342 - RNA, 15 nt, Escherichia coli CFT073
aaucaccgccaacaa

SEQ ID NO: 2681343 - RNA, 22 nt, Escherichia coli CFT073
aaucaccgcuucacucccugcc

SEQ ID NO: 2681344 - RNA, 19 nt, Escherichia coli CFT073
aaucaccucaucaccacag

SEQ ID NO: 2681345 - RNA, 15 nt, Escherichia coli CFT073
aaucaccucuuugua

SEQ ID NO: 2681346 - RNA, 19 nt, Escherichia coli CFT073
aaucaccugaccgagccag

SEQ ID NO: 2681347 - RNA, 13 nt, Escherichia coli CFT073
aaucaccugccgg

SEQ ID NO: 2681348 - RNA, 20 nt, Escherichia coli CFT073
aaucaccuuacaucaaaaaa

SEQ ID NO: 2681349 - RNA, 20 nt, Escherichia coli CFT073
aaucacgauggcgggccugg

SEQ ID NO: 2681350 - RNA, 23 nt, Escherichia coli CFT073
aaucacgcacucgacgcagcaga

SEQ ID NO: 2681351 - RNA, 23 nt, Escherichia coli CFT073
aaucacgcucaacuuccugaauc

SEQ ID NO: 2681352 - RNA, 22 nt, Escherichia coli CFT073
aaucacuauuaaagaaaguaau

SEQ ID NO: 2681353 - RNA, 13 nt, Escherichia coli CFT073
aaucacucaucau

SEQ ID NO: 2681354 - RNA, 15 nt, Escherichia coli CFT073
aaucacucuuccccg

SEQ ID NO: 2681355 - RNA, 15 nt, Escherichia coli CFT073
aaucacugccaccag

SEQ ID NO: 2681356 - RNA, 23 nt, Escherichia coli CFT073
aaucacugccaccaggaacgcgc

SEQ ID NO: 2681357 - RNA, 15 nt, Escherichia coli CFT073
aaucacugccagaau

SEQ ID NO: 2681358 - RNA, 14 nt, Escherichia coli CFT073
aaucacuucaucgc

SEQ ID NO: 2681359 - RNA, 17 nt, Escherichia coli CFT073
aaucacuucaucgccgc

SEQ ID NO: 2681360 - RNA, 19 nt, Escherichia coli CFT073
aaucacuugcgcauaauaa

SEQ ID NO: 2681361 - RNA, 23 nt, Escherichia coli CFT073
aaucagaccgauagcagcccaga

SEQ ID NO: 2681362 - RNA, 18 nt, Escherichia coli CFT073
aaucagacuuugaauaaa

SEQ ID NO: 2681363 - RNA, 14 nt, Escherichia coli CFT073
aaucagcacaauaa

SEQ ID NO: 2681364 - RNA, 19 nt, Escherichia coli CFT073
aaucagcacagagauaaaa

SEQ ID NO: 2681365 - RNA, 23 nt, Escherichia coli CFT073
aaucagcacuacugccagauucu

SEQ ID NO: 2681366 - RNA, 20 nt, Escherichia coli CFT073
aaucagcagauaucccgcca

SEQ ID NO: 2681367 - RNA, 22 nt, Escherichia coli CFT073
aaucagcagcguucccagccag

SEQ ID NO: 2681368 - RNA, 16 nt, Escherichia coli CFT073
aaucagcauacuccag

SEQ ID NO: 2681369 - RNA, 19 nt, Escherichia coli CFT073
aaucagcauacuccagccg

SEQ ID NO: 2681370 - RNA, 20 nt, Escherichia coli CFT073
aaucagcaucucauccauca

SEQ ID NO: 2681371 - RNA, 18 nt, Escherichia coli CFT073
aaucagccguuucaccac

SEQ ID NO: 2681372 - RNA, 20 nt, Escherichia coli CFT073
aaucagccuuaaucuucacu

SEQ ID NO: 2681373 - RNA, 22 nt, Escherichia coli CFT073
aaucagcgaauggguuguacuu

SEQ ID NO: 2681374 - RNA, 19 nt, Escherichia coli CFT073
aaucagcgagauaaugcgc

SEQ ID NO: 2681375 - RNA, 14 nt, Escherichia coli CFT073
aaucagcgcggaac

SEQ ID NO: 2681376 - RNA, 16 nt, Escherichia coli CFT073
aaucagcggcaguucg

SEQ ID NO: 2681377 - RNA, 21 nt, Escherichia coli CFT073
aaucagcgucgcguuuuucuc

SEQ ID NO: 2681378 - RNA, 16 nt, Escherichia coli CFT073
aaucagcguuucgcca

SEQ ID NO: 2681379 - RNA, 14 nt, Escherichia coli CFT073
aaucagcuuaucca

SEQ ID NO: 2681380 - RNA, 19 nt, Escherichia coli CFT073
aaucagcuuccuugcugau

SEQ ID NO: 2681381 - RNA, 17 nt, Escherichia coli CFT073
aaucagcuuuuccauau

SEQ ID NO: 2681382 - RNA, 19 nt, Escherichia coli CFT073
aaucagcuuuuccauauca

SEQ ID NO: 2681383 - RNA, 20 nt, Escherichia coli CFT073
aaucaggcggcucaccugca

SEQ ID NO: 2681384 - RNA, 20 nt, Escherichia coli CFT073
aaucagucccugaaucgcca

SEQ ID NO: 2681385 - RNA, 21 nt, Escherichia coli CFT073
aaucaguucguugaucaacuc

SEQ ID NO: 2681386 - RNA, 13 nt, Escherichia coli CFT073
aaucaguuuauca

SEQ ID NO: 2681387 - RNA, 21 nt, Escherichia coli CFT073
aaucauaauuauaauaaauau

SEQ ID NO: 2681388 - RNA, 15 nt, Escherichia coli CFT073
aaucaucaagcacuu

SEQ ID NO: 2681389 - RNA, 20 nt, Escherichia coli CFT073
aaucaucacgcgguuacgca

SEQ ID NO: 2681390 - RNA, 13 nt, Escherichia coli CFT073
aaucaucaucagc

SEQ ID NO: 2681391 - RNA, 17 nt, Escherichia coli CFT073
aaucaucaugcuuaaau

SEQ ID NO: 2681392 - RNA, 23 nt, Escherichia coli CFT073
aaucaucauugcuguuuuacagc

SEQ ID NO: 2681393 - RNA, 22 nt, Escherichia coli CFT073
aaucauccaggcuuuaaacccg

SEQ ID NO: 2681394 - RNA, 18 nt, Escherichia coli CFT073
aaucaucgacauugacca

SEQ ID NO: 2681395 - RNA, 13 nt, Escherichia coli CFT073
aaucaucgccuua

SEQ ID NO: 2681396 - RNA, 20 nt, Escherichia coli CFT073
aaucaucgccuuaugcugcu

SEQ ID NO: 2681397 - RNA, 23 nt, Escherichia coli CFT073
aaucaucggcaucuucuucuggc

SEQ ID NO: 2681398 - RNA, 23 nt, Escherichia coli CFT073
aaucaucugccgguuccagcuuc

SEQ ID NO: 2681399 - RNA, 11 nt, Escherichia coli CFT073
aaucaugacgc

SEQ ID NO: 2681400 - RNA, 17 nt, Escherichia coli CFT073
aaucaugccaaaaauaa

SEQ ID NO: 2681401 - RNA, 23 nt, Escherichia coli CFT073
aaucaugcuccuguaauggcugg

SEQ ID NO: 2681402 - RNA, 18 nt, Escherichia coli CFT073
aaucauggcguuuuuccc

SEQ ID NO: 2681403 - RNA, 15 nt, Escherichia coli CFT073
aaucauucgcccgcc

SEQ ID NO: 2681404 - RNA, 20 nt, Escherichia coli CFT073
aaucauucgcccgccgagaa

SEQ ID NO: 2681405 - RNA, 14 nt, Escherichia coli CFT073
aaucauugauaaua

SEQ ID NO: 2681406 - RNA, 15 nt, Escherichia coli CFT073
aaucauugauaauaa

SEQ ID NO: 2681407 - RNA, 17 nt, Escherichia coli CFT073
aaucauuguuuucauua

SEQ ID NO: 2681408 - RNA, 23 nt, Escherichia coli CFT073
aaucauuuccagacacaacaaua

SEQ ID NO: 2681409 - RNA, 15 nt, Escherichia coli CFT073
aauccaaacauggca

SEQ ID NO: 2681410 - RNA, 20 nt, Escherichia coli CFT073
aauccaacauagcuaaaaau

SEQ ID NO: 2681411 - RNA, 22 nt, Escherichia coli CFT073
aauccaacauagcuaaaaauaa

SEQ ID NO: 2681412 - RNA, 21 nt, Escherichia coli CFT073
aauccaauaaaaaucagauau

SEQ ID NO: 2681413 - RNA, 16 nt, Escherichia coli CFT073
aauccacguuccagau

SEQ ID NO: 2681414 - RNA, 22 nt, Escherichia coli CFT073
aauccacguuccuggaaccagu

SEQ ID NO: 2681415 - RNA, 23 nt, Escherichia coli CFT073
aauccacguuccuggaaccagug

SEQ ID NO: 2681416 - RNA, 22 nt, Escherichia coli CFT073
aauccacugguguaacuuugua

SEQ ID NO: 2681417 - RNA, 12 nt, Escherichia coli CFT073
aauccagaacac

SEQ ID NO: 2681418 - RNA, 15 nt, Escherichia coli CFT073
aauccagacugcgca

SEQ ID NO: 2681419 - RNA, 21 nt, Escherichia coli CFT073
aauccagauccugauccugca

SEQ ID NO: 2681420 - RNA, 17 nt, Escherichia coli CFT073
aauccagcaagcugugc

SEQ ID NO: 2681421 - RNA, 13 nt, Escherichia coli CFT073
aauccagcaccac

SEQ ID NO: 2681422 - RNA, 15 nt, Escherichia coli CFT073
aauccagcagaauaa

SEQ ID NO: 2681423 - RNA, 18 nt, Escherichia coli CFT073
aauccagcagaauaacau

SEQ ID NO: 2681424 - RNA, 22 nt, Escherichia coli CFT073
aauccagccccaccagcaaaaa

SEQ ID NO: 2681425 - RNA, 23 nt, Escherichia coli CFT073
aauccagccgcccagcgaaccgc

SEQ ID NO: 2681426 - RNA, 21 nt, Escherichia coli CFT073
aauccagcuaaccauccacau

SEQ ID NO: 2681427 - RNA, 22 nt, Escherichia coli CFT073
aauccagggguuguuauuuccg

SEQ ID NO: 2681428 - RNA, 21 nt, Escherichia coli CFT073
aauccaguaccaggcaauaaa

SEQ ID NO: 2681429 - RNA, 14 nt, Escherichia coli CFT073
aauccagucuuucg

SEQ ID NO: 2681430 - RNA, 20 nt, Escherichia coli CFT073
aauccaguugcguaauauca

SEQ ID NO: 2681431 - RNA, 15 nt, Escherichia coli CFT073
aauccauaaccauaa

SEQ ID NO: 2681432 - RNA, 16 nt, Escherichia coli CFT073
aauccauaccagcaca

SEQ ID NO: 2681433 - RNA, 17 nt, Escherichia coli CFT073
aauccauaccagcacau

SEQ ID NO: 2681434 - RNA, 22 nt, Escherichia coli CFT073
aauccauaccagcacauaacuc

SEQ ID NO: 2681435 - RNA, 12 nt, Escherichia coli CFT073
aauccauucauc

SEQ ID NO: 2681436 - RNA, 20 nt, Escherichia coli CFT073
aaucccaguacuguacaaca

SEQ ID NO: 2681437 - RNA, 13 nt, Escherichia coli CFT073
aaucccaucagac

SEQ ID NO: 2681438 - RNA, 17 nt, Escherichia coli CFT073
aaucccaucagacggga

SEQ ID NO: 2681439 - RNA, 13 nt, Escherichia coli CFT073
aauccccacugca

SEQ ID NO: 2681440 - RNA, 15 nt, Escherichia coli CFT073
aaucccccacuuuua

SEQ ID NO: 2681441 - RNA, 23 nt, Escherichia coli CFT073
aauccccucaauaauaauccgcu

SEQ ID NO: 2681442 - RNA, 15 nt, Escherichia coli CFT073
aaucccgccaucggc

SEQ ID NO: 2681443 - RNA, 13 nt, Escherichia coli CFT073
aaucccgccgcuu

SEQ ID NO: 2681444 - RNA, 14 nt, Escherichia coli CFT073
aaucccggcaccaa

SEQ ID NO: 2681445 - RNA, 19 nt, Escherichia coli CFT073
aaucccggcaccaaucacc

SEQ ID NO: 2681446 - RNA, 15 nt, Escherichia coli CFT073
aaucccggcgcagcg

SEQ ID NO: 2681447 - RNA, 22 nt, Escherichia coli CFT073
aaucccggcgcagcgcgcgaau

SEQ ID NO: 2681448 - RNA, 19 nt, Escherichia coli CFT073
aaucccguaggauuucuuc

SEQ ID NO: 2681449 - RNA, 14 nt, Escherichia coli CFT073
aaucccguugccac

SEQ ID NO: 2681450 - RNA, 23 nt, Escherichia coli CFT073
aaucccuuccaccgagccaaacu

SEQ ID NO: 2681451 - RNA, 22 nt, Escherichia coli CFT073
aaucccuuccgcuuuuaacauc

SEQ ID NO: 2681452 - RNA, 24 nt, Escherichia coli CFT073
aaucccuuccgcuuuuaacaucuu

SEQ ID NO: 2681453 - RNA, 12 nt, Escherichia coli CFT073
aaucccuucgac

SEQ ID NO: 2681454 - RNA, 18 nt, Escherichia coli CFT073
aaucccuugagugacaug

SEQ ID NO: 2681455 - RNA, 18 nt, Escherichia coli CFT073
aauccgaaguucauccau

SEQ ID NO: 2681456 - RNA, 13 nt, Escherichia coli CFT073
aauccgcaccaac

SEQ ID NO: 2681457 - RNA, 17 nt, Escherichia coli CFT073
aauccgcaccaacucca

SEQ ID NO: 2681458 - RNA, 12 nt, Escherichia coli CFT073
aauccgccaccg

SEQ ID NO: 2681459 - RNA, 17 nt, Escherichia coli CFT073
aauccgcccuaacaucg

SEQ ID NO: 2681460 - RNA, 12 nt, Escherichia coli CFT073
aauccgccgcca

SEQ ID NO: 2681461 - RNA, 17 nt, Escherichia coli CFT073
aauccgccgcuguggca

SEQ ID NO: 2681462 - RNA, 14 nt, Escherichia coli CFT073
aauccgcgauaacg

SEQ ID NO: 2681463 - RNA, 19 nt, Escherichia coli CFT073
aauccgcgauaacgcccca

SEQ ID NO: 2681464 - RNA, 14 nt, Escherichia coli CFT073
aauccgcucugccc

SEQ ID NO: 2681465 - RNA, 20 nt, Escherichia coli CFT073
aauccgcuggugcuuuaaau

SEQ ID NO: 2681466 - RNA, 14 nt, Escherichia coli CFT073
aauccggcagcgaa

SEQ ID NO: 2681467 - RNA, 15 nt, Escherichia coli CFT073
aauccggcagcgaac

SEQ ID NO: 2681468 - RNA, 17 nt, Escherichia coli CFT073
aauccggcagcgaaccg

SEQ ID NO: 2681469 - RNA, 18 nt, Escherichia coli CFT073
aauccggcgcucaucagg

SEQ ID NO: 2681470 - RNA, 18 nt, Escherichia coli CFT073
aauccgggcuaucaugcc

SEQ ID NO: 2681471 - RNA, 16 nt, Escherichia coli CFT073
aauccgggucuguaaa

SEQ ID NO: 2681472 - RNA, 23 nt, Escherichia coli CFT073
aauccggucccuucugccaccag

SEQ ID NO: 2681473 - RNA, 17 nt, Escherichia coli CFT073
aauccgguucauggucg

SEQ ID NO: 2681474 - RNA, 20 nt, Escherichia coli CFT073
aauccguauuccugaaucag

SEQ ID NO: 2681475 - RNA, 21 nt, Escherichia coli CFT073
aauccguauuccugaaucagc

SEQ ID NO: 2681476 - RNA, 17 nt, Escherichia coli CFT073
aauccguuccucaccgu

SEQ ID NO: 2681477 - RNA, 22 nt, Escherichia coli CFT073
aauccguuccucaccguuuaau

SEQ ID NO: 2681478 - RNA, 16 nt, Escherichia coli CFT073
aauccucaacgccgca

SEQ ID NO: 2681479 - RNA, 18 nt, Escherichia coli CFT073
aauccugauggaagacau

SEQ ID NO: 2681480 - RNA, 15 nt, Escherichia coli CFT073
aauccugcauaccau

SEQ ID NO: 2681481 - RNA, 12 nt, Escherichia coli CFT073
aauccugccaac

SEQ ID NO: 2681482 - RNA, 19 nt, Escherichia coli CFT073
aauccugccagugcaaaaa

SEQ ID NO: 2681483 - RNA, 19 nt, Escherichia coli CFT073
aauccuggcagcaucagac

SEQ ID NO: 2681484 - RNA, 12 nt, Escherichia coli CFT073
aauccuguaucu

SEQ ID NO: 2681485 - RNA, 13 nt, Escherichia coli CFT073
aauccuuauauaa

SEQ ID NO: 2681486 - RNA, 15 nt, Escherichia coli CFT073
aauccuuauuuuuau

SEQ ID NO: 2681487 - RNA, 22 nt, Escherichia coli CFT073
aauccuuauuuuuauaacuaua

SEQ ID NO: 2681488 - RNA, 14 nt, Escherichia coli CFT073
aauccuucaucuuu

SEQ ID NO: 2681489 - RNA, 13 nt, Escherichia coli CFT073
aauccuuccccca

SEQ ID NO: 2681490 - RNA, 15 nt, Escherichia coli CFT073
aaucgaaaucaacau

SEQ ID NO: 2681491 - RNA, 17 nt, Escherichia coli CFT073
aaucgaaaucaacaugu

SEQ ID NO: 2681492 - RNA, 18 nt, Escherichia coli CFT073
aaucgaaaucaacauguu

SEQ ID NO: 2681493 - RNA, 21 nt, Escherichia coli CFT073
aaucgaaccaaacagcgccag

SEQ ID NO: 2681494 - RNA, 14 nt, Escherichia coli CFT073
aaucgaacuucccg

SEQ ID NO: 2681495 - RNA, 20 nt, Escherichia coli CFT073
aaucgacaaugugaaaaccc

SEQ ID NO: 2681496 - RNA, 12 nt, Escherichia coli CFT073
aaucgacaccag

SEQ ID NO: 2681497 - RNA, 16 nt, Escherichia coli CFT073
aaucgacgaggaaaau

SEQ ID NO: 2681498 - RNA, 21 nt, Escherichia coli CFT073
aaucgacgaggaaaaugauca

SEQ ID NO: 2681499 - RNA, 19 nt, Escherichia coli CFT073
aaucgacucugaaugccag

SEQ ID NO: 2681500 - RNA, 13 nt, Escherichia coli CFT073
aaucgagcaauaa

SEQ ID NO: 2681501 - RNA, 13 nt, Escherichia coli CFT073
aaucgauaacccc

SEQ ID NO: 2681502 - RNA, 13 nt, Escherichia coli CFT073
aaucgauuuagaa

SEQ ID NO: 2681503 - RNA, 16 nt, Escherichia coli CFT073
aaucgauuugaaucgu

SEQ ID NO: 2681504 - RNA, 18 nt, Escherichia coli CFT073
aaucgauuuucucaccau

SEQ ID NO: 2681505 - RNA, 21 nt, Escherichia coli CFT073
aaucgauuuucucaccauugg

SEQ ID NO: 2681506 - RNA, 13 nt, Escherichia coli CFT073
aaucgcaaauaug

SEQ ID NO: 2681507 - RNA, 20 nt, Escherichia coli CFT073
aaucgcaacgguucugcugc

SEQ ID NO: 2681508 - RNA, 23 nt, Escherichia coli CFT073
aaucgcacgauagcuaacugccu

SEQ ID NO: 2681509 - RNA, 19 nt, Escherichia coli CFT073
aaucgcacguugucagcaa

SEQ ID NO: 2681510 - RNA, 14 nt, Escherichia coli CFT073
aaucgcacugguaa

SEQ ID NO: 2681511 - RNA, 21 nt, Escherichia coli CFT073
aaucgcaggcgagaacaugcg

SEQ ID NO: 2681512 - RNA, 15 nt, Escherichia coli CFT073
aaucgccaagauuag

SEQ ID NO: 2681513 - RNA, 21 nt, Escherichia coli CFT073
aaucgccacgccaaaaagcgu

SEQ ID NO: 2681514 - RNA, 12 nt, Escherichia coli CFT073
aaucgccagacu

SEQ ID NO: 2681515 - RNA, 19 nt, Escherichia coli CFT073
aaucgccagacucaccagc

SEQ ID NO: 2681516 - RNA, 14 nt, Escherichia coli CFT073
aaucgccagauccg

SEQ ID NO: 2681517 - RNA, 21 nt, Escherichia coli CFT073
aaucgccagcaaaaucaccau

SEQ ID NO: 2681518 - RNA, 14 nt, Escherichia coli CFT073
aaucgccagcggca

SEQ ID NO: 2681519 - RNA, 15 nt, Escherichia coli CFT073
aaucgccagcggcag

SEQ ID NO: 2681520 - RNA, 18 nt, Escherichia coli CFT073
aaucgccagcggcagcuc

SEQ ID NO: 2681521 - RNA, 15 nt, Escherichia coli CFT073
aaucgcccucgccuu

SEQ ID NO: 2681522 - RNA, 17 nt, Escherichia coli CFT073
aaucgccgaaauuucgc

SEQ ID NO: 2681523 - RNA, 15 nt, Escherichia coli CFT073
aaucgccgaaccagu

SEQ ID NO: 2681524 - RNA, 20 nt, Escherichia coli CFT073
aaucgccgcauaauaucuuu

SEQ ID NO: 2681525 - RNA, 14 nt, Escherichia coli CFT073
aaucgccgcaucau

SEQ ID NO: 2681526 - RNA, 14 nt, Escherichia coli CFT073
aaucgccuccagcg

SEQ ID NO: 2681527 - RNA, 19 nt, Escherichia coli CFT073
aaucgccugaacaccagaa

SEQ ID NO: 2681528 - RNA, 21 nt, Escherichia coli CFT073
aaucgccugcugaauauugcc

SEQ ID NO: 2681529 - RNA, 23 nt, Escherichia coli CFT073
aaucgccuuacccugaccgucuu

SEQ ID NO: 2681530 - RNA, 13 nt, Escherichia coli CFT073
aaucgcgccccac

SEQ ID NO: 2681531 - RNA, 12 nt, Escherichia coli CFT073
aaucgcggcagc

SEQ ID NO: 2681532 - RNA, 18 nt, Escherichia coli CFT073
aaucgcgggcaacgucgc

SEQ ID NO: 2681533 - RNA, 16 nt, Escherichia coli CFT073
aaucgcuauuaacccg

SEQ ID NO: 2681534 - RNA, 16 nt, Escherichia coli CFT073
aaucgcucacaacaau

SEQ ID NO: 2681535 - RNA, 22 nt, Escherichia coli CFT073
aaucgcuucaucgcccacauca

SEQ ID NO: 2681536 - RNA, 23 nt, Escherichia coli CFT073
aaucgcuucgugauugcuuugau

SEQ ID NO: 2681537 - RNA, 22 nt, Escherichia coli CFT073
aaucgcuucugccggaauaauc

SEQ ID NO: 2681538 - RNA, 17 nt, Escherichia coli CFT073
aaucggacgugauucca

SEQ ID NO: 2681539 - RNA, 18 nt, Escherichia coli CFT073
aaucggaucaauccccag

SEQ ID NO: 2681540 - RNA, 17 nt, Escherichia coli CFT073
aaucggaugacccagcg

SEQ ID NO: 2681541 - RNA, 15 nt, Escherichia coli CFT073
aaucggcaacaucaa

SEQ ID NO: 2681542 - RNA, 14 nt, Escherichia coli CFT073
aaucggcaccgccg

SEQ ID NO: 2681543 - RNA, 16 nt, Escherichia coli CFT073
aaucggcaccgccgcc

SEQ ID NO: 2681544 - RNA, 18 nt, Escherichia coli CFT073
aaucggcaccgccgccaa

SEQ ID NO: 2681545 - RNA, 17 nt, Escherichia coli CFT073
aaucgggaaaaucugcg

SEQ ID NO: 2681546 - RNA, 20 nt, Escherichia coli CFT073
aaucgggaaaaucugcggga

SEQ ID NO: 2681547 - RNA, 15 nt, Escherichia coli CFT073
aaucgggauauugcc

SEQ ID NO: 2681548 - RNA, 14 nt, Escherichia coli CFT073
aaucgguaacgcuu

SEQ ID NO: 2681549 - RNA, 13 nt, Escherichia coli CFT073
aaucggugauaaa

SEQ ID NO: 2681550 - RNA, 14 nt, Escherichia coli CFT073
aaucggugauaaau

SEQ ID NO: 2681551 - RNA, 16 nt, Escherichia coli CFT073
aaucggugauaaaugc

SEQ ID NO: 2681552 - RNA, 20 nt, Escherichia coli CFT073
aaucgguggcggcaguugcc

SEQ ID NO: 2681553 - RNA, 15 nt, Escherichia coli CFT073
aaucgguuucguuau

SEQ ID NO: 2681554 - RNA, 21 nt, Escherichia coli CFT073
aaucgguuuguaagcgggcaa

SEQ ID NO: 2681555 - RNA, 15 nt, Escherichia coli CFT073
aaucguaaucagcau

SEQ ID NO: 2681556 - RNA, 16 nt, Escherichia coli CFT073
aaucguaccagcgaaa

SEQ ID NO: 2681557 - RNA, 18 nt, Escherichia coli CFT073
aaucguaccagcgaaacg

SEQ ID NO: 2681558 - RNA, 16 nt, Escherichia coli CFT073
aaucguaggccggaua

SEQ ID NO: 2681559 - RNA, 15 nt, Escherichia coli CFT073
aaucguaugaucauc

SEQ ID NO: 2681560 - RNA, 22 nt, Escherichia coli CFT073
aaucgucaaugccgucaccagc

SEQ ID NO: 2681561 - RNA, 19 nt, Escherichia coli CFT073
aaucgucagcaucucugca

SEQ ID NO: 2681562 - RNA, 19 nt, Escherichia coli CFT073
aaucgucagcucgcugcca

SEQ ID NO: 2681563 - RNA, 22 nt, Escherichia coli CFT073
aaucgucagcucgcugccaucg

SEQ ID NO: 2681564 - RNA, 18 nt, Escherichia coli CFT073
aaucgucaggaucagcca

SEQ ID NO: 2681565 - RNA, 21 nt, Escherichia coli CFT073
aaucgucaguagcgcaauaac

SEQ ID NO: 2681566 - RNA, 16 nt, Escherichia coli CFT073
aaucgucaucgacagc

SEQ ID NO: 2681567 - RNA, 13 nt, Escherichia coli CFT073
aaucgucgcagac

SEQ ID NO: 2681568 - RNA, 21 nt, Escherichia coli CFT073
aaucgucgguguccacuuccg

SEQ ID NO: 2681569 - RNA, 15 nt, Escherichia coli CFT073
aaucgugcaucuccu

SEQ ID NO: 2681570 - RNA, 23 nt, Escherichia coli CFT073
aaucguucugugccgucugcccc

SEQ ID NO: 2681571 - RNA, 18 nt, Escherichia coli CFT073
aaucguuugcauccggca

SEQ ID NO: 2681572 - RNA, 20 nt, Escherichia coli CFT073
aaucguuugcauccggcacg

SEQ ID NO: 2681573 - RNA, 22 nt, Escherichia coli CFT073
aaucguuuuuuucgcaaaacac

SEQ ID NO: 2681574 - RNA, 21 nt, Escherichia coli CFT073
aaucuacaaaggguaaagcac

SEQ ID NO: 2681575 - RNA, 12 nt, Escherichia coli CFT073
aaucuaggcucu

SEQ ID NO: 2681576 - RNA, 12 nt, Escherichia coli CFT073
aaucucaccagg

SEQ ID NO: 2681577 - RNA, 23 nt, Escherichia coli CFT073
aaucucaccagguucgccaacaa

SEQ ID NO: 2681578 - RNA, 13 nt, Escherichia coli CFT073
aaucucaccgcag

SEQ ID NO: 2681579 - RNA, 11 nt, Escherichia coli CFT073
aaucucacgca

SEQ ID NO: 2681580 - RNA, 17 nt, Escherichia coli CFT073
aaucucacuacaacaac

SEQ ID NO: 2681581 - RNA, 14 nt, Escherichia coli CFT073
aaucuccagaugac

SEQ ID NO: 2681582 - RNA, 19 nt, Escherichia coli CFT073
aaucuccagaugacuggcu

SEQ ID NO: 2681583 - RNA, 13 nt, Escherichia coli CFT073
aaucuccugcgca

SEQ ID NO: 2681584 - RNA, 13 nt, Escherichia coli CFT073
aaucucgaaagag

SEQ ID NO: 2681585 - RNA, 17 nt, Escherichia coli CFT073
aaucucucccguugcuu

SEQ ID NO: 2681586 - RNA, 17 nt, Escherichia coli CFT073
aaucucucguauuucgc

SEQ ID NO: 2681587 - RNA, 21 nt, Escherichia coli CFT073
aaucucuuccagcgucuccag

SEQ ID NO: 2681588 - RNA, 23 nt, Escherichia coli CFT073
aaucucuuccgucgccagaaagu

SEQ ID NO: 2681589 - RNA, 21 nt, Escherichia coli CFT073
aaucucuucgagaauaucuuc

SEQ ID NO: 2681590 - RNA, 17 nt, Escherichia coli CFT073
aaucucuuuccauucuu

SEQ ID NO: 2681591 - RNA, 16 nt, Escherichia coli CFT073
aaucugaacggcugca

SEQ ID NO: 2681592 - RNA, 18 nt, Escherichia coli CFT073
aaucugacuuccugccuc

SEQ ID NO: 2681593 - RNA, 22 nt, Escherichia coli CFT073
aaucugacuuccugccucuuug

SEQ ID NO: 2681594 - RNA, 23 nt, Escherichia coli CFT073
aaucugacuuccugccucuuugc

SEQ ID NO: 2681595 - RNA, 12 nt, Escherichia coli CFT073
aaucugagcauu

SEQ ID NO: 2681596 - RNA, 14 nt, Escherichia coli CFT073
aaucugauauuuag

SEQ ID NO: 2681597 - RNA, 13 nt, Escherichia coli CFT073
aaucugcaaaaua

SEQ ID NO: 2681598 - RNA, 17 nt, Escherichia coli CFT073
aaucugcaaaauaccaa

SEQ ID NO: 2681599 - RNA, 19 nt, Escherichia coli CFT073
aaucugcccguuaaccaua

SEQ ID NO: 2681600 - RNA, 19 nt, Escherichia coli CFT073
aaucugccguaacugcgcc

SEQ ID NO: 2681601 - RNA, 22 nt, Escherichia coli CFT073
aaucugcgggaacauaugcaca

SEQ ID NO: 2681602 - RNA, 20 nt, Escherichia coli CFT073
aaucugcuccauuaacccga

SEQ ID NO: 2681603 - RNA, 22 nt, Escherichia coli CFT073
aaucugcuugcgauguucuuca

SEQ ID NO: 2681604 - RNA, 12 nt, Escherichia coli CFT073
aaucuggcgcgc

SEQ ID NO: 2681605 - RNA, 24 nt, Escherichia coli CFT073
aaucuggcguguucagaucaucaa

SEQ ID NO: 2681606 - RNA, 17 nt, Escherichia coli CFT073
aaucuggcuucaucugc

SEQ ID NO: 2681607 - RNA, 12 nt, Escherichia coli CFT073
aaucuggucugg

SEQ ID NO: 2681608 - RNA, 21 nt, Escherichia coli CFT073
aaucuguacaggacgcaaugu

SEQ ID NO: 2681609 - RNA, 17 nt, Escherichia coli CFT073
aaucugugcuugcagau

SEQ ID NO: 2681610 - RNA, 17 nt, Escherichia coli CFT073
aaucuguucuggaaaaa

SEQ ID NO: 2681611 - RNA, 19 nt, Escherichia coli CFT073
aaucuguugaaauuauugc

SEQ ID NO: 2681612 - RNA, 15 nt, Escherichia coli CFT073
aaucuucacaucauc

SEQ ID NO: 2681613 - RNA, 17 nt, Escherichia coli CFT073
aaucuucacaucaucau

SEQ ID NO: 2681614 - RNA, 22 nt, Escherichia coli CFT073
aaucuucacugaauaccguaaa

SEQ ID NO: 2681615 - RNA, 14 nt, Escherichia coli CFT073
aaucuucauagucu

SEQ ID NO: 2681616 - RNA, 20 nt, Escherichia coli CFT073
aaucuuccagaucaccgcag

SEQ ID NO: 2681617 - RNA, 14 nt, Escherichia coli CFT073
aaucuuccucgcca

SEQ ID NO: 2681618 - RNA, 22 nt, Escherichia coli CFT073
aaucuucucgaaacgcuuuuaa

SEQ ID NO: 2681619 - RNA, 14 nt, Escherichia coli CFT073
aaucuucuucuuua

SEQ ID NO: 2681620 - RNA, 19 nt, Escherichia coli CFT073
aaucuugccauuccacaaa

SEQ ID NO: 2681621 - RNA, 14 nt, Escherichia coli CFT073
aaucuugcugacgu

SEQ ID NO: 2681622 - RNA, 12 nt, Escherichia coli CFT073
aaucuuuaacca

SEQ ID NO: 2681623 - RNA, 13 nt, Escherichia coli CFT073
aaucuuuacacca

SEQ ID NO: 2681624 - RNA, 14 nt, Escherichia coli CFT073
aaucuuuacaccaa

SEQ ID NO: 2681625 - RNA, 23 nt, Escherichia coli CFT073
aaucuuuagcggcggaauuaacc

SEQ ID NO: 2681626 - RNA, 17 nt, Escherichia coli CFT073
aaucuuucacuuuugcc

SEQ ID NO: 2681627 - RNA, 23 nt, Escherichia coli CFT073
aaucuuucagaguuguaccaccc

SEQ ID NO: 2681628 - RNA, 13 nt, Escherichia coli CFT073
aaugaaaaacagg

SEQ ID NO: 2681629 - RNA, 22 nt, Escherichia coli CFT073
aaugaaaacgaauugucccauu

SEQ ID NO: 2681630 - RNA, 12 nt, Escherichia coli CFT073
aaugaaacucaa

SEQ ID NO: 2681631 - RNA, 21 nt, Escherichia coli CFT073
aaugaaagaugaagaguggaa

SEQ ID NO: 2681632 - RNA, 16 nt, Escherichia coli CFT073
aaugaaauaaaacaaa

SEQ ID NO: 2681633 - RNA, 17 nt, Escherichia coli CFT073
aaugaaauaaaacaaau

SEQ ID NO: 2681634 - RNA, 19 nt, Escherichia coli CFT073
aaugaaauauuaucuaacc

SEQ ID NO: 2681635 - RNA, 21 nt, Escherichia coli CFT073
aaugaaccaaucagccgagcu

SEQ ID NO: 2681636 - RNA, 18 nt, Escherichia coli CFT073
aaugaacgccaccccaca

SEQ ID NO: 2681637 - RNA, 15 nt, Escherichia coli CFT073
aaugaacucaacgcc

SEQ ID NO: 2681638 - RNA, 18 nt, Escherichia coli CFT073
aaugaagaaccgcaccag

SEQ ID NO: 2681639 - RNA, 14 nt, Escherichia coli CFT073
aaugaaucagcaga

SEQ ID NO: 2681640 - RNA, 15 nt, Escherichia coli CFT073
aaugaaucagcagau

SEQ ID NO: 2681641 - RNA, 17 nt, Escherichia coli CFT073
aaugaauugcuuaacag

SEQ ID NO: 2681642 - RNA, 12 nt, Escherichia coli CFT073
aaugacaacauu

SEQ ID NO: 2681643 - RNA, 15 nt, Escherichia coli CFT073
aaugacaauuacaaa

SEQ ID NO: 2681644 - RNA, 19 nt, Escherichia coli CFT073
aaugacagccccaccagca

SEQ ID NO: 2681645 - RNA, 19 nt, Escherichia coli CFT073
aaugacaguaucaccaacu

SEQ ID NO: 2681646 - RNA, 23 nt, Escherichia coli CFT073
aaugacaucgcccucuuucacca

SEQ ID NO: 2681647 - RNA, 20 nt, Escherichia coli CFT073
aaugacauuaaguaacaaua

SEQ ID NO: 2681648 - RNA, 17 nt, Escherichia coli CFT073
aaugaccgccugcgggg

SEQ ID NO: 2681649 - RNA, 14 nt, Escherichia coli CFT073
aaugacgaucaacc

SEQ ID NO: 2681650 - RNA, 16 nt, Escherichia coli CFT073
aaugacgcuuuauuca

SEQ ID NO: 2681651 - RNA, 16 nt, Escherichia coli CFT073
aaugacucacguuacu

SEQ ID NO: 2681652 - RNA, 17 nt, Escherichia coli CFT073
aaugacugguuuugugg

SEQ ID NO: 2681653 - RNA, 15 nt, Escherichia coli CFT073
aaugacuuccgccac

SEQ ID NO: 2681654 - RNA, 18 nt, Escherichia coli CFT073
aaugacuucgcuuucgcc

SEQ ID NO: 2681655 - RNA, 23 nt, Escherichia coli CFT073
aaugagaguacguucacuuuucu

SEQ ID NO: 2681656 - RNA, 21 nt, Escherichia coli CFT073
aaugagcgaacaauaaaguuu

SEQ ID NO: 2681657 - RNA, 14 nt, Escherichia coli CFT073
aaugaggcuuuaau

SEQ ID NO: 2681658 - RNA, 14 nt, Escherichia coli CFT073
aaugaguauuacgg

SEQ ID NO: 2681659 - RNA, 14 nt, Escherichia coli CFT073
aaugagucaguaaa

SEQ ID NO: 2681660 - RNA, 15 nt, Escherichia coli CFT073
aaugaguuauacaga

SEQ ID NO: 2681661 - RNA, 18 nt, Escherichia coli CFT073
aaugauaaguccgaugcc

SEQ ID NO: 2681662 - RNA, 15 nt, Escherichia coli CFT073
aaugauagccaggcg

SEQ ID NO: 2681663 - RNA, 21 nt, Escherichia coli CFT073
aaugauauuaauguuuucagu

SEQ ID NO: 2681664 - RNA, 19 nt, Escherichia coli CFT073
aaugauauugauaauaaaa

SEQ ID NO: 2681665 - RNA, 15 nt, Escherichia coli CFT073
aaugauauuuucugc

SEQ ID NO: 2681666 - RNA, 14 nt, Escherichia coli CFT073
aaugaucacuggaa

SEQ ID NO: 2681667 - RNA, 15 nt, Escherichia coli CFT073
aaugaucacuggaag

SEQ ID NO: 2681668 - RNA, 20 nt, Escherichia coli CFT073
aaugaucagcgguuuugcca

SEQ ID NO: 2681669 - RNA, 24 nt, Escherichia coli CFT073
aaugaucauuaacgcagaaucuuc

SEQ ID NO: 2681670 - RNA, 14 nt, Escherichia coli CFT073
aaugaugauugacc

SEQ ID NO: 2681671 - RNA, 15 nt, Escherichia coli CFT073
aaugaugauugacca

SEQ ID NO: 2681672 - RNA, 19 nt, Escherichia coli CFT073
aaugaugcaccaccugauu

SEQ ID NO: 2681673 - RNA, 15 nt, Escherichia coli CFT073
aaugauggugaaagc

SEQ ID NO: 2681674 - RNA, 16 nt, Escherichia coli CFT073
aaugauggugaaagca

SEQ ID NO: 2681675 - RNA, 16 nt, Escherichia coli CFT073
aaugaugucaaccauc

SEQ ID NO: 2681676 - RNA, 22 nt, Escherichia coli CFT073
aaugcaacugcccaggcaaaaa

SEQ ID NO: 2681677 - RNA, 22 nt, Escherichia coli CFT073
aaugcaauaaaaaagccgccag

SEQ ID NO: 2681678 - RNA, 15 nt, Escherichia coli CFT073
aaugcacacaaaauu

SEQ ID NO: 2681679 - RNA, 22 nt, Escherichia coli CFT073
aaugcacccgccagagagcgaa

SEQ ID NO: 2681680 - RNA, 17 nt, Escherichia coli CFT073
aaugcacuccgccgcac

SEQ ID NO: 2681681 - RNA, 17 nt, Escherichia coli CFT073
aaugcacuuccagcggc

SEQ ID NO: 2681682 - RNA, 15 nt, Escherichia coli CFT073
aaugcaggcaucggu

SEQ ID NO: 2681683 - RNA, 22 nt, Escherichia coli CFT073
aaugccaaauguauccaucacc

SEQ ID NO: 2681684 - RNA, 15 nt, Escherichia coli CFT073
aaugccaccacacca

SEQ ID NO: 2681685 - RNA, 14 nt, Escherichia coli CFT073
aaugccaccagugc

SEQ ID NO: 2681686 - RNA, 17 nt, Escherichia coli CFT073
aaugccacugaauaaag

SEQ ID NO: 2681687 - RNA, 14 nt, Escherichia coli CFT073
aaugccacugcgcc

SEQ ID NO: 2681688 - RNA, 13 nt, Escherichia coli CFT073
aaugccagcagca

SEQ ID NO: 2681689 - RNA, 13 nt, Escherichia coli CFT073
aaugccagccugc

SEQ ID NO: 2681690 - RNA, 10 nt, Escherichia coli CFT073
aaugccagcg

SEQ ID NO: 2681691 - RNA, 14 nt, Escherichia coli CFT073
aaugccaucaccaa

SEQ ID NO: 2681692 - RNA, 21 nt, Escherichia coli CFT073
aaugccauucacaaaaacagu

SEQ ID NO: 2681693 - RNA, 15 nt, Escherichia coli CFT073
aaugcccaaaauggc

SEQ ID NO: 2681694 - RNA, 23 nt, Escherichia coli CFT073
aaugcccaguguuguauucagac

SEQ ID NO: 2681695 - RNA, 15 nt, Escherichia coli CFT073
aaugcccgacaaaaa

SEQ ID NO: 2681696 - RNA, 16 nt, Escherichia coli CFT073
aaugcccgcaccaccg

SEQ ID NO: 2681697 - RNA, 12 nt, Escherichia coli CFT073
aaugcccgcagu

SEQ ID NO: 2681698 - RNA, 15 nt, Escherichia coli CFT073
aaugccgacaucaaa

SEQ ID NO: 2681699 - RNA, 12 nt, Escherichia coli CFT073
aaugccgcaacu

SEQ ID NO: 2681700 - RNA, 16 nt, Escherichia coli CFT073
aaugccgcaaugugcu

SEQ ID NO: 2681701 - RNA, 17 nt, Escherichia coli CFT073
aaugccggaaucagaau

SEQ ID NO: 2681702 - RNA, 22 nt, Escherichia coli CFT073
aaugccggaugcgacgcuagcc

SEQ ID NO: 2681703 - RNA, 15 nt, Escherichia coli CFT073
aaugccgggccguuu

SEQ ID NO: 2681704 - RNA, 16 nt, Escherichia coli CFT073
aaugccggguaaagau

SEQ ID NO: 2681705 - RNA, 18 nt, Escherichia coli CFT073
aaugccucgcuaaucucu

SEQ ID NO: 2681706 - RNA, 23 nt, Escherichia coli CFT073
aaugccugagacagacagccuca

SEQ ID NO: 2681707 - RNA, 21 nt, Escherichia coli CFT073
aaugccugcacuuugugucag

SEQ ID NO: 2681708 - RNA, 18 nt, Escherichia coli CFT073
aaugccuucaaaucgccc

SEQ ID NO: 2681709 - RNA, 18 nt, Escherichia coli CFT073
aaugccuugauauguauu

SEQ ID NO: 2681710 - RNA, 19 nt, Escherichia coli CFT073
aaugccuugauauguauua

SEQ ID NO: 2681711 - RNA, 15 nt, Escherichia coli CFT073
aaugccuuucuuugu

SEQ ID NO: 2681712 - RNA, 18 nt, Escherichia coli CFT073
aaugccuuucuuuguucu

SEQ ID NO: 2681713 - RNA, 15 nt, Escherichia coli CFT073
aaugccuuugaaauc

SEQ ID NO: 2681714 - RNA, 21 nt, Escherichia coli CFT073
aaugccuuugaaaucgaacag

SEQ ID NO: 2681715 - RNA, 16 nt, Escherichia coli CFT073
aaugccuuuuccagcg

SEQ ID NO: 2681716 - RNA, 11 nt, Escherichia coli CFT073
aaugcgaaaac

SEQ ID NO: 2681717 - RNA, 21 nt, Escherichia coli CFT073
aaugcgaaaacgauguuugcu

SEQ ID NO: 2681718 - RNA, 23 nt, Escherichia coli CFT073
aaugugcggcgcauucaccagcg

SEQ ID NO: 2681719 - RNA, 21 nt, Escherichia coli CFT073
aaugugcuccauuguuagcaa

SEQ ID NO: 2681720 - RNA, 15 nt, Escherichia coli CFT073
aaugugcugagaaca

SEQ ID NO: 2681721 - RNA, 22 nt, Escherichia coli CFT073
aaugugcuuucaccaauguugu

SEQ ID NO: 2681722 - RNA, 12 nt, Escherichia coli CFT073
aauguggaaagc

SEQ ID NO: 2681723 - RNA, 17 nt, Escherichia coli CFT073
aauguggaaagccccag

SEQ ID NO: 2681724 - RNA, 16 nt, Escherichia coli CFT073
aaugugguuagagaac

SEQ ID NO: 2681725 - RNA, 18 nt, Escherichia coli CFT073
aauguguuuauaagccau

SEQ ID NO: 2681726 - RNA, 22 nt, Escherichia coli CFT073
aauguuaccgaucgccagcagg

SEQ ID NO: 2681727 - RNA, 13 nt, Escherichia coli CFT073
aauguuacgaccu

SEQ ID NO: 2681728 - RNA, 14 nt, Escherichia coli CFT073
aauguuauccauau

SEQ ID NO: 2681729 - RNA, 21 nt, Escherichia coli CFT073
aauguucaauaagcuuagucu

SEQ ID NO: 2681730 - RNA, 13 nt, Escherichia coli CFT073
aauguucgccggg

SEQ ID NO: 2681731 - RNA, 19 nt, Escherichia coli CFT073
aauguugccggauggcacg

SEQ ID NO: 2681732 - RNA, 14 nt, Escherichia coli CFT073
aauuaaacaaauaa

SEQ ID NO: 2681733 - RNA, 14 nt, Escherichia coli CFT073
aauuaaacagcccu

SEQ ID NO: 2681734 - RNA, 16 nt, Escherichia coli CFT073
aauuaacaccaccagc

SEQ ID NO: 2681735 - RNA, 23 nt, Escherichia coli CFT073
aauuaacaccaccagcgccacca

SEQ ID NO: 2681736 - RNA, 15 nt, Escherichia coli CFT073
aauuaaccagaaaua

SEQ ID NO: 2681737 - RNA, 16 nt, Escherichia coli CFT073
aauuaaccagaaauag

SEQ ID NO: 2681738 - RNA, 22 nt, Escherichia coli CFT073
aauuaacccgcgacgacgacag

SEQ ID NO: 2681739 - RNA, 13 nt, Escherichia coli CFT073
aauuaacuccagu

SEQ ID NO: 2681740 - RNA, 17 nt, Escherichia coli CFT073
aauuaagaucagaagca

SEQ ID NO: 2681741 - RNA, 13 nt, Escherichia coli CFT073
aauuaaguugauu

SEQ ID NO: 2681742 - RNA, 15 nt, Escherichia coli CFT073
aauuaaguuuuccgc

SEQ ID NO: 2681743 - RNA, 15 nt, Escherichia coli CFT073
aauuaauaauauaaa

SEQ ID NO: 2681744 - RNA, 14 nt, Escherichia coli CFT073
aauuaauacgccag

SEQ ID NO: 2681745 - RNA, 21 nt, Escherichia coli CFT073
aauuaaucaucaugcuuaaau

SEQ ID NO: 2681746 - RNA, 13 nt, Escherichia coli CFT073
aauuaauugcuau

SEQ ID NO: 2681747 - RNA, 21 nt, Escherichia coli CFT073
aauuaauuuuuuaauaaaaag

SEQ ID NO: 2681748 - RNA, 23 nt, Escherichia coli CFT073
aauuaauuuuuuaauaaaaaggu

SEQ ID NO: 2681749 - RNA, 15 nt, Escherichia coli CFT073
aauuacaaaaugaca

SEQ ID NO: 2681750 - RNA, 15 nt, Escherichia coli CFT073
aauuaccagcgcagg

SEQ ID NO: 2681751 - RNA, 22 nt, Escherichia coli CFT073
aauuaccccauccauugcauaa

SEQ ID NO: 2681752 - RNA, 18 nt, Escherichia coli CFT073
aauuaccgcaccaccagc

SEQ ID NO: 2681753 - RNA, 16 nt, Escherichia coli CFT073
aauuaccugaugcgcu

SEQ ID NO: 2681754 - RNA, 18 nt, Escherichia coli CFT073
aauuaccuuuacaugaaa

SEQ ID NO: 2681755 - RNA, 18 nt, Escherichia coli CFT073
aauuaccuuuuuaccaac

SEQ ID NO: 2681756 - RNA, 17 nt, Escherichia coli CFT073
aauuacgacccgaccga

SEQ ID NO: 2681757 - RNA, 19 nt, Escherichia coli CFT073
ucacccgccgguggcguuu

SEQ ID NO: 2681758 - RNA, 22 nt, Escherichia coli CFT073
ucacccgccgguggcguuucca

SEQ ID NO: 2681759 - RNA, 18 nt, Escherichia coli CFT073
ucacccgccuucacuucc

SEQ ID NO: 2681760 - RNA, 18 nt, Escherichia coli CFT073
ucacccgcugcaacacuu

SEQ ID NO: 2681761 - RNA, 14 nt, Escherichia coli CFT073
ucacccuuuucgau

SEQ ID NO: 2681762 - RNA, 16 nt, Escherichia coli CFT073
ucaccgaaccagggcg

SEQ ID NO: 2681763 - RNA, 17 nt, Escherichia coli CFT073
ucaccgaaccagggcga

SEQ ID NO: 2681764 - RNA, 23 nt, Escherichia coli CFT073
ucaccgaagcggccgucagaucg

SEQ ID NO: 2681765 - RNA, 21 nt, Escherichia coli CFT073
ucaccgacggauuauucacua

SEQ ID NO: 2681766 - RNA, 17 nt, Escherichia coli CFT073
ucaccgaugaucgccau

SEQ ID NO: 2681767 - RNA, 16 nt, Escherichia coli CFT073
ucaccgcacgacgaau

SEQ ID NO: 2681768 - RNA, 23 nt, Escherichia coli CFT073
ucaccgcagcaucgucaucagcu

SEQ ID NO: 2681769 - RNA, 15 nt, Escherichia coli CFT073
ucaccgccacgccuu

SEQ ID NO: 2681770 - RNA, 13 nt, Escherichia coli CFT073
ucaccgccaggcc

SEQ ID NO: 2681771 - RNA, 20 nt, Escherichia coli CFT073
ucaccgccgagacauccacu

SEQ ID NO: 2681772 - RNA, 21 nt, Escherichia coli CFT073
ucaccgccgagacauccacuu

SEQ ID NO: 2681773 - RNA, 15 nt, Escherichia coli CFT073
ucaccgccugcugau

SEQ ID NO: 2681774 - RNA, 14 nt, Escherichia coli CFT073
ucaccgcgaccaga

SEQ ID NO: 2681775 - RNA, 21 nt, Escherichia coli CFT073
ucaccgcguaugcccagcgca

SEQ ID NO: 2681776 - RNA, 23 nt, Escherichia coli CFT073
ucaccgcucuucauacguggcag

SEQ ID NO: 2681777 - RNA, 15 nt, Escherichia coli CFT073
ucaccggagcugcca

SEQ ID NO: 2681778 - RNA, 20 nt, Escherichia coli CFT073
ucaccggaggccugauaaaa

SEQ ID NO: 2681779 - RNA, 15 nt, Escherichia coli CFT073
ucaccgggauccagu

SEQ ID NO: 2681780 - RNA, 14 nt, Escherichia coli CFT073
ucaccgguguuccc

SEQ ID NO: 2681781 - RNA, 19 nt, Escherichia coli CFT073
ucaccguccauccacagag

SEQ ID NO: 2681782 - RNA, 23 nt, Escherichia coli CFT073
ucaccuaauuuaaaauugauaac

SEQ ID NO: 2681783 - RNA, 15 nt, Escherichia coli CFT073
ucaccuacgcuggca

SEQ ID NO: 2681784 - RNA, 19 nt, Escherichia coli CFT073
ucaccucaauggcagcauc

SEQ ID NO: 2681785 - RNA, 22 nt, Escherichia coli CFT073
ucaccucugucgaugcgcucug

SEQ ID NO: 2681786 - RNA, 22 nt, Escherichia coli CFT073
ucaccucuucaccguccaucca

SEQ ID NO: 2681787 - RNA, 11 nt, Escherichia coli CFT073
ucaccucuuuc

SEQ ID NO: 2681788 - RNA, 19 nt, Escherichia coli CFT073
ucaccucuuuuucgacuuc

SEQ ID NO: 2681789 - RNA, 16 nt, Escherichia coli CFT073
ucaccugaccgagcca

SEQ ID NO: 2681790 - RNA, 23 nt, Escherichia coli CFT073
ucaccugauuuacguaaaaaccc

SEQ ID NO: 2681791 - RNA, 23 nt, Escherichia coli CFT073
ucaccugcccuccgguacgugcg

SEQ ID NO: 2681792 - RNA, 13 nt, Escherichia coli CFT073
ucaccugccugca

SEQ ID NO: 2681793 - RNA, 16 nt, Escherichia coli CFT073
ucaccugcgauaaacc

SEQ ID NO: 2681794 - RNA, 16 nt, Escherichia coli CFT073
ucaccugcgcuggcag

SEQ ID NO: 2681795 - RNA, 19 nt, Escherichia coli CFT073
ucaccugcgcuggcaggcc

SEQ ID NO: 2681796 - RNA, 19 nt, Escherichia coli CFT073
ucaccuuacuggaguaaau

SEQ ID NO: 2681797 - RNA, 23 nt, Escherichia coli CFT073
ucaccuuacuggaguaaaucaga

SEQ ID NO: 2681798 - RNA, 18 nt, Escherichia coli CFT073
ggcgacaauaaucguucc

SEQ ID NO: 2681799 - RNA, 19 nt, Escherichia coli CFT073
ggcgacacaucuaaugcuu

SEQ ID NO: 2681800 - RNA, 13 nt, Escherichia coli CFT073
ggcgacaggaacc

SEQ ID NO: 2681801 - RNA, 11 nt, Escherichia coli CFT073
ggcgacauuua

SEQ ID NO: 2681802 - RNA, 22 nt, Escherichia coli CFT073
ggcgaccacugaccgcccggcc

SEQ ID NO: 2681803 - RNA, 17 nt, Escherichia coli CFT073
ggcgaccaguucgcuuu

SEQ ID NO: 2681804 - RNA, 23 nt, Escherichia coli CFT073
ggcgaccguaaauucucccgccc

SEQ ID NO: 2681805 - RNA, 21 nt, Escherichia coli CFT073
ggcgaccguucgccaggucag

SEQ ID NO: 2681806 - RNA, 21 nt, Escherichia coli CFT073
ggcgacgaacaacucgguuaa

SEQ ID NO: 2681807 - RNA, 20 nt, Escherichia coli CFT073
ggcgacgauaagucuggccg

SEQ ID NO: 2681808 - RNA, 16 nt, Escherichia coli CFT073
ggcgacugccagccac

SEQ ID NO: 2681809 - RNA, 13 nt, Escherichia coli CFT073
ggcgacuggcuga

SEQ ID NO: 2681810 - RNA, 21 nt, Escherichia coli CFT073
ggcgagaacaccgagucgccu

SEQ ID NO: 2681811 - RNA, 18 nt, Escherichia coli CFT073
ggcgagaacgccuuaucc

SEQ ID NO: 2681812 - RNA, 21 nt, Escherichia coli CFT073
ggcgagaacgccuuauccggc

SEQ ID NO: 2681813 - RNA, 19 nt, Escherichia coli CFT073
ggcgagcaacgcagcggcg

SEQ ID NO: 2681814 - RNA, 15 nt, Escherichia coli CFT073
ggcgagccagcgcau

SEQ ID NO: 2681815 - RNA, 11 nt, Escherichia coli CFT073
ggcgagcgcca

SEQ ID NO: 2681816 - RNA, 16 nt, Escherichia coli CFT073
ggcgagcgccagcaug

SEQ ID NO: 2681817 - RNA, 21 nt, Escherichia coli CFT073
ggcgagcuuauauacucuaaa

SEQ ID NO: 2681818 - RNA, 20 nt, Escherichia coli CFT073
ggcgaggggaccgaucgcgc

SEQ ID NO: 2681819 - RNA, 17 nt, Escherichia coli CFT073
ggcgaggggacgguccg

SEQ ID NO: 2681820 - RNA, 19 nt, Escherichia coli CFT073
ggcgaggggagacuucacu

SEQ ID NO: 2681821 - RNA, 18 nt, Escherichia coli CFT073
ggcgauaaacagcacguu

SEQ ID NO: 2681822 - RNA, 20 nt, Escherichia coli CFT073
ggcgauaaaguguugagcuu

SEQ ID NO: 2681823 - RNA, 18 nt, Escherichia coli CFT073
ggcgauaaucagcgccag

SEQ ID NO: 2681824 - RNA, 13 nt, Escherichia coli CFT073
ggcgauaaugacg

SEQ ID NO: 2681825 - RNA, 23 nt, Escherichia coli CFT073
ggcgauagcauccaguuccacac

SEQ ID NO: 2681826 - RNA, 17 nt, Escherichia coli CFT073
ggcgauauccagcgcgg

SEQ ID NO: 2681827 - RNA, 21 nt, Escherichia coli CFT073
ggcgauauucugguaaucgca

SEQ ID NO: 2681828 - RNA, 19 nt, Escherichia coli CFT073
ggcgaucauauccagcauc

SEQ ID NO: 2681829 - RNA, 19 nt, Escherichia coli CFT073
ggcgaucccuaccacgauc

SEQ ID NO: 2681830 - RNA, 14 nt, Escherichia coli CFT073
ggcgaucgucgccg

SEQ ID NO: 2681831 - RNA, 16 nt, Escherichia coli CFT073
ggcgaucuguuccggc

SEQ ID NO: 2681832 - RNA, 22 nt, Escherichia coli CFT073
uaagucaacaccaucuucaacu

SEQ ID NO: 2681833 - RNA, 14 nt, Escherichia coli CFT073
uaagugacaguguc

SEQ ID NO: 2681834 - RNA, 22 nt, Escherichia coli CFT073
uaagugauggauguugccaaca

SEQ ID NO: 2681835 - RNA, 19 nt, Escherichia coli CFT073
uaagugccggaugcgaugc

SEQ ID NO: 2681836 - RNA, 15 nt, Escherichia coli CFT073
uaaguggaacuaaca

SEQ ID NO: 2681837 - RNA, 22 nt, Escherichia coli CFT073
uaaguguauguuggcuuuauaa

SEQ ID NO: 2681838 - RNA, 17 nt, Escherichia coli CFT073
uaaguguuguauuauau

SEQ ID NO: 2681839 - RNA, 21 nt, Escherichia coli CFT073
uaaguuacuaaaaguaaauaa

SEQ ID NO: 2681840 - RNA, 21 nt, Escherichia coli CFT073
uaaguuagacggaaaagacua

SEQ ID NO: 2681841 - RNA, 21 nt, Escherichia coli CFT073
uaaguuagucgcuuucauuca

SEQ ID NO: 2681842 - RNA, 12 nt, Escherichia coli CFT073
uaaguucagaaa

SEQ ID NO: 2681843 - RNA, 14 nt, Escherichia coli CFT073
uaaguugaaucggc

SEQ ID NO: 2681844 - RNA, 17 nt, Escherichia coli CFT073
uaaguugccacgcuuca

SEQ ID NO: 2681845 - RNA, 14 nt, Escherichia coli CFT073
uaaguuucccagcu

SEQ ID NO: 2681846 - RNA, 22 nt, Escherichia coli CFT073
uaaguuucccagcuuauuaaca

SEQ ID NO: 2681847 - RNA, 21 nt, Escherichia coli CFT073
uaaguuuuccguacucaaugc

SEQ ID NO: 2681848 - RNA, 12 nt, Escherichia coli CFT073
uaauaaaaaggu

SEQ ID NO: 2681849 - RNA, 20 nt, Escherichia coli CFT073
uaauaaaaaguuguuaauaa

SEQ ID NO: 2681850 - RNA, 14 nt, Escherichia coli CFT073
uaauaaacauuggu

SEQ ID NO: 2681851 - RNA, 20 nt, Escherichia coli CFT073
uaauaaacguggagauaaac

SEQ ID NO: 2681852 - RNA, 20 nt, Escherichia coli CFT073
uaauaaacucacuuaaagcc

SEQ ID NO: 2681853 - RNA, 19 nt, Escherichia coli CFT073
uaauaaauuuugccaccgg

SEQ ID NO: 2681854 - RNA, 21 nt, Escherichia coli CFT073
uaauaacagacuuuguaagaa

SEQ ID NO: 2681855 - RNA, 16 nt, Escherichia coli CFT073
uaauaaccaccacuga

SEQ ID NO: 2681856 - RNA, 19 nt, Escherichia coli CFT073
uaauaaggcucucauuauu

SEQ ID NO: 2681857 - RNA, 20 nt, Escherichia coli CFT073
uaauaaggcucucauuauuu

SEQ ID NO: 2681858 - RNA, 20 nt, Escherichia coli CFT073
uaauaaguggugucagaaga

SEQ ID NO: 2681859 - RNA, 14 nt, Escherichia coli CFT073
uaauaaucagcaca

SEQ ID NO: 2681860 - RNA, 22 nt, Escherichia coli CFT073
uaauaaucucgccuuaucagaa

SEQ ID NO: 2681861 - RNA, 14 nt, Escherichia coli CFT073
uaauaauucccgca

SEQ ID NO: 2681862 - RNA, 19 nt, Escherichia coli CFT073
uaauaauugcggcggcgca

SEQ ID NO: 2681863 - RNA, 22 nt, Escherichia coli CFT073
uaauaauuugcgcgguaacgcc

SEQ ID NO: 2681864 - RNA, 16 nt, Escherichia coli CFT073
uaauacaaacucacug

SEQ ID NO: 2681865 - RNA, 20 nt, Escherichia coli CFT073
uaauacccagacuuuucaga

SEQ ID NO: 2681866 - RNA, 16 nt, Escherichia coli CFT073
uaauaccgaacgcaga

SEQ ID NO: 2681867 - RNA, 16 nt, Escherichia coli CFT073
uaauaccgccaacaug

SEQ ID NO: 2681868 - RNA, 20 nt, Escherichia coli CFT073
uaauaccgccaacaugcgca

SEQ ID NO: 2681869 - RNA, 16 nt, Escherichia coli CFT073
uaauaccugcaccaac

SEQ ID NO: 2681870 - RNA, 20 nt, Escherichia coli CFT073
uaauacgcuaaauaaacaau

SEQ ID NO: 2681871 - RNA, 22 nt, Escherichia coli CFT073
uaauacgcuaaauaaacaauga

SEQ ID NO: 2681872 - RNA, 22 nt, Escherichia coli CFT073
uaauacgcugcgucugcgcgua

SEQ ID NO: 2681873 - RNA, 13 nt, Escherichia coli CFT073
uaauagauaauuu

SEQ ID NO: 2681874 - RNA, 18 nt, Escherichia coli CFT073
uaauagauaauuuugaaa

SEQ ID NO: 2681875 - RNA, 16 nt, Escherichia coli CFT073
uaauagccugauguag

SEQ ID NO: 2681876 - RNA, 20 nt, Escherichia coli CFT073
uaauagcucugcuaauaaug

SEQ ID NO: 2681877 - RNA, 16 nt, Escherichia coli CFT073
uaauagcugccagccc

SEQ ID NO: 2681878 - RNA, 13 nt, Escherichia coli CFT073
uaauagcuuaacu

SEQ ID NO: 2681879 - RNA, 19 nt, Escherichia coli CFT073
uaauaggcaggcaucauca

SEQ ID NO: 2681880 - RNA, 22 nt, Escherichia coli CFT073
uaauaggccgcaugugcccccu

SEQ ID NO: 2681881 - RNA, 14 nt, Escherichia coli CFT073
uaauauaaggagcc

SEQ ID NO: 2681882 - RNA, 21 nt, Escherichia coli CFT073
uaauauacagccuuaacaaga

SEQ ID NO: 2681883 - RNA, 15 nt, Escherichia coli CFT073
uaauauauaacagaa

SEQ ID NO: 2681884 - RNA, 13 nt, Escherichia coli CFT073
uaauaucaacgcu

SEQ ID NO: 2681885 - RNA, 21 nt, Escherichia coli CFT073
uaauaucccaacgcaaaacca

SEQ ID NO: 2681886 - RNA, 22 nt, Escherichia coli CFT073
uaauaucccaacgcaaaaccaa

SEQ ID NO: 2681887 - RNA, 23 nt, Escherichia coli CFT073
uaauauccccagccuaagccauu

SEQ ID NO: 2681888 - RNA, 19 nt, Escherichia coli CFT073
uaauauccggugcauucau

SEQ ID NO: 2681889 - RNA, 17 nt, Escherichia coli CFT073
uaauauccgguuucuga

SEQ ID NO: 2681890 - RNA, 21 nt, Escherichia coli CFT073
uaauaugcucaacaauaaacu

SEQ ID NO: 2681891 - RNA, 17 nt, Escherichia coli CFT073
uaauauugagauccauu

SEQ ID NO: 2681892 - RNA, 16 nt, Escherichia coli CFT073
uaauauugauauccgc

SEQ ID NO: 2681893 - RNA, 18 nt, Escherichia coli CFT073
uaauauugaugcacacca

SEQ ID NO: 2681894 - RNA, 13 nt, Escherichia coli CFT073
uaauauuuaucuu

SEQ ID NO: 2681895 - RNA, 19 nt, Escherichia coli CFT073
uaauauuuccccaauucau

SEQ ID NO: 2681896 - RNA, 19 nt, Escherichia coli CFT073
uaauauuuugugauuuauu

SEQ ID NO: 2681897 - RNA, 14 nt, Escherichia coli CFT073
uaaucaaauaaaua

SEQ ID NO: 2681898 - RNA, 19 nt, Escherichia coli CFT073
uaaucaaauaaauaaucuc

SEQ ID NO: 2681899 - RNA, 20 nt, Escherichia coli CFT073
uaaucaaauaaauaaucucu

SEQ ID NO: 2681900 - RNA, 19 nt, Escherichia coli CFT073
uaaucaaaucaacaaccug

SEQ ID NO: 2681901 - RNA, 15 nt, Escherichia coli CFT073
uaaucaacaaaccaa

SEQ ID NO: 2681902 - RNA, 21 nt, Escherichia coli CFT073
uaaucaacaaaccaaaaccgc

SEQ ID NO: 2681903 - RNA, 13 nt, Escherichia coli CFT073
uaaucaacgcgcc

SEQ ID NO: 2681904 - RNA, 22 nt, Escherichia coli CFT073
uaaucaacgcuacguuauuuau

SEQ ID NO: 2681905 - RNA, 14 nt, Escherichia coli CFT073
uaaucaaucaccuc

SEQ ID NO: 2681906 - RNA, 22 nt, Escherichia coli CFT073
uaaucaauuacuuauuaacgaa

SEQ ID NO: 2681907 - RNA, 16 nt, Escherichia coli CFT073
uaaucaauuuuuugau

SEQ ID NO: 2681908 - RNA, 12 nt, Escherichia coli CFT073
uaaucaccagcg

SEQ ID NO: 2681909 - RNA, 12 nt, Escherichia coli CFT073
uaaucaccagua

SEQ ID NO: 2681910 - RNA, 13 nt, Escherichia coli CFT073
uaaucaccaguca

SEQ ID NO: 2681911 - RNA, 14 nt, Escherichia coli CFT073
uaaucaccaucgcg

SEQ ID NO: 2681912 - RNA, 12 nt, Escherichia coli CFT073
uaaucaccggau

SEQ ID NO: 2681913 - RNA, 16 nt, Escherichia coli CFT073
uaaucaccugccaggg

SEQ ID NO: 2681914 - RNA, 18 nt, Escherichia coli CFT073
uaaucagaucguugaccu

SEQ ID NO: 2681915 - RNA, 12 nt, Escherichia coli CFT073
uaaucagcacaa

SEQ ID NO: 2681916 - RNA, 22 nt, Escherichia coli CFT073
uaaucagcacaauaaucagccc

SEQ ID NO: 2681917 - RNA, 12 nt, Escherichia coli CFT073
uaaucagcgcac

SEQ ID NO: 2681918 - RNA, 20 nt, Escherichia coli CFT073
uaaucagcgccguagccauu

SEQ ID NO: 2681919 - RNA, 14 nt, Escherichia coli CFT073
uaaucaggcuaucu

SEQ ID NO: 2681920 - RNA, 21 nt, Escherichia coli CFT073
uaaucauacucccagcguacc

SEQ ID NO: 2681921 - RNA, 15 nt, Escherichia coli CFT073
uaaucaucucuccuu

SEQ ID NO: 2681922 - RNA, 22 nt, Escherichia coli CFT073
uaaucaucuguugugccacauc

SEQ ID NO: 2681923 - RNA, 18 nt, Escherichia coli CFT073
uaaucauggcguuuuucc

SEQ ID NO: 2681924 - RNA, 17 nt, Escherichia coli CFT073
uaaucauuaacggccac

SEQ ID NO: 2681925 - RNA, 20 nt, Escherichia coli CFT073
uaaucauuaacggccacgau

SEQ ID NO: 2681926 - RNA, 12 nt, Escherichia coli CFT073
uaauccacuuuc

SEQ ID NO: 2681927 - RNA, 17 nt, Escherichia coli CFT073
uaauccacuuucuuaaa

SEQ ID NO: 2681928 - RNA, 20 nt, Escherichia coli CFT073
uaauccacuuucuuaaagcc

SEQ ID NO: 2681929 - RNA, 15 nt, Escherichia coli CFT073
uaauccagcaaacug

SEQ ID NO: 2681930 - RNA, 19 nt, Escherichia coli CFT073
uaauccaggacauaucagg

SEQ ID NO: 2681931 - RNA, 23 nt, Escherichia coli CFT073
uaauccagugccggaugauucac

SEQ ID NO: 2681932 - RNA, 21 nt, Escherichia coli CFT073
uaauccauaguguguuccucu

SEQ ID NO: 2681933 - RNA, 19 nt, Escherichia coli CFT073
uaauccauugcaacuggcu

SEQ ID NO: 2681934 - RNA, 20 nt, Escherichia coli CFT073
uaauccccacaucaggccca

SEQ ID NO: 2681935 - RNA, 21 nt, Escherichia coli CFT073
uaaucccgugccugcuucagu

SEQ ID NO: 2681936 - RNA, 15 nt, Escherichia coli CFT073
uaauccgcauuggca

SEQ ID NO: 2681937 - RNA, 11 nt, Escherichia coli CFT073
uaauccgcugu

SEQ ID NO: 2681938 - RNA, 17 nt, Escherichia coli CFT073
uaauccguaugacaaac

SEQ ID NO: 2681939 - RNA, 13 nt, Escherichia coli CFT073
uaauccguauucc

SEQ ID NO: 2681940 - RNA, 24 nt, Escherichia coli CFT073
uaauuggcagugguaucaauaucc

SEQ ID NO: 2681941 - RNA, 20 nt, Escherichia coli CFT073
uaauuuacaaucacuucauu

SEQ ID NO: 2681942 - RNA, 20 nt, Escherichia coli CFT073
uaauuuauagauucuacgaa

SEQ ID NO: 2681943 - RNA, 20 nt, Escherichia coli CFT073
uaauuucacaccaucaacaa

SEQ ID NO: 2681944 - RNA, 18 nt, Escherichia coli CFT073
uaauuucaugcucaccaa

SEQ ID NO: 2681945 - RNA, 12 nt, Escherichia coli CFT073
uaauuuccugcc

SEQ ID NO: 2681946 - RNA, 13 nt, Escherichia coli CFT073
uaauuuccugcca

SEQ ID NO: 2681947 - RNA, 17 nt, Escherichia coli CFT073
uaauuuccugccagcgu

SEQ ID NO: 2681948 - RNA, 21 nt, Escherichia coli CFT073
uaauuugaaaugacgcuuuau

SEQ ID NO: 2681949 - RNA, 14 nt, Escherichia coli CFT073
uaauuugaucaaau

SEQ ID NO: 2681950 - RNA, 22 nt, Escherichia coli CFT073
uaauuugcgcgguaacgccauc

SEQ ID NO: 2681951 - RNA, 15 nt, Escherichia coli CFT073
uaauuuugaaauaaa

SEQ ID NO: 2681952 - RNA, 17 nt, Escherichia coli CFT073
uaauuuugugcagcaca

SEQ ID NO: 2681953 - RNA, 23 nt, Escherichia coli CFT073
uaauuuuuccagcauuucuucca

SEQ ID NO: 2681954 - RNA, 13 nt, Escherichia coli CFT073
uacaaaaauaagu

SEQ ID NO: 2681955 - RNA, 14 nt, Escherichia coli CFT073
uacaaaaauaaguc

SEQ ID NO: 2681956 - RNA, 13 nt, Escherichia coli CFT073
uacaaaacauuau

SEQ ID NO: 2681957 - RNA, 15 nt, Escherichia coli CFT073
uacaaacacugcuuu

SEQ ID NO: 2681958 - RNA, 14 nt, Escherichia coli CFT073
uacaaacauaaagc

SEQ ID NO: 2681959 - RNA, 15 nt, Escherichia coli CFT073
uacaaacgccauaaa

SEQ ID NO: 2681960 - RNA, 23 nt, Escherichia coli CFT073
uacaaagccaacagcagccacac

SEQ ID NO: 2681961 - RNA, 12 nt, Escherichia coli CFT073
uacaaaggcacg

SEQ ID NO: 2681962 - RNA, 13 nt, Escherichia coli CFT073
uacaaaggcacgc

SEQ ID NO: 2681963 - RNA, 15 nt, Escherichia coli CFT073
uacaaaggcacgcca

SEQ ID NO: 2681964 - RNA, 21 nt, Escherichia coli CFT073
uacaaagggcuaacgugcagg

SEQ ID NO: 2681965 - RNA, 19 nt, Escherichia coli CFT073
uacaaauagaucgccagaa

SEQ ID NO: 2681966 - RNA, 13 nt, Escherichia coli CFT073
uacaaauagccaa

SEQ ID NO: 2681967 - RNA, 21 nt, Escherichia coli CFT073
uacaaauagccaauucccagu

SEQ ID NO: 2681968 - RNA, 12 nt, Escherichia coli CFT073
uacaaaucucca

SEQ ID NO: 2681969 - RNA, 22 nt, Escherichia coli CFT073
uacaaccaaaucugauuaauau

SEQ ID NO: 2681970 - RNA, 18 nt, Escherichia coli CFT073
uacaaccguuucaugcca

SEQ ID NO: 2681971 - RNA, 17 nt, Escherichia coli CFT073
uacaacgggggaauaac

SEQ ID NO: 2681972 - RNA, 20 nt, Escherichia coli CFT073
uacaacugcuuuuugcucuc

SEQ ID NO: 2681973 - RNA, 13 nt, Escherichia coli CFT073
uacaagcagagag

SEQ ID NO: 2681974 - RNA, 23 nt, Escherichia coli CFT073
uacaagcauauaaaccugauaau

SEQ ID NO: 2681975 - RNA, 21 nt, Escherichia coli CFT073
uacaauccugugcuccaguac

SEQ ID NO: 2681976 - RNA, 19 nt, Escherichia coli CFT073
uacaaugcaauauuuugaa

SEQ ID NO: 2681977 - RNA, 18 nt, Escherichia coli CFT073
uacaauuuguaacgauuc

SEQ ID NO: 2681978 - RNA, 22 nt, Escherichia coli CFT073
uacacaaugccugaugcgcuuc

SEQ ID NO: 2681979 - RNA, 21 nt, Escherichia coli CFT073
uacacagauaaacuacagaug

SEQ ID NO: 2681980 - RNA, 17 nt, Escherichia coli CFT073
uacacagcccaguuuuu

SEQ ID NO: 2681981 - RNA, 11 nt, Escherichia coli CFT073
uacacagcccg

SEQ ID NO: 2681982 - RNA, 14 nt, Escherichia coli CFT073
uacaccaaagcggu

SEQ ID NO: 2681983 - RNA, 21 nt, Escherichia coli CFT073
uacaccaccaccgacaccgca

SEQ ID NO: 2681984 - RNA, 23 nt, Escherichia coli CFT073
uacaccaccaccgacaccgcauu

SEQ ID NO: 2681985 - RNA, 21 nt, Escherichia coli CFT073
uacaccaucacgccccaaugc

SEQ ID NO: 2681986 - RNA, 19 nt, Escherichia coli CFT073
uacaccaucggcuggccuu

SEQ ID NO: 2681987 - RNA, 19 nt, Escherichia coli CFT073
uacacccaaucccugaccu

SEQ ID NO: 2681988 - RNA, 23 nt, Escherichia coli CFT073
uacacccagccccgguuuuucug

SEQ ID NO: 2681989 - RNA, 14 nt, Escherichia coli CFT073
uacaccccagccgg

SEQ ID NO: 2681990 - RNA, 13 nt, Escherichia coli CFT073
uacaccgcagccg

SEQ ID NO: 2681991 - RNA, 18 nt, Escherichia coli CFT073
uacaccguccggcacuca

SEQ ID NO: 2681992 - RNA, 18 nt, Escherichia coli CFT073
uacaccugcuccgccaga

SEQ ID NO: 2681993 - RNA, 22 nt, Escherichia coli CFT073
uacaccuuaaggcuguucccac

SEQ ID NO: 2681994 - RNA, 20 nt, Escherichia coli CFT073
uacacgcgauuuugccaguu

SEQ ID NO: 2681995 - RNA, 17 nt, Escherichia coli CFT073
uacacgugagccacggg

SEQ ID NO: 2681996 - RNA, 21 nt, Escherichia coli CFT073
uacacugguucccaacaacag

SEQ ID NO: 2681997 - RNA, 17 nt, Escherichia coli CFT073
uacagaccccggcauug

SEQ ID NO: 2681998 - RNA, 22 nt, Escherichia coli CFT073
uacagaccgaauucugcggcca

SEQ ID NO: 2681999 - RNA, 15 nt, Escherichia coli CFT073
uacagacucaaacca

SEQ ID NO: 2682000 - RNA, 17 nt, Escherichia coli CFT073
uacagacucaaaccaau

SEQ ID NO: 2682001 - RNA, 13 nt, Escherichia coli CFT073
uacagauacauuu

SEQ ID NO: 2682002 - RNA, 15 nt, Escherichia coli CFT073
uacagauacauuuca

SEQ ID NO: 2682003 - RNA, 23 nt, Escherichia coli CFT073
uacagauucaauuuugcagcauu

SEQ ID NO: 2682004 - RNA, 20 nt, Escherichia coli CFT073
uacagcagccauucauucaa

SEQ ID NO: 2682005 - RNA, 19 nt, Escherichia coli CFT073
uacagcaguacgccgagaa

SEQ ID NO: 2682006 - RNA, 13 nt, Escherichia coli CFT073
uacagcaucggcu

SEQ ID NO: 2682007 - RNA, 18 nt, Escherichia coli CFT073
uacagccaaaucaucagu

SEQ ID NO: 2682008 - RNA, 23 nt, Escherichia coli CFT073
uacagccagccagcaccaggcuu

SEQ ID NO: 2682009 - RNA, 19 nt, Escherichia coli CFT073
uacagccaugcgaaugcca

SEQ ID NO: 2682010 - RNA, 13 nt, Escherichia coli CFT073
uacagcccaggaa

SEQ ID NO: 2682011 - RNA, 18 nt, Escherichia coli CFT073
uacagcccgccggaaagc

SEQ ID NO: 2682012 - RNA, 12 nt, Escherichia coli CFT073
uacagccgccag

SEQ ID NO: 2682013 - RNA, 15 nt, Escherichia coli CFT073
uacagccgccagaca

SEQ ID NO: 2682014 - RNA, 16 nt, Escherichia coli CFT073
uacagccgccagacaa

SEQ ID NO: 2682015 - RNA, 13 nt, Escherichia coli CFT073
uacagccggguga

SEQ ID NO: 2682016 - RNA, 17 nt, Escherichia coli CFT073
uacagccuuaacaagau

SEQ ID NO: 2682017 - RNA, 20 nt, Escherichia coli CFT073
uacagcgaauaguggaguau

SEQ ID NO: 2682018 - RNA, 11 nt, Escherichia coli CFT073
uacagcggaac

SEQ ID NO: 2682019 - RNA, 17 nt, Escherichia coli CFT073
uacagcggaacuuuuuu

SEQ ID NO: 2682020 - RNA, 13 nt, Escherichia coli CFT073
uacagcucgguau

SEQ ID NO: 2682021 - RNA, 16 nt, Escherichia coli CFT073
uacaggaacagccacu

SEQ ID NO: 2682022 - RNA, 20 nt, Escherichia coli CFT073
uacaggauauauuucaucaa

SEQ ID NO: 2682023 - RNA, 14 nt, Escherichia coli CFT073
uacaggauuacuua

SEQ ID NO: 2682024 - RNA, 23 nt, Escherichia coli CFT073
uacaggcaucgggaauggcauac

SEQ ID NO: 2682025 - RNA, 18 nt, Escherichia coli CFT073
uacaggccaccaggccac

SEQ ID NO: 2682026 - RNA, 22 nt, Escherichia coli CFT073
uacaggccaccaggccacggcg

SEQ ID NO: 2682027 - RNA, 20 nt, Escherichia coli CFT073
uacaggccaccgcccaccau

SEQ ID NO: 2682028 - RNA, 11 nt, Escherichia coli CFT073
uacaggcggaa

SEQ ID NO: 2682029 - RNA, 22 nt, Escherichia coli CFT073
uacaggcggugucggaacggua

SEQ ID NO: 2682030 - RNA, 19 nt, Escherichia coli CFT073
uacaggcuaucggccaggu

SEQ ID NO: 2682031 - RNA, 22 nt, Escherichia coli CFT073
uacagggaacacauguguugau

SEQ ID NO: 2682032 - RNA, 14 nt, Escherichia coli CFT073
uacaggguaaaaag

SEQ ID NO: 2682033 - RNA, 22 nt, Escherichia coli CFT073
uacagucaaggaaugaaauauu

SEQ ID NO: 2682034 - RNA, 16 nt, Escherichia coli CFT073
uacagugccccaaaug

SEQ ID NO: 2682035 - RNA, 21 nt, Escherichia coli CFT073
uacaguuuccuucugauauua

SEQ ID NO: 2682036 - RNA, 14 nt, Escherichia coli CFT073
uacauaacgcagcg

SEQ ID NO: 2682037 - RNA, 16 nt, Escherichia coli CFT073
uacauaccagcagcau

SEQ ID NO: 2682038 - RNA, 14 nt, Escherichia coli CFT073
uacauaccagcagg

SEQ ID NO: 2682039 - RNA, 15 nt, Escherichia coli CFT073
uacauacugagaacc

SEQ ID NO: 2682040 - RNA, 14 nt, Escherichia coli CFT073
uacauagccaucug

SEQ ID NO: 2682041 - RNA, 16 nt, Escherichia coli CFT073
uacauagccaucugcc

SEQ ID NO: 2682042 - RNA, 21 nt, Escherichia coli CFT073
uacauagcguuaccucaaaau

SEQ ID NO: 2682043 - RNA, 15 nt, Escherichia coli CFT073
uacauaguucuucaa

SEQ ID NO: 2682044 - RNA, 13 nt, Escherichia coli CFT073
uacauauauuacu

SEQ ID NO: 2682045 - RNA, 18 nt, Escherichia coli CFT073
uacaucaccguucagcuu

SEQ ID NO: 2682046 - RNA, 16 nt, Escherichia coli CFT073
uacaucagaguacaga

SEQ ID NO: 2682047 - RNA, 16 nt, Escherichia coli CFT073
uacaucaggcagaacg

SEQ ID NO: 2682048 - RNA, 18 nt, Escherichia coli CFT073
uaccgaagaguaaccaaa

SEQ ID NO: 2682049 - RNA, 13 nt, Escherichia coli CFT073
uaccgaauccagc

SEQ ID NO: 2682050 - RNA, 14 nt, Escherichia coli CFT073
uaccgaauccagca

SEQ ID NO: 2682051 - RNA, 21 nt, Escherichia coli CFT073
uaccgagcguucaaaacggcu

SEQ ID NO: 2682052 - RNA, 14 nt, Escherichia coli CFT073
uaccgaguccgcca

SEQ ID NO: 2682053 - RNA, 16 nt, Escherichia coli CFT073
uaccgauaucaauaac

SEQ ID NO: 2682054 - RNA, 17 nt, Escherichia coli CFT073
uaccgaucaguaccagc

SEQ ID NO: 2682055 - RNA, 14 nt, Escherichia coli CFT073
uaccgauccccgga

SEQ ID NO: 2682056 - RNA, 17 nt, Escherichia coli CFT073
uaccgaucgccagcagg

SEQ ID NO: 2682057 - RNA, 19 nt, Escherichia coli CFT073
uaccgaucgcgguaacaga

SEQ ID NO: 2682058 - RNA, 13 nt, Escherichia coli CFT073
uaccgaugaaguc

SEQ ID NO: 2682059 - RNA, 16 nt, Escherichia coli CFT073
uaccgaugaagucauu

SEQ ID NO: 2682060 - RNA, 19 nt, Escherichia coli CFT073
uaccgaugaagucauugau

SEQ ID NO: 2682061 - RNA, 22 nt, Escherichia coli CFT073
uaccgaugagcugcaacuggcg

SEQ ID NO: 2682062 - RNA, 21 nt, Escherichia coli CFT073
uaccgauuuucucaccgauag

SEQ ID NO: 2682063 - RNA, 15 nt, Escherichia coli CFT073
uaccgcaccaccagc

SEQ ID NO: 2682064 - RNA, 20 nt, Escherichia coli CFT073
uaccgcaccaccagcagcug

SEQ ID NO: 2682065 - RNA, 18 nt, Escherichia coli CFT073
uaccgcagugaaauuucu

SEQ ID NO: 2682066 - RNA, 16 nt, Escherichia coli CFT073
uaccgcauuaucaagg

SEQ ID NO: 2682067 - RNA, 15 nt, Escherichia coli CFT073
uaccgccaauuacca

SEQ ID NO: 2682068 - RNA, 16 nt, Escherichia coli CFT073
uaccgccacagcagcc

SEQ ID NO: 2682069 - RNA, 12 nt, Escherichia coli CFT073
uaccgccagacc

SEQ ID NO: 2682070 - RNA, 17 nt, Escherichia coli CFT073
uaccgcccacuaccagc

SEQ ID NO: 2682071 - RNA, 20 nt, Escherichia coli CFT073
uaccgcgguucccagcgucg

SEQ ID NO: 2682072 - RNA, 20 nt, Escherichia coli CFT073
uaccggaaaaggccacggug

SEQ ID NO: 2682073 - RNA, 18 nt, Escherichia coli CFT073
uaccggaugcucacagag

SEQ ID NO: 2682074 - RNA, 13 nt, Escherichia coli CFT073
uaccggcaaacuu

SEQ ID NO: 2682075 - RNA, 15 nt, Escherichia coli CFT073
uaccggcaaugguuu

SEQ ID NO: 2682076 - RNA, 21 nt, Escherichia coli CFT073
uaccggcgacuuccugagcuc

SEQ ID NO: 2682077 - RNA, 18 nt, Escherichia coli CFT073
uaccggcgucccaucggc

SEQ ID NO: 2682078 - RNA, 17 nt, Escherichia coli CFT073
uaccggcuucgucgcca

SEQ ID NO: 2682079 - RNA, 20 nt, Escherichia coli CFT073
uaccgggccugaacaagcaa

SEQ ID NO: 2682080 - RNA, 19 nt, Escherichia coli CFT073
uaccgggcgcgaggccagc

SEQ ID NO: 2682081 - RNA, 21 nt, Escherichia coli CFT073
uaccgggcgcgaggccagcgg

SEQ ID NO: 2682082 - RNA, 14 nt, Escherichia coli CFT073
uaccggucagggcc

SEQ ID NO: 2682083 - RNA, 14 nt, Escherichia coli CFT073
uaccguaaaacuca

SEQ ID NO: 2682084 - RNA, 16 nt, Escherichia coli CFT073
uaccguaccaggcaua

SEQ ID NO: 2682085 - RNA, 15 nt, Escherichia coli CFT073
uaccguaucuaccac

SEQ ID NO: 2682086 - RNA, 22 nt, Escherichia coli CFT073
uaccguaugauguauauuucug

SEQ ID NO: 2682087 - RNA, 15 nt, Escherichia coli CFT073
uaccguauucaacga

SEQ ID NO: 2682088 - RNA, 13 nt, Escherichia coli CFT073
uaccgucuguaac

SEQ ID NO: 2682089 - RNA, 18 nt, Escherichia coli CFT073
uaccgugcagcacggaga

SEQ ID NO: 2682090 - RNA, 18 nt, Escherichia coli CFT073
uaccgugcuguacagcag

SEQ ID NO: 2682091 - RNA, 18 nt, Escherichia coli CFT073
uaccguuccgacaccgcc

SEQ ID NO: 2682092 - RNA, 22 nt, Escherichia coli CFT073
uaccguugcggcuccagacgcc

SEQ ID NO: 2682093 - RNA, 23 nt, Escherichia coli CFT073
uaccguugcggcuccagacgccc

SEQ ID NO: 2682094 - RNA, 13 nt, Escherichia coli CFT073
uaccguugugcuu

SEQ ID NO: 2682095 - RNA, 21 nt, Escherichia coli CFT073
uaccuaaaagcacgccagaca

SEQ ID NO: 2682096 - RNA, 19 nt, Escherichia coli CFT073
uaccuaacaguucacccgg

SEQ ID NO: 2682097 - RNA, 14 nt, Escherichia coli CFT073
uaccuacgcuugcu

SEQ ID NO: 2682098 - RNA, 19 nt, Escherichia coli CFT073
uaccugagccugugcaugu

SEQ ID NO: 2682099 - RNA, 22 nt, Escherichia coli CFT073
uaccugagucauuaacucaguu

SEQ ID NO: 2682100 - RNA, 17 nt, Escherichia coli CFT073
uaccugcguuuuuaacg

SEQ ID NO: 2682101 - RNA, 18 nt, Escherichia coli CFT073
uaccuggucgauaauaau

SEQ ID NO: 2682102 - RNA, 18 nt, Escherichia coli CFT073
uaccugucgcgucaauca

SEQ ID NO: 2682103 - RNA, 20 nt, Escherichia coli CFT073
uaccuguuaauucucccugc

SEQ ID NO: 2682104 - RNA, 17 nt, Escherichia coli CFT073
uaccuucaauacuggca

SEQ ID NO: 2682105 - RNA, 17 nt, Escherichia coli CFT073
uaccuucacaaaaugcc

SEQ ID NO: 2682106 - RNA, 20 nt, Escherichia coli CFT073
uaccuucagacucgaaggaa

SEQ ID NO: 2682107 - RNA, 14 nt, Escherichia coli CFT073
uaccuucaucccuu

SEQ ID NO: 2682108 - RNA, 20 nt, Escherichia coli CFT073
uaccuuccuacaagagguca

SEQ ID NO: 2682109 - RNA, 16 nt, Escherichia coli CFT073
uaccuucggccccauc

SEQ ID NO: 2682110 - RNA, 19 nt, Escherichia coli CFT073
uaccuuuaaacuguuucca

SEQ ID NO: 2682111 - RNA, 16 nt, Escherichia coli CFT073
uaccuuuccagucucc

SEQ ID NO: 2682112 - RNA, 16 nt, Escherichia coli CFT073
uaccuuuugcugucuc

SEQ ID NO: 2682113 - RNA, 15 nt, Escherichia coli CFT073
uacgaaacagacggc

SEQ ID NO: 2682114 - RNA, 18 nt, Escherichia coli CFT073
uacgaauugccgcgccgg

SEQ ID NO: 2682115 - RNA, 14 nt, Escherichia coli CFT073
uacgacagucaaua

SEQ ID NO: 2682116 - RNA, 23 nt, Escherichia coli CFT073
uacgaccgcaaagguugcagcuc

SEQ ID NO: 2682117 - RNA, 17 nt, Escherichia coli CFT073
uacgacuggccauggau

SEQ ID NO: 2682118 - RNA, 21 nt, Escherichia coli CFT073
uacgagcuucgacuuccugca

SEQ ID NO: 2682119 - RNA, 18 nt, Escherichia coli CFT073
uacgaggauucgaaccuc

SEQ ID NO: 2682120 - RNA, 20 nt, Escherichia coli CFT073
uacgauaaucaggaaugugg

SEQ ID NO: 2682121 - RNA, 13 nt, Escherichia coli CFT073
uacgaucagaguu

SEQ ID NO: 2682122 - RNA, 22 nt, Escherichia coli CFT073
uacgaucgagauugaucccggc

SEQ ID NO: 2682123 - RNA, 18 nt, Escherichia coli CFT073
uacgauuaacgccagacu

SEQ ID NO: 2682124 - RNA, 18 nt, Escherichia coli CFT073
uacgcaaagcagcaagaa

SEQ ID NO: 2682125 - RNA, 21 nt, Escherichia coli CFT073
uacgcaacugccaguaaagca

SEQ ID NO: 2682126 - RNA, 15 nt, Escherichia coli CFT073
uacgcaaugugcagc

SEQ ID NO: 2682127 - RNA, 23 nt, Escherichia coli CFT073
uacgcaccgguuccgggcuguuu

SEQ ID NO: 2682128 - RNA, 16 nt, Escherichia coli CFT073
uacgcacuucuucguu

SEQ ID NO: 2682129 - RNA, 14 nt, Escherichia coli CFT073
uacgcagacggcuu

SEQ ID NO: 2682130 - RNA, 21 nt, Escherichia coli CFT073
uacgcagacggcuuucuucag

SEQ ID NO: 2682131 - RNA, 20 nt, Escherichia coli CFT073
uacgcaguaaauaaaaaauc

SEQ ID NO: 2682132 - RNA, 15 nt, Escherichia coli CFT073
uacgcauaaacaucu

SEQ ID NO: 2682133 - RNA, 21 nt, Escherichia coli CFT073
uacgcauaaccgguaccugcc

SEQ ID NO: 2682134 - RNA, 11 nt, Escherichia coli CFT073
uacgcaucacc

SEQ ID NO: 2682135 - RNA, 14 nt, Escherichia coli CFT073
uacgcaucaugccg

SEQ ID NO: 2682136 - RNA, 18 nt, Escherichia coli CFT073
uacgcaucaugccgccca

SEQ ID NO: 2682137 - RNA, 21 nt, Escherichia coli CFT073
uacgccaucaguuucagagcg

SEQ ID NO: 2682138 - RNA, 15 nt, Escherichia coli CFT073
uacgccauccccgaa

SEQ ID NO: 2682139 - RNA, 15 nt, Escherichia coli CFT073
uacgccauucgcugu

SEQ ID NO: 2682140 - RNA, 22 nt, Escherichia coli CFT073
uacgcccacgcuucacugccgg

SEQ ID NO: 2682141 - RNA, 22 nt, Escherichia coli CFT073
uacgcccgcugcgcccaguuuc

SEQ ID NO: 2682142 - RNA, 18 nt, Escherichia coli CFT073
uacgccgccgcaaccgua

SEQ ID NO: 2682143 - RNA, 14 nt, Escherichia coli CFT073
uacgccgcuaaugu

SEQ ID NO: 2682144 - RNA, 17 nt, Escherichia coli CFT073
uacgccggucacgccgg

SEQ ID NO: 2682145 - RNA, 19 nt, Escherichia coli CFT073
uacgcgaucgcgaaaccac

SEQ ID NO: 2682146 - RNA, 16 nt, Escherichia coli CFT073
uacgcgcgcaggcaac

SEQ ID NO: 2682147 - RNA, 17 nt, Escherichia coli CFT073
uacgcggaaacuuaauc

SEQ ID NO: 2682148 - RNA, 19 nt, Escherichia coli CFT073
uacgcggaucuccggcgac

SEQ ID NO: 2682149 - RNA, 20 nt, Escherichia coli CFT073
uacgcgggaauagcucaguu

SEQ ID NO: 2682150 - RNA, 16 nt, Escherichia coli CFT073
uacgcguaaaauauug

SEQ ID NO: 2682151 - RNA, 21 nt, Escherichia coli CFT073
uacgcuauacaaccaccccac

SEQ ID NO: 2682152 - RNA, 17 nt, Escherichia coli CFT073
uacgcucauuuucuuuc

SEQ ID NO: 2682153 - RNA, 13 nt, Escherichia coli CFT073
uacgcugaccuua

SEQ ID NO: 2682154 - RNA, 22 nt, Escherichia coli CFT073
uacgcugacgugcugcaucucu

SEQ ID NO: 2682155 - RNA, 17 nt, Escherichia coli CFT073
uacgcugauuggcccca

SEQ ID NO: 2682156 - RNA, 21 nt, Haemophilus influenzae Rd
aaaaaagcguugaaaauaaau

SEQ ID NO: 2682157 - RNA, 19 nt, Haemophilus influenzae Rd
aaaaaagugcggaaaauuu

SEQ ID NO: 2682158 - RNA, 21 nt, Haemophilus influenzae Rd
aaaaaagugcgguugaaauuu

SEQ ID NO: 2682159 - RNA, 18 nt, Haemophilus influenzae Rd
aaaaaauaaaaaauauuu

SEQ ID NO: 2682160 - RNA, 11 nt, Haemophilus influenzae Rd
aaaaaauaagg

SEQ ID NO: 2682161 - RNA, 14 nt, Haemophilus influenzae Rd
aaaaaauaauucca

SEQ ID NO: 2682162 - RNA, 11 nt, Haemophilus influenzae Rd
aaaaaauaguu

SEQ ID NO: 2682163 - RNA, 18 nt, Haemophilus influenzae Rd
aaaaaauaguuaauaauc

SEQ ID NO: 2682164 - RNA, 12 nt, Haemophilus influenzae Rd
aaaaaauaguuu

SEQ ID NO: 2682165 - RNA, 17 nt, Haemophilus influenzae Rd
aaaaaauauccaaauca

SEQ ID NO: 2682166 - RNA, 13 nt, Haemophilus influenzae Rd
aaaaaaucaauca

SEQ ID NO: 2682167 - RNA, 13 nt, Haemophilus influenzae Rd
aaaaaauccuaaa

SEQ ID NO: 2682168 - RNA, 21 nt, Haemophilus influenzae Rd
aaaaaauccuaaauaaagauu

SEQ ID NO: 2682169 - RNA, 21 nt, Haemophilus influenzae Rd
aaaaaaucggugcaacaauau

SEQ ID NO: 2682170 - RNA, 23 nt, Haemophilus influenzae Rd
aaaaaauuaaauuguaacuauau

SEQ ID NO: 2682171 - RNA, 13 nt, Haemophilus influenzae Rd
aaaaaauuuauag

SEQ ID NO: 2682172 - RNA, 13 nt, Haemophilus influenzae Rd
aaaaacaagagga

SEQ ID NO: 2682173 - RNA, 13 nt, Haemophilus influenzae Rd
aaaaacaagugaa

SEQ ID NO: 2682174 - RNA, 13 nt, Haemophilus influenzae Rd
aaaaacaauacua

SEQ ID NO: 2682175 - RNA, 13 nt, Haemophilus influenzae Rd
aaaaacaccuaaa

SEQ ID NO: 2682176 - RNA, 13 nt, Haemophilus influenzae Rd
aaaaacauaauug

SEQ ID NO: 2682177 - RNA, 13 nt, Haemophilus influenzae Rd
aaaaacauaguaa

SEQ ID NO: 2682178 - RNA, 22 nt, Haemophilus influenzae Rd
aaaaacauauuccaagcacuga

SEQ ID NO: 2682179 - RNA, 12 nt, Haemophilus influenzae Rd
aaaaacauucaa

SEQ ID NO: 2682180 - RNA, 19 nt, Haemophilus influenzae Rd
aaaaacauucaaucuuuuu

SEQ ID NO: 2682181 - RNA, 18 nt, Haemophilus influenzae Rd
aaaaaccagauaaaaacu

SEQ ID NO: 2682182 - RNA, 14 nt, Haemophilus influenzae Rd
aaaaaccagauaag

SEQ ID NO: 2682183 - RNA, 17 nt, Haemophilus influenzae Rd
aaaaacccaguuuuaaa

SEQ ID NO: 2682184 - RNA, 18 nt, Haemophilus influenzae Rd
aaaaacccguaauuaaaa

SEQ ID NO: 2682185 - RNA, 19 nt, Haemophilus influenzae Rd
aaaaacccguaauuaaaaa

SEQ ID NO: 2682186 - RNA, 21 nt, Haemophilus influenzae Rd
aaaaacccguaauuaaaaaua

SEQ ID NO: 2682187 - RNA, 22 nt, Haemophilus influenzae Rd
aaaaacccguaauuaaaaauaa

SEQ ID NO: 2682188 - RNA, 21 nt, Haemophilus influenzae Rd
aaaaaccuuguggcaaccaac

SEQ ID NO: 2682189 - RNA, 22 nt, Haemophilus influenzae Rd
aaaaacgcaucguguccguaau

SEQ ID NO: 2682190 - RNA, 18 nt, Haemophilus influenzae Rd
aaaaacgcuggaauauuu

SEQ ID NO: 2682191 - RNA, 18 nt, Haemophilus influenzae Rd
aaaaacggauuaauuucu

SEQ ID NO: 2682192 - RNA, 15 nt, Haemophilus influenzae Rd
aaaaacguucgugcu

SEQ ID NO: 2682193 - RNA, 19 nt, Haemophilus influenzae Rd
aaaaacuaaccgcacuuuu

SEQ ID NO: 2682194 - RNA, 23 nt, Haemophilus influenzae Rd
aaaaacuagagauauaagaaaua

SEQ ID NO: 2682195 - RNA, 21 nt, Haemophilus influenzae Rd
aaaaagaaaaccaaaacauaa

SEQ ID NO: 2682196 - RNA, 14 nt, Haemophilus influenzae Rd
aaaaagaaauaaaa

SEQ ID NO: 2682197 - RNA, 12 nt, Haemophilus influenzae Rd
aaaaagaaauau

SEQ ID NO: 2682198 - RNA, 12 nt, Haemophilus influenzae Rd
aaaaagaaauuu

SEQ ID NO: 2682199 - RNA, 14 nt, Haemophilus influenzae Rd
aaaaagaacuacau

SEQ ID NO: 2682200 - RNA, 21 nt, Haemophilus influenzae Rd
aaaaagaagcucacuuuauau

SEQ ID NO: 2682201 - RNA, 14 nt, Haemophilus influenzae Rd
aaaaagacaaaacg

SEQ ID NO: 2682202 - RNA, 14 nt, Haemophilus influenzae Rd
aaaaagacgaaaau

SEQ ID NO: 2682203 - RNA, 14 nt, Haemophilus influenzae Rd
aaaaagacuaaacu

SEQ ID NO: 2682204 - RNA, 21 nt, Haemophilus influenzae Rd
aaaaagauaacuuagaaaaua

SEQ ID NO: 2682205 - RNA, 18 nt, Haemophilus influenzae Rd
aaaaagauugaauguuuu

SEQ ID NO: 2682206 - RNA, 20 nt, Haemophilus influenzae Rd
aaaaagauugcuccuacuuu

SEQ ID NO: 2682207 - RNA, 16 nt, Haemophilus influenzae Rd
aaaaagcaccuaaaaa

SEQ ID NO: 2682208 - RNA, 19 nt, Haemophilus influenzae Rd
aaaaagcaccuaaaaauuu

SEQ ID NO: 2682209 - RNA, 23 nt, Haemophilus influenzae Rd
aaaaagcccaaaugcaacaauaa

SEQ ID NO: 2682210 - RNA, 19 nt, Haemophilus influenzae Rd
aaaaagcccaaguaauaca

SEQ ID NO: 2682211 - RNA, 20 nt, Haemophilus influenzae Rd
aaaaagcgaaucuuucgauu

SEQ ID NO: 2682212 - RNA, 20 nt, Haemophilus influenzae Rd
aaaaagcgugauuuuuuuca

SEQ ID NO: 2682213 - RNA, 15 nt, Haemophilus influenzae Rd
aaaaagcguugaaaa

SEQ ID NO: 2682214 - RNA, 12 nt, Haemophilus influenzae Rd
aaaaagcuaaaa

SEQ ID NO: 2682215 - RNA, 14 nt, Haemophilus influenzae Rd
aaaaagcuaaaaaa

SEQ ID NO: 2682216 - RNA, 15 nt, Haemophilus influenzae Rd
aaaaagcuaaaaaaa

SEQ ID NO: 2682217 - RNA, 23 nt, Haemophilus influenzae Rd
aaaaagcuuccuuuaaucuguca

SEQ ID NO: 2682218 - RNA, 14 nt, Haemophilus influenzae Rd
aaaaaggaaauaau

SEQ ID NO: 2682219 - RNA, 15 nt, Haemophilus influenzae Rd
aaaaaggcuaaguuc

SEQ ID NO: 2682220 - RNA, 19 nt, Haemophilus influenzae Rd
aaaaagggaugguuaauuu

SEQ ID NO: 2682221 - RNA, 21 nt, Haemophilus influenzae Rd
aaaaagggaugguuaauuuuu

SEQ ID NO: 2682222 - RNA, 22 nt, Haemophilus influenzae Rd
aaaaagggaugguuaauuuuuc

SEQ ID NO: 2682223 - RNA, 18 nt, Haemophilus influenzae Rd
aaaaaguaguaucagauu

SEQ ID NO: 2682224 - RNA, 20 nt, Haemophilus influenzae Rd
aaaaagugcgguaaaaucac

SEQ ID NO: 2682225 - RNA, 21 nt, Haemophilus influenzae Rd
aaaaagugcgguaaaauuuca

SEQ ID NO: 2682226 - RNA, 21 nt, Haemophilus influenzae Rd
aaaaagugcgguaaauuuuua

SEQ ID NO: 2682227 - RNA, 20 nt, Haemophilus influenzae Rd
aaaaagugcggucaauaaaa

SEQ ID NO: 2682228 - RNA, 23 nt, Haemophilus influenzae Rd
aaaaagugcggucaauaaaaaua

SEQ ID NO: 2682229 - RNA, 19 nt, Haemophilus influenzae Rd
aaaaagugcggugaaauuu

SEQ ID NO: 2682230 - RNA, 21 nt, Haemophilus influenzae Rd
aaaaagugcggugaaauuuca

SEQ ID NO: 2682231 - RNA, 20 nt, Haemophilus influenzae Rd
aaaaagugcgguugaaauuu

SEQ ID NO: 2682232 - RNA, 19 nt, Haemophilus influenzae Rd
aaaaaguuugauaaaguuu

SEQ ID NO: 2682233 - RNA, 13 nt, Haemophilus influenzae Rd
aaaaauaaaaaaa

SEQ ID NO: 2682234 - RNA, 15 nt, Haemophilus influenzae Rd
aaaaauaaaaaauau

SEQ ID NO: 2682235 - RNA, 17 nt, Haemophilus influenzae Rd
aaaaauaaaaaauauuu

SEQ ID NO: 2682236 - RNA, 14 nt, Haemophilus influenzae Rd
aaaaauaaaaacau

SEQ ID NO: 2682237 - RNA, 19 nt, Haemophilus influenzae Rd
aaaaauaaaaacauugcca

SEQ ID NO: 2682238 - RNA, 13 nt, Haemophilus influenzae Rd
aaaaauaaaaagu

SEQ ID NO: 2682239 - RNA, 13 nt, Haemophilus influenzae Rd
aaaaauaaauaga

SEQ ID NO: 2682240 - RNA, 22 nt, Haemophilus influenzae Rd
aaaaauaaauagauacaagaaa

SEQ ID NO: 2682241 - RNA, 12 nt, Haemophilus influenzae Rd
aaaaauaaaugg

SEQ ID NO: 2682242 - RNA, 16 nt, Haemophilus influenzae Rd
aaaaauaaccuaauuu

SEQ ID NO: 2682243 - RNA, 22 nt, Haemophilus influenzae Rd
aaaaauaagggcugauuuuaaa

SEQ ID NO: 2682244 - RNA, 23 nt, Haemophilus influenzae Rd
aaaaauaauuuucauugaaaaag

SEQ ID NO: 2682245 - RNA, 18 nt, Haemophilus influenzae Rd
aaaaauacggugaaauuu

SEQ ID NO: 2682246 - RNA, 13 nt, Haemophilus influenzae Rd
aaaaauacuaacu

SEQ ID NO: 2682247 - RNA, 22 nt, Haemophilus influenzae Rd
aaaaauagccucagguauuucu

SEQ ID NO: 2682248 - RNA, 22 nt, Haemophilus influenzae Rd
aaaaauaguuaaucgaaaauuu

SEQ ID NO: 2682249 - RNA, 23 nt, Haemophilus influenzae Rd
aaaaauaguuaaucgaaaauuua

SEQ ID NO: 2682250 - RNA, 15 nt, Haemophilus influenzae Rd
aaaaauauaaacuga

SEQ ID NO: 2682251 - RNA, 12 nt, Haemophilus influenzae Rd
aaaaauauauuu

SEQ ID NO: 2682252 - RNA, 19 nt, Haemophilus influenzae Rd
aaaaauauauuuagauaca

SEQ ID NO: 2682253 - RNA, 17 nt, Haemophilus influenzae Rd
aaaaauaucgcacuuuu

SEQ ID NO: 2682254 - RNA, 21 nt, Haemophilus influenzae Rd
aaaaauaucgcacuuuuuuca

SEQ ID NO: 2682255 - RNA, 18 nt, Haemophilus influenzae Rd
aaaaauaucguaaaaaau

SEQ ID NO: 2682256 - RNA, 14 nt, Haemophilus influenzae Rd
aaaaauauguauuu

SEQ ID NO: 2682257 - RNA, 13 nt, Haemophilus influenzae Rd
aaaaauauuaaag

SEQ ID NO: 2682258 - RNA, 20 nt, Haemophilus influenzae Rd
aaaaauauuuuaauaaagau

SEQ ID NO: 2682259 - RNA, 19 nt, Haemophilus influenzae Rd
aaaaaucaucaauuugugc

SEQ ID NO: 2682260 - RNA, 19 nt, Haemophilus influenzae Rd
aaaaaucaucguauuaaaa

SEQ ID NO: 2682261 - RNA, 20 nt, Haemophilus influenzae Rd
aaaacuauuaucuacuagcc

SEQ ID NO: 2682262 - RNA, 17 nt, Haemophilus influenzae Rd
aaaacuauuuuuaauuu

SEQ ID NO: 2682263 - RNA, 15 nt, Haemophilus influenzae Rd
aaaacucgaauagaa

SEQ ID NO: 2682264 - RNA, 23 nt, Haemophilus influenzae Rd
aaaacucgacuuuugcauuugcu

SEQ ID NO: 2682265 - RNA, 16 nt, Haemophilus influenzae Rd
aaaacuuaucauuaau

SEQ ID NO: 2682266 - RNA, 17 nt, Haemophilus influenzae Rd
aaaacuuccuaaugcca

SEQ ID NO: 2682267 - RNA, 20 nt, Haemophilus influenzae Rd
aaaacuucucuuauuugugu

SEQ ID NO: 2682268 - RNA, 22 nt, Haemophilus influenzae Rd
aaaacuucucuuauuugugugg

SEQ ID NO: 2682269 - RNA, 13 nt, Haemophilus influenzae Rd
aaaacuugcaaac

SEQ ID NO: 2682270 - RNA, 16 nt, Haemophilus influenzae Rd
aaaacuugcaaaccaa

SEQ ID NO: 2682271 - RNA, 16 nt, Haemophilus influenzae Rd
aaaacuuggcaauuca

SEQ ID NO: 2682272 - RNA, 23 nt, Haemophilus influenzae Rd
aaaacuuuucuuauaauuacaga

SEQ ID NO: 2682273 - RNA, 18 nt, Haemophilus influenzae Rd
aaaacuuuuguucuugcu

SEQ ID NO: 2682274 - RNA, 15 nt, Haemophilus influenzae Rd
aaaagaaaagaugaa

SEQ ID NO: 2682275 - RNA, 14 nt, Haemophilus influenzae Rd
aaaagaaauaaaag

SEQ ID NO: 2682276 - RNA, 16 nt, Haemophilus influenzae Rd
aaaagaaauaaaagau

SEQ ID NO: 2682277 - RNA, 23 nt, Haemophilus influenzae Rd
aaaagaaauaacgucauuaauuu

SEQ ID NO: 2682278 - RNA, 11 nt, Haemophilus influenzae Rd
aaaagaaauau

SEQ ID NO: 2682279 - RNA, 13 nt, Haemophilus influenzae Rd
aaaagaaauuaag

SEQ ID NO: 2682280 - RNA, 16 nt, Haemophilus influenzae Rd
aaaagaaccuaucuca

SEQ ID NO: 2682281 - RNA, 17 nt, Haemophilus influenzae Rd
aaaagaacggucaaaau

SEQ ID NO: 2682282 - RNA, 13 nt, Haemophilus influenzae Rd
aaaagaauaauau

SEQ ID NO: 2682283 - RNA, 17 nt, Haemophilus influenzae Rd
aaaagaauauuccaaag

SEQ ID NO: 2682284 - RNA, 15 nt, Haemophilus influenzae Rd
aaaagacaauaauuc

SEQ ID NO: 2682285 - RNA, 13 nt, Haemophilus influenzae Rd
aaaagaccacauu

SEQ ID NO: 2682286 - RNA, 19 nt, Haemophilus influenzae Rd
aaaagaccaugccuguucu

SEQ ID NO: 2682287 - RNA, 19 nt, Haemophilus influenzae Rd
aaaagacgaagaaacaacc

SEQ ID NO: 2682288 - RNA, 15 nt, Haemophilus influenzae Rd
aaaagacuaaacuca

SEQ ID NO: 2682289 - RNA, 20 nt, Haemophilus influenzae Rd
aaaagagagcuucucuuuuu

SEQ ID NO: 2682290 - RNA, 20 nt, Haemophilus influenzae Rd
aaaagagcgguugaaaauuu

SEQ ID NO: 2682291 - RNA, 22 nt, Haemophilus influenzae Rd
aaaagagugcgguuaauuuuga

SEQ ID NO: 2682292 - RNA, 13 nt, Haemophilus influenzae Rd
aaaagauaaaaca

SEQ ID NO: 2682293 - RNA, 14 nt, Haemophilus influenzae Rd
aaaagauaaacaaa

SEQ ID NO: 2682294 - RNA, 20 nt, Haemophilus influenzae Rd
aaaagauaaacaaaccuaaa

SEQ ID NO: 2682295 - RNA, 19 nt, Haemophilus influenzae Rd
aaaagauacacucacuuuu

SEQ ID NO: 2682296 - RNA, 20 nt, Haemophilus influenzae Rd
aaaagaucaggaucaaaaau

SEQ ID NO: 2682297 - RNA, 22 nt, Haemophilus influenzae Rd
aaaagaucaggaucaaaaauau

SEQ ID NO: 2682298 - RNA, 19 nt, Haemophilus influenzae Rd
aaaagaucauuuuuuuaaa

SEQ ID NO: 2682299 - RNA, 18 nt, Haemophilus influenzae Rd
aaaagauuauacgaucac

SEQ ID NO: 2682300 - RNA, 22 nt, Haemophilus influenzae Rd
aaaagauucaacaauaauuuuu

SEQ ID NO: 2682301 - RNA, 13 nt, Haemophilus influenzae Rd
aaaagcaaaugag

SEQ ID NO: 2682302 - RNA, 13 nt, Haemophilus influenzae Rd
aaaagcaagauac

SEQ ID NO: 2682303 - RNA, 16 nt, Haemophilus influenzae Rd
aaaagcaauaauccaa

SEQ ID NO: 2682304 - RNA, 13 nt, Haemophilus influenzae Rd
aaaagcaauaaug

SEQ ID NO: 2682305 - RNA, 22 nt, Haemophilus influenzae Rd
aaaagccaccaaaugguggcuu

SEQ ID NO: 2682306 - RNA, 15 nt, Haemophilus influenzae Rd
aaaagccacuuucaa

SEQ ID NO: 2682307 - RNA, 16 nt, Haemophilus influenzae Rd
aaaagccacuuucaau

SEQ ID NO: 2682308 - RNA, 16 nt, Haemophilus influenzae Rd
aaaagcccuucuaugc

SEQ ID NO: 2682309 - RNA, 19 nt, Haemophilus influenzae Rd
aaaagcgaaucuuucgauu

SEQ ID NO: 2682310 - RNA, 17 nt, Haemophilus influenzae Rd
aaaagcggcgcaucaau

SEQ ID NO: 2682311 - RNA, 23 nt, Haemophilus influenzae Rd
aaaagcggcgcaucaauauguuc

SEQ ID NO: 2682312 - RNA, 19 nt, Haemophilus influenzae Rd
aaaagcguugaaaauaaau

SEQ ID NO: 2682313 - RNA, 22 nt, Haemophilus influenzae Rd
aaaagcguugaaaauaaauuga

SEQ ID NO: 2682314 - RNA, 15 nt, Haemophilus influenzae Rd
aaaagcuaaaaaaac

SEQ ID NO: 2682315 - RNA, 23 nt, Haemophilus influenzae Rd
aaaagcuacaccgauuucuuuac

SEQ ID NO: 2682316 - RNA, 20 nt, Haemophilus influenzae Rd
aaaagcugcacuauauacau

SEQ ID NO: 2682317 - RNA, 15 nt, Haemophilus influenzae Rd
aaaagcuguucugca

SEQ ID NO: 2682318 - RNA, 19 nt, Haemophilus influenzae Rd
aaaagcuuccauaauacuc

SEQ ID NO: 2682319 - RNA, 22 nt, Haemophilus influenzae Rd
aaaaggaaauaauuuccuuuuu

SEQ ID NO: 2682320 - RNA, 18 nt, Haemophilus influenzae Rd
aaaaggcgugauauuuuu

SEQ ID NO: 2682321 - RNA, 23 nt, Haemophilus influenzae Rd
aaaaggcuucgccauuuuuaaaa

SEQ ID NO: 2682322 - RNA, 13 nt, Haemophilus influenzae Rd
aaaaggucuuaau

SEQ ID NO: 2682323 - RNA, 20 nt, Haemophilus influenzae Rd
aaaaguaaaaauaaaaacau

SEQ ID NO: 2682324 - RNA, 20 nt, Haemophilus influenzae Rd
aaaaguaagcaauuuucugc

SEQ ID NO: 2682325 - RNA, 13 nt, Haemophilus influenzae Rd
aaaaguaccaaaa

SEQ ID NO: 2682326 - RNA, 21 nt, Haemophilus influenzae Rd
aaaaguaggagcaaucuuuuu

SEQ ID NO: 2682327 - RNA, 20 nt, Haemophilus influenzae Rd
aaaaguaggcauaaugccua

SEQ ID NO: 2682328 - RNA, 14 nt, Haemophilus influenzae Rd
aaaaguauaaacuu

SEQ ID NO: 2682329 - RNA, 22 nt, Haemophilus influenzae Rd
aaaagucaguaaaccaagugaa

SEQ ID NO: 2682330 - RNA, 20 nt, Haemophilus influenzae Rd
aaaagucccugauucuuuga

SEQ ID NO: 2682331 - RNA, 13 nt, Haemophilus influenzae Rd
aaaaguccgcauu

SEQ ID NO: 2682332 - RNA, 18 nt, Haemophilus influenzae Rd
aaaagucuguuuaaaaac

SEQ ID NO: 2682333 - RNA, 17 nt, Haemophilus influenzae Rd
aaaagugcgauauuuuu

SEQ ID NO: 2682334 - RNA, 17 nt, Haemophilus influenzae Rd
aaaagugcggaaaauuu

SEQ ID NO: 2682335 - RNA, 19 nt, Haemophilus influenzae Rd
aaaagugcggaaaauuuuc

SEQ ID NO: 2682336 - RNA, 19 nt, Haemophilus influenzae Rd
aaaagugcggcuucauuuu

SEQ ID NO: 2682337 - RNA, 20 nt, Haemophilus influenzae Rd
aaaagugcgguaaaaauuca

SEQ ID NO: 2682338 - RNA, 20 nt, Haemophilus influenzae Rd
aaaagugcgguaaaauuuca

SEQ ID NO: 2682339 - RNA, 20 nt, Haemophilus influenzae Rd
aaaagugcgguaaauuuuua

SEQ ID NO: 2682340 - RNA, 21 nt, Haemophilus influenzae Rd
aaaagugcggucaauaaaaau

SEQ ID NO: 2682341 - RNA, 22 nt, Haemophilus influenzae Rd
aaaagugcggucaauaaaaaua

SEQ ID NO: 2682342 - RNA, 19 nt, Haemophilus influenzae Rd
aaaagugcggucuuuuuuu

SEQ ID NO: 2682343 - RNA, 18 nt, Haemophilus influenzae Rd
aaaagugcggugauuuuu

SEQ ID NO: 2682344 - RNA, 21 nt, Haemophilus influenzae Rd
aaaagugcggugcaauuugaa

SEQ ID NO: 2682345 - RNA, 17 nt, Haemophilus influenzae Rd
aaaagugcgguuaaaau

SEQ ID NO: 2682346 - RNA, 20 nt, Haemophilus influenzae Rd
aaaagugcgguuaaaauuca

SEQ ID NO: 2682347 - RNA, 16 nt, Haemophilus influenzae Rd
aaaaguguauaaauau

SEQ ID NO: 2682348 - RNA, 13 nt, Haemophilus influenzae Rd
aaaaguuaaacua

SEQ ID NO: 2682349 - RNA, 12 nt, Haemophilus influenzae Rd
aaaaguucuuuc

SEQ ID NO: 2682350 - RNA, 23 nt, Haemophilus influenzae Rd
aaaaguucuuucugucaucacau

SEQ ID NO: 2682351 - RNA, 19 nt, Haemophilus influenzae Rd
aaaaguuggacuaaacaac

SEQ ID NO: 2682352 - RNA, 17 nt, Haemophilus influenzae Rd
aaaaguuggauuaaaca

SEQ ID NO: 2682353 - RNA, 22 nt, Haemophilus influenzae Rd
aaaaguuuuccgacaacacuug

SEQ ID NO: 2682354 - RNA, 14 nt, Haemophilus influenzae Rd
aaaauaaaaaauau

SEQ ID NO: 2682355 - RNA, 15 nt, Haemophilus influenzae Rd
aaaauaaaaacauug

SEQ ID NO: 2682356 - RNA, 13 nt, Haemophilus influenzae Rd
aaaauaaaaccau

SEQ ID NO: 2682357 - RNA, 14 nt, Haemophilus influenzae Rd
aaaauaaaaugaca

SEQ ID NO: 2682358 - RNA, 20 nt, Haemophilus influenzae Rd
aaaauaaacauuuuucauuu

SEQ ID NO: 2682359 - RNA, 14 nt, Haemophilus influenzae Rd
aaaauaaacucauu

SEQ ID NO: 2682360 - RNA, 23 nt, Haemophilus influenzae Rd
aaaauaaagaaacguaaacaaaa

SEQ ID NO: 2682361 - RNA, 23 nt, Haemophilus influenzae Rd
aaaauaaagggcgguuaaaaauc

SEQ ID NO: 2682362 - RNA, 14 nt, Haemophilus influenzae Rd
aaaauaaauuaacu

SEQ ID NO: 2682363 - RNA, 16 nt, Haemophilus influenzae Rd
aaaauaaauuuuaaaa

SEQ ID NO: 2682364 - RNA, 19 nt, Haemophilus influenzae Rd
aaaauaaauuuuaaaaucu

SEQ ID NO: 2682365 - RNA, 13 nt, Haemophilus influenzae Rd
aaaauaaccaaua

SEQ ID NO: 2682366 - RNA, 14 nt, Haemophilus influenzae Rd
aaaaucuuugaauu

SEQ ID NO: 2682367 - RNA, 13 nt, Haemophilus influenzae Rd
aaaaucuuuuauu

SEQ ID NO: 2682368 - RNA, 15 nt, Haemophilus influenzae Rd
aaaaucuuuuauucu

SEQ ID NO: 2682369 - RNA, 20 nt, Haemophilus influenzae Rd
aaaaugaaagggaaauaaca

SEQ ID NO: 2682370 - RNA, 12 nt, Haemophilus influenzae Rd
aaaaugaaauau

SEQ ID NO: 2682371 - RNA, 16 nt, Haemophilus influenzae Rd
aaaaugaacaaaaaau

SEQ ID NO: 2682372 - RNA, 22 nt, Haemophilus influenzae Rd
aaaaugacagucgauuacaaaa

SEQ ID NO: 2682373 - RNA, 16 nt, Haemophilus influenzae Rd
aaaaugaugauaauuu

SEQ ID NO: 2682374 - RNA, 17 nt, Haemophilus influenzae Rd
aaaaugccccagcaaga

SEQ ID NO: 2682375 - RNA, 19 nt, Haemophilus influenzae Rd
aaaaugcuuauaaaacaga

SEQ ID NO: 2682376 - RNA, 19 nt, Haemophilus influenzae Rd
aaaaugcuugaauaaauga

SEQ ID NO: 2682377 - RNA, 16 nt, Haemophilus influenzae Rd
aaaauggaaauuugag

SEQ ID NO: 2682378 - RNA, 16 nt, Haemophilus influenzae Rd
aaaauggaauaaaaac

SEQ ID NO: 2682379 - RNA, 17 nt, Haemophilus influenzae Rd
aaaauggaauaaaaacg

SEQ ID NO: 2682380 - RNA, 17 nt, Haemophilus influenzae Rd
aaaauggcaaacaaaau

SEQ ID NO: 2682381 - RNA, 23 nt, Haemophilus influenzae Rd
aaaauggcaacgccaauaaaaag

SEQ ID NO: 2682382 - RNA, 16 nt, Haemophilus influenzae Rd
aaaauggcccugaaag

SEQ ID NO: 2682383 - RNA, 18 nt, Haemophilus influenzae Rd
aaaauggcuaaauucacu

SEQ ID NO: 2682384 - RNA, 21 nt, Haemophilus influenzae Rd
aaaauggguaaggaaaguucu

SEQ ID NO: 2682385 - RNA, 16 nt, Haemophilus influenzae Rd
aaaauggugcaagcau

SEQ ID NO: 2682386 - RNA, 19 nt, Haemophilus influenzae Rd
aaaauggugcaagcaucau

SEQ ID NO: 2682387 - RNA, 23 nt, Haemophilus influenzae Rd
aaaauggugcuuuuuacaacauu

SEQ ID NO: 2682388 - RNA, 22 nt, Haemophilus influenzae Rd
aaaaugguuuaaauaaccaaua

SEQ ID NO: 2682389 - RNA, 22 nt, Haemophilus influenzae Rd
aaaaugguuugacauauuuucu

SEQ ID NO: 2682390 - RNA, 14 nt, Haemophilus influenzae Rd
aaaauguaaauugg

SEQ ID NO: 2682391 - RNA, 18 nt, Haemophilus influenzae Rd
aaaauguaaauuggcauu

SEQ ID NO: 2682392 - RNA, 23 nt, Haemophilus influenzae Rd
aaaauguaaauuggcauuuucaa

SEQ ID NO: 2682393 - RNA, 13 nt, Haemophilus influenzae Rd
aaaauguaauucu

SEQ ID NO: 2682394 - RNA, 20 nt, Haemophilus influenzae Rd
aaaauguagagauaauaaau

SEQ ID NO: 2682395 - RNA, 22 nt, Haemophilus influenzae Rd
aaaaugucagcuuggaauugca

SEQ ID NO: 2682396 - RNA, 14 nt, Haemophilus influenzae Rd
aaaaugucgccauu

SEQ ID NO: 2682397 - RNA, 20 nt, Haemophilus influenzae Rd
aaaaugucgcuuucuuauau

SEQ ID NO: 2682398 - RNA, 23 nt, Haemophilus influenzae Rd
aaaaugugguuagcgauccuaaa

SEQ ID NO: 2682399 - RNA, 15 nt, Haemophilus influenzae Rd
aaaauguuauaaaua

SEQ ID NO: 2682400 - RNA, 19 nt, Haemophilus influenzae Rd
aaaauuaaaaauuuaauac

SEQ ID NO: 2682401 - RNA, 12 nt, Haemophilus influenzae Rd
aaaauuaaaacu

SEQ ID NO: 2682402 - RNA, 21 nt, Haemophilus influenzae Rd
aaaauuaaccgcacuuuagaa

SEQ ID NO: 2682403 - RNA, 15 nt, Haemophilus influenzae Rd
aaaauuaagcaauag

SEQ ID NO: 2682404 - RNA, 15 nt, Haemophilus influenzae Rd
aaaauuaauacugaa

SEQ ID NO: 2682405 - RNA, 18 nt, Haemophilus influenzae Rd
aaaauuaaucauaaaaau

SEQ ID NO: 2682406 - RNA, 19 nt, Haemophilus influenzae Rd
aaaauuaaucauaaaaaug

SEQ ID NO: 2682407 - RNA, 20 nt, Haemophilus influenzae Rd
aaaauuaaucugcauucuaa

SEQ ID NO: 2682408 - RNA, 20 nt, Haemophilus influenzae Rd
aaaauuacaaaaccaaucau

SEQ ID NO: 2682409 - RNA, 19 nt, Haemophilus influenzae Rd
aaaauuaccgcucuuuucg

SEQ ID NO: 2682410 - RNA, 12 nt, Haemophilus influenzae Rd
aaaauuagguaa

SEQ ID NO: 2682411 - RNA, 20 nt, Haemophilus influenzae Rd
aaaauuauaaaccaguuaaa

SEQ ID NO: 2682412 - RNA, 15 nt, Haemophilus influenzae Rd
aaaauuauagaacuu

SEQ ID NO: 2682413 - RNA, 14 nt, Haemophilus influenzae Rd
aaaauuaucugcuc

SEQ ID NO: 2682414 - RNA, 15 nt, Haemophilus influenzae Rd
aaaauuaucuggcaa

SEQ ID NO: 2682415 - RNA, 21 nt, Haemophilus influenzae Rd
aaaauuaucuggcaaucgcca

SEQ ID NO: 2682416 - RNA, 15 nt, Haemophilus influenzae Rd
aaaauuauuugacuu

SEQ ID NO: 2682417 - RNA, 14 nt, Haemophilus influenzae Rd
aaaauucaaagaag

SEQ ID NO: 2682418 - RNA, 13 nt, Haemophilus influenzae Rd
aaaauucaaagau

SEQ ID NO: 2682419 - RNA, 14 nt, Haemophilus influenzae Rd
aaaauucaaugaaa

SEQ ID NO: 2682420 - RNA, 19 nt, Haemophilus influenzae Rd
aaaauucguacuuuugauu

SEQ ID NO: 2682421 - RNA, 22 nt, Haemophilus influenzae Rd
aaaauucuauuaaaauauuucc

SEQ ID NO: 2682422 - RNA, 20 nt, Haemophilus influenzae Rd
aaaauucucaggaaauuuca

SEQ ID NO: 2682423 - RNA, 10 nt, Haemophilus influenzae Rd
aaaauucucc

SEQ ID NO: 2682424 - RNA, 18 nt, Haemophilus influenzae Rd
aaaauucuucuaacauuu

SEQ ID NO: 2682425 - RNA, 22 nt, Haemophilus influenzae Rd
aaaauucuuuuuucuuccuaug

SEQ ID NO: 2682426 - RNA, 22 nt, Haemophilus influenzae Rd
aaaauugaagccgaugaaagcu

SEQ ID NO: 2682427 - RNA, 19 nt, Haemophilus influenzae Rd
aaaauugauaccaagauaa

SEQ ID NO: 2682428 - RNA, 20 nt, Haemophilus influenzae Rd
aaaauugaucgaaaaaucuu

SEQ ID NO: 2682429 - RNA, 18 nt, Haemophilus influenzae Rd
aaaauugaucuaaauuau

SEQ ID NO: 2682430 - RNA, 12 nt, Haemophilus influenzae Rd
aaaauugcaaag

SEQ ID NO: 2682431 - RNA, 15 nt, Haemophilus influenzae Rd
aaaauugcaccuucu

SEQ ID NO: 2682432 - RNA, 19 nt, Haemophilus influenzae Rd
aaaauugccccuucaccuu

SEQ ID NO: 2682433 - RNA, 15 nt, Haemophilus influenzae Rd
aaaauuggaaaauaa

SEQ ID NO: 2682434 - RNA, 17 nt, Haemophilus influenzae Rd
aaaauuggaaaauaaaa

SEQ ID NO: 2682435 - RNA, 23 nt, Haemophilus influenzae Rd
aaaauuggccgcacuuuugaucu

SEQ ID NO: 2682436 - RNA, 19 nt, Haemophilus influenzae Rd
aaaauuguucagccaauuu

SEQ ID NO: 2682437 - RNA, 12 nt, Haemophilus influenzae Rd
aaaauuuaagcc

SEQ ID NO: 2682438 - RNA, 19 nt, Haemophilus influenzae Rd
aaaauuuacucacaacaaa

SEQ ID NO: 2682439 - RNA, 22 nt, Haemophilus influenzae Rd
aaaauuuacucacaacaaagau

SEQ ID NO: 2682440 - RNA, 23 nt, Haemophilus influenzae Rd
aaaauuuauacgcauaauaaaaa

SEQ ID NO: 2682441 - RNA, 18 nt, Haemophilus influenzae Rd
aaaauuuauuuuaaaauc

SEQ ID NO: 2682442 - RNA, 18 nt, Haemophilus influenzae Rd
aaaauuucaauaaaaaau

SEQ ID NO: 2682443 - RNA, 16 nt, Haemophilus influenzae Rd
aaaauuucagacaaaa

SEQ ID NO: 2682444 - RNA, 19 nt, Haemophilus influenzae Rd
aaaauuucagacaaaacuu

SEQ ID NO: 2682445 - RNA, 20 nt, Haemophilus influenzae Rd
aaaauuucagacaaaacuua

SEQ ID NO: 2682446 - RNA, 12 nt, Haemophilus influenzae Rd
aaaauuucagcu

SEQ ID NO: 2682447 - RNA, 18 nt, Haemophilus influenzae Rd
aaaauuucucucauuuuu

SEQ ID NO: 2682448 - RNA, 17 nt, Haemophilus influenzae Rd
aaaauuucugcugccau

SEQ ID NO: 2682449 - RNA, 13 nt, Haemophilus influenzae Rd
aaaauuucuucua

SEQ ID NO: 2682450 - RNA, 18 nt, Haemophilus influenzae Rd
aaaauuucuucuacaccu

SEQ ID NO: 2682451 - RNA, 20 nt, Haemophilus influenzae Rd
aaaauuucuuuuguuuuaac

SEQ ID NO: 2682452 - RNA, 21 nt, Haemophilus influenzae Rd
aaaauuucuuuuguuuuaacc

SEQ ID NO: 2682453 - RNA, 16 nt, Haemophilus influenzae Rd
aaaauuuggaauaaac

SEQ ID NO: 2682454 - RNA, 17 nt, Haemophilus influenzae Rd
aaaauuuggaauaaacu

SEQ ID NO: 2682455 - RNA, 23 nt, Haemophilus influenzae Rd
aaaauuuguaccauugugccaaa

SEQ ID NO: 2682456 - RNA, 18 nt, Haemophilus influenzae Rd
aaaauuuguuaagugauc

SEQ ID NO: 2682457 - RNA, 12 nt, Haemophilus influenzae Rd
aaaauuuuaaac

SEQ ID NO: 2682458 - RNA, 15 nt, Haemophilus influenzae Rd
aaaauuuuaaacagc

SEQ ID NO: 2682459 - RNA, 16 nt, Haemophilus influenzae Rd
aaaauuuuaaauaaaa

SEQ ID NO: 2682460 - RNA, 17 nt, Haemophilus influenzae Rd
aaaauuuugccaauuac

SEQ ID NO: 2682461 - RNA, 18 nt, Haemophilus influenzae Rd
aaaauuuugccaauuaca

SEQ ID NO: 2682462 - RNA, 11 nt, Haemophilus influenzae Rd
aaaauuuuuaa

SEQ ID NO: 2682463 - RNA, 22 nt, Haemophilus influenzae Rd
aaaauuuuuaggugcuuuuugc

SEQ ID NO: 2682464 - RNA, 22 nt, Haemophilus influenzae Rd
aaaauuuuuaucuuuaaagaau

SEQ ID NO: 2682465 - RNA, 11 nt, Haemophilus influenzae Rd
aaaauuuuucu

SEQ ID NO: 2682466 - RNA, 16 nt, Haemophilus influenzae Rd
aaaauuuuucucacca

SEQ ID NO: 2682467 - RNA, 16 nt, Haemophilus influenzae Rd
aaaauuuuugcaaaaa

SEQ ID NO: 2682468 - RNA, 11 nt, Haemophilus influenzae Rd
aaacaaaaacc

SEQ ID NO: 2682469 - RNA, 18 nt, Haemophilus influenzae Rd
aaacaaaagaaauuuuaa

SEQ ID NO: 2682470 - RNA, 12 nt, Haemophilus influenzae Rd
aaacaaaauaaa

SEQ ID NO: 2682471 - RNA, 19 nt, Haemophilus influenzae Rd
aaaccugcaaggauauuuc

SEQ ID NO: 2682472 - RNA, 22 nt, Haemophilus influenzae Rd
aaaccugcaaggauauuuccau

SEQ ID NO: 2682473 - RNA, 13 nt, Haemophilus influenzae Rd
aaaccugcuugaa

SEQ ID NO: 2682474 - RNA, 13 nt, Haemophilus influenzae Rd
aaaccuuauugca

SEQ ID NO: 2682475 - RNA, 19 nt, Haemophilus influenzae Rd
aaaccuuauuuuaaauaaa

SEQ ID NO: 2682476 - RNA, 11 nt, Haemophilus influenzae Rd
aaaccuugcac

SEQ ID NO: 2682477 - RNA, 18 nt, Haemophilus influenzae Rd
aaaccuuguaaagcacca

SEQ ID NO: 2682478 - RNA, 14 nt, Haemophilus influenzae Rd
aaaccuuuuucuaa

SEQ ID NO: 2682479 - RNA, 21 nt, Haemophilus influenzae Rd
aaaccuuuuucuuccauuuca

SEQ ID NO: 2682480 - RNA, 21 nt, Haemophilus influenzae Rd
aaaccuuuuugcguauccgcu

SEQ ID NO: 2682481 - RNA, 13 nt, Haemophilus influenzae Rd
aaacgaagaaaaa

SEQ ID NO: 2682482 - RNA, 21 nt, Haemophilus influenzae Rd
aaacgaaucgguaacauauga

SEQ ID NO: 2682483 - RNA, 15 nt, Haemophilus influenzae Rd
aaacgaccuucauca

SEQ ID NO: 2682484 - RNA, 16 nt, Haemophilus influenzae Rd
aaacgagaaaauuucu

SEQ ID NO: 2682485 - RNA, 21 nt, Haemophilus influenzae Rd
aaacgagacauuauuuuuaca

SEQ ID NO: 2682486 - RNA, 18 nt, Haemophilus influenzae Rd
aaacgaugaagaaaauuu

SEQ ID NO: 2682487 - RNA, 16 nt, Haemophilus influenzae Rd
aaacgauucacgaaua

SEQ ID NO: 2682488 - RNA, 19 nt, Haemophilus influenzae Rd
aaacgauucacgaauacau

SEQ ID NO: 2682489 - RNA, 16 nt, Haemophilus influenzae Rd
aaacgcaccuccgcaa

SEQ ID NO: 2682490 - RNA, 18 nt, Haemophilus influenzae Rd
aaacgcacuugauuugcu

SEQ ID NO: 2682491 - RNA, 15 nt, Haemophilus influenzae Rd
aaacgcauagaaauu

SEQ ID NO: 2682492 - RNA, 23 nt, Haemophilus influenzae Rd
aaacgccucaucuuuuuuaagau

SEQ ID NO: 2682493 - RNA, 18 nt, Haemophilus influenzae Rd
aaacgcucaaauaaauug

SEQ ID NO: 2682494 - RNA, 22 nt, Haemophilus influenzae Rd
aaacgcuccucugcauucugaa

SEQ ID NO: 2682495 - RNA, 22 nt, Haemophilus influenzae Rd
aaacgcucuuuaauuguuuggu

SEQ ID NO: 2682496 - RNA, 21 nt, Haemophilus influenzae Rd
aaacgcugacguacaauuuca

SEQ ID NO: 2682497 - RNA, 19 nt, Haemophilus influenzae Rd
aaacgcuguuuugcuuccu

SEQ ID NO: 2682498 - RNA, 22 nt, Haemophilus influenzae Rd
aaacggcguaucauacuaaaaa

SEQ ID NO: 2682499 - RNA, 23 nt, Haemophilus influenzae Rd
aaacggcguaucauacuaaaaaa

SEQ ID NO: 2682500 - RNA, 23 nt, Haemophilus influenzae Rd
aaacggcguuagguuuugauucg

SEQ ID NO: 2682501 - RNA, 23 nt, Haemophilus influenzae Rd
aaacggcuuaguuaaauauaaac

SEQ ID NO: 2682502 - RNA, 20 nt, Haemophilus influenzae Rd
aaacggucgaguuuuucaaa

SEQ ID NO: 2682503 - RNA, 14 nt, Haemophilus influenzae Rd
aaacgguuaauaaa

SEQ ID NO: 2682504 - RNA, 15 nt, Haemophilus influenzae Rd
aaacgguuaauaaau

SEQ ID NO: 2682505 - RNA, 21 nt, Haemophilus influenzae Rd
aaacgguuuggauuauuaaaa

SEQ ID NO: 2682506 - RNA, 22 nt, Haemophilus influenzae Rd
aaacguaaaauaucuuucucuu

SEQ ID NO: 2682507 - RNA, 15 nt, Haemophilus influenzae Rd
aaacgugauuuacca

SEQ ID NO: 2682508 - RNA, 17 nt, Haemophilus influenzae Rd
aaacgugcaauuaauuc

SEQ ID NO: 2682509 - RNA, 18 nt, Haemophilus influenzae Rd
aaacgugugauaccaaga

SEQ ID NO: 2682510 - RNA, 19 nt, Haemophilus influenzae Rd
aaacguuaaaucacuuuca

SEQ ID NO: 2682511 - RNA, 18 nt, Haemophilus influenzae Rd
aaacguucuaagaauuuu

SEQ ID NO: 2682512 - RNA, 20 nt, Haemophilus influenzae Rd
aaacuaaaaacaaauauauu

SEQ ID NO: 2682513 - RNA, 18 nt, Haemophilus influenzae Rd
aaacuaaagaaucaaauu

SEQ ID NO: 2682514 - RNA, 22 nt, Haemophilus influenzae Rd
aaacuaaagacggcgcguucuu

SEQ ID NO: 2682515 - RNA, 23 nt, Haemophilus influenzae Rd
aaacuaaaucuugcuuuugguuu

SEQ ID NO: 2682516 - RNA, 15 nt, Haemophilus influenzae Rd
aaacuaauuucauuu

SEQ ID NO: 2682517 - RNA, 15 nt, Haemophilus influenzae Rd
aaacuacaacuuuuu

SEQ ID NO: 2682518 - RNA, 22 nt, Haemophilus influenzae Rd
aaacuacggacuaaauaaauca

SEQ ID NO: 2682519 - RNA, 22 nt, Haemophilus influenzae Rd
aaacuacuucuaaaggcuaaau

SEQ ID NO: 2682520 - RNA, 21 nt, Haemophilus influenzae Rd
aaacuacuuucuauuaaaaaa

SEQ ID NO: 2682521 - RNA, 15 nt, Haemophilus influenzae Rd
aaacuagguaauaau

SEQ ID NO: 2682522 - RNA, 15 nt, Haemophilus influenzae Rd
aaacuaugcagaauc

SEQ ID NO: 2682523 - RNA, 17 nt, Haemophilus influenzae Rd
aaacuauuaccuaacca

SEQ ID NO: 2682524 - RNA, 15 nt, Haemophilus influenzae Rd
aaacuauuaucuacu

SEQ ID NO: 2682525 - RNA, 20 nt, Haemophilus influenzae Rd
aaacuauuaucuacuagcca

SEQ ID NO: 2682526 - RNA, 13 nt, Haemophilus influenzae Rd
aaacuauuuuuaa

SEQ ID NO: 2682527 - RNA, 19 nt, Haemophilus influenzae Rd
aaacucaaugaauuaaaag

SEQ ID NO: 2682528 - RNA, 12 nt, Haemophilus influenzae Rd
aaacucacuaaa

SEQ ID NO: 2682529 - RNA, 17 nt, Haemophilus influenzae Rd
aaacucagaauauaagu

SEQ ID NO: 2682530 - RNA, 21 nt, Haemophilus influenzae Rd
aaacuccccuuaacuaauugu

SEQ ID NO: 2682531 - RNA, 23 nt, Haemophilus influenzae Rd
aaacuccguccaaucuaauucuu

SEQ ID NO: 2682532 - RNA, 22 nt, Haemophilus influenzae Rd
aaacucgacuuuugcauuugcu

SEQ ID NO: 2682533 - RNA, 20 nt, Haemophilus influenzae Rd
aaacucgggcguaaaccuuu

SEQ ID NO: 2682534 - RNA, 17 nt, Haemophilus influenzae Rd
aaacucgguuuauuuuc

SEQ ID NO: 2682535 - RNA, 14 nt, Haemophilus influenzae Rd
aaacucuaauucca

SEQ ID NO: 2682536 - RNA, 23 nt, Haemophilus influenzae Rd
aaacucuugugccaaauucauuc

SEQ ID NO: 2682537 - RNA, 22 nt, Haemophilus influenzae Rd
aaacugaugauggccaugacaa

SEQ ID NO: 2682538 - RNA, 24 nt, Haemophilus influenzae Rd
aaacugaugauggccaugacaagc

SEQ ID NO: 2682539 - RNA, 16 nt, Haemophilus influenzae Rd
aaacugccaaacaaau

SEQ ID NO: 2682540 - RNA, 19 nt, Haemophilus influenzae Rd
aaacugccgccuucuucca

SEQ ID NO: 2682541 - RNA, 16 nt, Haemophilus influenzae Rd
aaacuggaugaaauca

SEQ ID NO: 2682542 - RNA, 15 nt, Haemophilus influenzae Rd
aaacuguugccauaa

SEQ ID NO: 2682543 - RNA, 18 nt, Haemophilus influenzae Rd
aaacuguuuuggcauuuu

SEQ ID NO: 2682544 - RNA, 13 nt, Haemophilus influenzae Rd
aaacuuaaagaau

SEQ ID NO: 2682545 - RNA, 14 nt, Haemophilus influenzae Rd
aaacuuaaagaaua

SEQ ID NO: 2682546 - RNA, 14 nt, Haemophilus influenzae Rd
aaacuuaaauacau

SEQ ID NO: 2682547 - RNA, 17 nt, Haemophilus influenzae Rd
aaacuuacccaguaaaa

SEQ ID NO: 2682548 - RNA, 22 nt, Haemophilus influenzae Rd
aaacuuacccaguaaaacuugc

SEQ ID NO: 2682549 - RNA, 18 nt, Haemophilus influenzae Rd
aaacuuaccuaaaaauuu

SEQ ID NO: 2682550 - RNA, 21 nt, Haemophilus influenzae Rd
aaacuuaccuaaaaauuuaaa

SEQ ID NO: 2682551 - RNA, 23 nt, Haemophilus influenzae Rd
aaacuuaccuaaaaauuuaaaua

SEQ ID NO: 2682552 - RNA, 19 nt, Haemophilus influenzae Rd
aaacuuaggaugauacaau

SEQ ID NO: 2682553 - RNA, 16 nt, Haemophilus influenzae Rd
aaacuuauaaagauau

SEQ ID NO: 2682554 - RNA, 20 nt, Haemophilus influenzae Rd
aaacuuauaaagauauuacu

SEQ ID NO: 2682555 - RNA, 21 nt, Haemophilus influenzae Rd
aaacuucaccagugaauuucu

SEQ ID NO: 2682556 - RNA, 17 nt, Haemophilus influenzae Rd
aaacuugaauaauaacg

SEQ ID NO: 2682557 - RNA, 18 nt, Haemophilus influenzae Rd
aaacuugacguuguucuu

SEQ ID NO: 2682558 - RNA, 22 nt, Haemophilus influenzae Rd
aaacuugacguuguucuucugu

SEQ ID NO: 2682559 - RNA, 20 nt, Haemophilus influenzae Rd
aaacuugggugauccauuaa

SEQ ID NO: 2682560 - RNA, 14 nt, Haemophilus influenzae Rd
aaacuuguuaaaua

SEQ ID NO: 2682561 - RNA, 15 nt, Haemophilus influenzae Rd
aaacuuguuaaauaa

SEQ ID NO: 2682562 - RNA, 20 nt, Haemophilus influenzae Rd
aaacuuuagagauuuuauuc

SEQ ID NO: 2682563 - RNA, 21 nt, Haemophilus influenzae Rd
aaacuuucaauuuuuccaccg

SEQ ID NO: 2682564 - RNA, 13 nt, Haemophilus influenzae Rd
aaacuuuggaaua

SEQ ID NO: 2682565 - RNA, 22 nt, Haemophilus influenzae Rd
aaacuuuuguucuugcuuaaau

SEQ ID NO: 2682566 - RNA, 13 nt, Haemophilus influenzae Rd
aaagaaaacuuau

SEQ ID NO: 2682567 - RNA, 15 nt, Haemophilus influenzae Rd
aaagaaaacuuauaa

SEQ ID NO: 2682568 - RNA, 16 nt, Haemophilus influenzae Rd
aaagaaaagaugaaug

SEQ ID NO: 2682569 - RNA, 16 nt, Haemophilus influenzae Rd
aaagaaaagcgaauuu

SEQ ID NO: 2682570 - RNA, 14 nt, Haemophilus influenzae Rd
aaagaaaauauuua

SEQ ID NO: 2682571 - RNA, 22 nt, Haemophilus influenzae Rd
aaagaaaauauuuaacuaauuu

SEQ ID NO: 2682572 - RNA, 13 nt, Haemophilus influenzae Rd
aaagaaacaggac

SEQ ID NO: 2682573 - RNA, 23 nt, Haemophilus influenzae Rd
aaagaaacgccuacaucuuaaug

SEQ ID NO: 2682574 - RNA, 20 nt, Haemophilus influenzae Rd
aaagaaacguaaacaaaaua

SEQ ID NO: 2682575 - RNA, 16 nt, Haemophilus influenzae Rd
aaagcguuguucaucu

SEQ ID NO: 2682576 - RNA, 15 nt, Haemophilus influenzae Rd
aaagcuaaaaaaaca

SEQ ID NO: 2682577 - RNA, 16 nt, Haemophilus influenzae Rd
aaagcuaagacauuca

SEQ ID NO: 2682578 - RNA, 19 nt, Haemophilus influenzae Rd
aaagcucguauaauauuuu

SEQ ID NO: 2682579 - RNA, 23 nt, Haemophilus influenzae Rd
aaagcucguauaauauuuucuuu

SEQ ID NO: 2682580 - RNA, 14 nt, Haemophilus influenzae Rd
aaagcugaauaaau

SEQ ID NO: 2682581 - RNA, 18 nt, Haemophilus influenzae Rd
aaagcugaauaaauaaac

SEQ ID NO: 2682582 - RNA, 16 nt, Haemophilus influenzae Rd
aaagcugagaaauuaa

SEQ ID NO: 2682583 - RNA, 17 nt, Haemophilus influenzae Rd
aaagcugagaaauuaag

SEQ ID NO: 2682584 - RNA, 18 nt, Haemophilus influenzae Rd
aaagcugauauaaaaaug

SEQ ID NO: 2682585 - RNA, 23 nt, Haemophilus influenzae Rd
aaagcuggauuaaauaaccaacu

SEQ ID NO: 2682586 - RNA, 21 nt, Haemophilus influenzae Rd
aaagcuguuuacuuuuauaaa

SEQ ID NO: 2682587 - RNA, 22 nt, Haemophilus influenzae Rd
aaagcuguuugacaugacaguu

SEQ ID NO: 2682588 - RNA, 21 nt, Haemophilus influenzae Rd
aaaggaaucccauauuuaaaa

SEQ ID NO: 2682589 - RNA, 15 nt, Haemophilus influenzae Rd
aaaggauuaaauaac

SEQ ID NO: 2682590 - RNA, 22 nt, Haemophilus influenzae Rd
aaaggauuaucuggauguaaca

SEQ ID NO: 2682591 - RNA, 13 nt, Haemophilus influenzae Rd
aaaggcauuuuuu

SEQ ID NO: 2682592 - RNA, 19 nt, Haemophilus influenzae Rd
aaaggcgaacauaacuuuu

SEQ ID NO: 2682593 - RNA, 19 nt, Haemophilus influenzae Rd
aaaggcgagggauuuuaaa

SEQ ID NO: 2682594 - RNA, 21 nt, Haemophilus influenzae Rd
aaaggcgagggauuuuaaauc

SEQ ID NO: 2682595 - RNA, 19 nt, Haemophilus influenzae Rd
aaaggcggauuuauuauuu

SEQ ID NO: 2682596 - RNA, 22 nt, Haemophilus influenzae Rd
aaaggcucuaccuaaaauaaau

SEQ ID NO: 2682597 - RNA, 17 nt, Haemophilus influenzae Rd
aaaggcuuuuuacguuc

SEQ ID NO: 2682598 - RNA, 15 nt, Haemophilus influenzae Rd
aaagggaaauaacaa

SEQ ID NO: 2682599 - RNA, 14 nt, Haemophilus influenzae Rd
aaagggauuuuaau

SEQ ID NO: 2682600 - RNA, 16 nt, Haemophilus influenzae Rd
aaagggcgguuaaaaa

SEQ ID NO: 2682601 - RNA, 23 nt, Haemophilus influenzae Rd
aaagggcugauauuuaaaaucag

SEQ ID NO: 2682602 - RNA, 14 nt, Haemophilus influenzae Rd
aaagguaauugcca

SEQ ID NO: 2682603 - RNA, 16 nt, Haemophilus influenzae Rd
aaagguaauugccaau

SEQ ID NO: 2682604 - RNA, 17 nt, Haemophilus influenzae Rd
aaagguaauugccaaua

SEQ ID NO: 2682605 - RNA, 23 nt, Haemophilus influenzae Rd
aaaggugguuuugcaaaccaaau

SEQ ID NO: 2682606 - RNA, 14 nt, Haemophilus influenzae Rd
aaagguuacucauu

SEQ ID NO: 2682607 - RNA, 12 nt, Haemophilus influenzae Rd
aaagguugcggc

SEQ ID NO: 2682608 - RNA, 12 nt, Haemophilus influenzae Rd
aaaguaaaauau

SEQ ID NO: 2682609 - RNA, 13 nt, Haemophilus influenzae Rd
aaaguaaacaauu

SEQ ID NO: 2682610 - RNA, 15 nt, Haemophilus influenzae Rd
aaaguaaauuuuaaa

SEQ ID NO: 2682611 - RNA, 16 nt, Haemophilus influenzae Rd
aaaguaaauuuuaaaa

SEQ ID NO: 2682612 - RNA, 17 nt, Haemophilus influenzae Rd
aaaguaacguugcucuu

SEQ ID NO: 2682613 - RNA, 13 nt, Haemophilus influenzae Rd
aaaguaagaauua

SEQ ID NO: 2682614 - RNA, 14 nt, Haemophilus influenzae Rd
aaaguaagaauuag

SEQ ID NO: 2682615 - RNA, 23 nt, Haemophilus influenzae Rd
aaaguaauagcgacuugccgcuu

SEQ ID NO: 2682616 - RNA, 15 nt, Haemophilus influenzae Rd
aaaguaaucgcccca

SEQ ID NO: 2682617 - RNA, 19 nt, Haemophilus influenzae Rd
aaaguaaucuaaauauucu

SEQ ID NO: 2682618 - RNA, 15 nt, Haemophilus influenzae Rd
aaaguacacaagaaa

SEQ ID NO: 2682619 - RNA, 20 nt, Haemophilus influenzae Rd
aaaguacugcagcauuuaaa

SEQ ID NO: 2682620 - RNA, 12 nt, Haemophilus influenzae Rd
aaaguagcacuu

SEQ ID NO: 2682621 - RNA, 20 nt, Haemophilus influenzae Rd
aaaguauaauauagaugaag

SEQ ID NO: 2682622 - RNA, 17 nt, Haemophilus influenzae Rd
aaagucacgaggauuaa

SEQ ID NO: 2682623 - RNA, 19 nt, Haemophilus influenzae Rd
aaagucaguaaaccaagug

SEQ ID NO: 2682624 - RNA, 18 nt, Haemophilus influenzae Rd
aaagucccgugagcauuu

SEQ ID NO: 2682625 - RNA, 23 nt, Haemophilus influenzae Rd
aaagucgguuuuuaauucaguuc

SEQ ID NO: 2682626 - RNA, 20 nt, Haemophilus influenzae Rd
aaagucgguuuuuucauaga

SEQ ID NO: 2682627 - RNA, 23 nt, Haemophilus influenzae Rd
aaagucuaauuuuguaagcauua

SEQ ID NO: 2682628 - RNA, 13 nt, Haemophilus influenzae Rd
aaagucuguuuaa

SEQ ID NO: 2682629 - RNA, 20 nt, Haemophilus influenzae Rd
aaagucuuaaugacauuaaa

SEQ ID NO: 2682630 - RNA, 13 nt, Haemophilus influenzae Rd
aaagucuuuaccu

SEQ ID NO: 2682631 - RNA, 18 nt, Haemophilus influenzae Rd
aaagugaccgccuuuauu

SEQ ID NO: 2682632 - RNA, 19 nt, Haemophilus influenzae Rd
aaagugcagcccaaauaaa

SEQ ID NO: 2682633 - RNA, 21 nt, Haemophilus influenzae Rd
aaagugcagcccaaauaaaga

SEQ ID NO: 2682634 - RNA, 16 nt, Haemophilus influenzae Rd
aaagugcgaugacaaa

SEQ ID NO: 2682635 - RNA, 16 nt, Haemophilus influenzae Rd
aaagugcggaaaauuu

SEQ ID NO: 2682636 - RNA, 19 nt, Haemophilus influenzae Rd
aaagugcggaaauauuuua

SEQ ID NO: 2682637 - RNA, 15 nt, Haemophilus influenzae Rd
aaagugcgguaaaaa

SEQ ID NO: 2682638 - RNA, 17 nt, Haemophilus influenzae Rd
aaagugcgguaaaaaaa

SEQ ID NO: 2682639 - RNA, 20 nt, Haemophilus influenzae Rd
aaagugcgguaaaaauuaac

SEQ ID NO: 2682640 - RNA, 22 nt, Haemophilus influenzae Rd
aaagugcgguaaaaauuucucu

SEQ ID NO: 2682641 - RNA, 16 nt, Haemophilus influenzae Rd
aaagugcgguaaaauu

SEQ ID NO: 2682642 - RNA, 17 nt, Haemophilus influenzae Rd
aaagugcgguaaaauuu

SEQ ID NO: 2682643 - RNA, 17 nt, Haemophilus influenzae Rd
aaagugcgguaaauuuu

SEQ ID NO: 2682644 - RNA, 20 nt, Haemophilus influenzae Rd
aaagugcgguaaauuuuaaa

SEQ ID NO: 2682645 - RNA, 16 nt, Haemophilus influenzae Rd
aaagugcgguaauuuu

SEQ ID NO: 2682646 - RNA, 19 nt, Haemophilus influenzae Rd
aaagugcggucaacauaaa

SEQ ID NO: 2682647 - RNA, 20 nt, Haemophilus influenzae Rd
aaagugcggucaauaaaaau

SEQ ID NO: 2682648 - RNA, 17 nt, Haemophilus influenzae Rd
aaagugcggucaauuuc

SEQ ID NO: 2682649 - RNA, 18 nt, Haemophilus influenzae Rd
aaagugcggucaauuuuu

SEQ ID NO: 2682650 - RNA, 14 nt, Haemophilus influenzae Rd
aaagugcggucauu

SEQ ID NO: 2682651 - RNA, 22 nt, Haemophilus influenzae Rd
aaagugcggucugaaaaucaaa

SEQ ID NO: 2682652 - RNA, 19 nt, Haemophilus influenzae Rd
aaagugcggugaaauuuca

SEQ ID NO: 2682653 - RNA, 18 nt, Haemophilus influenzae Rd
aaagugcggugagauuuc

SEQ ID NO: 2682654 - RNA, 23 nt, Haemophilus influenzae Rd
aaagugcgguuaaaaaagaaaua

SEQ ID NO: 2682655 - RNA, 18 nt, Haemophilus influenzae Rd
aaagugcgguuaaaauuu

SEQ ID NO: 2682656 - RNA, 16 nt, Haemophilus influenzae Rd
aaagugcgguuaauuu

SEQ ID NO: 2682657 - RNA, 19 nt, Haemophilus influenzae Rd
aaagugcgguugaaauuuc

SEQ ID NO: 2682658 - RNA, 21 nt, Haemophilus influenzae Rd
aaagugcgguuguuuuugcca

SEQ ID NO: 2682659 - RNA, 17 nt, Haemophilus influenzae Rd
aaaguggagaaacauuu

SEQ ID NO: 2682660 - RNA, 15 nt, Haemophilus influenzae Rd
aaaguggaugaccaa

SEQ ID NO: 2682661 - RNA, 14 nt, Haemophilus influenzae Rd
aaaguguucaaugu

SEQ ID NO: 2682662 - RNA, 17 nt, Haemophilus influenzae Rd
aaaguuaaacuaaauaa

SEQ ID NO: 2682663 - RNA, 20 nt, Haemophilus influenzae Rd
aaaguuaaucaaacuuuuag

SEQ ID NO: 2682664 - RNA, 19 nt, Haemophilus influenzae Rd
aaaguuaccauuuauuccu

SEQ ID NO: 2682665 - RNA, 15 nt, Haemophilus influenzae Rd
aaaguuacucuugga

SEQ ID NO: 2682666 - RNA, 13 nt, Haemophilus influenzae Rd
aaaguuauaaagc

SEQ ID NO: 2682667 - RNA, 12 nt, Haemophilus influenzae Rd
aaaguuaucaaa

SEQ ID NO: 2682668 - RNA, 19 nt, Haemophilus influenzae Rd
aaaguuaucaaacaguuca

SEQ ID NO: 2682669 - RNA, 20 nt, Haemophilus influenzae Rd
aaaguucagauucaauaaua

SEQ ID NO: 2682670 - RNA, 18 nt, Haemophilus influenzae Rd
aaaguugaauauuuuguu

SEQ ID NO: 2682671 - RNA, 15 nt, Haemophilus influenzae Rd
aaaguugagaauuuu

SEQ ID NO: 2682672 - RNA, 12 nt, Haemophilus influenzae Rd
aaaguugauauu

SEQ ID NO: 2682673 - RNA, 20 nt, Haemophilus influenzae Rd
aaaguugauccguugucaca

SEQ ID NO: 2682674 - RNA, 19 nt, Haemophilus influenzae Rd
aaaguuggacuaaacaacu

SEQ ID NO: 2682675 - RNA, 22 nt, Haemophilus influenzae Rd
aaaguuggcaacauauuuucua

SEQ ID NO: 2682676 - RNA, 20 nt, Haemophilus influenzae Rd
aaaguuggcacuucaauuuc

SEQ ID NO: 2682677 - RNA, 18 nt, Haemophilus influenzae Rd
aaaguuggccaauuugca

SEQ ID NO: 2682678 - RNA, 19 nt, Haemophilus influenzae Rd
aaaguuggcuuacagcaaa

SEQ ID NO: 2682679 - RNA, 23 nt, Haemophilus influenzae Rd
aaaguuggcuuacagcaaaagca

SEQ ID NO: 2682680 - RNA, 14 nt, Haemophilus influenzae Rd
aaauacgagaaagc

SEQ ID NO: 2682681 - RNA, 14 nt, Haemophilus influenzae Rd
aaauacgaugauaa

SEQ ID NO: 2682682 - RNA, 19 nt, Haemophilus influenzae Rd
aaauacggugaaauuucac

SEQ ID NO: 2682683 - RNA, 20 nt, Haemophilus influenzae Rd
aaauacggugaaauuucacc

SEQ ID NO: 2682684 - RNA, 18 nt, Haemophilus influenzae Rd
aaauacguauaauugacc

SEQ ID NO: 2682685 - RNA, 21 nt, Haemophilus influenzae Rd
aaauacguuguuuuucuaccg

SEQ ID NO: 2682686 - RNA, 23 nt, Haemophilus influenzae Rd
aaauacuaauaggaguaaaaaua

SEQ ID NO: 2682687 - RNA, 20 nt, Haemophilus influenzae Rd
aaauacuguuuuaugcuaaa

SEQ ID NO: 2682688 - RNA, 23 nt, Haemophilus influenzae Rd
aaauagaaaguggcuuaauuuau

SEQ ID NO: 2682689 - RNA, 14 nt, Haemophilus influenzae Rd
aaauagaaauuacu

SEQ ID NO: 2682690 - RNA, 12 nt, Haemophilus influenzae Rd
aaauagaauauu

SEQ ID NO: 2682691 - RNA, 17 nt, Haemophilus influenzae Rd
aaauagaauauuuugca

SEQ ID NO: 2682692 - RNA, 14 nt, Haemophilus influenzae Rd
aaauagaaugaaaa

SEQ ID NO: 2682693 - RNA, 15 nt, Haemophilus influenzae Rd
aaauagaaugaaaaa

SEQ ID NO: 2682694 - RNA, 13 nt, Haemophilus influenzae Rd
aaauagacuaauu

SEQ ID NO: 2682695 - RNA, 18 nt, Haemophilus influenzae Rd
aaauagccuaaauauuua

SEQ ID NO: 2682696 - RNA, 19 nt, Haemophilus influenzae Rd
aaauagccuaaauauuuau

SEQ ID NO: 2682697 - RNA, 22 nt, Haemophilus influenzae Rd
aaauagccuucaucacaaaucu

SEQ ID NO: 2682698 - RNA, 22 nt, Haemophilus influenzae Rd
aaauagcgaucugcacuuuaac

SEQ ID NO: 2682699 - RNA, 23 nt, Haemophilus influenzae Rd
aaauagcguaaagggaagugaua

SEQ ID NO: 2682700 - RNA, 18 nt, Haemophilus influenzae Rd
aaauagcuaacaaauuua

SEQ ID NO: 2682701 - RNA, 22 nt, Haemophilus influenzae Rd
aaauagcuaacaaauuuaauau

SEQ ID NO: 2682702 - RNA, 14 nt, Haemophilus influenzae Rd
aaauagcuaacaau

SEQ ID NO: 2682703 - RNA, 16 nt, Haemophilus influenzae Rd
aaauagcuaacaauau

SEQ ID NO: 2682704 - RNA, 18 nt, Haemophilus influenzae Rd
aaauagcuacgguuauuu

SEQ ID NO: 2682705 - RNA, 15 nt, Haemophilus influenzae Rd
aaauagcugauaaua

SEQ ID NO: 2682706 - RNA, 21 nt, Haemophilus influenzae Rd
aaauaggaaaggcauuuuuua

SEQ ID NO: 2682707 - RNA, 13 nt, Haemophilus influenzae Rd
aaauaggcacaua

SEQ ID NO: 2682708 - RNA, 20 nt, Haemophilus influenzae Rd
aaauaggcacauaaguaaaa

SEQ ID NO: 2682709 - RNA, 22 nt, Haemophilus influenzae Rd
aaauaggcacauaaguaaaaua

SEQ ID NO: 2682710 - RNA, 17 nt, Haemophilus influenzae Rd
aaauaggcugaaaaaau

SEQ ID NO: 2682711 - RNA, 17 nt, Haemophilus influenzae Rd
aaauagguaucacuuaa

SEQ ID NO: 2682712 - RNA, 22 nt, Haemophilus influenzae Rd
aaauagucacuugugguuauuu

SEQ ID NO: 2682713 - RNA, 21 nt, Haemophilus influenzae Rd
aaauaguggugccuucuucag

SEQ ID NO: 2682714 - RNA, 21 nt, Haemophilus influenzae Rd
aaauaguuaaagaaaauauuu

SEQ ID NO: 2682715 - RNA, 14 nt, Haemophilus influenzae Rd
aaauaguuaauaau

SEQ ID NO: 2682716 - RNA, 17 nt, Haemophilus influenzae Rd
aaauaguugaugccccu

SEQ ID NO: 2682717 - RNA, 16 nt, Haemophilus influenzae Rd
aaauauaaaauaaaau

SEQ ID NO: 2682718 - RNA, 20 nt, Haemophilus influenzae Rd
aaauauaaacugacagaaga

SEQ ID NO: 2682719 - RNA, 15 nt, Haemophilus influenzae Rd
aaauauaaauggaaa

SEQ ID NO: 2682720 - RNA, 16 nt, Haemophilus influenzae Rd
aaauauaagaaaaaca

SEQ ID NO: 2682721 - RNA, 21 nt, Haemophilus influenzae Rd
aaauauaauaaauauguugaa

SEQ ID NO: 2682722 - RNA, 18 nt, Haemophilus influenzae Rd
aaauauaaucaauuucua

SEQ ID NO: 2682723 - RNA, 14 nt, Haemophilus influenzae Rd
aaauauaaugaaaa

SEQ ID NO: 2682724 - RNA, 16 nt, Haemophilus influenzae Rd
aaauauaaugaauuau

SEQ ID NO: 2682725 - RNA, 22 nt, Haemophilus influenzae Rd
aaauauacaauucuuguuuaau

SEQ ID NO: 2682726 - RNA, 22 nt, Haemophilus influenzae Rd
aaauauagccuagaaauaucua

SEQ ID NO: 2682727 - RNA, 12 nt, Haemophilus influenzae Rd
aaauauauauua

SEQ ID NO: 2682728 - RNA, 13 nt, Haemophilus influenzae Rd
aaauauauccaua

SEQ ID NO: 2682729 - RNA, 22 nt, Haemophilus influenzae Rd
aaauaucgcaaucaauucuuuc

SEQ ID NO: 2682730 - RNA, 21 nt, Haemophilus influenzae Rd
aaauaucgcccuuauuuugug

SEQ ID NO: 2682731 - RNA, 22 nt, Haemophilus influenzae Rd
aaauaucuaggcuaauuauuua

SEQ ID NO: 2682732 - RNA, 13 nt, Haemophilus influenzae Rd
aaauaucucuguu

SEQ ID NO: 2682733 - RNA, 17 nt, Haemophilus influenzae Rd
aaauaucuucaauuucu

SEQ ID NO: 2682734 - RNA, 23 nt, Haemophilus influenzae Rd
aaauaucuucauaucuuugaauu

SEQ ID NO: 2682735 - RNA, 13 nt, Haemophilus influenzae Rd
aaauaucuugcac

SEQ ID NO: 2682736 - RNA, 14 nt, Haemophilus influenzae Rd
aaauaucuuguuuu

SEQ ID NO: 2682737 - RNA, 13 nt, Haemophilus influenzae Rd
aaauaugaaauuu

SEQ ID NO: 2682738 - RNA, 17 nt, Haemophilus influenzae Rd
aaauaugacuuauuauc

SEQ ID NO: 2682739 - RNA, 15 nt, Haemophilus influenzae Rd
aaauaugauuuagaa

SEQ ID NO: 2682740 - RNA, 21 nt, Haemophilus influenzae Rd
aaauauuacuuaacaucauca

SEQ ID NO: 2682741 - RNA, 23 nt, Haemophilus influenzae Rd
aaauauuaguuagcuaaaaaaac

SEQ ID NO: 2682742 - RNA, 15 nt, Haemophilus influenzae Rd
aaauauuaucuucau

SEQ ID NO: 2682743 - RNA, 21 nt, Haemophilus influenzae Rd
aaauauuaucuucaugauuuu

SEQ ID NO: 2682744 - RNA, 22 nt, Haemophilus influenzae Rd
aaauauuaucuucaugauuuuc

SEQ ID NO: 2682745 - RNA, 15 nt, Haemophilus influenzae Rd
aaauauuauuaaaaa

SEQ ID NO: 2682746 - RNA, 18 nt, Haemophilus influenzae Rd
aaauauuauuaaguaaua

SEQ ID NO: 2682747 - RNA, 18 nt, Haemophilus influenzae Rd
aaauauucuucauaaaaa

SEQ ID NO: 2682748 - RNA, 23 nt, Haemophilus influenzae Rd
aaauauucuucauaaaaaaagac

SEQ ID NO: 2682749 - RNA, 15 nt, Haemophilus influenzae Rd
aaauauucuucuaaa

SEQ ID NO: 2682750 - RNA, 20 nt, Haemophilus influenzae Rd
aaauauucuuggagauaaua

SEQ ID NO: 2682751 - RNA, 17 nt, Haemophilus influenzae Rd
aaauauugauuacccau

SEQ ID NO: 2682752 - RNA, 16 nt, Haemophilus influenzae Rd
aaauauugguuauuua

SEQ ID NO: 2682753 - RNA, 20 nt, Haemophilus influenzae Rd
aaauauugucuauuugcuuu

SEQ ID NO: 2682754 - RNA, 19 nt, Haemophilus influenzae Rd
aaauauuuaaaaagaauau

SEQ ID NO: 2682755 - RNA, 22 nt, Haemophilus influenzae Rd
aaauauuuaggcuauuuuauaa

SEQ ID NO: 2682756 - RNA, 12 nt, Haemophilus influenzae Rd
aaauauuucacu

SEQ ID NO: 2682757 - RNA, 17 nt, Haemophilus influenzae Rd
aaauauuucacuagucu

SEQ ID NO: 2682758 - RNA, 13 nt, Haemophilus influenzae Rd
aaauauuucacuu

SEQ ID NO: 2682759 - RNA, 13 nt, Haemophilus influenzae Rd
aaauauuucagua

SEQ ID NO: 2682760 - RNA, 14 nt, Haemophilus influenzae Rd
aaauauuucaguau

SEQ ID NO: 2682761 - RNA, 14 nt, Haemophilus influenzae Rd
aaauauuucauuug

SEQ ID NO: 2682762 - RNA, 22 nt, Haemophilus influenzae Rd
aaauauuuuaauaaagauaaau

SEQ ID NO: 2682763 - RNA, 12 nt, Haemophilus influenzae Rd
aaauauuuuuac

SEQ ID NO: 2682764 - RNA, 16 nt, Haemophilus influenzae Rd
aaaucaaaaauaaaaa

SEQ ID NO: 2682765 - RNA, 14 nt, Haemophilus influenzae Rd
aaaucaaaaaugcu

SEQ ID NO: 2682766 - RNA, 17 nt, Haemophilus influenzae Rd
aaaucaaacaaaauuuu

SEQ ID NO: 2682767 - RNA, 13 nt, Haemophilus influenzae Rd
aaaucaaacaacg

SEQ ID NO: 2682768 - RNA, 14 nt, Haemophilus influenzae Rd
aaaucaaagauauu

SEQ ID NO: 2682769 - RNA, 18 nt, Haemophilus influenzae Rd
aaaucaaagauauuuuua

SEQ ID NO: 2682770 - RNA, 18 nt, Haemophilus influenzae Rd
aaaucaaauuuaggauuu

SEQ ID NO: 2682771 - RNA, 13 nt, Haemophilus influenzae Rd
aaaucaaauuuuc

SEQ ID NO: 2682772 - RNA, 17 nt, Haemophilus influenzae Rd
aaaucaacacaccauuu

SEQ ID NO: 2682773 - RNA, 19 nt, Haemophilus influenzae Rd
aaaucaaccgcacuuuauu

SEQ ID NO: 2682774 - RNA, 16 nt, Haemophilus influenzae Rd
aaaucaagaugacgaa

SEQ ID NO: 2682775 - RNA, 22 nt, Haemophilus influenzae Rd
aaaucaagaugacgaaaugaaa

SEQ ID NO: 2682776 - RNA, 20 nt, Haemophilus influenzae Rd
aaaucaagcccucgaauauu

SEQ ID NO: 2682777 - RNA, 17 nt, Haemophilus influenzae Rd
aaaucaaggacuaggcu

SEQ ID NO: 2682778 - RNA, 19 nt, Haemophilus influenzae Rd
aaaucaauuaacuauuuaa

SEQ ID NO: 2682779 - RNA, 21 nt, Haemophilus influenzae Rd
aaaucacaauaaaagcaauaa

SEQ ID NO: 2682780 - RNA, 13 nt, Haemophilus influenzae Rd
aaaucacaauaag

SEQ ID NO: 2682781 - RNA, 16 nt, Haemophilus influenzae Rd
aaaucacaauaagcaa

SEQ ID NO: 2682782 - RNA, 13 nt, Haemophilus influenzae Rd
aaaucacaccuuu

SEQ ID NO: 2682783 - RNA, 16 nt, Haemophilus influenzae Rd
aaaucacacguucauu

SEQ ID NO: 2682784 - RNA, 22 nt, Haemophilus influenzae Rd
aaaucacaucgccaacuugaau

SEQ ID NO: 2682785 - RNA, 20 nt, Haemophilus influenzae Rd
aaaugaaguaauaaucuucu

SEQ ID NO: 2682786 - RNA, 17 nt, Haemophilus influenzae Rd
aaaugaauaaaacuucc

SEQ ID NO: 2682787 - RNA, 21 nt, Haemophilus influenzae Rd
aaaugacaucauuaauaagcu

SEQ ID NO: 2682788 - RNA, 17 nt, Haemophilus influenzae Rd
aaaugagauuauuucua

SEQ ID NO: 2682789 - RNA, 12 nt, Haemophilus influenzae Rd
aaaugaggaaua

SEQ ID NO: 2682790 - RNA, 12 nt, Haemophilus influenzae Rd
aaaugauaaaaa

SEQ ID NO: 2682791 - RNA, 20 nt, Haemophilus influenzae Rd
aaaugauguaggcaaaaaca

SEQ ID NO: 2682792 - RNA, 23 nt, Haemophilus influenzae Rd
aaaugauuauccacuaaaaaacu

SEQ ID NO: 2682793 - RNA, 14 nt, Haemophilus influenzae Rd
aaaugcaacaauaa

SEQ ID NO: 2682794 - RNA, 20 nt, Haemophilus influenzae Rd
aaaugcaauaggauugccuu

SEQ ID NO: 2682795 - RNA, 21 nt, Haemophilus influenzae Rd
aaaugcaauaggauugccuuc

SEQ ID NO: 2682796 - RNA, 16 nt, Haemophilus influenzae Rd
aaaugcacauaacaaa

SEQ ID NO: 2682797 - RNA, 18 nt, Haemophilus influenzae Rd
aaaugcacccgcuguaau

SEQ ID NO: 2682798 - RNA, 21 nt, Haemophilus influenzae Rd
aaaugcagauccuuucacaaa

SEQ ID NO: 2682799 - RNA, 23 nt, Haemophilus influenzae Rd
aaaugccgccuuuuaauaaauug

SEQ ID NO: 2682800 - RNA, 15 nt, Haemophilus influenzae Rd
aaaugccuacuaaac

SEQ ID NO: 2682801 - RNA, 21 nt, Haemophilus influenzae Rd
aaaugccuuuccguucauaaa

SEQ ID NO: 2682802 - RNA, 22 nt, Haemophilus influenzae Rd
aaaugccuuuccguucauaaau

SEQ ID NO: 2682803 - RNA, 22 nt, Haemophilus influenzae Rd
aaaugcgaucuaaaucauuuau

SEQ ID NO: 2682804 - RNA, 16 nt, Haemophilus influenzae Rd
aaaugcgcuuuuaauu

SEQ ID NO: 2682805 - RNA, 23 nt, Haemophilus influenzae Rd
aaaugcgucgcagccuuguucug

SEQ ID NO: 2682806 - RNA, 15 nt, Haemophilus influenzae Rd
aaaugcuacuugaau

SEQ ID NO: 2682807 - RNA, 19 nt, Haemophilus influenzae Rd
aaaugcucgcuuuuguauu

SEQ ID NO: 2682808 - RNA, 16 nt, Haemophilus influenzae Rd
aaaugcuguagaaauu

SEQ ID NO: 2682809 - RNA, 19 nt, Haemophilus influenzae Rd
aaaugcuguagaaauuaau

SEQ ID NO: 2682810 - RNA, 21 nt, Haemophilus influenzae Rd
aaaugcuguagaaauuaauaa

SEQ ID NO: 2682811 - RNA, 18 nt, Haemophilus influenzae Rd
aaaugcuugaauaaauga

SEQ ID NO: 2682812 - RNA, 23 nt, Haemophilus influenzae Rd
aaaugcuugguuuuauauucauu

SEQ ID NO: 2682813 - RNA, 12 nt, Haemophilus influenzae Rd
aaaugcuuugac

SEQ ID NO: 2682814 - RNA, 20 nt, Haemophilus influenzae Rd
aaaugcuuuugccgaaaaug

SEQ ID NO: 2682815 - RNA, 21 nt, Haemophilus influenzae Rd
aaauggaauggauguaaugag

SEQ ID NO: 2682816 - RNA, 20 nt, Haemophilus influenzae Rd
aaauggaauguagauaauga

SEQ ID NO: 2682817 - RNA, 13 nt, Haemophilus influenzae Rd
aaauggacuaaau

SEQ ID NO: 2682818 - RNA, 17 nt, Haemophilus influenzae Rd
aaauggacuaaauuuag

SEQ ID NO: 2682819 - RNA, 17 nt, Haemophilus influenzae Rd
aaauggauucaaguaag

SEQ ID NO: 2682820 - RNA, 12 nt, Haemophilus influenzae Rd
aaauggcaaaca

SEQ ID NO: 2682821 - RNA, 13 nt, Haemophilus influenzae Rd
aaauggcaaacaa

SEQ ID NO: 2682822 - RNA, 16 nt, Haemophilus influenzae Rd
aaauggcaaacaaaau

SEQ ID NO: 2682823 - RNA, 22 nt, Haemophilus influenzae Rd
aaauggcaaacaaaauaaauga

SEQ ID NO: 2682824 - RNA, 18 nt, Haemophilus influenzae Rd
aaauggcaucaauauuau

SEQ ID NO: 2682825 - RNA, 20 nt, Haemophilus influenzae Rd
aaauggcaucaauauuaugu

SEQ ID NO: 2682826 - RNA, 15 nt, Haemophilus influenzae Rd
aaauggcauuuauaa

SEQ ID NO: 2682827 - RNA, 23 nt, Haemophilus influenzae Rd
aaauggcgguuuuuuaauuuuau

SEQ ID NO: 2682828 - RNA, 18 nt, Haemophilus influenzae Rd
aaauggcguuuugcguga

SEQ ID NO: 2682829 - RNA, 20 nt, Haemophilus influenzae Rd
aaauggcuagggauuaagaa

SEQ ID NO: 2682830 - RNA, 17 nt, Haemophilus influenzae Rd
aaauggcuuuuuugccu

SEQ ID NO: 2682831 - RNA, 18 nt, Haemophilus influenzae Rd
aaaugggacaaagcagua

SEQ ID NO: 2682832 - RNA, 19 nt, Haemophilus influenzae Rd
aaaugggcgggcaaaccgu

SEQ ID NO: 2682833 - RNA, 17 nt, Haemophilus influenzae Rd
aaaugggucaagauuaa

SEQ ID NO: 2682834 - RNA, 16 nt, Haemophilus influenzae Rd
aaaugguuuaaauaac

SEQ ID NO: 2682835 - RNA, 19 nt, Haemophilus influenzae Rd
aaauguaaaaauuggaaaa

SEQ ID NO: 2682836 - RNA, 13 nt, Haemophilus influenzae Rd
aaauguaaaacag

SEQ ID NO: 2682837 - RNA, 14 nt, Haemophilus influenzae Rd
aaauguaaaacagu

SEQ ID NO: 2682838 - RNA, 20 nt, Haemophilus influenzae Rd
aaauguaagagugaaguuau

SEQ ID NO: 2682839 - RNA, 18 nt, Haemophilus influenzae Rd
aaauguaauucuggcugu

SEQ ID NO: 2682840 - RNA, 18 nt, Haemophilus influenzae Rd
aaauguagaucgacucca

SEQ ID NO: 2682841 - RNA, 14 nt, Haemophilus influenzae Rd
aaauguauuuucca

SEQ ID NO: 2682842 - RNA, 18 nt, Haemophilus influenzae Rd
aaaugucguaagaacgac

SEQ ID NO: 2682843 - RNA, 16 nt, Haemophilus influenzae Rd
aaaugugaaaacuacu

SEQ ID NO: 2682844 - RNA, 20 nt, Haemophilus influenzae Rd
aaaugugaccgcuuguuuau

SEQ ID NO: 2682845 - RNA, 20 nt, Haemophilus influenzae Rd
aaauguguuucgauacuuuc

SEQ ID NO: 2682846 - RNA, 19 nt, Haemophilus influenzae Rd
aaauguuauaaauaaaaaa

SEQ ID NO: 2682847 - RNA, 14 nt, Haemophilus influenzae Rd
aaauguucauuuuu

SEQ ID NO: 2682848 - RNA, 21 nt, Haemophilus influenzae Rd
aaauguugaauauaauaaaaa

SEQ ID NO: 2682849 - RNA, 20 nt, Haemophilus influenzae Rd
aaauguuuaauuauagaaaa

SEQ ID NO: 2682850 - RNA, 19 nt, Haemophilus influenzae Rd
aaauguuuaccucgccauu

SEQ ID NO: 2682851 - RNA, 17 nt, Haemophilus influenzae Rd
aaauguuuauauuucca

SEQ ID NO: 2682852 - RNA, 14 nt, Haemophilus influenzae Rd
aaauguuugaaggc

SEQ ID NO: 2682853 - RNA, 15 nt, Haemophilus influenzae Rd
aaauuaaaaaaauag

SEQ ID NO: 2682854 - RNA, 16 nt, Haemophilus influenzae Rd
aaauuaaaaagacuaa

SEQ ID NO: 2682855 - RNA, 13 nt, Haemophilus influenzae Rd
aaauuaaaaauau

SEQ ID NO: 2682856 - RNA, 16 nt, Haemophilus influenzae Rd
aaauuaaaaauuuaau

SEQ ID NO: 2682857 - RNA, 13 nt, Haemophilus influenzae Rd
aaauuaaaauaau

SEQ ID NO: 2682858 - RNA, 20 nt, Haemophilus influenzae Rd
aaauuaaaucacccgcauaa

SEQ ID NO: 2682859 - RNA, 17 nt, Haemophilus influenzae Rd
aaauuaaauugaaaaaa

SEQ ID NO: 2682860 - RNA, 15 nt, Haemophilus influenzae Rd
aaauuaaauuguaac

SEQ ID NO: 2682861 - RNA, 18 nt, Haemophilus influenzae Rd
aaauuaaccgcacuuuaa

SEQ ID NO: 2682862 - RNA, 19 nt, Haemophilus influenzae Rd
aaauuaaccgcacuuuaaa

SEQ ID NO: 2682863 - RNA, 21 nt, Haemophilus influenzae Rd
aaauuaaccgcacuuuaaaua

SEQ ID NO: 2682864 - RNA, 18 nt, Haemophilus influenzae Rd
aaauuaaccgcacuuuca

SEQ ID NO: 2682865 - RNA, 19 nt, Haemophilus influenzae Rd
aaauuaaccgcacuuucau

SEQ ID NO: 2682866 - RNA, 17 nt, Haemophilus influenzae Rd
aaauuaacgguuuucga

SEQ ID NO: 2682867 - RNA, 21 nt, Haemophilus influenzae Rd
aaauuaacgguuuucgauuua

SEQ ID NO: 2682868 - RNA, 22 nt, Haemophilus influenzae Rd
aaauuaacuggcguuucuacca

SEQ ID NO: 2682869 - RNA, 23 nt, Haemophilus influenzae Rd
aaauuaacuggcguuucuaccac

SEQ ID NO: 2682870 - RNA, 18 nt, Haemophilus influenzae Rd
aaauuaacuuaucuaaaa

SEQ ID NO: 2682871 - RNA, 12 nt, Haemophilus influenzae Rd
aaauuaagaaaa

SEQ ID NO: 2682872 - RNA, 13 nt, Haemophilus influenzae Rd
aaauuaagaaaau

SEQ ID NO: 2682873 - RNA, 16 nt, Haemophilus influenzae Rd
aaauuaagaaaauaau

SEQ ID NO: 2682874 - RNA, 13 nt, Haemophilus influenzae Rd
aaauuaagaaauu

SEQ ID NO: 2682875 - RNA, 14 nt, Haemophilus influenzae Rd
aaauuaagaguaau

SEQ ID NO: 2682876 - RNA, 14 nt, Haemophilus influenzae Rd
aaauuaaggacuaa

SEQ ID NO: 2682877 - RNA, 17 nt, Haemophilus influenzae Rd
aaauuaagguuggaaua

SEQ ID NO: 2682878 - RNA, 19 nt, Haemophilus influenzae Rd
aaauuaauaaauauuauua

SEQ ID NO: 2682879 - RNA, 15 nt, Haemophilus influenzae Rd
aaauuaauaagaaaa

SEQ ID NO: 2682880 - RNA, 20 nt, Haemophilus influenzae Rd
aaauuaauaagaaaaucaaa

SEQ ID NO: 2682881 - RNA, 17 nt, Haemophilus influenzae Rd
aaauuaauaagaaagaa

SEQ ID NO: 2682882 - RNA, 16 nt, Haemophilus influenzae Rd
aaauuaauaagcccuu

SEQ ID NO: 2682883 - RNA, 15 nt, Haemophilus influenzae Rd
aaauuaauacugaaa

SEQ ID NO: 2682884 - RNA, 14 nt, Haemophilus influenzae Rd
aaauuaaucauaaa

SEQ ID NO: 2682885 - RNA, 12 nt, Haemophilus influenzae Rd
aaauuaaugcca

SEQ ID NO: 2682886 - RNA, 13 nt, Haemophilus influenzae Rd
aaauuaaugccaa

SEQ ID NO: 2682887 - RNA, 16 nt, Haemophilus influenzae Rd
aaauuaauuaggacaa

SEQ ID NO: 2682888 - RNA, 19 nt, Haemophilus influenzae Rd
aaauuaauucucauacaaa

SEQ ID NO: 2682889 - RNA, 13 nt, Haemophilus influenzae Rd
aaauuaauuuaac

SEQ ID NO: 2682890 - RNA, 21 nt, Haemophilus influenzae Rd
aaauugcuggauucaguugau

SEQ ID NO: 2682891 - RNA, 13 nt, Haemophilus influenzae Rd
aaauugcuguaau

SEQ ID NO: 2682892 - RNA, 20 nt, Haemophilus influenzae Rd
aaauuggaaaauaaaaugac

SEQ ID NO: 2682893 - RNA, 22 nt, Haemophilus influenzae Rd
aaauuggccgcacuuuugaucu

SEQ ID NO: 2682894 - RNA, 19 nt, Haemophilus influenzae Rd
aaauuggguucgcaaauaa

SEQ ID NO: 2682895 - RNA, 17 nt, Haemophilus influenzae Rd
aaauugguuaauguaaa

SEQ ID NO: 2682896 - RNA, 22 nt, Haemophilus influenzae Rd
aaauugguuaauguaaacaaaa

SEQ ID NO: 2682897 - RNA, 21 nt, Haemophilus influenzae Rd
aaauuguaacuauaugauaua

SEQ ID NO: 2682898 - RNA, 17 nt, Haemophilus influenzae Rd
aaauugucguccuucaa

SEQ ID NO: 2682899 - RNA, 19 nt, Haemophilus influenzae Rd
aaauugugucacauaauca

SEQ ID NO: 2682900 - RNA, 20 nt, Haemophilus influenzae Rd
aaauuguugccgccaaucca

SEQ ID NO: 2682901 - RNA, 12 nt, Haemophilus influenzae Rd
aaauuguuuaau

SEQ ID NO: 2682902 - RNA, 12 nt, Haemophilus influenzae Rd
aaauuuaaaaaa

SEQ ID NO: 2682903 - RNA, 17 nt, Haemophilus influenzae Rd
aaauuuaaaaucgcaau

SEQ ID NO: 2682904 - RNA, 16 nt, Haemophilus influenzae Rd
aaauuuaaaggacuaa

SEQ ID NO: 2682905 - RNA, 20 nt, Haemophilus influenzae Rd
aaauuuaaaggcggauuuau

SEQ ID NO: 2682906 - RNA, 21 nt, Haemophilus influenzae Rd
aaauuuaaaggcggauuuauu

SEQ ID NO: 2682907 - RNA, 19 nt, Haemophilus influenzae Rd
aaauuuaaccacuaaaaaa

SEQ ID NO: 2682908 - RNA, 19 nt, Haemophilus influenzae Rd
aaauuuaagccuguuaugc

SEQ ID NO: 2682909 - RNA, 13 nt, Haemophilus influenzae Rd
aaauuuaccgcac

SEQ ID NO: 2682910 - RNA, 20 nt, Haemophilus influenzae Rd
aaauuuaccgcacuuugauu

SEQ ID NO: 2682911 - RNA, 18 nt, Haemophilus influenzae Rd
aaauuuacucacaacaaa

SEQ ID NO: 2682912 - RNA, 15 nt, Haemophilus influenzae Rd
aaauuuacuuuccaa

SEQ ID NO: 2682913 - RNA, 20 nt, Haemophilus influenzae Rd
aaauuuagauaacaaugaaa

SEQ ID NO: 2682914 - RNA, 18 nt, Haemophilus influenzae Rd
aaauuuaggguauuuauu

SEQ ID NO: 2682915 - RNA, 20 nt, Haemophilus influenzae Rd
aaauuuaggguauuuauuau

SEQ ID NO: 2682916 - RNA, 22 nt, Haemophilus influenzae Rd
aaauuuaggguauuuauuauuc

SEQ ID NO: 2682917 - RNA, 19 nt, Haemophilus influenzae Rd
aaauuuaguggcuaaauua

SEQ ID NO: 2682918 - RNA, 17 nt, Haemophilus influenzae Rd
aaauuuaucuaaaagua

SEQ ID NO: 2682919 - RNA, 12 nt, Haemophilus influenzae Rd
aaauuuauuaua

SEQ ID NO: 2682920 - RNA, 22 nt, Haemophilus influenzae Rd
aaauuuauuauaaaaauauuuu

SEQ ID NO: 2682921 - RNA, 18 nt, Haemophilus influenzae Rd
aaauuuauuauauaaaaa

SEQ ID NO: 2682922 - RNA, 23 nt, Haemophilus influenzae Rd
aaauuuauuauauaaaaaacccg

SEQ ID NO: 2682923 - RNA, 21 nt, Haemophilus influenzae Rd
aaauuuauuuuuuaaaacuua

SEQ ID NO: 2682924 - RNA, 19 nt, Haemophilus influenzae Rd
aaauuucaauuaaaucaaa

SEQ ID NO: 2682925 - RNA, 20 nt, Haemophilus influenzae Rd
aaauuucaccguauuuuuua

SEQ ID NO: 2682926 - RNA, 15 nt, Haemophilus influenzae Rd
aaauuucagaauuag

SEQ ID NO: 2682927 - RNA, 15 nt, Haemophilus influenzae Rd
aaauuucagcuaguc

SEQ ID NO: 2682928 - RNA, 19 nt, Haemophilus influenzae Rd
aaauuucagcuuaaauacu

SEQ ID NO: 2682929 - RNA, 15 nt, Haemophilus influenzae Rd
aaauuucaguuuaag

SEQ ID NO: 2682930 - RNA, 22 nt, Haemophilus influenzae Rd
aaauuucauccuaaaaaaauaa

SEQ ID NO: 2682931 - RNA, 16 nt, Haemophilus influenzae Rd
aaauuuccauaugacc

SEQ ID NO: 2682932 - RNA, 18 nt, Haemophilus influenzae Rd
aaauuucgcucaauaauu

SEQ ID NO: 2682933 - RNA, 16 nt, Haemophilus influenzae Rd
aaauuucuucuacacc

SEQ ID NO: 2682934 - RNA, 20 nt, Haemophilus influenzae Rd
aaauuucuucuacaccuucu

SEQ ID NO: 2682935 - RNA, 15 nt, Haemophilus influenzae Rd
aaauuucuugcuauc

SEQ ID NO: 2682936 - RNA, 14 nt, Haemophilus influenzae Rd
aaauuucuugcucu

SEQ ID NO: 2682937 - RNA, 24 nt, Haemophilus influenzae Rd
aaauuucuugcucuaauuuuacca

SEQ ID NO: 2682938 - RNA, 12 nt, Haemophilus influenzae Rd
aaauuucuuuug

SEQ ID NO: 2682939 - RNA, 19 nt, Haemophilus influenzae Rd
aaauuucuuuuguuuuaac

SEQ ID NO: 2682940 - RNA, 14 nt, Haemophilus influenzae Rd
aaauuucuuuuuua

SEQ ID NO: 2682941 - RNA, 22 nt, Haemophilus influenzae Rd
aaauuuguugcauuucuaaaua

SEQ ID NO: 2682942 - RNA, 19 nt, Haemophilus influenzae Rd
aaauuuguuguucuccuug

SEQ ID NO: 2682943 - RNA, 21 nt, Haemophilus influenzae Rd
aaauuuguuguucuccuugua

SEQ ID NO: 2682944 - RNA, 11 nt, Haemophilus influenzae Rd
aaauuuuaaaa

SEQ ID NO: 2682945 - RNA, 22 nt, Haemophilus influenzae Rd
aaauuuuaaaaaauaauuuagu

SEQ ID NO: 2682946 - RNA, 14 nt, Haemophilus influenzae Rd
aaauuuuaaaauag

SEQ ID NO: 2682947 - RNA, 11 nt, Haemophilus influenzae Rd
aaauuuuaauu

SEQ ID NO: 2682948 - RNA, 13 nt, Haemophilus influenzae Rd
aaauuuuaauuua

SEQ ID NO: 2682949 - RNA, 23 nt, Haemophilus influenzae Rd
aaauuuuaccgccgaaauuccca

SEQ ID NO: 2682950 - RNA, 16 nt, Haemophilus influenzae Rd
aaauuuuauccaucaa

SEQ ID NO: 2682951 - RNA, 20 nt, Haemophilus influenzae Rd
aaauuuuauccgguuggaaa

SEQ ID NO: 2682952 - RNA, 18 nt, Haemophilus influenzae Rd
aaauuuucaaauugaaaa

SEQ ID NO: 2682953 - RNA, 17 nt, Haemophilus influenzae Rd
aaauuuucagcuugugc

SEQ ID NO: 2682954 - RNA, 20 nt, Haemophilus influenzae Rd
aaauuuuccaauucuaguuc

SEQ ID NO: 2682955 - RNA, 23 nt, Haemophilus influenzae Rd
aaauuuuccgcacuuuuuauuca

SEQ ID NO: 2682956 - RNA, 21 nt, Haemophilus influenzae Rd
aaauuuuccgcauaaauaaua

SEQ ID NO: 2682957 - RNA, 12 nt, Haemophilus influenzae Rd
aaauuuuccuuc

SEQ ID NO: 2682958 - RNA, 16 nt, Haemophilus influenzae Rd
aaauuuucggcaagaa

SEQ ID NO: 2682959 - RNA, 18 nt, Haemophilus influenzae Rd
aaauuuucggcaagaaau

SEQ ID NO: 2682960 - RNA, 22 nt, Haemophilus influenzae Rd
aaauuuucuuuucuaacgcuuu

SEQ ID NO: 2682961 - RNA, 12 nt, Haemophilus influenzae Rd
aaauuuugauau

SEQ ID NO: 2682962 - RNA, 20 nt, Haemophilus influenzae Rd
aaauuuugaugaaaguugaa

SEQ ID NO: 2682963 - RNA, 13 nt, Haemophilus influenzae Rd
aaauuuugcccuc

SEQ ID NO: 2682964 - RNA, 17 nt, Haemophilus influenzae Rd
aaauuuuuaaaguuauu

SEQ ID NO: 2682965 - RNA, 17 nt, Haemophilus influenzae Rd
aaauuuuuaaugcguuu

SEQ ID NO: 2682966 - RNA, 15 nt, Haemophilus influenzae Rd
aaauuuuuaccgcac

SEQ ID NO: 2682967 - RNA, 20 nt, Haemophilus influenzae Rd
aaauuuuuagcgaguuuaag

SEQ ID NO: 2682968 - RNA, 21 nt, Haemophilus influenzae Rd
aaauuuuuagcugauuuuuua

SEQ ID NO: 2682969 - RNA, 23 nt, Haemophilus influenzae Rd
aaauuuuuaggugcuuuuugcua

SEQ ID NO: 2682970 - RNA, 16 nt, Haemophilus influenzae Rd
aaauuuuucacagaaa

SEQ ID NO: 2682971 - RNA, 21 nt, Haemophilus influenzae Rd
aaauuuuucaucuuuuuauaa

SEQ ID NO: 2682972 - RNA, 14 nt, Haemophilus influenzae Rd
aaauuuuucauucu

SEQ ID NO: 2682973 - RNA, 17 nt, Haemophilus influenzae Rd
aaauuuuuccacauuaa

SEQ ID NO: 2682974 - RNA, 23 nt, Haemophilus influenzae Rd
aaauuuuucgcaagauagcaaaa

SEQ ID NO: 2682975 - RNA, 18 nt, Haemophilus influenzae Rd
aaauuuuucuuuucuucu

SEQ ID NO: 2682976 - RNA, 21 nt, Haemophilus influenzae Rd
aaauuuuucuuuucuucuaau

SEQ ID NO: 2682977 - RNA, 23 nt, Haemophilus influenzae Rd
aaauuuuuggcugcugcaccaga

SEQ ID NO: 2682978 - RNA, 21 nt, Haemophilus influenzae Rd
aaauuuuuguugauaaacaua

SEQ ID NO: 2682979 - RNA, 22 nt, Haemophilus influenzae Rd
aaauuuuuuugcuggaaaaaug

SEQ ID NO: 2682980 - RNA, 19 nt, Haemophilus influenzae Rd
aacaaaaagauugaauguu

SEQ ID NO: 2682981 - RNA, 13 nt, Haemophilus influenzae Rd
aacaaaaauacgu

SEQ ID NO: 2682982 - RNA, 17 nt, Haemophilus influenzae Rd
aacaaaagaaauuuuaa

SEQ ID NO: 2682983 - RNA, 12 nt, Haemophilus influenzae Rd
aacaaaaucaau

SEQ ID NO: 2682984 - RNA, 14 nt, Haemophilus influenzae Rd
aacaaaaucuuacu

SEQ ID NO: 2682985 - RNA, 11 nt, Haemophilus influenzae Rd
aacaaacauua

SEQ ID NO: 2682986 - RNA, 22 nt, Haemophilus influenzae Rd
aacaaacauuaaucgaucaauu

SEQ ID NO: 2682987 - RNA, 19 nt, Haemophilus influenzae Rd
aacaaaccagccugaaaaa

SEQ ID NO: 2682988 - RNA, 23 nt, Haemophilus influenzae Rd
aacaaaccuaaaccuuauuuuaa

SEQ ID NO: 2682989 - RNA, 21 nt, Haemophilus influenzae Rd
aacaaacgaugaagaaaauuu

SEQ ID NO: 2682990 - RNA, 19 nt, Haemophilus influenzae Rd
aacaaacuuucauucguau

SEQ ID NO: 2682991 - RNA, 21 nt, Haemophilus influenzae Rd
aacaaagggcugauauuuaaa

SEQ ID NO: 2682992 - RNA, 22 nt, Haemophilus influenzae Rd
aacaaagggcugauauuuaaaa

SEQ ID NO: 2682993 - RNA, 15 nt, Haemophilus influenzae Rd
aacaaaggguaaaua

SEQ ID NO: 2682994 - RNA, 17 nt, Haemophilus influenzae Rd
aacagcggucaaaauag

SEQ ID NO: 2682995 - RNA, 15 nt, Haemophilus influenzae Rd
aacagcuaaaaauga

SEQ ID NO: 2682996 - RNA, 16 nt, Haemophilus influenzae Rd
aacagcuugcauacgg

SEQ ID NO: 2682997 - RNA, 17 nt, Haemophilus influenzae Rd
aacaggaaucgugacaa

SEQ ID NO: 2682998 - RNA, 15 nt, Haemophilus influenzae Rd
aacaggcuuauuaaa

SEQ ID NO: 2682999 - RNA, 21 nt, Haemophilus influenzae Rd
aacaggcuuauuaaaaacuaa

SEQ ID NO: 2683000 - RNA, 19 nt, Haemophilus influenzae Rd
aacagggugucguagaaau

SEQ ID NO: 2683001 - RNA, 22 nt, Haemophilus influenzae Rd
aacagggugucguagaaauaag

SEQ ID NO: 2683002 - RNA, 15 nt, Haemophilus influenzae Rd
aacaguaaauuuuuc

SEQ ID NO: 2683003 - RNA, 22 nt, Haemophilus influenzae Rd
aacaguaaugaaagaaacacca

SEQ ID NO: 2683004 - RNA, 17 nt, Haemophilus influenzae Rd
aacaguagaaaucacaa

SEQ ID NO: 2683005 - RNA, 22 nt, Haemophilus influenzae Rd
aacagucugcgccuaaaauauu

SEQ ID NO: 2683006 - RNA, 11 nt, Haemophilus influenzae Rd
aacaguggguu

SEQ ID NO: 2683007 - RNA, 16 nt, Haemophilus influenzae Rd
aacaguggguuaugua

SEQ ID NO: 2683008 - RNA, 16 nt, Haemophilus influenzae Rd
aacaguucaauaaaaa

SEQ ID NO: 2683009 - RNA, 23 nt, Haemophilus influenzae Rd
aacaguuuucaaauuaaccgcac

SEQ ID NO: 2683010 - RNA, 13 nt, Haemophilus influenzae Rd
aacauaaacauug

SEQ ID NO: 2683011 - RNA, 13 nt, Haemophilus influenzae Rd
aacauaaagauua

SEQ ID NO: 2683012 - RNA, 16 nt, Haemophilus influenzae Rd
aacauaaagauuaaaa

SEQ ID NO: 2683013 - RNA, 20 nt, Haemophilus influenzae Rd
aacauaauaaaauuuauuac

SEQ ID NO: 2683014 - RNA, 22 nt, Haemophilus influenzae Rd
aacauaauaaaauuuauuacaa

SEQ ID NO: 2683015 - RNA, 14 nt, Haemophilus influenzae Rd
aacauaauauuuuc

SEQ ID NO: 2683016 - RNA, 23 nt, Haemophilus influenzae Rd
aacauaauauuuuccccuuguuc

SEQ ID NO: 2683017 - RNA, 17 nt, Haemophilus influenzae Rd
aacauaaugauuucuaa

SEQ ID NO: 2683018 - RNA, 15 nt, Haemophilus influenzae Rd
aacauaaugcgaugu

SEQ ID NO: 2683019 - RNA, 14 nt, Haemophilus influenzae Rd
aacauaauuuauau

SEQ ID NO: 2683020 - RNA, 15 nt, Haemophilus influenzae Rd
aacauaccuaaaaau

SEQ ID NO: 2683021 - RNA, 17 nt, Haemophilus influenzae Rd
aacauaccuaaaaaugc

SEQ ID NO: 2683022 - RNA, 23 nt, Haemophilus influenzae Rd
aacauaccuaaaaaugccccagc

SEQ ID NO: 2683023 - RNA, 22 nt, Haemophilus influenzae Rd
aacauagcugaaaaauaaaaaa

SEQ ID NO: 2683024 - RNA, 21 nt, Haemophilus influenzae Rd
aacauaggguguucaacuucc

SEQ ID NO: 2683025 - RNA, 16 nt, Haemophilus influenzae Rd
aacauaguaaauuuua

SEQ ID NO: 2683026 - RNA, 14 nt, Haemophilus influenzae Rd
aacauaguuaaugu

SEQ ID NO: 2683027 - RNA, 16 nt, Haemophilus influenzae Rd
aacauauaacccauag

SEQ ID NO: 2683028 - RNA, 22 nt, Haemophilus influenzae Rd
aacauaucggcaaucaauucau

SEQ ID NO: 2683029 - RNA, 21 nt, Haemophilus influenzae Rd
aacauaucguuaucuuuaaag

SEQ ID NO: 2683030 - RNA, 15 nt, Haemophilus influenzae Rd
aacaucaaaaccauu

SEQ ID NO: 2683031 - RNA, 19 nt, Haemophilus influenzae Rd
aacaucaccuguaaacaaa

SEQ ID NO: 2683032 - RNA, 14 nt, Haemophilus influenzae Rd
aacaucagcuucaa

SEQ ID NO: 2683033 - RNA, 18 nt, Haemophilus influenzae Rd
aacaucagcuucaauuuc

SEQ ID NO: 2683034 - RNA, 22 nt, Haemophilus influenzae Rd
aacaucauaagguacaacagac

SEQ ID NO: 2683035 - RNA, 12 nt, Haemophilus influenzae Rd
aacaucaucacc

SEQ ID NO: 2683036 - RNA, 21 nt, Haemophilus influenzae Rd
aacaucgcagaaauagauucu

SEQ ID NO: 2683037 - RNA, 16 nt, Haemophilus influenzae Rd
aacaucgcagugaucc

SEQ ID NO: 2683038 - RNA, 13 nt, Haemophilus influenzae Rd
aacaucgcuaaau

SEQ ID NO: 2683039 - RNA, 17 nt, Haemophilus influenzae Rd
aacaucgcuucaucauc

SEQ ID NO: 2683040 - RNA, 19 nt, Haemophilus influenzae Rd
aacaucggcaaccaaguau

SEQ ID NO: 2683041 - RNA, 16 nt, Haemophilus influenzae Rd
aacaucucuugaauac

SEQ ID NO: 2683042 - RNA, 21 nt, Haemophilus influenzae Rd
aacaucuucugcagaaaaaug

SEQ ID NO: 2683043 - RNA, 15 nt, Haemophilus influenzae Rd
aacaucuugccauuu

SEQ ID NO: 2683044 - RNA, 17 nt, Haemophilus influenzae Rd
aacaucuuguuuuaauu

SEQ ID NO: 2683045 - RNA, 21 nt, Haemophilus influenzae Rd
aacaugucuuguggguuuauu

SEQ ID NO: 2683046 - RNA, 15 nt, Haemophilus influenzae Rd
aacauuaaucgauca

SEQ ID NO: 2683047 - RNA, 18 nt, Haemophilus influenzae Rd
aacauuaccaagcccauu

SEQ ID NO: 2683048 - RNA, 16 nt, Haemophilus influenzae Rd
aacauuaugaaaaaaa

SEQ ID NO: 2683049 - RNA, 15 nt, Haemophilus influenzae Rd
aacauugccaaagca

SEQ ID NO: 2683050 - RNA, 17 nt, Haemophilus influenzae Rd
aacauuucacuaaauaa

SEQ ID NO: 2683051 - RNA, 13 nt, Haemophilus influenzae Rd
aacauuucaucgc

SEQ ID NO: 2683052 - RNA, 22 nt, Haemophilus influenzae Rd
aacauuuccaagcguaaaagua

SEQ ID NO: 2683053 - RNA, 17 nt, Haemophilus influenzae Rd
aacauuuccugugcauu

SEQ ID NO: 2683054 - RNA, 16 nt, Haemophilus influenzae Rd
aacauuuucugcucuu

SEQ ID NO: 2683055 - RNA, 14 nt, Haemophilus influenzae Rd
aacauuuuucauuu

SEQ ID NO: 2683056 - RNA, 17 nt, Haemophilus influenzae Rd
aacauuuuugguuucau

SEQ ID NO: 2683057 - RNA, 14 nt, Haemophilus influenzae Rd
aacauuuuuucaac

SEQ ID NO: 2683058 - RNA, 16 nt, Haemophilus influenzae Rd
aaccaaaacauaagaa

SEQ ID NO: 2683059 - RNA, 13 nt, Haemophilus influenzae Rd
aaccaaaaccaca

SEQ ID NO: 2683060 - RNA, 14 nt, Haemophilus influenzae Rd
aaccaaaagauuca

SEQ ID NO: 2683061 - RNA, 20 nt, Haemophilus influenzae Rd
aaccaaaaucuaaaccagca

SEQ ID NO: 2683062 - RNA, 13 nt, Haemophilus influenzae Rd
aaccaaacaaaaa

SEQ ID NO: 2683063 - RNA, 15 nt, Haemophilus influenzae Rd
aaccaaaccugcccu

SEQ ID NO: 2683064 - RNA, 16 nt, Haemophilus influenzae Rd
aaccaaacgagaaaau

SEQ ID NO: 2683065 - RNA, 19 nt, Haemophilus influenzae Rd
aaccaaacugccaaacaaa

SEQ ID NO: 2683066 - RNA, 13 nt, Haemophilus influenzae Rd
aaccaaagaaagc

SEQ ID NO: 2683067 - RNA, 22 nt, Haemophilus influenzae Rd
aaccaaagaguuugaauaauug

SEQ ID NO: 2683068 - RNA, 18 nt, Haemophilus influenzae Rd
aaccaaauaggcacauaa

SEQ ID NO: 2683069 - RNA, 13 nt, Haemophilus influenzae Rd
aaccaaauugauu

SEQ ID NO: 2683070 - RNA, 17 nt, Haemophilus influenzae Rd
aaccaaauuucuugcua

SEQ ID NO: 2683071 - RNA, 13 nt, Haemophilus influenzae Rd
aaccaacauaaac

SEQ ID NO: 2683072 - RNA, 11 nt, Haemophilus influenzae Rd
aaccaaccugc

SEQ ID NO: 2683073 - RNA, 15 nt, Haemophilus influenzae Rd
aaccaacgaaaauag

SEQ ID NO: 2683074 - RNA, 19 nt, Haemophilus influenzae Rd
aaccaagcgcgugugaaau

SEQ ID NO: 2683075 - RNA, 23 nt, Haemophilus influenzae Rd
aaccaagcgcgugugaaauuccu

SEQ ID NO: 2683076 - RNA, 13 nt, Haemophilus influenzae Rd
aaccaaguuggaa

SEQ ID NO: 2683077 - RNA, 12 nt, Haemophilus influenzae Rd
aaccaauaauuu

SEQ ID NO: 2683078 - RNA, 16 nt, Haemophilus influenzae Rd
aaccaauauaauuuac

SEQ ID NO: 2683079 - RNA, 17 nt, Haemophilus influenzae Rd
aaccaauauaauuuacu

SEQ ID NO: 2683080 - RNA, 18 nt, Haemophilus influenzae Rd
aaccaauggcaaucacaa

SEQ ID NO: 2683081 - RNA, 21 nt, Haemophilus influenzae Rd
aaccacaagaugguaauuuug

SEQ ID NO: 2683082 - RNA, 17 nt, Haemophilus influenzae Rd
aaccacaauaaaauaau

SEQ ID NO: 2683083 - RNA, 15 nt, Haemophilus influenzae Rd
aaccacacaagcacc

SEQ ID NO: 2683084 - RNA, 19 nt, Haemophilus influenzae Rd
aaccacccauacuuuaacu

SEQ ID NO: 2683085 - RNA, 20 nt, Haemophilus influenzae Rd
aaccacccauacuuuaacuu

SEQ ID NO: 2683086 - RNA, 18 nt, Haemophilus influenzae Rd
aaccaccccauuucuuga

SEQ ID NO: 2683087 - RNA, 21 nt, Haemophilus influenzae Rd
aaccaccgauuaauaaaauca

SEQ ID NO: 2683088 - RNA, 13 nt, Haemophilus influenzae Rd
aaccacuaaaaca

SEQ ID NO: 2683089 - RNA, 14 nt, Haemophilus influenzae Rd
aaccacuaaaacac

SEQ ID NO: 2683090 - RNA, 17 nt, Haemophilus influenzae Rd
aaccacuagccauugca

SEQ ID NO: 2683091 - RNA, 21 nt, Haemophilus influenzae Rd
aaccacuugucauuaaaaaau

SEQ ID NO: 2683092 - RNA, 14 nt, Haemophilus influenzae Rd
aaccagcagaaaau

SEQ ID NO: 2683093 - RNA, 15 nt, Haemophilus influenzae Rd
aaccagcagaaaaua

SEQ ID NO: 2683094 - RNA, 21 nt, Haemophilus influenzae Rd
aaccagccugaaaaagcuaaa

SEQ ID NO: 2683095 - RNA, 19 nt, Haemophilus influenzae Rd
aaccagguaauguuucaua

SEQ ID NO: 2683096 - RNA, 22 nt, Haemophilus influenzae Rd
aaccaguuuguguuuauuuaac

SEQ ID NO: 2683097 - RNA, 22 nt, Haemophilus influenzae Rd
aaccauaaaaaauggaauaaaa

SEQ ID NO: 2683098 - RNA, 14 nt, Haemophilus influenzae Rd
aaccauaaacaaua

SEQ ID NO: 2683099 - RNA, 15 nt, Haemophilus influenzae Rd
aaccauaacaagaau

SEQ ID NO: 2683100 - RNA, 23 nt, Haemophilus influenzae Rd
aacgccgcaacuaauaaaccaau

SEQ ID NO: 2683101 - RNA, 21 nt, Haemophilus influenzae Rd
aacgccuagauauuguucuac

SEQ ID NO: 2683102 - RNA, 13 nt, Haemophilus influenzae Rd
aacgccugcugca

SEQ ID NO: 2683103 - RNA, 18 nt, Haemophilus influenzae Rd
aacgcgaugaaauuauca

SEQ ID NO: 2683104 - RNA, 18 nt, Haemophilus influenzae Rd
aacgcgcauuaaacugga

SEQ ID NO: 2683105 - RNA, 17 nt, Haemophilus influenzae Rd
aacgcguacuuuuuuac

SEQ ID NO: 2683106 - RNA, 14 nt, Haemophilus influenzae Rd
aacgcucaaaaauu

SEQ ID NO: 2683107 - RNA, 16 nt, Haemophilus influenzae Rd
aacgcucaaaaauuuc

SEQ ID NO: 2683108 - RNA, 22 nt, Haemophilus influenzae Rd
aacgcucaaaaauuucagaauu

SEQ ID NO: 2683109 - RNA, 22 nt, Haemophilus influenzae Rd
aacgcucuuuaauacgagcuga

SEQ ID NO: 2683110 - RNA, 19 nt, Haemophilus influenzae Rd
aacgcugaaacgggcucau

SEQ ID NO: 2683111 - RNA, 20 nt, Haemophilus influenzae Rd
aacgcugcuuaaagcaauca

SEQ ID NO: 2683112 - RNA, 22 nt, Haemophilus influenzae Rd
aacgcugcuuaaagcaaucaaa

SEQ ID NO: 2683113 - RNA, 23 nt, Haemophilus influenzae Rd
aacgcuguaaaccuucaaacauc

SEQ ID NO: 2683114 - RNA, 17 nt, Haemophilus influenzae Rd
aacgcuguuuugcuucc

SEQ ID NO: 2683115 - RNA, 15 nt, Haemophilus influenzae Rd
aacgcuugaauaaau

SEQ ID NO: 2683116 - RNA, 18 nt, Haemophilus influenzae Rd
aacgcuuucucaauuuuu

SEQ ID NO: 2683117 - RNA, 13 nt, Haemophilus influenzae Rd
aacgcuuuuaaac

SEQ ID NO: 2683118 - RNA, 17 nt, Haemophilus influenzae Rd
aacggauuaacacaucc

SEQ ID NO: 2683119 - RNA, 15 nt, Haemophilus influenzae Rd
aacggcaagcaaaca

SEQ ID NO: 2683120 - RNA, 15 nt, Haemophilus influenzae Rd
aacggcgaagauuac

SEQ ID NO: 2683121 - RNA, 18 nt, Haemophilus influenzae Rd
aacggcgugaguugcaua

SEQ ID NO: 2683122 - RNA, 16 nt, Haemophilus influenzae Rd
aacggcuggugacagc

SEQ ID NO: 2683123 - RNA, 18 nt, Haemophilus influenzae Rd
aacgggcuuaaacuuuuu

SEQ ID NO: 2683124 - RNA, 19 nt, Haemophilus influenzae Rd
aacgguaacugauuuugcu

SEQ ID NO: 2683125 - RNA, 20 nt, Haemophilus influenzae Rd
aacgguaacugauuuugcua

SEQ ID NO: 2683126 - RNA, 14 nt, Haemophilus influenzae Rd
aacgguauuuucuc

SEQ ID NO: 2683127 - RNA, 16 nt, Haemophilus influenzae Rd
aacggucgaguuuuuc

SEQ ID NO: 2683128 - RNA, 23 nt, Haemophilus influenzae Rd
aacggucgaguuuuucaaaaauu

SEQ ID NO: 2683129 - RNA, 18 nt, Haemophilus influenzae Rd
aacggugugggugcugca

SEQ ID NO: 2683130 - RNA, 22 nt, Haemophilus influenzae Rd
aacggugugggugcugcaacug

SEQ ID NO: 2683131 - RNA, 13 nt, Haemophilus influenzae Rd
aacgguuaauaaa

SEQ ID NO: 2683132 - RNA, 19 nt, Haemophilus influenzae Rd
aacgguuaauaaauucuug

SEQ ID NO: 2683133 - RNA, 13 nt, Haemophilus influenzae Rd
aacgguuaugaaa

SEQ ID NO: 2683134 - RNA, 21 nt, Haemophilus influenzae Rd
aacgguucacguaaaaucauu

SEQ ID NO: 2683135 - RNA, 11 nt, Haemophilus influenzae Rd
aacguaaaaac

SEQ ID NO: 2683136 - RNA, 12 nt, Haemophilus influenzae Rd
aacguaaaaacg

SEQ ID NO: 2683137 - RNA, 14 nt, Haemophilus influenzae Rd
aacguaagaaauaa

SEQ ID NO: 2683138 - RNA, 17 nt, Haemophilus influenzae Rd
aacguaaucaaauccac

SEQ ID NO: 2683139 - RNA, 15 nt, Haemophilus influenzae Rd
aacguauuuucucau

SEQ ID NO: 2683140 - RNA, 15 nt, Haemophilus influenzae Rd
aacgucgaauaacuu

SEQ ID NO: 2683141 - RNA, 19 nt, Haemophilus influenzae Rd
aacgucgugggauuugcca

SEQ ID NO: 2683142 - RNA, 12 nt, Haemophilus influenzae Rd
aacgugaaguaa

SEQ ID NO: 2683143 - RNA, 14 nt, Haemophilus influenzae Rd
aacgugaaguaaau

SEQ ID NO: 2683144 - RNA, 14 nt, Haemophilus influenzae Rd
aacguuauaaacaa

SEQ ID NO: 2683145 - RNA, 20 nt, Haemophilus influenzae Rd
aacguugcucuuucaaguuu

SEQ ID NO: 2683146 - RNA, 17 nt, Haemophilus influenzae Rd
aacguuggguuugauuu

SEQ ID NO: 2683147 - RNA, 15 nt, Haemophilus influenzae Rd
aacguuuaaauuaua

SEQ ID NO: 2683148 - RNA, 18 nt, Haemophilus influenzae Rd
aacguuuauauugaacaa

SEQ ID NO: 2683149 - RNA, 22 nt, Haemophilus influenzae Rd
aacguuuauggcuuucaauuuc

SEQ ID NO: 2683150 - RNA, 19 nt, Haemophilus influenzae Rd
aacguuuuaauccuuccaa

SEQ ID NO: 2683151 - RNA, 14 nt, Haemophilus influenzae Rd
aacguuuuugaaua

SEQ ID NO: 2683152 - RNA, 17 nt, Haemophilus influenzae Rd
aacuaaaaaaauucaac

SEQ ID NO: 2683153 - RNA, 15 nt, Haemophilus influenzae Rd
aacuaaaaaauaguu

SEQ ID NO: 2683154 - RNA, 16 nt, Haemophilus influenzae Rd
aacuaaaaacaaauau

SEQ ID NO: 2683155 - RNA, 21 nt, Haemophilus influenzae Rd
aacuaaaaacaaauauauuuc

SEQ ID NO: 2683156 - RNA, 15 nt, Haemophilus influenzae Rd
aacuaaaaggacuaa

SEQ ID NO: 2683157 - RNA, 19 nt, Haemophilus influenzae Rd
aacuaaaagggucaaugcc

SEQ ID NO: 2683158 - RNA, 13 nt, Haemophilus influenzae Rd
aacuaaaauaguu

SEQ ID NO: 2683159 - RNA, 17 nt, Haemophilus influenzae Rd
aacuaaaccauuuaaua

SEQ ID NO: 2683160 - RNA, 22 nt, Haemophilus influenzae Rd
aacuaaaccauuuaauaaaaca

SEQ ID NO: 2683161 - RNA, 15 nt, Haemophilus influenzae Rd
aacuaaacuuaccua

SEQ ID NO: 2683162 - RNA, 21 nt, Haemophilus influenzae Rd
aacuaaacuuaccuaaaaauu

SEQ ID NO: 2683163 - RNA, 20 nt, Haemophilus influenzae Rd
aacuaaagaaucaaauucac

SEQ ID NO: 2683164 - RNA, 16 nt, Haemophilus influenzae Rd
aacuaaaugaaguuca

SEQ ID NO: 2683165 - RNA, 12 nt, Haemophilus influenzae Rd
aacuaaauucaa

SEQ ID NO: 2683166 - RNA, 14 nt, Haemophilus influenzae Rd
aacuaaauucaauu

SEQ ID NO: 2683167 - RNA, 16 nt, Haemophilus influenzae Rd
aacuaacauacccaug

SEQ ID NO: 2683168 - RNA, 15 nt, Haemophilus influenzae Rd
aacuaacuggcugug

SEQ ID NO: 2683169 - RNA, 15 nt, Haemophilus influenzae Rd
aacuaagaugaucaa

SEQ ID NO: 2683170 - RNA, 16 nt, Haemophilus influenzae Rd
aacuaagcucauccau

SEQ ID NO: 2683171 - RNA, 19 nt, Haemophilus influenzae Rd
aacuaauacuucauaguga

SEQ ID NO: 2683172 - RNA, 16 nt, Haemophilus influenzae Rd
aacuaauuaguuuuua

SEQ ID NO: 2683173 - RNA, 17 nt, Haemophilus influenzae Rd
aacuaauuguuuuaaaa

SEQ ID NO: 2683174 - RNA, 16 nt, Haemophilus influenzae Rd
aacuaauuuauuaaaa

SEQ ID NO: 2683175 - RNA, 17 nt, Haemophilus influenzae Rd
aacuaauuuauuaaaaa

SEQ ID NO: 2683176 - RNA, 20 nt, Haemophilus influenzae Rd
aacuaauuucgcauaauaua

SEQ ID NO: 2683177 - RNA, 17 nt, Haemophilus influenzae Rd
aacuaauuugggugcag

SEQ ID NO: 2683178 - RNA, 21 nt, Haemophilus influenzae Rd
aacuaauuugggugcagauuu

SEQ ID NO: 2683179 - RNA, 18 nt, Haemophilus influenzae Rd
aacuacaacuucaucaau

SEQ ID NO: 2683180 - RNA, 21 nt, Haemophilus influenzae Rd
aacuacaacuuuuuauuuucu

SEQ ID NO: 2683181 - RNA, 17 nt, Haemophilus influenzae Rd
aacuacccaaauuuaua

SEQ ID NO: 2683182 - RNA, 18 nt, Haemophilus influenzae Rd
aacuacccaaauuuauaa

SEQ ID NO: 2683183 - RNA, 13 nt, Haemophilus influenzae Rd
aacuaccgcacuu

SEQ ID NO: 2683184 - RNA, 16 nt, Haemophilus influenzae Rd
aacuaccuaauaaagc

SEQ ID NO: 2683185 - RNA, 22 nt, Haemophilus influenzae Rd
aacuaggcaucaaaauucaaaa

SEQ ID NO: 2683186 - RNA, 23 nt, Haemophilus influenzae Rd
aacuauaacuaggcaucaaaauu

SEQ ID NO: 2683187 - RNA, 22 nt, Haemophilus influenzae Rd
aacuauauagccuguuguucuc

SEQ ID NO: 2683188 - RNA, 22 nt, Haemophilus influenzae Rd
aacuauaugauauauaaaaccc

SEQ ID NO: 2683189 - RNA, 17 nt, Haemophilus influenzae Rd
aacuaucuuacuugccu

SEQ ID NO: 2683190 - RNA, 15 nt, Haemophilus influenzae Rd
aacuaugaagacuaa

SEQ ID NO: 2683191 - RNA, 19 nt, Haemophilus influenzae Rd
aacuaugcagaaucagaau

SEQ ID NO: 2683192 - RNA, 20 nt, Haemophilus influenzae Rd
aacuaugcagaaucagaaua

SEQ ID NO: 2683193 - RNA, 15 nt, Haemophilus influenzae Rd
aacuaugccuucuuc

SEQ ID NO: 2683194 - RNA, 20 nt, Haemophilus influenzae Rd
aacuauuaccuaaccaaagc

SEQ ID NO: 2683195 - RNA, 22 nt, Haemophilus influenzae Rd
aacuauuacgcuguccaauaau

SEQ ID NO: 2683196 - RNA, 23 nt, Haemophilus influenzae Rd
aacuauuacgcuguccaauaauu

SEQ ID NO: 2683197 - RNA, 22 nt, Haemophilus influenzae Rd
aacuauuuaaguguuuacuauu

SEQ ID NO: 2683198 - RNA, 12 nt, Haemophilus influenzae Rd
aacuauuuuuaa

SEQ ID NO: 2683199 - RNA, 18 nt, Haemophilus influenzae Rd
aacuauuuuuaauuuuga

SEQ ID NO: 2683200 - RNA, 21 nt, Haemophilus influenzae Rd
aacuauuuuuuauuuauauaa

SEQ ID NO: 2683201 - RNA, 20 nt, Haemophilus influenzae Rd
aacucaacaccgcaaaaaua

SEQ ID NO: 2683202 - RNA, 23 nt, Haemophilus influenzae Rd
aacucaacaccgcaaaaauacua

SEQ ID NO: 2683203 - RNA, 19 nt, Haemophilus influenzae Rd
aacucaaugaauuaaaagu

SEQ ID NO: 2683204 - RNA, 14 nt, Haemophilus influenzae Rd
aacucacaauugau

SEQ ID NO: 2683205 - RNA, 19 nt, Haemophilus influenzae Rd
aagaaagcgacauuuuguc

SEQ ID NO: 2683206 - RNA, 13 nt, Haemophilus influenzae Rd
aagaaaguuaaaa

SEQ ID NO: 2683207 - RNA, 15 nt, Haemophilus influenzae Rd
aagaaaguuaaaaca

SEQ ID NO: 2683208 - RNA, 11 nt, Haemophilus influenzae Rd
aagaaauaaaa

SEQ ID NO: 2683209 - RNA, 20 nt, Haemophilus influenzae Rd
aagaaauaaauuuauuuaau

SEQ ID NO: 2683210 - RNA, 20 nt, Haemophilus influenzae Rd
aagaaauaacgauaagauuu

SEQ ID NO: 2683211 - RNA, 20 nt, Haemophilus influenzae Rd
aagaaauaacgucauuaauu

SEQ ID NO: 2683212 - RNA, 19 nt, Haemophilus influenzae Rd
aagaaauaauaaaauagcu

SEQ ID NO: 2683213 - RNA, 21 nt, Haemophilus influenzae Rd
aagaaauauaauaaauauguu

SEQ ID NO: 2683214 - RNA, 13 nt, Haemophilus influenzae Rd
aagaaauggcuug

SEQ ID NO: 2683215 - RNA, 13 nt, Haemophilus influenzae Rd
aagaaauuuuaau

SEQ ID NO: 2683216 - RNA, 19 nt, Haemophilus influenzae Rd
aagaaauuuuauccaucaa

SEQ ID NO: 2683217 - RNA, 14 nt, Haemophilus influenzae Rd
aagaaauuuuguuu

SEQ ID NO: 2683218 - RNA, 21 nt, Haemophilus influenzae Rd
aagaaauuuuguuuuguucau

SEQ ID NO: 2683219 - RNA, 12 nt, Haemophilus influenzae Rd
aagaacaagggg

SEQ ID NO: 2683220 - RNA, 22 nt, Haemophilus influenzae Rd
aagaacaaggggaaaauauuau

SEQ ID NO: 2683221 - RNA, 11 nt, Haemophilus influenzae Rd
aagaacagaaa

SEQ ID NO: 2683222 - RNA, 18 nt, Haemophilus influenzae Rd
aagaacaucaaauccuug

SEQ ID NO: 2683223 - RNA, 20 nt, Haemophilus influenzae Rd
aagaaccacagccaagguuu

SEQ ID NO: 2683224 - RNA, 14 nt, Haemophilus influenzae Rd
aagaacggucaaaa

SEQ ID NO: 2683225 - RNA, 20 nt, Haemophilus influenzae Rd
aagaacggucaaaaugcagu

SEQ ID NO: 2683226 - RNA, 18 nt, Haemophilus influenzae Rd
aagaacguaaauuauguu

SEQ ID NO: 2683227 - RNA, 22 nt, Haemophilus influenzae Rd
aagaacuacauugaguuacuuu

SEQ ID NO: 2683228 - RNA, 18 nt, Haemophilus influenzae Rd
aagaacuugauaaucauu

SEQ ID NO: 2683229 - RNA, 16 nt, Haemophilus influenzae Rd
aagaagaaaguuaaaa

SEQ ID NO: 2683230 - RNA, 18 nt, Haemophilus influenzae Rd
aagaagaaugcggugaaa

SEQ ID NO: 2683231 - RNA, 21 nt, Haemophilus influenzae Rd
aagaagcgaauauuguuaauu

SEQ ID NO: 2683232 - RNA, 15 nt, Haemophilus influenzae Rd
aagaagcuuuccauc

SEQ ID NO: 2683233 - RNA, 14 nt, Haemophilus influenzae Rd
aagaagugaaauua

SEQ ID NO: 2683234 - RNA, 11 nt, Haemophilus influenzae Rd
aagaauaaaau

SEQ ID NO: 2683235 - RNA, 20 nt, Haemophilus influenzae Rd
aagaauaauauuaaagaaaa

SEQ ID NO: 2683236 - RNA, 14 nt, Haemophilus influenzae Rd
aagaauacaaauuc

SEQ ID NO: 2683237 - RNA, 16 nt, Haemophilus influenzae Rd
aagaauagucacacca

SEQ ID NO: 2683238 - RNA, 11 nt, Haemophilus influenzae Rd
aagaauauauu

SEQ ID NO: 2683239 - RNA, 20 nt, Haemophilus influenzae Rd
aagaauauucuuuucuccac

SEQ ID NO: 2683240 - RNA, 19 nt, Haemophilus influenzae Rd
aagaauauuuuaaugaaag

SEQ ID NO: 2683241 - RNA, 14 nt, Haemophilus influenzae Rd
aagaaucaucuuca

SEQ ID NO: 2683242 - RNA, 12 nt, Haemophilus influenzae Rd
aagaauccacau

SEQ ID NO: 2683243 - RNA, 22 nt, Haemophilus influenzae Rd
aagaaucuucuaauuugccauc

SEQ ID NO: 2683244 - RNA, 17 nt, Haemophilus influenzae Rd
aagaaugucaucuaauu

SEQ ID NO: 2683245 - RNA, 14 nt, Haemophilus influenzae Rd
aagaauguuugaaa

SEQ ID NO: 2683246 - RNA, 11 nt, Haemophilus influenzae Rd
aagaauguuuu

SEQ ID NO: 2683247 - RNA, 16 nt, Haemophilus influenzae Rd
aagaauguuuugauug

SEQ ID NO: 2683248 - RNA, 22 nt, Haemophilus influenzae Rd
aagaauuccauugcauccacuu

SEQ ID NO: 2683249 - RNA, 20 nt, Haemophilus influenzae Rd
aagaauucuggugcauuuau

SEQ ID NO: 2683250 - RNA, 13 nt, Haemophilus influenzae Rd
aagaauuuuuugc

SEQ ID NO: 2683251 - RNA, 14 nt, Haemophilus influenzae Rd
aagacaaauuuguu

SEQ ID NO: 2683252 - RNA, 14 nt, Haemophilus influenzae Rd
aagacaauggcuuu

SEQ ID NO: 2683253 - RNA, 17 nt, Haemophilus influenzae Rd
aagacaauggcuuugcc

SEQ ID NO: 2683254 - RNA, 18 nt, Haemophilus influenzae Rd
aagacagcuauuaaaaaa

SEQ ID NO: 2683255 - RNA, 19 nt, Haemophilus influenzae Rd
aagacagcuauuaaaaaaa

SEQ ID NO: 2683256 - RNA, 17 nt, Haemophilus influenzae Rd
aagaccugcuucuuuua

SEQ ID NO: 2683257 - RNA, 19 nt, Haemophilus influenzae Rd
aagaccugcuucuuuuaau

SEQ ID NO: 2683258 - RNA, 19 nt, Haemophilus influenzae Rd
aagacgaagaaacaaccag

SEQ ID NO: 2683259 - RNA, 15 nt, Haemophilus influenzae Rd
aagacgcuguuucuu

SEQ ID NO: 2683260 - RNA, 17 nt, Haemophilus influenzae Rd
aagacgggaaacaauau

SEQ ID NO: 2683261 - RNA, 19 nt, Haemophilus influenzae Rd
aagacguuugauuguaaaa

SEQ ID NO: 2683262 - RNA, 18 nt, Haemophilus influenzae Rd
aagacuaaacagaauuua

SEQ ID NO: 2683263 - RNA, 15 nt, Haemophilus influenzae Rd
aagacuaaacucaau

SEQ ID NO: 2683264 - RNA, 20 nt, Haemophilus influenzae Rd
aagacuaugcguagaaagau

SEQ ID NO: 2683265 - RNA, 14 nt, Haemophilus influenzae Rd
aagacuauuaaguu

SEQ ID NO: 2683266 - RNA, 15 nt, Haemophilus influenzae Rd
aagacuauuaaguuc

SEQ ID NO: 2683267 - RNA, 19 nt, Haemophilus influenzae Rd
aagacucucgccuuauuac

SEQ ID NO: 2683268 - RNA, 23 nt, Haemophilus influenzae Rd
aagacuuugguguuacaucuaca

SEQ ID NO: 2683269 - RNA, 15 nt, Haemophilus influenzae Rd
aagagacucuguucc

SEQ ID NO: 2683270 - RNA, 15 nt, Haemophilus influenzae Rd
aagagaggagaaaua

SEQ ID NO: 2683271 - RNA, 22 nt, Haemophilus influenzae Rd
aagagaucacuguaaauaauag

SEQ ID NO: 2683272 - RNA, 21 nt, Haemophilus influenzae Rd
aagagauuauuugcauauaaa

SEQ ID NO: 2683273 - RNA, 15 nt, Haemophilus influenzae Rd
aagagauugauuuuc

SEQ ID NO: 2683274 - RNA, 15 nt, Haemophilus influenzae Rd
aagagcaaauuuaaa

SEQ ID NO: 2683275 - RNA, 17 nt, Haemophilus influenzae Rd
aagagcggucaauuuuu

SEQ ID NO: 2683276 - RNA, 17 nt, Haemophilus influenzae Rd
aagagcgguugaaaauu

SEQ ID NO: 2683277 - RNA, 16 nt, Haemophilus influenzae Rd
aagaggagguagaaaa

SEQ ID NO: 2683278 - RNA, 23 nt, Haemophilus influenzae Rd
aagaggagguagaaaaucgcaau

SEQ ID NO: 2683279 - RNA, 14 nt, Haemophilus influenzae Rd
aagaguaaaacuaa

SEQ ID NO: 2683280 - RNA, 15 nt, Haemophilus influenzae Rd
aagaguaaauauugu

SEQ ID NO: 2683281 - RNA, 17 nt, Haemophilus influenzae Rd
aagaguuauaaacccau

SEQ ID NO: 2683282 - RNA, 21 nt, Haemophilus influenzae Rd
aagaguuuccuuauauucaga

SEQ ID NO: 2683283 - RNA, 14 nt, Haemophilus influenzae Rd
aagaguuugaauaa

SEQ ID NO: 2683284 - RNA, 18 nt, Haemophilus influenzae Rd
aagauaaauuacauaaaa

SEQ ID NO: 2683285 - RNA, 17 nt, Haemophilus influenzae Rd
aagauaaauuauauuuu

SEQ ID NO: 2683286 - RNA, 19 nt, Haemophilus influenzae Rd
aagauaaauuuaaaggacu

SEQ ID NO: 2683287 - RNA, 23 nt, Haemophilus influenzae Rd
aagauaaggacgaaggauaaauu

SEQ ID NO: 2683288 - RNA, 20 nt, Haemophilus influenzae Rd
aagauaaguggggaaaaaua

SEQ ID NO: 2683289 - RNA, 14 nt, Haemophilus influenzae Rd
aagauaauaaaugc

SEQ ID NO: 2683290 - RNA, 18 nt, Haemophilus influenzae Rd
aagauaaucgcaaagaau

SEQ ID NO: 2683291 - RNA, 17 nt, Haemophilus influenzae Rd
aagauacacucacuuuu

SEQ ID NO: 2683292 - RNA, 21 nt, Haemophilus influenzae Rd
aagauaccaauaaucaauacu

SEQ ID NO: 2683293 - RNA, 22 nt, Haemophilus influenzae Rd
aagauacuacacccaaaugcca

SEQ ID NO: 2683294 - RNA, 15 nt, Haemophilus influenzae Rd
aagauagggcugcau

SEQ ID NO: 2683295 - RNA, 17 nt, Haemophilus influenzae Rd
aagauagggcugcaugu

SEQ ID NO: 2683296 - RNA, 13 nt, Haemophilus influenzae Rd
aagauauaaacug

SEQ ID NO: 2683297 - RNA, 16 nt, Haemophilus influenzae Rd
aagauauaaacugauu

SEQ ID NO: 2683298 - RNA, 20 nt, Haemophilus influenzae Rd
aagauauaaacugauuuuga

SEQ ID NO: 2683299 - RNA, 13 nt, Haemophilus influenzae Rd
aagauauuuuuac

SEQ ID NO: 2683300 - RNA, 20 nt, Haemophilus influenzae Rd
aagauauuuuuaccgcacuu

SEQ ID NO: 2683301 - RNA, 14 nt, Haemophilus influenzae Rd
aagaucaagcacuu

SEQ ID NO: 2683302 - RNA, 16 nt, Haemophilus influenzae Rd
aagaucaguuaccaua

SEQ ID NO: 2683303 - RNA, 21 nt, Haemophilus influenzae Rd
aagaucaguuaccauacauuc

SEQ ID NO: 2683304 - RNA, 18 nt, Haemophilus influenzae Rd
aagaucauuuuuuuaaau

SEQ ID NO: 2683305 - RNA, 15 nt, Haemophilus influenzae Rd
aagauccuuccacca

SEQ ID NO: 2683306 - RNA, 14 nt, Haemophilus influenzae Rd
aagaucuaaaaacu

SEQ ID NO: 2683307 - RNA, 21 nt, Haemophilus influenzae Rd
aagaucuaaaaacuuuuguuc

SEQ ID NO: 2683308 - RNA, 21 nt, Haemophilus influenzae Rd
aagaucuaaaccuaagcaacc

SEQ ID NO: 2683309 - RNA, 21 nt, Haemophilus influenzae Rd
aagaucuucuacuguuaauuu

SEQ ID NO: 2683310 - RNA, 21 nt, Haemophilus influenzae Rd
aagaugaacgaguaaauuaau

SEQ ID NO: 2683311 - RNA, 21 nt, Haemophilus influenzae Rd
aagccugcuacagaagcugcg

SEQ ID NO: 2683312 - RNA, 20 nt, Haemophilus influenzae Rd
aagccuucaccuaauccuac

SEQ ID NO: 2683313 - RNA, 21 nt, Haemophilus influenzae Rd
aagccuucaccuaauccuacu

SEQ ID NO: 2683314 - RNA, 21 nt, Haemophilus influenzae Rd
aagccuucagccugcucacga

SEQ ID NO: 2683315 - RNA, 20 nt, Haemophilus influenzae Rd
aagccuucuaaaauaagaau

SEQ ID NO: 2683316 - RNA, 15 nt, Haemophilus influenzae Rd
aagccuugauuucag

SEQ ID NO: 2683317 - RNA, 13 nt, Haemophilus influenzae Rd
aagccuuuuauuu

SEQ ID NO: 2683318 - RNA, 16 nt, Haemophilus influenzae Rd
aagcgaacaaucgcuu

SEQ ID NO: 2683319 - RNA, 23 nt, Haemophilus influenzae Rd
aagcgaauuucuuuuaagaaauu

SEQ ID NO: 2683320 - RNA, 21 nt, Haemophilus influenzae Rd
aagcgaggauaaugcugagua

SEQ ID NO: 2683321 - RNA, 12 nt, Haemophilus influenzae Rd
aagcgauaaaua

SEQ ID NO: 2683322 - RNA, 19 nt, Haemophilus influenzae Rd
aagcgcgugugaaauuccu

SEQ ID NO: 2683323 - RNA, 17 nt, Haemophilus influenzae Rd
aagcggcacucucuugg

SEQ ID NO: 2683324 - RNA, 14 nt, Haemophilus influenzae Rd
aagcguaaaaguau

SEQ ID NO: 2683325 - RNA, 21 nt, Haemophilus influenzae Rd
aagcguaaugcacuuucaucu

SEQ ID NO: 2683326 - RNA, 15 nt, Haemophilus influenzae Rd
aagcguucaucaauu

SEQ ID NO: 2683327 - RNA, 19 nt, Haemophilus influenzae Rd
aagcguugaagcuaauucu

SEQ ID NO: 2683328 - RNA, 13 nt, Haemophilus influenzae Rd
aagcguuuuaaaa

SEQ ID NO: 2683329 - RNA, 19 nt, Haemophilus influenzae Rd
aagcguuuuucuacauaau

SEQ ID NO: 2683330 - RNA, 14 nt, Haemophilus influenzae Rd
aagcuaaaaaaaca

SEQ ID NO: 2683331 - RNA, 14 nt, Haemophilus influenzae Rd
aagcuaagauugac

SEQ ID NO: 2683332 - RNA, 23 nt, Haemophilus influenzae Rd
aagcuaauugguaaaauuaagca

SEQ ID NO: 2683333 - RNA, 13 nt, Haemophilus influenzae Rd
aagcuaauuuuuc

SEQ ID NO: 2683334 - RNA, 16 nt, Haemophilus influenzae Rd
aagcuaccugccauaa

SEQ ID NO: 2683335 - RNA, 12 nt, Haemophilus influenzae Rd
aagcuacuaaaa

SEQ ID NO: 2683336 - RNA, 18 nt, Haemophilus influenzae Rd
aagcuaucgucaaauuua

SEQ ID NO: 2683337 - RNA, 18 nt, Haemophilus influenzae Rd
aagcuauucauaccgaua

SEQ ID NO: 2683338 - RNA, 18 nt, Haemophilus influenzae Rd
aagcucaaaaguauaaac

SEQ ID NO: 2683339 - RNA, 14 nt, Haemophilus influenzae Rd
aagcucaacugcca

SEQ ID NO: 2683340 - RNA, 15 nt, Haemophilus influenzae Rd
aagcucaccugcccu

SEQ ID NO: 2683341 - RNA, 15 nt, Haemophilus influenzae Rd
aagcucacuuuauau

SEQ ID NO: 2683342 - RNA, 20 nt, Haemophilus influenzae Rd
aagcucagguucaaaacgcu

SEQ ID NO: 2683343 - RNA, 13 nt, Haemophilus influenzae Rd
aagcucgaaguuu

SEQ ID NO: 2683344 - RNA, 14 nt, Haemophilus influenzae Rd
aagcucgcuauuuu

SEQ ID NO: 2683345 - RNA, 15 nt, Haemophilus influenzae Rd
aagcucgguaaaaau

SEQ ID NO: 2683346 - RNA, 16 nt, Haemophilus influenzae Rd
aagcucgguaaaaauc

SEQ ID NO: 2683347 - RNA, 18 nt, Haemophilus influenzae Rd
aagcucgguaaaaaucau

SEQ ID NO: 2683348 - RNA, 15 nt, Haemophilus influenzae Rd
aagcucguauaauau

SEQ ID NO: 2683349 - RNA, 13 nt, Haemophilus influenzae Rd
aagcucgucuaaa

SEQ ID NO: 2683350 - RNA, 14 nt, Haemophilus influenzae Rd
aagcugaccacuuu

SEQ ID NO: 2683351 - RNA, 14 nt, Haemophilus influenzae Rd
aagcugauauaaaa

SEQ ID NO: 2683352 - RNA, 17 nt, Haemophilus influenzae Rd
aagcugcaucaauauug

SEQ ID NO: 2683353 - RNA, 18 nt, Haemophilus influenzae Rd
aagcuggcguucugucua

SEQ ID NO: 2683354 - RNA, 22 nt, Haemophilus influenzae Rd
aagcuggcguuuacuuggcauu

SEQ ID NO: 2683355 - RNA, 23 nt, Haemophilus influenzae Rd
aagcuggcuuucuuuuucaaguu

SEQ ID NO: 2683356 - RNA, 23 nt, Haemophilus influenzae Rd
aagcuuaauauguucuuuguuga

SEQ ID NO: 2683357 - RNA, 14 nt, Haemophilus influenzae Rd
aagcuuauuucacu

SEQ ID NO: 2683358 - RNA, 18 nt, Haemophilus influenzae Rd
aagcuugcguaauguuua

SEQ ID NO: 2683359 - RNA, 23 nt, Haemophilus influenzae Rd
aagcuuuaccgucagccaaauuu

SEQ ID NO: 2683360 - RNA, 21 nt, Haemophilus influenzae Rd
aagcuuuccaucgcacuguua

SEQ ID NO: 2683361 - RNA, 20 nt, Haemophilus influenzae Rd
aagcuuuuucuuguucugcc

SEQ ID NO: 2683362 - RNA, 14 nt, Haemophilus influenzae Rd
aaggaacaauuucu

SEQ ID NO: 2683363 - RNA, 18 nt, Haemophilus influenzae Rd
aaggaauauucuuuaaau

SEQ ID NO: 2683364 - RNA, 22 nt, Haemophilus influenzae Rd
aaggaaucgaaauuaaaauaau

SEQ ID NO: 2683365 - RNA, 14 nt, Haemophilus influenzae Rd
aaggaccaagcaau

SEQ ID NO: 2683366 - RNA, 20 nt, Haemophilus influenzae Rd
aaggacgaaggauaaauuga

SEQ ID NO: 2683367 - RNA, 16 nt, Haemophilus influenzae Rd
aaggacuaaacuuuua

SEQ ID NO: 2683368 - RNA, 21 nt, Haemophilus influenzae Rd
aaggacuaagcuuuuuuuaau

SEQ ID NO: 2683369 - RNA, 22 nt, Haemophilus influenzae Rd
aaggacugaguucuguaauuca

SEQ ID NO: 2683370 - RNA, 13 nt, Haemophilus influenzae Rd
aaggaguaaguuu

SEQ ID NO: 2683371 - RNA, 15 nt, Haemophilus influenzae Rd
aaggauucgaaccuu

SEQ ID NO: 2683372 - RNA, 22 nt, Haemophilus influenzae Rd
aaggauugaccgcccaacauuu

SEQ ID NO: 2683373 - RNA, 13 nt, Haemophilus influenzae Rd
aaggauuuuauca

SEQ ID NO: 2683374 - RNA, 20 nt, Haemophilus influenzae Rd
aaggauuuuugaauuucacu

SEQ ID NO: 2683375 - RNA, 14 nt, Haemophilus influenzae Rd
aaggcaaaauugaa

SEQ ID NO: 2683376 - RNA, 21 nt, Haemophilus influenzae Rd
aaggcaaagcaaaaucaaagu

SEQ ID NO: 2683377 - RNA, 23 nt, Haemophilus influenzae Rd
aaggcaauucccaguaaucuuuu

SEQ ID NO: 2683378 - RNA, 20 nt, Haemophilus influenzae Rd
aaggcaauuuuuaaugccau

SEQ ID NO: 2683379 - RNA, 21 nt, Haemophilus influenzae Rd
aaggcacagggcugauaaauu

SEQ ID NO: 2683380 - RNA, 22 nt, Haemophilus influenzae Rd
aaggcacagggcugauaaauuu

SEQ ID NO: 2683381 - RNA, 11 nt, Haemophilus influenzae Rd
aaggcacugcg

SEQ ID NO: 2683382 - RNA, 14 nt, Haemophilus influenzae Rd
aaggcagaaaugaa

SEQ ID NO: 2683383 - RNA, 19 nt, Haemophilus influenzae Rd
aaggcagccauaaaugcua

SEQ ID NO: 2683384 - RNA, 19 nt, Haemophilus influenzae Rd
aaggcaggacguuuuaaua

SEQ ID NO: 2683385 - RNA, 19 nt, Haemophilus influenzae Rd
aaggcauuuauuucaauau

SEQ ID NO: 2683386 - RNA, 15 nt, Haemophilus influenzae Rd
aaggcauuuuuuaua

SEQ ID NO: 2683387 - RNA, 16 nt, Haemophilus influenzae Rd
aaggcauuuuuuauaa

SEQ ID NO: 2683388 - RNA, 13 nt, Haemophilus influenzae Rd
aaggccauauuuu

SEQ ID NO: 2683389 - RNA, 20 nt, Haemophilus influenzae Rd
aaggcgauccugaugcagaa

SEQ ID NO: 2683390 - RNA, 14 nt, Haemophilus influenzae Rd
aaggcgauuuaagu

SEQ ID NO: 2683391 - RNA, 13 nt, Haemophilus influenzae Rd
aaggcuaaguucu

SEQ ID NO: 2683392 - RNA, 15 nt, Haemophilus influenzae Rd
aaggcucaucauuau

SEQ ID NO: 2683393 - RNA, 18 nt, Haemophilus influenzae Rd
aaggcuccaguuguaaag

SEQ ID NO: 2683394 - RNA, 22 nt, Haemophilus influenzae Rd
aaggcuccaguuguaaagauug

SEQ ID NO: 2683395 - RNA, 20 nt, Haemophilus influenzae Rd
aaggcucuaccuaaaauaaa

SEQ ID NO: 2683396 - RNA, 17 nt, Haemophilus influenzae Rd
aaggcuuauuuuuaaac

SEQ ID NO: 2683397 - RNA, 17 nt, Haemophilus influenzae Rd
aaggcuucauuugcuuc

SEQ ID NO: 2683398 - RNA, 18 nt, Haemophilus influenzae Rd
aaggcuucauuugcuucu

SEQ ID NO: 2683399 - RNA, 21 nt, Haemophilus influenzae Rd
aaggcuuucuguguuagaaag

SEQ ID NO: 2683400 - RNA, 21 nt, Haemophilus influenzae Rd
aaggcuuuguaaugcuuuuag

SEQ ID NO: 2683401 - RNA, 15 nt, Haemophilus influenzae Rd
aaggcuuuucuuuua

SEQ ID NO: 2683402 - RNA, 18 nt, Haemophilus influenzae Rd
aaggcuuuucuuuuauac

SEQ ID NO: 2683403 - RNA, 15 nt, Haemophilus influenzae Rd
aagggaaauaacaaa

SEQ ID NO: 2683404 - RNA, 15 nt, Haemophilus influenzae Rd
aagggauuugaaaau

SEQ ID NO: 2683405 - RNA, 23 nt, Haemophilus influenzae Rd
aagggcagauuuaauucugcccu

SEQ ID NO: 2683406 - RNA, 23 nt, Haemophilus influenzae Rd
aagggcgagcaacuuggaaugca

SEQ ID NO: 2683407 - RNA, 13 nt, Haemophilus influenzae Rd
aagguaauuuaag

SEQ ID NO: 2683408 - RNA, 16 nt, Haemophilus influenzae Rd
aagguauaaauaauuu

SEQ ID NO: 2683409 - RNA, 15 nt, Haemophilus influenzae Rd
aagguauccacuuuu

SEQ ID NO: 2683410 - RNA, 19 nt, Haemophilus influenzae Rd
aaggugcaacgugugccag

SEQ ID NO: 2683411 - RNA, 18 nt, Haemophilus influenzae Rd
aaggugcagauuaaauau

SEQ ID NO: 2683412 - RNA, 23 nt, Haemophilus influenzae Rd
aaggugcagauuaauuauauuuu

SEQ ID NO: 2683413 - RNA, 17 nt, Haemophilus influenzae Rd
aaggugcguucuacacg

SEQ ID NO: 2683414 - RNA, 21 nt, Haemophilus influenzae Rd
aagguggcacgccuaauucuu

SEQ ID NO: 2683415 - RNA, 19 nt, Haemophilus influenzae Rd
aaggugguuuugcaaacca

SEQ ID NO: 2683416 - RNA, 13 nt, Haemophilus influenzae Rd
aagugcgguaaau

SEQ ID NO: 2683417 - RNA, 18 nt, Haemophilus influenzae Rd
aagugcgguaaauuuuua

SEQ ID NO: 2683418 - RNA, 19 nt, Haemophilus influenzae Rd
aagugcgguaaauuuuuac

SEQ ID NO: 2683419 - RNA, 16 nt, Haemophilus influenzae Rd
aagugcgguaagaaaa

SEQ ID NO: 2683420 - RNA, 18 nt, Haemophilus influenzae Rd
aagugcgguaagaaaauc

SEQ ID NO: 2683421 - RNA, 20 nt, Haemophilus influenzae Rd
aagugcgguaaucuuucacu

SEQ ID NO: 2683422 - RNA, 17 nt, Haemophilus influenzae Rd
aagugcgguaauuuuua

SEQ ID NO: 2683423 - RNA, 17 nt, Haemophilus influenzae Rd
aagugcgguagaaauua

SEQ ID NO: 2683424 - RNA, 17 nt, Haemophilus influenzae Rd
aagugcggucaauaaaa

SEQ ID NO: 2683425 - RNA, 17 nt, Haemophilus influenzae Rd
aagugcggucaauuuuc

SEQ ID NO: 2683426 - RNA, 17 nt, Haemophilus influenzae Rd
aagugcggucaauuuuu

SEQ ID NO: 2683427 - RNA, 18 nt, Haemophilus influenzae Rd
aagugcggucaauuuuuc

SEQ ID NO: 2683428 - RNA, 22 nt, Haemophilus influenzae Rd
aagugcggucagcauaaagaga

SEQ ID NO: 2683429 - RNA, 20 nt, Haemophilus influenzae Rd
aagugcggucugaaaaucaa

SEQ ID NO: 2683430 - RNA, 14 nt, Haemophilus influenzae Rd
aagugcggugaaaa

SEQ ID NO: 2683431 - RNA, 18 nt, Haemophilus influenzae Rd
aagugcggugaaaaauca

SEQ ID NO: 2683432 - RNA, 20 nt, Haemophilus influenzae Rd
aagugcgguuaauuuucacc

SEQ ID NO: 2683433 - RNA, 17 nt, Haemophilus influenzae Rd
aagugcgguuaauuuuu

SEQ ID NO: 2683434 - RNA, 19 nt, Haemophilus influenzae Rd
aagugcgguuaauuuuuac

SEQ ID NO: 2683435 - RNA, 18 nt, Haemophilus influenzae Rd
aagugcgguugaaaaauu

SEQ ID NO: 2683436 - RNA, 23 nt, Haemophilus influenzae Rd
aagugcgguugaaaaauuuguug

SEQ ID NO: 2683437 - RNA, 17 nt, Haemophilus influenzae Rd
aagugcgguugaaaauu

SEQ ID NO: 2683438 - RNA, 18 nt, Haemophilus influenzae Rd
aagugcgguugaaauuua

SEQ ID NO: 2683439 - RNA, 18 nt, Haemophilus influenzae Rd
aagugcgguugaaauuuc

SEQ ID NO: 2683440 - RNA, 15 nt, Haemophilus influenzae Rd
aagugcgguugcuuu

SEQ ID NO: 2683441 - RNA, 18 nt, Haemophilus influenzae Rd
aagugcgguuguuuuugc

SEQ ID NO: 2683442 - RNA, 15 nt, Haemophilus influenzae Rd
aagugcguguauaua

SEQ ID NO: 2683443 - RNA, 22 nt, Haemophilus influenzae Rd
aagugcugguagcaauaaccaa

SEQ ID NO: 2683444 - RNA, 13 nt, Haemophilus influenzae Rd
aagugcuuuaccu

SEQ ID NO: 2683445 - RNA, 22 nt, Haemophilus influenzae Rd
aaguggagaaacauuuuucccu

SEQ ID NO: 2683446 - RNA, 19 nt, Haemophilus influenzae Rd
aaguggcauaaagaaacag

SEQ ID NO: 2683447 - RNA, 14 nt, Haemophilus influenzae Rd
aaguggggaaaaau

SEQ ID NO: 2683448 - RNA, 15 nt, Haemophilus influenzae Rd
aaguggggaaaaaua

SEQ ID NO: 2683449 - RNA, 21 nt, Haemophilus influenzae Rd
aagugguggaauaaaagucag

SEQ ID NO: 2683450 - RNA, 19 nt, Haemophilus influenzae Rd
aaguguuuacuauuaauuc

SEQ ID NO: 2683451 - RNA, 23 nt, Haemophilus influenzae Rd
aaguguuuuugcuuguaaaaacg

SEQ ID NO: 2683452 - RNA, 18 nt, Haemophilus influenzae Rd
aaguuaaaaaaugauuaa

SEQ ID NO: 2683453 - RNA, 13 nt, Haemophilus influenzae Rd
aaguuaaaacuug

SEQ ID NO: 2683454 - RNA, 14 nt, Haemophilus influenzae Rd
aaguuaaaacuuga

SEQ ID NO: 2683455 - RNA, 23 nt, Haemophilus influenzae Rd
aaguuaaaacuugauugaaaugc

SEQ ID NO: 2683456 - RNA, 13 nt, Haemophilus influenzae Rd
aaguuaaaccaac

SEQ ID NO: 2683457 - RNA, 16 nt, Haemophilus influenzae Rd
aaguuaaaccaacaac

SEQ ID NO: 2683458 - RNA, 23 nt, Haemophilus influenzae Rd
aaguuaaagcacccaucacauuu

SEQ ID NO: 2683459 - RNA, 15 nt, Haemophilus influenzae Rd
aaguuaaucaaacuu

SEQ ID NO: 2683460 - RNA, 21 nt, Haemophilus influenzae Rd
aaguuaccauuuauuccuuua

SEQ ID NO: 2683461 - RNA, 22 nt, Haemophilus influenzae Rd
aaguuaccgcucgccaauaaaa

SEQ ID NO: 2683462 - RNA, 18 nt, Haemophilus influenzae Rd
aaguuaccgcuucuuccu

SEQ ID NO: 2683463 - RNA, 19 nt, Haemophilus influenzae Rd
aaguuacuuaauuuugcua

SEQ ID NO: 2683464 - RNA, 15 nt, Haemophilus influenzae Rd
aaguuaggauuaaua

SEQ ID NO: 2683465 - RNA, 12 nt, Haemophilus influenzae Rd
aaguuauaaagc

SEQ ID NO: 2683466 - RNA, 21 nt, Haemophilus influenzae Rd
aaguuaugggcugacauaaau

SEQ ID NO: 2683467 - RNA, 18 nt, Haemophilus influenzae Rd
aaguuauuuauauaauuu

SEQ ID NO: 2683468 - RNA, 19 nt, Haemophilus influenzae Rd
aaguuauuuauauaauuua

SEQ ID NO: 2683469 - RNA, 23 nt, Haemophilus influenzae Rd
aaguucaacaccuaaaugagaaa

SEQ ID NO: 2683470 - RNA, 16 nt, Haemophilus influenzae Rd
aaguucacaaaucuaa

SEQ ID NO: 2683471 - RNA, 20 nt, Haemophilus influenzae Rd
aaguucaccgggcgauaaaa

SEQ ID NO: 2683472 - RNA, 22 nt, Haemophilus influenzae Rd
aaguucaccgggcgauaaaauc

SEQ ID NO: 2683473 - RNA, 23 nt, Haemophilus influenzae Rd
aaguucaccgggcgauaaaaucg

SEQ ID NO: 2683474 - RNA, 13 nt, Haemophilus influenzae Rd
aaguucagaaaga

SEQ ID NO: 2683475 - RNA, 14 nt, Haemophilus influenzae Rd
aaguucagaaagag

SEQ ID NO: 2683476 - RNA, 15 nt, Haemophilus influenzae Rd
aaguucagaaagaga

SEQ ID NO: 2683477 - RNA, 15 nt, Haemophilus influenzae Rd
aaguucagauucaau

SEQ ID NO: 2683478 - RNA, 22 nt, Haemophilus influenzae Rd
aaguucagcucgagaaauagca

SEQ ID NO: 2683479 - RNA, 16 nt, Haemophilus influenzae Rd
aaguucauaaaagggg

SEQ ID NO: 2683480 - RNA, 15 nt, Haemophilus influenzae Rd
aaguucauauaaaua

SEQ ID NO: 2683481 - RNA, 17 nt, Haemophilus influenzae Rd
aaguucauauaaauaag

SEQ ID NO: 2683482 - RNA, 13 nt, Haemophilus influenzae Rd
aaguucaucaacu

SEQ ID NO: 2683483 - RNA, 16 nt, Haemophilus influenzae Rd
aaguuccuagaauuaa

SEQ ID NO: 2683484 - RNA, 19 nt, Haemophilus influenzae Rd
aaguuccuagaauuaaaag

SEQ ID NO: 2683485 - RNA, 18 nt, Haemophilus influenzae Rd
aaguucuaaaauuauaga

SEQ ID NO: 2683486 - RNA, 20 nt, Haemophilus influenzae Rd
aaguucuaauucauuuugag

SEQ ID NO: 2683487 - RNA, 16 nt, Haemophilus influenzae Rd
aaguucuacccauuca

SEQ ID NO: 2683488 - RNA, 17 nt, Haemophilus influenzae Rd
aaguucuacccauucaa

SEQ ID NO: 2683489 - RNA, 17 nt, Haemophilus influenzae Rd
aaguucuauaauuuuag

SEQ ID NO: 2683490 - RNA, 18 nt, Haemophilus influenzae Rd
aaguucucaaaaaguuaa

SEQ ID NO: 2683491 - RNA, 11 nt, Haemophilus influenzae Rd
aaguucuuauc

SEQ ID NO: 2683492 - RNA, 21 nt, Haemophilus influenzae Rd
aaguucuuucugucaucacau

SEQ ID NO: 2683493 - RNA, 14 nt, Haemophilus influenzae Rd
aaguugauaaucau

SEQ ID NO: 2683494 - RNA, 15 nt, Haemophilus influenzae Rd
aaguugauagugcca

SEQ ID NO: 2683495 - RNA, 19 nt, Haemophilus influenzae Rd
aaguugcauaacuucacca

SEQ ID NO: 2683496 - RNA, 11 nt, Haemophilus influenzae Rd
aaguuggauua

SEQ ID NO: 2683497 - RNA, 20 nt, Haemophilus influenzae Rd
aaguugugaguaaaccacaa

SEQ ID NO: 2683498 - RNA, 13 nt, Haemophilus influenzae Rd
aaguugugccaau

SEQ ID NO: 2683499 - RNA, 23 nt, Haemophilus influenzae Rd
aaguuguuuugcuuuugcacaga

SEQ ID NO: 2683500 - RNA, 14 nt, Haemophilus influenzae Rd
aaguuuaagaaaag

SEQ ID NO: 2683501 - RNA, 13 nt, Haemophilus influenzae Rd
aaguuuaagcccg

SEQ ID NO: 2683502 - RNA, 19 nt, Haemophilus influenzae Rd
aaguuuacuauuaaagugu

SEQ ID NO: 2683503 - RNA, 21 nt, Haemophilus influenzae Rd
aaguuuagauuagugugauuu

SEQ ID NO: 2683504 - RNA, 23 nt, Haemophilus influenzae Rd
aaguuuaguccuuaauuuaauua

SEQ ID NO: 2683505 - RNA, 22 nt, Haemophilus influenzae Rd
aaguuuccuucgccauuuuuaa

SEQ ID NO: 2683506 - RNA, 15 nt, Haemophilus influenzae Rd
aaguuugacuauucu

SEQ ID NO: 2683507 - RNA, 12 nt, Haemophilus influenzae Rd
aaguuugcaaca

SEQ ID NO: 2683508 - RNA, 19 nt, Haemophilus influenzae Rd
aaguuugcuaauuuaucca

SEQ ID NO: 2683509 - RNA, 14 nt, Haemophilus influenzae Rd
aaguuugcuaucuu

SEQ ID NO: 2683510 - RNA, 19 nt, Haemophilus influenzae Rd
aaguuugcuaucuuaccuu

SEQ ID NO: 2683511 - RNA, 16 nt, Haemophilus influenzae Rd
aaguuuguuugcugca

SEQ ID NO: 2683512 - RNA, 15 nt, Haemophilus influenzae Rd
aaguuuguuuuuuac

SEQ ID NO: 2683513 - RNA, 12 nt, Haemophilus influenzae Rd
aaguuuuaagug

SEQ ID NO: 2683514 - RNA, 23 nt, Haemophilus influenzae Rd
aaguuuuaccuucaguuuucauu

SEQ ID NO: 2683515 - RNA, 17 nt, Haemophilus influenzae Rd
aaguuuuacugauucuu

SEQ ID NO: 2683516 - RNA, 21 nt, Haemophilus influenzae Rd
aaguuuucauuaaagaagaaa

SEQ ID NO: 2683517 - RNA, 15 nt, Haemophilus influenzae Rd
aaguuuucguaaauu

SEQ ID NO: 2683518 - RNA, 11 nt, Haemophilus influenzae Rd
aaguuuucuac

SEQ ID NO: 2683519 - RNA, 19 nt, Haemophilus influenzae Rd
aaguuuugucugaaauuuu

SEQ ID NO: 2683520 - RNA, 22 nt, Haemophilus influenzae Rd
aaguuuuuccguugucacaaua

SEQ ID NO: 2683521 - RNA, 22 nt, Haemophilus influenzae Rd
aauaacgcaucaccacaaaaua

SEQ ID NO: 2683522 - RNA, 17 nt, Haemophilus influenzae Rd
aauaacgcucauaagca

SEQ ID NO: 2683523 - RNA, 23 nt, Haemophilus influenzae Rd
aauaacgucauuaauuuuuucac

SEQ ID NO: 2683524 - RNA, 19 nt, Haemophilus influenzae Rd
aauaacguguaaauugcuu

SEQ ID NO: 2683525 - RNA, 20 nt, Haemophilus influenzae Rd
aauaacguuacuaaaauccu

SEQ ID NO: 2683526 - RNA, 17 nt, Haemophilus influenzae Rd
aauaacuacaacacaga

SEQ ID NO: 2683527 - RNA, 17 nt, Haemophilus influenzae Rd
aauaacucuauaaaaug

SEQ ID NO: 2683528 - RNA, 16 nt, Haemophilus influenzae Rd
aauaacugaauaauuu

SEQ ID NO: 2683529 - RNA, 24 nt, Haemophilus influenzae Rd
aauaacugaucgccaucuucuucu

SEQ ID NO: 2683530 - RNA, 14 nt, Haemophilus influenzae Rd
aauaacugccacau

SEQ ID NO: 2683531 - RNA, 16 nt, Haemophilus influenzae Rd
aauaacugcgccaaua

SEQ ID NO: 2683532 - RNA, 20 nt, Haemophilus influenzae Rd
aauaacugcgccaauauaag

SEQ ID NO: 2683533 - RNA, 13 nt, Haemophilus influenzae Rd
aauaacuuuaauu

SEQ ID NO: 2683534 - RNA, 14 nt, Haemophilus influenzae Rd
aauaacuuuauuua

SEQ ID NO: 2683535 - RNA, 13 nt, Haemophilus influenzae Rd
aauaagaaagaau

SEQ ID NO: 2683536 - RNA, 21 nt, Haemophilus influenzae Rd
aauaagaauacaaauucgcca

SEQ ID NO: 2683537 - RNA, 18 nt, Haemophilus influenzae Rd
aauaagaaugucagguuu

SEQ ID NO: 2683538 - RNA, 15 nt, Haemophilus influenzae Rd
aauaagaauuuuaau

SEQ ID NO: 2683539 - RNA, 18 nt, Haemophilus influenzae Rd
aauaagaggcauaaccca

SEQ ID NO: 2683540 - RNA, 16 nt, Haemophilus influenzae Rd
aauaagauagaaaugu

SEQ ID NO: 2683541 - RNA, 13 nt, Haemophilus influenzae Rd
aauaagauuuuua

SEQ ID NO: 2683542 - RNA, 18 nt, Haemophilus influenzae Rd
aauaagauuuuugauaaa

SEQ ID NO: 2683543 - RNA, 23 nt, Haemophilus influenzae Rd
aauaagauuuuugauaaaaaaga

SEQ ID NO: 2683544 - RNA, 19 nt, Haemophilus influenzae Rd
aauaagcaauccuaagaau

SEQ ID NO: 2683545 - RNA, 17 nt, Haemophilus influenzae Rd
aauaagcaauuucacga

SEQ ID NO: 2683546 - RNA, 21 nt, Haemophilus influenzae Rd
aauaagccaaucauugcuaaa

SEQ ID NO: 2683547 - RNA, 17 nt, Haemophilus influenzae Rd
aauaagccgaagaagau

SEQ ID NO: 2683548 - RNA, 16 nt, Haemophilus influenzae Rd
aauaagccuugcauaa

SEQ ID NO: 2683549 - RNA, 20 nt, Haemophilus influenzae Rd
aauaagcuaaguacaaaaga

SEQ ID NO: 2683550 - RNA, 22 nt, Haemophilus influenzae Rd
aauaagcuaucgucaaauuuaa

SEQ ID NO: 2683551 - RNA, 22 nt, Haemophilus influenzae Rd
aauaagggcugauuuuaaauau

SEQ ID NO: 2683552 - RNA, 16 nt, Haemophilus influenzae Rd
aauaaguaguuaccau

SEQ ID NO: 2683553 - RNA, 19 nt, Haemophilus influenzae Rd
aauaagugcgguaaaaaaa

SEQ ID NO: 2683554 - RNA, 17 nt, Haemophilus influenzae Rd
aauaaguucaucaacug

SEQ ID NO: 2683555 - RNA, 14 nt, Haemophilus influenzae Rd
aauaaguuuucauc

SEQ ID NO: 2683556 - RNA, 15 nt, Haemophilus influenzae Rd
aauaaguuuucauca

SEQ ID NO: 2683557 - RNA, 11 nt, Haemophilus influenzae Rd
aauaauaaaaa

SEQ ID NO: 2683558 - RNA, 13 nt, Haemophilus influenzae Rd
aauaauaaauugg

SEQ ID NO: 2683559 - RNA, 18 nt, Haemophilus influenzae Rd
aauaauaaucuucuugaa

SEQ ID NO: 2683560 - RNA, 13 nt, Haemophilus influenzae Rd
aauaauacugcuu

SEQ ID NO: 2683561 - RNA, 14 nt, Haemophilus influenzae Rd
aauaauagacauaa

SEQ ID NO: 2683562 - RNA, 19 nt, Haemophilus influenzae Rd
aauaauaggcgaaucaaaa

SEQ ID NO: 2683563 - RNA, 20 nt, Haemophilus influenzae Rd
aauaauaggcgaaucaaaau

SEQ ID NO: 2683564 - RNA, 13 nt, Haemophilus influenzae Rd
aauaauauaagug

SEQ ID NO: 2683565 - RNA, 21 nt, Haemophilus influenzae Rd
aauaauauaggcgaacaaaag

SEQ ID NO: 2683566 - RNA, 14 nt, Haemophilus influenzae Rd
aauaauaucaauca

SEQ ID NO: 2683567 - RNA, 16 nt, Haemophilus influenzae Rd
aauaauauuaaagaaa

SEQ ID NO: 2683568 - RNA, 19 nt, Haemophilus influenzae Rd
aauaauauuaaagaaaaua

SEQ ID NO: 2683569 - RNA, 12 nt, Haemophilus influenzae Rd
aauaauauucaa

SEQ ID NO: 2683570 - RNA, 17 nt, Haemophilus influenzae Rd
aauaauauucaaaacau

SEQ ID NO: 2683571 - RNA, 15 nt, Haemophilus influenzae Rd
aauaaucacaacaaa

SEQ ID NO: 2683572 - RNA, 23 nt, Haemophilus influenzae Rd
aauaaucacuugauaaaaaugag

SEQ ID NO: 2683573 - RNA, 23 nt, Haemophilus influenzae Rd
aauaaucaggauuaaugcuauaa

SEQ ID NO: 2683574 - RNA, 17 nt, Haemophilus influenzae Rd
aauaauccucuuuaaaa

SEQ ID NO: 2683575 - RNA, 18 nt, Haemophilus influenzae Rd
aauaauccucuuuaaaau

SEQ ID NO: 2683576 - RNA, 15 nt, Haemophilus influenzae Rd
aauaaucgaaaaagu

SEQ ID NO: 2683577 - RNA, 16 nt, Haemophilus influenzae Rd
aauaaucuaauccaaa

SEQ ID NO: 2683578 - RNA, 14 nt, Haemophilus influenzae Rd
aauaaucuauuucu

SEQ ID NO: 2683579 - RNA, 13 nt, Haemophilus influenzae Rd
aauaaugaaauau

SEQ ID NO: 2683580 - RNA, 12 nt, Haemophilus influenzae Rd
aauaaugaauaa

SEQ ID NO: 2683581 - RNA, 18 nt, Haemophilus influenzae Rd
aauaaugaauauauucau

SEQ ID NO: 2683582 - RNA, 17 nt, Haemophilus influenzae Rd
aauaaugcauagccaag

SEQ ID NO: 2683583 - RNA, 21 nt, Haemophilus influenzae Rd
aauaaugccaagaaagucauu

SEQ ID NO: 2683584 - RNA, 23 nt, Haemophilus influenzae Rd
aauaaugccauuggacacaauaa

SEQ ID NO: 2683585 - RNA, 18 nt, Haemophilus influenzae Rd
aauaaugcccgcacuuuu

SEQ ID NO: 2683586 - RNA, 22 nt, Haemophilus influenzae Rd
aauaauguugcugauugcacau

SEQ ID NO: 2683587 - RNA, 13 nt, Haemophilus influenzae Rd
aauaauguuuuca

SEQ ID NO: 2683588 - RNA, 16 nt, Haemophilus influenzae Rd
aauaauguuuucauua

SEQ ID NO: 2683589 - RNA, 19 nt, Haemophilus influenzae Rd
aauaauguuuuuaugaccg

SEQ ID NO: 2683590 - RNA, 13 nt, Haemophilus influenzae Rd
aauaauuaaaaau

SEQ ID NO: 2683591 - RNA, 14 nt, Haemophilus influenzae Rd
aauaauuaaaaaua

SEQ ID NO: 2683592 - RNA, 15 nt, Haemophilus influenzae Rd
aauaauuaaaaauaa

SEQ ID NO: 2683593 - RNA, 14 nt, Haemophilus influenzae Rd
aauaauuaaacuuu

SEQ ID NO: 2683594 - RNA, 19 nt, Haemophilus influenzae Rd
aauaauuaaaucuucgccu

SEQ ID NO: 2683595 - RNA, 15 nt, Haemophilus influenzae Rd
aauaauuacuugcuc

SEQ ID NO: 2683596 - RNA, 18 nt, Haemophilus influenzae Rd
aauaauuagcuaaauacu

SEQ ID NO: 2683597 - RNA, 20 nt, Haemophilus influenzae Rd
aauaauuauggugaauaaaa

SEQ ID NO: 2683598 - RNA, 22 nt, Haemophilus influenzae Rd
aauaauucaagaugauauuuaa

SEQ ID NO: 2683599 - RNA, 20 nt, Haemophilus influenzae Rd
aauaauucauuauuuggugc

SEQ ID NO: 2683600 - RNA, 21 nt, Haemophilus influenzae Rd
aauaauucauugaugcccacu

SEQ ID NO: 2683601 - RNA, 23 nt, Haemophilus influenzae Rd
aauaauucauugaugcccacuuu

SEQ ID NO: 2683602 - RNA, 12 nt, Haemophilus influenzae Rd
aauaauucuuua

SEQ ID NO: 2683603 - RNA, 16 nt, Haemophilus influenzae Rd
aauaauugaagcaauu

SEQ ID NO: 2683604 - RNA, 14 nt, Haemophilus influenzae Rd
aauaauugaugcua

SEQ ID NO: 2683605 - RNA, 13 nt, Haemophilus influenzae Rd
aauaauuucaaua

SEQ ID NO: 2683606 - RNA, 20 nt, Haemophilus influenzae Rd
aauaauuucaauauaaguug

SEQ ID NO: 2683607 - RNA, 13 nt, Haemophilus influenzae Rd
aauaauuuccuuu

SEQ ID NO: 2683608 - RNA, 19 nt, Haemophilus influenzae Rd
aauaauuuuacuugugcau

SEQ ID NO: 2683609 - RNA, 15 nt, Haemophilus influenzae Rd
aauaauuuuguuacu

SEQ ID NO: 2683610 - RNA, 20 nt, Haemophilus influenzae Rd
aauaauuuuuaauucuuuuu

SEQ ID NO: 2683611 - RNA, 23 nt, Haemophilus influenzae Rd
aauaauuuuuaauucuuuuucac

SEQ ID NO: 2683612 - RNA, 11 nt, Haemophilus influenzae Rd
aauaauuuuuc

SEQ ID NO: 2683613 - RNA, 13 nt, Haemophilus influenzae Rd
aauacaaauacau

SEQ ID NO: 2683614 - RNA, 17 nt, Haemophilus influenzae Rd
aauacaaauacauuuug

SEQ ID NO: 2683615 - RNA, 16 nt, Haemophilus influenzae Rd
aauacaacaagaaauu

SEQ ID NO: 2683616 - RNA, 16 nt, Haemophilus influenzae Rd
aauacaacgguuggaa

SEQ ID NO: 2683617 - RNA, 16 nt, Haemophilus influenzae Rd
aauacaagaccaauau

SEQ ID NO: 2683618 - RNA, 15 nt, Haemophilus influenzae Rd
aauacacaaaaucca

SEQ ID NO: 2683619 - RNA, 17 nt, Haemophilus influenzae Rd
aauacaccaauaauuaa

SEQ ID NO: 2683620 - RNA, 20 nt, Haemophilus influenzae Rd
aauacaccaauaauuaaaca

SEQ ID NO: 2683621 - RNA, 15 nt, Haemophilus influenzae Rd
aauacacgaugcucu

SEQ ID NO: 2683622 - RNA, 21 nt, Haemophilus influenzae Rd
aauacacuuuaaauuuuccug

SEQ ID NO: 2683623 - RNA, 23 nt, Haemophilus influenzae Rd
aauacacuuuaaauuuuccuguu

SEQ ID NO: 2683624 - RNA, 23 nt, Haemophilus influenzae Rd
aauacagcgaacauuuuugguuu

SEQ ID NO: 2683625 - RNA, 14 nt, Haemophilus influenzae Rd
aauacagugacaaa

SEQ ID NO: 2683626 - RNA, 17 nt, Haemophilus influenzae Rd
aauacaguuucugguuu

SEQ ID NO: 2683627 - RNA, 14 nt, Haemophilus influenzae Rd
aauauaacauuuau

SEQ ID NO: 2683628 - RNA, 17 nt, Haemophilus influenzae Rd
aauauaaccuuguccgc

SEQ ID NO: 2683629 - RNA, 21 nt, Haemophilus influenzae Rd
aauauaaguuauuuauauaau

SEQ ID NO: 2683630 - RNA, 14 nt, Haemophilus influenzae Rd
aauauaauaaauuc

SEQ ID NO: 2683631 - RNA, 15 nt, Haemophilus influenzae Rd
aauauaaugaaaaca

SEQ ID NO: 2683632 - RNA, 19 nt, Haemophilus influenzae Rd
aauauaauucagcaagaaa

SEQ ID NO: 2683633 - RNA, 15 nt, Haemophilus influenzae Rd
aauauaauuuagcau

SEQ ID NO: 2683634 - RNA, 20 nt, Haemophilus influenzae Rd
aauauaccccaaacuauaua

SEQ ID NO: 2683635 - RNA, 22 nt, Haemophilus influenzae Rd
aauauacgccaggcucuguaau

SEQ ID NO: 2683636 - RNA, 18 nt, Haemophilus influenzae Rd
aauauagaugaagugaac

SEQ ID NO: 2683637 - RNA, 19 nt, Haemophilus influenzae Rd
aauauagaugaagugaacu

SEQ ID NO: 2683638 - RNA, 20 nt, Haemophilus influenzae Rd
aauauagcaaacuagguaau

SEQ ID NO: 2683639 - RNA, 18 nt, Haemophilus influenzae Rd
aauauaggcgaacaaaag

SEQ ID NO: 2683640 - RNA, 21 nt, Haemophilus influenzae Rd
aauauaggcuauauuuuccac

SEQ ID NO: 2683641 - RNA, 21 nt, Haemophilus influenzae Rd
aauauaggguaaauaaaaaug

SEQ ID NO: 2683642 - RNA, 16 nt, Haemophilus influenzae Rd
aauauagguuaauagu

SEQ ID NO: 2683643 - RNA, 17 nt, Haemophilus influenzae Rd
aauauagguuaauaguu

SEQ ID NO: 2683644 - RNA, 12 nt, Haemophilus influenzae Rd
aauauagucaaa

SEQ ID NO: 2683645 - RNA, 16 nt, Haemophilus influenzae Rd
aauauagucaaauaac

SEQ ID NO: 2683646 - RNA, 15 nt, Haemophilus influenzae Rd
aauauauaaauccgu

SEQ ID NO: 2683647 - RNA, 15 nt, Haemophilus influenzae Rd
aauauaucaagcaga

SEQ ID NO: 2683648 - RNA, 14 nt, Haemophilus influenzae Rd
aauauaugaaaaau

SEQ ID NO: 2683649 - RNA, 20 nt, Haemophilus influenzae Rd
aauauaugggaaacaauaug

SEQ ID NO: 2683650 - RNA, 17 nt, Haemophilus influenzae Rd
aauauaugguucauuau

SEQ ID NO: 2683651 - RNA, 23 nt, Haemophilus influenzae Rd
aauauauucacgcuaaggcaaaa

SEQ ID NO: 2683652 - RNA, 16 nt, Haemophilus influenzae Rd
aauauauucggaaaaa

SEQ ID NO: 2683653 - RNA, 17 nt, Haemophilus influenzae Rd
aauauauucggaaaaaa

SEQ ID NO: 2683654 - RNA, 18 nt, Haemophilus influenzae Rd
aauauauucggaaaaaau

SEQ ID NO: 2683655 - RNA, 13 nt, Haemophilus influenzae Rd
aauauauucugcu

SEQ ID NO: 2683656 - RNA, 18 nt, Haemophilus influenzae Rd
aauauauuuagauacaaa

SEQ ID NO: 2683657 - RNA, 23 nt, Haemophilus influenzae Rd
aauauauuucuaauaaagugcgg

SEQ ID NO: 2683658 - RNA, 16 nt, Haemophilus influenzae Rd
aauaucaaaaaaauuu

SEQ ID NO: 2683659 - RNA, 22 nt, Haemophilus influenzae Rd
aauaucaaagaaaaauugugua

SEQ ID NO: 2683660 - RNA, 23 nt, Haemophilus influenzae Rd
aauaucaagucaaaaaccgcuuu

SEQ ID NO: 2683661 - RNA, 14 nt, Haemophilus influenzae Rd
aauaucaaucacuu

SEQ ID NO: 2683662 - RNA, 19 nt, Haemophilus influenzae Rd
aauaucaaugcucucuuuu

SEQ ID NO: 2683663 - RNA, 17 nt, Haemophilus influenzae Rd
aauaucacaaccaccaa

SEQ ID NO: 2683664 - RNA, 17 nt, Haemophilus influenzae Rd
aauaucacgccuuuuuu

SEQ ID NO: 2683665 - RNA, 14 nt, Haemophilus influenzae Rd
aauaucacuuugua

SEQ ID NO: 2683666 - RNA, 20 nt, Haemophilus influenzae Rd
aauaucagaagaaucuucua

SEQ ID NO: 2683667 - RNA, 22 nt, Haemophilus influenzae Rd
aauaucagcccuuuguuuuaau

SEQ ID NO: 2683668 - RNA, 14 nt, Haemophilus influenzae Rd
aauaucaucuagau

SEQ ID NO: 2683669 - RNA, 20 nt, Haemophilus influenzae Rd
aauaucauggcgaccauucu

SEQ ID NO: 2683670 - RNA, 15 nt, Haemophilus influenzae Rd
aauaucauuagcaua

SEQ ID NO: 2683671 - RNA, 19 nt, Haemophilus influenzae Rd
aauaucauugacuuuuggc

SEQ ID NO: 2683672 - RNA, 12 nt, Haemophilus influenzae Rd
aauaucauuuuu

SEQ ID NO: 2683673 - RNA, 14 nt, Haemophilus influenzae Rd
aauauccaaaaugu

SEQ ID NO: 2683674 - RNA, 20 nt, Haemophilus influenzae Rd
aauauccaagaaguuuucca

SEQ ID NO: 2683675 - RNA, 12 nt, Haemophilus influenzae Rd
aauauccaaugu

SEQ ID NO: 2683676 - RNA, 20 nt, Haemophilus influenzae Rd
aauauccacuucauuaaaac

SEQ ID NO: 2683677 - RNA, 23 nt, Haemophilus influenzae Rd
aauauccacuucauuaaaaccaa

SEQ ID NO: 2683678 - RNA, 17 nt, Haemophilus influenzae Rd
aauaucccuuauuuuag

SEQ ID NO: 2683679 - RNA, 17 nt, Haemophilus influenzae Rd
aauauccguaauauuug

SEQ ID NO: 2683680 - RNA, 17 nt, Haemophilus influenzae Rd
aauauccguuacauauu

SEQ ID NO: 2683681 - RNA, 21 nt, Haemophilus influenzae Rd
aauaucuaaaugacgugcuaa

SEQ ID NO: 2683682 - RNA, 14 nt, Haemophilus influenzae Rd
aauaucuaacauaa

SEQ ID NO: 2683683 - RNA, 14 nt, Haemophilus influenzae Rd
aauaucuaagauuu

SEQ ID NO: 2683684 - RNA, 14 nt, Haemophilus influenzae Rd
aauaucuagcacag

SEQ ID NO: 2683685 - RNA, 14 nt, Haemophilus influenzae Rd
aauaucuaggcuaa

SEQ ID NO: 2683686 - RNA, 13 nt, Haemophilus influenzae Rd
aauaucugcaaaa

SEQ ID NO: 2683687 - RNA, 19 nt, Haemophilus influenzae Rd
aauaucuuccguuuuuuuc

SEQ ID NO: 2683688 - RNA, 14 nt, Haemophilus influenzae Rd
aauaucuucuaaua

SEQ ID NO: 2683689 - RNA, 16 nt, Haemophilus influenzae Rd
aauaucuuugacuaaa

SEQ ID NO: 2683690 - RNA, 16 nt, Haemophilus influenzae Rd
aauaugaaaaaggcgg

SEQ ID NO: 2683691 - RNA, 23 nt, Haemophilus influenzae Rd
aauaugaaucguugaucagcaau

SEQ ID NO: 2683692 - RNA, 20 nt, Haemophilus influenzae Rd
aauaugacgaagacccaauu

SEQ ID NO: 2683693 - RNA, 16 nt, Haemophilus influenzae Rd
aauaugauguggcuuu

SEQ ID NO: 2683694 - RNA, 14 nt, Haemophilus influenzae Rd
aauaugauuaauca

SEQ ID NO: 2683695 - RNA, 14 nt, Haemophilus influenzae Rd
aauaugauuuagaa

SEQ ID NO: 2683696 - RNA, 17 nt, Haemophilus influenzae Rd
aauaugcauucaaauuu

SEQ ID NO: 2683697 - RNA, 15 nt, Haemophilus influenzae Rd
aauaugccaaauaaa

SEQ ID NO: 2683698 - RNA, 17 nt, Haemophilus influenzae Rd
aauaugccuguggaaac

SEQ ID NO: 2683699 - RNA, 19 nt, Haemophilus influenzae Rd
aauaugccuguggaaacua

SEQ ID NO: 2683700 - RNA, 17 nt, Haemophilus influenzae Rd
aauaugcgcuucaucaa

SEQ ID NO: 2683701 - RNA, 17 nt, Haemophilus influenzae Rd
aauaugcguugaugcaa

SEQ ID NO: 2683702 - RNA, 14 nt, Haemophilus influenzae Rd
aauaugcugacaaa

SEQ ID NO: 2683703 - RNA, 18 nt, Haemophilus influenzae Rd
aauauguaauauuuuccc

SEQ ID NO: 2683704 - RNA, 12 nt, Haemophilus influenzae Rd
aauauguucuuu

SEQ ID NO: 2683705 - RNA, 14 nt, Haemophilus influenzae Rd
aauauguucuuugu

SEQ ID NO: 2683706 - RNA, 16 nt, Haemophilus influenzae Rd
aauauguuuaccaccg

SEQ ID NO: 2683707 - RNA, 21 nt, Haemophilus influenzae Rd
aauauuaagcaauugaauaaa

SEQ ID NO: 2683708 - RNA, 13 nt, Haemophilus influenzae Rd
aauauuacgcaua

SEQ ID NO: 2683709 - RNA, 12 nt, Haemophilus influenzae Rd
aauauuaggaau

SEQ ID NO: 2683710 - RNA, 19 nt, Haemophilus influenzae Rd
aauauuaggaauagcaaga

SEQ ID NO: 2683711 - RNA, 20 nt, Haemophilus influenzae Rd
aauauuaguuagcuaaaaaa

SEQ ID NO: 2683712 - RNA, 23 nt, Haemophilus influenzae Rd
aauauuaguuagcuaaaaaaacu

SEQ ID NO: 2683713 - RNA, 19 nt, Haemophilus influenzae Rd
aauauuaucuucaugauuu

SEQ ID NO: 2683714 - RNA, 13 nt, Haemophilus influenzae Rd
aauauuauuaagu

SEQ ID NO: 2683715 - RNA, 22 nt, Haemophilus influenzae Rd
aauauuauuaaguaauacauuu

SEQ ID NO: 2683716 - RNA, 13 nt, Haemophilus influenzae Rd
aauauucaaaaca

SEQ ID NO: 2683717 - RNA, 17 nt, Haemophilus influenzae Rd
aauauucagucgguuua

SEQ ID NO: 2683718 - RNA, 19 nt, Haemophilus influenzae Rd
aauauucgccuaauugcug

SEQ ID NO: 2683719 - RNA, 23 nt, Haemophilus influenzae Rd
aauauucgcuucuuuuaaugggg

SEQ ID NO: 2683720 - RNA, 15 nt, Haemophilus influenzae Rd
aauauucuauuuaua

SEQ ID NO: 2683721 - RNA, 22 nt, Haemophilus influenzae Rd
aauauucugaggauuuuauggc

SEQ ID NO: 2683722 - RNA, 21 nt, Haemophilus influenzae Rd
aauauucugcauuaaauucau

SEQ ID NO: 2683723 - RNA, 17 nt, Haemophilus influenzae Rd
aauauucuucauaaaaa

SEQ ID NO: 2683724 - RNA, 21 nt, Haemophilus influenzae Rd
aauauucuuuuuaaauauuua

SEQ ID NO: 2683725 - RNA, 14 nt, Haemophilus influenzae Rd
aauauugaaaagua

SEQ ID NO: 2683726 - RNA, 21 nt, Haemophilus influenzae Rd
aauauugauuauguaaacuuc

SEQ ID NO: 2683727 - RNA, 15 nt, Haemophilus influenzae Rd
aauauugcaccauaa

SEQ ID NO: 2683728 - RNA, 22 nt, Haemophilus influenzae Rd
aauauugccauaauaaucacaa

SEQ ID NO: 2683729 - RNA, 16 nt, Haemophilus influenzae Rd
aauauugcggacaaua

SEQ ID NO: 2683730 - RNA, 22 nt, Haemophilus influenzae Rd
aauauugcucucccuugcccag

SEQ ID NO: 2683731 - RNA, 19 nt, Haemophilus influenzae Rd
aauauugguagcuaaaaau

SEQ ID NO: 2683732 - RNA, 21 nt, Haemophilus influenzae Rd
aaucauauuucugcaaauaaa

SEQ ID NO: 2683733 - RNA, 13 nt, Haemophilus influenzae Rd
aaucaucagaaua

SEQ ID NO: 2683734 - RNA, 22 nt, Haemophilus influenzae Rd
aaucaucauuuauuaaaaguaa

SEQ ID NO: 2683735 - RNA, 19 nt, Haemophilus influenzae Rd
aaucaucgcgaugacuaaa

SEQ ID NO: 2683736 - RNA, 22 nt, Haemophilus influenzae Rd
aaucaucgcgaugacuaaacaa

SEQ ID NO: 2683737 - RNA, 23 nt, Haemophilus influenzae Rd
aaucaucgcgaugacuaaacaaa

SEQ ID NO: 2683738 - RNA, 23 nt, Haemophilus influenzae Rd
aaucaucuaccacgauaaauccu

SEQ ID NO: 2683739 - RNA, 23 nt, Haemophilus influenzae Rd
aaucaucuucaucugcaucacaa

SEQ ID NO: 2683740 - RNA, 19 nt, Haemophilus influenzae Rd
aaucaugaauaauuuuguu

SEQ ID NO: 2683741 - RNA, 22 nt, Haemophilus influenzae Rd
aaucaugaauaauuuuguuacu

SEQ ID NO: 2683742 - RNA, 13 nt, Haemophilus influenzae Rd
aaucauuaaauaa

SEQ ID NO: 2683743 - RNA, 15 nt, Haemophilus influenzae Rd
aaucauuaacaaauu

SEQ ID NO: 2683744 - RNA, 16 nt, Haemophilus influenzae Rd
aaucauuauauugugc

SEQ ID NO: 2683745 - RNA, 12 nt, Haemophilus influenzae Rd
aaucauugcaag

SEQ ID NO: 2683746 - RNA, 14 nt, Haemophilus influenzae Rd
aaucauugcugcaa

SEQ ID NO: 2683747 - RNA, 17 nt, Haemophilus influenzae Rd
aaucauuucaauguuug

SEQ ID NO: 2683748 - RNA, 20 nt, Haemophilus influenzae Rd
aaucauuugccgccaaaaug

SEQ ID NO: 2683749 - RNA, 21 nt, Haemophilus influenzae Rd
aaucauuugccgccaaaauga

SEQ ID NO: 2683750 - RNA, 24 nt, Haemophilus influenzae Rd
aaucauuugccgccaaaaugagcu

SEQ ID NO: 2683751 - RNA, 13 nt, Haemophilus influenzae Rd
aaucauuuucacc

SEQ ID NO: 2683752 - RNA, 18 nt, Haemophilus influenzae Rd
aaucauuuucaccaauuu

SEQ ID NO: 2683753 - RNA, 22 nt, Haemophilus influenzae Rd
aaucauuuucaccaauuuaucu

SEQ ID NO: 2683754 - RNA, 23 nt, Haemophilus influenzae Rd
aauccaaaacgugucacuuuacu

SEQ ID NO: 2683755 - RNA, 16 nt, Haemophilus influenzae Rd
aauccaaaauuacuuu

SEQ ID NO: 2683756 - RNA, 16 nt, Haemophilus influenzae Rd
aauccaacuaaaccac

SEQ ID NO: 2683757 - RNA, 13 nt, Haemophilus influenzae Rd
aauccaaguuugu

SEQ ID NO: 2683758 - RNA, 15 nt, Haemophilus influenzae Rd
aauccaaucagcaaa

SEQ ID NO: 2683759 - RNA, 18 nt, Haemophilus influenzae Rd
aauccaaugauccccauu

SEQ ID NO: 2683760 - RNA, 14 nt, Haemophilus influenzae Rd
aauccaaugcacuu

SEQ ID NO: 2683761 - RNA, 16 nt, Haemophilus influenzae Rd
aauccacacuuuaaaa

SEQ ID NO: 2683762 - RNA, 23 nt, Haemophilus influenzae Rd
aauccacacuuuaaaaguuuacu

SEQ ID NO: 2683763 - RNA, 17 nt, Haemophilus influenzae Rd
aauccacgccagcuaca

SEQ ID NO: 2683764 - RNA, 18 nt, Haemophilus influenzae Rd
aauccacgccccaacaua

SEQ ID NO: 2683765 - RNA, 14 nt, Haemophilus influenzae Rd
aauccacuaaaaac

SEQ ID NO: 2683766 - RNA, 21 nt, Haemophilus influenzae Rd
aauccacucuuuuaauaaaac

SEQ ID NO: 2683767 - RNA, 20 nt, Haemophilus influenzae Rd
aauccagaacgaacaauuuc

SEQ ID NO: 2683768 - RNA, 23 nt, Haemophilus influenzae Rd
aauccagcaugagcuucaaaauc

SEQ ID NO: 2683769 - RNA, 19 nt, Haemophilus influenzae Rd
aauccagcccguucuuugc

SEQ ID NO: 2683770 - RNA, 21 nt, Haemophilus influenzae Rd
aauccagcuacauucaucaaa

SEQ ID NO: 2683771 - RNA, 17 nt, Haemophilus influenzae Rd
aauccaucaauucuucc

SEQ ID NO: 2683772 - RNA, 15 nt, Haemophilus influenzae Rd
aauccaucauuucuu

SEQ ID NO: 2683773 - RNA, 13 nt, Haemophilus influenzae Rd
aauccaugccaua

SEQ ID NO: 2683774 - RNA, 18 nt, Haemophilus influenzae Rd
aauccauugguggguuca

SEQ ID NO: 2683775 - RNA, 23 nt, Haemophilus influenzae Rd
aauccauuucgucgcuuuucccu

SEQ ID NO: 2683776 - RNA, 13 nt, Haemophilus influenzae Rd
aauccauuuugaa

SEQ ID NO: 2683777 - RNA, 13 nt, Haemophilus influenzae Rd
aauccauuuuuaa

SEQ ID NO: 2683778 - RNA, 21 nt, Haemophilus influenzae Rd
aaucccauagcggauaaccaa

SEQ ID NO: 2683779 - RNA, 23 nt, Haemophilus influenzae Rd
aaucccauagcggauaaccaaaa

SEQ ID NO: 2683780 - RNA, 17 nt, Haemophilus influenzae Rd
aaucccauuucaucuuc

SEQ ID NO: 2683781 - RNA, 16 nt, Haemophilus influenzae Rd
aauccccccauuacaa

SEQ ID NO: 2683782 - RNA, 14 nt, Haemophilus influenzae Rd
aauccccuuucuuc

SEQ ID NO: 2683783 - RNA, 14 nt, Haemophilus influenzae Rd
aaucccgauuaaga

SEQ ID NO: 2683784 - RNA, 14 nt, Haemophilus influenzae Rd
aaucccuauaaugc

SEQ ID NO: 2683785 - RNA, 19 nt, Haemophilus influenzae Rd
aaucccuuauguuaugaag

SEQ ID NO: 2683786 - RNA, 15 nt, Haemophilus influenzae Rd
aauccgaaauuaaau

SEQ ID NO: 2683787 - RNA, 23 nt, Haemophilus influenzae Rd
aauccgcacgcgugaugaaacaa

SEQ ID NO: 2683788 - RNA, 14 nt, Haemophilus influenzae Rd
aauccgcugcagcu

SEQ ID NO: 2683789 - RNA, 16 nt, Haemophilus influenzae Rd
aauccguuaaauuuag

SEQ ID NO: 2683790 - RNA, 18 nt, Haemophilus influenzae Rd
aauccguuggucgaaggu

SEQ ID NO: 2683791 - RNA, 16 nt, Haemophilus influenzae Rd
aauccuaagaauccca

SEQ ID NO: 2683792 - RNA, 13 nt, Haemophilus influenzae Rd
aauccuagaguaa

SEQ ID NO: 2683793 - RNA, 16 nt, Haemophilus influenzae Rd
aauccuagaguaagua

SEQ ID NO: 2683794 - RNA, 23 nt, Haemophilus influenzae Rd
aauccuagaguaaguaaccauaa

SEQ ID NO: 2683795 - RNA, 12 nt, Haemophilus influenzae Rd
aauccugaagau

SEQ ID NO: 2683796 - RNA, 16 nt, Haemophilus influenzae Rd
aauccugcauuuucuu

SEQ ID NO: 2683797 - RNA, 21 nt, Haemophilus influenzae Rd
aauccugcgggucuuguucca

SEQ ID NO: 2683798 - RNA, 17 nt, Haemophilus influenzae Rd
aauccugcgugaaugac

SEQ ID NO: 2683799 - RNA, 17 nt, Haemophilus influenzae Rd
aauccugcuugaauauc

SEQ ID NO: 2683800 - RNA, 19 nt, Haemophilus influenzae Rd
aauccugguauuuacaagu

SEQ ID NO: 2683801 - RNA, 15 nt, Haemophilus influenzae Rd
aauccuuccaaaucc

SEQ ID NO: 2683802 - RNA, 22 nt, Haemophilus influenzae Rd
aauccuucgccgccauuuggca

SEQ ID NO: 2683803 - RNA, 12 nt, Haemophilus influenzae Rd
aauccuucuucg

SEQ ID NO: 2683804 - RNA, 22 nt, Haemophilus influenzae Rd
aauccuugcgauguuauuuguu

SEQ ID NO: 2683805 - RNA, 22 nt, Haemophilus influenzae Rd
aauccuuuuguuuuaucagaau

SEQ ID NO: 2683806 - RNA, 15 nt, Haemophilus influenzae Rd
aaucgaaauuaaaau

SEQ ID NO: 2683807 - RNA, 18 nt, Haemophilus influenzae Rd
aaucgaucacuuaauaaa

SEQ ID NO: 2683808 - RNA, 20 nt, Haemophilus influenzae Rd
aaucgaucacuuaauaaaaa

SEQ ID NO: 2683809 - RNA, 18 nt, Haemophilus influenzae Rd
aaucgcaaagaauuugcc

SEQ ID NO: 2683810 - RNA, 12 nt, Haemophilus influenzae Rd
aaucgcaauaaa

SEQ ID NO: 2683811 - RNA, 20 nt, Haemophilus influenzae Rd
aaucgcacucacaauaccaa

SEQ ID NO: 2683812 - RNA, 14 nt, Haemophilus influenzae Rd
aaucgcauugcguu

SEQ ID NO: 2683813 - RNA, 19 nt, Haemophilus influenzae Rd
aaucgccaaaaucaucaca

SEQ ID NO: 2683814 - RNA, 18 nt, Haemophilus influenzae Rd
aaucgcccacgaaaagca

SEQ ID NO: 2683815 - RNA, 19 nt, Haemophilus influenzae Rd
aaucgcccacgaaaagcac

SEQ ID NO: 2683816 - RNA, 16 nt, Haemophilus influenzae Rd
aaucgcccuauuaaaa

SEQ ID NO: 2683817 - RNA, 23 nt, Haemophilus influenzae Rd
aaucgcccuuuuguuauuaaaua

SEQ ID NO: 2683818 - RNA, 23 nt, Haemophilus influenzae Rd
aaucgcugggauuuugucaccaa

SEQ ID NO: 2683819 - RNA, 14 nt, Haemophilus influenzae Rd
aaucgcuucauucu

SEQ ID NO: 2683820 - RNA, 16 nt, Haemophilus influenzae Rd
aaucgcuugcgguuca

SEQ ID NO: 2683821 - RNA, 19 nt, Haemophilus influenzae Rd
aaucgcuugugcagaauau

SEQ ID NO: 2683822 - RNA, 15 nt, Haemophilus influenzae Rd
aaucggauguuugaa

SEQ ID NO: 2683823 - RNA, 16 nt, Haemophilus influenzae Rd
aaucggcaauucugcu

SEQ ID NO: 2683824 - RNA, 19 nt, Haemophilus influenzae Rd
aaucgggcguucuuuaaua

SEQ ID NO: 2683825 - RNA, 18 nt, Haemophilus influenzae Rd
aaucgguagacacaaggg

SEQ ID NO: 2683826 - RNA, 20 nt, Haemophilus influenzae Rd
aaucgguuucacaaaacgca

SEQ ID NO: 2683827 - RNA, 20 nt, Haemophilus influenzae Rd
aaucguauucucauuuuaga

SEQ ID NO: 2683828 - RNA, 14 nt, Haemophilus influenzae Rd
aaucgucaaaauca

SEQ ID NO: 2683829 - RNA, 22 nt, Haemophilus influenzae Rd
aaucguccaaagaaguuuucca

SEQ ID NO: 2683830 - RNA, 23 nt, Haemophilus influenzae Rd
aaucgugaguuugugcaagcaca

SEQ ID NO: 2683831 - RNA, 23 nt, Haemophilus influenzae Rd
aaucguugaucagcaaucaacac

SEQ ID NO: 2683832 - RNA, 16 nt, Haemophilus influenzae Rd
aaucguuuguaaaagu

SEQ ID NO: 2683833 - RNA, 14 nt, Haemophilus influenzae Rd
aaucguuugucgua

SEQ ID NO: 2683834 - RNA, 16 nt, Haemophilus influenzae Rd
aaucguuugucguaau

SEQ ID NO: 2683835 - RNA, 13 nt, Haemophilus influenzae Rd
aaucguuuguucu

SEQ ID NO: 2683836 - RNA, 12 nt, Haemophilus influenzae Rd
aaucuaaaaaac

SEQ ID NO: 2683837 - RNA, 16 nt, Haemophilus influenzae Rd
aaugacgagugagaua

SEQ ID NO: 2683838 - RNA, 17 nt, Haemophilus influenzae Rd
aaugacguaauuugugc

SEQ ID NO: 2683839 - RNA, 21 nt, Haemophilus influenzae Rd
aaugacuuucacuacagguug

SEQ ID NO: 2683840 - RNA, 17 nt, Haemophilus influenzae Rd
aaugagaaaaagucgcu

SEQ ID NO: 2683841 - RNA, 18 nt, Haemophilus influenzae Rd
aaugagacuuaaccaaau

SEQ ID NO: 2683842 - RNA, 20 nt, Haemophilus influenzae Rd
aaugagacuuaaccaaauag

SEQ ID NO: 2683843 - RNA, 14 nt, Haemophilus influenzae Rd
aaugagauuauuuc

SEQ ID NO: 2683844 - RNA, 15 nt, Haemophilus influenzae Rd
aaugagauuauuucu

SEQ ID NO: 2683845 - RNA, 21 nt, Haemophilus influenzae Rd
aaugagcacgccuaauaccaa

SEQ ID NO: 2683846 - RNA, 19 nt, Haemophilus influenzae Rd
aaugaguguuauugaugaa

SEQ ID NO: 2683847 - RNA, 22 nt, Haemophilus influenzae Rd
aaugaguguuauugaugaagau

SEQ ID NO: 2683848 - RNA, 13 nt, Haemophilus influenzae Rd
aaugauaaaaauc

SEQ ID NO: 2683849 - RNA, 11 nt, Haemophilus influenzae Rd
aaugauaaauu

SEQ ID NO: 2683850 - RNA, 19 nt, Haemophilus influenzae Rd
aaugauaaauuuuauucca

SEQ ID NO: 2683851 - RNA, 23 nt, Haemophilus influenzae Rd
aaugauaaccuugcgcugcuuua

SEQ ID NO: 2683852 - RNA, 15 nt, Haemophilus influenzae Rd
aaugauaccuuguua

SEQ ID NO: 2683853 - RNA, 22 nt, Haemophilus influenzae Rd
aaugaucaaaucaaauuuuccu

SEQ ID NO: 2683854 - RNA, 16 nt, Haemophilus influenzae Rd
aaugaucagcuaaacg

SEQ ID NO: 2683855 - RNA, 20 nt, Haemophilus influenzae Rd
aaugaucagcuaaacgcacu

SEQ ID NO: 2683856 - RNA, 17 nt, Haemophilus influenzae Rd
aaugaucgaguaaaaau

SEQ ID NO: 2683857 - RNA, 22 nt, Haemophilus influenzae Rd
aaugaugaaacaagcuguagca

SEQ ID NO: 2683858 - RNA, 20 nt, Haemophilus influenzae Rd
aaugaugaguagauuuuuau

SEQ ID NO: 2683859 - RNA, 17 nt, Haemophilus influenzae Rd
aaugauguaggcaaaaa

SEQ ID NO: 2683860 - RNA, 20 nt, Haemophilus influenzae Rd
aaugauguaggcaaaaacac

SEQ ID NO: 2683861 - RNA, 21 nt, Haemophilus influenzae Rd
aaugauguaggcaaaaacacu

SEQ ID NO: 2683862 - RNA, 12 nt, Haemophilus influenzae Rd
aaugauuaauau

SEQ ID NO: 2683863 - RNA, 14 nt, Haemophilus influenzae Rd
aaugauuaauuaaa

SEQ ID NO: 2683864 - RNA, 16 nt, Haemophilus influenzae Rd
aaugauuaauuaaauu

SEQ ID NO: 2683865 - RNA, 16 nt, Haemophilus influenzae Rd
aaugauuagaaguaaa

SEQ ID NO: 2683866 - RNA, 20 nt, Haemophilus influenzae Rd
aaugauugagcgauagaaau

SEQ ID NO: 2683867 - RNA, 23 nt, Haemophilus influenzae Rd
aaugauugagcgauagaaauaaa

SEQ ID NO: 2683868 - RNA, 20 nt, Haemophilus influenzae Rd
aaugauuuuuucagguuggu

SEQ ID NO: 2683869 - RNA, 15 nt, Haemophilus influenzae Rd
aaugcaaaaucuuua

SEQ ID NO: 2683870 - RNA, 18 nt, Haemophilus influenzae Rd
aaugcaaaaucuuuacga

SEQ ID NO: 2683871 - RNA, 14 nt, Haemophilus influenzae Rd
aaugcaaauacaag

SEQ ID NO: 2683872 - RNA, 19 nt, Haemophilus influenzae Rd
aaugcaacaauaacugcca

SEQ ID NO: 2683873 - RNA, 16 nt, Haemophilus influenzae Rd
aaugcaaccaaacaaa

SEQ ID NO: 2683874 - RNA, 14 nt, Haemophilus influenzae Rd
aaugcaaguuugau

SEQ ID NO: 2683875 - RNA, 23 nt, Haemophilus influenzae Rd
aaugcaauauuauucagcacuuu

SEQ ID NO: 2683876 - RNA, 16 nt, Haemophilus influenzae Rd
aaugcaauauucaccc

SEQ ID NO: 2683877 - RNA, 13 nt, Haemophilus influenzae Rd
aaugcacauaaca

SEQ ID NO: 2683878 - RNA, 19 nt, Haemophilus influenzae Rd
aaugcaccaaaaauccuca

SEQ ID NO: 2683879 - RNA, 17 nt, Haemophilus influenzae Rd
aaugcaccgcacacaac

SEQ ID NO: 2683880 - RNA, 19 nt, Haemophilus influenzae Rd
aaugcagccaucaauaaaa

SEQ ID NO: 2683881 - RNA, 20 nt, Haemophilus influenzae Rd
aaugcagccaucaauaaaaa

SEQ ID NO: 2683882 - RNA, 15 nt, Haemophilus influenzae Rd
aaugcaggcaacuca

SEQ ID NO: 2683883 - RNA, 15 nt, Haemophilus influenzae Rd
aaugcaguaacgcga

SEQ ID NO: 2683884 - RNA, 19 nt, Haemophilus influenzae Rd
aaugcaguaacgcgauaaa

SEQ ID NO: 2683885 - RNA, 20 nt, Haemophilus influenzae Rd
aaugcaguaacgcgauaaau

SEQ ID NO: 2683886 - RNA, 21 nt, Haemophilus influenzae Rd
aaugcaguaacuucugcugca

SEQ ID NO: 2683887 - RNA, 16 nt, Haemophilus influenzae Rd
aaugcaguaauaaauc

SEQ ID NO: 2683888 - RNA, 21 nt, Haemophilus influenzae Rd
aaugcaguagguauguuuagu

SEQ ID NO: 2683889 - RNA, 19 nt, Haemophilus influenzae Rd
aaugcaguauaaaccgcau

SEQ ID NO: 2683890 - RNA, 18 nt, Haemophilus influenzae Rd
aaugcaucauuaauacac

SEQ ID NO: 2683891 - RNA, 18 nt, Haemophilus influenzae Rd
aaugcauugaugacugca

SEQ ID NO: 2683892 - RNA, 20 nt, Haemophilus influenzae Rd
aaugcauugaugacugcauc

SEQ ID NO: 2683893 - RNA, 16 nt, Haemophilus influenzae Rd
aaugcauugauugcua

SEQ ID NO: 2683894 - RNA, 21 nt, Haemophilus influenzae Rd
aaugccaccgcgaucuguuuu

SEQ ID NO: 2683895 - RNA, 20 nt, Haemophilus influenzae Rd
aaugccaucaccaagaauca

SEQ ID NO: 2683896 - RNA, 16 nt, Haemophilus influenzae Rd
aaugccauuaaacuuc

SEQ ID NO: 2683897 - RNA, 13 nt, Haemophilus influenzae Rd
aaugccauuugcu

SEQ ID NO: 2683898 - RNA, 22 nt, Haemophilus influenzae Rd
aaugccccagcaagaagcauga

SEQ ID NO: 2683899 - RNA, 20 nt, Haemophilus influenzae Rd
aaugccgcaaaaccuaacau

SEQ ID NO: 2683900 - RNA, 21 nt, Haemophilus influenzae Rd
aaugccuugugcauaaacaaa

SEQ ID NO: 2683901 - RNA, 20 nt, Haemophilus influenzae Rd
aaugccuuuccguucauaaa

SEQ ID NO: 2683902 - RNA, 15 nt, Haemophilus influenzae Rd
aaugcgcugauuuuu

SEQ ID NO: 2683903 - RNA, 23 nt, Haemophilus influenzae Rd
aaugcggcaaugguuaauacaaa

SEQ ID NO: 2683904 - RNA, 19 nt, Haemophilus influenzae Rd
aaugcgucgcagccuuguu

SEQ ID NO: 2683905 - RNA, 21 nt, Haemophilus influenzae Rd
aaugcgucgcagccuuguucu

SEQ ID NO: 2683906 - RNA, 23 nt, Haemophilus influenzae Rd
aaugcgugguuacgaaaaguuga

SEQ ID NO: 2683907 - RNA, 23 nt, Haemophilus influenzae Rd
aaugcguucacgacgaagcgcau

SEQ ID NO: 2683908 - RNA, 15 nt, Haemophilus influenzae Rd
aaugcguucagaauu

SEQ ID NO: 2683909 - RNA, 13 nt, Haemophilus influenzae Rd
aaugcuaaaccaa

SEQ ID NO: 2683910 - RNA, 16 nt, Haemophilus influenzae Rd
aaugcucgaauauaag

SEQ ID NO: 2683911 - RNA, 22 nt, Haemophilus influenzae Rd
aaugcucgcacuuggcgaacau

SEQ ID NO: 2683912 - RNA, 23 nt, Haemophilus influenzae Rd
aaugcucgcacuuggcgaacauu

SEQ ID NO: 2683913 - RNA, 16 nt, Haemophilus influenzae Rd
aaugcucuaaaucccc

SEQ ID NO: 2683914 - RNA, 13 nt, Haemophilus influenzae Rd
aaugcuguagaaa

SEQ ID NO: 2683915 - RNA, 23 nt, Haemophilus influenzae Rd
aaugcuguuuaaaucuaagccuu

SEQ ID NO: 2683916 - RNA, 15 nt, Haemophilus influenzae Rd
aaugcuugguuuuau

SEQ ID NO: 2683917 - RNA, 18 nt, Haemophilus influenzae Rd
aaugcuugguuuuauauu

SEQ ID NO: 2683918 - RNA, 16 nt, Haemophilus influenzae Rd
aaugcuuguucugauu

SEQ ID NO: 2683919 - RNA, 15 nt, Haemophilus influenzae Rd
aaugcuuuaauuugu

SEQ ID NO: 2683920 - RNA, 17 nt, Haemophilus influenzae Rd
aaugcuuuauuuaaauu

SEQ ID NO: 2683921 - RNA, 15 nt, Haemophilus influenzae Rd
aaugcuuuugcuuca

SEQ ID NO: 2683922 - RNA, 16 nt, Haemophilus influenzae Rd
aaugcuuuugcuucaa

SEQ ID NO: 2683923 - RNA, 13 nt, Haemophilus influenzae Rd
aauggaaaccauu

SEQ ID NO: 2683924 - RNA, 14 nt, Haemophilus influenzae Rd
aauggaauauggcg

SEQ ID NO: 2683925 - RNA, 17 nt, Haemophilus influenzae Rd
aauggaauguagauaau

SEQ ID NO: 2683926 - RNA, 21 nt, Haemophilus influenzae Rd
aauggaggauuagaaaugauc

SEQ ID NO: 2683927 - RNA, 23 nt, Haemophilus influenzae Rd
aauggagguuuuacauauaaaga

SEQ ID NO: 2683928 - RNA, 21 nt, Haemophilus influenzae Rd
aauggauaaaccguacaaacc

SEQ ID NO: 2683929 - RNA, 13 nt, Haemophilus influenzae Rd
aauggauuauaaa

SEQ ID NO: 2683930 - RNA, 15 nt, Haemophilus influenzae Rd
aauggcaaacaaaau

SEQ ID NO: 2683931 - RNA, 17 nt, Haemophilus influenzae Rd
aauggcaaacaaaauaa

SEQ ID NO: 2683932 - RNA, 19 nt, Haemophilus influenzae Rd
aauggcaacgccaauaaaa

SEQ ID NO: 2683933 - RNA, 13 nt, Haemophilus influenzae Rd
aauggcaaucaca

SEQ ID NO: 2683934 - RNA, 20 nt, Haemophilus influenzae Rd
aauggcaauuuuauauucau

SEQ ID NO: 2683935 - RNA, 21 nt, Haemophilus influenzae Rd
aauggcaucaauauuaugugc

SEQ ID NO: 2683936 - RNA, 21 nt, Haemophilus influenzae Rd
aauggcgaauuucacgcccaa

SEQ ID NO: 2683937 - RNA, 22 nt, Haemophilus influenzae Rd
aauggcgauaauuauugaguag

SEQ ID NO: 2683938 - RNA, 18 nt, Haemophilus influenzae Rd
aauggcggcggaauucau

SEQ ID NO: 2683939 - RNA, 20 nt, Haemophilus influenzae Rd
aauggcgguaaaaaaguaac

SEQ ID NO: 2683940 - RNA, 16 nt, Haemophilus influenzae Rd
aauggcuaucugcuuu

SEQ ID NO: 2683941 - RNA, 22 nt, Haemophilus influenzae Rd
aauuaaucugcauucuaaaagu

SEQ ID NO: 2683942 - RNA, 23 nt, Haemophilus influenzae Rd
aauuaaucuuuuuucuuucuagu

SEQ ID NO: 2683943 - RNA, 18 nt, Haemophilus influenzae Rd
aauuaaugcuaaaccaau

SEQ ID NO: 2683944 - RNA, 20 nt, Haemophilus influenzae Rd
aauuaauggcaauucgugaa

SEQ ID NO: 2683945 - RNA, 16 nt, Haemophilus influenzae Rd
aauuaaugggcuaguu

SEQ ID NO: 2683946 - RNA, 19 nt, Haemophilus influenzae Rd
aauuaaugucgcauuugua

SEQ ID NO: 2683947 - RNA, 18 nt, Haemophilus influenzae Rd
aauuaauucucauacaaa

SEQ ID NO: 2683948 - RNA, 13 nt, Haemophilus influenzae Rd
aauuaauugcucu

SEQ ID NO: 2683949 - RNA, 13 nt, Haemophilus influenzae Rd
aauuacaaaacca

SEQ ID NO: 2683950 - RNA, 15 nt, Haemophilus influenzae Rd
aauuacaaaaccaau

SEQ ID NO: 2683951 - RNA, 16 nt, Haemophilus influenzae Rd
aauuacaaaaccaauc

SEQ ID NO: 2683952 - RNA, 20 nt, Haemophilus influenzae Rd
aauuacauucccaaauaaua

SEQ ID NO: 2683953 - RNA, 22 nt, Haemophilus influenzae Rd
aauuaccacaucauuauugccu

SEQ ID NO: 2683954 - RNA, 17 nt, Haemophilus influenzae Rd
aauuacccaaaugauga

SEQ ID NO: 2683955 - RNA, 16 nt, Haemophilus influenzae Rd
aauuaccgcacuuuaa

SEQ ID NO: 2683956 - RNA, 20 nt, Haemophilus influenzae Rd
aauuaccgcacuuuagguuu

SEQ ID NO: 2683957 - RNA, 17 nt, Haemophilus influenzae Rd
aauuaccgcacuuuuua

SEQ ID NO: 2683958 - RNA, 14 nt, Haemophilus influenzae Rd
aauuaccugccaaa

SEQ ID NO: 2683959 - RNA, 17 nt, Haemophilus influenzae Rd
aauuacgacauucuuua

SEQ ID NO: 2683960 - RNA, 12 nt, Haemophilus influenzae Rd
aauuacgccuaa

SEQ ID NO: 2683961 - RNA, 16 nt, Haemophilus influenzae Rd
aauuacgccuaaccaa

SEQ ID NO: 2683962 - RNA, 16 nt, Haemophilus influenzae Rd
aauuacgccugcaaau

SEQ ID NO: 2683963 - RNA, 18 nt, Haemophilus influenzae Rd
aauuacgccugcccaagu

SEQ ID NO: 2683964 - RNA, 22 nt, Haemophilus influenzae Rd
aauuacuaaugccgcaaaaccu

SEQ ID NO: 2683965 - RNA, 14 nt, Haemophilus influenzae Rd
aauuacuauauagu

SEQ ID NO: 2683966 - RNA, 19 nt, Haemophilus influenzae Rd
aauuacuggcguagcugca

SEQ ID NO: 2683967 - RNA, 22 nt, Haemophilus influenzae Rd
aauuacuggcguagcugcaggg

SEQ ID NO: 2683968 - RNA, 19 nt, Haemophilus influenzae Rd
aauuacuucuuacaacaaa

SEQ ID NO: 2683969 - RNA, 13 nt, Haemophilus influenzae Rd
aauuacuuuuaua

SEQ ID NO: 2683970 - RNA, 17 nt, Haemophilus influenzae Rd
aauuacuuuuauaucua

SEQ ID NO: 2683971 - RNA, 14 nt, Haemophilus influenzae Rd
aauuagaauaacaa

SEQ ID NO: 2683972 - RNA, 20 nt, Haemophilus influenzae Rd
aauuagaauaacaacaaaag

SEQ ID NO: 2683973 - RNA, 11 nt, Haemophilus influenzae Rd
aauuagaauuu

SEQ ID NO: 2683974 - RNA, 16 nt, Haemophilus influenzae Rd
aauuagagagaaaaau

SEQ ID NO: 2683975 - RNA, 21 nt, Haemophilus influenzae Rd
aauuagauaauacagaaauau

SEQ ID NO: 2683976 - RNA, 14 nt, Haemophilus influenzae Rd
aauuagaugauuuu

SEQ ID NO: 2683977 - RNA, 17 nt, Haemophilus influenzae Rd
aauuagaugauuuuaaa

SEQ ID NO: 2683978 - RNA, 19 nt, Haemophilus influenzae Rd
aauuagaugauuuuaaaau

SEQ ID NO: 2683979 - RNA, 22 nt, Haemophilus influenzae Rd
aauuagaugauuuuaaaauaaa

SEQ ID NO: 2683980 - RNA, 23 nt, Haemophilus influenzae Rd
aauuagaugauuuuaaaauaaau

SEQ ID NO: 2683981 - RNA, 19 nt, Haemophilus influenzae Rd
aauuagaugauuuuaaagu

SEQ ID NO: 2683982 - RNA, 21 nt, Haemophilus influenzae Rd
aauuagauuucuguuaaaucu

SEQ ID NO: 2683983 - RNA, 22 nt, Haemophilus influenzae Rd
aauuagauuucuguuaaaucua

SEQ ID NO: 2683984 - RNA, 22 nt, Haemophilus influenzae Rd
aauuagccuuucuggcucugcu

SEQ ID NO: 2683985 - RNA, 15 nt, Haemophilus influenzae Rd
aauuagcuaaauacu

SEQ ID NO: 2683986 - RNA, 18 nt, Haemophilus influenzae Rd
aauuagcugguuuauuua

SEQ ID NO: 2683987 - RNA, 15 nt, Haemophilus influenzae Rd
aauuagcuuaauaaa

SEQ ID NO: 2683988 - RNA, 19 nt, Haemophilus influenzae Rd
aauuaggcgaugaucauaa

SEQ ID NO: 2683989 - RNA, 19 nt, Haemophilus influenzae Rd
aauuagguugaauuuuugu

SEQ ID NO: 2683990 - RNA, 14 nt, Haemophilus influenzae Rd
aauuagguuuugua

SEQ ID NO: 2683991 - RNA, 22 nt, Haemophilus influenzae Rd
aauuaguaguuagaauuuuaac

SEQ ID NO: 2683992 - RNA, 21 nt, Haemophilus influenzae Rd
aauuaguuggacuacauaacc

SEQ ID NO: 2683993 - RNA, 18 nt, Haemophilus influenzae Rd
aauuaguuuuuuauuucu

SEQ ID NO: 2683994 - RNA, 18 nt, Haemophilus influenzae Rd
aauuauaaaccaguuaaa

SEQ ID NO: 2683995 - RNA, 19 nt, Haemophilus influenzae Rd
aauuauaaaccaguuaaau

SEQ ID NO: 2683996 - RNA, 13 nt, Haemophilus influenzae Rd
aauuauagaaaag

SEQ ID NO: 2683997 - RNA, 14 nt, Haemophilus influenzae Rd
aauuauagagaaau

SEQ ID NO: 2683998 - RNA, 17 nt, Haemophilus influenzae Rd
aauuauagagaaauaau

SEQ ID NO: 2683999 - RNA, 20 nt, Haemophilus influenzae Rd
aauuauagauaaauaucaaa

SEQ ID NO: 2684000 - RNA, 23 nt, Haemophilus influenzae Rd
aauuauagauaaauaucaaaauu

SEQ ID NO: 2684001 - RNA, 16 nt, Haemophilus influenzae Rd
aauuauaggcuauaaa

SEQ ID NO: 2684002 - RNA, 18 nt, Haemophilus influenzae Rd
aauuauaggcuauaaaga

SEQ ID NO: 2684003 - RNA, 14 nt, Haemophilus influenzae Rd
aauuauauuuuccu

SEQ ID NO: 2684004 - RNA, 17 nt, Haemophilus influenzae Rd
aauuaucaaaaagaaau

SEQ ID NO: 2684005 - RNA, 23 nt, Haemophilus influenzae Rd
aauuaucaaaagaaaagaugaau

SEQ ID NO: 2684006 - RNA, 19 nt, Haemophilus influenzae Rd
aauuaucaaagaauuuuuu

SEQ ID NO: 2684007 - RNA, 17 nt, Haemophilus influenzae Rd
aauuaucaacaucaacu

SEQ ID NO: 2684008 - RNA, 15 nt, Haemophilus influenzae Rd
aauuaucaauguuug

SEQ ID NO: 2684009 - RNA, 23 nt, Haemophilus influenzae Rd
aauuaucaucgcguuuauuuuua

SEQ ID NO: 2684010 - RNA, 16 nt, Haemophilus influenzae Rd
aauuauccgagagaaa

SEQ ID NO: 2684011 - RNA, 17 nt, Haemophilus influenzae Rd
aauuauccgagagaaag

SEQ ID NO: 2684012 - RNA, 21 nt, Haemophilus influenzae Rd
aauuaucguuuacuuaaaauc

SEQ ID NO: 2684013 - RNA, 23 nt, Haemophilus influenzae Rd
aauuauggguguuuaaauuuuua

SEQ ID NO: 2684014 - RNA, 15 nt, Haemophilus influenzae Rd
aauuauggugaauaa

SEQ ID NO: 2684015 - RNA, 14 nt, Haemophilus influenzae Rd
aauuauguauuuua

SEQ ID NO: 2684016 - RNA, 19 nt, Haemophilus influenzae Rd
aauuauguauuuucuuuaa

SEQ ID NO: 2684017 - RNA, 21 nt, Haemophilus influenzae Rd
aauuauguuuuaucuuuaccc

SEQ ID NO: 2684018 - RNA, 12 nt, Haemophilus influenzae Rd
aauuauucuuca

SEQ ID NO: 2684019 - RNA, 17 nt, Haemophilus influenzae Rd
aauuauugcauuuuuaa

SEQ ID NO: 2684020 - RNA, 18 nt, Haemophilus influenzae Rd
aauuauugcuuaugauuu

SEQ ID NO: 2684021 - RNA, 13 nt, Haemophilus influenzae Rd
aauuauuggauug

SEQ ID NO: 2684022 - RNA, 15 nt, Haemophilus influenzae Rd
aauuauugucuuuuc

SEQ ID NO: 2684023 - RNA, 22 nt, Haemophilus influenzae Rd
aauuauuuaaacuugaauaaua

SEQ ID NO: 2684024 - RNA, 13 nt, Haemophilus influenzae Rd
aauuauuuaaauc

SEQ ID NO: 2684025 - RNA, 15 nt, Haemophilus influenzae Rd
aauuauuuauacuaa

SEQ ID NO: 2684026 - RNA, 17 nt, Haemophilus influenzae Rd
aauuauuucaguaacuu

SEQ ID NO: 2684027 - RNA, 15 nt, Haemophilus influenzae Rd
aauuauuugacuuau

SEQ ID NO: 2684028 - RNA, 12 nt, Haemophilus influenzae Rd
aauucaaacaau

SEQ ID NO: 2684029 - RNA, 13 nt, Haemophilus influenzae Rd
aauucaaagcgau

SEQ ID NO: 2684030 - RNA, 23 nt, Haemophilus influenzae Rd
aauucaaagcgaugacguuguuc

SEQ ID NO: 2684031 - RNA, 17 nt, Haemophilus influenzae Rd
aauucaaaucuugacau

SEQ ID NO: 2684032 - RNA, 20 nt, Haemophilus influenzae Rd
aauucaaaucuugacauaau

SEQ ID NO: 2684033 - RNA, 17 nt, Haemophilus influenzae Rd
aauucaaccgcacuuua

SEQ ID NO: 2684034 - RNA, 14 nt, Haemophilus influenzae Rd
aauucaagaugaua

SEQ ID NO: 2684035 - RNA, 18 nt, Haemophilus influenzae Rd
aauucaagcaaauauuua

SEQ ID NO: 2684036 - RNA, 19 nt, Haemophilus influenzae Rd
aauucaagcaaauauuuag

SEQ ID NO: 2684037 - RNA, 17 nt, Haemophilus influenzae Rd
aauucaaugaaaugccc

SEQ ID NO: 2684038 - RNA, 21 nt, Haemophilus influenzae Rd
aauucaauggcuuauugcuau

SEQ ID NO: 2684039 - RNA, 14 nt, Haemophilus influenzae Rd
aauucaauuuuccc

SEQ ID NO: 2684040 - RNA, 23 nt, Haemophilus influenzae Rd
aauucaccgcacuuuuuacuuuu

SEQ ID NO: 2684041 - RNA, 12 nt, Haemophilus influenzae Rd
aauucacgaaug

SEQ ID NO: 2684042 - RNA, 16 nt, Haemophilus influenzae Rd
aauucacgaauguuuu

SEQ ID NO: 2684043 - RNA, 22 nt, Haemophilus influenzae Rd
aauucacgcauuuaaauaaaau

SEQ ID NO: 2684044 - RNA, 23 nt, Haemophilus influenzae Rd
aauucacuaccucgaauagcaau

SEQ ID NO: 2684045 - RNA, 18 nt, Haemophilus influenzae Rd
aauucacuacgauuuaau

SEQ ID NO: 2684046 - RNA, 19 nt, Haemophilus influenzae Rd
aauugauggcgugaaauau

SEQ ID NO: 2684047 - RNA, 20 nt, Haemophilus influenzae Rd
aauugauguaaaagauaaaa

SEQ ID NO: 2684048 - RNA, 21 nt, Haemophilus influenzae Rd
aauugauucauuugaugguaa

SEQ ID NO: 2684049 - RNA, 17 nt, Haemophilus influenzae Rd
aauugauuccgauuuua

SEQ ID NO: 2684050 - RNA, 22 nt, Haemophilus influenzae Rd
aauugauuccgauuuuacgauu

SEQ ID NO: 2684051 - RNA, 14 nt, Haemophilus influenzae Rd
aauugauuuaaaaa

SEQ ID NO: 2684052 - RNA, 15 nt, Haemophilus influenzae Rd
aauugauuuaaaaau

SEQ ID NO: 2684053 - RNA, 14 nt, Haemophilus influenzae Rd
aauugauuuuaaag

SEQ ID NO: 2684054 - RNA, 22 nt, Haemophilus influenzae Rd
aauugauuuuaaagaauguuug

SEQ ID NO: 2684055 - RNA, 16 nt, Haemophilus influenzae Rd
aauugauuuucagaaa

SEQ ID NO: 2684056 - RNA, 17 nt, Haemophilus influenzae Rd
aauugauuuucagaaag

SEQ ID NO: 2684057 - RNA, 13 nt, Haemophilus influenzae Rd
aauugauuuuuca

SEQ ID NO: 2684058 - RNA, 14 nt, Haemophilus influenzae Rd
aauugcaauaacca

SEQ ID NO: 2684059 - RNA, 16 nt, Haemophilus influenzae Rd
aauugcaccuucuuuu

SEQ ID NO: 2684060 - RNA, 17 nt, Haemophilus influenzae Rd
aauugcauuuucuucca

SEQ ID NO: 2684061 - RNA, 20 nt, Haemophilus influenzae Rd
aauugcauuuucuuccaaug

SEQ ID NO: 2684062 - RNA, 18 nt, Haemophilus influenzae Rd
aauugcccaauaaaagua

SEQ ID NO: 2684063 - RNA, 15 nt, Haemophilus influenzae Rd
aauugcucugacacu

SEQ ID NO: 2684064 - RNA, 21 nt, Haemophilus influenzae Rd
aauugcucugacacuucucgc

SEQ ID NO: 2684065 - RNA, 14 nt, Haemophilus influenzae Rd
aauugcuggauuca

SEQ ID NO: 2684066 - RNA, 21 nt, Haemophilus influenzae Rd
aauugcuggcuugccaauuca

SEQ ID NO: 2684067 - RNA, 19 nt, Haemophilus influenzae Rd
aauugcugggcaauauaaa

SEQ ID NO: 2684068 - RNA, 22 nt, Haemophilus influenzae Rd
aauugcuuuaauuucuuuuccu

SEQ ID NO: 2684069 - RNA, 18 nt, Haemophilus influenzae Rd
aauugcuuuguuaauuca

SEQ ID NO: 2684070 - RNA, 13 nt, Haemophilus influenzae Rd
aauuggaaaagua

SEQ ID NO: 2684071 - RNA, 19 nt, Haemophilus influenzae Rd
aauuggauuugaacguguu

SEQ ID NO: 2684072 - RNA, 20 nt, Haemophilus influenzae Rd
aauuggcgcaggcaaaccaa

SEQ ID NO: 2684073 - RNA, 17 nt, Haemophilus influenzae Rd
aauugggcgcauaacca

SEQ ID NO: 2684074 - RNA, 22 nt, Haemophilus influenzae Rd
aauugguuaauguaaacaaaaa

SEQ ID NO: 2684075 - RNA, 17 nt, Haemophilus influenzae Rd
aauugguucuaaauauu

SEQ ID NO: 2684076 - RNA, 14 nt, Haemophilus influenzae Rd
aauuguaacuauau

SEQ ID NO: 2684077 - RNA, 21 nt, Haemophilus influenzae Rd
aauuguagccguaaguuaaac

SEQ ID NO: 2684078 - RNA, 16 nt, Haemophilus influenzae Rd
aauugucaaaauugau

SEQ ID NO: 2684079 - RNA, 20 nt, Haemophilus influenzae Rd
aauugucaaaauugaugaaa

SEQ ID NO: 2684080 - RNA, 20 nt, Haemophilus influenzae Rd
aauuguccgccaucaguaaa

SEQ ID NO: 2684081 - RNA, 13 nt, Haemophilus influenzae Rd
aauugugauggaa

SEQ ID NO: 2684082 - RNA, 17 nt, Haemophilus influenzae Rd
aauugugauggaaguag

SEQ ID NO: 2684083 - RNA, 16 nt, Haemophilus influenzae Rd
aauugugcuaaauuuu

SEQ ID NO: 2684084 - RNA, 13 nt, Haemophilus influenzae Rd
aauuguguaauga

SEQ ID NO: 2684085 - RNA, 17 nt, Haemophilus influenzae Rd
aauuguguuggaacguu

SEQ ID NO: 2684086 - RNA, 14 nt, Haemophilus influenzae Rd
aauuguugcaccaa

SEQ ID NO: 2684087 - RNA, 16 nt, Haemophilus influenzae Rd
aauuguuguaaaauag

SEQ ID NO: 2684088 - RNA, 15 nt, Haemophilus influenzae Rd
aauuguuugaaauca

SEQ ID NO: 2684089 - RNA, 13 nt, Haemophilus influenzae Rd
aauuguuuuaaaa

SEQ ID NO: 2684090 - RNA, 14 nt, Haemophilus influenzae Rd
aauuuaaaaaguag

SEQ ID NO: 2684091 - RNA, 20 nt, Haemophilus influenzae Rd
aauuuaaaagcaccuaaaau

SEQ ID NO: 2684092 - RNA, 14 nt, Haemophilus influenzae Rd
aauuuaaaaucgca

SEQ ID NO: 2684093 - RNA, 13 nt, Haemophilus influenzae Rd
aauuuaaauaaag

SEQ ID NO: 2684094 - RNA, 14 nt, Haemophilus influenzae Rd
aauuuaaauaaagc

SEQ ID NO: 2684095 - RNA, 15 nt, Haemophilus influenzae Rd
aauuuaaauaauaaa

SEQ ID NO: 2684096 - RNA, 13 nt, Haemophilus influenzae Rd
aauuuaaauauaa

SEQ ID NO: 2684097 - RNA, 16 nt, Haemophilus influenzae Rd
aauuuaaauauaauuu

SEQ ID NO: 2684098 - RNA, 15 nt, Haemophilus influenzae Rd
aauuuaaaugaugaa

SEQ ID NO: 2684099 - RNA, 13 nt, Haemophilus influenzae Rd
aauuuaaauuuau

SEQ ID NO: 2684100 - RNA, 18 nt, Haemophilus influenzae Rd
aauuuaaccacuaaaaaa

SEQ ID NO: 2684101 - RNA, 16 nt, Haemophilus influenzae Rd
aauuuaacugaauuaa

SEQ ID NO: 2684102 - RNA, 22 nt, Haemophilus influenzae Rd
aauuuaagccuguuaugcuuua

SEQ ID NO: 2684103 - RNA, 15 nt, Haemophilus influenzae Rd
aauuuaauaagaauu

SEQ ID NO: 2684104 - RNA, 15 nt, Haemophilus influenzae Rd
aauuuaaucaaagua

SEQ ID NO: 2684105 - RNA, 14 nt, Haemophilus influenzae Rd
aauuuaauucuaaa

SEQ ID NO: 2684106 - RNA, 19 nt, Haemophilus influenzae Rd
aauuuacccacaacucauu

SEQ ID NO: 2684107 - RNA, 18 nt, Haemophilus influenzae Rd
aauuuaccgcacuuugau

SEQ ID NO: 2684108 - RNA, 19 nt, Haemophilus influenzae Rd
aauuuaccgcacuuugauu

SEQ ID NO: 2684109 - RNA, 22 nt, Haemophilus influenzae Rd
aauuuacucacaacaaagaugg

SEQ ID NO: 2684110 - RNA, 17 nt, Haemophilus influenzae Rd
aauuuacuguuuaaaua

SEQ ID NO: 2684111 - RNA, 21 nt, Haemophilus influenzae Rd
aauuuagauaaaaauuucaga

SEQ ID NO: 2684112 - RNA, 19 nt, Haemophilus influenzae Rd
aauuuagauacaaagauuu

SEQ ID NO: 2684113 - RNA, 23 nt, Haemophilus influenzae Rd
aauuuaguuauaugccuaaaaag

SEQ ID NO: 2684114 - RNA, 17 nt, Haemophilus influenzae Rd
aauuuauacgcuuuaac

SEQ ID NO: 2684115 - RNA, 19 nt, Haemophilus influenzae Rd
aauuuauacuaaauuagua

SEQ ID NO: 2684116 - RNA, 23 nt, Haemophilus influenzae Rd
aauuuauauaugauaaaaauaaa

SEQ ID NO: 2684117 - RNA, 17 nt, Haemophilus influenzae Rd
aauuuaucaucuaguuu

SEQ ID NO: 2684118 - RNA, 20 nt, Haemophilus influenzae Rd
aauuuaucgccauagaaaau

SEQ ID NO: 2684119 - RNA, 18 nt, Haemophilus influenzae Rd
aauuuaucgggaauaaua

SEQ ID NO: 2684120 - RNA, 16 nt, Haemophilus influenzae Rd
aauuuaucuaaaagua

SEQ ID NO: 2684121 - RNA, 13 nt, Haemophilus influenzae Rd
aauuuaugcuguu

SEQ ID NO: 2684122 - RNA, 13 nt, Haemophilus influenzae Rd
aauuuauguuaca

SEQ ID NO: 2684123 - RNA, 19 nt, Haemophilus influenzae Rd
aauuuauguuacaaauugc

SEQ ID NO: 2684124 - RNA, 13 nt, Haemophilus influenzae Rd
aauuuauuaaaaa

SEQ ID NO: 2684125 - RNA, 14 nt, Haemophilus influenzae Rd
aauuuauuaaaaau

SEQ ID NO: 2684126 - RNA, 13 nt, Haemophilus influenzae Rd
aauuuauuacaaa

SEQ ID NO: 2684127 - RNA, 12 nt, Haemophilus influenzae Rd
aauuuauuauaa

SEQ ID NO: 2684128 - RNA, 15 nt, Haemophilus influenzae Rd
aauuuauucaaaaua

SEQ ID NO: 2684129 - RNA, 16 nt, Haemophilus influenzae Rd
aauuuauucaaaauaa

SEQ ID NO: 2684130 - RNA, 18 nt, Haemophilus influenzae Rd
aauuuauucaaaauaaaa

SEQ ID NO: 2684131 - RNA, 22 nt, Haemophilus influenzae Rd
aauuuauucaaaauaaaaccau

SEQ ID NO: 2684132 - RNA, 16 nt, Haemophilus influenzae Rd
aauuuauuucaucaau

SEQ ID NO: 2684133 - RNA, 13 nt, Haemophilus influenzae Rd
aauuuauuuucua

SEQ ID NO: 2684134 - RNA, 16 nt, Haemophilus influenzae Rd
aauuuauuuucuaaua

SEQ ID NO: 2684135 - RNA, 22 nt, Haemophilus influenzae Rd
aauuuauuuuuuaaaacuuacc

SEQ ID NO: 2684136 - RNA, 20 nt, Haemophilus influenzae Rd
aauuucaauuaaaucaaaaa

SEQ ID NO: 2684137 - RNA, 15 nt, Haemophilus influenzae Rd
aauuucacaauuuuu

SEQ ID NO: 2684138 - RNA, 16 nt, Haemophilus influenzae Rd
aauuucacaauuuuug

SEQ ID NO: 2684139 - RNA, 13 nt, Haemophilus influenzae Rd
aauuucaccgcac

SEQ ID NO: 2684140 - RNA, 19 nt, Haemophilus influenzae Rd
aauuucaccgcauucuucu

SEQ ID NO: 2684141 - RNA, 19 nt, Haemophilus influenzae Rd
aauuucacguaguuaaacc

SEQ ID NO: 2684142 - RNA, 17 nt, Haemophilus influenzae Rd
aauuucacugaaaguaa

SEQ ID NO: 2684143 - RNA, 18 nt, Haemophilus influenzae Rd
aauuucagaauuaguaaa

SEQ ID NO: 2684144 - RNA, 23 nt, Haemophilus influenzae Rd
aauuucagacaaaacuuaucauu

SEQ ID NO: 2684145 - RNA, 19 nt, Haemophilus influenzae Rd
aauuucagcaucagaaaua

SEQ ID NO: 2684146 - RNA, 22 nt, Haemophilus influenzae Rd
aauuucagcgaaacuugagauu

SEQ ID NO: 2684147 - RNA, 17 nt, Haemophilus influenzae Rd
aauuucauaaaaauuag

SEQ ID NO: 2684148 - RNA, 18 nt, Haemophilus influenzae Rd
aauuucauaaaaauuagg

SEQ ID NO: 2684149 - RNA, 21 nt, Haemophilus influenzae Rd
aauuucauaguuuucugauuu

SEQ ID NO: 2684150 - RNA, 17 nt, Haemophilus influenzae Rd
aauuucauaucuucuuc

SEQ ID NO: 2684151 - RNA, 17 nt, Haemophilus influenzae Rd
aauuucaucgcauuuuu

SEQ ID NO: 2684152 - RNA, 13 nt, Haemophilus influenzae Rd
aauuuuuuauaaa

SEQ ID NO: 2684153 - RNA, 22 nt, Haemophilus influenzae Rd
aauuuuuuauagugauuauuua

SEQ ID NO: 2684154 - RNA, 18 nt, Haemophilus influenzae Rd
aauuuuuuaucaaauaac

SEQ ID NO: 2684155 - RNA, 20 nt, Haemophilus influenzae Rd
aauuuuuuauucaaaauuug

SEQ ID NO: 2684156 - RNA, 20 nt, Haemophilus influenzae Rd
aauuuuuucagauaaucaaa

SEQ ID NO: 2684157 - RNA, 14 nt, Haemophilus influenzae Rd
aauuuuuucugaau

SEQ ID NO: 2684158 - RNA, 20 nt, Haemophilus influenzae Rd
aauuuuuucugaauaaauuu

SEQ ID NO: 2684159 - RNA, 23 nt, Haemophilus influenzae Rd
aauuuuuugucugaaauuuugau

SEQ ID NO: 2684160 - RNA, 20 nt, Haemophilus influenzae Rd
aauuuuuuugcuggaaaaau

SEQ ID NO: 2684161 - RNA, 18 nt, Haemophilus influenzae Rd
aauuuuuuuucuaauaau

SEQ ID NO: 2684162 - RNA, 19 nt, Haemophilus influenzae Rd
acaaaaaacggacuaucau

SEQ ID NO: 2684163 - RNA, 18 nt, Haemophilus influenzae Rd
acaaaaaauucuuugccu

SEQ ID NO: 2684164 - RNA, 16 nt, Haemophilus influenzae Rd
acaaaaaguacuugca

SEQ ID NO: 2684165 - RNA, 22 nt, Haemophilus influenzae Rd
acaaaaagugcgguuaaaaauu

SEQ ID NO: 2684166 - RNA, 17 nt, Haemophilus influenzae Rd
acaaaaauacagccacu

SEQ ID NO: 2684167 - RNA, 12 nt, Haemophilus influenzae Rd
acaaaaccugca

SEQ ID NO: 2684168 - RNA, 19 nt, Haemophilus influenzae Rd
acaaaagugcgguaaauuu

SEQ ID NO: 2684169 - RNA, 23 nt, Haemophilus influenzae Rd
acaaaagugcgguaaauuuuuac

SEQ ID NO: 2684170 - RNA, 18 nt, Haemophilus influenzae Rd
acaaaagugcgguuaauu

SEQ ID NO: 2684171 - RNA, 19 nt, Haemophilus influenzae Rd
acaaaaguuugcaacauau

SEQ ID NO: 2684172 - RNA, 19 nt, Haemophilus influenzae Rd
acaaaauaaacacuccaac

SEQ ID NO: 2684173 - RNA, 20 nt, Haemophilus influenzae Rd
acaaaauccacacuuuaaaa

SEQ ID NO: 2684174 - RNA, 16 nt, Haemophilus influenzae Rd
acaaaauggcaaacaa

SEQ ID NO: 2684175 - RNA, 18 nt, Haemophilus influenzae Rd
acaaaauggcaaacaaaa

SEQ ID NO: 2684176 - RNA, 19 nt, Haemophilus influenzae Rd
acaaaauggcaaacaaaau

SEQ ID NO: 2684177 - RNA, 20 nt, Haemophilus influenzae Rd
acaaaauggcaaacaaaaua

SEQ ID NO: 2684178 - RNA, 23 nt, Haemophilus influenzae Rd
acaaaauggcaaacaaaauaaau

SEQ ID NO: 2684179 - RNA, 13 nt, Haemophilus influenzae Rd
acaaaauggcugu

SEQ ID NO: 2684180 - RNA, 22 nt, Haemophilus influenzae Rd
acaaaauggcuguuguuuuggc

SEQ ID NO: 2684181 - RNA, 22 nt, Haemophilus influenzae Rd
acaaaauggcuuuuuugccuuu

SEQ ID NO: 2684182 - RNA, 15 nt, Haemophilus influenzae Rd
acaaaauuaaugcca

SEQ ID NO: 2684183 - RNA, 18 nt, Haemophilus influenzae Rd
acaaaauuagacuuucuu

SEQ ID NO: 2684184 - RNA, 16 nt, Haemophilus influenzae Rd
acaaaauuuuaaauaa

SEQ ID NO: 2684185 - RNA, 22 nt, Haemophilus influenzae Rd
acaaaauuuuaaauaaaauauu

SEQ ID NO: 2684186 - RNA, 15 nt, Haemophilus influenzae Rd
acaaacaauaugcgu

SEQ ID NO: 2684187 - RNA, 16 nt, Haemophilus influenzae Rd
acaaacaaucuuaacu

SEQ ID NO: 2684188 - RNA, 23 nt, Haemophilus influenzae Rd
acaaaccagccugaaaaagcuaa

SEQ ID NO: 2684189 - RNA, 12 nt, Haemophilus influenzae Rd
acaaacccauuu

SEQ ID NO: 2684190 - RNA, 20 nt, Haemophilus influenzae Rd
acaaaccuaaaccuuauuuu

SEQ ID NO: 2684191 - RNA, 20 nt, Haemophilus influenzae Rd
acaaacgguuucaauaugac

SEQ ID NO: 2684192 - RNA, 19 nt, Haemophilus influenzae Rd
acaaacugguuaaaaucca

SEQ ID NO: 2684193 - RNA, 21 nt, Haemophilus influenzae Rd
acaaacuuaccgaucauuucu

SEQ ID NO: 2684194 - RNA, 14 nt, Haemophilus influenzae Rd
acaaagaaucuuaa

SEQ ID NO: 2684195 - RNA, 18 nt, Haemophilus influenzae Rd
acaaagaaucuuaaauuc

SEQ ID NO: 2684196 - RNA, 23 nt, Haemophilus influenzae Rd
acaaagacagcuauuaaaaaaag

SEQ ID NO: 2684197 - RNA, 18 nt, Haemophilus influenzae Rd
acaaagauuucauagcca

SEQ ID NO: 2684198 - RNA, 17 nt, Haemophilus influenzae Rd
acaaagauuuucucgug

SEQ ID NO: 2684199 - RNA, 22 nt, Haemophilus influenzae Rd
acaaagcguaccgccaguauca

SEQ ID NO: 2684200 - RNA, 16 nt, Haemophilus influenzae Rd
acaaagcuuaguccuu

SEQ ID NO: 2684201 - RNA, 19 nt, Haemophilus influenzae Rd
acaaagggcugauauuuaa

SEQ ID NO: 2684202 - RNA, 20 nt, Haemophilus influenzae Rd
acaaagggcugauauuuaaa

SEQ ID NO: 2684203 - RNA, 18 nt, Haemophilus influenzae Rd
acaaagguaaaacuuucu

SEQ ID NO: 2684204 - RNA, 15 nt, Haemophilus influenzae Rd
acaaagguugaaugc

SEQ ID NO: 2684205 - RNA, 14 nt, Haemophilus influenzae Rd
acaaagucaauuuu

SEQ ID NO: 2684206 - RNA, 19 nt, Haemophilus influenzae Rd
acaaaguggagaaacauuu

SEQ ID NO: 2684207 - RNA, 19 nt, Haemophilus influenzae Rd
acaaaguguuuuauuuauc

SEQ ID NO: 2684208 - RNA, 23 nt, Haemophilus influenzae Rd
acaaaguguuuuauuuaucagcc

SEQ ID NO: 2684209 - RNA, 12 nt, Haemophilus influenzae Rd
acaaauaaaaag

SEQ ID NO: 2684210 - RNA, 20 nt, Haemophilus influenzae Rd
acaaauaaacaaacuuucau

SEQ ID NO: 2684211 - RNA, 12 nt, Haemophilus influenzae Rd
acaaauaaauca

SEQ ID NO: 2684212 - RNA, 14 nt, Haemophilus influenzae Rd
acaaauaaaucaua

SEQ ID NO: 2684213 - RNA, 20 nt, Haemophilus influenzae Rd
acaaauaacacagaaaccaa

SEQ ID NO: 2684214 - RNA, 22 nt, Haemophilus influenzae Rd
acaaauaacacagaaaccaaua

SEQ ID NO: 2684215 - RNA, 14 nt, Haemophilus influenzae Rd
acaaauaagccaau

SEQ ID NO: 2684216 - RNA, 20 nt, Haemophilus influenzae Rd
acaaauaagcccaacuuaag

SEQ ID NO: 2684217 - RNA, 12 nt, Haemophilus influenzae Rd
acaaauaauaug

SEQ ID NO: 2684218 - RNA, 15 nt, Haemophilus influenzae Rd
acaaauaauuauuau

SEQ ID NO: 2684219 - RNA, 15 nt, Haemophilus influenzae Rd
acaaauaggauaaaa

SEQ ID NO: 2684220 - RNA, 17 nt, Haemophilus influenzae Rd
acaaauauugguuauuu

SEQ ID NO: 2684221 - RNA, 20 nt, Haemophilus influenzae Rd
acaaauauugguuauuuaaa

SEQ ID NO: 2684222 - RNA, 17 nt, Haemophilus influenzae Rd
acaaaucugccugauuu

SEQ ID NO: 2684223 - RNA, 19 nt, Haemophilus influenzae Rd
acaaaucugccugauuuuu

SEQ ID NO: 2684224 - RNA, 18 nt, Haemophilus influenzae Rd
acaaaugaucauuuuggg

SEQ ID NO: 2684225 - RNA, 14 nt, Haemophilus influenzae Rd
acaaaugauuagaa

SEQ ID NO: 2684226 - RNA, 15 nt, Haemophilus influenzae Rd
acaaaugucauugau

SEQ ID NO: 2684227 - RNA, 22 nt, Haemophilus influenzae Rd
acaaauuaauaagaaaaucaaa

SEQ ID NO: 2684228 - RNA, 18 nt, Haemophilus influenzae Rd
acaaauuagcgauuaaag

SEQ ID NO: 2684229 - RNA, 19 nt, Haemophilus influenzae Rd
acaaauucagcuaauucag

SEQ ID NO: 2684230 - RNA, 14 nt, Haemophilus influenzae Rd
acaaauuuaaauga

SEQ ID NO: 2684231 - RNA, 12 nt, Haemophilus influenzae Rd
acaaauuuagau

SEQ ID NO: 2684232 - RNA, 13 nt, Haemophilus influenzae Rd
acaaauuuagaua

SEQ ID NO: 2684233 - RNA, 23 nt, Haemophilus influenzae Rd
acaaauuuagauaacaaugaaau

SEQ ID NO: 2684234 - RNA, 12 nt, Haemophilus influenzae Rd
acaaauuucacg

SEQ ID NO: 2684235 - RNA, 18 nt, Haemophilus influenzae Rd
acaaauuuccauaugacc

SEQ ID NO: 2684236 - RNA, 19 nt, Haemophilus influenzae Rd
acaaauuuccauaugacca

SEQ ID NO: 2684237 - RNA, 21 nt, Haemophilus influenzae Rd
acaaauuuuauauauccaaau

SEQ ID NO: 2684238 - RNA, 24 nt, Haemophilus influenzae Rd
acaaauuuuuacagauaaaucagc

SEQ ID NO: 2684239 - RNA, 20 nt, Haemophilus influenzae Rd
acaacaacgcaucuuuauaa

SEQ ID NO: 2684240 - RNA, 15 nt, Haemophilus influenzae Rd
acaacaacuuuucua

SEQ ID NO: 2684241 - RNA, 12 nt, Haemophilus influenzae Rd
acaacaagaaau

SEQ ID NO: 2684242 - RNA, 15 nt, Haemophilus influenzae Rd
acaacaagaaauuuu

SEQ ID NO: 2684243 - RNA, 19 nt, Haemophilus influenzae Rd
acaacagauugauaaguuu

SEQ ID NO: 2684244 - RNA, 12 nt, Haemophilus influenzae Rd
acaacagcaaua

SEQ ID NO: 2684245 - RNA, 15 nt, Haemophilus influenzae Rd
acaacagcaauaagc

SEQ ID NO: 2684246 - RNA, 19 nt, Haemophilus influenzae Rd
acaacagcgaaauauuuca

SEQ ID NO: 2684247 - RNA, 21 nt, Haemophilus influenzae Rd
acaacagcgaaauauuucacu

SEQ ID NO: 2684248 - RNA, 19 nt, Haemophilus influenzae Rd
acaacaguagaaaucacaa

SEQ ID NO: 2684249 - RNA, 23 nt, Haemophilus influenzae Rd
acaacaguagaaaucacaauaaa

SEQ ID NO: 2684250 - RNA, 22 nt, Haemophilus influenzae Rd
acaacauaguuaauguuuucuu

SEQ ID NO: 2684251 - RNA, 12 nt, Haemophilus influenzae Rd
acaacaucagau

SEQ ID NO: 2684252 - RNA, 23 nt, Haemophilus influenzae Rd
acaacaucagauggaauauuugc

SEQ ID NO: 2684253 - RNA, 15 nt, Haemophilus influenzae Rd
acaacaucuuguuuu

SEQ ID NO: 2684254 - RNA, 17 nt, Haemophilus influenzae Rd
acaacaucuuguuuuaa

SEQ ID NO: 2684255 - RNA, 21 nt, Haemophilus influenzae Rd
acaaccaagcgcgugugaaau

SEQ ID NO: 2684256 - RNA, 23 nt, Haemophilus influenzae Rd
acaaccaagcgcgugugaaauuc

SEQ ID NO: 2684257 - RNA, 22 nt, Haemophilus influenzae Rd
acaauuuguccuuuaucaagca

SEQ ID NO: 2684258 - RNA, 17 nt, Haemophilus influenzae Rd
acaauuuucuuuucaaa

SEQ ID NO: 2684259 - RNA, 16 nt, Haemophilus influenzae Rd
acacaaacugguuaaa

SEQ ID NO: 2684260 - RNA, 17 nt, Haemophilus influenzae Rd
acacaaacugguuaaaa

SEQ ID NO: 2684261 - RNA, 21 nt, Haemophilus influenzae Rd
acacaaacugguuaaaaucca

SEQ ID NO: 2684262 - RNA, 12 nt, Haemophilus influenzae Rd
acacaacaucag

SEQ ID NO: 2684263 - RNA, 13 nt, Haemophilus influenzae Rd
acacaagcaccag

SEQ ID NO: 2684264 - RNA, 17 nt, Haemophilus influenzae Rd
acacaagggauuuaaaa

SEQ ID NO: 2684265 - RNA, 14 nt, Haemophilus influenzae Rd
acacaaucgguaac

SEQ ID NO: 2684266 - RNA, 21 nt, Haemophilus influenzae Rd
acacacaccauccaugacaga

SEQ ID NO: 2684267 - RNA, 15 nt, Haemophilus influenzae Rd
acacaccauuuuugc

SEQ ID NO: 2684268 - RNA, 19 nt, Haemophilus influenzae Rd
acacaccuauuuuuuccug

SEQ ID NO: 2684269 - RNA, 17 nt, Haemophilus influenzae Rd
acacacgaucaccaaga

SEQ ID NO: 2684270 - RNA, 13 nt, Haemophilus influenzae Rd
acacacuaaucaa

SEQ ID NO: 2684271 - RNA, 14 nt, Haemophilus influenzae Rd
acacacuaaucaau

SEQ ID NO: 2684272 - RNA, 17 nt, Haemophilus influenzae Rd
acacaguuauacacaag

SEQ ID NO: 2684273 - RNA, 14 nt, Haemophilus influenzae Rd
acacaguuauuuuu

SEQ ID NO: 2684274 - RNA, 17 nt, Haemophilus influenzae Rd
acacaguuauuuuuuau

SEQ ID NO: 2684275 - RNA, 18 nt, Haemophilus influenzae Rd
acacauaauauuuuuacu

SEQ ID NO: 2684276 - RNA, 17 nt, Haemophilus influenzae Rd
acacauggccaauuuca

SEQ ID NO: 2684277 - RNA, 20 nt, Haemophilus influenzae Rd
acacauggccaauuucaucg

SEQ ID NO: 2684278 - RNA, 13 nt, Haemophilus influenzae Rd
acacauugccaua

SEQ ID NO: 2684279 - RNA, 15 nt, Haemophilus influenzae Rd
acaccaaaaaugccg

SEQ ID NO: 2684280 - RNA, 14 nt, Haemophilus influenzae Rd
acaccaaaaccaau

SEQ ID NO: 2684281 - RNA, 17 nt, Haemophilus influenzae Rd
acaccaacggcauuucc

SEQ ID NO: 2684282 - RNA, 14 nt, Haemophilus influenzae Rd
acaccacccgauaa

SEQ ID NO: 2684283 - RNA, 20 nt, Haemophilus influenzae Rd
acaccacccgauaaaugcac

SEQ ID NO: 2684284 - RNA, 18 nt, Haemophilus influenzae Rd
acaccaccugaugcuuua

SEQ ID NO: 2684285 - RNA, 21 nt, Haemophilus influenzae Rd
acaccauuuuugcgcugacca

SEQ ID NO: 2684286 - RNA, 17 nt, Haemophilus influenzae Rd
acacccaaauuaaaaaa

SEQ ID NO: 2684287 - RNA, 22 nt, Haemophilus influenzae Rd
acacccaaauuaaaaaagcaaa

SEQ ID NO: 2684288 - RNA, 13 nt, Haemophilus influenzae Rd
acaccccaaaauc

SEQ ID NO: 2684289 - RNA, 15 nt, Haemophilus influenzae Rd
acaccgauuucuuua

SEQ ID NO: 2684290 - RNA, 15 nt, Haemophilus influenzae Rd
acaccuaaaugagaa

SEQ ID NO: 2684291 - RNA, 22 nt, Haemophilus influenzae Rd
acaccuaaguaagucgcaucaa

SEQ ID NO: 2684292 - RNA, 13 nt, Haemophilus influenzae Rd
acaccuauuauuc

SEQ ID NO: 2684293 - RNA, 19 nt, Haemophilus influenzae Rd
acaccuuuaaaaauuacaa

SEQ ID NO: 2684294 - RNA, 16 nt, Haemophilus influenzae Rd
acacgcgcaaauuuuc

SEQ ID NO: 2684295 - RNA, 21 nt, Haemophilus influenzae Rd
acacgcucaggaaaacguuca

SEQ ID NO: 2684296 - RNA, 16 nt, Haemophilus influenzae Rd
acacggauuggguugu

SEQ ID NO: 2684297 - RNA, 18 nt, Haemophilus influenzae Rd
acacggccguaaugaauu

SEQ ID NO: 2684298 - RNA, 16 nt, Haemophilus influenzae Rd
acacgguaguaaauaa

SEQ ID NO: 2684299 - RNA, 19 nt, Haemophilus influenzae Rd
acacguccgcaaccagcag

SEQ ID NO: 2684300 - RNA, 21 nt, Haemophilus influenzae Rd
acacguccuugacuaucuguu

SEQ ID NO: 2684301 - RNA, 20 nt, Haemophilus influenzae Rd
acacguuaugcguuuuuaau

SEQ ID NO: 2684302 - RNA, 14 nt, Haemophilus influenzae Rd
acacguuugccaga

SEQ ID NO: 2684303 - RNA, 18 nt, Haemophilus influenzae Rd
acacguuugccagaaagc

SEQ ID NO: 2684304 - RNA, 20 nt, Haemophilus influenzae Rd
acacguuugccagaaagcau

SEQ ID NO: 2684305 - RNA, 14 nt, Haemophilus influenzae Rd
acacuaaaaagccc

SEQ ID NO: 2684306 - RNA, 22 nt, Haemophilus influenzae Rd
acacuaaucuaaacuuguuaaa

SEQ ID NO: 2684307 - RNA, 18 nt, Haemophilus influenzae Rd
acacuaccgcccgcauca

SEQ ID NO: 2684308 - RNA, 19 nt, Haemophilus influenzae Rd
acacuauuaauuacuuuua

SEQ ID NO: 2684309 - RNA, 12 nt, Haemophilus influenzae Rd
acacucuaucua

SEQ ID NO: 2684310 - RNA, 13 nt, Haemophilus influenzae Rd
acacucuaucuaa

SEQ ID NO: 2684311 - RNA, 21 nt, Haemophilus influenzae Rd
acacuuaaacucgaaggaaau

SEQ ID NO: 2684312 - RNA, 24 nt, Haemophilus influenzae Rd
acacuuccccuguaauaaaugcgu

SEQ ID NO: 2684313 - RNA, 19 nt, Haemophilus influenzae Rd
acacuuuaaaaguuuacua

SEQ ID NO: 2684314 - RNA, 19 nt, Haemophilus influenzae Rd
acacuuuaauaguaaacuu

SEQ ID NO: 2684315 - RNA, 18 nt, Haemophilus influenzae Rd
acacuuuguauggcaaau

SEQ ID NO: 2684316 - RNA, 22 nt, Haemophilus influenzae Rd
acacuuuguauggcaaauuagc

SEQ ID NO: 2684317 - RNA, 17 nt, Haemophilus influenzae Rd
acagaaauaugaaauuu

SEQ ID NO: 2684318 - RNA, 16 nt, Haemophilus influenzae Rd
acagaaaucauuucaa

SEQ ID NO: 2684319 - RNA, 17 nt, Haemophilus influenzae Rd
acagaaaucauuucaau

SEQ ID NO: 2684320 - RNA, 22 nt, Haemophilus influenzae Rd
acagaaaucauuucaauguuug

SEQ ID NO: 2684321 - RNA, 12 nt, Haemophilus influenzae Rd
acagaacaaaau

SEQ ID NO: 2684322 - RNA, 18 nt, Haemophilus influenzae Rd
acagaaguauuuacugau

SEQ ID NO: 2684323 - RNA, 20 nt, Haemophilus influenzae Rd
acagaaguauuuacugauuu

SEQ ID NO: 2684324 - RNA, 20 nt, Haemophilus influenzae Rd
acagaagugcguucauauuu

SEQ ID NO: 2684325 - RNA, 21 nt, Haemophilus influenzae Rd
acagaagugcguucauauuug

SEQ ID NO: 2684326 - RNA, 12 nt, Haemophilus influenzae Rd
acagaaucuaaa

SEQ ID NO: 2684327 - RNA, 15 nt, Haemophilus influenzae Rd
acagauacauuuaau

SEQ ID NO: 2684328 - RNA, 21 nt, Haemophilus influenzae Rd
acagauagcauaaguuaauuc

SEQ ID NO: 2684329 - RNA, 18 nt, Haemophilus influenzae Rd
acagauuuuuaaaucaau

SEQ ID NO: 2684330 - RNA, 22 nt, Haemophilus influenzae Rd
acagauuuuuacuucaucaaaa

SEQ ID NO: 2684331 - RNA, 16 nt, Haemophilus influenzae Rd
acagcaaaagaaauaa

SEQ ID NO: 2684332 - RNA, 21 nt, Haemophilus influenzae Rd
acagcaaaagaaauaacguca

SEQ ID NO: 2684333 - RNA, 22 nt, Haemophilus influenzae Rd
acagcaaaagugcuuaaaugca

SEQ ID NO: 2684334 - RNA, 20 nt, Haemophilus influenzae Rd
acagcaaacuuaaauacauu

SEQ ID NO: 2684335 - RNA, 12 nt, Haemophilus influenzae Rd
acagcaaauccu

SEQ ID NO: 2684336 - RNA, 13 nt, Haemophilus influenzae Rd
acagcaaauccuu

SEQ ID NO: 2684337 - RNA, 22 nt, Haemophilus influenzae Rd
acagcaagcaucgcuggauaaa

SEQ ID NO: 2684338 - RNA, 14 nt, Haemophilus influenzae Rd
acagcaauaaauaa

SEQ ID NO: 2684339 - RNA, 17 nt, Haemophilus influenzae Rd
acagcaauuugaauuaa

SEQ ID NO: 2684340 - RNA, 18 nt, Haemophilus influenzae Rd
acagcaauuugaauuaau

SEQ ID NO: 2684341 - RNA, 14 nt, Haemophilus influenzae Rd
acagcacacuaaua

SEQ ID NO: 2684342 - RNA, 16 nt, Haemophilus influenzae Rd
acagcagcuaaaagug

SEQ ID NO: 2684343 - RNA, 15 nt, Haemophilus influenzae Rd
acagccugcgagcag

SEQ ID NO: 2684344 - RNA, 20 nt, Haemophilus influenzae Rd
acagcguuauccaucaagaa

SEQ ID NO: 2684345 - RNA, 17 nt, Haemophilus influenzae Rd
acagcuaccaauucaaa

SEQ ID NO: 2684346 - RNA, 20 nt, Haemophilus influenzae Rd
acagcuauuaaaaaaagcaa

SEQ ID NO: 2684347 - RNA, 22 nt, Haemophilus influenzae Rd
acagcuauuaaaaaaagcaaua

SEQ ID NO: 2684348 - RNA, 14 nt, Haemophilus influenzae Rd
acagcucaaaaugc

SEQ ID NO: 2684349 - RNA, 15 nt, Haemophilus influenzae Rd
acagcucaaaaugcu

SEQ ID NO: 2684350 - RNA, 24 nt, Haemophilus influenzae Rd
acagcucuguaaaacauuucaucg

SEQ ID NO: 2684351 - RNA, 20 nt, Haemophilus influenzae Rd
acagcuugguaguuuuucac

SEQ ID NO: 2684352 - RNA, 18 nt, Haemophilus influenzae Rd
acagcuuugcugucuuug

SEQ ID NO: 2684353 - RNA, 21 nt, Haemophilus influenzae Rd
acaggaauacucacagagccu

SEQ ID NO: 2684354 - RNA, 15 nt, Haemophilus influenzae Rd
acaggauaaaaacca

SEQ ID NO: 2684355 - RNA, 22 nt, Haemophilus influenzae Rd
acaggcuaucaucaucauuuug

SEQ ID NO: 2684356 - RNA, 19 nt, Haemophilus influenzae Rd
acaggcuucaauuugagaa

SEQ ID NO: 2684357 - RNA, 18 nt, Haemophilus influenzae Rd
acaggcuuccaacaaaau

SEQ ID NO: 2684358 - RNA, 17 nt, Haemophilus influenzae Rd
acagggcagugauguaa

SEQ ID NO: 2684359 - RNA, 15 nt, Haemophilus influenzae Rd
acagggcauaaauca

SEQ ID NO: 2684360 - RNA, 16 nt, Haemophilus influenzae Rd
acagggugguugcgaa

SEQ ID NO: 2684361 - RNA, 18 nt, Haemophilus influenzae Rd
acagggugucguagaaau

SEQ ID NO: 2684362 - RNA, 21 nt, Haemophilus influenzae Rd
acauuauugaagcacugaaau

SEQ ID NO: 2684363 - RNA, 17 nt, Haemophilus influenzae Rd
acauuauuuaauuuuuu

SEQ ID NO: 2684364 - RNA, 12 nt, Haemophilus influenzae Rd
acauucaaaucc

SEQ ID NO: 2684365 - RNA, 15 nt, Haemophilus influenzae Rd
acauucacuaacaaa

SEQ ID NO: 2684366 - RNA, 15 nt, Haemophilus influenzae Rd
acauucccaaauaau

SEQ ID NO: 2684367 - RNA, 15 nt, Haemophilus influenzae Rd
acauucccuuuccaa

SEQ ID NO: 2684368 - RNA, 16 nt, Haemophilus influenzae Rd
acauucccuuuccaau

SEQ ID NO: 2684369 - RNA, 23 nt, Haemophilus influenzae Rd
acauuccguuuuuaaucucccaa

SEQ ID NO: 2684370 - RNA, 12 nt, Haemophilus influenzae Rd
acauuccuauuc

SEQ ID NO: 2684371 - RNA, 14 nt, Haemophilus influenzae Rd
acauucgcauauuu

SEQ ID NO: 2684372 - RNA, 22 nt, Haemophilus influenzae Rd
acauucuccagacugcauugca

SEQ ID NO: 2684373 - RNA, 15 nt, Haemophilus influenzae Rd
acauucuuuuaaaua

SEQ ID NO: 2684374 - RNA, 16 nt, Haemophilus influenzae Rd
acauugcaucagccac

SEQ ID NO: 2684375 - RNA, 17 nt, Haemophilus influenzae Rd
acauugcaucagccacc

SEQ ID NO: 2684376 - RNA, 15 nt, Haemophilus influenzae Rd
acauuguaaagugau

SEQ ID NO: 2684377 - RNA, 22 nt, Haemophilus influenzae Rd
acauuguaaagugauugauuug

SEQ ID NO: 2684378 - RNA, 15 nt, Haemophilus influenzae Rd
acauuguuguuuaau

SEQ ID NO: 2684379 - RNA, 17 nt, Haemophilus influenzae Rd
acauuguuucaaucacu

SEQ ID NO: 2684380 - RNA, 12 nt, Haemophilus influenzae Rd
acauuuaaacuc

SEQ ID NO: 2684381 - RNA, 17 nt, Haemophilus influenzae Rd
acauuuaaccaaaacgu

SEQ ID NO: 2684382 - RNA, 15 nt, Haemophilus influenzae Rd
acauuucacuaaaua

SEQ ID NO: 2684383 - RNA, 12 nt, Haemophilus influenzae Rd
acauuucauaac

SEQ ID NO: 2684384 - RNA, 21 nt, Haemophilus influenzae Rd
acauuuccaagcguaaaagua

SEQ ID NO: 2684385 - RNA, 22 nt, Haemophilus influenzae Rd
acauuuccaagcguaaaaguau

SEQ ID NO: 2684386 - RNA, 13 nt, Haemophilus influenzae Rd
acauuucccuuag

SEQ ID NO: 2684387 - RNA, 14 nt, Haemophilus influenzae Rd
acauuucuaaaaua

SEQ ID NO: 2684388 - RNA, 12 nt, Haemophilus influenzae Rd
acauuucuuuug

SEQ ID NO: 2684389 - RNA, 16 nt, Haemophilus influenzae Rd
acauuucuuuuggcca

SEQ ID NO: 2684390 - RNA, 12 nt, Haemophilus influenzae Rd
acauuugacgaa

SEQ ID NO: 2684391 - RNA, 20 nt, Haemophilus influenzae Rd
acauuuuacuuuagcaaugc

SEQ ID NO: 2684392 - RNA, 16 nt, Haemophilus influenzae Rd
acauuuucaaauuguc

SEQ ID NO: 2684393 - RNA, 18 nt, Haemophilus influenzae Rd
acauuuugucuaaagagc

SEQ ID NO: 2684394 - RNA, 16 nt, Haemophilus influenzae Rd
acauuuuguuucuaaa

SEQ ID NO: 2684395 - RNA, 16 nt, Haemophilus influenzae Rd
acauuuuuauuuuuac

SEQ ID NO: 2684396 - RNA, 17 nt, Haemophilus influenzae Rd
acauuuuuauuuuuacu

SEQ ID NO: 2684397 - RNA, 20 nt, Haemophilus influenzae Rd
acauuuuugauugcaccuaa

SEQ ID NO: 2684398 - RNA, 21 nt, Haemophilus influenzae Rd
acauuuuugucuuuguugauu

SEQ ID NO: 2684399 - RNA, 14 nt, Haemophilus influenzae Rd
acauuuuuucaacu

SEQ ID NO: 2684400 - RNA, 13 nt, Haemophilus influenzae Rd
acauuuuuugcug

SEQ ID NO: 2684401 - RNA, 17 nt, Haemophilus influenzae Rd
acauuuuuuuuauccaa

SEQ ID NO: 2684402 - RNA, 22 nt, Haemophilus influenzae Rd
accaaaaaauucguaaagcgag

SEQ ID NO: 2684403 - RNA, 16 nt, Haemophilus influenzae Rd
accaaaauacaaucac

SEQ ID NO: 2684404 - RNA, 17 nt, Haemophilus influenzae Rd
accaaaaucuaaaccag

SEQ ID NO: 2684405 - RNA, 20 nt, Haemophilus influenzae Rd
accaaaaugucgccauuuaa

SEQ ID NO: 2684406 - RNA, 16 nt, Haemophilus influenzae Rd
accaaaauucuacgcc

SEQ ID NO: 2684407 - RNA, 12 nt, Haemophilus influenzae Rd
accaaaauuuaa

SEQ ID NO: 2684408 - RNA, 14 nt, Haemophilus influenzae Rd
accaaaauuuaaaa

SEQ ID NO: 2684409 - RNA, 15 nt, Haemophilus influenzae Rd
accaaacgagaaaau

SEQ ID NO: 2684410 - RNA, 16 nt, Haemophilus influenzae Rd
accaaacgagaaaauu

SEQ ID NO: 2684411 - RNA, 17 nt, Haemophilus influenzae Rd
accaaacgagaaaauuu

SEQ ID NO: 2684412 - RNA, 17 nt, Haemophilus influenzae Rd
accaaacugccaaacaa

SEQ ID NO: 2684413 - RNA, 12 nt, Haemophilus influenzae Rd
accaaagaaacg

SEQ ID NO: 2684414 - RNA, 20 nt, Haemophilus influenzae Rd
accaaaguuuccuucgccau

SEQ ID NO: 2684415 - RNA, 12 nt, Haemophilus influenzae Rd
accaaauacaau

SEQ ID NO: 2684416 - RNA, 16 nt, Haemophilus influenzae Rd
accaaauacaauuuuu

SEQ ID NO: 2684417 - RNA, 18 nt, Haemophilus influenzae Rd
accaaauagaugaaauuu

SEQ ID NO: 2684418 - RNA, 15 nt, Haemophilus influenzae Rd
accaacaaauucuaa

SEQ ID NO: 2684419 - RNA, 13 nt, Haemophilus influenzae Rd
accaacaacugca

SEQ ID NO: 2684420 - RNA, 12 nt, Haemophilus influenzae Rd
accaacacgcca

SEQ ID NO: 2684421 - RNA, 12 nt, Haemophilus influenzae Rd
accaacacuugc

SEQ ID NO: 2684422 - RNA, 20 nt, Haemophilus influenzae Rd
accaacacuugcagcccaac

SEQ ID NO: 2684423 - RNA, 18 nt, Haemophilus influenzae Rd
accaacauacauuaaugc

SEQ ID NO: 2684424 - RNA, 15 nt, Haemophilus influenzae Rd
accaaccgguaaaau

SEQ ID NO: 2684425 - RNA, 16 nt, Haemophilus influenzae Rd
accaaccgguaaaauu

SEQ ID NO: 2684426 - RNA, 19 nt, Haemophilus influenzae Rd
accaaccgguaaaauuaau

SEQ ID NO: 2684427 - RNA, 19 nt, Haemophilus influenzae Rd
accaaccuaaguuugcccc

SEQ ID NO: 2684428 - RNA, 16 nt, Haemophilus influenzae Rd
accaaccuuuuacaac

SEQ ID NO: 2684429 - RNA, 13 nt, Haemophilus influenzae Rd
accaacgaaaaua

SEQ ID NO: 2684430 - RNA, 17 nt, Haemophilus influenzae Rd
accaacggauuaaaagu

SEQ ID NO: 2684431 - RNA, 15 nt, Haemophilus influenzae Rd
accaacguggcuuuu

SEQ ID NO: 2684432 - RNA, 18 nt, Haemophilus influenzae Rd
accaacguggcuuuucug

SEQ ID NO: 2684433 - RNA, 18 nt, Haemophilus influenzae Rd
accaagaaagcaugaaua

SEQ ID NO: 2684434 - RNA, 12 nt, Haemophilus influenzae Rd
accaagaaauaa

SEQ ID NO: 2684435 - RNA, 14 nt, Haemophilus influenzae Rd
accaagaaauaagg

SEQ ID NO: 2684436 - RNA, 21 nt, Haemophilus influenzae Rd
accaagagccuccacaagcaa

SEQ ID NO: 2684437 - RNA, 11 nt, Haemophilus influenzae Rd
accaagcaaug

SEQ ID NO: 2684438 - RNA, 12 nt, Haemophilus influenzae Rd
accaagcaaugc

SEQ ID NO: 2684439 - RNA, 14 nt, Haemophilus influenzae Rd
accaagcaauuuca

SEQ ID NO: 2684440 - RNA, 15 nt, Haemophilus influenzae Rd
accaagcaauuucau

SEQ ID NO: 2684441 - RNA, 15 nt, Haemophilus influenzae Rd
accaagcauauuugc

SEQ ID NO: 2684442 - RNA, 16 nt, Haemophilus influenzae Rd
accaagccauuuaacu

SEQ ID NO: 2684443 - RNA, 17 nt, Haemophilus influenzae Rd
accaagccauuuaacua

SEQ ID NO: 2684444 - RNA, 20 nt, Haemophilus influenzae Rd
accaagcgcgugugaaauuc

SEQ ID NO: 2684445 - RNA, 22 nt, Haemophilus influenzae Rd
accaagcgcgugugaaauuccu

SEQ ID NO: 2684446 - RNA, 14 nt, Haemophilus influenzae Rd
accaaggcauuuuu

SEQ ID NO: 2684447 - RNA, 19 nt, Haemophilus influenzae Rd
accaaguaaaccaaaucca

SEQ ID NO: 2684448 - RNA, 14 nt, Haemophilus influenzae Rd
accaagugaaauuc

SEQ ID NO: 2684449 - RNA, 21 nt, Haemophilus influenzae Rd
accaagugcugguagcaauaa

SEQ ID NO: 2684450 - RNA, 19 nt, Haemophilus influenzae Rd
accaauaagauagaaaugu

SEQ ID NO: 2684451 - RNA, 17 nt, Haemophilus influenzae Rd
accaauaauccuuuuuu

SEQ ID NO: 2684452 - RNA, 21 nt, Haemophilus influenzae Rd
accaauaauuaaacagccaaa

SEQ ID NO: 2684453 - RNA, 13 nt, Haemophilus influenzae Rd
accaauaauuaau

SEQ ID NO: 2684454 - RNA, 17 nt, Haemophilus influenzae Rd
accaauaauugaugcua

SEQ ID NO: 2684455 - RNA, 19 nt, Haemophilus influenzae Rd
accaauacgauaauuaaag

SEQ ID NO: 2684456 - RNA, 19 nt, Haemophilus influenzae Rd
accaauaggaagcauuucu

SEQ ID NO: 2684457 - RNA, 20 nt, Haemophilus influenzae Rd
accaauauucuuuaaaacau

SEQ ID NO: 2684458 - RNA, 22 nt, Haemophilus influenzae Rd
accaauauucuuuaaaacauuc

SEQ ID NO: 2684459 - RNA, 17 nt, Haemophilus influenzae Rd
accaauauuuguugcca

SEQ ID NO: 2684460 - RNA, 15 nt, Haemophilus influenzae Rd
accaaucacaacaca

SEQ ID NO: 2684461 - RNA, 22 nt, Haemophilus influenzae Rd
accaaucauuggauaauugcca

SEQ ID NO: 2684462 - RNA, 23 nt, Haemophilus influenzae Rd
accaauggcaaucacaaauccau

SEQ ID NO: 2684463 - RNA, 17 nt, Haemophilus influenzae Rd
accaauucaaaaaccaa

SEQ ID NO: 2684464 - RNA, 19 nt, Haemophilus influenzae Rd
accaauucaaaaaccaaac

SEQ ID NO: 2684465 - RNA, 21 nt, Haemophilus influenzae Rd
accaauucaaagauuuuaaaa

SEQ ID NO: 2684466 - RNA, 17 nt, Haemophilus influenzae Rd
accaauugaugcacaac

SEQ ID NO: 2684467 - RNA, 14 nt, Haemophilus influenzae Rd
accaauugauuuuu

SEQ ID NO: 2684468 - RNA, 16 nt, Haemophilus influenzae Rd
acccacuaaguauuaa

SEQ ID NO: 2684469 - RNA, 14 nt, Haemophilus influenzae Rd
acccacugauuuuu

SEQ ID NO: 2684470 - RNA, 17 nt, Haemophilus influenzae Rd
acccacuucaccuuggc

SEQ ID NO: 2684471 - RNA, 20 nt, Haemophilus influenzae Rd
acccaggaguaaccacaaaa

SEQ ID NO: 2684472 - RNA, 13 nt, Haemophilus influenzae Rd
acccaucaaaucu

SEQ ID NO: 2684473 - RNA, 15 nt, Haemophilus influenzae Rd
acccaucaaaucuuu

SEQ ID NO: 2684474 - RNA, 22 nt, Haemophilus influenzae Rd
acccaucacauuuucaaauugu

SEQ ID NO: 2684475 - RNA, 16 nt, Haemophilus influenzae Rd
acccauuuugauugcu

SEQ ID NO: 2684476 - RNA, 20 nt, Haemophilus influenzae Rd
accccaauuccuugugaacc

SEQ ID NO: 2684477 - RNA, 23 nt, Haemophilus influenzae Rd
accccauuucuugaccuuucaau

SEQ ID NO: 2684478 - RNA, 16 nt, Haemophilus influenzae Rd
accccucguucuccca

SEQ ID NO: 2684479 - RNA, 16 nt, Haemophilus influenzae Rd
acccgaaccgauuuua

SEQ ID NO: 2684480 - RNA, 16 nt, Haemophilus influenzae Rd
acccgauuauucuuag

SEQ ID NO: 2684481 - RNA, 22 nt, Haemophilus influenzae Rd
acccgcuuuuaacaaauacauc

SEQ ID NO: 2684482 - RNA, 18 nt, Haemophilus influenzae Rd
acccggcacauaaaucau

SEQ ID NO: 2684483 - RNA, 16 nt, Haemophilus influenzae Rd
acccguaauuaaaaau

SEQ ID NO: 2684484 - RNA, 20 nt, Haemophilus influenzae Rd
acccguaccuuuaaauucuu

SEQ ID NO: 2684485 - RNA, 15 nt, Haemophilus influenzae Rd
acccguaucaacuaa

SEQ ID NO: 2684486 - RNA, 24 nt, Haemophilus influenzae Rd
acccuaaucguucauaaaacgagc

SEQ ID NO: 2684487 - RNA, 21 nt, Haemophilus influenzae Rd
acccuacaggcuuccaacaaa

SEQ ID NO: 2684488 - RNA, 19 nt, Haemophilus influenzae Rd
accgaaaaaauaguuuaau

SEQ ID NO: 2684489 - RNA, 19 nt, Haemophilus influenzae Rd
accgaaaaccgaaaaaaua

SEQ ID NO: 2684490 - RNA, 22 nt, Haemophilus influenzae Rd
accgaaugacgcguuaauuuuu

SEQ ID NO: 2684491 - RNA, 18 nt, Haemophilus influenzae Rd
accgacucguccaucaaa

SEQ ID NO: 2684492 - RNA, 14 nt, Haemophilus influenzae Rd
accgacuuugucaa

SEQ ID NO: 2684493 - RNA, 16 nt, Haemophilus influenzae Rd
accgagcggucagagg

SEQ ID NO: 2684494 - RNA, 17 nt, Haemophilus influenzae Rd
accgauaaggaaaauac

SEQ ID NO: 2684495 - RNA, 13 nt, Haemophilus influenzae Rd
accgauagcuuuu

SEQ ID NO: 2684496 - RNA, 14 nt, Haemophilus influenzae Rd
accgauuuugacuu

SEQ ID NO: 2684497 - RNA, 14 nt, Haemophilus influenzae Rd
accgcaaaaauacu

SEQ ID NO: 2684498 - RNA, 18 nt, Haemophilus influenzae Rd
accgcaaaaauacuaacu

SEQ ID NO: 2684499 - RNA, 15 nt, Haemophilus influenzae Rd
accgcacuuaauaaa

SEQ ID NO: 2684500 - RNA, 16 nt, Haemophilus influenzae Rd
accgcacuuuaaacug

SEQ ID NO: 2684501 - RNA, 19 nt, Haemophilus influenzae Rd
accgcacuuuaaauauuua

SEQ ID NO: 2684502 - RNA, 22 nt, Haemophilus influenzae Rd
accgcacuuuaaauauuuaaaa

SEQ ID NO: 2684503 - RNA, 17 nt, Haemophilus influenzae Rd
accgcacuuuaaucucu

SEQ ID NO: 2684504 - RNA, 14 nt, Haemophilus influenzae Rd
accgcacuuuagaa

SEQ ID NO: 2684505 - RNA, 16 nt, Haemophilus influenzae Rd
accgcacuuuagaaaa

SEQ ID NO: 2684506 - RNA, 13 nt, Haemophilus influenzae Rd
accgcacuuucuu

SEQ ID NO: 2684507 - RNA, 16 nt, Haemophilus influenzae Rd
accgcacuuucuucuu

SEQ ID NO: 2684508 - RNA, 17 nt, Haemophilus influenzae Rd
accgcacuuugauuuug

SEQ ID NO: 2684509 - RNA, 21 nt, Haemophilus influenzae Rd
accgcacuuuuauccaccagc

SEQ ID NO: 2684510 - RNA, 23 nt, Haemophilus influenzae Rd
accgcacuuuuauccaccagcac

SEQ ID NO: 2684511 - RNA, 21 nt, Haemophilus influenzae Rd
accgcacuuuugagugcugua

SEQ ID NO: 2684512 - RNA, 16 nt, Haemophilus influenzae Rd
accgcacuuuugcgau

SEQ ID NO: 2684513 - RNA, 15 nt, Haemophilus influenzae Rd
accgcacuuuuguau

SEQ ID NO: 2684514 - RNA, 22 nt, Haemophilus influenzae Rd
accgcacuuuugugauuaaaau

SEQ ID NO: 2684515 - RNA, 16 nt, Haemophilus influenzae Rd
accgcacuuuuuacuu

SEQ ID NO: 2684516 - RNA, 21 nt, Haemophilus influenzae Rd
accgcacuuuuuauauuuuuu

SEQ ID NO: 2684517 - RNA, 22 nt, Haemophilus influenzae Rd
accgcacuuuuuaucuaaaaaa

SEQ ID NO: 2684518 - RNA, 23 nt, Haemophilus influenzae Rd
accgcacuuuuuauuagauggaa

SEQ ID NO: 2684519 - RNA, 17 nt, Haemophilus influenzae Rd
accgcacuuuuuuguau

SEQ ID NO: 2684520 - RNA, 19 nt, Haemophilus influenzae Rd
accgcacuuuuuuguuuuc

SEQ ID NO: 2684521 - RNA, 23 nt, Haemophilus influenzae Rd
accgcacuuuuuuguuuucagga

SEQ ID NO: 2684522 - RNA, 16 nt, Haemophilus influenzae Rd
accgcacuuuuuuuau

SEQ ID NO: 2684523 - RNA, 22 nt, Haemophilus influenzae Rd
accgcagcagguuuuccuacag

SEQ ID NO: 2684524 - RNA, 16 nt, Haemophilus influenzae Rd
accgcagcuaauccaa

SEQ ID NO: 2684525 - RNA, 12 nt, Haemophilus influenzae Rd
accgcaucaaaa

SEQ ID NO: 2684526 - RNA, 22 nt, Haemophilus influenzae Rd
accgcaucaaaauuauaaacca

SEQ ID NO: 2684527 - RNA, 20 nt, Haemophilus influenzae Rd
accgcauuguaaaccaaauu

SEQ ID NO: 2684528 - RNA, 19 nt, Haemophilus influenzae Rd
accgcauuuuuaauuuuua

SEQ ID NO: 2684529 - RNA, 17 nt, Haemophilus influenzae Rd
accgccaaaaauuaaua

SEQ ID NO: 2684530 - RNA, 16 nt, Haemophilus influenzae Rd
accgccagugauuuuu

SEQ ID NO: 2684531 - RNA, 19 nt, Haemophilus influenzae Rd
accgccgaaauucccauuu

SEQ ID NO: 2684532 - RNA, 23 nt, Haemophilus influenzae Rd
accgccguauugaauaauuacuu

SEQ ID NO: 2684533 - RNA, 21 nt, Haemophilus influenzae Rd
accgccuaaaguuacacaaug

SEQ ID NO: 2684534 - RNA, 17 nt, Haemophilus influenzae Rd
accgcgaucuguuuuaa

SEQ ID NO: 2684535 - RNA, 13 nt, Haemophilus influenzae Rd
accgcguaaaaau

SEQ ID NO: 2684536 - RNA, 15 nt, Haemophilus influenzae Rd
accgcuauuuuuaau

SEQ ID NO: 2684537 - RNA, 19 nt, Haemophilus influenzae Rd
accgcucaacuuaaacaag

SEQ ID NO: 2684538 - RNA, 22 nt, Haemophilus influenzae Rd
accgcucaacuuaaacaagcuc

SEQ ID NO: 2684539 - RNA, 21 nt, Haemophilus influenzae Rd
accgcucauugcugcuuuaau

SEQ ID NO: 2684540 - RNA, 20 nt, Haemophilus influenzae Rd
accgcugucauauucauuuu

SEQ ID NO: 2684541 - RNA, 22 nt, Haemophilus influenzae Rd
accgcuugaauaucuuguuuua

SEQ ID NO: 2684542 - RNA, 16 nt, Haemophilus influenzae Rd
accgcuugcaaccauc

SEQ ID NO: 2684543 - RNA, 13 nt, Haemophilus influenzae Rd
accgcuuuaucaa

SEQ ID NO: 2684544 - RNA, 15 nt, Haemophilus influenzae Rd
accgcuuucaauuaa

SEQ ID NO: 2684545 - RNA, 16 nt, Haemophilus influenzae Rd
accgggcgauaaaauc

SEQ ID NO: 2684546 - RNA, 15 nt, Haemophilus influenzae Rd
accgguacagaugcc

SEQ ID NO: 2684547 - RNA, 17 nt, Haemophilus influenzae Rd
accgguuacuuggauga

SEQ ID NO: 2684548 - RNA, 20 nt, Haemophilus influenzae Rd
accguauuuuuuuaauuuuu

SEQ ID NO: 2684549 - RNA, 21 nt, Haemophilus influenzae Rd
accguauuuuuuuaauuuuuu

SEQ ID NO: 2684550 - RNA, 22 nt, Haemophilus influenzae Rd
accgucaugggauaaacauuuc

SEQ ID NO: 2684551 - RNA, 21 nt, Haemophilus influenzae Rd
accgucuaaaaauccugaaga

SEQ ID NO: 2684552 - RNA, 14 nt, Haemophilus influenzae Rd
accgugggugugaa

SEQ ID NO: 2684553 - RNA, 13 nt, Haemophilus influenzae Rd
accguuaauacuu

SEQ ID NO: 2684554 - RNA, 19 nt, Haemophilus influenzae Rd
accguucuauauuuugaau

SEQ ID NO: 2684555 - RNA, 18 nt, Haemophilus influenzae Rd
accguuuacguuaagugc

SEQ ID NO: 2684556 - RNA, 17 nt, Haemophilus influenzae Rd
accguuugacguaucca

SEQ ID NO: 2684557 - RNA, 23 nt, Haemophilus influenzae Rd
accguuuuuauuuguucuacuuu

SEQ ID NO: 2684558 - RNA, 21 nt, Haemophilus influenzae Rd
accguuuuuucuuuuuccuga

SEQ ID NO: 2684559 - RNA, 19 nt, Haemophilus influenzae Rd
accuaaaaauuuaaauaua

SEQ ID NO: 2684560 - RNA, 23 nt, Haemophilus influenzae Rd
accuaaaaauuuuaggugcuuuu

SEQ ID NO: 2684561 - RNA, 16 nt, Haemophilus influenzae Rd
accuaaaccuucccca

SEQ ID NO: 2684562 - RNA, 16 nt, Haemophilus influenzae Rd
accuaaagagugacca

SEQ ID NO: 2684563 - RNA, 13 nt, Haemophilus influenzae Rd
accuaaagccaag

SEQ ID NO: 2684564 - RNA, 22 nt, Haemophilus influenzae Rd
accuaaaugagaaaaauccugu

SEQ ID NO: 2684565 - RNA, 18 nt, Haemophilus influenzae Rd
accuaaauuguugcucug

SEQ ID NO: 2684566 - RNA, 24 nt, Haemophilus influenzae Rd
accuaacauacugcuuucuagaug

SEQ ID NO: 2684567 - RNA, 23 nt, Haemophilus influenzae Rd
accuaauggauauagaaaucaua

SEQ ID NO: 2684568 - RNA, 19 nt, Haemophilus influenzae Rd
accuacacccacugauuuu

SEQ ID NO: 2684569 - RNA, 15 nt, Haemophilus influenzae Rd
accuacauuaaucac

SEQ ID NO: 2684570 - RNA, 15 nt, Haemophilus influenzae Rd
accuaccggaaacca

SEQ ID NO: 2684571 - RNA, 17 nt, Haemophilus influenzae Rd
accuacugguguagaug

SEQ ID NO: 2684572 - RNA, 15 nt, Haemophilus influenzae Rd
acgagccaauacagc

SEQ ID NO: 2684573 - RNA, 15 nt, Haemophilus influenzae Rd
acgaguaaauuaauu

SEQ ID NO: 2684574 - RNA, 15 nt, Haemophilus influenzae Rd
acgaguauauugcau

SEQ ID NO: 2684575 - RNA, 13 nt, Haemophilus influenzae Rd
acgauaagaaugu

SEQ ID NO: 2684576 - RNA, 13 nt, Haemophilus influenzae Rd
acgauaauauuuu

SEQ ID NO: 2684577 - RNA, 19 nt, Haemophilus influenzae Rd
acgauaaugccauuugcuu

SEQ ID NO: 2684578 - RNA, 19 nt, Haemophilus influenzae Rd
acgauacuuuuaauuaaau

SEQ ID NO: 2684579 - RNA, 20 nt, Haemophilus influenzae Rd
acgauacuuuuaauuaaaua

SEQ ID NO: 2684580 - RNA, 17 nt, Haemophilus influenzae Rd
acgauagguaaacuuug

SEQ ID NO: 2684581 - RNA, 22 nt, Haemophilus influenzae Rd
acgauagguaaacuuuggaaua

SEQ ID NO: 2684582 - RNA, 15 nt, Haemophilus influenzae Rd
acgauauugcacaau

SEQ ID NO: 2684583 - RNA, 13 nt, Haemophilus influenzae Rd
acgauauuuuccu

SEQ ID NO: 2684584 - RNA, 14 nt, Haemophilus influenzae Rd
acgaucauaaauuu

SEQ ID NO: 2684585 - RNA, 23 nt, Haemophilus influenzae Rd
acgaucuaauacaguuucugguu

SEQ ID NO: 2684586 - RNA, 16 nt, Haemophilus influenzae Rd
acgaugauccaaaaau

SEQ ID NO: 2684587 - RNA, 20 nt, Haemophilus influenzae Rd
acgaugcaacgcauuagcau

SEQ ID NO: 2684588 - RNA, 16 nt, Haemophilus influenzae Rd
acgauuaaaaaugcuu

SEQ ID NO: 2684589 - RNA, 19 nt, Haemophilus influenzae Rd
acgauuaauaccaauaaua

SEQ ID NO: 2684590 - RNA, 17 nt, Haemophilus influenzae Rd
acgauuacaucuaaugc

SEQ ID NO: 2684591 - RNA, 15 nt, Haemophilus influenzae Rd
acgauucguuucagu

SEQ ID NO: 2684592 - RNA, 21 nt, Haemophilus influenzae Rd
acgauuuaauagcacagaaaa

SEQ ID NO: 2684593 - RNA, 13 nt, Haemophilus influenzae Rd
acgauuuuucucu

SEQ ID NO: 2684594 - RNA, 20 nt, Haemophilus influenzae Rd
acgauuuuuuuauaaaaaaa

SEQ ID NO: 2684595 - RNA, 21 nt, Haemophilus influenzae Rd
acgauuuuuuuauaaaaaaac

SEQ ID NO: 2684596 - RNA, 17 nt, Haemophilus influenzae Rd
acgcaaacuacaacuuu

SEQ ID NO: 2684597 - RNA, 18 nt, Haemophilus influenzae Rd
acgcaaacuacaacuuuu

SEQ ID NO: 2684598 - RNA, 19 nt, Haemophilus influenzae Rd
acgcaaccaucuuuaauuc

SEQ ID NO: 2684599 - RNA, 20 nt, Haemophilus influenzae Rd
acgcaagcgcguuuaucauc

SEQ ID NO: 2684600 - RNA, 17 nt, Haemophilus influenzae Rd
acgcaagcgguuaaauu

SEQ ID NO: 2684601 - RNA, 15 nt, Haemophilus influenzae Rd
acgcaagguauuuuu

SEQ ID NO: 2684602 - RNA, 20 nt, Haemophilus influenzae Rd
acgcaaugacgcgccuaaua

SEQ ID NO: 2684603 - RNA, 14 nt, Haemophilus influenzae Rd
acgcacacaacaaa

SEQ ID NO: 2684604 - RNA, 13 nt, Haemophilus influenzae Rd
acgcacaccaccu

SEQ ID NO: 2684605 - RNA, 17 nt, Haemophilus influenzae Rd
acgcacguaacaaaugc

SEQ ID NO: 2684606 - RNA, 18 nt, Haemophilus influenzae Rd
acgcauagaaauucacgc

SEQ ID NO: 2684607 - RNA, 19 nt, Haemophilus influenzae Rd
acgcauaucacgauaagca

SEQ ID NO: 2684608 - RNA, 21 nt, Haemophilus influenzae Rd
acgcauauuaguuaguuuuuu

SEQ ID NO: 2684609 - RNA, 15 nt, Haemophilus influenzae Rd
acgcauucuuucucu

SEQ ID NO: 2684610 - RNA, 18 nt, Haemophilus influenzae Rd
acgccaacgcuuaaugaa

SEQ ID NO: 2684611 - RNA, 17 nt, Haemophilus influenzae Rd
acgccaauuaauaacgc

SEQ ID NO: 2684612 - RNA, 21 nt, Haemophilus influenzae Rd
acgccagucacuucuucaaua

SEQ ID NO: 2684613 - RNA, 19 nt, Haemophilus influenzae Rd
acgccauaaacgcaccaca

SEQ ID NO: 2684614 - RNA, 14 nt, Haemophilus influenzae Rd
acgccaucaaccau

SEQ ID NO: 2684615 - RNA, 15 nt, Haemophilus influenzae Rd
acgccaucuuuaaag

SEQ ID NO: 2684616 - RNA, 22 nt, Haemophilus influenzae Rd
acgccaucuuuaaaguguuuuu

SEQ ID NO: 2684617 - RNA, 15 nt, Haemophilus influenzae Rd
acgccauuaccacug

SEQ ID NO: 2684618 - RNA, 16 nt, Haemophilus influenzae Rd
acgccauuaccacugc

SEQ ID NO: 2684619 - RNA, 19 nt, Haemophilus influenzae Rd
acgccauucacauucuuuu

SEQ ID NO: 2684620 - RNA, 23 nt, Haemophilus influenzae Rd
acgccauucacauucuuuuaaau

SEQ ID NO: 2684621 - RNA, 18 nt, Haemophilus influenzae Rd
acgccauuuucgguuaag

SEQ ID NO: 2684622 - RNA, 20 nt, Haemophilus influenzae Rd
acgccauuuucgguuaagua

SEQ ID NO: 2684623 - RNA, 21 nt, Haemophilus influenzae Rd
acgccauuuucgguuaaguaa

SEQ ID NO: 2684624 - RNA, 13 nt, Haemophilus influenzae Rd
acgcccaaauacu

SEQ ID NO: 2684625 - RNA, 16 nt, Haemophilus influenzae Rd
acgccuaauucaucuu

SEQ ID NO: 2684626 - RNA, 17 nt, Haemophilus influenzae Rd
acgccuaauucaucuuc

SEQ ID NO: 2684627 - RNA, 17 nt, Haemophilus influenzae Rd
acgccugcccaaguugu

SEQ ID NO: 2684628 - RNA, 16 nt, Haemophilus influenzae Rd
acgccuguggcaaaau

SEQ ID NO: 2684629 - RNA, 16 nt, Haemophilus influenzae Rd
acgccuucgaaugcuu

SEQ ID NO: 2684630 - RNA, 19 nt, Haemophilus influenzae Rd
acgccuuuaaaacgcgcau

SEQ ID NO: 2684631 - RNA, 22 nt, Haemophilus influenzae Rd
acgccuuuaaaacgcgcauuaa

SEQ ID NO: 2684632 - RNA, 17 nt, Haemophilus influenzae Rd
acgcgaguaaaauaaaa

SEQ ID NO: 2684633 - RNA, 15 nt, Haemophilus influenzae Rd
acgcgaugaauuuaa

SEQ ID NO: 2684634 - RNA, 18 nt, Haemophilus influenzae Rd
acgcgcaaauuuucguuu

SEQ ID NO: 2684635 - RNA, 14 nt, Haemophilus influenzae Rd
acgcgcaauuucag

SEQ ID NO: 2684636 - RNA, 23 nt, Haemophilus influenzae Rd
acgcgcaauuucagcacccacau

SEQ ID NO: 2684637 - RNA, 17 nt, Haemophilus influenzae Rd
acgcgcacauacuucuu

SEQ ID NO: 2684638 - RNA, 17 nt, Haemophilus influenzae Rd
acgcgcuacaauauuua

SEQ ID NO: 2684639 - RNA, 21 nt, Haemophilus influenzae Rd
acgcgcugauucuaaugccau

SEQ ID NO: 2684640 - RNA, 23 nt, Haemophilus influenzae Rd
acgcggucagaaauauguuuuac

SEQ ID NO: 2684641 - RNA, 13 nt, Haemophilus influenzae Rd
acgcguacuuuuu

SEQ ID NO: 2684642 - RNA, 11 nt, Haemophilus influenzae Rd
acgcguuaaau

SEQ ID NO: 2684643 - RNA, 13 nt, Haemophilus influenzae Rd
acgcguuaauuuu

SEQ ID NO: 2684644 - RNA, 20 nt, Haemophilus influenzae Rd
acgcguuuuuacauauucga

SEQ ID NO: 2684645 - RNA, 18 nt, Haemophilus influenzae Rd
acgcuacccguauuaaau

SEQ ID NO: 2684646 - RNA, 18 nt, Haemophilus influenzae Rd
acgcuaucuuuugguaaa

SEQ ID NO: 2684647 - RNA, 20 nt, Haemophilus influenzae Rd
acgcucaaaaauuucagaau

SEQ ID NO: 2684648 - RNA, 16 nt, Haemophilus influenzae Rd
acgcucaaucucuuua

SEQ ID NO: 2684649 - RNA, 23 nt, Haemophilus influenzae Rd
acgcuccauuaccguaugcaaac

SEQ ID NO: 2684650 - RNA, 20 nt, Haemophilus influenzae Rd
acgcuccucugcauucugaa

SEQ ID NO: 2684651 - RNA, 21 nt, Haemophilus influenzae Rd
acgcucgaggguuaagauuau

SEQ ID NO: 2684652 - RNA, 17 nt, Haemophilus influenzae Rd
acgcucguuaaaucacg

SEQ ID NO: 2684653 - RNA, 22 nt, Haemophilus influenzae Rd
acgcucuacauuuacaucuaaa

SEQ ID NO: 2684654 - RNA, 21 nt, Haemophilus influenzae Rd
acgcugacguacaauuucaaa

SEQ ID NO: 2684655 - RNA, 18 nt, Haemophilus influenzae Rd
acgcuguucuucuaaugu

SEQ ID NO: 2684656 - RNA, 23 nt, Haemophilus influenzae Rd
acgcuguucuucuaauguaguug

SEQ ID NO: 2684657 - RNA, 19 nt, Haemophilus influenzae Rd
acgcuguuuugcuuccuua

SEQ ID NO: 2684658 - RNA, 13 nt, Haemophilus influenzae Rd
acgcuuaaccauc

SEQ ID NO: 2684659 - RNA, 15 nt, Haemophilus influenzae Rd
acgcuuacucauuua

SEQ ID NO: 2684660 - RNA, 22 nt, Haemophilus influenzae Rd
acgcuuacucauuuaucaaaca

SEQ ID NO: 2684661 - RNA, 17 nt, Haemophilus influenzae Rd
acgcuugaauaaauccc

SEQ ID NO: 2684662 - RNA, 15 nt, Haemophilus influenzae Rd
acgcuuggaaauguu

SEQ ID NO: 2684663 - RNA, 19 nt, Haemophilus influenzae Rd
acgcuugggcuuuuucaau

SEQ ID NO: 2684664 - RNA, 17 nt, Haemophilus influenzae Rd
acggaaaguauuuucuu

SEQ ID NO: 2684665 - RNA, 20 nt, Haemophilus influenzae Rd
acggaagauuuacccaacaa

SEQ ID NO: 2684666 - RNA, 18 nt, Haemophilus influenzae Rd
acggaaguggauauuuuu

SEQ ID NO: 2684667 - RNA, 16 nt, Haemophilus influenzae Rd
acggauaauuucccua

SEQ ID NO: 2684668 - RNA, 21 nt, Haemophilus influenzae Rd
acggauuggaccguuugguaa

SEQ ID NO: 2684669 - RNA, 17 nt, Haemophilus influenzae Rd
acggcaaaaucauuaaa

SEQ ID NO: 2684670 - RNA, 17 nt, Haemophilus influenzae Rd
acggcaagcaaacagca

SEQ ID NO: 2684671 - RNA, 17 nt, Haemophilus influenzae Rd
acggcaauuggauaaaa

SEQ ID NO: 2684672 - RNA, 23 nt, Haemophilus influenzae Rd
acggcauaauccgcugcagcuuc

SEQ ID NO: 2684673 - RNA, 16 nt, Haemophilus influenzae Rd
acggcgcguaaaucag

SEQ ID NO: 2684674 - RNA, 17 nt, Haemophilus influenzae Rd
acggcguagaaugcaaa

SEQ ID NO: 2684675 - RNA, 18 nt, Haemophilus influenzae Rd
acggcuaaauugugccgc

SEQ ID NO: 2684676 - RNA, 18 nt, Haemophilus influenzae Rd
acggcuuagauaauaaaa

SEQ ID NO: 2684677 - RNA, 12 nt, Haemophilus influenzae Rd
acuaaauucagu

SEQ ID NO: 2684678 - RNA, 22 nt, Haemophilus influenzae Rd
acuaaauucaguaagaaaccaa

SEQ ID NO: 2684679 - RNA, 20 nt, Haemophilus influenzae Rd
acuaaauuuaguugguaaag

SEQ ID NO: 2684680 - RNA, 12 nt, Haemophilus influenzae Rd
acuaacuuuccu

SEQ ID NO: 2684681 - RNA, 13 nt, Haemophilus influenzae Rd
acuaacuuuccua

SEQ ID NO: 2684682 - RNA, 14 nt, Haemophilus influenzae Rd
acuaagaaagcuaa

SEQ ID NO: 2684683 - RNA, 19 nt, Haemophilus influenzae Rd
acuaagcuuuuuuuaauca

SEQ ID NO: 2684684 - RNA, 22 nt, Haemophilus influenzae Rd
acuaaggccgcucuuuggaaug

SEQ ID NO: 2684685 - RNA, 13 nt, Haemophilus influenzae Rd
acuaauaaaccaa

SEQ ID NO: 2684686 - RNA, 15 nt, Haemophilus influenzae Rd
acuaauaaaccaaua

SEQ ID NO: 2684687 - RNA, 18 nt, Haemophilus influenzae Rd
acuaauacuucauaguga

SEQ ID NO: 2684688 - RNA, 14 nt, Haemophilus influenzae Rd
acuaauagcgugaa

SEQ ID NO: 2684689 - RNA, 16 nt, Haemophilus influenzae Rd
acuaauaggaguaaaa

SEQ ID NO: 2684690 - RNA, 19 nt, Haemophilus influenzae Rd
acuaauaggaguaaaaaua

SEQ ID NO: 2684691 - RNA, 20 nt, Haemophilus influenzae Rd
acuaauaggaguaaaaauau

SEQ ID NO: 2684692 - RNA, 22 nt, Haemophilus influenzae Rd
acuaaucgaccuucugcaucag

SEQ ID NO: 2684693 - RNA, 20 nt, Haemophilus influenzae Rd
acuaaucuaaacuuguuaaa

SEQ ID NO: 2684694 - RNA, 12 nt, Haemophilus influenzae Rd
acuaauuaaaag

SEQ ID NO: 2684695 - RNA, 13 nt, Haemophilus influenzae Rd
acuaauuaaaagg

SEQ ID NO: 2684696 - RNA, 15 nt, Haemophilus influenzae Rd
acuaauuaaaaggac

SEQ ID NO: 2684697 - RNA, 17 nt, Haemophilus influenzae Rd
acuaauuaguuuuuaau

SEQ ID NO: 2684698 - RNA, 22 nt, Haemophilus influenzae Rd
acuaauucaagcaaauauuuag

SEQ ID NO: 2684699 - RNA, 20 nt, Haemophilus influenzae Rd
acuaauucauuacauaauac

SEQ ID NO: 2684700 - RNA, 16 nt, Haemophilus influenzae Rd
acuaauucguuucuug

SEQ ID NO: 2684701 - RNA, 21 nt, Haemophilus influenzae Rd
acuaauucguuucuugguuua

SEQ ID NO: 2684702 - RNA, 20 nt, Haemophilus influenzae Rd
acuaauugcauuaaaagucu

SEQ ID NO: 2684703 - RNA, 14 nt, Haemophilus influenzae Rd
acuaauugugguaa

SEQ ID NO: 2684704 - RNA, 16 nt, Haemophilus influenzae Rd
acuaauuuauuaaaaa

SEQ ID NO: 2684705 - RNA, 20 nt, Haemophilus influenzae Rd
acuaauuucacaccauuuuu

SEQ ID NO: 2684706 - RNA, 23 nt, Haemophilus influenzae Rd
acuaauuucacaccauuuuuaau

SEQ ID NO: 2684707 - RNA, 11 nt, Haemophilus influenzae Rd
acuaauuucau

SEQ ID NO: 2684708 - RNA, 14 nt, Haemophilus influenzae Rd
acuaauuugcacac

SEQ ID NO: 2684709 - RNA, 19 nt, Haemophilus influenzae Rd
acuaauuugcacacuuaaa

SEQ ID NO: 2684710 - RNA, 20 nt, Haemophilus influenzae Rd
acuaauuugcacacuuaaac

SEQ ID NO: 2684711 - RNA, 21 nt, Haemophilus influenzae Rd
acuaauuugggugcagauuuu

SEQ ID NO: 2684712 - RNA, 21 nt, Haemophilus influenzae Rd
acuaauuuguggaaauugcca

SEQ ID NO: 2684713 - RNA, 15 nt, Haemophilus influenzae Rd
acuaauuuuaguauu

SEQ ID NO: 2684714 - RNA, 18 nt, Haemophilus influenzae Rd
acuaauuuuuuaauuuuu

SEQ ID NO: 2684715 - RNA, 13 nt, Haemophilus influenzae Rd
acuacaaacaaau

SEQ ID NO: 2684716 - RNA, 18 nt, Haemophilus influenzae Rd
acuacaaacaaauuuuua

SEQ ID NO: 2684717 - RNA, 22 nt, Haemophilus influenzae Rd
acuacaacuucaucaauggcau

SEQ ID NO: 2684718 - RNA, 23 nt, Haemophilus influenzae Rd
acuacaacuuuuuauuuucugca

SEQ ID NO: 2684719 - RNA, 21 nt, Haemophilus influenzae Rd
acuacacccucaguuaccaua

SEQ ID NO: 2684720 - RNA, 13 nt, Haemophilus influenzae Rd
acuacagcccaau

SEQ ID NO: 2684721 - RNA, 19 nt, Haemophilus influenzae Rd
acuacaucagguuuaauaa

SEQ ID NO: 2684722 - RNA, 20 nt, Haemophilus influenzae Rd
acuacgauuuaauguauaaa

SEQ ID NO: 2684723 - RNA, 18 nt, Haemophilus influenzae Rd
acuacggcguagaaugca

SEQ ID NO: 2684724 - RNA, 21 nt, Haemophilus influenzae Rd
acuacguaaagagagcauauu

SEQ ID NO: 2684725 - RNA, 18 nt, Haemophilus influenzae Rd
acuacuaacguuucuaau

SEQ ID NO: 2684726 - RNA, 23 nt, Haemophilus influenzae Rd
acuacuaacguuucuaauaccaa

SEQ ID NO: 2684727 - RNA, 24 nt, Haemophilus influenzae Rd
acuacuugaacuaauaucacuuug

SEQ ID NO: 2684728 - RNA, 22 nt, Haemophilus influenzae Rd
acuacuugacguaaugcuccag

SEQ ID NO: 2684729 - RNA, 18 nt, Haemophilus influenzae Rd
acuacuuuccaauuccau

SEQ ID NO: 2684730 - RNA, 23 nt, Haemophilus influenzae Rd
acuagauaaacgcuguuuugcuu

SEQ ID NO: 2684731 - RNA, 16 nt, Haemophilus influenzae Rd
acuagauauaaaaacu

SEQ ID NO: 2684732 - RNA, 13 nt, Haemophilus influenzae Rd
acuagauuuucuu

SEQ ID NO: 2684733 - RNA, 23 nt, Haemophilus influenzae Rd
acuagauuuucuucaucauacaa

SEQ ID NO: 2684734 - RNA, 14 nt, Haemophilus influenzae Rd
acuagccauaaaua

SEQ ID NO: 2684735 - RNA, 20 nt, Haemophilus influenzae Rd
acuagcuccuugauauucaa

SEQ ID NO: 2684736 - RNA, 20 nt, Haemophilus influenzae Rd
acuaguucagcgauuuuaac

SEQ ID NO: 2684737 - RNA, 15 nt, Haemophilus influenzae Rd
acuaguucaucauca

SEQ ID NO: 2684738 - RNA, 13 nt, Haemophilus influenzae Rd
acuauaaaauacu

SEQ ID NO: 2684739 - RNA, 16 nt, Haemophilus influenzae Rd
acuauaauuagaucau

SEQ ID NO: 2684740 - RNA, 17 nt, Haemophilus influenzae Rd
acuauauacauuaacaa

SEQ ID NO: 2684741 - RNA, 17 nt, Haemophilus influenzae Rd
acuauauccaaaucaaa

SEQ ID NO: 2684742 - RNA, 23 nt, Haemophilus influenzae Rd
acuaucauaacgggcauuuuucu

SEQ ID NO: 2684743 - RNA, 21 nt, Haemophilus influenzae Rd
acuaucauccgcuuguaauuu

SEQ ID NO: 2684744 - RNA, 21 nt, Haemophilus influenzae Rd
acuaucuguuuuaccugaaaa

SEQ ID NO: 2684745 - RNA, 18 nt, Haemophilus influenzae Rd
acuauuaaguucaaauuu

SEQ ID NO: 2684746 - RNA, 20 nt, Haemophilus influenzae Rd
acuauuaaguucaaauuucu

SEQ ID NO: 2684747 - RNA, 21 nt, Haemophilus influenzae Rd
acuauuaaguucaaauuucuu

SEQ ID NO: 2684748 - RNA, 17 nt, Haemophilus influenzae Rd
acuauuaauucucuuuc

SEQ ID NO: 2684749 - RNA, 19 nt, Haemophilus influenzae Rd
acuauuaauucucuuucca

SEQ ID NO: 2684750 - RNA, 16 nt, Haemophilus influenzae Rd
acuauuacaagauaau

SEQ ID NO: 2684751 - RNA, 16 nt, Haemophilus influenzae Rd
acuauuaccuaaccaa

SEQ ID NO: 2684752 - RNA, 12 nt, Haemophilus influenzae Rd
acuauuaucuac

SEQ ID NO: 2684753 - RNA, 16 nt, Haemophilus influenzae Rd
acuauuaucuacuagc

SEQ ID NO: 2684754 - RNA, 16 nt, Haemophilus influenzae Rd
acuauucaaaugaaau

SEQ ID NO: 2684755 - RNA, 16 nt, Haemophilus influenzae Rd
acuauugaaaauuaaa

SEQ ID NO: 2684756 - RNA, 19 nt, Haemophilus influenzae Rd
acuauuuaaguguuuacua

SEQ ID NO: 2684757 - RNA, 23 nt, Haemophilus influenzae Rd
acuauuuaaguguuuacuauuaa

SEQ ID NO: 2684758 - RNA, 14 nt, Haemophilus influenzae Rd
acuauuucaucuuu

SEQ ID NO: 2684759 - RNA, 19 nt, Haemophilus influenzae Rd
acucaacaccgcaaaaaua

SEQ ID NO: 2684760 - RNA, 16 nt, Haemophilus influenzae Rd
acucaaugaauuaaaa

SEQ ID NO: 2684761 - RNA, 19 nt, Haemophilus influenzae Rd
acucaaugaauuaaaaguu

SEQ ID NO: 2684762 - RNA, 20 nt, Haemophilus influenzae Rd
acucacaagucuguaauuuu

SEQ ID NO: 2684763 - RNA, 22 nt, Haemophilus influenzae Rd
acucacaagucuguaauuuuac

SEQ ID NO: 2684764 - RNA, 13 nt, Haemophilus influenzae Rd
acucacaauaaua

SEQ ID NO: 2684765 - RNA, 16 nt, Haemophilus influenzae Rd
acucacaauaccaagu

SEQ ID NO: 2684766 - RNA, 17 nt, Haemophilus influenzae Rd
acucacaauaccaagug

SEQ ID NO: 2684767 - RNA, 15 nt, Haemophilus influenzae Rd
acucacauuguuucc

SEQ ID NO: 2684768 - RNA, 16 nt, Haemophilus influenzae Rd
acucaccauuuugccc

SEQ ID NO: 2684769 - RNA, 21 nt, Haemophilus influenzae Rd
acucaccauuuugcccaauuc

SEQ ID NO: 2684770 - RNA, 15 nt, Haemophilus influenzae Rd
acucacgauucuucc

SEQ ID NO: 2684771 - RNA, 20 nt, Haemophilus influenzae Rd
acucacggcaacuucugcgc

SEQ ID NO: 2684772 - RNA, 15 nt, Haemophilus influenzae Rd
acucacggcaauaau

SEQ ID NO: 2684773 - RNA, 21 nt, Haemophilus influenzae Rd
acucacucguggaauuucaua

SEQ ID NO: 2684774 - RNA, 17 nt, Haemophilus influenzae Rd
acucacuggcucaagua

SEQ ID NO: 2684775 - RNA, 22 nt, Haemophilus influenzae Rd
acucacuggcucaaguaaugcu

SEQ ID NO: 2684776 - RNA, 13 nt, Haemophilus influenzae Rd
acucacuuuuccu

SEQ ID NO: 2684777 - RNA, 21 nt, Haemophilus influenzae Rd
acucauccaaucaucagaaua

SEQ ID NO: 2684778 - RNA, 16 nt, Haemophilus influenzae Rd
acucaugaguuguuuu

SEQ ID NO: 2684779 - RNA, 11 nt, Haemophilus influenzae Rd
acucauuacac

SEQ ID NO: 2684780 - RNA, 17 nt, Haemophilus influenzae Rd
acucauuuaucaaacaa

SEQ ID NO: 2684781 - RNA, 21 nt, Haemophilus influenzae Rd
acuccaaaaguuggauuaaac

SEQ ID NO: 2684782 - RNA, 21 nt, Haemophilus influenzae Rd
acuuaaaaauaaaguaagcac

SEQ ID NO: 2684783 - RNA, 14 nt, Haemophilus influenzae Rd
acuuaaaagauuaa

SEQ ID NO: 2684784 - RNA, 22 nt, Haemophilus influenzae Rd
acuuaaaaucuugguuuaaauu

SEQ ID NO: 2684785 - RNA, 20 nt, Haemophilus influenzae Rd
acuuaaagcaccgcauuaau

SEQ ID NO: 2684786 - RNA, 15 nt, Haemophilus influenzae Rd
acuuaaaucuuuacc

SEQ ID NO: 2684787 - RNA, 20 nt, Haemophilus influenzae Rd
acuuaaauuuuuauaaaguu

SEQ ID NO: 2684788 - RNA, 21 nt, Haemophilus influenzae Rd
acuuaaauuuuuauaaaguuu

SEQ ID NO: 2684789 - RNA, 18 nt, Haemophilus influenzae Rd
acuuaaccaaauaggcac

SEQ ID NO: 2684790 - RNA, 20 nt, Haemophilus influenzae Rd
acuuaaccaaauaggcacau

SEQ ID NO: 2684791 - RNA, 16 nt, Haemophilus influenzae Rd
acuuaacgaaccauca

SEQ ID NO: 2684792 - RNA, 22 nt, Haemophilus influenzae Rd
acuuaaguugggcuuauuuguu

SEQ ID NO: 2684793 - RNA, 13 nt, Haemophilus influenzae Rd
acuuaauaaaaau

SEQ ID NO: 2684794 - RNA, 17 nt, Haemophilus influenzae Rd
acuuaaucaaauaagau

SEQ ID NO: 2684795 - RNA, 23 nt, Haemophilus influenzae Rd
acuuaaucacugaauuucauuca

SEQ ID NO: 2684796 - RNA, 13 nt, Haemophilus influenzae Rd
acuuaaucauuuu

SEQ ID NO: 2684797 - RNA, 17 nt, Haemophilus influenzae Rd
acuuaaugcaaaaucuu

SEQ ID NO: 2684798 - RNA, 15 nt, Haemophilus influenzae Rd
acuuaauuaaagaua

SEQ ID NO: 2684799 - RNA, 20 nt, Haemophilus influenzae Rd
acuuaauugacguaaaaguu

SEQ ID NO: 2684800 - RNA, 15 nt, Haemophilus influenzae Rd
acuuaauuucacauu

SEQ ID NO: 2684801 - RNA, 14 nt, Haemophilus influenzae Rd
acuuaauuucucag

SEQ ID NO: 2684802 - RNA, 18 nt, Haemophilus influenzae Rd
acuuaauuucuuaauuaa

SEQ ID NO: 2684803 - RNA, 20 nt, Haemophilus influenzae Rd
acuuaccgaucauuucugga

SEQ ID NO: 2684804 - RNA, 17 nt, Haemophilus influenzae Rd
acuuaccuaaaaauuua

SEQ ID NO: 2684805 - RNA, 17 nt, Haemophilus influenzae Rd
acuuacgccagcuaaag

SEQ ID NO: 2684806 - RNA, 19 nt, Haemophilus influenzae Rd
acuuacuacguguucauca

SEQ ID NO: 2684807 - RNA, 13 nt, Haemophilus influenzae Rd
acuuagauaaauu

SEQ ID NO: 2684808 - RNA, 14 nt, Haemophilus influenzae Rd
acuuagauaaauuc

SEQ ID NO: 2684809 - RNA, 14 nt, Haemophilus influenzae Rd
acuuagauauauua

SEQ ID NO: 2684810 - RNA, 16 nt, Haemophilus influenzae Rd
acuuagcccuuaaacu

SEQ ID NO: 2684811 - RNA, 16 nt, Haemophilus influenzae Rd
acuuaggaugauacaa

SEQ ID NO: 2684812 - RNA, 15 nt, Haemophilus influenzae Rd
acuuaguuuuaauuc

SEQ ID NO: 2684813 - RNA, 16 nt, Haemophilus influenzae Rd
acuuaucuaaaaagau

SEQ ID NO: 2684814 - RNA, 15 nt, Haemophilus influenzae Rd
acuuaucuuaaaaaa

SEQ ID NO: 2684815 - RNA, 17 nt, Haemophilus influenzae Rd
acuuaucuuaaaaaaga

SEQ ID NO: 2684816 - RNA, 17 nt, Haemophilus influenzae Rd
acuuaugugcaccuuca

SEQ ID NO: 2684817 - RNA, 21 nt, Haemophilus influenzae Rd
acuuauuagagugcagauuuu

SEQ ID NO: 2684818 - RNA, 18 nt, Haemophilus influenzae Rd
acuuauucaaacgcccuu

SEQ ID NO: 2684819 - RNA, 22 nt, Haemophilus influenzae Rd
acuuauucgguguucugcauca

SEQ ID NO: 2684820 - RNA, 18 nt, Haemophilus influenzae Rd
acuucaaauuguacuuuu

SEQ ID NO: 2684821 - RNA, 16 nt, Haemophilus influenzae Rd
acuucaaccacuucaa

SEQ ID NO: 2684822 - RNA, 21 nt, Haemophilus influenzae Rd
acuucaagugauuauuucucu

SEQ ID NO: 2684823 - RNA, 22 nt, Haemophilus influenzae Rd
acuucaauagauaaaucaaaac

SEQ ID NO: 2684824 - RNA, 16 nt, Haemophilus influenzae Rd
acuucaauuucaccgc

SEQ ID NO: 2684825 - RNA, 20 nt, Haemophilus influenzae Rd
acuucaauuuuuuaucaaau

SEQ ID NO: 2684826 - RNA, 15 nt, Haemophilus influenzae Rd
acuucaccaaucaca

SEQ ID NO: 2684827 - RNA, 17 nt, Haemophilus influenzae Rd
acuucaccgauauguuu

SEQ ID NO: 2684828 - RNA, 17 nt, Haemophilus influenzae Rd
acuucagcauaauguuu

SEQ ID NO: 2684829 - RNA, 16 nt, Haemophilus influenzae Rd
acuucaggguuuucau

SEQ ID NO: 2684830 - RNA, 21 nt, Haemophilus influenzae Rd
acuucaggguuuucaucauua

SEQ ID NO: 2684831 - RNA, 13 nt, Haemophilus influenzae Rd
acuucaucaaaac

SEQ ID NO: 2684832 - RNA, 17 nt, Haemophilus influenzae Rd
acuucaucaaaaccauc

SEQ ID NO: 2684833 - RNA, 13 nt, Haemophilus influenzae Rd
acuucauccauug

SEQ ID NO: 2684834 - RNA, 15 nt, Haemophilus influenzae Rd
acuucauccauugga

SEQ ID NO: 2684835 - RNA, 22 nt, Haemophilus influenzae Rd
acuucaucccauuuuugcgauu

SEQ ID NO: 2684836 - RNA, 22 nt, Haemophilus influenzae Rd
acuucauuaaaaccaauuuuuu

SEQ ID NO: 2684837 - RNA, 16 nt, Haemophilus influenzae Rd
acuuccacaggcuuga

SEQ ID NO: 2684838 - RNA, 19 nt, Haemophilus influenzae Rd
acuuccacaggcuugaguu

SEQ ID NO: 2684839 - RNA, 14 nt, Haemophilus influenzae Rd
acuuccacaucgcu

SEQ ID NO: 2684840 - RNA, 14 nt, Haemophilus influenzae Rd
acuuccgauuuuaa

SEQ ID NO: 2684841 - RNA, 15 nt, Haemophilus influenzae Rd
acuuccguuccccaa

SEQ ID NO: 2684842 - RNA, 16 nt, Haemophilus influenzae Rd
acuucgauauuuuccg

SEQ ID NO: 2684843 - RNA, 21 nt, Haemophilus influenzae Rd
acuucgcaggaauaucggcaa

SEQ ID NO: 2684844 - RNA, 16 nt, Haemophilus influenzae Rd
acuucgcuaauuuuuu

SEQ ID NO: 2684845 - RNA, 16 nt, Haemophilus influenzae Rd
acuucgcuuacguuca

SEQ ID NO: 2684846 - RNA, 17 nt, Haemophilus influenzae Rd
acuucggggaucauuuc

SEQ ID NO: 2684847 - RNA, 13 nt, Haemophilus influenzae Rd
acuucuaaaacca

SEQ ID NO: 2684848 - RNA, 14 nt, Haemophilus influenzae Rd
acuucuaaaaccaa

SEQ ID NO: 2684849 - RNA, 15 nt, Haemophilus influenzae Rd
acuucuaaaaccaau

SEQ ID NO: 2684850 - RNA, 18 nt, Haemophilus influenzae Rd
acuucuaaaggcuaaaua

SEQ ID NO: 2684851 - RNA, 12 nt, Haemophilus influenzae Rd
acuucuaugaag

SEQ ID NO: 2684852 - RNA, 22 nt, Haemophilus influenzae Rd
acuucuauguuugcaucaauca

SEQ ID NO: 2684853 - RNA, 17 nt, Haemophilus influenzae Rd
acuucucuuauuugugu

SEQ ID NO: 2684854 - RNA, 12 nt, Haemophilus influenzae Rd
acuucugcugca

SEQ ID NO: 2684855 - RNA, 17 nt, Haemophilus influenzae Rd
acuucuguaagcagcua

SEQ ID NO: 2684856 - RNA, 20 nt, Haemophilus influenzae Rd
acuucuuguggagauugcgc

SEQ ID NO: 2684857 - RNA, 18 nt, Haemophilus influenzae Rd
acuucuuuagcugcaaua

SEQ ID NO: 2684858 - RNA, 16 nt, Haemophilus influenzae Rd
acuugaacgauuuugu

SEQ ID NO: 2684859 - RNA, 16 nt, Haemophilus influenzae Rd
acuugaagucuauaaa

SEQ ID NO: 2684860 - RNA, 19 nt, Haemophilus influenzae Rd
acuugaauggcuaaagaaa

SEQ ID NO: 2684861 - RNA, 14 nt, Haemophilus influenzae Rd
acuugaauugaaga

SEQ ID NO: 2684862 - RNA, 15 nt, Haemophilus influenzae Rd
acuugaccagagcca

SEQ ID NO: 2684863 - RNA, 16 nt, Haemophilus influenzae Rd
acuugaccagagccaa

SEQ ID NO: 2684864 - RNA, 21 nt, Haemophilus influenzae Rd
acuugaccagagccaaauaca

SEQ ID NO: 2684865 - RNA, 18 nt, Haemophilus influenzae Rd
acuugacgguuuuuauua

SEQ ID NO: 2684866 - RNA, 23 nt, Haemophilus influenzae Rd
acuugacgguuuuuauuagagaa

SEQ ID NO: 2684867 - RNA, 15 nt, Haemophilus influenzae Rd
acuugacguaaugcu

SEQ ID NO: 2684868 - RNA, 23 nt, Haemophilus influenzae Rd
acuugacguuguucuucuguuaa

SEQ ID NO: 2684869 - RNA, 19 nt, Haemophilus influenzae Rd
acuugagaaaguaauggaa

SEQ ID NO: 2684870 - RNA, 13 nt, Haemophilus influenzae Rd
acuugagauuuuu

SEQ ID NO: 2684871 - RNA, 23 nt, Haemophilus influenzae Rd
acuugagccugaaucgacacauc

SEQ ID NO: 2684872 - RNA, 14 nt, Haemophilus influenzae Rd
acuugauaaucauu

SEQ ID NO: 2684873 - RNA, 21 nt, Haemophilus influenzae Rd
acuugauauaaguucuaaaua

SEQ ID NO: 2684874 - RNA, 18 nt, Haemophilus influenzae Rd
acuugaucaccuaucaca

SEQ ID NO: 2684875 - RNA, 23 nt, Haemophilus influenzae Rd
acuugaucggcuacuauacacau

SEQ ID NO: 2684876 - RNA, 23 nt, Haemophilus influenzae Rd
acuugauguuuuugaaguaaaaa

SEQ ID NO: 2684877 - RNA, 17 nt, Haemophilus influenzae Rd
acuugcaaaccaaccua

SEQ ID NO: 2684878 - RNA, 19 nt, Haemophilus influenzae Rd
acuugcaagggauuugaaa

SEQ ID NO: 2684879 - RNA, 18 nt, Haemophilus influenzae Rd
acuugcacaauuacuucu

SEQ ID NO: 2684880 - RNA, 17 nt, Haemophilus influenzae Rd
acuugcagcccaacagc

SEQ ID NO: 2684881 - RNA, 20 nt, Haemophilus influenzae Rd
acuugcaucuaaaaauaauu

SEQ ID NO: 2684882 - RNA, 17 nt, Haemophilus influenzae Rd
acuugccaaacauuacc

SEQ ID NO: 2684883 - RNA, 19 nt, Haemophilus influenzae Rd
acuugccacagguaaagaa

SEQ ID NO: 2684884 - RNA, 17 nt, Haemophilus influenzae Rd
acuugcgacuuggugga

SEQ ID NO: 2684885 - RNA, 15 nt, Haemophilus influenzae Rd
acuugcgauaucuuc

SEQ ID NO: 2684886 - RNA, 15 nt, Haemophilus influenzae Rd
acuugcguugauuuc

SEQ ID NO: 2684887 - RNA, 19 nt, Haemophilus influenzae Rd
acuuuuuagcucguugcca

SEQ ID NO: 2684888 - RNA, 21 nt, Haemophilus influenzae Rd
acuuuuuagcucguugccaua

SEQ ID NO: 2684889 - RNA, 16 nt, Haemophilus influenzae Rd
acuuuuuaucuaaaaa

SEQ ID NO: 2684890 - RNA, 17 nt, Haemophilus influenzae Rd
acuuuuuaucuaaaaaa

SEQ ID NO: 2684891 - RNA, 16 nt, Haemophilus influenzae Rd
acuuuuuaucuaaauu

SEQ ID NO: 2684892 - RNA, 18 nt, Haemophilus influenzae Rd
acuuuuuauuaguuacaa

SEQ ID NO: 2684893 - RNA, 20 nt, Haemophilus influenzae Rd
acuuuuuauuaguuacaaac

SEQ ID NO: 2684894 - RNA, 14 nt, Haemophilus influenzae Rd
acuuuuuauuuucu

SEQ ID NO: 2684895 - RNA, 15 nt, Haemophilus influenzae Rd
acuuuuuauuuucug

SEQ ID NO: 2684896 - RNA, 15 nt, Haemophilus influenzae Rd
acuuuuuauuuuucc

SEQ ID NO: 2684897 - RNA, 15 nt, Haemophilus influenzae Rd
acuuuuucaaugaaa

SEQ ID NO: 2684898 - RNA, 20 nt, Haemophilus influenzae Rd
acuuuuucagauacuuucua

SEQ ID NO: 2684899 - RNA, 13 nt, Haemophilus influenzae Rd
acuuuuucaucug

SEQ ID NO: 2684900 - RNA, 13 nt, Haemophilus influenzae Rd
acuuuuucaucuu

SEQ ID NO: 2684901 - RNA, 21 nt, Haemophilus influenzae Rd
acuuuuugacccgcuuuuaau

SEQ ID NO: 2684902 - RNA, 16 nt, Haemophilus influenzae Rd
acuuuuuguuuguaau

SEQ ID NO: 2684903 - RNA, 13 nt, Haemophilus influenzae Rd
acuuuuuuauaau

SEQ ID NO: 2684904 - RNA, 16 nt, Haemophilus influenzae Rd
acuuuuuuauaugcaa

SEQ ID NO: 2684905 - RNA, 20 nt, Haemophilus influenzae Rd
acuuuuuuaucgguuauuac

SEQ ID NO: 2684906 - RNA, 17 nt, Haemophilus influenzae Rd
acuuuuuugauaugcca

SEQ ID NO: 2684907 - RNA, 22 nt, Haemophilus influenzae Rd
acuuuuuuguauaaaaauuauu

SEQ ID NO: 2684908 - RNA, 15 nt, Haemophilus influenzae Rd
acuuuuuuuauaucu

SEQ ID NO: 2684909 - RNA, 15 nt, Haemophilus influenzae Rd
acuuuuuuucaucuc

SEQ ID NO: 2684910 - RNA, 16 nt, Haemophilus influenzae Rd
acuuuuuuucaucuca

SEQ ID NO: 2684911 - RNA, 13 nt, Haemophilus influenzae Rd
agaaaaaauauaa

SEQ ID NO: 2684912 - RNA, 17 nt, Haemophilus influenzae Rd
agaaaaagaaaaccugc

SEQ ID NO: 2684913 - RNA, 20 nt, Haemophilus influenzae Rd
agaaaaaucgaagaaauaug

SEQ ID NO: 2684914 - RNA, 22 nt, Haemophilus influenzae Rd
agaaaaaucuuuaccaaaaaau

SEQ ID NO: 2684915 - RNA, 23 nt, Haemophilus influenzae Rd
agaaaaaucuuuaccaaaaaauu

SEQ ID NO: 2684916 - RNA, 23 nt, Haemophilus influenzae Rd
agaaaaauugguacgagaaaaau

SEQ ID NO: 2684917 - RNA, 15 nt, Haemophilus influenzae Rd
agaaaacaaacgaug

SEQ ID NO: 2684918 - RNA, 20 nt, Haemophilus influenzae Rd
agaaaacaauaaaaaaacuu

SEQ ID NO: 2684919 - RNA, 22 nt, Haemophilus influenzae Rd
agaaaaccaaaacauaagaaau

SEQ ID NO: 2684920 - RNA, 16 nt, Haemophilus influenzae Rd
agaaaacucauccaau

SEQ ID NO: 2684921 - RNA, 21 nt, Haemophilus influenzae Rd
agaaaagcgaauuucuuaaaa

SEQ ID NO: 2684922 - RNA, 14 nt, Haemophilus influenzae Rd
agaaaauaauauaa

SEQ ID NO: 2684923 - RNA, 19 nt, Haemophilus influenzae Rd
agaaaauaaugaacgccgc

SEQ ID NO: 2684924 - RNA, 17 nt, Haemophilus influenzae Rd
agaaaauacaauaucua

SEQ ID NO: 2684925 - RNA, 20 nt, Haemophilus influenzae Rd
agaaaauacaauaucuagca

SEQ ID NO: 2684926 - RNA, 16 nt, Haemophilus influenzae Rd
agaaaauagaaagaau

SEQ ID NO: 2684927 - RNA, 23 nt, Haemophilus influenzae Rd
agaaaauagaaagaauauuuaau

SEQ ID NO: 2684928 - RNA, 17 nt, Haemophilus influenzae Rd
agaaaauagaauuugca

SEQ ID NO: 2684929 - RNA, 19 nt, Haemophilus influenzae Rd
agaaaauaucuuuggcuuu

SEQ ID NO: 2684930 - RNA, 15 nt, Haemophilus influenzae Rd
agaaaaucgcaauaa

SEQ ID NO: 2684931 - RNA, 23 nt, Haemophilus influenzae Rd
agaaaaucguauucucauuuuag

SEQ ID NO: 2684932 - RNA, 23 nt, Haemophilus influenzae Rd
agaaacaaauccugaaaguagau

SEQ ID NO: 2684933 - RNA, 12 nt, Haemophilus influenzae Rd
agaaacagaagu

SEQ ID NO: 2684934 - RNA, 15 nt, Haemophilus influenzae Rd
agaaacaggacaccg

SEQ ID NO: 2684935 - RNA, 12 nt, Haemophilus influenzae Rd
agaaacauugau

SEQ ID NO: 2684936 - RNA, 14 nt, Haemophilus influenzae Rd
agaaaccaauaauu

SEQ ID NO: 2684937 - RNA, 16 nt, Haemophilus influenzae Rd
agaaaccagaaauaga

SEQ ID NO: 2684938 - RNA, 17 nt, Haemophilus influenzae Rd
agaaaccagaaauagag

SEQ ID NO: 2684939 - RNA, 18 nt, Haemophilus influenzae Rd
agaaaccgcauauucuug

SEQ ID NO: 2684940 - RNA, 17 nt, Haemophilus influenzae Rd
agaaacguaaacaaaau

SEQ ID NO: 2684941 - RNA, 15 nt, Haemophilus influenzae Rd
agaaagaaaucccac

SEQ ID NO: 2684942 - RNA, 14 nt, Haemophilus influenzae Rd
agaaagaauauaaa

SEQ ID NO: 2684943 - RNA, 16 nt, Haemophilus influenzae Rd
agaaagaauauaaaua

SEQ ID NO: 2684944 - RNA, 15 nt, Haemophilus influenzae Rd
agaaagaauauuuaa

SEQ ID NO: 2684945 - RNA, 16 nt, Haemophilus influenzae Rd
agaaagacgauauuuu

SEQ ID NO: 2684946 - RNA, 16 nt, Haemophilus influenzae Rd
agaaagaguaauccaa

SEQ ID NO: 2684947 - RNA, 19 nt, Haemophilus influenzae Rd
agaaagauaggauuccacu

SEQ ID NO: 2684948 - RNA, 12 nt, Haemophilus influenzae Rd
agaaagauuaca

SEQ ID NO: 2684949 - RNA, 10 nt, Haemophilus influenzae Rd
agaaagcgac

SEQ ID NO: 2684950 - RNA, 13 nt, Haemophilus influenzae Rd
agaaagcggauuu

SEQ ID NO: 2684951 - RNA, 20 nt, Haemophilus influenzae Rd
agaaaggcaauauuuuagca

SEQ ID NO: 2684952 - RNA, 17 nt, Haemophilus influenzae Rd
agaaagggauuuuaauu

SEQ ID NO: 2684953 - RNA, 21 nt, Haemophilus influenzae Rd
agaaagguguaauuccauauu

SEQ ID NO: 2684954 - RNA, 13 nt, Haemophilus influenzae Rd
agaaaguaaacaa

SEQ ID NO: 2684955 - RNA, 15 nt, Haemophilus influenzae Rd
agaaaguaaacaauu

SEQ ID NO: 2684956 - RNA, 13 nt, Haemophilus influenzae Rd
agaaaguaaugga

SEQ ID NO: 2684957 - RNA, 13 nt, Haemophilus influenzae Rd
agaaaguauuaaa

SEQ ID NO: 2684958 - RNA, 14 nt, Haemophilus influenzae Rd
agaaaguucuaauu

SEQ ID NO: 2684959 - RNA, 20 nt, Haemophilus influenzae Rd
agaaaguuuaacuuucaaca

SEQ ID NO: 2684960 - RNA, 23 nt, Haemophilus influenzae Rd
agaaaguuuaacuuucaacacgg

SEQ ID NO: 2684961 - RNA, 12 nt, Haemophilus influenzae Rd
agaaaguuuuaa

SEQ ID NO: 2684962 - RNA, 12 nt, Haemophilus influenzae Rd
agaaaguuuuac

SEQ ID NO: 2684963 - RNA, 21 nt, Haemophilus influenzae Rd
agaaauaaacgcaucaacuuu

SEQ ID NO: 2684964 - RNA, 14 nt, Haemophilus influenzae Rd
agaaauaaauuuau

SEQ ID NO: 2684965 - RNA, 14 nt, Haemophilus influenzae Rd
agaaauaacgucau

SEQ ID NO: 2684966 - RNA, 14 nt, Haemophilus influenzae Rd
agaaauaaguugau

SEQ ID NO: 2684967 - RNA, 10 nt, Haemophilus influenzae Rd
agaaauaaua

SEQ ID NO: 2684968 - RNA, 12 nt, Haemophilus influenzae Rd
agaaauaauaua

SEQ ID NO: 2684969 - RNA, 24 nt, Haemophilus influenzae Rd
agaaauaaucucuuuauagccuau

SEQ ID NO: 2684970 - RNA, 17 nt, Haemophilus influenzae Rd
agaaauacauuauuaaa

SEQ ID NO: 2684971 - RNA, 18 nt, Haemophilus influenzae Rd
agaaauacauuauuaaaa

SEQ ID NO: 2684972 - RNA, 18 nt, Haemophilus influenzae Rd
agaaauaccgauaauaug

SEQ ID NO: 2684973 - RNA, 18 nt, Haemophilus influenzae Rd
agaaauagauuauuagca

SEQ ID NO: 2684974 - RNA, 23 nt, Haemophilus influenzae Rd
agaaauauaauaaauauguugaa

SEQ ID NO: 2684975 - RNA, 12 nt, Haemophilus influenzae Rd
agaaauauauuu

SEQ ID NO: 2684976 - RNA, 14 nt, Haemophilus influenzae Rd
agaaauauauuugu

SEQ ID NO: 2684977 - RNA, 16 nt, Haemophilus influenzae Rd
agaaauaucuucaauu

SEQ ID NO: 2684978 - RNA, 16 nt, Haemophilus influenzae Rd
agaaauaugaaauuuc

SEQ ID NO: 2684979 - RNA, 18 nt, Haemophilus influenzae Rd
agaaauaugauuuagaac

SEQ ID NO: 2684980 - RNA, 23 nt, Haemophilus influenzae Rd
agaaauaugauuuagaacaauau

SEQ ID NO: 2684981 - RNA, 21 nt, Haemophilus influenzae Rd
agaaauauugucuauuugcuu

SEQ ID NO: 2684982 - RNA, 14 nt, Haemophilus influenzae Rd
agaaauauuuuuac

SEQ ID NO: 2684983 - RNA, 15 nt, Haemophilus influenzae Rd
agaaaucaaaaaugc

SEQ ID NO: 2684984 - RNA, 21 nt, Haemophilus influenzae Rd
agaaaucacuaaauuucagcu

SEQ ID NO: 2684985 - RNA, 14 nt, Haemophilus influenzae Rd
agaaaucauaaacu

SEQ ID NO: 2684986 - RNA, 23 nt, Haemophilus influenzae Rd
agaaaucaucucuaaccuaaaau

SEQ ID NO: 2684987 - RNA, 17 nt, Haemophilus influenzae Rd
agaaaucauugcugcaa

SEQ ID NO: 2684988 - RNA, 17 nt, Haemophilus influenzae Rd
agaaauccacaaaaucu

SEQ ID NO: 2684989 - RNA, 18 nt, Haemophilus influenzae Rd
agaaaucccgcagggaug

SEQ ID NO: 2684990 - RNA, 18 nt, Haemophilus influenzae Rd
agaaaucguuugauauac

SEQ ID NO: 2684991 - RNA, 17 nt, Haemophilus influenzae Rd
agaaaucucuuucaauu

SEQ ID NO: 2684992 - RNA, 20 nt, Haemophilus influenzae Rd
agaaaucucuuucaauuuca

SEQ ID NO: 2684993 - RNA, 14 nt, Haemophilus influenzae Rd
agacaaauuaaauu

SEQ ID NO: 2684994 - RNA, 20 nt, Haemophilus influenzae Rd
agacaauauaauuaucaaca

SEQ ID NO: 2684995 - RNA, 15 nt, Haemophilus influenzae Rd
agacaauauugaaau

SEQ ID NO: 2684996 - RNA, 16 nt, Haemophilus influenzae Rd
agacaauauugaaaua

SEQ ID NO: 2684997 - RNA, 22 nt, Haemophilus influenzae Rd
agacagcgaguacgaaauacgc

SEQ ID NO: 2684998 - RNA, 15 nt, Haemophilus influenzae Rd
agacagcuauuaaaa

SEQ ID NO: 2684999 - RNA, 16 nt, Haemophilus influenzae Rd
agacagcuauuaaaaa

SEQ ID NO: 2685000 - RNA, 18 nt, Haemophilus influenzae Rd
agacagcuauuaaaaaaa

SEQ ID NO: 2685001 - RNA, 15 nt, Haemophilus influenzae Rd
agaccaaaaaucgca

SEQ ID NO: 2685002 - RNA, 15 nt, Haemophilus influenzae Rd
agaccaaacuccccu

SEQ ID NO: 2685003 - RNA, 13 nt, Haemophilus influenzae Rd
agaccacaugaau

SEQ ID NO: 2685004 - RNA, 19 nt, Haemophilus influenzae Rd
agaccacaugaauuucuaa

SEQ ID NO: 2685005 - RNA, 18 nt, Haemophilus influenzae Rd
agacccaccgcaaaagcc

SEQ ID NO: 2685006 - RNA, 23 nt, Haemophilus influenzae Rd
agaccgcacuuuaaaagugcggu

SEQ ID NO: 2685007 - RNA, 18 nt, Haemophilus influenzae Rd
agaccgcacuuugcacuu

SEQ ID NO: 2685008 - RNA, 18 nt, Haemophilus influenzae Rd
agacgauauuuuccuugu

SEQ ID NO: 2685009 - RNA, 14 nt, Haemophilus influenzae Rd
agacgauuuuagag

SEQ ID NO: 2685010 - RNA, 20 nt, Haemophilus influenzae Rd
agacgcauucuuucucuuuu

SEQ ID NO: 2685011 - RNA, 17 nt, Haemophilus influenzae Rd
agacgccuuuaaaacgc

SEQ ID NO: 2685012 - RNA, 17 nt, Haemophilus influenzae Rd
agacgcugcccaaauaa

SEQ ID NO: 2685013 - RNA, 19 nt, Haemophilus influenzae Rd
agacgcuguuucuuuucau

SEQ ID NO: 2685014 - RNA, 22 nt, Haemophilus influenzae Rd
agacgcuguuucuuuucaucuu

SEQ ID NO: 2685015 - RNA, 18 nt, Haemophilus influenzae Rd
agacggcgcguucuucug

SEQ ID NO: 2685016 - RNA, 15 nt, Haemophilus influenzae Rd
agacuaaaaccacau

SEQ ID NO: 2685017 - RNA, 19 nt, Haemophilus influenzae Rd
agacuaaaaccacaucauu

SEQ ID NO: 2685018 - RNA, 15 nt, Haemophilus influenzae Rd
agacuaauuuuuuaa

SEQ ID NO: 2685019 - RNA, 17 nt, Haemophilus influenzae Rd
agacuacuuaaaauuca

SEQ ID NO: 2685020 - RNA, 16 nt, Haemophilus influenzae Rd
agacuagugaaauauu

SEQ ID NO: 2685021 - RNA, 19 nt, Haemophilus influenzae Rd
agacuaugcguagaaagau

SEQ ID NO: 2685022 - RNA, 21 nt, Haemophilus influenzae Rd
agacucucugacuucuagcca

SEQ ID NO: 2685023 - RNA, 18 nt, Haemophilus influenzae Rd
agacucuguuccacaggu

SEQ ID NO: 2685024 - RNA, 17 nt, Haemophilus influenzae Rd
agacucuugcacuuggu

SEQ ID NO: 2685025 - RNA, 22 nt, Haemophilus influenzae Rd
agacugcauugcacgagcaaua

SEQ ID NO: 2685026 - RNA, 12 nt, Haemophilus influenzae Rd
agacuucaagug

SEQ ID NO: 2685027 - RNA, 17 nt, Haemophilus influenzae Rd
agacuuguaaauaccag

SEQ ID NO: 2685028 - RNA, 20 nt, Haemophilus influenzae Rd
agacuuucaagcaagccaca

SEQ ID NO: 2685029 - RNA, 14 nt, Haemophilus influenzae Rd
agagaaaacucaca

SEQ ID NO: 2685030 - RNA, 14 nt, Haemophilus influenzae Rd
agagaaaucaucaa

SEQ ID NO: 2685031 - RNA, 17 nt, Haemophilus influenzae Rd
agagaacguauuauuca

SEQ ID NO: 2685032 - RNA, 16 nt, Haemophilus influenzae Rd
agagaagcugaauaaa

SEQ ID NO: 2685033 - RNA, 17 nt, Haemophilus influenzae Rd
agagaauauuuagauua

SEQ ID NO: 2685034 - RNA, 19 nt, Haemophilus influenzae Rd
agagacucuguuccacagg

SEQ ID NO: 2685035 - RNA, 18 nt, Haemophilus influenzae Rd
agagauaauaaauauaau

SEQ ID NO: 2685036 - RNA, 17 nt, Haemophilus influenzae Rd
agagauugauuuucuuu

SEQ ID NO: 2685037 - RNA, 16 nt, Haemophilus influenzae Rd
agagauuguaugaaaa

SEQ ID NO: 2685038 - RNA, 18 nt, Haemophilus influenzae Rd
agagauuguaugaaaaau

SEQ ID NO: 2685039 - RNA, 20 nt, Haemophilus influenzae Rd
agagauuuagauaauaaaaa

SEQ ID NO: 2685040 - RNA, 14 nt, Haemophilus influenzae Rd
agagauuuuauuca

SEQ ID NO: 2685041 - RNA, 15 nt, Haemophilus influenzae Rd
agagauuuuauucau

SEQ ID NO: 2685042 - RNA, 16 nt, Haemophilus influenzae Rd
agagauuuuauucaua

SEQ ID NO: 2685043 - RNA, 14 nt, Haemophilus influenzae Rd
agagcaaauuuaaa

SEQ ID NO: 2685044 - RNA, 17 nt, Haemophilus influenzae Rd
agagcaaauuuaaauaa

SEQ ID NO: 2685045 - RNA, 13 nt, Haemophilus influenzae Rd
agagcaagcaaua

SEQ ID NO: 2685046 - RNA, 22 nt, Haemophilus influenzae Rd
agagcaggggauugaaaauccc

SEQ ID NO: 2685047 - RNA, 14 nt, Haemophilus influenzae Rd
agagccaaauacaa

SEQ ID NO: 2685048 - RNA, 15 nt, Haemophilus influenzae Rd
agagccaaauacaau

SEQ ID NO: 2685049 - RNA, 20 nt, Haemophilus influenzae Rd
agagccaguuggguuaaaua

SEQ ID NO: 2685050 - RNA, 15 nt, Haemophilus influenzae Rd
agagccuuuuucuaa

SEQ ID NO: 2685051 - RNA, 13 nt, Haemophilus influenzae Rd
agagcgucaaaau

SEQ ID NO: 2685052 - RNA, 19 nt, Haemophilus influenzae Rd
agagcuuagauacauaaaa

SEQ ID NO: 2685053 - RNA, 17 nt, Haemophilus influenzae Rd
agagcuucucuuuuuau

SEQ ID NO: 2685054 - RNA, 20 nt, Haemophilus influenzae Rd
agaggaaaaucgaucuaauc

SEQ ID NO: 2685055 - RNA, 21 nt, Haemophilus influenzae Rd
agaggaaucgugucaguaacu

SEQ ID NO: 2685056 - RNA, 14 nt, Haemophilus influenzae Rd
agaggaaucuaaua

SEQ ID NO: 2685057 - RNA, 14 nt, Haemophilus influenzae Rd
agaggagguagaaa

SEQ ID NO: 2685058 - RNA, 13 nt, Haemophilus influenzae Rd
agaggcaauuuua

SEQ ID NO: 2685059 - RNA, 17 nt, Haemophilus influenzae Rd
agaggggauaaaauaaa

SEQ ID NO: 2685060 - RNA, 18 nt, Haemophilus influenzae Rd
agaggggauaaaauaaac

SEQ ID NO: 2685061 - RNA, 23 nt, Haemophilus influenzae Rd
agaggggauaaaauaaacauuuu

SEQ ID NO: 2685062 - RNA, 18 nt, Haemophilus influenzae Rd
agaguaaguaaccauaaa

SEQ ID NO: 2685063 - RNA, 24 nt, Haemophilus influenzae Rd
agaguacgcccauugaaaauacag

SEQ ID NO: 2685064 - RNA, 14 nt, Haemophilus influenzae Rd
agagucaauccagu

SEQ ID NO: 2685065 - RNA, 18 nt, Haemophilus influenzae Rd
agagucauuuacagguug

SEQ ID NO: 2685066 - RNA, 20 nt, Haemophilus influenzae Rd
agagucgaugccaagggcug

SEQ ID NO: 2685067 - RNA, 17 nt, Haemophilus influenzae Rd
agagugaguuuggaaua

SEQ ID NO: 2685068 - RNA, 16 nt, Haemophilus influenzae Rd
agaguguuauaaagcu

SEQ ID NO: 2685069 - RNA, 15 nt, Haemophilus influenzae Rd
agaguuuuuucacuu

SEQ ID NO: 2685070 - RNA, 12 nt, Haemophilus influenzae Rd
agauaaaaaccu

SEQ ID NO: 2685071 - RNA, 13 nt, Haemophilus influenzae Rd
agauaaaaaccua

SEQ ID NO: 2685072 - RNA, 21 nt, Haemophilus influenzae Rd
agauaaaauaaaacccaguuu

SEQ ID NO: 2685073 - RNA, 12 nt, Haemophilus influenzae Rd
agauaaaauuuu

SEQ ID NO: 2685074 - RNA, 14 nt, Haemophilus influenzae Rd
agauaaaauuuuua

SEQ ID NO: 2685075 - RNA, 18 nt, Haemophilus influenzae Rd
agauaaacaaaccuaaac

SEQ ID NO: 2685076 - RNA, 20 nt, Haemophilus influenzae Rd
agauaaaucagcgaguuuga

SEQ ID NO: 2685077 - RNA, 13 nt, Haemophilus influenzae Rd
agauaaauuuuua

SEQ ID NO: 2685078 - RNA, 16 nt, Haemophilus influenzae Rd
agauaacaaugaaauc

SEQ ID NO: 2685079 - RNA, 13 nt, Haemophilus influenzae Rd
agauaacaucacg

SEQ ID NO: 2685080 - RNA, 15 nt, Haemophilus influenzae Rd
agauaacguaaguaa

SEQ ID NO: 2685081 - RNA, 21 nt, Haemophilus influenzae Rd
agauaacguaaguaaugaaaa

SEQ ID NO: 2685082 - RNA, 14 nt, Haemophilus influenzae Rd
agauaagaaaaucc

SEQ ID NO: 2685083 - RNA, 15 nt, Haemophilus influenzae Rd
agauaauauuccaaa

SEQ ID NO: 2685084 - RNA, 19 nt, Haemophilus influenzae Rd
agauaauauuccaaaaaau

SEQ ID NO: 2685085 - RNA, 22 nt, Haemophilus influenzae Rd
agauaauauuccaaaaaauaag

SEQ ID NO: 2685086 - RNA, 13 nt, Haemophilus influenzae Rd
agauaaucaaaaa

SEQ ID NO: 2685087 - RNA, 11 nt, Haemophilus influenzae Rd
agauaaugaua

SEQ ID NO: 2685088 - RNA, 21 nt, Haemophilus influenzae Rd
agauaaugguuacagaaauau

SEQ ID NO: 2685089 - RNA, 16 nt, Haemophilus influenzae Rd
agauaauuaaaauccc

SEQ ID NO: 2685090 - RNA, 15 nt, Haemophilus influenzae Rd
agauacaaaauguuu

SEQ ID NO: 2685091 - RNA, 20 nt, Haemophilus influenzae Rd
agauacaaauaacacagaaa

SEQ ID NO: 2685092 - RNA, 13 nt, Haemophilus influenzae Rd
agauacaagaaag

SEQ ID NO: 2685093 - RNA, 19 nt, Haemophilus influenzae Rd
agauacacucacuuuuccu

SEQ ID NO: 2685094 - RNA, 23 nt, Haemophilus influenzae Rd
agauacagaaggauccauuacaa

SEQ ID NO: 2685095 - RNA, 18 nt, Haemophilus influenzae Rd
agauacauaaaaaacaca

SEQ ID NO: 2685096 - RNA, 21 nt, Haemophilus influenzae Rd
agauacauuuaaugaugaaac

SEQ ID NO: 2685097 - RNA, 13 nt, Haemophilus influenzae Rd
agauaccaauaau

SEQ ID NO: 2685098 - RNA, 21 nt, Haemophilus influenzae Rd
agauagagccaacucaucaaa

SEQ ID NO: 2685099 - RNA, 12 nt, Haemophilus influenzae Rd
agcaaaucaaaa

SEQ ID NO: 2685100 - RNA, 23 nt, Haemophilus influenzae Rd
agcaaauccuugaaucauuucau

SEQ ID NO: 2685101 - RNA, 22 nt, Haemophilus influenzae Rd
agcaaauuacccaaaugaugaa

SEQ ID NO: 2685102 - RNA, 12 nt, Haemophilus influenzae Rd
agcaaauuaucu

SEQ ID NO: 2685103 - RNA, 13 nt, Haemophilus influenzae Rd
agcaaauuaucug

SEQ ID NO: 2685104 - RNA, 13 nt, Haemophilus influenzae Rd
agcaacaauauua

SEQ ID NO: 2685105 - RNA, 14 nt, Haemophilus influenzae Rd
agcaacaauauuag

SEQ ID NO: 2685106 - RNA, 23 nt, Haemophilus influenzae Rd
agcaacaucauaagguacaacag

SEQ ID NO: 2685107 - RNA, 17 nt, Haemophilus influenzae Rd
agcaaccacuaaaacac

SEQ ID NO: 2685108 - RNA, 17 nt, Haemophilus influenzae Rd
agcaacgacacacuauu

SEQ ID NO: 2685109 - RNA, 18 nt, Haemophilus influenzae Rd
agcaacgacacacuauua

SEQ ID NO: 2685110 - RNA, 23 nt, Haemophilus influenzae Rd
agcaacgcaucgcccaauuuggc

SEQ ID NO: 2685111 - RNA, 16 nt, Haemophilus influenzae Rd
agcaacgguguggaaa

SEQ ID NO: 2685112 - RNA, 13 nt, Haemophilus influenzae Rd
agcaacuuccgcg

SEQ ID NO: 2685113 - RNA, 14 nt, Haemophilus influenzae Rd
agcaagaacuugau

SEQ ID NO: 2685114 - RNA, 20 nt, Haemophilus influenzae Rd
agcaagaacuugauaaucau

SEQ ID NO: 2685115 - RNA, 21 nt, Haemophilus influenzae Rd
agcaagaacuugauaaucauu

SEQ ID NO: 2685116 - RNA, 16 nt, Haemophilus influenzae Rd
agcaagauaaucccuu

SEQ ID NO: 2685117 - RNA, 15 nt, Haemophilus influenzae Rd
agcaagauacuuuua

SEQ ID NO: 2685118 - RNA, 14 nt, Haemophilus influenzae Rd
agcaagaucaauau

SEQ ID NO: 2685119 - RNA, 15 nt, Haemophilus influenzae Rd
agcaagcaaaauuaa

SEQ ID NO: 2685120 - RNA, 17 nt, Haemophilus influenzae Rd
agcaagggauuuucuua

SEQ ID NO: 2685121 - RNA, 12 nt, Haemophilus influenzae Rd
agcaauaauauc

SEQ ID NO: 2685122 - RNA, 14 nt, Haemophilus influenzae Rd
agcaauaauuucau

SEQ ID NO: 2685123 - RNA, 23 nt, Haemophilus influenzae Rd
agcaauaauuucauuguuaaaua

SEQ ID NO: 2685124 - RNA, 20 nt, Haemophilus influenzae Rd
agcaauaucugcuaauacug

SEQ ID NO: 2685125 - RNA, 21 nt, Haemophilus influenzae Rd
agcaauauggguucaauauaa

SEQ ID NO: 2685126 - RNA, 17 nt, Haemophilus influenzae Rd
agcaaucauuugccgcc

SEQ ID NO: 2685127 - RNA, 14 nt, Haemophilus influenzae Rd
agcaauccaaucag

SEQ ID NO: 2685128 - RNA, 20 nt, Haemophilus influenzae Rd
agcaaucuuuggcaaaaaau

SEQ ID NO: 2685129 - RNA, 23 nt, Haemophilus influenzae Rd
agcaaucuuuggcaaaaaauaca

SEQ ID NO: 2685130 - RNA, 20 nt, Haemophilus influenzae Rd
agcaaugccgaagccuugua

SEQ ID NO: 2685131 - RNA, 21 nt, Haemophilus influenzae Rd
agcaaugccgaagccuuguaa

SEQ ID NO: 2685132 - RNA, 18 nt, Haemophilus influenzae Rd
agcaaugcuuuaaucauu

SEQ ID NO: 2685133 - RNA, 18 nt, Haemophilus influenzae Rd
agcaauggcaauucucug

SEQ ID NO: 2685134 - RNA, 11 nt, Haemophilus influenzae Rd
agcaauguuuu

SEQ ID NO: 2685135 - RNA, 16 nt, Haemophilus influenzae Rd
agcaauugccgacacu

SEQ ID NO: 2685136 - RNA, 14 nt, Haemophilus influenzae Rd
agcaauuuucugca

SEQ ID NO: 2685137 - RNA, 17 nt, Haemophilus influenzae Rd
agcaauuuucugcagaa

SEQ ID NO: 2685138 - RNA, 22 nt, Haemophilus influenzae Rd
agcacaagauuugccaaaauca

SEQ ID NO: 2685139 - RNA, 22 nt, Haemophilus influenzae Rd
agcacaaucgcuagcgcaauca

SEQ ID NO: 2685140 - RNA, 18 nt, Haemophilus influenzae Rd
agcacacuaauaagaaua

SEQ ID NO: 2685141 - RNA, 18 nt, Haemophilus influenzae Rd
agcacauuaaucauuuca

SEQ ID NO: 2685142 - RNA, 15 nt, Haemophilus influenzae Rd
agcaccaaauaucgc

SEQ ID NO: 2685143 - RNA, 16 nt, Haemophilus influenzae Rd
agcaccaaauaucgca

SEQ ID NO: 2685144 - RNA, 15 nt, Haemophilus influenzae Rd
agcaccaaauuaaaa

SEQ ID NO: 2685145 - RNA, 16 nt, Haemophilus influenzae Rd
agcaccaaauuaaaaa

SEQ ID NO: 2685146 - RNA, 18 nt, Haemophilus influenzae Rd
agcaccaaauuaaaaaua

SEQ ID NO: 2685147 - RNA, 15 nt, Haemophilus influenzae Rd
agcacgauaaccauc

SEQ ID NO: 2685148 - RNA, 14 nt, Haemophilus influenzae Rd
agcacgauuuucaa

SEQ ID NO: 2685149 - RNA, 12 nt, Haemophilus influenzae Rd
agcacuaaaagc

SEQ ID NO: 2685150 - RNA, 21 nt, Haemophilus influenzae Rd
agcacuaauuuguggaaauug

SEQ ID NO: 2685151 - RNA, 20 nt, Haemophilus influenzae Rd
agcacuggcagacaaguuua

SEQ ID NO: 2685152 - RNA, 15 nt, Haemophilus influenzae Rd
agcacuggugugacu

SEQ ID NO: 2685153 - RNA, 19 nt, Haemophilus influenzae Rd
agcacugguuacgccugca

SEQ ID NO: 2685154 - RNA, 21 nt, Haemophilus influenzae Rd
agcacuucagcauaauguuug

SEQ ID NO: 2685155 - RNA, 16 nt, Haemophilus influenzae Rd
agcacuugcaucuaaa

SEQ ID NO: 2685156 - RNA, 15 nt, Haemophilus influenzae Rd
agcacuuguuuuuag

SEQ ID NO: 2685157 - RNA, 13 nt, Haemophilus influenzae Rd
agcacuuuuccuu

SEQ ID NO: 2685158 - RNA, 15 nt, Haemophilus influenzae Rd
agcagaacauuguga

SEQ ID NO: 2685159 - RNA, 14 nt, Haemophilus influenzae Rd
agcagacaaaauug

SEQ ID NO: 2685160 - RNA, 12 nt, Haemophilus influenzae Rd
agcagacauuaa

SEQ ID NO: 2685161 - RNA, 17 nt, Haemophilus influenzae Rd
agcagcuaacaaaauua

SEQ ID NO: 2685162 - RNA, 14 nt, Haemophilus influenzae Rd
agcagcuaauaggc

SEQ ID NO: 2685163 - RNA, 18 nt, Haemophilus influenzae Rd
agcagcuaauaggcuuaa

SEQ ID NO: 2685164 - RNA, 16 nt, Haemophilus influenzae Rd
agcaggaaaaccacaa

SEQ ID NO: 2685165 - RNA, 19 nt, Haemophilus influenzae Rd
agcaggaaaaccacaagau

SEQ ID NO: 2685166 - RNA, 12 nt, Haemophilus influenzae Rd
agcaggaagaac

SEQ ID NO: 2685167 - RNA, 22 nt, Haemophilus influenzae Rd
agcagggauuuuaaguuucacu

SEQ ID NO: 2685168 - RNA, 15 nt, Haemophilus influenzae Rd
agcagguuuuucuuu

SEQ ID NO: 2685169 - RNA, 21 nt, Haemophilus influenzae Rd
agcagguuuuuuauuucucau

SEQ ID NO: 2685170 - RNA, 17 nt, Haemophilus influenzae Rd
agcagugguaaauuuua

SEQ ID NO: 2685171 - RNA, 18 nt, Haemophilus influenzae Rd
agcaguugcuaaaucacc

SEQ ID NO: 2685172 - RNA, 19 nt, Haemophilus influenzae Rd
agcaguuuucgugauuuug

SEQ ID NO: 2685173 - RNA, 12 nt, Haemophilus influenzae Rd
agcauaaaacag

SEQ ID NO: 2685174 - RNA, 13 nt, Haemophilus influenzae Rd
agcauaaacaaaa

SEQ ID NO: 2685175 - RNA, 13 nt, Haemophilus influenzae Rd
agcauaaagagaa

SEQ ID NO: 2685176 - RNA, 15 nt, Haemophilus influenzae Rd
agcauaacguauuuu

SEQ ID NO: 2685177 - RNA, 17 nt, Haemophilus influenzae Rd
agcauaacguauuuucu

SEQ ID NO: 2685178 - RNA, 20 nt, Haemophilus influenzae Rd
agcauaaggaccaagcaaug

SEQ ID NO: 2685179 - RNA, 13 nt, Haemophilus influenzae Rd
agcauaauguuug

SEQ ID NO: 2685180 - RNA, 14 nt, Haemophilus influenzae Rd
agcauauugaaauu

SEQ ID NO: 2685181 - RNA, 19 nt, Haemophilus influenzae Rd
agcauauuuuccaucaccu

SEQ ID NO: 2685182 - RNA, 15 nt, Haemophilus influenzae Rd
agcaucaaaauaaau

SEQ ID NO: 2685183 - RNA, 17 nt, Haemophilus influenzae Rd
agcaucggcuaaauaag

SEQ ID NO: 2685184 - RNA, 15 nt, Haemophilus influenzae Rd
agcaucuacccaaua

SEQ ID NO: 2685185 - RNA, 15 nt, Haemophilus influenzae Rd
agcaucugauuuuca

SEQ ID NO: 2685186 - RNA, 15 nt, Haemophilus influenzae Rd
agcaugaauaaaaau

SEQ ID NO: 2685187 - RNA, 17 nt, Haemophilus influenzae Rd
agcaugaauaaaaaugg

SEQ ID NO: 2685188 - RNA, 21 nt, Haemophilus influenzae Rd
agcauggauuuuucuucuaga

SEQ ID NO: 2685189 - RNA, 21 nt, Haemophilus influenzae Rd
agcauguggcucuguuaaaau

SEQ ID NO: 2685190 - RNA, 13 nt, Haemophilus influenzae Rd
agcauuaaaaauu

SEQ ID NO: 2685191 - RNA, 15 nt, Haemophilus influenzae Rd
agcauuaaaaauuua

SEQ ID NO: 2685192 - RNA, 22 nt, Haemophilus influenzae Rd
agcauuaaaaauuuaaaagcac

SEQ ID NO: 2685193 - RNA, 11 nt, Haemophilus influenzae Rd
agcauuaaguu

SEQ ID NO: 2685194 - RNA, 22 nt, Haemophilus influenzae Rd
agcauuggcuagguaacauaau

SEQ ID NO: 2685195 - RNA, 18 nt, Haemophilus influenzae Rd
agcauuguaagacgcauu

SEQ ID NO: 2685196 - RNA, 23 nt, Haemophilus influenzae Rd
agcauuguccacagcaaaagaaa

SEQ ID NO: 2685197 - RNA, 17 nt, Haemophilus influenzae Rd
agcauuuagagcaagca

SEQ ID NO: 2685198 - RNA, 20 nt, Haemophilus influenzae Rd
agcauuucaagcuuugcaac

SEQ ID NO: 2685199 - RNA, 21 nt, Haemophilus influenzae Rd
agcauuucaagcuuugcaaca

SEQ ID NO: 2685200 - RNA, 18 nt, Haemophilus influenzae Rd
agcauuucuaaaggagua

SEQ ID NO: 2685201 - RNA, 20 nt, Haemophilus influenzae Rd
agcauuuugauaauuuuuca

SEQ ID NO: 2685202 - RNA, 19 nt, Haemophilus influenzae Rd
agcauuuuuuauuaaaaaa

SEQ ID NO: 2685203 - RNA, 20 nt, Haemophilus influenzae Rd
agcauuuuuuauuaaaaaag

SEQ ID NO: 2685204 - RNA, 20 nt, Haemophilus influenzae Rd
agccaaaacgaauagaaaua

SEQ ID NO: 2685205 - RNA, 13 nt, Haemophilus influenzae Rd
aggaaaaaggcau

SEQ ID NO: 2685206 - RNA, 13 nt, Haemophilus influenzae Rd
aggaaaaauaaau

SEQ ID NO: 2685207 - RNA, 20 nt, Haemophilus influenzae Rd
aggaaacguaaaauaucuuu

SEQ ID NO: 2685208 - RNA, 21 nt, Haemophilus influenzae Rd
aggaaagccccauuucuuuuu

SEQ ID NO: 2685209 - RNA, 22 nt, Haemophilus influenzae Rd
aggaaauccugcgggucuuguu

SEQ ID NO: 2685210 - RNA, 14 nt, Haemophilus influenzae Rd
aggaaguaaauagu

SEQ ID NO: 2685211 - RNA, 12 nt, Haemophilus influenzae Rd
aggaauaaauug

SEQ ID NO: 2685212 - RNA, 22 nt, Haemophilus influenzae Rd
aggaauacucacagagccuuuu

SEQ ID NO: 2685213 - RNA, 22 nt, Haemophilus influenzae Rd
aggaaucgaaauuaaaauaaua

SEQ ID NO: 2685214 - RNA, 17 nt, Haemophilus influenzae Rd
aggaaucgugucaguaa

SEQ ID NO: 2685215 - RNA, 21 nt, Haemophilus influenzae Rd
aggaauuucgacauauucuac

SEQ ID NO: 2685216 - RNA, 15 nt, Haemophilus influenzae Rd
aggacaaucugcugu

SEQ ID NO: 2685217 - RNA, 14 nt, Haemophilus influenzae Rd
aggaccaagcaaug

SEQ ID NO: 2685218 - RNA, 13 nt, Haemophilus influenzae Rd
aggacguuuuaau

SEQ ID NO: 2685219 - RNA, 16 nt, Haemophilus influenzae Rd
aggacuaaaucaaaaa

SEQ ID NO: 2685220 - RNA, 13 nt, Haemophilus influenzae Rd
aggagaaauaauc

SEQ ID NO: 2685221 - RNA, 19 nt, Haemophilus influenzae Rd
aggagaaucagaguuaaaa

SEQ ID NO: 2685222 - RNA, 14 nt, Haemophilus influenzae Rd
aggagcaaucuuuu

SEQ ID NO: 2685223 - RNA, 15 nt, Haemophilus influenzae Rd
aggagccaaauuuaa

SEQ ID NO: 2685224 - RNA, 14 nt, Haemophilus influenzae Rd
aggaggaauaauga

SEQ ID NO: 2685225 - RNA, 11 nt, Haemophilus influenzae Rd
aggauaaaaac

SEQ ID NO: 2685226 - RNA, 13 nt, Haemophilus influenzae Rd
aggauaaaaacca

SEQ ID NO: 2685227 - RNA, 14 nt, Haemophilus influenzae Rd
aggauaaaaaccag

SEQ ID NO: 2685228 - RNA, 13 nt, Haemophilus influenzae Rd
aggauaaauaaac

SEQ ID NO: 2685229 - RNA, 17 nt, Haemophilus influenzae Rd
aggaucacuaauugcau

SEQ ID NO: 2685230 - RNA, 20 nt, Haemophilus influenzae Rd
aggaucgaauaauccuucuu

SEQ ID NO: 2685231 - RNA, 16 nt, Haemophilus influenzae Rd
aggaucgauuaaaauu

SEQ ID NO: 2685232 - RNA, 13 nt, Haemophilus influenzae Rd
aggaucuuuuucu

SEQ ID NO: 2685233 - RNA, 15 nt, Haemophilus influenzae Rd
aggauuaaagggcug

SEQ ID NO: 2685234 - RNA, 23 nt, Haemophilus influenzae Rd
aggauuaaagggcugcuacaauu

SEQ ID NO: 2685235 - RNA, 13 nt, Haemophilus influenzae Rd
aggauuaaauaac

SEQ ID NO: 2685236 - RNA, 21 nt, Haemophilus influenzae Rd
aggauuaauuacgccugccca

SEQ ID NO: 2685237 - RNA, 15 nt, Haemophilus influenzae Rd
aggauuagaaaugau

SEQ ID NO: 2685238 - RNA, 16 nt, Haemophilus influenzae Rd
aggauuaguaagugcu

SEQ ID NO: 2685239 - RNA, 22 nt, Haemophilus influenzae Rd
aggauucgaaccuucgaccaac

SEQ ID NO: 2685240 - RNA, 13 nt, Haemophilus influenzae Rd
aggauugccuuca

SEQ ID NO: 2685241 - RNA, 12 nt, Haemophilus influenzae Rd
aggauugcguuc

SEQ ID NO: 2685242 - RNA, 18 nt, Haemophilus influenzae Rd
aggauuuauuuaacaaug

SEQ ID NO: 2685243 - RNA, 17 nt, Haemophilus influenzae Rd
aggauuucuaaaguuuc

SEQ ID NO: 2685244 - RNA, 22 nt, Haemophilus influenzae Rd
aggauuucuuaugaaaaaaaau

SEQ ID NO: 2685245 - RNA, 17 nt, Haemophilus influenzae Rd
aggauuugccucuucuu

SEQ ID NO: 2685246 - RNA, 19 nt, Haemophilus influenzae Rd
aggauuuuugaauuucacu

SEQ ID NO: 2685247 - RNA, 13 nt, Haemophilus influenzae Rd
aggauuuuugccg

SEQ ID NO: 2685248 - RNA, 21 nt, Haemophilus influenzae Rd
aggcaaaaacacucucagaau

SEQ ID NO: 2685249 - RNA, 14 nt, Haemophilus influenzae Rd
aggcaaaaucgcaa

SEQ ID NO: 2685250 - RNA, 17 nt, Haemophilus influenzae Rd
aggcaaaaucgcaauau

SEQ ID NO: 2685251 - RNA, 14 nt, Haemophilus influenzae Rd
aggcaaagcaaaau

SEQ ID NO: 2685252 - RNA, 20 nt, Haemophilus influenzae Rd
aggcaaguucguuuuuucca

SEQ ID NO: 2685253 - RNA, 13 nt, Haemophilus influenzae Rd
aggcaauaaaaaa

SEQ ID NO: 2685254 - RNA, 16 nt, Haemophilus influenzae Rd
aggcaauguuccacca

SEQ ID NO: 2685255 - RNA, 18 nt, Haemophilus influenzae Rd
aggcacaacgguugaaau

SEQ ID NO: 2685256 - RNA, 19 nt, Haemophilus influenzae Rd
aggcacaacgguugaaauu

SEQ ID NO: 2685257 - RNA, 19 nt, Haemophilus influenzae Rd
aggcacagggcugauaaau

SEQ ID NO: 2685258 - RNA, 21 nt, Haemophilus influenzae Rd
aggcacagggcugauaaauuu

SEQ ID NO: 2685259 - RNA, 16 nt, Haemophilus influenzae Rd
aggcacauaaguaaaa

SEQ ID NO: 2685260 - RNA, 21 nt, Haemophilus influenzae Rd
aggcacugauuuuuuuauaau

SEQ ID NO: 2685261 - RNA, 17 nt, Haemophilus influenzae Rd
aggcagaaaugaauugg

SEQ ID NO: 2685262 - RNA, 19 nt, Haemophilus influenzae Rd
aggcaucaaaauucaaaau

SEQ ID NO: 2685263 - RNA, 22 nt, Haemophilus influenzae Rd
aggcauuaugccuacuuuuuau

SEQ ID NO: 2685264 - RNA, 13 nt, Haemophilus influenzae Rd
aggcauugcgccu

SEQ ID NO: 2685265 - RNA, 22 nt, Haemophilus influenzae Rd
aggcauugcgccuuuuuggaaa

SEQ ID NO: 2685266 - RNA, 15 nt, Haemophilus influenzae Rd
aggcauugcugugcg

SEQ ID NO: 2685267 - RNA, 22 nt, Haemophilus influenzae Rd
aggcauuuagagggauaaaaau

SEQ ID NO: 2685268 - RNA, 14 nt, Haemophilus influenzae Rd
aggcauuucaucag

SEQ ID NO: 2685269 - RNA, 13 nt, Haemophilus influenzae Rd
aggcauuuucaac

SEQ ID NO: 2685270 - RNA, 14 nt, Haemophilus influenzae Rd
aggcauuuucaacu

SEQ ID NO: 2685271 - RNA, 20 nt, Haemophilus influenzae Rd
aggccagcuugacgaaauaa

SEQ ID NO: 2685272 - RNA, 23 nt, Haemophilus influenzae Rd
aggccauauuuucccaguaaaua

SEQ ID NO: 2685273 - RNA, 16 nt, Haemophilus influenzae Rd
aggcccaucauuuguu

SEQ ID NO: 2685274 - RNA, 18 nt, Haemophilus influenzae Rd
aggccuccgccaagugcg

SEQ ID NO: 2685275 - RNA, 17 nt, Haemophilus influenzae Rd
aggcgaacauaacuuuu

SEQ ID NO: 2685276 - RNA, 23 nt, Haemophilus influenzae Rd
aggcgaauuugugagguuuugag

SEQ ID NO: 2685277 - RNA, 22 nt, Haemophilus influenzae Rd
aggcgaucugcuaauagaacug

SEQ ID NO: 2685278 - RNA, 20 nt, Haemophilus influenzae Rd
aggcggauuuauuauuuaau

SEQ ID NO: 2685279 - RNA, 16 nt, Haemophilus influenzae Rd
aggcgugccaguucaa

SEQ ID NO: 2685280 - RNA, 17 nt, Haemophilus influenzae Rd
aggcuaaauaaccuaaa

SEQ ID NO: 2685281 - RNA, 17 nt, Haemophilus influenzae Rd
aggcuaauaauaaaaag

SEQ ID NO: 2685282 - RNA, 19 nt, Haemophilus influenzae Rd
aggcucaucauuaugaaaa

SEQ ID NO: 2685283 - RNA, 16 nt, Haemophilus influenzae Rd
aggcucuaccuaaaau

SEQ ID NO: 2685284 - RNA, 14 nt, Haemophilus influenzae Rd
aggcugugcauaau

SEQ ID NO: 2685285 - RNA, 14 nt, Haemophilus influenzae Rd
aggcuuaauucuug

SEQ ID NO: 2685286 - RNA, 19 nt, Haemophilus influenzae Rd
aggcuuaauucuugccaua

SEQ ID NO: 2685287 - RNA, 13 nt, Haemophilus influenzae Rd
aggcuuaucuacu

SEQ ID NO: 2685288 - RNA, 16 nt, Haemophilus influenzae Rd
aggcuuaucuacugcu

SEQ ID NO: 2685289 - RNA, 23 nt, Haemophilus influenzae Rd
aggcuucauuugcuucuaucaga

SEQ ID NO: 2685290 - RNA, 20 nt, Haemophilus influenzae Rd
aggcuuccaacaaaauaaac

SEQ ID NO: 2685291 - RNA, 18 nt, Haemophilus influenzae Rd
aggcuuuaauuuuaucua

SEQ ID NO: 2685292 - RNA, 18 nt, Haemophilus influenzae Rd
aggcuuucacuauuucau

SEQ ID NO: 2685293 - RNA, 13 nt, Haemophilus influenzae Rd
aggcuuucauuuu

SEQ ID NO: 2685294 - RNA, 22 nt, Haemophilus influenzae Rd
aggcuuuucccuuuucuuauuu

SEQ ID NO: 2685295 - RNA, 18 nt, Haemophilus influenzae Rd
aggcuuuuuuaauuacuc

SEQ ID NO: 2685296 - RNA, 12 nt, Haemophilus influenzae Rd
agggaaaauuuu

SEQ ID NO: 2685297 - RNA, 14 nt, Haemophilus influenzae Rd
agggaaauuuauua

SEQ ID NO: 2685298 - RNA, 12 nt, Haemophilus influenzae Rd
agggauaaaccc

SEQ ID NO: 2685299 - RNA, 19 nt, Haemophilus influenzae Rd
agggauaaacccaaaaaag

SEQ ID NO: 2685300 - RNA, 20 nt, Haemophilus influenzae Rd
agggaucgcauuaucaaaug

SEQ ID NO: 2685301 - RNA, 18 nt, Haemophilus influenzae Rd
agggaugguuaauuuuuc

SEQ ID NO: 2685302 - RNA, 14 nt, Haemophilus influenzae Rd
agggauuaagaaaa

SEQ ID NO: 2685303 - RNA, 16 nt, Haemophilus influenzae Rd
agggauuugaaaaucc

SEQ ID NO: 2685304 - RNA, 16 nt, Haemophilus influenzae Rd
agggauuugaaaaucu

SEQ ID NO: 2685305 - RNA, 20 nt, Haemophilus influenzae Rd
agggauuuuaaaucccuugu

SEQ ID NO: 2685306 - RNA, 15 nt, Haemophilus influenzae Rd
agggauuuuaaguuu

SEQ ID NO: 2685307 - RNA, 21 nt, Haemophilus influenzae Rd
agggauuuuaauuaucuaaau

SEQ ID NO: 2685308 - RNA, 15 nt, Haemophilus influenzae Rd
agggauuuucaucca

SEQ ID NO: 2685309 - RNA, 21 nt, Haemophilus influenzae Rd
agggauuuuuuauacuuguuu

SEQ ID NO: 2685310 - RNA, 15 nt, Haemophilus influenzae Rd
agggcaaaaaaucuu

SEQ ID NO: 2685311 - RNA, 15 nt, Haemophilus influenzae Rd
aguaagggcaaaaaa

SEQ ID NO: 2685312 - RNA, 17 nt, Haemophilus influenzae Rd
aguaagggcaaaaaauc

SEQ ID NO: 2685313 - RNA, 23 nt, Haemophilus influenzae Rd
aguaaguaggcugaauacauuaa

SEQ ID NO: 2685314 - RNA, 21 nt, Haemophilus influenzae Rd
aguaagucgcaucaacaacua

SEQ ID NO: 2685315 - RNA, 15 nt, Haemophilus influenzae Rd
aguaagugcuuugag

SEQ ID NO: 2685316 - RNA, 12 nt, Haemophilus influenzae Rd
aguaauaaaaag

SEQ ID NO: 2685317 - RNA, 16 nt, Haemophilus influenzae Rd
aguaauaaaaagcacu

SEQ ID NO: 2685318 - RNA, 13 nt, Haemophilus influenzae Rd
aguaauaaauuca

SEQ ID NO: 2685319 - RNA, 20 nt, Haemophilus influenzae Rd
aguaauaaauucaaaaaaug

SEQ ID NO: 2685320 - RNA, 14 nt, Haemophilus influenzae Rd
aguaauaaucuucu

SEQ ID NO: 2685321 - RNA, 11 nt, Haemophilus influenzae Rd
aguaauacacc

SEQ ID NO: 2685322 - RNA, 16 nt, Haemophilus influenzae Rd
aguaauauauucuacg

SEQ ID NO: 2685323 - RNA, 17 nt, Haemophilus influenzae Rd
aguaauauuucuuguuc

SEQ ID NO: 2685324 - RNA, 20 nt, Haemophilus influenzae Rd
aguaaucgccccaaaagcug

SEQ ID NO: 2685325 - RNA, 15 nt, Haemophilus influenzae Rd
aguaaucuaauucuu

SEQ ID NO: 2685326 - RNA, 23 nt, Haemophilus influenzae Rd
aguaaucuggugcuuguuuuaaa

SEQ ID NO: 2685327 - RNA, 15 nt, Haemophilus influenzae Rd
aguaaugaaagaaac

SEQ ID NO: 2685328 - RNA, 19 nt, Haemophilus influenzae Rd
aguaaugcuaaauauauau

SEQ ID NO: 2685329 - RNA, 18 nt, Haemophilus influenzae Rd
aguaaugcuuuaaauugu

SEQ ID NO: 2685330 - RNA, 14 nt, Haemophilus influenzae Rd
aguaauggaagaau

SEQ ID NO: 2685331 - RNA, 19 nt, Haemophilus influenzae Rd
aguaauucgggauaaggca

SEQ ID NO: 2685332 - RNA, 12 nt, Haemophilus influenzae Rd
aguaauuuaaaa

SEQ ID NO: 2685333 - RNA, 15 nt, Haemophilus influenzae Rd
aguaauuuaaaaagu

SEQ ID NO: 2685334 - RNA, 17 nt, Haemophilus influenzae Rd
aguaauuucauaucuuc

SEQ ID NO: 2685335 - RNA, 19 nt, Haemophilus influenzae Rd
aguaauuucauaucuucuu

SEQ ID NO: 2685336 - RNA, 21 nt, Haemophilus influenzae Rd
aguaauuuuacaguuucaaca

SEQ ID NO: 2685337 - RNA, 13 nt, Haemophilus influenzae Rd
aguaauuuucacg

SEQ ID NO: 2685338 - RNA, 22 nt, Haemophilus influenzae Rd
aguacacgaugaugcaggaaag

SEQ ID NO: 2685339 - RNA, 23 nt, Haemophilus influenzae Rd
aguacacgaugaugcaggaaagg

SEQ ID NO: 2685340 - RNA, 16 nt, Haemophilus influenzae Rd
aguacaucauuugcaa

SEQ ID NO: 2685341 - RNA, 19 nt, Haemophilus influenzae Rd
aguacaucauuugcaauau

SEQ ID NO: 2685342 - RNA, 22 nt, Haemophilus influenzae Rd
aguaccacuuucaacuguucuu

SEQ ID NO: 2685343 - RNA, 15 nt, Haemophilus influenzae Rd
aguacgauaaacacu

SEQ ID NO: 2685344 - RNA, 17 nt, Haemophilus influenzae Rd
aguacgauugcaauaau

SEQ ID NO: 2685345 - RNA, 22 nt, Haemophilus influenzae Rd
aguacgauugcaauaaucacag

SEQ ID NO: 2685346 - RNA, 18 nt, Haemophilus influenzae Rd
aguacugcagcauuuaaa

SEQ ID NO: 2685347 - RNA, 19 nt, Haemophilus influenzae Rd
aguagaaaaucagauuaug

SEQ ID NO: 2685348 - RNA, 21 nt, Haemophilus influenzae Rd
aguagaaaaucagauuauguu

SEQ ID NO: 2685349 - RNA, 20 nt, Haemophilus influenzae Rd
aguagauaacaacuaaaaau

SEQ ID NO: 2685350 - RNA, 22 nt, Haemophilus influenzae Rd
aguagauuacacauuaacagaa

SEQ ID NO: 2685351 - RNA, 13 nt, Haemophilus influenzae Rd
aguagauuuuuau

SEQ ID NO: 2685352 - RNA, 14 nt, Haemophilus influenzae Rd
aguagcaacaccac

SEQ ID NO: 2685353 - RNA, 21 nt, Haemophilus influenzae Rd
aguaggagcaaucuuuuucuu

SEQ ID NO: 2685354 - RNA, 16 nt, Haemophilus influenzae Rd
aguauaaaaaaucccu

SEQ ID NO: 2685355 - RNA, 13 nt, Haemophilus influenzae Rd
aguauaaauuugu

SEQ ID NO: 2685356 - RNA, 20 nt, Haemophilus influenzae Rd
aguauaacguagcgauaaaa

SEQ ID NO: 2685357 - RNA, 21 nt, Haemophilus influenzae Rd
aguauaacguagcgauaaaau

SEQ ID NO: 2685358 - RNA, 16 nt, Haemophilus influenzae Rd
aguauaagcaaugcaa

SEQ ID NO: 2685359 - RNA, 23 nt, Haemophilus influenzae Rd
aguauagucauucaaugcagaaa

SEQ ID NO: 2685360 - RNA, 22 nt, Haemophilus influenzae Rd
aguauauucgccuucacaaacc

SEQ ID NO: 2685361 - RNA, 15 nt, Haemophilus influenzae Rd
aguauauuuaucuaa

SEQ ID NO: 2685362 - RNA, 16 nt, Haemophilus influenzae Rd
aguaucaaucauauca

SEQ ID NO: 2685363 - RNA, 20 nt, Haemophilus influenzae Rd
aguaucccaaauuaaauccu

SEQ ID NO: 2685364 - RNA, 15 nt, Haemophilus influenzae Rd
aguaugaaaacgcga

SEQ ID NO: 2685365 - RNA, 22 nt, Haemophilus influenzae Rd
aguaugaugauuguuauuguga

SEQ ID NO: 2685366 - RNA, 23 nt, Haemophilus influenzae Rd
aguaugaugauuguuauugugau

SEQ ID NO: 2685367 - RNA, 15 nt, Haemophilus influenzae Rd
aguauggcaagugca

SEQ ID NO: 2685368 - RNA, 17 nt, Haemophilus influenzae Rd
aguaugggguuaaaaag

SEQ ID NO: 2685369 - RNA, 18 nt, Haemophilus influenzae Rd
aguauuaaauauaaugaa

SEQ ID NO: 2685370 - RNA, 15 nt, Haemophilus influenzae Rd
aguauuaaauuuuua

SEQ ID NO: 2685371 - RNA, 19 nt, Haemophilus influenzae Rd
aguauucauauaauucauu

SEQ ID NO: 2685372 - RNA, 20 nt, Haemophilus influenzae Rd
aguauuccccgcuuucgcuu

SEQ ID NO: 2685373 - RNA, 20 nt, Haemophilus influenzae Rd
aguauuuacuaaauuauuug

SEQ ID NO: 2685374 - RNA, 15 nt, Haemophilus influenzae Rd
aguauuuuauuuaua

SEQ ID NO: 2685375 - RNA, 12 nt, Haemophilus influenzae Rd
aguauuuuccuu

SEQ ID NO: 2685376 - RNA, 13 nt, Haemophilus influenzae Rd
aguauuuuuguga

SEQ ID NO: 2685377 - RNA, 23 nt, Haemophilus influenzae Rd
agucaaaaaugugguugcggcug

SEQ ID NO: 2685378 - RNA, 23 nt, Haemophilus influenzae Rd
agucaaaaauugauaccaagaua

SEQ ID NO: 2685379 - RNA, 13 nt, Haemophilus influenzae Rd
agucaaauuuuua

SEQ ID NO: 2685380 - RNA, 16 nt, Haemophilus influenzae Rd
agucaauccaguuacc

SEQ ID NO: 2685381 - RNA, 15 nt, Haemophilus influenzae Rd
agucaauuugaccga

SEQ ID NO: 2685382 - RNA, 23 nt, Haemophilus influenzae Rd
agucaauuugaccgacaagauaa

SEQ ID NO: 2685383 - RNA, 12 nt, Haemophilus influenzae Rd
agucacaacaau

SEQ ID NO: 2685384 - RNA, 16 nt, Haemophilus influenzae Rd
agucagcgcagcaauu

SEQ ID NO: 2685385 - RNA, 14 nt, Haemophilus influenzae Rd
agucaggaauaaaa

SEQ ID NO: 2685386 - RNA, 21 nt, Haemophilus influenzae Rd
agucaggaauaaaagauuuug

SEQ ID NO: 2685387 - RNA, 21 nt, Haemophilus influenzae Rd
agucaguaaaccaagugaaau

SEQ ID NO: 2685388 - RNA, 13 nt, Haemophilus influenzae Rd
agucauacagaaa

SEQ ID NO: 2685389 - RNA, 19 nt, Haemophilus influenzae Rd
agucauauugauuucucug

SEQ ID NO: 2685390 - RNA, 19 nt, Haemophilus influenzae Rd
agucaucgaguuuuaucuu

SEQ ID NO: 2685391 - RNA, 18 nt, Haemophilus influenzae Rd
agucauuaaugcauugau

SEQ ID NO: 2685392 - RNA, 19 nt, Haemophilus influenzae Rd
agucauucaaugcagaaau

SEQ ID NO: 2685393 - RNA, 22 nt, Haemophilus influenzae Rd
agucauuuuuuacauuaagugc

SEQ ID NO: 2685394 - RNA, 21 nt, Haemophilus influenzae Rd
aguccaaguuuuuuaucuuuu

SEQ ID NO: 2685395 - RNA, 22 nt, Haemophilus influenzae Rd
aguccacaucagguauaaagau

SEQ ID NO: 2685396 - RNA, 20 nt, Haemophilus influenzae Rd
aguccaugcguuuuauuugg

SEQ ID NO: 2685397 - RNA, 15 nt, Haemophilus influenzae Rd
agucccaaaagcaaa

SEQ ID NO: 2685398 - RNA, 14 nt, Haemophilus influenzae Rd
aguccgccuugaga

SEQ ID NO: 2685399 - RNA, 20 nt, Haemophilus influenzae Rd
aguccuuaaacaaauguauc

SEQ ID NO: 2685400 - RNA, 15 nt, Haemophilus influenzae Rd
aguccuucugcgauu

SEQ ID NO: 2685401 - RNA, 20 nt, Haemophilus influenzae Rd
aguccuucugcgauuucauu

SEQ ID NO: 2685402 - RNA, 23 nt, Haemophilus influenzae Rd
aguccuuuuacuuuuacuuaaag

SEQ ID NO: 2685403 - RNA, 12 nt, Haemophilus influenzae Rd
agucgaugccaa

SEQ ID NO: 2685404 - RNA, 22 nt, Haemophilus influenzae Rd
agucgcacccgccuuaaucauu

SEQ ID NO: 2685405 - RNA, 18 nt, Haemophilus influenzae Rd
agucgcuacauuucgacu

SEQ ID NO: 2685406 - RNA, 19 nt, Haemophilus influenzae Rd
agucgcuuucaacacaaca

SEQ ID NO: 2685407 - RNA, 14 nt, Haemophilus influenzae Rd
agucgguagagcag

SEQ ID NO: 2685408 - RNA, 16 nt, Haemophilus influenzae Rd
agucuaauaugauuaa

SEQ ID NO: 2685409 - RNA, 22 nt, Haemophilus influenzae Rd
agucuaaugaugcuucagcguu

SEQ ID NO: 2685410 - RNA, 14 nt, Haemophilus influenzae Rd
agucuauaaaagaa

SEQ ID NO: 2685411 - RNA, 15 nt, Haemophilus influenzae Rd
agucuauuacuaaaa

SEQ ID NO: 2685412 - RNA, 15 nt, Haemophilus influenzae Rd
agucucaaauuuuuc

SEQ ID NO: 2685413 - RNA, 19 nt, Haemophilus influenzae Rd
agucucuaugauuuuuuug

SEQ ID NO: 2685414 - RNA, 16 nt, Haemophilus influenzae Rd
agucugcuacaaguga

SEQ ID NO: 2685415 - RNA, 19 nt, Haemophilus influenzae Rd
agucuuaauuuguugaauu

SEQ ID NO: 2685416 - RNA, 17 nt, Haemophilus influenzae Rd
aguuaauuagaauaaca

SEQ ID NO: 2685417 - RNA, 11 nt, Haemophilus influenzae Rd
aguuacaagua

SEQ ID NO: 2685418 - RNA, 15 nt, Haemophilus influenzae Rd
aguuacacaaugcca

SEQ ID NO: 2685419 - RNA, 21 nt, Haemophilus influenzae Rd
aguuaccauacagccugcgau

SEQ ID NO: 2685420 - RNA, 19 nt, Haemophilus influenzae Rd
aguuaccgcucgccaauaa

SEQ ID NO: 2685421 - RNA, 20 nt, Haemophilus influenzae Rd
aguuaccgcucgccaauaaa

SEQ ID NO: 2685422 - RNA, 19 nt, Haemophilus influenzae Rd
aguuacgagguugaucuac

SEQ ID NO: 2685423 - RNA, 14 nt, Haemophilus influenzae Rd
aguuagcucucuuu

SEQ ID NO: 2685424 - RNA, 22 nt, Haemophilus influenzae Rd
aguuaggcuaagguuuaacuga

SEQ ID NO: 2685425 - RNA, 12 nt, Haemophilus influenzae Rd
aguuauaaaccc

SEQ ID NO: 2685426 - RNA, 23 nt, Haemophilus influenzae Rd
aguuauaaacccaucauaaauau

SEQ ID NO: 2685427 - RNA, 16 nt, Haemophilus influenzae Rd
aguuauaguauauuua

SEQ ID NO: 2685428 - RNA, 19 nt, Haemophilus influenzae Rd
aguuaucaaacaguucaau

SEQ ID NO: 2685429 - RNA, 13 nt, Haemophilus influenzae Rd
aguuaucaauaaa

SEQ ID NO: 2685430 - RNA, 15 nt, Haemophilus influenzae Rd
aguuaucgccaauaa

SEQ ID NO: 2685431 - RNA, 17 nt, Haemophilus influenzae Rd
aguuaucgccaauaaua

SEQ ID NO: 2685432 - RNA, 16 nt, Haemophilus influenzae Rd
aguuaucuguauaaau

SEQ ID NO: 2685433 - RNA, 19 nt, Haemophilus influenzae Rd
aguuaugggcugacauaaa

SEQ ID NO: 2685434 - RNA, 20 nt, Haemophilus influenzae Rd
aguuauucuucagaacugcu

SEQ ID NO: 2685435 - RNA, 23 nt, Haemophilus influenzae Rd
aguuauuuauauaauuuaacaua

SEQ ID NO: 2685436 - RNA, 22 nt, Haemophilus influenzae Rd
aguuauuuuuaaucaaauaaaa

SEQ ID NO: 2685437 - RNA, 17 nt, Haemophilus influenzae Rd
aguucaaauuucuucac

SEQ ID NO: 2685438 - RNA, 11 nt, Haemophilus influenzae Rd
aguucaagcaa

SEQ ID NO: 2685439 - RNA, 14 nt, Haemophilus influenzae Rd
aguucaauaaaaau

SEQ ID NO: 2685440 - RNA, 20 nt, Haemophilus influenzae Rd
aguucaauaaaaauauauuu

SEQ ID NO: 2685441 - RNA, 22 nt, Haemophilus influenzae Rd
aguucaauaaaaauauauuuag

SEQ ID NO: 2685442 - RNA, 20 nt, Haemophilus influenzae Rd
aguucacaaaucuaaaaaua

SEQ ID NO: 2685443 - RNA, 14 nt, Haemophilus influenzae Rd
aguucacuaaaaau

SEQ ID NO: 2685444 - RNA, 19 nt, Haemophilus influenzae Rd
aguucagcgauuuuaacug

SEQ ID NO: 2685445 - RNA, 12 nt, Haemophilus influenzae Rd
aguucauaaaag

SEQ ID NO: 2685446 - RNA, 14 nt, Haemophilus influenzae Rd
aguucauauaaaua

SEQ ID NO: 2685447 - RNA, 22 nt, Haemophilus influenzae Rd
aguuccugacccacaucaucaa

SEQ ID NO: 2685448 - RNA, 19 nt, Haemophilus influenzae Rd
aguucuaaaauuauagaac

SEQ ID NO: 2685449 - RNA, 13 nt, Haemophilus influenzae Rd
aguucuaaauaaa

SEQ ID NO: 2685450 - RNA, 14 nt, Haemophilus influenzae Rd
aguucuaaauaaac

SEQ ID NO: 2685451 - RNA, 14 nt, Haemophilus influenzae Rd
aguucuacccauuc

SEQ ID NO: 2685452 - RNA, 17 nt, Haemophilus influenzae Rd
aguucucaaaaaguuaa

SEQ ID NO: 2685453 - RNA, 15 nt, Haemophilus influenzae Rd
aguucuuccacgugc

SEQ ID NO: 2685454 - RNA, 19 nt, Haemophilus influenzae Rd
aguucuuccuugguuaauc

SEQ ID NO: 2685455 - RNA, 22 nt, Haemophilus influenzae Rd
aguucuuuugguaauaaaucaa

SEQ ID NO: 2685456 - RNA, 22 nt, Haemophilus influenzae Rd
aguucuuuuuuggcuucaucuu

SEQ ID NO: 2685457 - RNA, 14 nt, Haemophilus influenzae Rd
aguugaaacuguuu

SEQ ID NO: 2685458 - RNA, 13 nt, Haemophilus influenzae Rd
aguugaauauuuu

SEQ ID NO: 2685459 - RNA, 18 nt, Haemophilus influenzae Rd
aguugaauauuuuguuga

SEQ ID NO: 2685460 - RNA, 19 nt, Haemophilus influenzae Rd
aguugaauauuuuguugaa

SEQ ID NO: 2685461 - RNA, 23 nt, Haemophilus influenzae Rd
aguugaauuuucaaugguuuaua

SEQ ID NO: 2685462 - RNA, 15 nt, Haemophilus influenzae Rd
aguugagaauuuuuu

SEQ ID NO: 2685463 - RNA, 20 nt, Haemophilus influenzae Rd
aguugagcuaaagugcgguu

SEQ ID NO: 2685464 - RNA, 22 nt, Haemophilus influenzae Rd
aguugauuuaaauugaaaaaau

SEQ ID NO: 2685465 - RNA, 14 nt, Haemophilus influenzae Rd
aguugauuuuaaaa

SEQ ID NO: 2685466 - RNA, 21 nt, Haemophilus influenzae Rd
aguugauuuuaaaauaucaaa

SEQ ID NO: 2685467 - RNA, 19 nt, Haemophilus influenzae Rd
aguugcgguggugaaaauc

SEQ ID NO: 2685468 - RNA, 19 nt, Haemophilus influenzae Rd
aguuggacuacauaaccca

SEQ ID NO: 2685469 - RNA, 15 nt, Haemophilus influenzae Rd
aguuggagauuuuuu

SEQ ID NO: 2685470 - RNA, 18 nt, Haemophilus influenzae Rd
aguuggagauuuuuuagg

SEQ ID NO: 2685471 - RNA, 19 nt, Haemophilus influenzae Rd
aguuggauaacguuuaugg

SEQ ID NO: 2685472 - RNA, 15 nt, Haemophilus influenzae Rd
aguuggauuaaacaa

SEQ ID NO: 2685473 - RNA, 14 nt, Haemophilus influenzae Rd
aguuggcaacauau

SEQ ID NO: 2685474 - RNA, 17 nt, Haemophilus influenzae Rd
aguuggcaacauauuuu

SEQ ID NO: 2685475 - RNA, 20 nt, Haemophilus influenzae Rd
aguuggcaacauauuuucua

SEQ ID NO: 2685476 - RNA, 14 nt, Haemophilus influenzae Rd
aguugggauuuauc

SEQ ID NO: 2685477 - RNA, 21 nt, Haemophilus influenzae Rd
aguugggauuuaucuuccccc

SEQ ID NO: 2685478 - RNA, 23 nt, Haemophilus influenzae Rd
aguugggcaagucccuguucaaa

SEQ ID NO: 2685479 - RNA, 17 nt, Haemophilus influenzae Rd
aguuggguaaucaaauu

SEQ ID NO: 2685480 - RNA, 13 nt, Haemophilus influenzae Rd
aguuggguuaaau

SEQ ID NO: 2685481 - RNA, 17 nt, Haemophilus influenzae Rd
aguuguaauaaagcuga

SEQ ID NO: 2685482 - RNA, 18 nt, Haemophilus influenzae Rd
aguugucgcuacaucaac

SEQ ID NO: 2685483 - RNA, 18 nt, Haemophilus influenzae Rd
aguuguggaaguugcucu

SEQ ID NO: 2685484 - RNA, 21 nt, Haemophilus influenzae Rd
aguuguuucaccauuuccuuu

SEQ ID NO: 2685485 - RNA, 17 nt, Haemophilus influenzae Rd
aguuguuuguuaugaaa

SEQ ID NO: 2685486 - RNA, 16 nt, Haemophilus influenzae Rd
aguuuaacuuucaaca

SEQ ID NO: 2685487 - RNA, 17 nt, Haemophilus influenzae Rd
aguuuaacuuucaacac

SEQ ID NO: 2685488 - RNA, 12 nt, Haemophilus influenzae Rd
aguuuaagggcu

SEQ ID NO: 2685489 - RNA, 19 nt, Haemophilus influenzae Rd
aguuuaagugguuucaacg

SEQ ID NO: 2685490 - RNA, 23 nt, Haemophilus influenzae Rd
aguuuaauacaaucuguccaucu

SEQ ID NO: 2685491 - RNA, 19 nt, Haemophilus influenzae Rd
aguuuaaucuuaaagaauu

SEQ ID NO: 2685492 - RNA, 20 nt, Haemophilus influenzae Rd
aguuuaccgccaagucccca

SEQ ID NO: 2685493 - RNA, 12 nt, Haemophilus influenzae Rd
aguuuacuuuug

SEQ ID NO: 2685494 - RNA, 18 nt, Haemophilus influenzae Rd
aguuuacuuuugauuuua

SEQ ID NO: 2685495 - RNA, 14 nt, Haemophilus influenzae Rd
aguuuauaaaaaaa

SEQ ID NO: 2685496 - RNA, 15 nt, Haemophilus influenzae Rd
aguuuauaaaaaaau

SEQ ID NO: 2685497 - RNA, 22 nt, Haemophilus influenzae Rd
aguuuaucucuuucuuaaaaua

SEQ ID NO: 2685498 - RNA, 12 nt, Haemophilus influenzae Rd
aguuuauucagu

SEQ ID NO: 2685499 - RNA, 22 nt, Haemophilus influenzae Rd
aguuucaagucguuauuuucua

SEQ ID NO: 2685500 - RNA, 14 nt, Haemophilus influenzae Rd
aguuucacucuacc

SEQ ID NO: 2685501 - RNA, 16 nt, Haemophilus influenzae Rd
aguuucacucuaccau

SEQ ID NO: 2685502 - RNA, 22 nt, Haemophilus influenzae Rd
aguuucaguaucacgcacacca

SEQ ID NO: 2685503 - RNA, 19 nt, Haemophilus influenzae Rd
aguuuccacguuuucaacu

SEQ ID NO: 2685504 - RNA, 16 nt, Haemophilus influenzae Rd
aguuucugguuccauu

SEQ ID NO: 2685505 - RNA, 19 nt, Haemophilus influenzae Rd
aguuucuucuuucaaugca

SEQ ID NO: 2685506 - RNA, 13 nt, Haemophilus influenzae Rd
aguuucuugggau

SEQ ID NO: 2685507 - RNA, 13 nt, Haemophilus influenzae Rd
aguuugacuauuc

SEQ ID NO: 2685508 - RNA, 16 nt, Haemophilus influenzae Rd
aguuugauuaacuuuc

SEQ ID NO: 2685509 - RNA, 17 nt, Haemophilus influenzae Rd
aguuugauuacaguaca

SEQ ID NO: 2685510 - RNA, 14 nt, Haemophilus influenzae Rd
aguuugcaacauau

SEQ ID NO: 2685511 - RNA, 22 nt, Haemophilus influenzae Rd
aguuugcaauaaagcuugaaaa

SEQ ID NO: 2685512 - RNA, 16 nt, Haemophilus influenzae Rd
aguuugccgccaaucc

SEQ ID NO: 2685513 - RNA, 22 nt, Haemophilus influenzae Rd
aguuugcgugaauaucuaacau

SEQ ID NO: 2685514 - RNA, 19 nt, Haemophilus influenzae Rd
aguuugcuuugauaaaugg

SEQ ID NO: 2685515 - RNA, 20 nt, Haemophilus influenzae Rd
aguuuguggaguaauucuuu

SEQ ID NO: 2685516 - RNA, 21 nt, Haemophilus influenzae Rd
aguuuguuucucaaguuuaac

SEQ ID NO: 2685517 - RNA, 14 nt, Haemophilus influenzae Rd
aguuuguuuuuaac

SEQ ID NO: 2685518 - RNA, 16 nt, Haemophilus influenzae Rd
aguuuuaauacuaaag

SEQ ID NO: 2685519 - RNA, 21 nt, Haemophilus influenzae Rd
aguuuuacguugcaacgcugc

SEQ ID NO: 2685520 - RNA, 17 nt, Haemophilus influenzae Rd
aguuuuagggaagauua

SEQ ID NO: 2685521 - RNA, 20 nt, Haemophilus influenzae Rd
auaaacuucugcaaguugag

SEQ ID NO: 2685522 - RNA, 18 nt, Haemophilus influenzae Rd
auaaagaaaggaauagau

SEQ ID NO: 2685523 - RNA, 17 nt, Haemophilus influenzae Rd
auaaagaauuggcgaac

SEQ ID NO: 2685524 - RNA, 20 nt, Haemophilus influenzae Rd
auaaagagauuauuucuccu

SEQ ID NO: 2685525 - RNA, 15 nt, Haemophilus influenzae Rd
auaaagauaaauuau

SEQ ID NO: 2685526 - RNA, 13 nt, Haemophilus influenzae Rd
auaaagauaacua

SEQ ID NO: 2685527 - RNA, 20 nt, Haemophilus influenzae Rd
auaaagauaacuaagaugau

SEQ ID NO: 2685528 - RNA, 14 nt, Haemophilus influenzae Rd
auaaagauugcaua

SEQ ID NO: 2685529 - RNA, 14 nt, Haemophilus influenzae Rd
auaaagcaaccaau

SEQ ID NO: 2685530 - RNA, 15 nt, Haemophilus influenzae Rd
auaaagcauaauauu

SEQ ID NO: 2685531 - RNA, 12 nt, Haemophilus influenzae Rd
auaaagcccugu

SEQ ID NO: 2685532 - RNA, 21 nt, Haemophilus influenzae Rd
auaaagccuauucucacauca

SEQ ID NO: 2685533 - RNA, 22 nt, Haemophilus influenzae Rd
auaaagccuauucucacaucau

SEQ ID NO: 2685534 - RNA, 19 nt, Haemophilus influenzae Rd
auaaagcgugagccaaugc

SEQ ID NO: 2685535 - RNA, 16 nt, Haemophilus influenzae Rd
auaaagcuacuaaaaa

SEQ ID NO: 2685536 - RNA, 17 nt, Haemophilus influenzae Rd
auaaagcuacuaaaaau

SEQ ID NO: 2685537 - RNA, 19 nt, Haemophilus influenzae Rd
auaaagcucagccaaacug

SEQ ID NO: 2685538 - RNA, 18 nt, Haemophilus influenzae Rd
auaaaggauuaaauaaca

SEQ ID NO: 2685539 - RNA, 13 nt, Haemophilus influenzae Rd
auaaaggauuuua

SEQ ID NO: 2685540 - RNA, 18 nt, Haemophilus influenzae Rd
auaaaggcauuuauuuca

SEQ ID NO: 2685541 - RNA, 23 nt, Haemophilus influenzae Rd
auaaagggaaagugcagcccaaa

SEQ ID NO: 2685542 - RNA, 17 nt, Haemophilus influenzae Rd
auaaagggaaguucaca

SEQ ID NO: 2685543 - RNA, 16 nt, Haemophilus influenzae Rd
auaaagguuacucauu

SEQ ID NO: 2685544 - RNA, 15 nt, Haemophilus influenzae Rd
auaaaguaaaauauu

SEQ ID NO: 2685545 - RNA, 18 nt, Haemophilus influenzae Rd
auaaaguaguuuuaguaa

SEQ ID NO: 2685546 - RNA, 22 nt, Haemophilus influenzae Rd
auaaaguauucauauaauucau

SEQ ID NO: 2685547 - RNA, 18 nt, Haemophilus influenzae Rd
auaaagugcgguaaaauu

SEQ ID NO: 2685548 - RNA, 22 nt, Haemophilus influenzae Rd
auaaagugcgguaaaauucuau

SEQ ID NO: 2685549 - RNA, 21 nt, Haemophilus influenzae Rd
auaaagugcggucaauuuuca

SEQ ID NO: 2685550 - RNA, 21 nt, Haemophilus influenzae Rd
auaaagugcgguuauuuuauu

SEQ ID NO: 2685551 - RNA, 20 nt, Haemophilus influenzae Rd
auaaagugcgguuauuuuuu

SEQ ID NO: 2685552 - RNA, 23 nt, Haemophilus influenzae Rd
auaaaguggaugaccaacaccau

SEQ ID NO: 2685553 - RNA, 19 nt, Haemophilus influenzae Rd
auaaaguugagaauuuuuu

SEQ ID NO: 2685554 - RNA, 18 nt, Haemophilus influenzae Rd
auaaaguuuuuucaauaa

SEQ ID NO: 2685555 - RNA, 13 nt, Haemophilus influenzae Rd
auaaauaaaacaa

SEQ ID NO: 2685556 - RNA, 14 nt, Haemophilus influenzae Rd
auaaauaaaacaag

SEQ ID NO: 2685557 - RNA, 16 nt, Haemophilus influenzae Rd
auaaauaaaccagcua

SEQ ID NO: 2685558 - RNA, 14 nt, Haemophilus influenzae Rd
auaaauaaacuauu

SEQ ID NO: 2685559 - RNA, 21 nt, Haemophilus influenzae Rd
auaaauaacaucgcuaaaucu

SEQ ID NO: 2685560 - RNA, 14 nt, Haemophilus influenzae Rd
auaaauaauaaagu

SEQ ID NO: 2685561 - RNA, 16 nt, Haemophilus influenzae Rd
auaaauaccgcuugca

SEQ ID NO: 2685562 - RNA, 17 nt, Haemophilus influenzae Rd
auaaauaguuaaagccu

SEQ ID NO: 2685563 - RNA, 17 nt, Haemophilus influenzae Rd
auaaauaucaaaauuau

SEQ ID NO: 2685564 - RNA, 18 nt, Haemophilus influenzae Rd
auaaauaucaaaauuaug

SEQ ID NO: 2685565 - RNA, 20 nt, Haemophilus influenzae Rd
auaaauaucuaaacuucaau

SEQ ID NO: 2685566 - RNA, 14 nt, Haemophilus influenzae Rd
auaaauaucuugca

SEQ ID NO: 2685567 - RNA, 14 nt, Haemophilus influenzae Rd
auaaauauguugaa

SEQ ID NO: 2685568 - RNA, 21 nt, Haemophilus influenzae Rd
auaaauauuacuuaacaucau

SEQ ID NO: 2685569 - RNA, 12 nt, Haemophilus influenzae Rd
auaaauauuuag

SEQ ID NO: 2685570 - RNA, 23 nt, Haemophilus influenzae Rd
auaaauauuuaggcuauuuuaua

SEQ ID NO: 2685571 - RNA, 21 nt, Haemophilus influenzae Rd
auaaaucaaaagaauuaaaaa

SEQ ID NO: 2685572 - RNA, 22 nt, Haemophilus influenzae Rd
auaaaucaaaagaauuaaaaau

SEQ ID NO: 2685573 - RNA, 22 nt, Haemophilus influenzae Rd
auaaaucacccggcacauaaau

SEQ ID NO: 2685574 - RNA, 14 nt, Haemophilus influenzae Rd
auaaaucauaggcu

SEQ ID NO: 2685575 - RNA, 12 nt, Haemophilus influenzae Rd
auaaaucauuuu

SEQ ID NO: 2685576 - RNA, 16 nt, Haemophilus influenzae Rd
auaaauccaaauaagu

SEQ ID NO: 2685577 - RNA, 21 nt, Haemophilus influenzae Rd
auaaaucccaauagguuugua

SEQ ID NO: 2685578 - RNA, 16 nt, Haemophilus influenzae Rd
auaaauccguaaaaua

SEQ ID NO: 2685579 - RNA, 14 nt, Haemophilus influenzae Rd
auaaauccuuaauu

SEQ ID NO: 2685580 - RNA, 21 nt, Haemophilus influenzae Rd
auaaaucggcguauuuuacaa

SEQ ID NO: 2685581 - RNA, 19 nt, Haemophilus influenzae Rd
auaaaucuauuccuuucuu

SEQ ID NO: 2685582 - RNA, 20 nt, Haemophilus influenzae Rd
auaaaucuauuccuuucuuu

SEQ ID NO: 2685583 - RNA, 17 nt, Haemophilus influenzae Rd
auaaaucuuuaaaugcu

SEQ ID NO: 2685584 - RNA, 19 nt, Haemophilus influenzae Rd
auaaaucuuuaaaugcugc

SEQ ID NO: 2685585 - RNA, 15 nt, Haemophilus influenzae Rd
auaaaugacauauaa

SEQ ID NO: 2685586 - RNA, 16 nt, Haemophilus influenzae Rd
auaaaugauuauccac

SEQ ID NO: 2685587 - RNA, 21 nt, Haemophilus influenzae Rd
auaaaugauuauccacuaaaa

SEQ ID NO: 2685588 - RNA, 22 nt, Haemophilus influenzae Rd
auaaaugcaucauuaauacaca

SEQ ID NO: 2685589 - RNA, 19 nt, Haemophilus influenzae Rd
auaaaugccgccuuuuaau

SEQ ID NO: 2685590 - RNA, 18 nt, Haemophilus influenzae Rd
auaaaugcgugaacugcu

SEQ ID NO: 2685591 - RNA, 11 nt, Haemophilus influenzae Rd
auaaauggaaa

SEQ ID NO: 2685592 - RNA, 19 nt, Haemophilus influenzae Rd
auaaauggaaaccauugau

SEQ ID NO: 2685593 - RNA, 21 nt, Haemophilus influenzae Rd
auaaaugggcaaacauuuuuu

SEQ ID NO: 2685594 - RNA, 17 nt, Haemophilus influenzae Rd
auaaauguguuaaauaa

SEQ ID NO: 2685595 - RNA, 21 nt, Haemophilus influenzae Rd
auaaauuaaaaaaauaguuaa

SEQ ID NO: 2685596 - RNA, 20 nt, Haemophilus influenzae Rd
auaaauuaacuuaucuaaaa

SEQ ID NO: 2685597 - RNA, 16 nt, Haemophilus influenzae Rd
auaaauuacauaaaag

SEQ ID NO: 2685598 - RNA, 10 nt, Haemophilus influenzae Rd
auaaauuacc

SEQ ID NO: 2685599 - RNA, 20 nt, Haemophilus influenzae Rd
auaaauuagccccaaauuac

SEQ ID NO: 2685600 - RNA, 17 nt, Haemophilus influenzae Rd
auaaauuagcuuaauaa

SEQ ID NO: 2685601 - RNA, 13 nt, Haemophilus influenzae Rd
auaaauuauauuu

SEQ ID NO: 2685602 - RNA, 14 nt, Haemophilus influenzae Rd
auaaauuauauuuu

SEQ ID NO: 2685603 - RNA, 16 nt, Haemophilus influenzae Rd
auaaauuauauuuuua

SEQ ID NO: 2685604 - RNA, 19 nt, Haemophilus influenzae Rd
auaaauuauauuuuuaauu

SEQ ID NO: 2685605 - RNA, 20 nt, Haemophilus influenzae Rd
auaaauuauguuaaauugca

SEQ ID NO: 2685606 - RNA, 23 nt, Haemophilus influenzae Rd
auaaauuauucuucaucuucuuu

SEQ ID NO: 2685607 - RNA, 13 nt, Haemophilus influenzae Rd
auaaauuccuuuu

SEQ ID NO: 2685608 - RNA, 14 nt, Haemophilus influenzae Rd
auaaauuccuuuuu

SEQ ID NO: 2685609 - RNA, 19 nt, Haemophilus influenzae Rd
auaaauucguacaaaugaa

SEQ ID NO: 2685610 - RNA, 14 nt, Haemophilus influenzae Rd
auaaauucuuacca

SEQ ID NO: 2685611 - RNA, 21 nt, Haemophilus influenzae Rd
auaaauuggggaaguaauauu

SEQ ID NO: 2685612 - RNA, 15 nt, Haemophilus influenzae Rd
auaaauuuaaaggac

SEQ ID NO: 2685613 - RNA, 15 nt, Haemophilus influenzae Rd
auaaauuuaaauuau

SEQ ID NO: 2685614 - RNA, 12 nt, Haemophilus influenzae Rd
auaaauuuagaa

SEQ ID NO: 2685615 - RNA, 14 nt, Haemophilus influenzae Rd
auaaauuuagaaua

SEQ ID NO: 2685616 - RNA, 18 nt, Haemophilus influenzae Rd
auaaauuuagaauagggu

SEQ ID NO: 2685617 - RNA, 17 nt, Haemophilus influenzae Rd
auaaauuucaauuaaau

SEQ ID NO: 2685618 - RNA, 21 nt, Haemophilus influenzae Rd
auaaauuuggauaguuuauua

SEQ ID NO: 2685619 - RNA, 14 nt, Haemophilus influenzae Rd
auaaauuuuaaaau

SEQ ID NO: 2685620 - RNA, 17 nt, Haemophilus influenzae Rd
auaaauuuuauuauguu

SEQ ID NO: 2685621 - RNA, 21 nt, Haemophilus influenzae Rd
auaaauuuuauuccaccacag

SEQ ID NO: 2685622 - RNA, 20 nt, Haemophilus influenzae Rd
auaaauuuucaaauugaaaa

SEQ ID NO: 2685623 - RNA, 22 nt, Haemophilus influenzae Rd
auaaauuuucaaauugaaaaga

SEQ ID NO: 2685624 - RNA, 23 nt, Haemophilus influenzae Rd
auaaauuuucaaauugaaaagaa

SEQ ID NO: 2685625 - RNA, 17 nt, Haemophilus influenzae Rd
auaaauuuugguugauu

SEQ ID NO: 2685626 - RNA, 13 nt, Haemophilus influenzae Rd
auaagcugcauca

SEQ ID NO: 2685627 - RNA, 14 nt, Haemophilus influenzae Rd
auaagcugcgccua

SEQ ID NO: 2685628 - RNA, 15 nt, Haemophilus influenzae Rd
auaagcugcuuaauu

SEQ ID NO: 2685629 - RNA, 20 nt, Haemophilus influenzae Rd
auaagcuugcguaauguuua

SEQ ID NO: 2685630 - RNA, 14 nt, Haemophilus influenzae Rd
auaagcuuggcuua

SEQ ID NO: 2685631 - RNA, 20 nt, Haemophilus influenzae Rd
auaaggaccaagcaaugcuu

SEQ ID NO: 2685632 - RNA, 20 nt, Haemophilus influenzae Rd
auaaggaucuuguaaagauu

SEQ ID NO: 2685633 - RNA, 16 nt, Haemophilus influenzae Rd
auaaggcagaaaugaa

SEQ ID NO: 2685634 - RNA, 15 nt, Haemophilus influenzae Rd
auaaggcuuauuuuu

SEQ ID NO: 2685635 - RNA, 21 nt, Haemophilus influenzae Rd
auaagggcugauuuuaaauau

SEQ ID NO: 2685636 - RNA, 17 nt, Haemophilus influenzae Rd
auaaggggcugaaugga

SEQ ID NO: 2685637 - RNA, 14 nt, Haemophilus influenzae Rd
auaagguacaacag

SEQ ID NO: 2685638 - RNA, 18 nt, Haemophilus influenzae Rd
auaaggucagcaaauuau

SEQ ID NO: 2685639 - RNA, 14 nt, Haemophilus influenzae Rd
auaaguaaaaccau

SEQ ID NO: 2685640 - RNA, 14 nt, Haemophilus influenzae Rd
auaaguaaaauagu

SEQ ID NO: 2685641 - RNA, 19 nt, Haemophilus influenzae Rd
auaaguaaaauagucacuu

SEQ ID NO: 2685642 - RNA, 15 nt, Haemophilus influenzae Rd
auaaguaacuuuaga

SEQ ID NO: 2685643 - RNA, 14 nt, Haemophilus influenzae Rd
auaaguagaaaaau

SEQ ID NO: 2685644 - RNA, 15 nt, Haemophilus influenzae Rd
auaaguaggcaaaau

SEQ ID NO: 2685645 - RNA, 21 nt, Haemophilus influenzae Rd
auaaguaugugauguaauauu

SEQ ID NO: 2685646 - RNA, 22 nt, Haemophilus influenzae Rd
auaaguauuuugcagaauacug

SEQ ID NO: 2685647 - RNA, 13 nt, Haemophilus influenzae Rd
auaagugaaaugc

SEQ ID NO: 2685648 - RNA, 20 nt, Haemophilus influenzae Rd
auaagugaaaugcucuaaau

SEQ ID NO: 2685649 - RNA, 17 nt, Haemophilus influenzae Rd
auaagugagaaaauacg

SEQ ID NO: 2685650 - RNA, 14 nt, Haemophilus influenzae Rd
auaagugauuaaag

SEQ ID NO: 2685651 - RNA, 16 nt, Haemophilus influenzae Rd
auaagugcgguaaaaa

SEQ ID NO: 2685652 - RNA, 18 nt, Haemophilus influenzae Rd
auaaguggggaaaaauau

SEQ ID NO: 2685653 - RNA, 22 nt, Haemophilus influenzae Rd
auaaguuaccgcuucuuccugu

SEQ ID NO: 2685654 - RNA, 15 nt, Haemophilus influenzae Rd
auaaguuauuuuuac

SEQ ID NO: 2685655 - RNA, 20 nt, Haemophilus influenzae Rd
auaaguucauaaaaggggca

SEQ ID NO: 2685656 - RNA, 21 nt, Haemophilus influenzae Rd
auaaguucauaaaaggggcaa

SEQ ID NO: 2685657 - RNA, 15 nt, Haemophilus influenzae Rd
auaaguucaucaacu

SEQ ID NO: 2685658 - RNA, 18 nt, Haemophilus influenzae Rd
auaaguucuaaauaaacu

SEQ ID NO: 2685659 - RNA, 19 nt, Haemophilus influenzae Rd
auaaguucuaaauaaacua

SEQ ID NO: 2685660 - RNA, 21 nt, Haemophilus influenzae Rd
auaaguucuaaauaaacuacu

SEQ ID NO: 2685661 - RNA, 17 nt, Haemophilus influenzae Rd
auaaguugggauaagcu

SEQ ID NO: 2685662 - RNA, 23 nt, Haemophilus influenzae Rd
auaaguuuugucugaaauuuuua

SEQ ID NO: 2685663 - RNA, 12 nt, Haemophilus influenzae Rd
auaaguuuuuug

SEQ ID NO: 2685664 - RNA, 12 nt, Haemophilus influenzae Rd
auaauaaaaaaa

SEQ ID NO: 2685665 - RNA, 12 nt, Haemophilus influenzae Rd
auaauaaaaauu

SEQ ID NO: 2685666 - RNA, 14 nt, Haemophilus influenzae Rd
auaauaaaaauuaa

SEQ ID NO: 2685667 - RNA, 12 nt, Haemophilus influenzae Rd
auaauaaaauag

SEQ ID NO: 2685668 - RNA, 11 nt, Haemophilus influenzae Rd
auaauaaaaug

SEQ ID NO: 2685669 - RNA, 12 nt, Haemophilus influenzae Rd
auaauaaaaugg

SEQ ID NO: 2685670 - RNA, 21 nt, Haemophilus influenzae Rd
auaauaaagcuacuaaaaauu

SEQ ID NO: 2685671 - RNA, 14 nt, Haemophilus influenzae Rd
auaauaagaaagua

SEQ ID NO: 2685672 - RNA, 16 nt, Haemophilus influenzae Rd
auaauaagauuuuugg

SEQ ID NO: 2685673 - RNA, 14 nt, Haemophilus influenzae Rd
auaauaagcacaau

SEQ ID NO: 2685674 - RNA, 19 nt, Haemophilus influenzae Rd
auaauaagccgaagaagau

SEQ ID NO: 2685675 - RNA, 21 nt, Haemophilus influenzae Rd
auaauaauuagcuaaauacuu

SEQ ID NO: 2685676 - RNA, 15 nt, Haemophilus influenzae Rd
auaauaauuuuuccg

SEQ ID NO: 2685677 - RNA, 16 nt, Haemophilus influenzae Rd
auaauaccuuuccauu

SEQ ID NO: 2685678 - RNA, 14 nt, Haemophilus influenzae Rd
auaauacugcuugu

SEQ ID NO: 2685679 - RNA, 12 nt, Haemophilus influenzae Rd
auaauagacaua

SEQ ID NO: 2685680 - RNA, 16 nt, Haemophilus influenzae Rd
auaauagacugaaaaa

SEQ ID NO: 2685681 - RNA, 21 nt, Haemophilus influenzae Rd
auaauaggcgaaucaaaaucu

SEQ ID NO: 2685682 - RNA, 21 nt, Haemophilus influenzae Rd
auaauaggcgcguaauaaaua

SEQ ID NO: 2685683 - RNA, 22 nt, Haemophilus influenzae Rd
auaauaggcgcguaauaaauaa

SEQ ID NO: 2685684 - RNA, 19 nt, Haemophilus influenzae Rd
auaauaguuggguuagcuu

SEQ ID NO: 2685685 - RNA, 14 nt, Haemophilus influenzae Rd
auaauauaaauuau

SEQ ID NO: 2685686 - RNA, 19 nt, Haemophilus influenzae Rd
auaauauaggcgaacaaaa

SEQ ID NO: 2685687 - RNA, 14 nt, Haemophilus influenzae Rd
auaauauauuaugu

SEQ ID NO: 2685688 - RNA, 21 nt, Haemophilus influenzae Rd
auaauauauuauguauuacca

SEQ ID NO: 2685689 - RNA, 16 nt, Haemophilus influenzae Rd
auaauaucaaucacuu

SEQ ID NO: 2685690 - RNA, 23 nt, Haemophilus influenzae Rd
auaauaucacaaccaccaauuaa

SEQ ID NO: 2685691 - RNA, 20 nt, Haemophilus influenzae Rd
auaauaucgcccgcuuuaag

SEQ ID NO: 2685692 - RNA, 18 nt, Haemophilus influenzae Rd
auaauaucugcuuuuucu

SEQ ID NO: 2685693 - RNA, 15 nt, Haemophilus influenzae Rd
auaauaugcaucacu

SEQ ID NO: 2685694 - RNA, 11 nt, Haemophilus influenzae Rd
auaauauguuu

SEQ ID NO: 2685695 - RNA, 20 nt, Haemophilus influenzae Rd
auaauauuaaagaaaauaca

SEQ ID NO: 2685696 - RNA, 14 nt, Haemophilus influenzae Rd
auaauauucaaaac

SEQ ID NO: 2685697 - RNA, 20 nt, Haemophilus influenzae Rd
auaauauucaaaacauuaau

SEQ ID NO: 2685698 - RNA, 18 nt, Haemophilus influenzae Rd
auaauauuccaaaaaaua

SEQ ID NO: 2685699 - RNA, 12 nt, Haemophilus influenzae Rd
auaauauuuaaa

SEQ ID NO: 2685700 - RNA, 14 nt, Haemophilus influenzae Rd
auaauauuuucuuu

SEQ ID NO: 2685701 - RNA, 12 nt, Haemophilus influenzae Rd
auaauauuuuua

SEQ ID NO: 2685702 - RNA, 20 nt, Haemophilus influenzae Rd
auaauauuuuuacuccuauu

SEQ ID NO: 2685703 - RNA, 13 nt, Haemophilus influenzae Rd
auaauauuuuugc

SEQ ID NO: 2685704 - RNA, 16 nt, Haemophilus influenzae Rd
auaaucaaaaaugcuc

SEQ ID NO: 2685705 - RNA, 18 nt, Haemophilus influenzae Rd
auaaucacaguaccuaca

SEQ ID NO: 2685706 - RNA, 18 nt, Haemophilus influenzae Rd
auaaucaggaauaaacca

SEQ ID NO: 2685707 - RNA, 20 nt, Haemophilus influenzae Rd
auaaucaggauauuuuauug

SEQ ID NO: 2685708 - RNA, 19 nt, Haemophilus influenzae Rd
auaaucagugauuauauuu

SEQ ID NO: 2685709 - RNA, 18 nt, Haemophilus influenzae Rd
auaaucauugaaauguug

SEQ ID NO: 2685710 - RNA, 16 nt, Haemophilus influenzae Rd
auaauccaacuaugaa

SEQ ID NO: 2685711 - RNA, 22 nt, Haemophilus influenzae Rd
auaauccaacuaugaagacuaa

SEQ ID NO: 2685712 - RNA, 15 nt, Haemophilus influenzae Rd
auaauccacuaaaaa

SEQ ID NO: 2685713 - RNA, 18 nt, Haemophilus influenzae Rd
auaauccagcuacauuca

SEQ ID NO: 2685714 - RNA, 17 nt, Haemophilus influenzae Rd
auaauccucuuuaaaau

SEQ ID NO: 2685715 - RNA, 18 nt, Haemophilus influenzae Rd
auaauccucuuuaaaauu

SEQ ID NO: 2685716 - RNA, 16 nt, Haemophilus influenzae Rd
auaaucgaucuuuuuu

SEQ ID NO: 2685717 - RNA, 17 nt, Haemophilus influenzae Rd
auaaucgaucuuuuuuu

SEQ ID NO: 2685718 - RNA, 21 nt, Haemophilus influenzae Rd
auaaucgcaaggucaagaucg

SEQ ID NO: 2685719 - RNA, 14 nt, Haemophilus influenzae Rd
auaaucgccaaaau

SEQ ID NO: 2685720 - RNA, 20 nt, Haemophilus influenzae Rd
auaaucgccaaaaucaucac

SEQ ID NO: 2685721 - RNA, 20 nt, Haemophilus influenzae Rd
auaaucgcuuggucacuggu

SEQ ID NO: 2685722 - RNA, 21 nt, Haemophilus influenzae Rd
auaaucgguuguuuuuuaaua

SEQ ID NO: 2685723 - RNA, 14 nt, Haemophilus influenzae Rd
auaaucguuaaacu

SEQ ID NO: 2685724 - RNA, 14 nt, Haemophilus influenzae Rd
auaaucuaauccaa

SEQ ID NO: 2685725 - RNA, 22 nt, Haemophilus influenzae Rd
auaaucuacaaaacauaauaaa

SEQ ID NO: 2685726 - RNA, 17 nt, Haemophilus influenzae Rd
auaaucuccauaauauu

SEQ ID NO: 2685727 - RNA, 15 nt, Haemophilus influenzae Rd
auaaucucuucuaaa

SEQ ID NO: 2685728 - RNA, 14 nt, Haemophilus influenzae Rd
auaaucugauuauu

SEQ ID NO: 2685729 - RNA, 17 nt, Haemophilus influenzae Rd
auaaucugauugagaaa

SEQ ID NO: 2685730 - RNA, 17 nt, Haemophilus influenzae Rd
auaaucuuaaauaauua

SEQ ID NO: 2685731 - RNA, 20 nt, Haemophilus influenzae Rd
auaaucuucccauuugaauu

SEQ ID NO: 2685732 - RNA, 14 nt, Haemophilus influenzae Rd
auacacaaaucaca

SEQ ID NO: 2685733 - RNA, 13 nt, Haemophilus influenzae Rd
auacacuucuaaa

SEQ ID NO: 2685734 - RNA, 17 nt, Haemophilus influenzae Rd
auacacuuuaaauuuuc

SEQ ID NO: 2685735 - RNA, 21 nt, Haemophilus influenzae Rd
auacacuuuaaauuuuccugu

SEQ ID NO: 2685736 - RNA, 14 nt, Haemophilus influenzae Rd
auacacuuuuaacu

SEQ ID NO: 2685737 - RNA, 19 nt, Haemophilus influenzae Rd
auacagaaaccagaaauag

SEQ ID NO: 2685738 - RNA, 14 nt, Haemophilus influenzae Rd
auacagcucaaaau

SEQ ID NO: 2685739 - RNA, 14 nt, Haemophilus influenzae Rd
auacaguaaaaaua

SEQ ID NO: 2685740 - RNA, 17 nt, Haemophilus influenzae Rd
auacagugacaaauuuu

SEQ ID NO: 2685741 - RNA, 17 nt, Haemophilus influenzae Rd
auacauaauuaaauuaa

SEQ ID NO: 2685742 - RNA, 18 nt, Haemophilus influenzae Rd
auacauaauuaaauuaag

SEQ ID NO: 2685743 - RNA, 15 nt, Haemophilus influenzae Rd
auacaucacuaauac

SEQ ID NO: 2685744 - RNA, 16 nt, Haemophilus influenzae Rd
auacaucuaauuuuag

SEQ ID NO: 2685745 - RNA, 18 nt, Haemophilus influenzae Rd
auacaucuaauuuuaguu

SEQ ID NO: 2685746 - RNA, 18 nt, Haemophilus influenzae Rd
auacaucuacuguggcaa

SEQ ID NO: 2685747 - RNA, 21 nt, Haemophilus influenzae Rd
auacaucucauaaaguauacu

SEQ ID NO: 2685748 - RNA, 18 nt, Haemophilus influenzae Rd
auacauggaacguuuuuu

SEQ ID NO: 2685749 - RNA, 22 nt, Haemophilus influenzae Rd
auacauggaacguuuuuuacuu

SEQ ID NO: 2685750 - RNA, 17 nt, Haemophilus influenzae Rd
auacauuauuaaaagca

SEQ ID NO: 2685751 - RNA, 23 nt, Haemophilus influenzae Rd
auacauugcuauggcaaugaaua

SEQ ID NO: 2685752 - RNA, 22 nt, Haemophilus influenzae Rd
auacauuggguuacggcuaaau

SEQ ID NO: 2685753 - RNA, 17 nt, Haemophilus influenzae Rd
auacauuucuaaaauaa

SEQ ID NO: 2685754 - RNA, 18 nt, Haemophilus influenzae Rd
auacauuucuaaaauaau

SEQ ID NO: 2685755 - RNA, 22 nt, Haemophilus influenzae Rd
auacauuuuguuucuaaauuau

SEQ ID NO: 2685756 - RNA, 12 nt, Haemophilus influenzae Rd
auaccaaaauug

SEQ ID NO: 2685757 - RNA, 14 nt, Haemophilus influenzae Rd
auaccaagauaaua

SEQ ID NO: 2685758 - RNA, 21 nt, Haemophilus influenzae Rd
auaccaagauaauaaaguuac

SEQ ID NO: 2685759 - RNA, 23 nt, Haemophilus influenzae Rd
auaccaaggcauuuuuucugcau

SEQ ID NO: 2685760 - RNA, 14 nt, Haemophilus influenzae Rd
auaccaauaaucaa

SEQ ID NO: 2685761 - RNA, 13 nt, Haemophilus influenzae Rd
auaccaauugcaa

SEQ ID NO: 2685762 - RNA, 12 nt, Haemophilus influenzae Rd
auaccacacccu

SEQ ID NO: 2685763 - RNA, 18 nt, Haemophilus influenzae Rd
auaccacacccuuuucaa

SEQ ID NO: 2685764 - RNA, 13 nt, Haemophilus influenzae Rd
auaccacauaaau

SEQ ID NO: 2685765 - RNA, 15 nt, Haemophilus influenzae Rd
auaccacgcgugaaa

SEQ ID NO: 2685766 - RNA, 14 nt, Haemophilus influenzae Rd
auaccacuccccaa

SEQ ID NO: 2685767 - RNA, 20 nt, Haemophilus influenzae Rd
auaccacuccccaaaaacca

SEQ ID NO: 2685768 - RNA, 15 nt, Haemophilus influenzae Rd
auaccagaggaauau

SEQ ID NO: 2685769 - RNA, 16 nt, Haemophilus influenzae Rd
auaccagccugaaugg

SEQ ID NO: 2685770 - RNA, 18 nt, Haemophilus influenzae Rd
auaccauacauaaaaucu

SEQ ID NO: 2685771 - RNA, 18 nt, Haemophilus influenzae Rd
auaccauuuaaaaguaaa

SEQ ID NO: 2685772 - RNA, 21 nt, Haemophilus influenzae Rd
auaccauuuaaaaguaaaaau

SEQ ID NO: 2685773 - RNA, 23 nt, Haemophilus influenzae Rd
auaccauuuaaaaguaaaaauaa

SEQ ID NO: 2685774 - RNA, 13 nt, Haemophilus influenzae Rd
auacccauuucga

SEQ ID NO: 2685775 - RNA, 18 nt, Haemophilus influenzae Rd
auaccccaauuaagucaa

SEQ ID NO: 2685776 - RNA, 22 nt, Haemophilus influenzae Rd
auaccgaguaacguuaaacccu

SEQ ID NO: 2685777 - RNA, 18 nt, Haemophilus influenzae Rd
auaccgauaauauguuuu

SEQ ID NO: 2685778 - RNA, 16 nt, Haemophilus influenzae Rd
auaccgcacuuuuauu

SEQ ID NO: 2685779 - RNA, 13 nt, Haemophilus influenzae Rd
auaccgcccauuc

SEQ ID NO: 2685780 - RNA, 14 nt, Haemophilus influenzae Rd
auaccgcccauucc

SEQ ID NO: 2685781 - RNA, 15 nt, Haemophilus influenzae Rd
auaccgcccauucca

SEQ ID NO: 2685782 - RNA, 23 nt, Haemophilus influenzae Rd
auaccguauuuuuuuaauuuuuu

SEQ ID NO: 2685783 - RNA, 17 nt, Haemophilus influenzae Rd
auaccguuacgaacuuc

SEQ ID NO: 2685784 - RNA, 16 nt, Haemophilus influenzae Rd
auaccuagacgauugc

SEQ ID NO: 2685785 - RNA, 16 nt, Haemophilus influenzae Rd
auacgaaaaauuacuu

SEQ ID NO: 2685786 - RNA, 15 nt, Haemophilus influenzae Rd
auacgaauguuugau

SEQ ID NO: 2685787 - RNA, 15 nt, Haemophilus influenzae Rd
auacgaguaaaaaau

SEQ ID NO: 2685788 - RNA, 14 nt, Haemophilus influenzae Rd
auacgauagguaaa

SEQ ID NO: 2685789 - RNA, 14 nt, Haemophilus influenzae Rd
auacgauauuugug

SEQ ID NO: 2685790 - RNA, 18 nt, Haemophilus influenzae Rd
auacgaucacgauuuuuc

SEQ ID NO: 2685791 - RNA, 13 nt, Haemophilus influenzae Rd
auacgaucugcau

SEQ ID NO: 2685792 - RNA, 18 nt, Haemophilus influenzae Rd
auacgauucguuucagua

SEQ ID NO: 2685793 - RNA, 20 nt, Haemophilus influenzae Rd
auacgcccauugaaauaaca

SEQ ID NO: 2685794 - RNA, 19 nt, Haemophilus influenzae Rd
auacgcgcccauucauuuu

SEQ ID NO: 2685795 - RNA, 20 nt, Haemophilus influenzae Rd
auacgcuucuugaauaugau

SEQ ID NO: 2685796 - RNA, 19 nt, Haemophilus influenzae Rd
auacguaauacuuuugcuu

SEQ ID NO: 2685797 - RNA, 15 nt, Haemophilus influenzae Rd
auacguauaauugac

SEQ ID NO: 2685798 - RNA, 15 nt, Haemophilus influenzae Rd
auacgucaauagcgg

SEQ ID NO: 2685799 - RNA, 14 nt, Haemophilus influenzae Rd
auacgucaauugcu

SEQ ID NO: 2685800 - RNA, 18 nt, Haemophilus influenzae Rd
auacuaaauacauuuuua

SEQ ID NO: 2685801 - RNA, 14 nt, Haemophilus influenzae Rd
auacuaacucaaaa

SEQ ID NO: 2685802 - RNA, 19 nt, Haemophilus influenzae Rd
auacuaacucaaaauacuc

SEQ ID NO: 2685803 - RNA, 21 nt, Haemophilus influenzae Rd
auacuaaggguauacuuuauu

SEQ ID NO: 2685804 - RNA, 21 nt, Haemophilus influenzae Rd
auacuaauuuuaguauucuuu

SEQ ID NO: 2685805 - RNA, 19 nt, Haemophilus influenzae Rd
auacuacacccaaaugcca

SEQ ID NO: 2685806 - RNA, 11 nt, Haemophilus influenzae Rd
auacuauauuu

SEQ ID NO: 2685807 - RNA, 15 nt, Haemophilus influenzae Rd
auacuauauuuucuu

SEQ ID NO: 2685808 - RNA, 11 nt, Haemophilus influenzae Rd
auacucacaga

SEQ ID NO: 2685809 - RNA, 20 nt, Haemophilus influenzae Rd
auacucaccgcacuuugugg

SEQ ID NO: 2685810 - RNA, 20 nt, Haemophilus influenzae Rd
auacuccacuauaaaauacu

SEQ ID NO: 2685811 - RNA, 22 nt, Haemophilus influenzae Rd
auacuccacuauaaaauacuau

SEQ ID NO: 2685812 - RNA, 21 nt, Haemophilus influenzae Rd
auacucguucguuauuuugau

SEQ ID NO: 2685813 - RNA, 23 nt, Haemophilus influenzae Rd
auacucucccgaaaauuguucag

SEQ ID NO: 2685814 - RNA, 24 nt, Haemophilus influenzae Rd
auacucuucaaguuuaucguauuc

SEQ ID NO: 2685815 - RNA, 13 nt, Haemophilus influenzae Rd
auacugaaaugau

SEQ ID NO: 2685816 - RNA, 19 nt, Haemophilus influenzae Rd
auacugaaaugauuauaau

SEQ ID NO: 2685817 - RNA, 16 nt, Haemophilus influenzae Rd
auacugaauuaccagc

SEQ ID NO: 2685818 - RNA, 13 nt, Haemophilus influenzae Rd
auacugauaccgu

SEQ ID NO: 2685819 - RNA, 15 nt, Haemophilus influenzae Rd
auacugcacaaucaa

SEQ ID NO: 2685820 - RNA, 17 nt, Haemophilus influenzae Rd
auacugcgacuuucccu

SEQ ID NO: 2685821 - RNA, 17 nt, Haemophilus influenzae Rd
auacugcucuuggauuu

SEQ ID NO: 2685822 - RNA, 13 nt, Haemophilus influenzae Rd
auacugcuuguuc

SEQ ID NO: 2685823 - RNA, 19 nt, Haemophilus influenzae Rd
auacugcuuucuagaugau

SEQ ID NO: 2685824 - RNA, 22 nt, Haemophilus influenzae Rd
auacuggcacuaaaccugcuuc

SEQ ID NO: 2685825 - RNA, 16 nt, Haemophilus influenzae Rd
auacuguuuggcaaau

SEQ ID NO: 2685826 - RNA, 12 nt, Haemophilus influenzae Rd
auacuguuuuau

SEQ ID NO: 2685827 - RNA, 14 nt, Haemophilus influenzae Rd
auacuguuuuaugc

SEQ ID NO: 2685828 - RNA, 18 nt, Haemophilus influenzae Rd
auacuguuuuaugcuaaa

SEQ ID NO: 2685829 - RNA, 21 nt, Haemophilus influenzae Rd
auacuuaauagcugggcaaaa

SEQ ID NO: 2685830 - RNA, 15 nt, Haemophilus influenzae Rd
auacuuaauuucuca

SEQ ID NO: 2685831 - RNA, 16 nt, Haemophilus influenzae Rd
auacuuaauuucucag

SEQ ID NO: 2685832 - RNA, 15 nt, Haemophilus influenzae Rd
auacuuacucaauau

SEQ ID NO: 2685833 - RNA, 21 nt, Haemophilus influenzae Rd
auacuucggggaucauuucau

SEQ ID NO: 2685834 - RNA, 22 nt, Haemophilus influenzae Rd
auacuugacaacgcucacuuaa

SEQ ID NO: 2685835 - RNA, 16 nt, Haemophilus influenzae Rd
auacuugaccaaaauu

SEQ ID NO: 2685836 - RNA, 13 nt, Haemophilus influenzae Rd
auacuugcaguga

SEQ ID NO: 2685837 - RNA, 20 nt, Haemophilus influenzae Rd
auacuugccacagguaaaga

SEQ ID NO: 2685838 - RNA, 14 nt, Haemophilus influenzae Rd
auaguuauuuauuc

SEQ ID NO: 2685839 - RNA, 14 nt, Haemophilus influenzae Rd
auaguucacuaaaa

SEQ ID NO: 2685840 - RNA, 21 nt, Haemophilus influenzae Rd
auaguugaugaaccauaaaca

SEQ ID NO: 2685841 - RNA, 23 nt, Haemophilus influenzae Rd
auaguugaugaaccauaaacaau

SEQ ID NO: 2685842 - RNA, 20 nt, Haemophilus influenzae Rd
auaguuggauuauuuagaua

SEQ ID NO: 2685843 - RNA, 16 nt, Haemophilus influenzae Rd
auaguuggguaaucaa

SEQ ID NO: 2685844 - RNA, 21 nt, Haemophilus influenzae Rd
auaguuggguaaucaaauuca

SEQ ID NO: 2685845 - RNA, 14 nt, Haemophilus influenzae Rd
auaguuuaaacuca

SEQ ID NO: 2685846 - RNA, 17 nt, Haemophilus influenzae Rd
auaguuuuauuuuaauu

SEQ ID NO: 2685847 - RNA, 21 nt, Haemophilus influenzae Rd
auaguuuuauuuuaauuuuau

SEQ ID NO: 2685848 - RNA, 14 nt, Haemophilus influenzae Rd
auaguuuucacaau

SEQ ID NO: 2685849 - RNA, 13 nt, Haemophilus influenzae Rd
auaguuuucugau

SEQ ID NO: 2685850 - RNA, 14 nt, Haemophilus influenzae Rd
auauaaaaaacccg

SEQ ID NO: 2685851 - RNA, 22 nt, Haemophilus influenzae Rd
auauaaaaaagcguugaguaaa

SEQ ID NO: 2685852 - RNA, 22 nt, Haemophilus influenzae Rd
auauaaaagugcgguaaaaauu

SEQ ID NO: 2685853 - RNA, 13 nt, Haemophilus influenzae Rd
auauaaaauaaaa

SEQ ID NO: 2685854 - RNA, 11 nt, Haemophilus influenzae Rd
auauaaaauau

SEQ ID NO: 2685855 - RNA, 21 nt, Haemophilus influenzae Rd
auauaaacggagcgauguuuu

SEQ ID NO: 2685856 - RNA, 16 nt, Haemophilus influenzae Rd
auauaaacguugugaa

SEQ ID NO: 2685857 - RNA, 12 nt, Haemophilus influenzae Rd
auauaaauaaaa

SEQ ID NO: 2685858 - RNA, 19 nt, Haemophilus influenzae Rd
auauaaauuauguuaaauu

SEQ ID NO: 2685859 - RNA, 13 nt, Haemophilus influenzae Rd
auauaacaacaac

SEQ ID NO: 2685860 - RNA, 23 nt, Haemophilus influenzae Rd
auauaacauaccuagauugcuuu

SEQ ID NO: 2685861 - RNA, 22 nt, Haemophilus influenzae Rd
auauaacucaacaccgcaaaaa

SEQ ID NO: 2685862 - RNA, 13 nt, Haemophilus influenzae Rd
auauaagaaauaa

SEQ ID NO: 2685863 - RNA, 21 nt, Haemophilus influenzae Rd
auauaagaaaucucuuucaau

SEQ ID NO: 2685864 - RNA, 20 nt, Haemophilus influenzae Rd
auauaagcaaagaaauuuaa

SEQ ID NO: 2685865 - RNA, 20 nt, Haemophilus influenzae Rd
auauaagcguucguuaucau

SEQ ID NO: 2685866 - RNA, 14 nt, Haemophilus influenzae Rd
auauaaguuuguuu

SEQ ID NO: 2685867 - RNA, 16 nt, Haemophilus influenzae Rd
auauaauaaauucaau

SEQ ID NO: 2685868 - RNA, 15 nt, Haemophilus influenzae Rd
auauaauacguaaau

SEQ ID NO: 2685869 - RNA, 15 nt, Haemophilus influenzae Rd
auauaaugaaaacag

SEQ ID NO: 2685870 - RNA, 13 nt, Haemophilus influenzae Rd
auauaauuaucaa

SEQ ID NO: 2685871 - RNA, 15 nt, Haemophilus influenzae Rd
auauaauuuaacaua

SEQ ID NO: 2685872 - RNA, 17 nt, Haemophilus influenzae Rd
auauaauuuaacauaac

SEQ ID NO: 2685873 - RNA, 12 nt, Haemophilus influenzae Rd
auauaauuuacu

SEQ ID NO: 2685874 - RNA, 14 nt, Haemophilus influenzae Rd
auauacauuaacaa

SEQ ID NO: 2685875 - RNA, 19 nt, Haemophilus influenzae Rd
auauacauuaacaaugcgg

SEQ ID NO: 2685876 - RNA, 13 nt, Haemophilus influenzae Rd
auauaccaauaau

SEQ ID NO: 2685877 - RNA, 14 nt, Haemophilus influenzae Rd
auauaccaauaauu

SEQ ID NO: 2685878 - RNA, 15 nt, Haemophilus influenzae Rd
auauaccauucuuuc

SEQ ID NO: 2685879 - RNA, 16 nt, Haemophilus influenzae Rd
auauaccauuugauuc

SEQ ID NO: 2685880 - RNA, 16 nt, Haemophilus influenzae Rd
auauacggcuaaacga

SEQ ID NO: 2685881 - RNA, 16 nt, Haemophilus influenzae Rd
auauacuuuuuugaua

SEQ ID NO: 2685882 - RNA, 18 nt, Haemophilus influenzae Rd
auauaggcuauauuuucc

SEQ ID NO: 2685883 - RNA, 19 nt, Haemophilus influenzae Rd
auauaggguaaauaaaaau

SEQ ID NO: 2685884 - RNA, 14 nt, Haemophilus influenzae Rd
auauagucaaauaa

SEQ ID NO: 2685885 - RNA, 16 nt, Haemophilus influenzae Rd
auauagugaaaaaaua

SEQ ID NO: 2685886 - RNA, 22 nt, Haemophilus influenzae Rd
auauaguuuuacugcuuuauuu

SEQ ID NO: 2685887 - RNA, 12 nt, Haemophilus influenzae Rd
auauauaaauuu

SEQ ID NO: 2685888 - RNA, 13 nt, Haemophilus influenzae Rd
auauauaaauuua

SEQ ID NO: 2685889 - RNA, 14 nt, Haemophilus influenzae Rd
auauauaucacaga

SEQ ID NO: 2685890 - RNA, 16 nt, Haemophilus influenzae Rd
auauaucacagauuuu

SEQ ID NO: 2685891 - RNA, 19 nt, Haemophilus influenzae Rd
auauaucacagauuuuuaa

SEQ ID NO: 2685892 - RNA, 22 nt, Haemophilus influenzae Rd
auauauccaaaugccuaacaca

SEQ ID NO: 2685893 - RNA, 19 nt, Haemophilus influenzae Rd
auauaucucuaaaaaauaa

SEQ ID NO: 2685894 - RNA, 15 nt, Haemophilus influenzae Rd
auauaugaaaaauaa

SEQ ID NO: 2685895 - RNA, 15 nt, Haemophilus influenzae Rd
auauaugauuauaaa

SEQ ID NO: 2685896 - RNA, 13 nt, Haemophilus influenzae Rd
auauauucugcua

SEQ ID NO: 2685897 - RNA, 12 nt, Haemophilus influenzae Rd
auauauugguuu

SEQ ID NO: 2685898 - RNA, 12 nt, Haemophilus influenzae Rd
auauauuucuaa

SEQ ID NO: 2685899 - RNA, 12 nt, Haemophilus influenzae Rd
auauauuuuccu

SEQ ID NO: 2685900 - RNA, 18 nt, Haemophilus influenzae Rd
auaucaaaaaguugaauu

SEQ ID NO: 2685901 - RNA, 15 nt, Haemophilus influenzae Rd
auaucaaagaaaaau

SEQ ID NO: 2685902 - RNA, 17 nt, Haemophilus influenzae Rd
auaucaagcagauuauu

SEQ ID NO: 2685903 - RNA, 10 nt, Haemophilus influenzae Rd
auaucaaguc

SEQ ID NO: 2685904 - RNA, 22 nt, Haemophilus influenzae Rd
auaucaauuuggcucacaagac

SEQ ID NO: 2685905 - RNA, 15 nt, Haemophilus influenzae Rd
auaucacaaccacca

SEQ ID NO: 2685906 - RNA, 14 nt, Haemophilus influenzae Rd
auaucacagauuuu

SEQ ID NO: 2685907 - RNA, 17 nt, Haemophilus influenzae Rd
auaucacagauuuuuaa

SEQ ID NO: 2685908 - RNA, 17 nt, Haemophilus influenzae Rd
auaucacagauuuuuua

SEQ ID NO: 2685909 - RNA, 21 nt, Haemophilus influenzae Rd
auaucacagauuuuuuauuaa

SEQ ID NO: 2685910 - RNA, 14 nt, Haemophilus influenzae Rd
auaucacauuuuau

SEQ ID NO: 2685911 - RNA, 15 nt, Haemophilus influenzae Rd
auaucacgacaaagu

SEQ ID NO: 2685912 - RNA, 23 nt, Haemophilus influenzae Rd
auaucacgcaccacuucauauaa

SEQ ID NO: 2685913 - RNA, 16 nt, Haemophilus influenzae Rd
auaucacgccuuuuuu

SEQ ID NO: 2685914 - RNA, 13 nt, Haemophilus influenzae Rd
auaucacuuuuuu

SEQ ID NO: 2685915 - RNA, 21 nt, Haemophilus influenzae Rd
auaucagcccuuuguuuuaau

SEQ ID NO: 2685916 - RNA, 21 nt, Haemophilus influenzae Rd
auaucaucaaccaaaauacaa

SEQ ID NO: 2685917 - RNA, 23 nt, Haemophilus influenzae Rd
auaucaucaaccaaaauacaauc

SEQ ID NO: 2685918 - RNA, 15 nt, Haemophilus influenzae Rd
auaucaucaagauuu

SEQ ID NO: 2685919 - RNA, 19 nt, Haemophilus influenzae Rd
auaucaucaucagacauau

SEQ ID NO: 2685920 - RNA, 16 nt, Haemophilus influenzae Rd
auauccaaaucaaaaa

SEQ ID NO: 2685921 - RNA, 14 nt, Haemophilus influenzae Rd
auauccaaaugccu

SEQ ID NO: 2685922 - RNA, 20 nt, Haemophilus influenzae Rd
auauccaaaugccuaacaca

SEQ ID NO: 2685923 - RNA, 16 nt, Haemophilus influenzae Rd
auauccacauaaccaa

SEQ ID NO: 2685924 - RNA, 13 nt, Haemophilus influenzae Rd
auauccauaaaca

SEQ ID NO: 2685925 - RNA, 15 nt, Haemophilus influenzae Rd
auauccauugcaaca

SEQ ID NO: 2685926 - RNA, 16 nt, Haemophilus influenzae Rd
auaucccaacuuuaug

SEQ ID NO: 2685927 - RNA, 22 nt, Haemophilus influenzae Rd
auaucccaagguuuuuuagauu

SEQ ID NO: 2685928 - RNA, 19 nt, Haemophilus influenzae Rd
auauccgagcucuuucauu

SEQ ID NO: 2685929 - RNA, 19 nt, Haemophilus influenzae Rd
auaucgaauuaaagaaaaa

SEQ ID NO: 2685930 - RNA, 20 nt, Haemophilus influenzae Rd
auaucgagcagacaaaauug

SEQ ID NO: 2685931 - RNA, 16 nt, Haemophilus influenzae Rd
auaucgaggcuuuuuu

SEQ ID NO: 2685932 - RNA, 17 nt, Haemophilus influenzae Rd
auaucgcaaucaauucu

SEQ ID NO: 2685933 - RNA, 18 nt, Haemophilus influenzae Rd
auaucgcccuuauuuugu

SEQ ID NO: 2685934 - RNA, 14 nt, Haemophilus influenzae Rd
auaucguauguuaa

SEQ ID NO: 2685935 - RNA, 14 nt, Haemophilus influenzae Rd
auaucuacuuucag

SEQ ID NO: 2685936 - RNA, 16 nt, Haemophilus influenzae Rd
auaucuagcacagcaa

SEQ ID NO: 2685937 - RNA, 22 nt, Haemophilus influenzae Rd
auaucuaggcuaauuauuuaaa

SEQ ID NO: 2685938 - RNA, 18 nt, Haemophilus influenzae Rd
auaucuauccaacucauu

SEQ ID NO: 2685939 - RNA, 20 nt, Haemophilus influenzae Rd
auaucuauuggaauggcaaa

SEQ ID NO: 2685940 - RNA, 14 nt, Haemophilus influenzae Rd
auaucucacaauaa

SEQ ID NO: 2685941 - RNA, 11 nt, Haemophilus influenzae Rd
auaucucugcc

SEQ ID NO: 2685942 - RNA, 13 nt, Haemophilus influenzae Rd
auaucucugccau

SEQ ID NO: 2685943 - RNA, 13 nt, Haemophilus influenzae Rd
auaucugaaaaua

SEQ ID NO: 2685944 - RNA, 19 nt, Haemophilus influenzae Rd
auaucugauacuuugcuug

SEQ ID NO: 2685945 - RNA, 22 nt, Haemophilus influenzae Rd
auauuggucacgcuguaaacaa

SEQ ID NO: 2685946 - RNA, 22 nt, Haemophilus influenzae Rd
auauuguaaugucgugaaagaa

SEQ ID NO: 2685947 - RNA, 22 nt, Haemophilus influenzae Rd
auauuguaggaagacaggauug

SEQ ID NO: 2685948 - RNA, 15 nt, Haemophilus influenzae Rd
auauugucuauuugc

SEQ ID NO: 2685949 - RNA, 14 nt, Haemophilus influenzae Rd
auauuguuucaaca

SEQ ID NO: 2685950 - RNA, 14 nt, Haemophilus influenzae Rd
auauuguuuuaauu

SEQ ID NO: 2685951 - RNA, 12 nt, Haemophilus influenzae Rd
auauuuaaauac

SEQ ID NO: 2685952 - RNA, 15 nt, Haemophilus influenzae Rd
auauuuaaugauaau

SEQ ID NO: 2685953 - RNA, 22 nt, Haemophilus influenzae Rd
auauuuaaugauaaucuaaaaa

SEQ ID NO: 2685954 - RNA, 17 nt, Haemophilus influenzae Rd
auauuuaauguguagau

SEQ ID NO: 2685955 - RNA, 23 nt, Haemophilus influenzae Rd
auauuuacaacugcaaaugaaac

SEQ ID NO: 2685956 - RNA, 21 nt, Haemophilus influenzae Rd
auauuuaggcuauuuuauaau

SEQ ID NO: 2685957 - RNA, 18 nt, Haemophilus influenzae Rd
auauuucacuaaauccuu

SEQ ID NO: 2685958 - RNA, 12 nt, Haemophilus influenzae Rd
auauuucaguau

SEQ ID NO: 2685959 - RNA, 14 nt, Haemophilus influenzae Rd
auauuucaguauuu

SEQ ID NO: 2685960 - RNA, 13 nt, Haemophilus influenzae Rd
auauuuccuucua

SEQ ID NO: 2685961 - RNA, 16 nt, Haemophilus influenzae Rd
auauuucuucauuuua

SEQ ID NO: 2685962 - RNA, 18 nt, Haemophilus influenzae Rd
auauuucuucauuuuaaa

SEQ ID NO: 2685963 - RNA, 19 nt, Haemophilus influenzae Rd
auauuucuucauuuuaaau

SEQ ID NO: 2685964 - RNA, 22 nt, Haemophilus influenzae Rd
auauuucuucgauuuuucuaaa

SEQ ID NO: 2685965 - RNA, 21 nt, Haemophilus influenzae Rd
auauuucuuuucaaacacaaa

SEQ ID NO: 2685966 - RNA, 22 nt, Haemophilus influenzae Rd
auauuucuuuucaaacacaaaa

SEQ ID NO: 2685967 - RNA, 15 nt, Haemophilus influenzae Rd
auauuucuuuuugau

SEQ ID NO: 2685968 - RNA, 21 nt, Haemophilus influenzae Rd
auauuugaguuauuuuuaauc

SEQ ID NO: 2685969 - RNA, 21 nt, Haemophilus influenzae Rd
auauuuguugccauuguuaaa

SEQ ID NO: 2685970 - RNA, 13 nt, Haemophilus influenzae Rd
auauuuuaaauaa

SEQ ID NO: 2685971 - RNA, 15 nt, Haemophilus influenzae Rd
auauuuuaaauaauu

SEQ ID NO: 2685972 - RNA, 22 nt, Haemophilus influenzae Rd
auauuuuaauaaagauaaauua

SEQ ID NO: 2685973 - RNA, 18 nt, Haemophilus influenzae Rd
auauuuuaaugaaaguaa

SEQ ID NO: 2685974 - RNA, 22 nt, Haemophilus influenzae Rd
auauuuuccccuuguucuucau

SEQ ID NO: 2685975 - RNA, 17 nt, Haemophilus influenzae Rd
auauuuugaauaauaaa

SEQ ID NO: 2685976 - RNA, 21 nt, Haemophilus influenzae Rd
auauuuugcauguuauucucc

SEQ ID NO: 2685977 - RNA, 18 nt, Haemophilus influenzae Rd
auauuuuguugaagaaag

SEQ ID NO: 2685978 - RNA, 15 nt, Haemophilus influenzae Rd
auauuuuuaauuugg

SEQ ID NO: 2685979 - RNA, 24 nt, Haemophilus influenzae Rd
auauuuuuauuugguuaugauaua

SEQ ID NO: 2685980 - RNA, 10 nt, Haemophilus influenzae Rd
auauuuuuca

SEQ ID NO: 2685981 - RNA, 13 nt, Haemophilus influenzae Rd
auauuuuugccaa

SEQ ID NO: 2685982 - RNA, 20 nt, Haemophilus influenzae Rd
auauuuuuuacuauucuuca

SEQ ID NO: 2685983 - RNA, 16 nt, Haemophilus influenzae Rd
auauuuuuuaguuugu

SEQ ID NO: 2685984 - RNA, 23 nt, Haemophilus influenzae Rd
auauuuuuucagccuauuuuuag

SEQ ID NO: 2685985 - RNA, 13 nt, Haemophilus influenzae Rd
auauuuuuucuua

SEQ ID NO: 2685986 - RNA, 15 nt, Haemophilus influenzae Rd
aucaaaaaaauaagu

SEQ ID NO: 2685987 - RNA, 12 nt, Haemophilus influenzae Rd
aucaaaaagaaa

SEQ ID NO: 2685988 - RNA, 14 nt, Haemophilus influenzae Rd
aucaaaaagaaaua

SEQ ID NO: 2685989 - RNA, 15 nt, Haemophilus influenzae Rd
aucaaaaauaaaaag

SEQ ID NO: 2685990 - RNA, 15 nt, Haemophilus influenzae Rd
aucaaaaaucaacca

SEQ ID NO: 2685991 - RNA, 16 nt, Haemophilus influenzae Rd
aucaaaaaugcuuuug

SEQ ID NO: 2685992 - RNA, 19 nt, Haemophilus influenzae Rd
aucaaaaccaaucauugga

SEQ ID NO: 2685993 - RNA, 17 nt, Haemophilus influenzae Rd
aucaaaaccauuuuucg

SEQ ID NO: 2685994 - RNA, 14 nt, Haemophilus influenzae Rd
aucaaaacuugcua

SEQ ID NO: 2685995 - RNA, 16 nt, Haemophilus influenzae Rd
aucaaaagaauuaaaa

SEQ ID NO: 2685996 - RNA, 19 nt, Haemophilus influenzae Rd
aucaaaagaauuaaaaaug

SEQ ID NO: 2685997 - RNA, 15 nt, Haemophilus influenzae Rd
aucaaaauaaauaaa

SEQ ID NO: 2685998 - RNA, 16 nt, Haemophilus influenzae Rd
aucaaaauuauaaacc

SEQ ID NO: 2685999 - RNA, 22 nt, Haemophilus influenzae Rd
aucaaaauuauguuuuaucuuu

SEQ ID NO: 2686000 - RNA, 12 nt, Haemophilus influenzae Rd
aucaaaauuuaa

SEQ ID NO: 2686001 - RNA, 20 nt, Haemophilus influenzae Rd
aucaaacaguucaauaaaaa

SEQ ID NO: 2686002 - RNA, 16 nt, Haemophilus influenzae Rd
aucaaaccaaccacag

SEQ ID NO: 2686003 - RNA, 20 nt, Haemophilus influenzae Rd
aucaaaccugcuucauccac

SEQ ID NO: 2686004 - RNA, 17 nt, Haemophilus influenzae Rd
aucaaagaaaaauugug

SEQ ID NO: 2686005 - RNA, 13 nt, Haemophilus influenzae Rd
aucaaagaaacug

SEQ ID NO: 2686006 - RNA, 16 nt, Haemophilus influenzae Rd
aucaaagaaacugucu

SEQ ID NO: 2686007 - RNA, 19 nt, Haemophilus influenzae Rd
aucaaagaaacugucuacu

SEQ ID NO: 2686008 - RNA, 15 nt, Haemophilus influenzae Rd
aucaaagaauuuuuu

SEQ ID NO: 2686009 - RNA, 12 nt, Haemophilus influenzae Rd
aucaaagagaag

SEQ ID NO: 2686010 - RNA, 20 nt, Haemophilus influenzae Rd
aucaaagcgagaaaaacgaa

SEQ ID NO: 2686011 - RNA, 22 nt, Haemophilus influenzae Rd
aucaaagcguucauuuugaucu

SEQ ID NO: 2686012 - RNA, 23 nt, Haemophilus influenzae Rd
aucaaagcguuuuucuacauaau

SEQ ID NO: 2686013 - RNA, 14 nt, Haemophilus influenzae Rd
aucaaagcucaccu

SEQ ID NO: 2686014 - RNA, 19 nt, Haemophilus influenzae Rd
aucaaaguagucuauuuac

SEQ ID NO: 2686015 - RNA, 19 nt, Haemophilus influenzae Rd
aucaaagugcgguaaauuu

SEQ ID NO: 2686016 - RNA, 21 nt, Haemophilus influenzae Rd
aucaaagugcgguaaucuuuc

SEQ ID NO: 2686017 - RNA, 14 nt, Haemophilus influenzae Rd
aucaaauaaaauau

SEQ ID NO: 2686018 - RNA, 16 nt, Haemophilus influenzae Rd
aucaaauaaaauauuu

SEQ ID NO: 2686019 - RNA, 20 nt, Haemophilus influenzae Rd
aucaaaucauuuuuugcaaa

SEQ ID NO: 2686020 - RNA, 23 nt, Haemophilus influenzae Rd
aucaaaucuuuugcacuuugauu

SEQ ID NO: 2686021 - RNA, 14 nt, Haemophilus influenzae Rd
aucaaauucuaaaa

SEQ ID NO: 2686022 - RNA, 16 nt, Haemophilus influenzae Rd
aucaaauucuaaaaca

SEQ ID NO: 2686023 - RNA, 19 nt, Haemophilus influenzae Rd
aucaaauucucuguuucuu

SEQ ID NO: 2686024 - RNA, 19 nt, Haemophilus influenzae Rd
aucaaauugucaaaauuga

SEQ ID NO: 2686025 - RNA, 15 nt, Haemophilus influenzae Rd
aucaaauuuaggauu

SEQ ID NO: 2686026 - RNA, 13 nt, Haemophilus influenzae Rd
aucaaauuuuccu

SEQ ID NO: 2686027 - RNA, 14 nt, Haemophilus influenzae Rd
aucaaauuuuccuu

SEQ ID NO: 2686028 - RNA, 19 nt, Haemophilus influenzae Rd
aucaacaaaugucauugau

SEQ ID NO: 2686029 - RNA, 15 nt, Haemophilus influenzae Rd
aucaacaauccauuu

SEQ ID NO: 2686030 - RNA, 18 nt, Haemophilus influenzae Rd
aucaacacaccuauuuuu

SEQ ID NO: 2686031 - RNA, 14 nt, Haemophilus influenzae Rd
aucaacaucaacua

SEQ ID NO: 2686032 - RNA, 21 nt, Haemophilus influenzae Rd
aucaaccgcacuuuuauauuu

SEQ ID NO: 2686033 - RNA, 23 nt, Haemophilus influenzae Rd
aucaaccgcacuuuuauauuuau

SEQ ID NO: 2686034 - RNA, 20 nt, Haemophilus influenzae Rd
aucaacgcgccacgguaaau

SEQ ID NO: 2686035 - RNA, 19 nt, Haemophilus influenzae Rd
aucaacgcuguacaaagca

SEQ ID NO: 2686036 - RNA, 14 nt, Haemophilus influenzae Rd
aucaacuaaaaaau

SEQ ID NO: 2686037 - RNA, 15 nt, Haemophilus influenzae Rd
aucaacuaaaaaaua

SEQ ID NO: 2686038 - RNA, 12 nt, Haemophilus influenzae Rd
aucaacuaaauc

SEQ ID NO: 2686039 - RNA, 13 nt, Haemophilus influenzae Rd
aucaacuaaauca

SEQ ID NO: 2686040 - RNA, 20 nt, Haemophilus influenzae Rd
aucaacuaauuuauuaaaaa

SEQ ID NO: 2686041 - RNA, 15 nt, Haemophilus influenzae Rd
aucaacugcaacaau

SEQ ID NO: 2686042 - RNA, 22 nt, Haemophilus influenzae Rd
aucaacugcaacaauuucauca

SEQ ID NO: 2686043 - RNA, 14 nt, Haemophilus influenzae Rd
aucaacuuuaucau

SEQ ID NO: 2686044 - RNA, 12 nt, Haemophilus influenzae Rd
aucaagaaaguu

SEQ ID NO: 2686045 - RNA, 14 nt, Haemophilus influenzae Rd
aucaagaauuccau

SEQ ID NO: 2686046 - RNA, 18 nt, Haemophilus influenzae Rd
aucaagaauuccauugca

SEQ ID NO: 2686047 - RNA, 22 nt, Haemophilus influenzae Rd
aucaagaauuccauugcaucca

SEQ ID NO: 2686048 - RNA, 15 nt, Haemophilus influenzae Rd
aucaagauaacugau

SEQ ID NO: 2686049 - RNA, 16 nt, Haemophilus influenzae Rd
aucaagauaacugauu

SEQ ID NO: 2686050 - RNA, 23 nt, Haemophilus influenzae Rd
aucaagaugacgaaaugaaauua

SEQ ID NO: 2686051 - RNA, 17 nt, Haemophilus influenzae Rd
aucaagcaaacuuagau

SEQ ID NO: 2686052 - RNA, 15 nt, Haemophilus influenzae Rd
aucaagcacaaucag

SEQ ID NO: 2686053 - RNA, 14 nt, Haemophilus influenzae Rd
aucaagcacaucau

SEQ ID NO: 2686054 - RNA, 22 nt, Haemophilus influenzae Rd
aucaagcacuuuuccuuuuauu

SEQ ID NO: 2686055 - RNA, 21 nt, Haemophilus influenzae Rd
aucaagcccucgaauauugag

SEQ ID NO: 2686056 - RNA, 20 nt, Haemophilus influenzae Rd
aucaagcugugcaaaacuag

SEQ ID NO: 2686057 - RNA, 19 nt, Haemophilus influenzae Rd
aucaaggcuggaauaugga

SEQ ID NO: 2686058 - RNA, 23 nt, Haemophilus influenzae Rd
aucaaggcuuuaauuuuaucuaa

SEQ ID NO: 2686059 - RNA, 21 nt, Haemophilus influenzae Rd
aucaaggguacaacaaauuuc

SEQ ID NO: 2686060 - RNA, 15 nt, Haemophilus influenzae Rd
aucaaguuaaaaaau

SEQ ID NO: 2686061 - RNA, 21 nt, Haemophilus influenzae Rd
aucaaguuaaaaaaugauuaa

SEQ ID NO: 2686062 - RNA, 12 nt, Haemophilus influenzae Rd
aucaauaacaag

SEQ ID NO: 2686063 - RNA, 17 nt, Haemophilus influenzae Rd
aucaauaacugauuuug

SEQ ID NO: 2686064 - RNA, 18 nt, Haemophilus influenzae Rd
aucaauaauucauuagaa

SEQ ID NO: 2686065 - RNA, 19 nt, Haemophilus influenzae Rd
aucaauacgccuaaaacaa

SEQ ID NO: 2686066 - RNA, 21 nt, Haemophilus influenzae Rd
aucaauagaacgaaccccuug

SEQ ID NO: 2686067 - RNA, 17 nt, Haemophilus influenzae Rd
aucaauauaaccuuguc

SEQ ID NO: 2686068 - RNA, 11 nt, Haemophilus influenzae Rd
aucaauauuau

SEQ ID NO: 2686069 - RNA, 15 nt, Haemophilus influenzae Rd
aucaauauuaugugc

SEQ ID NO: 2686070 - RNA, 13 nt, Haemophilus influenzae Rd
aucaauauuuauu

SEQ ID NO: 2686071 - RNA, 17 nt, Haemophilus influenzae Rd
aucaaucaaauucaaca

SEQ ID NO: 2686072 - RNA, 12 nt, Haemophilus influenzae Rd
aucaaucacuuc

SEQ ID NO: 2686073 - RNA, 19 nt, Haemophilus influenzae Rd
aucaaucaggcuuucauuu

SEQ ID NO: 2686074 - RNA, 13 nt, Haemophilus influenzae Rd
aucaaucauaaaa

SEQ ID NO: 2686075 - RNA, 16 nt, Haemophilus influenzae Rd
aucaaucauaaaaaca

SEQ ID NO: 2686076 - RNA, 14 nt, Haemophilus influenzae Rd
aucaaucauuaacu

SEQ ID NO: 2686077 - RNA, 21 nt, Haemophilus influenzae Rd
aucaauccagaacgaacaauu

SEQ ID NO: 2686078 - RNA, 22 nt, Haemophilus influenzae Rd
aucaauccagaacgaacaauuu

SEQ ID NO: 2686079 - RNA, 21 nt, Haemophilus influenzae Rd
aucaaucggcaauucugcucu

SEQ ID NO: 2686080 - RNA, 16 nt, Haemophilus influenzae Rd
aucaaucgguuucaca

SEQ ID NO: 2686081 - RNA, 14 nt, Haemophilus influenzae Rd
aucaaucuuuaaaa

SEQ ID NO: 2686082 - RNA, 16 nt, Haemophilus influenzae Rd
aucaaucuuuaaaacu

SEQ ID NO: 2686083 - RNA, 13 nt, Haemophilus influenzae Rd
aucaaugcaacau

SEQ ID NO: 2686084 - RNA, 18 nt, Haemophilus influenzae Rd
aucaaugucguuauucau

SEQ ID NO: 2686085 - RNA, 21 nt, Haemophilus influenzae Rd
aucaauguuuucagcuucaau

SEQ ID NO: 2686086 - RNA, 18 nt, Haemophilus influenzae Rd
aucaauuacguaaucauc

SEQ ID NO: 2686087 - RNA, 23 nt, Haemophilus influenzae Rd
aucaauuagaugacuggcaaaaa

SEQ ID NO: 2686088 - RNA, 14 nt, Haemophilus influenzae Rd
aucaauucuuucac

SEQ ID NO: 2686089 - RNA, 21 nt, Haemophilus influenzae Rd
aucaauuugcggagaaaacaa

SEQ ID NO: 2686090 - RNA, 19 nt, Haemophilus influenzae Rd
aucaauuuggcucacaaga

SEQ ID NO: 2686091 - RNA, 16 nt, Haemophilus influenzae Rd
aucaauuuugacaauu

SEQ ID NO: 2686092 - RNA, 18 nt, Haemophilus influenzae Rd
aucaauuuuuucuccaca

SEQ ID NO: 2686093 - RNA, 21 nt, Haemophilus influenzae Rd
aucacaaaauggcaaacaaaa

SEQ ID NO: 2686094 - RNA, 23 nt, Haemophilus influenzae Rd
aucacaaaauggcaaacaaaaua

SEQ ID NO: 2686095 - RNA, 13 nt, Haemophilus influenzae Rd
aucacaaauccau

SEQ ID NO: 2686096 - RNA, 12 nt, Haemophilus influenzae Rd
aucacaaaucuu

SEQ ID NO: 2686097 - RNA, 14 nt, Haemophilus influenzae Rd
aucacaaauuucca

SEQ ID NO: 2686098 - RNA, 16 nt, Haemophilus influenzae Rd
aucacaacauauaaau

SEQ ID NO: 2686099 - RNA, 19 nt, Haemophilus influenzae Rd
aucacaacuugcaaccaua

SEQ ID NO: 2686100 - RNA, 21 nt, Haemophilus influenzae Rd
aucacaacuugcaaccauaaa

SEQ ID NO: 2686101 - RNA, 14 nt, Haemophilus influenzae Rd
aucacaagcaaguu

SEQ ID NO: 2686102 - RNA, 21 nt, Haemophilus influenzae Rd
aucacaaggcucaucauuaug

SEQ ID NO: 2686103 - RNA, 20 nt, Haemophilus influenzae Rd
aucacacguccaucacgcau

SEQ ID NO: 2686104 - RNA, 19 nt, Haemophilus influenzae Rd
aucacagccgcauuuuuac

SEQ ID NO: 2686105 - RNA, 14 nt, Haemophilus influenzae Rd
aucacaguuuuauu

SEQ ID NO: 2686106 - RNA, 23 nt, Haemophilus influenzae Rd
aucacaguuuuauuuuccaucau

SEQ ID NO: 2686107 - RNA, 13 nt, Haemophilus influenzae Rd
aucacauaaaaaa

SEQ ID NO: 2686108 - RNA, 11 nt, Haemophilus influenzae Rd
aucacauccac

SEQ ID NO: 2686109 - RNA, 17 nt, Haemophilus influenzae Rd
aucacauccacaaaaaa

SEQ ID NO: 2686110 - RNA, 13 nt, Haemophilus influenzae Rd
aucacaucgccaa

SEQ ID NO: 2686111 - RNA, 14 nt, Haemophilus influenzae Rd
aucacauuuuauug

SEQ ID NO: 2686112 - RNA, 17 nt, Haemophilus influenzae Rd
aucacccaucaaaucuu

SEQ ID NO: 2686113 - RNA, 14 nt, Haemophilus influenzae Rd
aucacccauuaaau

SEQ ID NO: 2686114 - RNA, 21 nt, Haemophilus influenzae Rd
aucacccccacggcaaucaua

SEQ ID NO: 2686115 - RNA, 16 nt, Haemophilus influenzae Rd
aucacccggcacauaa

SEQ ID NO: 2686116 - RNA, 17 nt, Haemophilus influenzae Rd
aucaccgcacuuuuauu

SEQ ID NO: 2686117 - RNA, 18 nt, Haemophilus influenzae Rd
aucaccgcacuuuuauug

SEQ ID NO: 2686118 - RNA, 23 nt, Haemophilus influenzae Rd
aucaccgcccuuuuuaucuauuu

SEQ ID NO: 2686119 - RNA, 17 nt, Haemophilus influenzae Rd
aucaccuguaaacaaau

SEQ ID NO: 2686120 - RNA, 11 nt, Haemophilus influenzae Rd
aucaccuucaa

SEQ ID NO: 2686121 - RNA, 17 nt, Haemophilus influenzae Rd
aucacgacaucaaucaa

SEQ ID NO: 2686122 - RNA, 16 nt, Haemophilus influenzae Rd
aucacgaguaauauga

SEQ ID NO: 2686123 - RNA, 14 nt, Haemophilus influenzae Rd
aucacgaucugcaa

SEQ ID NO: 2686124 - RNA, 13 nt, Haemophilus influenzae Rd
aucacgauuuuuc

SEQ ID NO: 2686125 - RNA, 14 nt, Haemophilus influenzae Rd
aucacgauuuuucu

SEQ ID NO: 2686126 - RNA, 15 nt, Haemophilus influenzae Rd
aucacgauuuuucuc

SEQ ID NO: 2686127 - RNA, 14 nt, Haemophilus influenzae Rd
aucacgccagauaa

SEQ ID NO: 2686128 - RNA, 15 nt, Haemophilus influenzae Rd
aucacgccagauaaa

SEQ ID NO: 2686129 - RNA, 15 nt, Haemophilus influenzae Rd
aucacguaauacaaa

SEQ ID NO: 2686130 - RNA, 17 nt, Haemophilus influenzae Rd
aucacguucaaaaauau

SEQ ID NO: 2686131 - RNA, 18 nt, Haemophilus influenzae Rd
aucacguucaaaaauauu

SEQ ID NO: 2686132 - RNA, 16 nt, Haemophilus influenzae Rd
aucacuaauauaaaga

SEQ ID NO: 2686133 - RNA, 23 nt, Haemophilus influenzae Rd
aucacuaauauaaagauaauuac

SEQ ID NO: 2686134 - RNA, 18 nt, Haemophilus influenzae Rd
aucacugaauuucauuca

SEQ ID NO: 2686135 - RNA, 20 nt, Haemophilus influenzae Rd
aucacuuaauuucuuaauua

SEQ ID NO: 2686136 - RNA, 14 nt, Haemophilus influenzae Rd
aucacuucaaaaaa

SEQ ID NO: 2686137 - RNA, 17 nt, Haemophilus influenzae Rd
aucacuucauaaauugu

SEQ ID NO: 2686138 - RNA, 23 nt, Haemophilus influenzae Rd
aucacuugauaaaaaugagauua

SEQ ID NO: 2686139 - RNA, 22 nt, Haemophilus influenzae Rd
aucacuuuguacaccaaaauaa

SEQ ID NO: 2686140 - RNA, 14 nt, Haemophilus influenzae Rd
aucacuuuuuuauu

SEQ ID NO: 2686141 - RNA, 17 nt, Haemophilus influenzae Rd
aucagaaaaucaaaaau

SEQ ID NO: 2686142 - RNA, 15 nt, Haemophilus influenzae Rd
aucagaaauaucuuc

SEQ ID NO: 2686143 - RNA, 16 nt, Haemophilus influenzae Rd
aucagaacaagcauuu

SEQ ID NO: 2686144 - RNA, 20 nt, Haemophilus influenzae Rd
aucagaacaagcauuuuuca

SEQ ID NO: 2686145 - RNA, 14 nt, Haemophilus influenzae Rd
aucagaaggaauau

SEQ ID NO: 2686146 - RNA, 19 nt, Haemophilus influenzae Rd
aucagaauagccgcaauca

SEQ ID NO: 2686147 - RNA, 15 nt, Haemophilus influenzae Rd
aucagaaugauuauc

SEQ ID NO: 2686148 - RNA, 16 nt, Haemophilus influenzae Rd
aucagaaugauuaucu

SEQ ID NO: 2686149 - RNA, 21 nt, Haemophilus influenzae Rd
aucagacaaucugugugggca

SEQ ID NO: 2686150 - RNA, 17 nt, Haemophilus influenzae Rd
aucagaguuaaaagucg

SEQ ID NO: 2686151 - RNA, 19 nt, Haemophilus influenzae Rd
aucagauuauguucauuuu

SEQ ID NO: 2686152 - RNA, 21 nt, Haemophilus influenzae Rd
aucagauuuaggcaauaaaaa

SEQ ID NO: 2686153 - RNA, 22 nt, Haemophilus influenzae Rd
aucagauuuaggcaauaaaaaa

SEQ ID NO: 2686154 - RNA, 17 nt, Haemophilus influenzae Rd
aucagauuuuucgcauu

SEQ ID NO: 2686155 - RNA, 22 nt, Haemophilus influenzae Rd
aucagauuuuucgcauuuuaac

SEQ ID NO: 2686156 - RNA, 23 nt, Haemophilus influenzae Rd
aucagauuuuucgcauuuuaacu

SEQ ID NO: 2686157 - RNA, 17 nt, Haemophilus influenzae Rd
auccaagaaguuuucca

SEQ ID NO: 2686158 - RNA, 14 nt, Haemophilus influenzae Rd
auccaaguauaaaa

SEQ ID NO: 2686159 - RNA, 13 nt, Haemophilus influenzae Rd
auccaaguauuuu

SEQ ID NO: 2686160 - RNA, 11 nt, Haemophilus influenzae Rd
auccaagugca

SEQ ID NO: 2686161 - RNA, 18 nt, Haemophilus influenzae Rd
auccaaguuuguuuuuua

SEQ ID NO: 2686162 - RNA, 18 nt, Haemophilus influenzae Rd
auccaauagauaaaauaa

SEQ ID NO: 2686163 - RNA, 18 nt, Haemophilus influenzae Rd
auccaauccuaaaucugc

SEQ ID NO: 2686164 - RNA, 19 nt, Haemophilus influenzae Rd
auccaaugauccccauucu

SEQ ID NO: 2686165 - RNA, 13 nt, Haemophilus influenzae Rd
auccaauuucaca

SEQ ID NO: 2686166 - RNA, 12 nt, Haemophilus influenzae Rd
auccacaaaaaa

SEQ ID NO: 2686167 - RNA, 15 nt, Haemophilus influenzae Rd
auccacaaaauuccg

SEQ ID NO: 2686168 - RNA, 17 nt, Haemophilus influenzae Rd
auccacaauucuuaaau

SEQ ID NO: 2686169 - RNA, 15 nt, Haemophilus influenzae Rd
auccacacuuuaaaa

SEQ ID NO: 2686170 - RNA, 17 nt, Haemophilus influenzae Rd
auccacacuuuaaaagu

SEQ ID NO: 2686171 - RNA, 22 nt, Haemophilus influenzae Rd
auccacacuuuaauaguaaacu

SEQ ID NO: 2686172 - RNA, 14 nt, Haemophilus influenzae Rd
auccacaugauaua

SEQ ID NO: 2686173 - RNA, 17 nt, Haemophilus influenzae Rd
auccacaugauauauuu

SEQ ID NO: 2686174 - RNA, 20 nt, Haemophilus influenzae Rd
auccacauuuuuuguaauuc

SEQ ID NO: 2686175 - RNA, 12 nt, Haemophilus influenzae Rd
auccaccagcac

SEQ ID NO: 2686176 - RNA, 17 nt, Haemophilus influenzae Rd
auccacgccccaacaua

SEQ ID NO: 2686177 - RNA, 17 nt, Haemophilus influenzae Rd
auccacgguauuuucuu

SEQ ID NO: 2686178 - RNA, 21 nt, Haemophilus influenzae Rd
auccacuaauuccgcaccugc

SEQ ID NO: 2686179 - RNA, 21 nt, Haemophilus influenzae Rd
auccacuacuaacguuucuaa

SEQ ID NO: 2686180 - RNA, 16 nt, Haemophilus influenzae Rd
auccacuuacauuaug

SEQ ID NO: 2686181 - RNA, 17 nt, Haemophilus influenzae Rd
auccacuucauccauug

SEQ ID NO: 2686182 - RNA, 20 nt, Haemophilus influenzae Rd
auccacuucauccauuggau

SEQ ID NO: 2686183 - RNA, 12 nt, Haemophilus influenzae Rd
auccacuuuuuu

SEQ ID NO: 2686184 - RNA, 19 nt, Haemophilus influenzae Rd
auccagaaaauugcaccuu

SEQ ID NO: 2686185 - RNA, 18 nt, Haemophilus influenzae Rd
auccagacgcauucuuuc

SEQ ID NO: 2686186 - RNA, 16 nt, Haemophilus influenzae Rd
auccagauuaaaaauu

SEQ ID NO: 2686187 - RNA, 20 nt, Haemophilus influenzae Rd
auccagauuaaaaauucaau

SEQ ID NO: 2686188 - RNA, 22 nt, Haemophilus influenzae Rd
auccagcaugagcuucaaaauc

SEQ ID NO: 2686189 - RNA, 22 nt, Haemophilus influenzae Rd
auccagcguaaccaauggcaau

SEQ ID NO: 2686190 - RNA, 22 nt, Haemophilus influenzae Rd
auccaguuggcgugcuuccauu

SEQ ID NO: 2686191 - RNA, 12 nt, Haemophilus influenzae Rd
auccauaaaaua

SEQ ID NO: 2686192 - RNA, 18 nt, Haemophilus influenzae Rd
auccauaaaauacaggua

SEQ ID NO: 2686193 - RNA, 18 nt, Haemophilus influenzae Rd
auccauaacaaccauugu

SEQ ID NO: 2686194 - RNA, 22 nt, Haemophilus influenzae Rd
auccauaacggcaagcaaacag

SEQ ID NO: 2686195 - RNA, 20 nt, Haemophilus influenzae Rd
auccauaaggaaauugcagg

SEQ ID NO: 2686196 - RNA, 13 nt, Haemophilus influenzae Rd
auccauacaguaa

SEQ ID NO: 2686197 - RNA, 16 nt, Haemophilus influenzae Rd
auccauacaguaaaaa

SEQ ID NO: 2686198 - RNA, 18 nt, Haemophilus influenzae Rd
auccaucaaacgcuccau

SEQ ID NO: 2686199 - RNA, 22 nt, Haemophilus influenzae Rd
auccaucaaauccgccaaucau

SEQ ID NO: 2686200 - RNA, 16 nt, Haemophilus influenzae Rd
auccaucaagaaaguu

SEQ ID NO: 2686201 - RNA, 17 nt, Haemophilus influenzae Rd
auccaucaauucuuccc

SEQ ID NO: 2686202 - RNA, 21 nt, Haemophilus influenzae Rd
auccaucauuuuucgcaaaau

SEQ ID NO: 2686203 - RNA, 19 nt, Haemophilus influenzae Rd
auccaucgacauacaaagu

SEQ ID NO: 2686204 - RNA, 16 nt, Haemophilus influenzae Rd
auccaugaugaaauaa

SEQ ID NO: 2686205 - RNA, 16 nt, Haemophilus influenzae Rd
auccauuccugcaaga

SEQ ID NO: 2686206 - RNA, 17 nt, Haemophilus influenzae Rd
auccauuccugcaagaa

SEQ ID NO: 2686207 - RNA, 13 nt, Haemophilus influenzae Rd
auccauucucaaa

SEQ ID NO: 2686208 - RNA, 17 nt, Haemophilus influenzae Rd
auccauuggauuaagaa

SEQ ID NO: 2686209 - RNA, 17 nt, Haemophilus influenzae Rd
auccauuucuaaaggca

SEQ ID NO: 2686210 - RNA, 23 nt, Haemophilus influenzae Rd
auccauuucuaaaggcaauuccc

SEQ ID NO: 2686211 - RNA, 14 nt, Haemophilus influenzae Rd
auccauuuugaaca

SEQ ID NO: 2686212 - RNA, 14 nt, Haemophilus influenzae Rd
auccauuuuuaaau

SEQ ID NO: 2686213 - RNA, 13 nt, Haemophilus influenzae Rd
aucccaaauuaaa

SEQ ID NO: 2686214 - RNA, 13 nt, Haemophilus influenzae Rd
aucccaacuuuau

SEQ ID NO: 2686215 - RNA, 16 nt, Haemophilus influenzae Rd
aucccauauacuugcc

SEQ ID NO: 2686216 - RNA, 24 nt, Haemophilus influenzae Rd
aucccauauacuugccaaaacgac

SEQ ID NO: 2686217 - RNA, 15 nt, Haemophilus influenzae Rd
aucccauuucaucuu

SEQ ID NO: 2686218 - RNA, 21 nt, Haemophilus influenzae Rd
auccccauugaauuaaaaaug

SEQ ID NO: 2686219 - RNA, 17 nt, Haemophilus influenzae Rd
auccccguuaaauuuau

SEQ ID NO: 2686220 - RNA, 21 nt, Haemophilus influenzae Rd
aucccuuauguuaugaagccc

SEQ ID NO: 2686221 - RNA, 21 nt, Haemophilus influenzae Rd
aucccuucugcuccacaaaaa

SEQ ID NO: 2686222 - RNA, 16 nt, Haemophilus influenzae Rd
auccgcaauaauuaag

SEQ ID NO: 2686223 - RNA, 21 nt, Haemophilus influenzae Rd
auccgcauugcccgcuucuuc

SEQ ID NO: 2686224 - RNA, 20 nt, Haemophilus influenzae Rd
auccgcgagauacuauauuu

SEQ ID NO: 2686225 - RNA, 13 nt, Haemophilus influenzae Rd
auccgcuaaaauu

SEQ ID NO: 2686226 - RNA, 13 nt, Haemophilus influenzae Rd
auccgcugcaaau

SEQ ID NO: 2686227 - RNA, 18 nt, Haemophilus influenzae Rd
auccgcugcaaauugccc

SEQ ID NO: 2686228 - RNA, 19 nt, Haemophilus influenzae Rd
auccgcuuguuaauacacu

SEQ ID NO: 2686229 - RNA, 20 nt, Haemophilus influenzae Rd
auccgcuuucugacacccaa

SEQ ID NO: 2686230 - RNA, 20 nt, Haemophilus influenzae Rd
auccguaaucgugccugcca

SEQ ID NO: 2686231 - RNA, 17 nt, Haemophilus influenzae Rd
auccguuaagaaacgau

SEQ ID NO: 2686232 - RNA, 15 nt, Haemophilus influenzae Rd
auccguuaauuucau

SEQ ID NO: 2686233 - RNA, 17 nt, Haemophilus influenzae Rd
auccguugucacagaaa

SEQ ID NO: 2686234 - RNA, 22 nt, Haemophilus influenzae Rd
auccguugucacagaaaccaac

SEQ ID NO: 2686235 - RNA, 12 nt, Haemophilus influenzae Rd
auccuaaaaaac

SEQ ID NO: 2686236 - RNA, 16 nt, Haemophilus influenzae Rd
auccuaaauaaagauu

SEQ ID NO: 2686237 - RNA, 21 nt, Haemophilus influenzae Rd
auccuaaauaaagauuauuua

SEQ ID NO: 2686238 - RNA, 15 nt, Haemophilus influenzae Rd
auccuaacuuuucuu

SEQ ID NO: 2686239 - RNA, 16 nt, Haemophilus influenzae Rd
auccuaacuuuucuuc

SEQ ID NO: 2686240 - RNA, 22 nt, Haemophilus influenzae Rd
auccuagauguaacugaaacua

SEQ ID NO: 2686241 - RNA, 22 nt, Haemophilus influenzae Rd
auccuauuaauuuaauucuaaa

SEQ ID NO: 2686242 - RNA, 16 nt, Haemophilus influenzae Rd
auccucaacaucaaaa

SEQ ID NO: 2686243 - RNA, 16 nt, Haemophilus influenzae Rd
auccucagcaauuucu

SEQ ID NO: 2686244 - RNA, 17 nt, Haemophilus influenzae Rd
auccucagcaauuucuu

SEQ ID NO: 2686245 - RNA, 19 nt, Haemophilus influenzae Rd
auccucucgccaaaucuca

SEQ ID NO: 2686246 - RNA, 16 nt, Haemophilus influenzae Rd
auccucuuuaaaauua

SEQ ID NO: 2686247 - RNA, 17 nt, Haemophilus influenzae Rd
auccucuuuaaaauuac

SEQ ID NO: 2686248 - RNA, 13 nt, Haemophilus influenzae Rd
auccugaagauuu

SEQ ID NO: 2686249 - RNA, 17 nt, Haemophilus influenzae Rd
auccugaugcagaagua

SEQ ID NO: 2686250 - RNA, 14 nt, Haemophilus influenzae Rd
auccugcacauccu

SEQ ID NO: 2686251 - RNA, 20 nt, Haemophilus influenzae Rd
auccugccuugcauucgguu

SEQ ID NO: 2686252 - RNA, 15 nt, Haemophilus influenzae Rd
auccuguucagcuuu

SEQ ID NO: 2686253 - RNA, 14 nt, Haemophilus influenzae Rd
auccuguuuauuuu

SEQ ID NO: 2686254 - RNA, 15 nt, Haemophilus influenzae Rd
auccuuaccuuccac

SEQ ID NO: 2686255 - RNA, 20 nt, Haemophilus influenzae Rd
auccuucaggauaaaacaau

SEQ ID NO: 2686256 - RNA, 23 nt, Haemophilus influenzae Rd
auccuucaggauaaaacaaugca

SEQ ID NO: 2686257 - RNA, 14 nt, Haemophilus influenzae Rd
auccuuccaaaucc

SEQ ID NO: 2686258 - RNA, 18 nt, Haemophilus influenzae Rd
auccuuccaaauccauca

SEQ ID NO: 2686259 - RNA, 14 nt, Haemophilus influenzae Rd
auccuugcucacgg

SEQ ID NO: 2686260 - RNA, 14 nt, Haemophilus influenzae Rd
auccuuguuuuuca

SEQ ID NO: 2686261 - RNA, 21 nt, Haemophilus influenzae Rd
auccuuguuuuucaaaaagau

SEQ ID NO: 2686262 - RNA, 23 nt, Haemophilus influenzae Rd
auccuuuaccaaccgguaaaauu

SEQ ID NO: 2686263 - RNA, 15 nt, Haemophilus influenzae Rd
aucuaauucuugccc

SEQ ID NO: 2686264 - RNA, 18 nt, Haemophilus influenzae Rd
aucuaauuggacaagaaa

SEQ ID NO: 2686265 - RNA, 15 nt, Haemophilus influenzae Rd
aucuacaaaacauaa

SEQ ID NO: 2686266 - RNA, 16 nt, Haemophilus influenzae Rd
aucuacaaaacauaau

SEQ ID NO: 2686267 - RNA, 21 nt, Haemophilus influenzae Rd
aucuacaaucaaaaaaucuac

SEQ ID NO: 2686268 - RNA, 18 nt, Haemophilus influenzae Rd
aucuacaucaguaccuuu

SEQ ID NO: 2686269 - RNA, 22 nt, Haemophilus influenzae Rd
aucuacaucaguaccuuuaauu

SEQ ID NO: 2686270 - RNA, 20 nt, Haemophilus influenzae Rd
aucuaccacaucaaauuuau

SEQ ID NO: 2686271 - RNA, 14 nt, Haemophilus influenzae Rd
aucuacccaauaaa

SEQ ID NO: 2686272 - RNA, 15 nt, Haemophilus influenzae Rd
aucuacccacacacc

SEQ ID NO: 2686273 - RNA, 22 nt, Haemophilus influenzae Rd
aucuacgcggauacccauugag

SEQ ID NO: 2686274 - RNA, 15 nt, Haemophilus influenzae Rd
aucuacuuaauugau

SEQ ID NO: 2686275 - RNA, 18 nt, Haemophilus influenzae Rd
aucuacuuaauugauuuu

SEQ ID NO: 2686276 - RNA, 22 nt, Haemophilus influenzae Rd
aucuacuuggacauuguuguuu

SEQ ID NO: 2686277 - RNA, 14 nt, Haemophilus influenzae Rd
aucuacuuucagga

SEQ ID NO: 2686278 - RNA, 15 nt, Haemophilus influenzae Rd
aucuagcacaaagac

SEQ ID NO: 2686279 - RNA, 16 nt, Haemophilus influenzae Rd
aucuagcacaaagaca

SEQ ID NO: 2686280 - RNA, 17 nt, Haemophilus influenzae Rd
aucuauaaaaagaacua

SEQ ID NO: 2686281 - RNA, 20 nt, Haemophilus influenzae Rd
aucuauaauuucgccauuuu

SEQ ID NO: 2686282 - RNA, 20 nt, Haemophilus influenzae Rd
aucuauauuugaguuauuuu

SEQ ID NO: 2686283 - RNA, 23 nt, Haemophilus influenzae Rd
aucuauauuugaguuauuuuuaa

SEQ ID NO: 2686284 - RNA, 23 nt, Haemophilus influenzae Rd
aucuaucccaacagaaaauuuga

SEQ ID NO: 2686285 - RNA, 16 nt, Haemophilus influenzae Rd
aucuauugagauuuaa

SEQ ID NO: 2686286 - RNA, 22 nt, Haemophilus influenzae Rd
aucuauugagauuuaauuuauu

SEQ ID NO: 2686287 - RNA, 16 nt, Haemophilus influenzae Rd
aucuauugauucuaaa

SEQ ID NO: 2686288 - RNA, 19 nt, Haemophilus influenzae Rd
aucuauuggauaaauuauu

SEQ ID NO: 2686289 - RNA, 22 nt, Haemophilus influenzae Rd
aucuauuggauaaauuauucug

SEQ ID NO: 2686290 - RNA, 13 nt, Haemophilus influenzae Rd
aucuauuucauau

SEQ ID NO: 2686291 - RNA, 16 nt, Haemophilus influenzae Rd
aucucaaaaucagcaa

SEQ ID NO: 2686292 - RNA, 17 nt, Haemophilus influenzae Rd
aucucacaauaauuuuc

SEQ ID NO: 2686293 - RNA, 22 nt, Haemophilus influenzae Rd
aucucacguacuuuuaacacuu

SEQ ID NO: 2686294 - RNA, 20 nt, Haemophilus influenzae Rd
aucucauccacuaaaccauu

SEQ ID NO: 2686295 - RNA, 21 nt, Haemophilus influenzae Rd
aucucccaaagaagcuuucca

SEQ ID NO: 2686296 - RNA, 16 nt, Haemophilus influenzae Rd
aucucgcauugauucu

SEQ ID NO: 2686297 - RNA, 14 nt, Haemophilus influenzae Rd
aucucggcuaaaau

SEQ ID NO: 2686298 - RNA, 17 nt, Haemophilus influenzae Rd
aucucuaaccuaaaaua

SEQ ID NO: 2686299 - RNA, 15 nt, Haemophilus influenzae Rd
aucucuauugcuuuu

SEQ ID NO: 2686300 - RNA, 16 nt, Haemophilus influenzae Rd
aucucuauugcuuuua

SEQ ID NO: 2686301 - RNA, 16 nt, Haemophilus influenzae Rd
aucucuuguuuuucca

SEQ ID NO: 2686302 - RNA, 23 nt, Haemophilus influenzae Rd
aucucuuguuuuuccaauucuuu

SEQ ID NO: 2686303 - RNA, 17 nt, Haemophilus influenzae Rd
aucucuuucaauuucaa

SEQ ID NO: 2686304 - RNA, 16 nt, Haemophilus influenzae Rd
aucucuuucuuaaaau

SEQ ID NO: 2686305 - RNA, 17 nt, Haemophilus influenzae Rd
aucucuuucuuaaaaua

SEQ ID NO: 2686306 - RNA, 14 nt, Haemophilus influenzae Rd
aucugaaccaccgc

SEQ ID NO: 2686307 - RNA, 17 nt, Haemophilus influenzae Rd
aucugaacguaagauca

SEQ ID NO: 2686308 - RNA, 18 nt, Haemophilus influenzae Rd
aucugaacguaagaucag

SEQ ID NO: 2686309 - RNA, 16 nt, Haemophilus influenzae Rd
aucugaccccaaaaag

SEQ ID NO: 2686310 - RNA, 16 nt, Haemophilus influenzae Rd
aucugaguauguuguu

SEQ ID NO: 2686311 - RNA, 11 nt, Haemophilus influenzae Rd
aucugauaaau

SEQ ID NO: 2686312 - RNA, 15 nt, Haemophilus influenzae Rd
aucugauaaauuuug

SEQ ID NO: 2686313 - RNA, 21 nt, Haemophilus influenzae Rd
aucugauccacgguauuuucu

SEQ ID NO: 2686314 - RNA, 17 nt, Haemophilus influenzae Rd
aucugaugggaauucau

SEQ ID NO: 2686315 - RNA, 16 nt, Haemophilus influenzae Rd
aucugauugagaaaau

SEQ ID NO: 2686316 - RNA, 17 nt, Haemophilus influenzae Rd
aucugauugagaaaaug

SEQ ID NO: 2686317 - RNA, 16 nt, Haemophilus influenzae Rd
aucugauuuaaucauu

SEQ ID NO: 2686318 - RNA, 21 nt, Haemophilus influenzae Rd
aucugcacaaaguugauaauc

SEQ ID NO: 2686319 - RNA, 17 nt, Haemophilus influenzae Rd
aucugcacgauagcaau

SEQ ID NO: 2686320 - RNA, 17 nt, Haemophilus influenzae Rd
aucugcacguaaaguug

SEQ ID NO: 2686321 - RNA, 19 nt, Haemophilus influenzae Rd
aucugcacuccaaaaguug

SEQ ID NO: 2686322 - RNA, 15 nt, Haemophilus influenzae Rd
aucugcacuuuaaca

SEQ ID NO: 2686323 - RNA, 17 nt, Haemophilus influenzae Rd
aucugccacagaccaaa

SEQ ID NO: 2686324 - RNA, 15 nt, Haemophilus influenzae Rd
aucugccugauuuuu

SEQ ID NO: 2686325 - RNA, 16 nt, Haemophilus influenzae Rd
aucugcucuugaaaua

SEQ ID NO: 2686326 - RNA, 12 nt, Haemophilus influenzae Rd
aucugcuuuaau

SEQ ID NO: 2686327 - RNA, 18 nt, Haemophilus influenzae Rd
aucugcuuuuucuugcuc

SEQ ID NO: 2686328 - RNA, 16 nt, Haemophilus influenzae Rd
aucuggauauugcuca

SEQ ID NO: 2686329 - RNA, 23 nt, Haemophilus influenzae Rd
aucuggcucaauguuaaguucau

SEQ ID NO: 2686330 - RNA, 21 nt, Haemophilus influenzae Rd
aucuggguuuacaucuugcgu

SEQ ID NO: 2686331 - RNA, 19 nt, Haemophilus influenzae Rd
aucuggugagugagcauuu

SEQ ID NO: 2686332 - RNA, 21 nt, Haemophilus influenzae Rd
aucuggugagugagcauuucg

SEQ ID NO: 2686333 - RNA, 13 nt, Haemophilus influenzae Rd
aucugguuuugug

SEQ ID NO: 2686334 - RNA, 14 nt, Haemophilus influenzae Rd
aucuguaaaccauu

SEQ ID NO: 2686335 - RNA, 15 nt, Haemophilus influenzae Rd
aucuguaaaccauuc

SEQ ID NO: 2686336 - RNA, 22 nt, Haemophilus influenzae Rd
aucuguaaaccuuuuggcauua

SEQ ID NO: 2686337 - RNA, 12 nt, Haemophilus influenzae Rd
aucuguaaacga

SEQ ID NO: 2686338 - RNA, 19 nt, Haemophilus influenzae Rd
aucuguaaacgaccuugca

SEQ ID NO: 2686339 - RNA, 23 nt, Haemophilus influenzae Rd
aucugugauaacuaugccuucuu

SEQ ID NO: 2686340 - RNA, 21 nt, Haemophilus influenzae Rd
aucugugauauauaucacaga

SEQ ID NO: 2686341 - RNA, 19 nt, Haemophilus influenzae Rd
aucuguugugaaugcaaua

SEQ ID NO: 2686342 - RNA, 16 nt, Haemophilus influenzae Rd
aucuuaaaaaagauga

SEQ ID NO: 2686343 - RNA, 17 nt, Haemophilus influenzae Rd
aucuuaaauuauagaua

SEQ ID NO: 2686344 - RNA, 17 nt, Haemophilus influenzae Rd
aucuuaccuuuuucuac

SEQ ID NO: 2686345 - RNA, 23 nt, Haemophilus influenzae Rd
aucuuacgaagaauccacauuuu

SEQ ID NO: 2686346 - RNA, 20 nt, Haemophilus influenzae Rd
aucuuagacaaauuaaauua

SEQ ID NO: 2686347 - RNA, 15 nt, Haemophilus influenzae Rd
aucuuauauuuuuga

SEQ ID NO: 2686348 - RNA, 15 nt, Haemophilus influenzae Rd
aucuuaugaaacagc

SEQ ID NO: 2686349 - RNA, 15 nt, Haemophilus influenzae Rd
aucuuauuucaauau

SEQ ID NO: 2686350 - RNA, 14 nt, Haemophilus influenzae Rd
aucuuauuugauua

SEQ ID NO: 2686351 - RNA, 15 nt, Haemophilus influenzae Rd
aucuucaaaaacaua

SEQ ID NO: 2686352 - RNA, 16 nt, Haemophilus influenzae Rd
aucuucaacgauaaca

SEQ ID NO: 2686353 - RNA, 18 nt, Haemophilus influenzae Rd
aucuucaaucaucauuua

SEQ ID NO: 2686354 - RNA, 22 nt, Haemophilus influenzae Rd
aucuucaaucaucauuuauuaa

SEQ ID NO: 2686355 - RNA, 16 nt, Haemophilus influenzae Rd
aucuucacaaaacaac

SEQ ID NO: 2686356 - RNA, 23 nt, Haemophilus influenzae Rd
aucuucaguacgcaccacuucgc

SEQ ID NO: 2686357 - RNA, 18 nt, Haemophilus influenzae Rd
aucuucauaucuuugaau

SEQ ID NO: 2686358 - RNA, 12 nt, Haemophilus influenzae Rd
aucuucaucaau

SEQ ID NO: 2686359 - RNA, 19 nt, Haemophilus influenzae Rd
aucuucaugauuuuccaaa

SEQ ID NO: 2686360 - RNA, 13 nt, Haemophilus influenzae Rd
aucuuccaaagca

SEQ ID NO: 2686361 - RNA, 21 nt, Haemophilus influenzae Rd
aucuuccaauaauucuuuaau

SEQ ID NO: 2686362 - RNA, 14 nt, Haemophilus influenzae Rd
aucuuccaauacaa

SEQ ID NO: 2686363 - RNA, 17 nt, Haemophilus influenzae Rd
aucuuccaauacaauca

SEQ ID NO: 2686364 - RNA, 15 nt, Haemophilus influenzae Rd
aucuucccccaaaaa

SEQ ID NO: 2686365 - RNA, 17 nt, Haemophilus influenzae Rd
aucuuccgcgucauuua

SEQ ID NO: 2686366 - RNA, 22 nt, Haemophilus influenzae Rd
aucuucgaugugcauuuuucau

SEQ ID NO: 2686367 - RNA, 16 nt, Haemophilus influenzae Rd
aucuucggauuuuuca

SEQ ID NO: 2686368 - RNA, 17 nt, Haemophilus influenzae Rd
augaccaaauacaauuu

SEQ ID NO: 2686369 - RNA, 19 nt, Haemophilus influenzae Rd
augaccaaauacaauuuuu

SEQ ID NO: 2686370 - RNA, 18 nt, Haemophilus influenzae Rd
augaccaaguaaaccaaa

SEQ ID NO: 2686371 - RNA, 21 nt, Haemophilus influenzae Rd
augaccauuggcuuucauuac

SEQ ID NO: 2686372 - RNA, 20 nt, Haemophilus influenzae Rd
augaccgcacuuuuuauauu

SEQ ID NO: 2686373 - RNA, 15 nt, Haemophilus influenzae Rd
augaccugcagagaa

SEQ ID NO: 2686374 - RNA, 21 nt, Haemophilus influenzae Rd
augaccuuuuuuuagaauuaa

SEQ ID NO: 2686375 - RNA, 19 nt, Haemophilus influenzae Rd
augacgcgccuaauauugc

SEQ ID NO: 2686376 - RNA, 19 nt, Haemophilus influenzae Rd
augacgugcuaauucugcu

SEQ ID NO: 2686377 - RNA, 21 nt, Haemophilus influenzae Rd
augacuggcuugugaaauaaa

SEQ ID NO: 2686378 - RNA, 13 nt, Haemophilus influenzae Rd
augacuuucacua

SEQ ID NO: 2686379 - RNA, 21 nt, Haemophilus influenzae Rd
augacuuucacuacagguugc

SEQ ID NO: 2686380 - RNA, 14 nt, Haemophilus influenzae Rd
augagaaaaagucg

SEQ ID NO: 2686381 - RNA, 20 nt, Haemophilus influenzae Rd
augagaaaugcgauuuccaa

SEQ ID NO: 2686382 - RNA, 14 nt, Haemophilus influenzae Rd
augagacuuaacca

SEQ ID NO: 2686383 - RNA, 11 nt, Haemophilus influenzae Rd
augagcaaaua

SEQ ID NO: 2686384 - RNA, 13 nt, Haemophilus influenzae Rd
augagcacgaaaa

SEQ ID NO: 2686385 - RNA, 22 nt, Haemophilus influenzae Rd
augagccaacucgaacaugaag

SEQ ID NO: 2686386 - RNA, 18 nt, Haemophilus influenzae Rd
augagcuucaaaaucacc

SEQ ID NO: 2686387 - RNA, 14 nt, Haemophilus influenzae Rd
augaggaaaauaaa

SEQ ID NO: 2686388 - RNA, 15 nt, Haemophilus influenzae Rd
augaggaaaauaaag

SEQ ID NO: 2686389 - RNA, 23 nt, Haemophilus influenzae Rd
augaggauuuucaugcauuaaaa

SEQ ID NO: 2686390 - RNA, 15 nt, Haemophilus influenzae Rd
augagguauuucuau

SEQ ID NO: 2686391 - RNA, 15 nt, Haemophilus influenzae Rd
augagguguuauuug

SEQ ID NO: 2686392 - RNA, 19 nt, Haemophilus influenzae Rd
augaguaaaccgauuaauu

SEQ ID NO: 2686393 - RNA, 14 nt, Haemophilus influenzae Rd
augaguagauuuuu

SEQ ID NO: 2686394 - RNA, 15 nt, Haemophilus influenzae Rd
augaguucauuuuca

SEQ ID NO: 2686395 - RNA, 14 nt, Haemophilus influenzae Rd
augauaaaugcaau

SEQ ID NO: 2686396 - RNA, 15 nt, Haemophilus influenzae Rd
augauaaaugcaaua

SEQ ID NO: 2686397 - RNA, 22 nt, Haemophilus influenzae Rd
augauaaauucuuaccaaaagg

SEQ ID NO: 2686398 - RNA, 14 nt, Haemophilus influenzae Rd
augauaaucuuccc

SEQ ID NO: 2686399 - RNA, 17 nt, Haemophilus influenzae Rd
augauacaaucgguuaa

SEQ ID NO: 2686400 - RNA, 16 nt, Haemophilus influenzae Rd
augauaccuuguuaau

SEQ ID NO: 2686401 - RNA, 23 nt, Haemophilus influenzae Rd
augauauuucaauuuaagcccug

SEQ ID NO: 2686402 - RNA, 18 nt, Haemophilus influenzae Rd
augaucaaaucaaauuuu

SEQ ID NO: 2686403 - RNA, 21 nt, Haemophilus influenzae Rd
augaucaaggguacaacaaau

SEQ ID NO: 2686404 - RNA, 15 nt, Haemophilus influenzae Rd
augaucaccgugcaa

SEQ ID NO: 2686405 - RNA, 17 nt, Haemophilus influenzae Rd
augaucacuucauaaau

SEQ ID NO: 2686406 - RNA, 16 nt, Haemophilus influenzae Rd
augaucauaagauaag

SEQ ID NO: 2686407 - RNA, 13 nt, Haemophilus influenzae Rd
augauccaaaaau

SEQ ID NO: 2686408 - RNA, 15 nt, Haemophilus influenzae Rd
augaucgaccauugc

SEQ ID NO: 2686409 - RNA, 16 nt, Haemophilus influenzae Rd
augaucgaguaaaaau

SEQ ID NO: 2686410 - RNA, 17 nt, Haemophilus influenzae Rd
augaucgaguaaaaaua

SEQ ID NO: 2686411 - RNA, 13 nt, Haemophilus influenzae Rd
augaucuaauggg

SEQ ID NO: 2686412 - RNA, 20 nt, Haemophilus influenzae Rd
augaucuucaaucaucauuu

SEQ ID NO: 2686413 - RNA, 16 nt, Haemophilus influenzae Rd
augaucuuuaauuaaa

SEQ ID NO: 2686414 - RNA, 17 nt, Haemophilus influenzae Rd
augaucuuuaauuaaaa

SEQ ID NO: 2686415 - RNA, 20 nt, Haemophilus influenzae Rd
augaucuuuaauuaaaauau

SEQ ID NO: 2686416 - RNA, 16 nt, Haemophilus influenzae Rd
augaucuuugguucau

SEQ ID NO: 2686417 - RNA, 16 nt, Haemophilus influenzae Rd
augaugaaauuuuuca

SEQ ID NO: 2686418 - RNA, 12 nt, Haemophilus influenzae Rd
augaugguguuc

SEQ ID NO: 2686419 - RNA, 17 nt, Haemophilus influenzae Rd
augauguaggcaaaaac

SEQ ID NO: 2686420 - RNA, 22 nt, Haemophilus influenzae Rd
augauuaaccauuaauaaauuu

SEQ ID NO: 2686421 - RNA, 15 nt, Haemophilus influenzae Rd
augauuaauaucacu

SEQ ID NO: 2686422 - RNA, 14 nt, Haemophilus influenzae Rd
augauuaauuaaau

SEQ ID NO: 2686423 - RNA, 16 nt, Haemophilus influenzae Rd
augauuaauuaaauua

SEQ ID NO: 2686424 - RNA, 14 nt, Haemophilus influenzae Rd
augauuauaaauua

SEQ ID NO: 2686425 - RNA, 21 nt, Haemophilus influenzae Rd
augauuauccacuaaaaaacu

SEQ ID NO: 2686426 - RNA, 17 nt, Haemophilus influenzae Rd
augauuccaaaguuuag

SEQ ID NO: 2686427 - RNA, 16 nt, Haemophilus influenzae Rd
augauugacgaaaaau

SEQ ID NO: 2686428 - RNA, 12 nt, Haemophilus influenzae Rd
augauuuagaac

SEQ ID NO: 2686429 - RNA, 14 nt, Haemophilus influenzae Rd
augauuuagaacaa

SEQ ID NO: 2686430 - RNA, 17 nt, Haemophilus influenzae Rd
augauuuagaacaauau

SEQ ID NO: 2686431 - RNA, 19 nt, Haemophilus influenzae Rd
augauuuaugaauguuuca

SEQ ID NO: 2686432 - RNA, 18 nt, Haemophilus influenzae Rd
augauuugcauaaaacca

SEQ ID NO: 2686433 - RNA, 19 nt, Haemophilus influenzae Rd
augauuugcauaaaaccag

SEQ ID NO: 2686434 - RNA, 23 nt, Haemophilus influenzae Rd
augauuuuaaaauaaauuuuaaa

SEQ ID NO: 2686435 - RNA, 13 nt, Haemophilus influenzae Rd
augauuuuaaagc

SEQ ID NO: 2686436 - RNA, 21 nt, Haemophilus influenzae Rd
augauuuucauuccuucacuu

SEQ ID NO: 2686437 - RNA, 14 nt, Haemophilus influenzae Rd
augauuuuccaaaa

SEQ ID NO: 2686438 - RNA, 16 nt, Haemophilus influenzae Rd
augauuuuccaaaauu

SEQ ID NO: 2686439 - RNA, 13 nt, Haemophilus influenzae Rd
augauuuuuacaa

SEQ ID NO: 2686440 - RNA, 11 nt, Haemophilus influenzae Rd
augcaaaauua

SEQ ID NO: 2686441 - RNA, 14 nt, Haemophilus influenzae Rd
augcaaaguauuuu

SEQ ID NO: 2686442 - RNA, 17 nt, Haemophilus influenzae Rd
augcaaaguauuuuucu

SEQ ID NO: 2686443 - RNA, 21 nt, Haemophilus influenzae Rd
augcaaaguauuuuucuaaau

SEQ ID NO: 2686444 - RNA, 15 nt, Haemophilus influenzae Rd
augcaaauacauauu

SEQ ID NO: 2686445 - RNA, 15 nt, Haemophilus influenzae Rd
augcaacaaguacga

SEQ ID NO: 2686446 - RNA, 17 nt, Haemophilus influenzae Rd
augcaacaauaacugcc

SEQ ID NO: 2686447 - RNA, 15 nt, Haemophilus influenzae Rd
augcaauaaauaaga

SEQ ID NO: 2686448 - RNA, 13 nt, Haemophilus influenzae Rd
augcaauauuauu

SEQ ID NO: 2686449 - RNA, 16 nt, Haemophilus influenzae Rd
augcaauuggcaauau

SEQ ID NO: 2686450 - RNA, 19 nt, Haemophilus influenzae Rd
augcaauuggcaauauuaa

SEQ ID NO: 2686451 - RNA, 16 nt, Haemophilus influenzae Rd
augcacauaacaaaau

SEQ ID NO: 2686452 - RNA, 17 nt, Haemophilus influenzae Rd
augcacauaacaaaaug

SEQ ID NO: 2686453 - RNA, 14 nt, Haemophilus influenzae Rd
augcacauuuuuac

SEQ ID NO: 2686454 - RNA, 19 nt, Haemophilus influenzae Rd
augcacauuuuuaccaauu

SEQ ID NO: 2686455 - RNA, 17 nt, Haemophilus influenzae Rd
augcaccagaugcaaua

SEQ ID NO: 2686456 - RNA, 21 nt, Haemophilus influenzae Rd
augcaccguaaccgcccagca

SEQ ID NO: 2686457 - RNA, 20 nt, Haemophilus influenzae Rd
augcacgagcaggaaaacca

SEQ ID NO: 2686458 - RNA, 16 nt, Haemophilus influenzae Rd
augcacuuucaucuac

SEQ ID NO: 2686459 - RNA, 22 nt, Haemophilus influenzae Rd
augcagauccuuucacaaaaua

SEQ ID NO: 2686460 - RNA, 14 nt, Haemophilus influenzae Rd
augcaggaaaggca

SEQ ID NO: 2686461 - RNA, 23 nt, Haemophilus influenzae Rd
augcaggggcuuuuaaugaugcg

SEQ ID NO: 2686462 - RNA, 21 nt, Haemophilus influenzae Rd
augcaguaacgcgauaaaucg

SEQ ID NO: 2686463 - RNA, 20 nt, Haemophilus influenzae Rd
augcaguaacuucugcugca

SEQ ID NO: 2686464 - RNA, 14 nt, Haemophilus influenzae Rd
augcaguaauaaau

SEQ ID NO: 2686465 - RNA, 15 nt, Haemophilus influenzae Rd
augcaguauaaaccg

SEQ ID NO: 2686466 - RNA, 17 nt, Haemophilus influenzae Rd
augcaucagauuuuucg

SEQ ID NO: 2686467 - RNA, 16 nt, Haemophilus influenzae Rd
augcaugugguaauua

SEQ ID NO: 2686468 - RNA, 16 nt, Haemophilus influenzae Rd
augcauuaaaaaacau

SEQ ID NO: 2686469 - RNA, 16 nt, Haemophilus influenzae Rd
augcauugauugcuuu

SEQ ID NO: 2686470 - RNA, 23 nt, Haemophilus influenzae Rd
augcauugauugcuuuaacugaa

SEQ ID NO: 2686471 - RNA, 12 nt, Haemophilus influenzae Rd
augccaaauaaa

SEQ ID NO: 2686472 - RNA, 15 nt, Haemophilus influenzae Rd
augccaaauaaaauu

SEQ ID NO: 2686473 - RNA, 16 nt, Haemophilus influenzae Rd
augccaaauuucuccg

SEQ ID NO: 2686474 - RNA, 21 nt, Haemophilus influenzae Rd
augggauuuucacuaauuugc

SEQ ID NO: 2686475 - RNA, 18 nt, Haemophilus influenzae Rd
augggauuuuuaccccac

SEQ ID NO: 2686476 - RNA, 15 nt, Haemophilus influenzae Rd
augggcaauggcaau

SEQ ID NO: 2686477 - RNA, 19 nt, Haemophilus influenzae Rd
augggcaauggcaaucaca

SEQ ID NO: 2686478 - RNA, 18 nt, Haemophilus influenzae Rd
augggcauccaaaguaca

SEQ ID NO: 2686479 - RNA, 20 nt, Haemophilus influenzae Rd
auggggcuuuuuuuuauuca

SEQ ID NO: 2686480 - RNA, 16 nt, Haemophilus influenzae Rd
augggggaauaaauuc

SEQ ID NO: 2686481 - RNA, 19 nt, Haemophilus influenzae Rd
augggggaauaaauucuga

SEQ ID NO: 2686482 - RNA, 12 nt, Haemophilus influenzae Rd
augguaaauauu

SEQ ID NO: 2686483 - RNA, 21 nt, Haemophilus influenzae Rd
augguaauagaguaccaaaau

SEQ ID NO: 2686484 - RNA, 14 nt, Haemophilus influenzae Rd
augguauaaaaaau

SEQ ID NO: 2686485 - RNA, 22 nt, Haemophilus influenzae Rd
auggugcacuuggccaguggga

SEQ ID NO: 2686486 - RNA, 20 nt, Haemophilus influenzae Rd
auggugggcuggguagaaau

SEQ ID NO: 2686487 - RNA, 20 nt, Haemophilus influenzae Rd
augguucgagaaacuuucaa

SEQ ID NO: 2686488 - RNA, 22 nt, Haemophilus influenzae Rd
augguucgagaaacuuucaaaa

SEQ ID NO: 2686489 - RNA, 19 nt, Haemophilus influenzae Rd
augguugcacccacuaaaa

SEQ ID NO: 2686490 - RNA, 17 nt, Haemophilus influenzae Rd
augguuguaaauuuuca

SEQ ID NO: 2686491 - RNA, 18 nt, Haemophilus influenzae Rd
augguuguaaauuuucaa

SEQ ID NO: 2686492 - RNA, 14 nt, Haemophilus influenzae Rd
augguuguaauaau

SEQ ID NO: 2686493 - RNA, 14 nt, Haemophilus influenzae Rd
augguuuguuccaa

SEQ ID NO: 2686494 - RNA, 14 nt, Haemophilus influenzae Rd
auguaaaaaauaau

SEQ ID NO: 2686495 - RNA, 15 nt, Haemophilus influenzae Rd
auguaaaaaauccuc

SEQ ID NO: 2686496 - RNA, 12 nt, Haemophilus influenzae Rd
auguaaaaauaa

SEQ ID NO: 2686497 - RNA, 14 nt, Haemophilus influenzae Rd
auguaaaagauaaa

SEQ ID NO: 2686498 - RNA, 16 nt, Haemophilus influenzae Rd
auguaaacaaaaauac

SEQ ID NO: 2686499 - RNA, 22 nt, Haemophilus influenzae Rd
auguaaacaaaaauacagccac

SEQ ID NO: 2686500 - RNA, 13 nt, Haemophilus influenzae Rd
auguaaauuauuu

SEQ ID NO: 2686501 - RNA, 19 nt, Haemophilus influenzae Rd
auguaaauuauuuuaauaa

SEQ ID NO: 2686502 - RNA, 17 nt, Haemophilus influenzae Rd
auguaacugaaacuaac

SEQ ID NO: 2686503 - RNA, 22 nt, Haemophilus influenzae Rd
auguaaguagcguaaaccuugu

SEQ ID NO: 2686504 - RNA, 23 nt, Haemophilus influenzae Rd
auguaauagccauuuuggaaugg

SEQ ID NO: 2686505 - RNA, 21 nt, Haemophilus influenzae Rd
auguaauuccuuguagagcag

SEQ ID NO: 2686506 - RNA, 22 nt, Haemophilus influenzae Rd
auguacauuaauguaaucaauu

SEQ ID NO: 2686507 - RNA, 19 nt, Haemophilus influenzae Rd
auguaccgauugauggauc

SEQ ID NO: 2686508 - RNA, 13 nt, Haemophilus influenzae Rd
auguagauaauga

SEQ ID NO: 2686509 - RNA, 22 nt, Haemophilus influenzae Rd
auguagcacgaucuaauugcgg

SEQ ID NO: 2686510 - RNA, 17 nt, Haemophilus influenzae Rd
auguagcugaaacuaaa

SEQ ID NO: 2686511 - RNA, 15 nt, Haemophilus influenzae Rd
auguagcuugaauau

SEQ ID NO: 2686512 - RNA, 16 nt, Haemophilus influenzae Rd
auguagcuugaauauu

SEQ ID NO: 2686513 - RNA, 14 nt, Haemophilus influenzae Rd
auguaggcucuuuc

SEQ ID NO: 2686514 - RNA, 17 nt, Haemophilus influenzae Rd
auguaguugugauuuuc

SEQ ID NO: 2686515 - RNA, 13 nt, Haemophilus influenzae Rd
auguauaaagcau

SEQ ID NO: 2686516 - RNA, 21 nt, Haemophilus influenzae Rd
auguauuucuaacaaaugauu

SEQ ID NO: 2686517 - RNA, 22 nt, Haemophilus influenzae Rd
auguauuuuacguauguauuuu

SEQ ID NO: 2686518 - RNA, 23 nt, Haemophilus influenzae Rd
auguccauuuuuaguaauuggca

SEQ ID NO: 2686519 - RNA, 14 nt, Haemophilus influenzae Rd
augucgaaauuuuu

SEQ ID NO: 2686520 - RNA, 16 nt, Haemophilus influenzae Rd
augucgaaauuuuucg

SEQ ID NO: 2686521 - RNA, 17 nt, Haemophilus influenzae Rd
augucgugaaagaauaa

SEQ ID NO: 2686522 - RNA, 22 nt, Haemophilus influenzae Rd
augucuggcugaguaaauaauu

SEQ ID NO: 2686523 - RNA, 23 nt, Haemophilus influenzae Rd
augucuuuaggauuguugauuuu

SEQ ID NO: 2686524 - RNA, 14 nt, Haemophilus influenzae Rd
augucuuuuucuua

SEQ ID NO: 2686525 - RNA, 17 nt, Haemophilus influenzae Rd
augugaaaacuacuuuc

SEQ ID NO: 2686526 - RNA, 16 nt, Haemophilus influenzae Rd
augugacauuguaaag

SEQ ID NO: 2686527 - RNA, 22 nt, Haemophilus influenzae Rd
auguggcguacaacgugaagua

SEQ ID NO: 2686528 - RNA, 13 nt, Haemophilus influenzae Rd
auguguaggcaua

SEQ ID NO: 2686529 - RNA, 13 nt, Haemophilus influenzae Rd
auguguuccugua

SEQ ID NO: 2686530 - RNA, 21 nt, Haemophilus influenzae Rd
auguguugauuucuacacuua

SEQ ID NO: 2686531 - RNA, 13 nt, Haemophilus influenzae Rd
auguguuuaggcg

SEQ ID NO: 2686532 - RNA, 19 nt, Haemophilus influenzae Rd
auguuaaguucaucauaaa

SEQ ID NO: 2686533 - RNA, 12 nt, Haemophilus influenzae Rd
auguuaauaauu

SEQ ID NO: 2686534 - RNA, 16 nt, Haemophilus influenzae Rd
auguuaauuuuaaauu

SEQ ID NO: 2686535 - RNA, 16 nt, Haemophilus influenzae Rd
auguuaccgacaacca

SEQ ID NO: 2686536 - RNA, 13 nt, Haemophilus influenzae Rd
auguuauuaaaua

SEQ ID NO: 2686537 - RNA, 15 nt, Haemophilus influenzae Rd
auguuauuaaauaua

SEQ ID NO: 2686538 - RNA, 22 nt, Haemophilus influenzae Rd
auguuauucuccuuaauuucau

SEQ ID NO: 2686539 - RNA, 22 nt, Haemophilus influenzae Rd
auguucaacaaguaaaucaaca

SEQ ID NO: 2686540 - RNA, 13 nt, Haemophilus influenzae Rd
auguucagccacu

SEQ ID NO: 2686541 - RNA, 15 nt, Haemophilus influenzae Rd
auguucagccacuuc

SEQ ID NO: 2686542 - RNA, 16 nt, Haemophilus influenzae Rd
auguucauuuuuauga

SEQ ID NO: 2686543 - RNA, 14 nt, Haemophilus influenzae Rd
auguucgauuuuac

SEQ ID NO: 2686544 - RNA, 17 nt, Haemophilus influenzae Rd
auguucuaagguauaaa

SEQ ID NO: 2686545 - RNA, 19 nt, Haemophilus influenzae Rd
auguucuacguaauuuaau

SEQ ID NO: 2686546 - RNA, 18 nt, Haemophilus influenzae Rd
auguucuuuguugaugau

SEQ ID NO: 2686547 - RNA, 20 nt, Haemophilus influenzae Rd
auguucuuuguugaugauuu

SEQ ID NO: 2686548 - RNA, 17 nt, Haemophilus influenzae Rd
auguucuuuuaaaagac

SEQ ID NO: 2686549 - RNA, 16 nt, Haemophilus influenzae Rd
auguugaauuuucacc

SEQ ID NO: 2686550 - RNA, 19 nt, Haemophilus influenzae Rd
auguugcaaguauuagcug

SEQ ID NO: 2686551 - RNA, 14 nt, Haemophilus influenzae Rd
auguuguaaaauau

SEQ ID NO: 2686552 - RNA, 22 nt, Haemophilus influenzae Rd
auguuguccaucaaucauaaaa

SEQ ID NO: 2686553 - RNA, 20 nt, Haemophilus influenzae Rd
auguuuaaaguaagaauuag

SEQ ID NO: 2686554 - RNA, 21 nt, Haemophilus influenzae Rd
auguuuaagccaucacugcca

SEQ ID NO: 2686555 - RNA, 16 nt, Haemophilus influenzae Rd
auguuucacuuugccc

SEQ ID NO: 2686556 - RNA, 19 nt, Haemophilus influenzae Rd
auguuugaaggcaaaauug

SEQ ID NO: 2686557 - RNA, 18 nt, Haemophilus influenzae Rd
auguuugaucgguuuuau

SEQ ID NO: 2686558 - RNA, 18 nt, Haemophilus influenzae Rd
auguuugcaucaaucauu

SEQ ID NO: 2686559 - RNA, 19 nt, Haemophilus influenzae Rd
auguuuuagagaaaugccu

SEQ ID NO: 2686560 - RNA, 18 nt, Haemophilus influenzae Rd
auguuuuccccuuuuuaa

SEQ ID NO: 2686561 - RNA, 14 nt, Haemophilus influenzae Rd
auguuuucuugacc

SEQ ID NO: 2686562 - RNA, 15 nt, Haemophilus influenzae Rd
auguuuugauaaccu

SEQ ID NO: 2686563 - RNA, 23 nt, Haemophilus influenzae Rd
auguuuugguuuucuuuuuuuca

SEQ ID NO: 2686564 - RNA, 15 nt, Haemophilus influenzae Rd
auguuuuuuagauuu

SEQ ID NO: 2686565 - RNA, 13 nt, Haemophilus influenzae Rd
auuaaaaaaagca

SEQ ID NO: 2686566 - RNA, 17 nt, Haemophilus influenzae Rd
auuaaaaaaauaguuaa

SEQ ID NO: 2686567 - RNA, 17 nt, Haemophilus influenzae Rd
auuaaaaaaaucuuuau

SEQ ID NO: 2686568 - RNA, 15 nt, Haemophilus influenzae Rd
auuaaaaaagcaaga

SEQ ID NO: 2686569 - RNA, 16 nt, Haemophilus influenzae Rd
auuaaaaaagcaagau

SEQ ID NO: 2686570 - RNA, 22 nt, Haemophilus influenzae Rd
auuaaaaaagcaagauacuuuu

SEQ ID NO: 2686571 - RNA, 20 nt, Haemophilus influenzae Rd
auuaaaaaaucaucaauuug

SEQ ID NO: 2686572 - RNA, 13 nt, Haemophilus influenzae Rd
auuaaaaagacua

SEQ ID NO: 2686573 - RNA, 13 nt, Haemophilus influenzae Rd
auuaaaaauaaau

SEQ ID NO: 2686574 - RNA, 20 nt, Haemophilus influenzae Rd
auuaaaaauaaguucaucaa

SEQ ID NO: 2686575 - RNA, 13 nt, Haemophilus influenzae Rd
auuaaaaauuuaa

SEQ ID NO: 2686576 - RNA, 14 nt, Haemophilus influenzae Rd
auuaaaaauuuaaa

SEQ ID NO: 2686577 - RNA, 15 nt, Haemophilus influenzae Rd
auuaaaaauuuaaaa

SEQ ID NO: 2686578 - RNA, 16 nt, Haemophilus influenzae Rd
auuaaaaccaauuuuu

SEQ ID NO: 2686579 - RNA, 23 nt, Haemophilus influenzae Rd
auuaauccaucauuuuucgcaaa

SEQ ID NO: 2686580 - RNA, 15 nt, Haemophilus influenzae Rd
auuaaucgaaguaug

SEQ ID NO: 2686581 - RNA, 14 nt, Haemophilus influenzae Rd
auuaaucugauaaa

SEQ ID NO: 2686582 - RNA, 17 nt, Haemophilus influenzae Rd
auuaaucugcaccuuaa

SEQ ID NO: 2686583 - RNA, 18 nt, Haemophilus influenzae Rd
auuaaucuuauacaacaa

SEQ ID NO: 2686584 - RNA, 17 nt, Haemophilus influenzae Rd
auuaaucuuuuuucuug

SEQ ID NO: 2686585 - RNA, 23 nt, Haemophilus influenzae Rd
auuaaucuuuuuucuuucuagua

SEQ ID NO: 2686586 - RNA, 19 nt, Haemophilus influenzae Rd
auuaaugaacgaacuaaaa

SEQ ID NO: 2686587 - RNA, 19 nt, Haemophilus influenzae Rd
auuaaugacaccuuuaaaa

SEQ ID NO: 2686588 - RNA, 21 nt, Haemophilus influenzae Rd
auuaaugcagccaucaauaaa

SEQ ID NO: 2686589 - RNA, 22 nt, Haemophilus influenzae Rd
auuaaugcagccaucaauaaaa

SEQ ID NO: 2686590 - RNA, 23 nt, Haemophilus influenzae Rd
auuaaugcagccaucaauaaaaa

SEQ ID NO: 2686591 - RNA, 15 nt, Haemophilus influenzae Rd
auuaaugcuaaacca

SEQ ID NO: 2686592 - RNA, 16 nt, Haemophilus influenzae Rd
auuaaugcuaaaccaa

SEQ ID NO: 2686593 - RNA, 23 nt, Haemophilus influenzae Rd
auuaauggguaaucaauauuuau

SEQ ID NO: 2686594 - RNA, 23 nt, Haemophilus influenzae Rd
auuaaugguauugugauuacucu

SEQ ID NO: 2686595 - RNA, 12 nt, Haemophilus influenzae Rd
auuaauguaauc

SEQ ID NO: 2686596 - RNA, 14 nt, Haemophilus influenzae Rd
auuaaugucgcauu

SEQ ID NO: 2686597 - RNA, 22 nt, Haemophilus influenzae Rd
auuaauuaaaagugcgguuaaa

SEQ ID NO: 2686598 - RNA, 20 nt, Haemophilus influenzae Rd
auuaauuaacgcucaaaaau

SEQ ID NO: 2686599 - RNA, 23 nt, Haemophilus influenzae Rd
auuaauuaacgcucaaaaauuuc

SEQ ID NO: 2686600 - RNA, 17 nt, Haemophilus influenzae Rd
auuaauuaccugccaaa

SEQ ID NO: 2686601 - RNA, 22 nt, Haemophilus influenzae Rd
auuaauuaccugccaaaccauc

SEQ ID NO: 2686602 - RNA, 15 nt, Haemophilus influenzae Rd
auuaauuauaaaaua

SEQ ID NO: 2686603 - RNA, 12 nt, Haemophilus influenzae Rd
auuaauuauuuu

SEQ ID NO: 2686604 - RNA, 18 nt, Haemophilus influenzae Rd
auuaauuccagugguaaa

SEQ ID NO: 2686605 - RNA, 16 nt, Haemophilus influenzae Rd
auuaauucucccucaa

SEQ ID NO: 2686606 - RNA, 21 nt, Haemophilus influenzae Rd
auuaauugauggaauuuauac

SEQ ID NO: 2686607 - RNA, 17 nt, Haemophilus influenzae Rd
auuaauugcuaccauuu

SEQ ID NO: 2686608 - RNA, 21 nt, Haemophilus influenzae Rd
auuaauugcuaccauuuaucu

SEQ ID NO: 2686609 - RNA, 22 nt, Haemophilus influenzae Rd
auuaauugcucugacacuucuc

SEQ ID NO: 2686610 - RNA, 18 nt, Haemophilus influenzae Rd
auuaauuggcgaaggcaa

SEQ ID NO: 2686611 - RNA, 21 nt, Haemophilus influenzae Rd
auuaauuggcgcaacaucaaa

SEQ ID NO: 2686612 - RNA, 20 nt, Haemophilus influenzae Rd
auuaauuugggugguuuuug

SEQ ID NO: 2686613 - RNA, 18 nt, Haemophilus influenzae Rd
auuaauuuuauuuuuugc

SEQ ID NO: 2686614 - RNA, 13 nt, Haemophilus influenzae Rd
auuaauuuuccua

SEQ ID NO: 2686615 - RNA, 11 nt, Haemophilus influenzae Rd
auuaauuuuuu

SEQ ID NO: 2686616 - RNA, 16 nt, Haemophilus influenzae Rd
auuaauuuuuuauaaa

SEQ ID NO: 2686617 - RNA, 21 nt, Haemophilus influenzae Rd
auuaauuuuuuauaaaauuuc

SEQ ID NO: 2686618 - RNA, 13 nt, Haemophilus influenzae Rd
auuacaaaaacac

SEQ ID NO: 2686619 - RNA, 14 nt, Haemophilus influenzae Rd
auuacaaaaccaau

SEQ ID NO: 2686620 - RNA, 15 nt, Haemophilus influenzae Rd
auuacaaaaccaauc

SEQ ID NO: 2686621 - RNA, 18 nt, Haemophilus influenzae Rd
auuacaaaaccaaucaua

SEQ ID NO: 2686622 - RNA, 23 nt, Haemophilus influenzae Rd
auuacaaaauccacacuuuaaaa

SEQ ID NO: 2686623 - RNA, 13 nt, Haemophilus influenzae Rd
auuacaaacaaaa

SEQ ID NO: 2686624 - RNA, 14 nt, Haemophilus influenzae Rd
auuacaagcauuaa

SEQ ID NO: 2686625 - RNA, 14 nt, Haemophilus influenzae Rd
auuacaaguauaaa

SEQ ID NO: 2686626 - RNA, 21 nt, Haemophilus influenzae Rd
auuacacgagcaauggcaauu

SEQ ID NO: 2686627 - RNA, 18 nt, Haemophilus influenzae Rd
auuacagaaucauuuuca

SEQ ID NO: 2686628 - RNA, 19 nt, Haemophilus influenzae Rd
auuacagugcgguuauuua

SEQ ID NO: 2686629 - RNA, 16 nt, Haemophilus influenzae Rd
auuacauaaaaccaau

SEQ ID NO: 2686630 - RNA, 21 nt, Haemophilus influenzae Rd
auuacauagauugaaaaguaa

SEQ ID NO: 2686631 - RNA, 14 nt, Haemophilus influenzae Rd
auuacaucauuccg

SEQ ID NO: 2686632 - RNA, 18 nt, Haemophilus influenzae Rd
auuacauccacuuuuucu

SEQ ID NO: 2686633 - RNA, 17 nt, Haemophilus influenzae Rd
auuacauucccaaauaa

SEQ ID NO: 2686634 - RNA, 18 nt, Haemophilus influenzae Rd
auuaccaauuccaaagcu

SEQ ID NO: 2686635 - RNA, 20 nt, Haemophilus influenzae Rd
auuaccacaucauuauugcc

SEQ ID NO: 2686636 - RNA, 19 nt, Haemophilus influenzae Rd
auuaccacaugcauuuuuc

SEQ ID NO: 2686637 - RNA, 20 nt, Haemophilus influenzae Rd
auuaccacaugcauuuuucu

SEQ ID NO: 2686638 - RNA, 20 nt, Haemophilus influenzae Rd
auuaccacccaaaauuucag

SEQ ID NO: 2686639 - RNA, 23 nt, Haemophilus influenzae Rd
auuaccacccaaaauuucagcua

SEQ ID NO: 2686640 - RNA, 17 nt, Haemophilus influenzae Rd
auuaccacguucauuuc

SEQ ID NO: 2686641 - RNA, 20 nt, Haemophilus influenzae Rd
auuaccacugcauuuucucg

SEQ ID NO: 2686642 - RNA, 21 nt, Haemophilus influenzae Rd
auuaccacuugccaaacauua

SEQ ID NO: 2686643 - RNA, 16 nt, Haemophilus influenzae Rd
auuaccaggaaauauu

SEQ ID NO: 2686644 - RNA, 15 nt, Haemophilus influenzae Rd
auuaccauuugauau

SEQ ID NO: 2686645 - RNA, 18 nt, Haemophilus influenzae Rd
auuaccccaauuccuugu

SEQ ID NO: 2686646 - RNA, 18 nt, Haemophilus influenzae Rd
auuaccgcacuuuuuauu

SEQ ID NO: 2686647 - RNA, 16 nt, Haemophilus influenzae Rd
auuaccguguuuuuca

SEQ ID NO: 2686648 - RNA, 23 nt, Haemophilus influenzae Rd
auuaccuucuguuuucaauacgc

SEQ ID NO: 2686649 - RNA, 18 nt, Haemophilus influenzae Rd
auuacgacauucuuuaga

SEQ ID NO: 2686650 - RNA, 20 nt, Haemophilus influenzae Rd
auuacgacauucuuuagaau

SEQ ID NO: 2686651 - RNA, 21 nt, Haemophilus influenzae Rd
auuacgauaguaaaaaaucaa

SEQ ID NO: 2686652 - RNA, 15 nt, Haemophilus influenzae Rd
auuacgccuaaccaa

SEQ ID NO: 2686653 - RNA, 18 nt, Haemophilus influenzae Rd
auuacgccugcaaauaag

SEQ ID NO: 2686654 - RNA, 17 nt, Haemophilus influenzae Rd
auuacgcguacgcaauu

SEQ ID NO: 2686655 - RNA, 22 nt, Haemophilus influenzae Rd
auuacgcguacgcaauuuagau

SEQ ID NO: 2686656 - RNA, 19 nt, Haemophilus influenzae Rd
auuacgcuguccaauaauu

SEQ ID NO: 2686657 - RNA, 22 nt, Haemophilus influenzae Rd
auuacgcuuuacuacaucaggu

SEQ ID NO: 2686658 - RNA, 19 nt, Haemophilus influenzae Rd
auuacguagaaaacaauaa

SEQ ID NO: 2686659 - RNA, 20 nt, Haemophilus influenzae Rd
auuacguagaaaacaauaaa

SEQ ID NO: 2686660 - RNA, 18 nt, Haemophilus influenzae Rd
auuacgugcaaauaaauu

SEQ ID NO: 2686661 - RNA, 19 nt, Haemophilus influenzae Rd
auuacgugcaaauaaauuu

SEQ ID NO: 2686662 - RNA, 15 nt, Haemophilus influenzae Rd
auuacguguuugguu

SEQ ID NO: 2686663 - RNA, 19 nt, Haemophilus influenzae Rd
auuacguucauauaaauuu

SEQ ID NO: 2686664 - RNA, 21 nt, Haemophilus influenzae Rd
auuacguucauauaaauuuga

SEQ ID NO: 2686665 - RNA, 21 nt, Haemophilus influenzae Rd
auuacucacuauaacuuuuca

SEQ ID NO: 2686666 - RNA, 22 nt, Haemophilus influenzae Rd
auuacugucgaaccaaguugga

SEQ ID NO: 2686667 - RNA, 12 nt, Haemophilus influenzae Rd
auuacuuaaagu

SEQ ID NO: 2686668 - RNA, 15 nt, Haemophilus influenzae Rd
auuacuuaacaucau

SEQ ID NO: 2686669 - RNA, 19 nt, Haemophilus influenzae Rd
auuacuuacuacuuuggau

SEQ ID NO: 2686670 - RNA, 17 nt, Haemophilus influenzae Rd
auuacuuagauauauua

SEQ ID NO: 2686671 - RNA, 13 nt, Haemophilus influenzae Rd
auuacuugaaauu

SEQ ID NO: 2686672 - RNA, 22 nt, Haemophilus influenzae Rd
auuacuuggggcuaauuuuuaa

SEQ ID NO: 2686673 - RNA, 21 nt, Haemophilus influenzae Rd
auuacuuuccauaauagaaac

SEQ ID NO: 2686674 - RNA, 21 nt, Haemophilus influenzae Rd
auuacuuuuagauaaauuuca

SEQ ID NO: 2686675 - RNA, 14 nt, Haemophilus influenzae Rd
auuacuuuuaucca

SEQ ID NO: 2686676 - RNA, 20 nt, Haemophilus influenzae Rd
auuacuuuuauccacaugau

SEQ ID NO: 2686677 - RNA, 19 nt, Haemophilus influenzae Rd
auuacuuuuuuaaguagua

SEQ ID NO: 2686678 - RNA, 19 nt, Haemophilus influenzae Rd
auuagaaauauauuuguuu

SEQ ID NO: 2686679 - RNA, 11 nt, Haemophilus influenzae Rd
auuagaaauga

SEQ ID NO: 2686680 - RNA, 15 nt, Haemophilus influenzae Rd
auuagaaaugaucaa

SEQ ID NO: 2686681 - RNA, 20 nt, Haemophilus influenzae Rd
auuagaaaugaucaaaucaa

SEQ ID NO: 2686682 - RNA, 18 nt, Haemophilus influenzae Rd
auuagaaguaaauucagu

SEQ ID NO: 2686683 - RNA, 21 nt, Haemophilus influenzae Rd
auuauuuagauauaaaaaucu

SEQ ID NO: 2686684 - RNA, 16 nt, Haemophilus influenzae Rd
auuauuuauuuugaau

SEQ ID NO: 2686685 - RNA, 19 nt, Haemophilus influenzae Rd
auuauuucaguaacuuuaa

SEQ ID NO: 2686686 - RNA, 22 nt, Haemophilus influenzae Rd
auuauuucaguaacuuuaauaa

SEQ ID NO: 2686687 - RNA, 16 nt, Haemophilus influenzae Rd
auuauuuccucuucuu

SEQ ID NO: 2686688 - RNA, 21 nt, Haemophilus influenzae Rd
auuauuucguuguuuuaauaa

SEQ ID NO: 2686689 - RNA, 18 nt, Haemophilus influenzae Rd
auuauuugcauauaaaaa

SEQ ID NO: 2686690 - RNA, 14 nt, Haemophilus influenzae Rd
auuauuuuaaauaa

SEQ ID NO: 2686691 - RNA, 16 nt, Haemophilus influenzae Rd
auuauuuuaaauaaau

SEQ ID NO: 2686692 - RNA, 14 nt, Haemophilus influenzae Rd
auuauuuuacuuuu

SEQ ID NO: 2686693 - RNA, 16 nt, Haemophilus influenzae Rd
auuauuuuuacaaaua

SEQ ID NO: 2686694 - RNA, 13 nt, Haemophilus influenzae Rd
auuauuuuuuaac

SEQ ID NO: 2686695 - RNA, 14 nt, Haemophilus influenzae Rd
auucaaaacauuaa

SEQ ID NO: 2686696 - RNA, 13 nt, Haemophilus influenzae Rd
auucaaaauuugu

SEQ ID NO: 2686697 - RNA, 22 nt, Haemophilus influenzae Rd
auucaaacaggcuuauuaaaaa

SEQ ID NO: 2686698 - RNA, 22 nt, Haemophilus influenzae Rd
auucaaacguuaaaucacuuuc

SEQ ID NO: 2686699 - RNA, 17 nt, Haemophilus influenzae Rd
auucaaagauuuuaaaa

SEQ ID NO: 2686700 - RNA, 18 nt, Haemophilus influenzae Rd
auucaaagauuuuaaaau

SEQ ID NO: 2686701 - RNA, 23 nt, Haemophilus influenzae Rd
auucaaagauuuuaaaauuuauu

SEQ ID NO: 2686702 - RNA, 21 nt, Haemophilus influenzae Rd
auucaaauaacgcauaauuug

SEQ ID NO: 2686703 - RNA, 17 nt, Haemophilus influenzae Rd
auucaaaucgaucacuu

SEQ ID NO: 2686704 - RNA, 15 nt, Haemophilus influenzae Rd
auucaaaucuugaca

SEQ ID NO: 2686705 - RNA, 15 nt, Haemophilus influenzae Rd
auucaaauuucaacu

SEQ ID NO: 2686706 - RNA, 16 nt, Haemophilus influenzae Rd
auucaacuaaaggcac

SEQ ID NO: 2686707 - RNA, 22 nt, Haemophilus influenzae Rd
auucaacuaaaggcacaaaaaa

SEQ ID NO: 2686708 - RNA, 19 nt, Haemophilus influenzae Rd
auucaagccuucuaaaaua

SEQ ID NO: 2686709 - RNA, 18 nt, Haemophilus influenzae Rd
auucaauagguuauaagu

SEQ ID NO: 2686710 - RNA, 22 nt, Haemophilus influenzae Rd
auucaauagguuauaaguuuuu

SEQ ID NO: 2686711 - RNA, 17 nt, Haemophilus influenzae Rd
auucaauccuauuuuua

SEQ ID NO: 2686712 - RNA, 15 nt, Haemophilus influenzae Rd
auucaaucuuuuugu

SEQ ID NO: 2686713 - RNA, 19 nt, Haemophilus influenzae Rd
auucaaucuuuuuguuaau

SEQ ID NO: 2686714 - RNA, 14 nt, Haemophilus influenzae Rd
auucaaugcaacaa

SEQ ID NO: 2686715 - RNA, 18 nt, Haemophilus influenzae Rd
auucaaugcagaaauacu

SEQ ID NO: 2686716 - RNA, 17 nt, Haemophilus influenzae Rd
auucaaugcuuccuuca

SEQ ID NO: 2686717 - RNA, 19 nt, Haemophilus influenzae Rd
auucaaugcuuccuucaaa

SEQ ID NO: 2686718 - RNA, 21 nt, Haemophilus influenzae Rd
auucaauuuuccccucaauuu

SEQ ID NO: 2686719 - RNA, 16 nt, Haemophilus influenzae Rd
auucacaggguucagc

SEQ ID NO: 2686720 - RNA, 18 nt, Haemophilus influenzae Rd
auucacauucuuuuaaau

SEQ ID NO: 2686721 - RNA, 19 nt, Haemophilus influenzae Rd
auucacauucuuuuaaaua

SEQ ID NO: 2686722 - RNA, 21 nt, Haemophilus influenzae Rd
auucacauucuuuuaaauaca

SEQ ID NO: 2686723 - RNA, 20 nt, Haemophilus influenzae Rd
auucaccgcacuuuuuacuu

SEQ ID NO: 2686724 - RNA, 17 nt, Haemophilus influenzae Rd
auucacgaauacaucca

SEQ ID NO: 2686725 - RNA, 14 nt, Haemophilus influenzae Rd
auucacgaucacuu

SEQ ID NO: 2686726 - RNA, 19 nt, Haemophilus influenzae Rd
auucacgcauuuaaauaaa

SEQ ID NO: 2686727 - RNA, 20 nt, Haemophilus influenzae Rd
auucacgcauuuaaauaaaa

SEQ ID NO: 2686728 - RNA, 22 nt, Haemophilus influenzae Rd
auucacgguguuuuuuuucuuu

SEQ ID NO: 2686729 - RNA, 20 nt, Haemophilus influenzae Rd
auucacguucuuuaauauca

SEQ ID NO: 2686730 - RNA, 23 nt, Haemophilus influenzae Rd
auucacuuaauugugugcguuuu

SEQ ID NO: 2686731 - RNA, 17 nt, Haemophilus influenzae Rd
auucacuucuaaaacca

SEQ ID NO: 2686732 - RNA, 22 nt, Haemophilus influenzae Rd
auucacuuucacauaaauuaca

SEQ ID NO: 2686733 - RNA, 16 nt, Haemophilus influenzae Rd
auucagcaaaaucacu

SEQ ID NO: 2686734 - RNA, 13 nt, Haemophilus influenzae Rd
auucagcacuuuc

SEQ ID NO: 2686735 - RNA, 19 nt, Haemophilus influenzae Rd
auucagccccuuauggugg

SEQ ID NO: 2686736 - RNA, 17 nt, Haemophilus influenzae Rd
auucagcgagagaauau

SEQ ID NO: 2686737 - RNA, 22 nt, Haemophilus influenzae Rd
auucaggugggaaauaauuuuc

SEQ ID NO: 2686738 - RNA, 16 nt, Haemophilus influenzae Rd
auucaguaagaaacca

SEQ ID NO: 2686739 - RNA, 20 nt, Haemophilus influenzae Rd
auucaguccaugcguuuuau

SEQ ID NO: 2686740 - RNA, 21 nt, Haemophilus influenzae Rd
auucaguccaugcguuuuauu

SEQ ID NO: 2686741 - RNA, 14 nt, Haemophilus influenzae Rd
auucaguccgcauu

SEQ ID NO: 2686742 - RNA, 16 nt, Haemophilus influenzae Rd
auucaguccgcauuga

SEQ ID NO: 2686743 - RNA, 13 nt, Haemophilus influenzae Rd
auucagugccaua

SEQ ID NO: 2686744 - RNA, 17 nt, Haemophilus influenzae Rd
auucagugccuaaauuu

SEQ ID NO: 2686745 - RNA, 16 nt, Haemophilus influenzae Rd
auucagugcuuuuuca

SEQ ID NO: 2686746 - RNA, 20 nt, Haemophilus influenzae Rd
auucagugcuuuuucaagga

SEQ ID NO: 2686747 - RNA, 22 nt, Haemophilus influenzae Rd
auucagugcuuuuucaaggaaa

SEQ ID NO: 2686748 - RNA, 16 nt, Haemophilus influenzae Rd
auucaguguaguuuuc

SEQ ID NO: 2686749 - RNA, 18 nt, Haemophilus influenzae Rd
auucaguguaguuuucug

SEQ ID NO: 2686750 - RNA, 19 nt, Haemophilus influenzae Rd
auucaguugauagacaaua

SEQ ID NO: 2686751 - RNA, 23 nt, Haemophilus influenzae Rd
auucaguugauagacaauauaau

SEQ ID NO: 2686752 - RNA, 21 nt, Haemophilus influenzae Rd
auucauaaauuccuuuuuaau

SEQ ID NO: 2686753 - RNA, 14 nt, Haemophilus influenzae Rd
auucaucacuucuu

SEQ ID NO: 2686754 - RNA, 18 nt, Haemophilus influenzae Rd
auucaucacuucuugugg

SEQ ID NO: 2686755 - RNA, 19 nt, Haemophilus influenzae Rd
auucaucacuucuugugga

SEQ ID NO: 2686756 - RNA, 21 nt, Haemophilus influenzae Rd
auucaucguaauuaaacaaaa

SEQ ID NO: 2686757 - RNA, 20 nt, Haemophilus influenzae Rd
auucaugagcugggcaaaca

SEQ ID NO: 2686758 - RNA, 17 nt, Haemophilus influenzae Rd
auucauguuuuuuagau

SEQ ID NO: 2686759 - RNA, 21 nt, Haemophilus influenzae Rd
auucauguuuuuuagauuuau

SEQ ID NO: 2686760 - RNA, 19 nt, Haemophilus influenzae Rd
auucauuaaggcuuuucuu

SEQ ID NO: 2686761 - RNA, 20 nt, Haemophilus influenzae Rd
auucauuaaggcuuuucuuu

SEQ ID NO: 2686762 - RNA, 21 nt, Haemophilus influenzae Rd
auucauuauuacuuuuuuaag

SEQ ID NO: 2686763 - RNA, 13 nt, Haemophilus influenzae Rd
auucauucauuuu

SEQ ID NO: 2686764 - RNA, 14 nt, Haemophilus influenzae Rd
auucauucuugcuu

SEQ ID NO: 2686765 - RNA, 22 nt, Haemophilus influenzae Rd
auucauugaugcccacuuuucc

SEQ ID NO: 2686766 - RNA, 16 nt, Haemophilus influenzae Rd
auucauugcauuuuua

SEQ ID NO: 2686767 - RNA, 17 nt, Haemophilus influenzae Rd
auucauugcauuuuuau

SEQ ID NO: 2686768 - RNA, 20 nt, Haemophilus influenzae Rd
auucauuguuucucaauaaa

SEQ ID NO: 2686769 - RNA, 15 nt, Haemophilus influenzae Rd
auucauuuaaaauau

SEQ ID NO: 2686770 - RNA, 21 nt, Haemophilus influenzae Rd
auucauuuaaaauauauauua

SEQ ID NO: 2686771 - RNA, 17 nt, Haemophilus influenzae Rd
auucauuugcaaaucaa

SEQ ID NO: 2686772 - RNA, 14 nt, Haemophilus influenzae Rd
auucauuuuuuauu

SEQ ID NO: 2686773 - RNA, 22 nt, Haemophilus influenzae Rd
auuccaaacuggaauaaagcaa

SEQ ID NO: 2686774 - RNA, 23 nt, Haemophilus influenzae Rd
auuccaaacuggaauaaagcaac

SEQ ID NO: 2686775 - RNA, 16 nt, Haemophilus influenzae Rd
auuccaaaucauacca

SEQ ID NO: 2686776 - RNA, 19 nt, Haemophilus influenzae Rd
auuccaacgauuuugcaag

SEQ ID NO: 2686777 - RNA, 12 nt, Haemophilus influenzae Rd
auuccaagguuu

SEQ ID NO: 2686778 - RNA, 15 nt, Haemophilus influenzae Rd
auuccaagguuuuuu

SEQ ID NO: 2686779 - RNA, 19 nt, Haemophilus influenzae Rd
auuccaccacucgggcaua

SEQ ID NO: 2686780 - RNA, 14 nt, Haemophilus influenzae Rd
auuccacccauacc

SEQ ID NO: 2686781 - RNA, 15 nt, Haemophilus influenzae Rd
auuccacuuuuucau

SEQ ID NO: 2686782 - RNA, 18 nt, Haemophilus influenzae Rd
auuccacuuuuucaugua

SEQ ID NO: 2686783 - RNA, 22 nt, Haemophilus influenzae Rd
auuccaguaaugguuacuuuau

SEQ ID NO: 2686784 - RNA, 19 nt, Haemophilus influenzae Rd
auuccagugguaaaccuaa

SEQ ID NO: 2686785 - RNA, 17 nt, Haemophilus influenzae Rd
auuccaguucuccuucu

SEQ ID NO: 2686786 - RNA, 16 nt, Haemophilus influenzae Rd
auuccauaauaucuuu

SEQ ID NO: 2686787 - RNA, 23 nt, Haemophilus influenzae Rd
auucuucgaaaauaacuucaucc

SEQ ID NO: 2686788 - RNA, 15 nt, Haemophilus influenzae Rd
auucuucgccauuuu

SEQ ID NO: 2686789 - RNA, 15 nt, Haemophilus influenzae Rd
auucuucuaaaagau

SEQ ID NO: 2686790 - RNA, 18 nt, Haemophilus influenzae Rd
auucuugacguaauucuc

SEQ ID NO: 2686791 - RNA, 16 nt, Haemophilus influenzae Rd
auucuugccagauuuu

SEQ ID NO: 2686792 - RNA, 16 nt, Haemophilus influenzae Rd
auucuugcguaaccaa

SEQ ID NO: 2686793 - RNA, 15 nt, Haemophilus influenzae Rd
auucuugcguuucaa

SEQ ID NO: 2686794 - RNA, 22 nt, Haemophilus influenzae Rd
auucuugcuugaucauccauuu

SEQ ID NO: 2686795 - RNA, 15 nt, Haemophilus influenzae Rd
auucuugucuuuuaa

SEQ ID NO: 2686796 - RNA, 22 nt, Haemophilus influenzae Rd
auucuugucuuuuaaguuagga

SEQ ID NO: 2686797 - RNA, 12 nt, Haemophilus influenzae Rd
auucuuguucug

SEQ ID NO: 2686798 - RNA, 13 nt, Haemophilus influenzae Rd
auucuuuaaauau

SEQ ID NO: 2686799 - RNA, 16 nt, Haemophilus influenzae Rd
auucuuuaaauauuca

SEQ ID NO: 2686800 - RNA, 18 nt, Haemophilus influenzae Rd
auucuuuagauugcucaa

SEQ ID NO: 2686801 - RNA, 23 nt, Haemophilus influenzae Rd
auucuuuaguguauaacaaauag

SEQ ID NO: 2686802 - RNA, 17 nt, Haemophilus influenzae Rd
auucuuuaugaauuacc

SEQ ID NO: 2686803 - RNA, 16 nt, Haemophilus influenzae Rd
auucuuucaauaauuu

SEQ ID NO: 2686804 - RNA, 19 nt, Haemophilus influenzae Rd
auucuuucaauaauuuuuc

SEQ ID NO: 2686805 - RNA, 14 nt, Haemophilus influenzae Rd
auucuuuccucucc

SEQ ID NO: 2686806 - RNA, 14 nt, Haemophilus influenzae Rd
auucuuucucuuuu

SEQ ID NO: 2686807 - RNA, 22 nt, Haemophilus influenzae Rd
auucuuugagucggggauuuuu

SEQ ID NO: 2686808 - RNA, 17 nt, Haemophilus influenzae Rd
auucuuugccuugaugc

SEQ ID NO: 2686809 - RNA, 12 nt, Haemophilus influenzae Rd
auucuuuuaaau

SEQ ID NO: 2686810 - RNA, 16 nt, Haemophilus influenzae Rd
auucuuuugccauaua

SEQ ID NO: 2686811 - RNA, 22 nt, Haemophilus influenzae Rd
auucuuuugcuaguaagauuuu

SEQ ID NO: 2686812 - RNA, 14 nt, Haemophilus influenzae Rd
auucuuuuuguaau

SEQ ID NO: 2686813 - RNA, 16 nt, Haemophilus influenzae Rd
auucuuuuuucuuccu

SEQ ID NO: 2686814 - RNA, 23 nt, Haemophilus influenzae Rd
auucuuuuuucuuccuaugaaua

SEQ ID NO: 2686815 - RNA, 20 nt, Haemophilus influenzae Rd
auugaaaauuaaacgauaaa

SEQ ID NO: 2686816 - RNA, 21 nt, Haemophilus influenzae Rd
auugaaaccugaguaaauaaa

SEQ ID NO: 2686817 - RNA, 18 nt, Haemophilus influenzae Rd
auugaaagauuaauuuuc

SEQ ID NO: 2686818 - RNA, 11 nt, Haemophilus influenzae Rd
auugaaauuuu

SEQ ID NO: 2686819 - RNA, 23 nt, Haemophilus influenzae Rd
auugaacaauguuuaauccaaac

SEQ ID NO: 2686820 - RNA, 20 nt, Haemophilus influenzae Rd
auugaacgccuagauauugu

SEQ ID NO: 2686821 - RNA, 18 nt, Haemophilus influenzae Rd
auugaacugaauuaaaaa

SEQ ID NO: 2686822 - RNA, 12 nt, Haemophilus influenzae Rd
auugaacuguuu

SEQ ID NO: 2686823 - RNA, 15 nt, Haemophilus influenzae Rd
auugaacuguuugau

SEQ ID NO: 2686824 - RNA, 12 nt, Haemophilus influenzae Rd
auugaaggucau

SEQ ID NO: 2686825 - RNA, 16 nt, Haemophilus influenzae Rd
auugaaggucauacga

SEQ ID NO: 2686826 - RNA, 19 nt, Haemophilus influenzae Rd
auugaauaauuacuugcuc

SEQ ID NO: 2686827 - RNA, 16 nt, Haemophilus influenzae Rd
auugaauguuuuucau

SEQ ID NO: 2686828 - RNA, 19 nt, Haemophilus influenzae Rd
auugaauuagauucggcua

SEQ ID NO: 2686829 - RNA, 22 nt, Haemophilus influenzae Rd
auugaauuagauucggcuaaaa

SEQ ID NO: 2686830 - RNA, 14 nt, Haemophilus influenzae Rd
auugaauuugguaa

SEQ ID NO: 2686831 - RNA, 20 nt, Haemophilus influenzae Rd
auugaauuuuucuaagguau

SEQ ID NO: 2686832 - RNA, 20 nt, Haemophilus influenzae Rd
auugacaacgcgacuaaauc

SEQ ID NO: 2686833 - RNA, 13 nt, Haemophilus influenzae Rd
auugacaauuaau

SEQ ID NO: 2686834 - RNA, 15 nt, Haemophilus influenzae Rd
auugacaauuaauau

SEQ ID NO: 2686835 - RNA, 16 nt, Haemophilus influenzae Rd
auugacauuuuacuuu

SEQ ID NO: 2686836 - RNA, 21 nt, Haemophilus influenzae Rd
auugaccgccacgagcucgca

SEQ ID NO: 2686837 - RNA, 14 nt, Haemophilus influenzae Rd
auugacgaaaaauu

SEQ ID NO: 2686838 - RNA, 19 nt, Haemophilus influenzae Rd
auugacgaaaaauuaacca

SEQ ID NO: 2686839 - RNA, 19 nt, Haemophilus influenzae Rd
auugacggugcauuugcau

SEQ ID NO: 2686840 - RNA, 12 nt, Haemophilus influenzae Rd
auugacuugcac

SEQ ID NO: 2686841 - RNA, 19 nt, Haemophilus influenzae Rd
auugacuugcacaauuacu

SEQ ID NO: 2686842 - RNA, 15 nt, Haemophilus influenzae Rd
auugacuuguuuuaa

SEQ ID NO: 2686843 - RNA, 17 nt, Haemophilus influenzae Rd
auugacuuguuuuaaaa

SEQ ID NO: 2686844 - RNA, 13 nt, Haemophilus influenzae Rd
auugagcauuuuu

SEQ ID NO: 2686845 - RNA, 22 nt, Haemophilus influenzae Rd
auugagcauuuuuuauuaaaaa

SEQ ID NO: 2686846 - RNA, 20 nt, Haemophilus influenzae Rd
auugagcgauagaaauaaag

SEQ ID NO: 2686847 - RNA, 19 nt, Haemophilus influenzae Rd
auugauacaggaaugcguu

SEQ ID NO: 2686848 - RNA, 20 nt, Haemophilus influenzae Rd
auugauauauucuucuucaa

SEQ ID NO: 2686849 - RNA, 17 nt, Haemophilus influenzae Rd
auugauauuaauuuuau

SEQ ID NO: 2686850 - RNA, 14 nt, Haemophilus influenzae Rd
auugaucagaaguu

SEQ ID NO: 2686851 - RNA, 23 nt, Haemophilus influenzae Rd
auugauccuagauguaacugaaa

SEQ ID NO: 2686852 - RNA, 21 nt, Haemophilus influenzae Rd
auugaucgccuaaauacauuu

SEQ ID NO: 2686853 - RNA, 13 nt, Haemophilus influenzae Rd
auugaugaagaug

SEQ ID NO: 2686854 - RNA, 16 nt, Haemophilus influenzae Rd
auugaugacugcauca

SEQ ID NO: 2686855 - RNA, 15 nt, Haemophilus influenzae Rd
auugaugcccacuuu

SEQ ID NO: 2686856 - RNA, 20 nt, Haemophilus influenzae Rd
auugaugcccacuuuuccua

SEQ ID NO: 2686857 - RNA, 22 nt, Haemophilus influenzae Rd
auugauguaaaagauaaaacag

SEQ ID NO: 2686858 - RNA, 14 nt, Haemophilus influenzae Rd
auugauucauuuga

SEQ ID NO: 2686859 - RNA, 16 nt, Haemophilus influenzae Rd
auugauucgauaaauu

SEQ ID NO: 2686860 - RNA, 19 nt, Haemophilus influenzae Rd
auugauucgauaaauuagg

SEQ ID NO: 2686861 - RNA, 18 nt, Haemophilus influenzae Rd
auugauucuuuaugaauu

SEQ ID NO: 2686862 - RNA, 15 nt, Haemophilus influenzae Rd
auugauugcuaaaua

SEQ ID NO: 2686863 - RNA, 16 nt, Haemophilus influenzae Rd
auugauugcuaaauaa

SEQ ID NO: 2686864 - RNA, 18 nt, Haemophilus influenzae Rd
auugauugcuaaauaaau

SEQ ID NO: 2686865 - RNA, 13 nt, Haemophilus influenzae Rd
auugauuuacauu

SEQ ID NO: 2686866 - RNA, 23 nt, Haemophilus influenzae Rd
auugauuuacauuaauuuuuccg

SEQ ID NO: 2686867 - RNA, 16 nt, Haemophilus influenzae Rd
auugauuucauauauu

SEQ ID NO: 2686868 - RNA, 20 nt, Haemophilus influenzae Rd
auugauuucauauauugugu

SEQ ID NO: 2686869 - RNA, 14 nt, Haemophilus influenzae Rd
auugauuuccaguu

SEQ ID NO: 2686870 - RNA, 18 nt, Haemophilus influenzae Rd
auugauuuccaguuacuu

SEQ ID NO: 2686871 - RNA, 14 nt, Haemophilus influenzae Rd
auugauuucucuga

SEQ ID NO: 2686872 - RNA, 19 nt, Haemophilus influenzae Rd
auugauuucucugacguaa

SEQ ID NO: 2686873 - RNA, 20 nt, Haemophilus influenzae Rd
auugauuucucugacguaau

SEQ ID NO: 2686874 - RNA, 19 nt, Haemophilus influenzae Rd
auugauuuuucaacuggcu

SEQ ID NO: 2686875 - RNA, 23 nt, Haemophilus influenzae Rd
auugcaaaggcagccauaaaugc

SEQ ID NO: 2686876 - RNA, 23 nt, Haemophilus influenzae Rd
auugcaagugcaguuucaguauc

SEQ ID NO: 2686877 - RNA, 18 nt, Haemophilus influenzae Rd
auugcaauaaccacgccu

SEQ ID NO: 2686878 - RNA, 16 nt, Haemophilus influenzae Rd
auugcaccaaauuucg

SEQ ID NO: 2686879 - RNA, 18 nt, Haemophilus influenzae Rd
auugcaccaucguuaaac

SEQ ID NO: 2686880 - RNA, 21 nt, Haemophilus influenzae Rd
auugcaccaucguuaaaccaa

SEQ ID NO: 2686881 - RNA, 22 nt, Haemophilus influenzae Rd
auugcacuaauaaauagaaauu

SEQ ID NO: 2686882 - RNA, 13 nt, Haemophilus influenzae Rd
auugcacuucacc

SEQ ID NO: 2686883 - RNA, 20 nt, Haemophilus influenzae Rd
auugcaggcuuagcaauaau

SEQ ID NO: 2686884 - RNA, 17 nt, Haemophilus influenzae Rd
auugcagggauauugcc

SEQ ID NO: 2686885 - RNA, 15 nt, Haemophilus influenzae Rd
auugcauaguuuuau

SEQ ID NO: 2686886 - RNA, 21 nt, Haemophilus influenzae Rd
auugcauauagagucaaucca

SEQ ID NO: 2686887 - RNA, 17 nt, Haemophilus influenzae Rd
auugcaucauaguccac

SEQ ID NO: 2686888 - RNA, 21 nt, Haemophilus influenzae Rd
auugcaucuuggcauuuuugc

SEQ ID NO: 2686889 - RNA, 16 nt, Haemophilus influenzae Rd
auugcaugaaauguag

SEQ ID NO: 2686890 - RNA, 20 nt, Haemophilus influenzae Rd
auugcauugccuaaauacau

SEQ ID NO: 2686891 - RNA, 12 nt, Haemophilus influenzae Rd
auugcauuuucu

SEQ ID NO: 2686892 - RNA, 22 nt, Haemophilus influenzae Rd
auuguuugcuaauguaguugga

SEQ ID NO: 2686893 - RNA, 12 nt, Haemophilus influenzae Rd
auuguuuuaaaa

SEQ ID NO: 2686894 - RNA, 21 nt, Haemophilus influenzae Rd
auuguuuucugaacuaaaaua

SEQ ID NO: 2686895 - RNA, 20 nt, Haemophilus influenzae Rd
auuguuuuuucauauuuuaa

SEQ ID NO: 2686896 - RNA, 16 nt, Haemophilus influenzae Rd
auuuaaaaaaacguua

SEQ ID NO: 2686897 - RNA, 16 nt, Haemophilus influenzae Rd
auuuaaaaaucuguga

SEQ ID NO: 2686898 - RNA, 14 nt, Haemophilus influenzae Rd
auuuaaaacaaaag

SEQ ID NO: 2686899 - RNA, 12 nt, Haemophilus influenzae Rd
auuuaaaagcac

SEQ ID NO: 2686900 - RNA, 13 nt, Haemophilus influenzae Rd
auuuaaaaguaaa

SEQ ID NO: 2686901 - RNA, 15 nt, Haemophilus influenzae Rd
auuuaaaaguaaaaa

SEQ ID NO: 2686902 - RNA, 17 nt, Haemophilus influenzae Rd
auuuaaaaguaaaaaua

SEQ ID NO: 2686903 - RNA, 19 nt, Haemophilus influenzae Rd
auuuaaaaguaaaaauaaa

SEQ ID NO: 2686904 - RNA, 20 nt, Haemophilus influenzae Rd
auuuaaaaguaaaaauaaaa

SEQ ID NO: 2686905 - RNA, 16 nt, Haemophilus influenzae Rd
auuuaaaauauauauu

SEQ ID NO: 2686906 - RNA, 22 nt, Haemophilus influenzae Rd
auuuaaaaucagcccuuauuuu

SEQ ID NO: 2686907 - RNA, 20 nt, Haemophilus influenzae Rd
auuuaaaauuggacaauguu

SEQ ID NO: 2686908 - RNA, 19 nt, Haemophilus influenzae Rd
auuuaaaccauuuuaauca

SEQ ID NO: 2686909 - RNA, 20 nt, Haemophilus influenzae Rd
auuuaaacggauuaacacau

SEQ ID NO: 2686910 - RNA, 22 nt, Haemophilus influenzae Rd
auuuaaacggauuaacacaucc

SEQ ID NO: 2686911 - RNA, 20 nt, Haemophilus influenzae Rd
auuuaaaggcggauuuauua

SEQ ID NO: 2686912 - RNA, 19 nt, Haemophilus influenzae Rd
auuuaaauaaaauaacaaa

SEQ ID NO: 2686913 - RNA, 22 nt, Haemophilus influenzae Rd
auuuaaauacacuucuaaaaua

SEQ ID NO: 2686914 - RNA, 23 nt, Haemophilus influenzae Rd
auuuaaauauaauuuagcaucua

SEQ ID NO: 2686915 - RNA, 17 nt, Haemophilus influenzae Rd
auuuaaauggcuuuauu

SEQ ID NO: 2686916 - RNA, 16 nt, Haemophilus influenzae Rd
auuuaaauuaaaaaga

SEQ ID NO: 2686917 - RNA, 23 nt, Haemophilus influenzae Rd
auuuaaauuaaaaagacuaaacu

SEQ ID NO: 2686918 - RNA, 13 nt, Haemophilus influenzae Rd
auuuaaauuauua

SEQ ID NO: 2686919 - RNA, 21 nt, Haemophilus influenzae Rd
auuuaaauuuauuuuuuaaaa

SEQ ID NO: 2686920 - RNA, 15 nt, Haemophilus influenzae Rd
auuuaacaauaacuu

SEQ ID NO: 2686921 - RNA, 17 nt, Haemophilus influenzae Rd
auuuaacaaugaaauua

SEQ ID NO: 2686922 - RNA, 20 nt, Haemophilus influenzae Rd
auuuaacaauggcaacaaau

SEQ ID NO: 2686923 - RNA, 18 nt, Haemophilus influenzae Rd
auuuaacauaacuuucca

SEQ ID NO: 2686924 - RNA, 16 nt, Haemophilus influenzae Rd
auuuaacauaauuuau

SEQ ID NO: 2686925 - RNA, 21 nt, Haemophilus influenzae Rd
auuuaaccacuugucauuaaa

SEQ ID NO: 2686926 - RNA, 23 nt, Haemophilus influenzae Rd
auuuaaccacuugucauuaaaaa

SEQ ID NO: 2686927 - RNA, 22 nt, Haemophilus influenzae Rd
auuuaaccccugaauuuuguac

SEQ ID NO: 2686928 - RNA, 18 nt, Haemophilus influenzae Rd
auuuaaccguaauuucaa

SEQ ID NO: 2686929 - RNA, 15 nt, Haemophilus influenzae Rd
auuuaacuguaucua

SEQ ID NO: 2686930 - RNA, 21 nt, Haemophilus influenzae Rd
auuuaacuguaucuacuuuau

SEQ ID NO: 2686931 - RNA, 22 nt, Haemophilus influenzae Rd
auuuaacuguaucuacuuuauu

SEQ ID NO: 2686932 - RNA, 17 nt, Haemophilus influenzae Rd
auuuaagaaaaaauaua

SEQ ID NO: 2686933 - RNA, 22 nt, Haemophilus influenzae Rd
auuuaagauuuacagaacaaaa

SEQ ID NO: 2686934 - RNA, 23 nt, Haemophilus influenzae Rd
auuuaagccagaacauauaaccc

SEQ ID NO: 2686935 - RNA, 22 nt, Haemophilus influenzae Rd
auuuaagccuguuaugcuuuau

SEQ ID NO: 2686936 - RNA, 14 nt, Haemophilus influenzae Rd
auuuaauaaaacaa

SEQ ID NO: 2686937 - RNA, 20 nt, Haemophilus influenzae Rd
auuuaauaacaaaagggcga

SEQ ID NO: 2686938 - RNA, 18 nt, Haemophilus influenzae Rd
auuuaauaagaauuuuaa

SEQ ID NO: 2686939 - RNA, 19 nt, Haemophilus influenzae Rd
auuuaauaagaauuuuaau

SEQ ID NO: 2686940 - RNA, 15 nt, Haemophilus influenzae Rd
auuuaauaauaucaa

SEQ ID NO: 2686941 - RNA, 13 nt, Haemophilus influenzae Rd
auuuaauaaugaa

SEQ ID NO: 2686942 - RNA, 18 nt, Haemophilus influenzae Rd
auuuaauaccauacauaa

SEQ ID NO: 2686943 - RNA, 15 nt, Haemophilus influenzae Rd
auuuaauacuuucuu

SEQ ID NO: 2686944 - RNA, 14 nt, Haemophilus influenzae Rd
auuuaauagcacag

SEQ ID NO: 2686945 - RNA, 14 nt, Haemophilus influenzae Rd
auuuaauauuucuu

SEQ ID NO: 2686946 - RNA, 16 nt, Haemophilus influenzae Rd
auuuaauauuucuuca

SEQ ID NO: 2686947 - RNA, 23 nt, Haemophilus influenzae Rd
auuuaauccugucaucuguaaac

SEQ ID NO: 2686948 - RNA, 14 nt, Haemophilus influenzae Rd
auuuaaugaugaaa

SEQ ID NO: 2686949 - RNA, 20 nt, Haemophilus influenzae Rd
auuuaaugggugauccauaa

SEQ ID NO: 2686950 - RNA, 21 nt, Haemophilus influenzae Rd
auuuaaugggugauccauaau

SEQ ID NO: 2686951 - RNA, 21 nt, Haemophilus influenzae Rd
auuuaauguauaaaaguggaa

SEQ ID NO: 2686952 - RNA, 14 nt, Haemophilus influenzae Rd
auuuaauucuaaau

SEQ ID NO: 2686953 - RNA, 21 nt, Haemophilus influenzae Rd
auuuaauugaaauuuaucuaa

SEQ ID NO: 2686954 - RNA, 14 nt, Haemophilus influenzae Rd
auuuaauuucaaaa

SEQ ID NO: 2686955 - RNA, 19 nt, Haemophilus influenzae Rd
auuuaauuucaaaaucaca

SEQ ID NO: 2686956 - RNA, 12 nt, Haemophilus influenzae Rd
auuuaauuuuuu

SEQ ID NO: 2686957 - RNA, 18 nt, Haemophilus influenzae Rd
auuuacaagucucuauga

SEQ ID NO: 2686958 - RNA, 17 nt, Haemophilus influenzae Rd
auuuacagaacaaaaua

SEQ ID NO: 2686959 - RNA, 20 nt, Haemophilus influenzae Rd
auuuacagaacaaaauaauu

SEQ ID NO: 2686960 - RNA, 18 nt, Haemophilus influenzae Rd
auuuacauuaauuuuucc

SEQ ID NO: 2686961 - RNA, 21 nt, Haemophilus influenzae Rd
auuuaccaauaggaagcauuu

SEQ ID NO: 2686962 - RNA, 16 nt, Haemophilus influenzae Rd
auuuacccacaacuca

SEQ ID NO: 2686963 - RNA, 20 nt, Haemophilus influenzae Rd
auuuaccgcuuucaauuaau

SEQ ID NO: 2686964 - RNA, 21 nt, Haemophilus influenzae Rd
auuuaccugauucauugcauu

SEQ ID NO: 2686965 - RNA, 15 nt, Haemophilus influenzae Rd
auuuacguaaaaaag

SEQ ID NO: 2686966 - RNA, 18 nt, Haemophilus influenzae Rd
auuuacguaaaaaaguuu

SEQ ID NO: 2686967 - RNA, 22 nt, Haemophilus influenzae Rd
auuuacguaaugcuuuugcuuc

SEQ ID NO: 2686968 - RNA, 19 nt, Haemophilus influenzae Rd
auuuacucuuuuuuagaua

SEQ ID NO: 2686969 - RNA, 23 nt, Haemophilus influenzae Rd
auuuacucuuuuuuagauaaaaa

SEQ ID NO: 2686970 - RNA, 14 nt, Haemophilus influenzae Rd
auuuacugauuuaa

SEQ ID NO: 2686971 - RNA, 16 nt, Haemophilus influenzae Rd
auuuacugauuuaaaa

SEQ ID NO: 2686972 - RNA, 17 nt, Haemophilus influenzae Rd
auuuacugauuuaaaaa

SEQ ID NO: 2686973 - RNA, 19 nt, Haemophilus influenzae Rd
auuuacugauuuuaagaaa

SEQ ID NO: 2686974 - RNA, 20 nt, Haemophilus influenzae Rd
auuuacuguuuuuauauuua

SEQ ID NO: 2686975 - RNA, 21 nt, Haemophilus influenzae Rd
auuuacuguuuuuauauuuag

SEQ ID NO: 2686976 - RNA, 16 nt, Haemophilus influenzae Rd
auuuacuuuauaaaug

SEQ ID NO: 2686977 - RNA, 17 nt, Haemophilus influenzae Rd
auuuacuuuauaaauga

SEQ ID NO: 2686978 - RNA, 14 nt, Haemophilus influenzae Rd
auuuagaaaguaua

SEQ ID NO: 2686979 - RNA, 15 nt, Haemophilus influenzae Rd
auuuagaaaguauaa

SEQ ID NO: 2686980 - RNA, 15 nt, Haemophilus influenzae Rd
auuuagaacaauauu

SEQ ID NO: 2686981 - RNA, 18 nt, Haemophilus influenzae Rd
auuuagaacaauauuuau

SEQ ID NO: 2686982 - RNA, 14 nt, Haemophilus influenzae Rd
auuuagaauuuuua

SEQ ID NO: 2686983 - RNA, 13 nt, Haemophilus influenzae Rd
auuuagauaaaaa

SEQ ID NO: 2686984 - RNA, 14 nt, Haemophilus influenzae Rd
auuuagauaaaaau

SEQ ID NO: 2686985 - RNA, 18 nt, Haemophilus influenzae Rd
auuuagauacaaaauguu

SEQ ID NO: 2686986 - RNA, 15 nt, Haemophilus influenzae Rd
auuuagauauaaaaa

SEQ ID NO: 2686987 - RNA, 15 nt, Haemophilus influenzae Rd
auuuagauuacuuuu

SEQ ID NO: 2686988 - RNA, 16 nt, Haemophilus influenzae Rd
auuuagauuacuuuua

SEQ ID NO: 2686989 - RNA, 13 nt, Haemophilus influenzae Rd
auuuagccaguaa

SEQ ID NO: 2686990 - RNA, 20 nt, Haemophilus influenzae Rd
auuuagccaguaauuuuaca

SEQ ID NO: 2686991 - RNA, 19 nt, Haemophilus influenzae Rd
auuuagccccuuuugcugu

SEQ ID NO: 2686992 - RNA, 21 nt, Haemophilus influenzae Rd
auuuagcccgaaaauuaagaa

SEQ ID NO: 2686993 - RNA, 23 nt, Haemophilus influenzae Rd
auuuagcccgaaaauuaagaaaa

SEQ ID NO: 2686994 - RNA, 18 nt, Haemophilus influenzae Rd
auuuagccgcaccuugag

SEQ ID NO: 2686995 - RNA, 23 nt, Haemophilus influenzae Rd
auuuagccgcaccuugagaaaua

SEQ ID NO: 2686996 - RNA, 18 nt, Haemophilus influenzae Rd
auuucauccuaaaaaaau

SEQ ID NO: 2686997 - RNA, 18 nt, Haemophilus influenzae Rd
auuucaucgcgcaaaaua

SEQ ID NO: 2686998 - RNA, 18 nt, Haemophilus influenzae Rd
auuucaucgcguuuuuuc

SEQ ID NO: 2686999 - RNA, 17 nt, Haemophilus influenzae Rd
auuucaucuacaccaaa

SEQ ID NO: 2687000 - RNA, 16 nt, Haemophilus influenzae Rd
auuucaucuucaguac

SEQ ID NO: 2687001 - RNA, 16 nt, Haemophilus influenzae Rd
auuucaucuuuuaaau

SEQ ID NO: 2687002 - RNA, 17 nt, Haemophilus influenzae Rd
auuucaucuuuuaaaua

SEQ ID NO: 2687003 - RNA, 16 nt, Haemophilus influenzae Rd
auuucauucaaaaaua

SEQ ID NO: 2687004 - RNA, 19 nt, Haemophilus influenzae Rd
auuucauucaacaauucau

SEQ ID NO: 2687005 - RNA, 13 nt, Haemophilus influenzae Rd
auuucauuguuaa

SEQ ID NO: 2687006 - RNA, 20 nt, Haemophilus influenzae Rd
auuucauuguuaaauaaauc

SEQ ID NO: 2687007 - RNA, 21 nt, Haemophilus influenzae Rd
auuucauuugcgccaauaaua

SEQ ID NO: 2687008 - RNA, 15 nt, Haemophilus influenzae Rd
auuuccacuuuuuca

SEQ ID NO: 2687009 - RNA, 15 nt, Haemophilus influenzae Rd
auuucccucaaaauu

SEQ ID NO: 2687010 - RNA, 19 nt, Haemophilus influenzae Rd
auuuccuauuuacguaaaa

SEQ ID NO: 2687011 - RNA, 19 nt, Haemophilus influenzae Rd
auuuccuccccacacuuug

SEQ ID NO: 2687012 - RNA, 16 nt, Haemophilus influenzae Rd
auuuccucuaaauaaa

SEQ ID NO: 2687013 - RNA, 17 nt, Haemophilus influenzae Rd
auuuccugagaauuuuc

SEQ ID NO: 2687014 - RNA, 18 nt, Haemophilus influenzae Rd
auuuccugugcauuggcu

SEQ ID NO: 2687015 - RNA, 17 nt, Haemophilus influenzae Rd
auuuccuuugcugccau

SEQ ID NO: 2687016 - RNA, 17 nt, Haemophilus influenzae Rd
auuucgacauauucuac

SEQ ID NO: 2687017 - RNA, 16 nt, Haemophilus influenzae Rd
auuucgccauuuuuuc

SEQ ID NO: 2687018 - RNA, 19 nt, Haemophilus influenzae Rd
auuucgcggacuuuuuuau

SEQ ID NO: 2687019 - RNA, 18 nt, Haemophilus influenzae Rd
auuucgcuauuguuaaaa

SEQ ID NO: 2687020 - RNA, 20 nt, Haemophilus influenzae Rd
auuucgcucaauaauuuuca

SEQ ID NO: 2687021 - RNA, 15 nt, Haemophilus influenzae Rd
auuucgcugcgaugu

SEQ ID NO: 2687022 - RNA, 18 nt, Haemophilus influenzae Rd
auuucggcaguacucgaa

SEQ ID NO: 2687023 - RNA, 12 nt, Haemophilus influenzae Rd
auuucgguuuca

SEQ ID NO: 2687024 - RNA, 19 nt, Haemophilus influenzae Rd
auuucguccaguuauaaua

SEQ ID NO: 2687025 - RNA, 14 nt, Haemophilus influenzae Rd
auuucgugcaauaa

SEQ ID NO: 2687026 - RNA, 23 nt, Haemophilus influenzae Rd
auuucgugcaauaacaagcacaa

SEQ ID NO: 2687027 - RNA, 16 nt, Haemophilus influenzae Rd
auuucguuguuuuaau

SEQ ID NO: 2687028 - RNA, 17 nt, Haemophilus influenzae Rd
auuucguuguuuuaaua

SEQ ID NO: 2687029 - RNA, 19 nt, Haemophilus influenzae Rd
auuucguuuaauggacgga

SEQ ID NO: 2687030 - RNA, 22 nt, Haemophilus influenzae Rd
auuucuaaaauaauaucacaac

SEQ ID NO: 2687031 - RNA, 13 nt, Haemophilus influenzae Rd
auuucuaaauaaa

SEQ ID NO: 2687032 - RNA, 14 nt, Haemophilus influenzae Rd
auuucuaaucauuu

SEQ ID NO: 2687033 - RNA, 22 nt, Haemophilus influenzae Rd
auuucuaaucauuuguuuuccg

SEQ ID NO: 2687034 - RNA, 18 nt, Haemophilus influenzae Rd
auuucuaaugcaauuuca

SEQ ID NO: 2687035 - RNA, 19 nt, Haemophilus influenzae Rd
auuucuacuugacgguuuu

SEQ ID NO: 2687036 - RNA, 19 nt, Haemophilus influenzae Rd
auuucuaggcuauauuuuu

SEQ ID NO: 2687037 - RNA, 14 nt, Haemophilus influenzae Rd
auuucuauagauuu

SEQ ID NO: 2687038 - RNA, 14 nt, Haemophilus influenzae Rd
auuucuauccauuu

SEQ ID NO: 2687039 - RNA, 16 nt, Haemophilus influenzae Rd
auuucuauccauuucu

SEQ ID NO: 2687040 - RNA, 17 nt, Haemophilus influenzae Rd
auuucuaucgcauuuua

SEQ ID NO: 2687041 - RNA, 18 nt, Haemophilus influenzae Rd
auuucuaucgcauuuuac

SEQ ID NO: 2687042 - RNA, 19 nt, Haemophilus influenzae Rd
auuucuaucgcauuuuaca

SEQ ID NO: 2687043 - RNA, 18 nt, Haemophilus influenzae Rd
auuucuauguuauuaaaa

SEQ ID NO: 2687044 - RNA, 22 nt, Haemophilus influenzae Rd
auuucuauguuauuaaaauuaa

SEQ ID NO: 2687045 - RNA, 14 nt, Haemophilus influenzae Rd
auuucuauuguuuu

SEQ ID NO: 2687046 - RNA, 15 nt, Haemophilus influenzae Rd
auuucuauuguuuuu

SEQ ID NO: 2687047 - RNA, 18 nt, Haemophilus influenzae Rd
auuucucaccaaauuguu

SEQ ID NO: 2687048 - RNA, 19 nt, Haemophilus influenzae Rd
auuucucauuuaaccguaa

SEQ ID NO: 2687049 - RNA, 22 nt, Haemophilus influenzae Rd
auuucucugacguaauuguucc

SEQ ID NO: 2687050 - RNA, 16 nt, Haemophilus influenzae Rd
auuucucugauucgug

SEQ ID NO: 2687051 - RNA, 18 nt, Haemophilus influenzae Rd
auuucucuggcucgcucu

SEQ ID NO: 2687052 - RNA, 15 nt, Haemophilus influenzae Rd
auuucugaacacaag

SEQ ID NO: 2687053 - RNA, 16 nt, Haemophilus influenzae Rd
auuucugcaaauaaag

SEQ ID NO: 2687054 - RNA, 21 nt, Haemophilus influenzae Rd
auuucugcagcaaacgaacca

SEQ ID NO: 2687055 - RNA, 15 nt, Haemophilus influenzae Rd
auuucugcauuuaau

SEQ ID NO: 2687056 - RNA, 22 nt, Haemophilus influenzae Rd
auuucugccucuguauuuuuca

SEQ ID NO: 2687057 - RNA, 17 nt, Haemophilus influenzae Rd
auuucuguauuaucuaa

SEQ ID NO: 2687058 - RNA, 15 nt, Haemophilus influenzae Rd
auuucuguauuuuuu

SEQ ID NO: 2687059 - RNA, 16 nt, Haemophilus influenzae Rd
auuucuguauuuuuua

SEQ ID NO: 2687060 - RNA, 17 nt, Haemophilus influenzae Rd
auuucuguauuuuuuau

SEQ ID NO: 2687061 - RNA, 22 nt, Haemophilus influenzae Rd
auuucuguauuuuuuauuuaau

SEQ ID NO: 2687062 - RNA, 16 nt, Haemophilus influenzae Rd
auuucuguuacuaaau

SEQ ID NO: 2687063 - RNA, 15 nt, Haemophilus influenzae Rd
auuucuguugaaauc

SEQ ID NO: 2687064 - RNA, 13 nt, Haemophilus influenzae Rd
auuucuguuugau

SEQ ID NO: 2687065 - RNA, 17 nt, Haemophilus influenzae Rd
auuucuuaaaagaaauu

SEQ ID NO: 2687066 - RNA, 12 nt, Haemophilus influenzae Rd
auuucuucaaag

SEQ ID NO: 2687067 - RNA, 11 nt, Haemophilus influenzae Rd
auuucuucacu

SEQ ID NO: 2687068 - RNA, 17 nt, Haemophilus influenzae Rd
auuucuucuacaccuuc

SEQ ID NO: 2687069 - RNA, 17 nt, Haemophilus influenzae Rd
auuucuugaccuuucaa

SEQ ID NO: 2687070 - RNA, 23 nt, Haemophilus influenzae Rd
auuucuugaccuuucaauaauuu

SEQ ID NO: 2687071 - RNA, 19 nt, Haemophilus influenzae Rd
auuucuugccgaaaauuua

SEQ ID NO: 2687072 - RNA, 20 nt, Haemophilus influenzae Rd
auuucuugccgaaaauuuac

SEQ ID NO: 2687073 - RNA, 19 nt, Haemophilus influenzae Rd
auuucuuguuuaaauucag

SEQ ID NO: 2687074 - RNA, 15 nt, Haemophilus influenzae Rd
auuucuuuaaauggc

SEQ ID NO: 2687075 - RNA, 21 nt, Haemophilus influenzae Rd
auuucuuucguucaacccauu

SEQ ID NO: 2687076 - RNA, 19 nt, Haemophilus influenzae Rd
auuucuuugaguaaaaaau

SEQ ID NO: 2687077 - RNA, 14 nt, Haemophilus influenzae Rd
auuucuuuugcaag

SEQ ID NO: 2687078 - RNA, 16 nt, Haemophilus influenzae Rd
auuucuuuuguuuuaa

SEQ ID NO: 2687079 - RNA, 19 nt, Haemophilus influenzae Rd
auuucuuuuuuaucaaaaa

SEQ ID NO: 2687080 - RNA, 18 nt, Haemophilus influenzae Rd
auuugaaaagaauuucau

SEQ ID NO: 2687081 - RNA, 12 nt, Haemophilus influenzae Rd
auuugaaaaucu

SEQ ID NO: 2687082 - RNA, 16 nt, Haemophilus influenzae Rd
auuugaaaaucucuau

SEQ ID NO: 2687083 - RNA, 14 nt, Haemophilus influenzae Rd
auuugaacaaacgc

SEQ ID NO: 2687084 - RNA, 17 nt, Haemophilus influenzae Rd
auuugaaccuucacaga

SEQ ID NO: 2687085 - RNA, 19 nt, Haemophilus influenzae Rd
auuugaagaauuuguuguu

SEQ ID NO: 2687086 - RNA, 15 nt, Haemophilus influenzae Rd
auuugaagauuaaau

SEQ ID NO: 2687087 - RNA, 18 nt, Haemophilus influenzae Rd
auuugaagauuaaaugua

SEQ ID NO: 2687088 - RNA, 15 nt, Haemophilus influenzae Rd
auuugaauuaccaca

SEQ ID NO: 2687089 - RNA, 18 nt, Haemophilus influenzae Rd
auuugaauuuuacuucuu

SEQ ID NO: 2687090 - RNA, 17 nt, Haemophilus influenzae Rd
auuugaccuucauaaac

SEQ ID NO: 2687091 - RNA, 15 nt, Haemophilus influenzae Rd
auuugacgaaauaaa

SEQ ID NO: 2687092 - RNA, 23 nt, Haemophilus influenzae Rd
auuugacgauaauauuuuugcca

SEQ ID NO: 2687093 - RNA, 22 nt, Haemophilus influenzae Rd
auuugacgcgcacauacuucuu

SEQ ID NO: 2687094 - RNA, 15 nt, Haemophilus influenzae Rd
auuugacuuaaauga

SEQ ID NO: 2687095 - RNA, 15 nt, Haemophilus influenzae Rd
auuugacuuauucca

SEQ ID NO: 2687096 - RNA, 17 nt, Haemophilus influenzae Rd
auuugagaaaaauguua

SEQ ID NO: 2687097 - RNA, 13 nt, Haemophilus influenzae Rd
auuugagauuuua

SEQ ID NO: 2687098 - RNA, 17 nt, Haemophilus influenzae Rd
auuugagcaagaugaau

SEQ ID NO: 2687099 - RNA, 13 nt, Haemophilus influenzae Rd
auuugagcauuua

SEQ ID NO: 2687100 - RNA, 13 nt, Haemophilus influenzae Rd
auuugagucucaa

SEQ ID NO: 2687101 - RNA, 23 nt, Haemophilus influenzae Rd
auuugagucucaaauuuuucaca

SEQ ID NO: 2687102 - RNA, 17 nt, Haemophilus influenzae Rd
auuuuagcuaauggcug

SEQ ID NO: 2687103 - RNA, 20 nt, Haemophilus influenzae Rd
auuuuaggugcuuuuaaauu

SEQ ID NO: 2687104 - RNA, 14 nt, Haemophilus influenzae Rd
auuuuaguauuuuu

SEQ ID NO: 2687105 - RNA, 23 nt, Haemophilus influenzae Rd
auuuuaguuagauaagccauuaa

SEQ ID NO: 2687106 - RNA, 18 nt, Haemophilus influenzae Rd
auuuuauaaacaucuucu

SEQ ID NO: 2687107 - RNA, 18 nt, Haemophilus influenzae Rd
auuuuauaaucuuuaaaa

SEQ ID NO: 2687108 - RNA, 16 nt, Haemophilus influenzae Rd
auuuuauagcuuuagu

SEQ ID NO: 2687109 - RNA, 12 nt, Haemophilus influenzae Rd
auuuuauauauu

SEQ ID NO: 2687110 - RNA, 18 nt, Haemophilus influenzae Rd
auuuuaucacaaguuaaa

SEQ ID NO: 2687111 - RNA, 13 nt, Haemophilus influenzae Rd
auuuuauccaacc

SEQ ID NO: 2687112 - RNA, 14 nt, Haemophilus influenzae Rd
auuuuaucuaauca

SEQ ID NO: 2687113 - RNA, 21 nt, Haemophilus influenzae Rd
auuuuaucuugcugcuuugag

SEQ ID NO: 2687114 - RNA, 13 nt, Haemophilus influenzae Rd
auuuuaugaaauc

SEQ ID NO: 2687115 - RNA, 15 nt, Haemophilus influenzae Rd
auuuuauuccaccac

SEQ ID NO: 2687116 - RNA, 16 nt, Haemophilus influenzae Rd
auuuuauucugcaccu

SEQ ID NO: 2687117 - RNA, 16 nt, Haemophilus influenzae Rd
auuuuauugaagagua

SEQ ID NO: 2687118 - RNA, 19 nt, Haemophilus influenzae Rd
auuuuauuugccuugugac

SEQ ID NO: 2687119 - RNA, 19 nt, Haemophilus influenzae Rd
auuuucaaagcguuuuaaa

SEQ ID NO: 2687120 - RNA, 18 nt, Haemophilus influenzae Rd
auuuucaaauugaaaaga

SEQ ID NO: 2687121 - RNA, 21 nt, Haemophilus influenzae Rd
auuuucaaauuguccuuugcc

SEQ ID NO: 2687122 - RNA, 12 nt, Haemophilus influenzae Rd
auuuucaacaaa

SEQ ID NO: 2687123 - RNA, 23 nt, Haemophilus influenzae Rd
auuuucaacaaacggucgaguuu

SEQ ID NO: 2687124 - RNA, 11 nt, Haemophilus influenzae Rd
auuuucaagcc

SEQ ID NO: 2687125 - RNA, 18 nt, Haemophilus influenzae Rd
auuuucaaguaacuuuca

SEQ ID NO: 2687126 - RNA, 12 nt, Haemophilus influenzae Rd
auuuucaauauc

SEQ ID NO: 2687127 - RNA, 16 nt, Haemophilus influenzae Rd
auuuucaaucccuucu

SEQ ID NO: 2687128 - RNA, 18 nt, Haemophilus influenzae Rd
auuuucaauggcaucaau

SEQ ID NO: 2687129 - RNA, 19 nt, Haemophilus influenzae Rd
auuuucaauggcaucaaua

SEQ ID NO: 2687130 - RNA, 21 nt, Haemophilus influenzae Rd
auuuucaaugguuuauaacaa

SEQ ID NO: 2687131 - RNA, 18 nt, Haemophilus influenzae Rd
auuuucaccguuuuuccu

SEQ ID NO: 2687132 - RNA, 21 nt, Haemophilus influenzae Rd
auuuucaccguuuuuccuuug

SEQ ID NO: 2687133 - RNA, 19 nt, Haemophilus influenzae Rd
auuuucaccugaagaauac

SEQ ID NO: 2687134 - RNA, 17 nt, Haemophilus influenzae Rd
auuuucagcguuuucaa

SEQ ID NO: 2687135 - RNA, 20 nt, Haemophilus influenzae Rd
auuuucaggugcuauuuuau

SEQ ID NO: 2687136 - RNA, 19 nt, Haemophilus influenzae Rd
auuuucauaaccaaauaga

SEQ ID NO: 2687137 - RNA, 22 nt, Haemophilus influenzae Rd
auuuucauaaccaaauagauga

SEQ ID NO: 2687138 - RNA, 12 nt, Haemophilus influenzae Rd
auuuucaucaau

SEQ ID NO: 2687139 - RNA, 16 nt, Haemophilus influenzae Rd
auuuuccaaaauuucu

SEQ ID NO: 2687140 - RNA, 12 nt, Haemophilus influenzae Rd
auuuuccacauu

SEQ ID NO: 2687141 - RNA, 15 nt, Haemophilus influenzae Rd
auuuuccacauuuug

SEQ ID NO: 2687142 - RNA, 19 nt, Haemophilus influenzae Rd
auuuuccaccgcacuuucc

SEQ ID NO: 2687143 - RNA, 16 nt, Haemophilus influenzae Rd
auuuuccaucaccuuc

SEQ ID NO: 2687144 - RNA, 13 nt, Haemophilus influenzae Rd
auuuuccaucauc

SEQ ID NO: 2687145 - RNA, 16 nt, Haemophilus influenzae Rd
auuuuccaucaucuua

SEQ ID NO: 2687146 - RNA, 10 nt, Haemophilus influenzae Rd
auuuucccau

SEQ ID NO: 2687147 - RNA, 13 nt, Haemophilus influenzae Rd
auuuucccauuua

SEQ ID NO: 2687148 - RNA, 17 nt, Haemophilus influenzae Rd
auuuuccgaaaaaacaa

SEQ ID NO: 2687149 - RNA, 18 nt, Haemophilus influenzae Rd
auuuuccgaaaaaacaag

SEQ ID NO: 2687150 - RNA, 21 nt, Haemophilus influenzae Rd
auuuuccgugccacgaauaag

SEQ ID NO: 2687151 - RNA, 17 nt, Haemophilus influenzae Rd
auuuuccucgacauaaa

SEQ ID NO: 2687152 - RNA, 18 nt, Haemophilus influenzae Rd
auuuuccucgacauaaaa

SEQ ID NO: 2687153 - RNA, 17 nt, Haemophilus influenzae Rd
auuuuccucuuuuaugu

SEQ ID NO: 2687154 - RNA, 19 nt, Haemophilus influenzae Rd
auuuuccucuuuuauguuu

SEQ ID NO: 2687155 - RNA, 12 nt, Haemophilus influenzae Rd
auuuuccuucua

SEQ ID NO: 2687156 - RNA, 21 nt, Haemophilus influenzae Rd
auuuuccuucuauaucagaaa

SEQ ID NO: 2687157 - RNA, 18 nt, Haemophilus influenzae Rd
auuuuccuucugccauaa

SEQ ID NO: 2687158 - RNA, 23 nt, Haemophilus influenzae Rd
auuuucgacuugugcaagaaauu

SEQ ID NO: 2687159 - RNA, 15 nt, Haemophilus influenzae Rd
auuuucgcaucaauc

SEQ ID NO: 2687160 - RNA, 16 nt, Haemophilus influenzae Rd
auuuucgcaucaauca

SEQ ID NO: 2687161 - RNA, 21 nt, Haemophilus influenzae Rd
auuuucgcaucaaucacagca

SEQ ID NO: 2687162 - RNA, 23 nt, Haemophilus influenzae Rd
auuuucuaaaaaacguauuauac

SEQ ID NO: 2687163 - RNA, 23 nt, Haemophilus influenzae Rd
auuuucuaaggcuuguuguucaa

SEQ ID NO: 2687164 - RNA, 11 nt, Haemophilus influenzae Rd
auuuucuaagu

SEQ ID NO: 2687165 - RNA, 13 nt, Haemophilus influenzae Rd
auuuucuaaugaa

SEQ ID NO: 2687166 - RNA, 15 nt, Haemophilus influenzae Rd
auuuucuaaugaaau

SEQ ID NO: 2687167 - RNA, 17 nt, Haemophilus influenzae Rd
auuuucucaucauuauu

SEQ ID NO: 2687168 - RNA, 19 nt, Haemophilus influenzae Rd
auuuucucaucauuauuuu

SEQ ID NO: 2687169 - RNA, 17 nt, Haemophilus influenzae Rd
auuuucugcauccaaac

SEQ ID NO: 2687170 - RNA, 19 nt, Haemophilus influenzae Rd
auuuucugcucuucaucaa

SEQ ID NO: 2687171 - RNA, 20 nt, Haemophilus influenzae Rd
auuuucugcucuucaucaaa

SEQ ID NO: 2687172 - RNA, 21 nt, Haemophilus influenzae Rd
auuuucugcucuucaucaaaa

SEQ ID NO: 2687173 - RNA, 20 nt, Haemophilus influenzae Rd
auuuucugugagucuugcuu

SEQ ID NO: 2687174 - RNA, 16 nt, Haemophilus influenzae Rd
auuuucuuaauuuuau

SEQ ID NO: 2687175 - RNA, 11 nt, Haemophilus influenzae Rd
auuuucuuauc

SEQ ID NO: 2687176 - RNA, 19 nt, Haemophilus influenzae Rd
auuuucuuauuauacauuu

SEQ ID NO: 2687177 - RNA, 18 nt, Haemophilus influenzae Rd
auuuucuuauugaagaaa

SEQ ID NO: 2687178 - RNA, 15 nt, Haemophilus influenzae Rd
auuuucuuguucucc

SEQ ID NO: 2687179 - RNA, 22 nt, Haemophilus influenzae Rd
auuuucuuuuauccgaguuaaa

SEQ ID NO: 2687180 - RNA, 23 nt, Haemophilus influenzae Rd
auuuucuuuuucaagaacagaaa

SEQ ID NO: 2687181 - RNA, 19 nt, Haemophilus influenzae Rd
auuuugaacaaugucagaa

SEQ ID NO: 2687182 - RNA, 16 nt, Haemophilus influenzae Rd
auuuugaauaauaaau

SEQ ID NO: 2687183 - RNA, 22 nt, Haemophilus influenzae Rd
auuuugaaugguuguucuggug

SEQ ID NO: 2687184 - RNA, 16 nt, Haemophilus influenzae Rd
auuuugacaauuugau

SEQ ID NO: 2687185 - RNA, 12 nt, Haemophilus influenzae Rd
auuuugacuuuu

SEQ ID NO: 2687186 - RNA, 15 nt, Haemophilus influenzae Rd
auuuugacuuuugcc

SEQ ID NO: 2687187 - RNA, 19 nt, Haemophilus influenzae Rd
auuuugagauaaauuuuua

SEQ ID NO: 2687188 - RNA, 20 nt, Haemophilus influenzae Rd
auuuugagauaaauuuuuag

SEQ ID NO: 2687189 - RNA, 18 nt, Haemophilus influenzae Rd
auuuugagcuuauuuuua

SEQ ID NO: 2687190 - RNA, 17 nt, Haemophilus influenzae Rd
auuuugaggaauaaauu

SEQ ID NO: 2687191 - RNA, 14 nt, Haemophilus influenzae Rd
auuuugaucuuccg

SEQ ID NO: 2687192 - RNA, 10 nt, Haemophilus influenzae Rd
auuuugauug

SEQ ID NO: 2687193 - RNA, 20 nt, Haemophilus influenzae Rd
auuuugauugcuacagcaaa

SEQ ID NO: 2687194 - RNA, 17 nt, Haemophilus influenzae Rd
auuuugcaacuguuuau

SEQ ID NO: 2687195 - RNA, 13 nt, Haemophilus influenzae Rd
auuuugcagaaua

SEQ ID NO: 2687196 - RNA, 17 nt, Haemophilus influenzae Rd
auuuugcaugauauuuu

SEQ ID NO: 2687197 - RNA, 22 nt, Haemophilus influenzae Rd
auuuugcaugauauuuuacguu

SEQ ID NO: 2687198 - RNA, 20 nt, Haemophilus influenzae Rd
auuuugcauguuauucuccu

SEQ ID NO: 2687199 - RNA, 13 nt, Haemophilus influenzae Rd
auuuugccaauua

SEQ ID NO: 2687200 - RNA, 16 nt, Haemophilus influenzae Rd
auuuugccagauuuuu

SEQ ID NO: 2687201 - RNA, 18 nt, Haemophilus influenzae Rd
auuuugccagauuuuuag

SEQ ID NO: 2687202 - RNA, 17 nt, Haemophilus influenzae Rd
auuuugccguucaaaac

SEQ ID NO: 2687203 - RNA, 21 nt, Haemophilus influenzae Rd
auuuugcguguguuaucacaa

SEQ ID NO: 2687204 - RNA, 22 nt, Haemophilus influenzae Rd
auuuugcguguguuaucacaau

SEQ ID NO: 2687205 - RNA, 19 nt, Haemophilus influenzae Rd
auuuugcuuuaaaucaaau

SEQ ID NO: 2687206 - RNA, 20 nt, Haemophilus influenzae Rd
auuuugcuuuaaaucaaaua

SEQ ID NO: 2687207 - RNA, 18 nt, Haemophilus influenzae Rd
auuuuuucgguuuuuccg

SEQ ID NO: 2687208 - RNA, 23 nt, Haemophilus influenzae Rd
auuuuuucucucgccaauagguu

SEQ ID NO: 2687209 - RNA, 15 nt, Haemophilus influenzae Rd
auuuuuucugaauaa

SEQ ID NO: 2687210 - RNA, 17 nt, Haemophilus influenzae Rd
auuuuuucugaauaaau

SEQ ID NO: 2687211 - RNA, 13 nt, Haemophilus influenzae Rd
auuuuuucugcaa

SEQ ID NO: 2687212 - RNA, 11 nt, Haemophilus influenzae Rd
auuuuuucuuc

SEQ ID NO: 2687213 - RNA, 18 nt, Haemophilus influenzae Rd
auuuuuugaauaaauauu

SEQ ID NO: 2687214 - RNA, 18 nt, Haemophilus influenzae Rd
auuuuuuggaauauuauc

SEQ ID NO: 2687215 - RNA, 16 nt, Haemophilus influenzae Rd
auuuuuuguucauuuu

SEQ ID NO: 2687216 - RNA, 19 nt, Haemophilus influenzae Rd
auuuuuuguucauuuuaaa

SEQ ID NO: 2687217 - RNA, 14 nt, Haemophilus influenzae Rd
auuuuuuguuugag

SEQ ID NO: 2687218 - RNA, 15 nt, Haemophilus influenzae Rd
auuuuuuuagagcuu

SEQ ID NO: 2687219 - RNA, 22 nt, Haemophilus influenzae Rd
auuuuuuuaggaugaaauuuga

SEQ ID NO: 2687220 - RNA, 12 nt, Haemophilus influenzae Rd
auuuuuuuauga

SEQ ID NO: 2687221 - RNA, 15 nt, Haemophilus influenzae Rd
auuuuuuuaugauua

SEQ ID NO: 2687222 - RNA, 14 nt, Haemophilus influenzae Rd
auuuuuuucaauga

SEQ ID NO: 2687223 - RNA, 15 nt, Haemophilus influenzae Rd
auuuuuuucaaugaa

SEQ ID NO: 2687224 - RNA, 19 nt, Haemophilus influenzae Rd
auuuuuuucaaugaaauau

SEQ ID NO: 2687225 - RNA, 20 nt, Haemophilus influenzae Rd
auuuuuuucaaugaaauauu

SEQ ID NO: 2687226 - RNA, 12 nt, Haemophilus influenzae Rd
auuuuuuucuau

SEQ ID NO: 2687227 - RNA, 18 nt, Haemophilus influenzae Rd
auuuuuuucuauuuaaag

SEQ ID NO: 2687228 - RNA, 18 nt, Haemophilus influenzae Rd
auuuuuuugcuuuucccu

SEQ ID NO: 2687229 - RNA, 18 nt, Haemophilus influenzae Rd
auuuuuuuuauaucuucu

SEQ ID NO: 2687230 - RNA, 15 nt, Haemophilus influenzae Rd
caaaaaacaccuaaa

SEQ ID NO: 2687231 - RNA, 19 nt, Haemophilus influenzae Rd
caaaaaacggacuaucaua

SEQ ID NO: 2687232 - RNA, 22 nt, Haemophilus influenzae Rd
caaaaaacuuugguuuguuaaa

SEQ ID NO: 2687233 - RNA, 23 nt, Haemophilus influenzae Rd
caaaaaagcccaaguaauacacc

SEQ ID NO: 2687234 - RNA, 21 nt, Haemophilus influenzae Rd
caaaaaagugcgguaaaaauu

SEQ ID NO: 2687235 - RNA, 21 nt, Haemophilus influenzae Rd
caaaaaagugcgguuaaaauu

SEQ ID NO: 2687236 - RNA, 12 nt, Haemophilus influenzae Rd
caaaaaauacau

SEQ ID NO: 2687237 - RNA, 15 nt, Haemophilus influenzae Rd
caaaaaccaaacugc

SEQ ID NO: 2687238 - RNA, 15 nt, Haemophilus influenzae Rd
caaaaacuaaauauu

SEQ ID NO: 2687239 - RNA, 15 nt, Haemophilus influenzae Rd
caaaaacuucucuua

SEQ ID NO: 2687240 - RNA, 22 nt, Haemophilus influenzae Rd
caaaaagaacggucaaaaugca

SEQ ID NO: 2687241 - RNA, 19 nt, Haemophilus influenzae Rd
caaaaagcaccuaaaaauu

SEQ ID NO: 2687242 - RNA, 21 nt, Haemophilus influenzae Rd
caaaaagcuuaauggcuugcu

SEQ ID NO: 2687243 - RNA, 20 nt, Haemophilus influenzae Rd
caaaaagugcgguuaaaauu

SEQ ID NO: 2687244 - RNA, 14 nt, Haemophilus influenzae Rd
caaaaauaaaaagu

SEQ ID NO: 2687245 - RNA, 15 nt, Haemophilus influenzae Rd
caaaaauacagccac

SEQ ID NO: 2687246 - RNA, 22 nt, Haemophilus influenzae Rd
caaaaauacagccacuauuacu

SEQ ID NO: 2687247 - RNA, 16 nt, Haemophilus influenzae Rd
caaaaauacguuguuu

SEQ ID NO: 2687248 - RNA, 17 nt, Haemophilus influenzae Rd
caaaaauagccuucauc

SEQ ID NO: 2687249 - RNA, 16 nt, Haemophilus influenzae Rd
caaaaauauaaacuga

SEQ ID NO: 2687250 - RNA, 14 nt, Haemophilus influenzae Rd
caaaaaucaaccau

SEQ ID NO: 2687251 - RNA, 19 nt, Haemophilus influenzae Rd
caaaaauccucaucugaac

SEQ ID NO: 2687252 - RNA, 22 nt, Haemophilus influenzae Rd
caaaaaugaaagggaaauaaca

SEQ ID NO: 2687253 - RNA, 18 nt, Haemophilus influenzae Rd
caaaaaugcucgcuggcu

SEQ ID NO: 2687254 - RNA, 12 nt, Haemophilus influenzae Rd
caaaaauuaaua

SEQ ID NO: 2687255 - RNA, 12 nt, Haemophilus influenzae Rd
caaaaauugcau

SEQ ID NO: 2687256 - RNA, 23 nt, Haemophilus influenzae Rd
caaaaauuucagaauuaguaaag

SEQ ID NO: 2687257 - RNA, 17 nt, Haemophilus influenzae Rd
caaaaauuugaauguaa

SEQ ID NO: 2687258 - RNA, 13 nt, Haemophilus influenzae Rd
caaaacaaccaag

SEQ ID NO: 2687259 - RNA, 14 nt, Haemophilus influenzae Rd
caaaacaauggcug

SEQ ID NO: 2687260 - RNA, 23 nt, Haemophilus influenzae Rd
caaaacaauggcugaaaaauuca

SEQ ID NO: 2687261 - RNA, 20 nt, Haemophilus influenzae Rd
caaaacagacugaaauucug

SEQ ID NO: 2687262 - RNA, 22 nt, Haemophilus influenzae Rd
caaaacagggcgacaauuuauc

SEQ ID NO: 2687263 - RNA, 18 nt, Haemophilus influenzae Rd
caaaacaguaaugaaaga

SEQ ID NO: 2687264 - RNA, 22 nt, Haemophilus influenzae Rd
caaaacaguaaugaaagaaaca

SEQ ID NO: 2687265 - RNA, 21 nt, Haemophilus influenzae Rd
caaaacaguuuucaaauuaac

SEQ ID NO: 2687266 - RNA, 19 nt, Haemophilus influenzae Rd
caaaaccaaucauaaaauu

SEQ ID NO: 2687267 - RNA, 14 nt, Haemophilus influenzae Rd
caaaaccauucagu

SEQ ID NO: 2687268 - RNA, 18 nt, Haemophilus influenzae Rd
caaaaccuagaaauuuug

SEQ ID NO: 2687269 - RNA, 17 nt, Haemophilus influenzae Rd
caaaacgcacuucaaau

SEQ ID NO: 2687270 - RNA, 20 nt, Haemophilus influenzae Rd
caaaacgcacuucaaaugaa

SEQ ID NO: 2687271 - RNA, 15 nt, Haemophilus influenzae Rd
caaaacgugcugcag

SEQ ID NO: 2687272 - RNA, 19 nt, Haemophilus influenzae Rd
caaaacgugucacuuuacu

SEQ ID NO: 2687273 - RNA, 15 nt, Haemophilus influenzae Rd
caaaacguucuacuu

SEQ ID NO: 2687274 - RNA, 16 nt, Haemophilus influenzae Rd
caaaacuaucaaaauc

SEQ ID NO: 2687275 - RNA, 17 nt, Haemophilus influenzae Rd
caaaacuaucaaaauca

SEQ ID NO: 2687276 - RNA, 21 nt, Haemophilus influenzae Rd
caaaagaaaagaugaaugaac

SEQ ID NO: 2687277 - RNA, 13 nt, Haemophilus influenzae Rd
caaaagaaagacu

SEQ ID NO: 2687278 - RNA, 16 nt, Haemophilus influenzae Rd
caaaagaaauuaagca

SEQ ID NO: 2687279 - RNA, 17 nt, Haemophilus influenzae Rd
caaaagaauuaaaaaug

SEQ ID NO: 2687280 - RNA, 19 nt, Haemophilus influenzae Rd
caaaagaauuaaaaauggc

SEQ ID NO: 2687281 - RNA, 22 nt, Haemophilus influenzae Rd
caaaagagcgguugaaaauuua

SEQ ID NO: 2687282 - RNA, 23 nt, Haemophilus influenzae Rd
caaaagaucaggaucaaaaauau

SEQ ID NO: 2687283 - RNA, 15 nt, Haemophilus influenzae Rd
caaaagauccuucca

SEQ ID NO: 2687284 - RNA, 23 nt, Haemophilus influenzae Rd
caaaagcaaaugaggaaaauaaa

SEQ ID NO: 2687285 - RNA, 14 nt, Haemophilus influenzae Rd
caaaagcaauaaug

SEQ ID NO: 2687286 - RNA, 23 nt, Haemophilus influenzae Rd
caaaagcuggauuaaauaaccaa

SEQ ID NO: 2687287 - RNA, 16 nt, Haemophilus influenzae Rd
caaaaggcagcaagac

SEQ ID NO: 2687288 - RNA, 14 nt, Haemophilus influenzae Rd
caaaagguaaaaau

SEQ ID NO: 2687289 - RNA, 22 nt, Haemophilus influenzae Rd
caaaagguaaaaauucuuuuuu

SEQ ID NO: 2687290 - RNA, 14 nt, Haemophilus influenzae Rd
caaaaguaaauaau

SEQ ID NO: 2687291 - RNA, 14 nt, Haemophilus influenzae Rd
caaaaguauugagc

SEQ ID NO: 2687292 - RNA, 18 nt, Haemophilus influenzae Rd
caaaagugcgguaaaaau

SEQ ID NO: 2687293 - RNA, 19 nt, Haemophilus influenzae Rd
caaaagugcgguaaaaauu

SEQ ID NO: 2687294 - RNA, 20 nt, Haemophilus influenzae Rd
caaaagugcgguaaaaauua

SEQ ID NO: 2687295 - RNA, 22 nt, Haemophilus influenzae Rd
caaaaguuggacuaaacaacua

SEQ ID NO: 2687296 - RNA, 13 nt, Haemophilus influenzae Rd
caaaaguuggauu

SEQ ID NO: 2687297 - RNA, 14 nt, Haemophilus influenzae Rd
caaaauaaaaccau

SEQ ID NO: 2687298 - RNA, 14 nt, Haemophilus influenzae Rd
caaaauaaaugauu

SEQ ID NO: 2687299 - RNA, 15 nt, Haemophilus influenzae Rd
caaaauaaaugauua

SEQ ID NO: 2687300 - RNA, 22 nt, Haemophilus influenzae Rd
caaaauaauauccaaaauguuc

SEQ ID NO: 2687301 - RNA, 13 nt, Haemophilus influenzae Rd
caaaauacaauca

SEQ ID NO: 2687302 - RNA, 23 nt, Haemophilus influenzae Rd
caaaauacaaucacgaucugcaa

SEQ ID NO: 2687303 - RNA, 20 nt, Haemophilus influenzae Rd
caaaauagauguaaccuuuc

SEQ ID NO: 2687304 - RNA, 16 nt, Haemophilus influenzae Rd
caaaauaguaaaaauu

SEQ ID NO: 2687305 - RNA, 22 nt, Haemophilus influenzae Rd
caaaauaguaaaaauuguugau

SEQ ID NO: 2687306 - RNA, 22 nt, Haemophilus influenzae Rd
caaaauaucacuuuuuuauucu

SEQ ID NO: 2687307 - RNA, 20 nt, Haemophilus influenzae Rd
caaaauaugcaucagauuuu

SEQ ID NO: 2687308 - RNA, 23 nt, Haemophilus influenzae Rd
caaaauauuaguuagcuaaaaaa

SEQ ID NO: 2687309 - RNA, 22 nt, Haemophilus influenzae Rd
caaaauauucugaggauuuuau

SEQ ID NO: 2687310 - RNA, 21 nt, Haemophilus influenzae Rd
caaaauauuuucaaauaaguu

SEQ ID NO: 2687311 - RNA, 10 nt, Haemophilus influenzae Rd
caaaaucaau

SEQ ID NO: 2687312 - RNA, 15 nt, Haemophilus influenzae Rd
caaagguugaaugcg

SEQ ID NO: 2687313 - RNA, 15 nt, Haemophilus influenzae Rd
caaaguaacuuuaau

SEQ ID NO: 2687314 - RNA, 17 nt, Haemophilus influenzae Rd
caaaguaacuuuaauua

SEQ ID NO: 2687315 - RNA, 17 nt, Haemophilus influenzae Rd
caaagucaauacacauu

SEQ ID NO: 2687316 - RNA, 19 nt, Haemophilus influenzae Rd
caaagucgguuuuuaauuc

SEQ ID NO: 2687317 - RNA, 21 nt, Haemophilus influenzae Rd
caaagucgguuuuuaauucag

SEQ ID NO: 2687318 - RNA, 17 nt, Haemophilus influenzae Rd
caaagucuucaucuuua

SEQ ID NO: 2687319 - RNA, 19 nt, Haemophilus influenzae Rd
caaagugcgguaagaaaau

SEQ ID NO: 2687320 - RNA, 23 nt, Haemophilus influenzae Rd
caaagugcgguaagaaaaucaac

SEQ ID NO: 2687321 - RNA, 18 nt, Haemophilus influenzae Rd
caaagugcgguaaucuuu

SEQ ID NO: 2687322 - RNA, 22 nt, Haemophilus influenzae Rd
caaagugcgguuaguuuuuuau

SEQ ID NO: 2687323 - RNA, 17 nt, Haemophilus influenzae Rd
caaaguggagaaacauu

SEQ ID NO: 2687324 - RNA, 18 nt, Haemophilus influenzae Rd
caaaguuaccauuuauuc

SEQ ID NO: 2687325 - RNA, 17 nt, Haemophilus influenzae Rd
caaaguuccuagaauua

SEQ ID NO: 2687326 - RNA, 13 nt, Haemophilus influenzae Rd
caaauaaaauaga

SEQ ID NO: 2687327 - RNA, 17 nt, Haemophilus influenzae Rd
caaauaaaauagacaau

SEQ ID NO: 2687328 - RNA, 12 nt, Haemophilus influenzae Rd
caaauaaaauau

SEQ ID NO: 2687329 - RNA, 21 nt, Haemophilus influenzae Rd
caaauaaaauuacaaaaccaa

SEQ ID NO: 2687330 - RNA, 13 nt, Haemophilus influenzae Rd
caaauaaauuugg

SEQ ID NO: 2687331 - RNA, 23 nt, Haemophilus influenzae Rd
caaauaaccacuccaaauaauac

SEQ ID NO: 2687332 - RNA, 19 nt, Haemophilus influenzae Rd
caaauaaccuaucccaaaa

SEQ ID NO: 2687333 - RNA, 20 nt, Haemophilus influenzae Rd
caaauaacgcauaauuugcu

SEQ ID NO: 2687334 - RNA, 16 nt, Haemophilus influenzae Rd
caaauaacguuuuaag

SEQ ID NO: 2687335 - RNA, 20 nt, Haemophilus influenzae Rd
caaauaacugauaugccaag

SEQ ID NO: 2687336 - RNA, 15 nt, Haemophilus influenzae Rd
caaauaauccuagag

SEQ ID NO: 2687337 - RNA, 23 nt, Haemophilus influenzae Rd
caaauacaaguggcgguaaaaau

SEQ ID NO: 2687338 - RNA, 16 nt, Haemophilus influenzae Rd
caaauacaauuuuuuu

SEQ ID NO: 2687339 - RNA, 15 nt, Haemophilus influenzae Rd
caaauacacaaauca

SEQ ID NO: 2687340 - RNA, 21 nt, Haemophilus influenzae Rd
caaauacaccgucaucuugag

SEQ ID NO: 2687341 - RNA, 16 nt, Haemophilus influenzae Rd
caaauacagugacaaa

SEQ ID NO: 2687342 - RNA, 18 nt, Haemophilus influenzae Rd
caaauacauauuuuuaga

SEQ ID NO: 2687343 - RNA, 21 nt, Haemophilus influenzae Rd
caaauacauuuuguuucuaaa

SEQ ID NO: 2687344 - RNA, 13 nt, Haemophilus influenzae Rd
caaauauaaaaua

SEQ ID NO: 2687345 - RNA, 15 nt, Haemophilus influenzae Rd
caaauauaaaauaaa

SEQ ID NO: 2687346 - RNA, 19 nt, Haemophilus influenzae Rd
caaauauaaaauaaaauuc

SEQ ID NO: 2687347 - RNA, 21 nt, Haemophilus influenzae Rd
caaauauauuucuaauaaagu

SEQ ID NO: 2687348 - RNA, 19 nt, Haemophilus influenzae Rd
caaauaucaaaaaaauuua

SEQ ID NO: 2687349 - RNA, 21 nt, Haemophilus influenzae Rd
caaauaugaacuuguucguca

SEQ ID NO: 2687350 - RNA, 17 nt, Haemophilus influenzae Rd
caaauauuccacaucac

SEQ ID NO: 2687351 - RNA, 14 nt, Haemophilus influenzae Rd
caaaucaaaaagcu

SEQ ID NO: 2687352 - RNA, 14 nt, Haemophilus influenzae Rd
caaaucaaauuuuc

SEQ ID NO: 2687353 - RNA, 15 nt, Haemophilus influenzae Rd
caaaucaaauuuucc

SEQ ID NO: 2687354 - RNA, 16 nt, Haemophilus influenzae Rd
caaaucaaauuuuccu

SEQ ID NO: 2687355 - RNA, 18 nt, Haemophilus influenzae Rd
caaaucaaauuuuccuuc

SEQ ID NO: 2687356 - RNA, 17 nt, Haemophilus influenzae Rd
caaaucacacguucauu

SEQ ID NO: 2687357 - RNA, 21 nt, Haemophilus influenzae Rd
caaaucacacguucauuacgu

SEQ ID NO: 2687358 - RNA, 20 nt, Haemophilus influenzae Rd
caaauccauaaggaaauugc

SEQ ID NO: 2687359 - RNA, 14 nt, Haemophilus influenzae Rd
caaauccuacaaca

SEQ ID NO: 2687360 - RNA, 20 nt, Haemophilus influenzae Rd
caaauccuuguuuuucaaaa

SEQ ID NO: 2687361 - RNA, 18 nt, Haemophilus influenzae Rd
caaaucgagguuuuccac

SEQ ID NO: 2687362 - RNA, 17 nt, Haemophilus influenzae Rd
caaaucuaacguauuua

SEQ ID NO: 2687363 - RNA, 14 nt, Haemophilus influenzae Rd
caaaucuaaugccu

SEQ ID NO: 2687364 - RNA, 19 nt, Haemophilus influenzae Rd
caaaucuuucgcuugcugu

SEQ ID NO: 2687365 - RNA, 14 nt, Haemophilus influenzae Rd
caaaugaggaaaau

SEQ ID NO: 2687366 - RNA, 16 nt, Haemophilus influenzae Rd
caaaugaggaaaauaa

SEQ ID NO: 2687367 - RNA, 16 nt, Haemophilus influenzae Rd
caaaugaucauuuugg

SEQ ID NO: 2687368 - RNA, 17 nt, Haemophilus influenzae Rd
caaaugaugaaacaagc

SEQ ID NO: 2687369 - RNA, 15 nt, Haemophilus influenzae Rd
caaaugcaacaauaa

SEQ ID NO: 2687370 - RNA, 16 nt, Haemophilus influenzae Rd
caaaugggaaagcguu

SEQ ID NO: 2687371 - RNA, 13 nt, Haemophilus influenzae Rd
caaauuaaccgca

SEQ ID NO: 2687372 - RNA, 17 nt, Haemophilus influenzae Rd
caaauuaauaagaaaau

SEQ ID NO: 2687373 - RNA, 21 nt, Haemophilus influenzae Rd
caaauuaauaagaaaaucaaa

SEQ ID NO: 2687374 - RNA, 21 nt, Haemophilus influenzae Rd
caaauuaauuaaucaauaaga

SEQ ID NO: 2687375 - RNA, 16 nt, Haemophilus influenzae Rd
caaauuacccaaauga

SEQ ID NO: 2687376 - RNA, 18 nt, Haemophilus influenzae Rd
caaauuauucuacauaau

SEQ ID NO: 2687377 - RNA, 13 nt, Haemophilus influenzae Rd
caaauucaauugu

SEQ ID NO: 2687378 - RNA, 17 nt, Haemophilus influenzae Rd
caaauucauucuugcuu

SEQ ID NO: 2687379 - RNA, 21 nt, Haemophilus influenzae Rd
caaauuccaucaauuaaugga

SEQ ID NO: 2687380 - RNA, 12 nt, Haemophilus influenzae Rd
caaauuccauuc

SEQ ID NO: 2687381 - RNA, 13 nt, Haemophilus influenzae Rd
caaauuccauuca

SEQ ID NO: 2687382 - RNA, 18 nt, Haemophilus influenzae Rd
caaauuccgcaauauuua

SEQ ID NO: 2687383 - RNA, 16 nt, Haemophilus influenzae Rd
caaauucuaaaacaaa

SEQ ID NO: 2687384 - RNA, 13 nt, Haemophilus influenzae Rd
caaauucuacacc

SEQ ID NO: 2687385 - RNA, 16 nt, Haemophilus influenzae Rd
caaauucuacauggcg

SEQ ID NO: 2687386 - RNA, 14 nt, Haemophilus influenzae Rd
caaauugagaucuu

SEQ ID NO: 2687387 - RNA, 16 nt, Haemophilus influenzae Rd
caaauugaugcucugc

SEQ ID NO: 2687388 - RNA, 14 nt, Haemophilus influenzae Rd
caaauugcaaaaaa

SEQ ID NO: 2687389 - RNA, 15 nt, Haemophilus influenzae Rd
caaauugcaaaaaac

SEQ ID NO: 2687390 - RNA, 17 nt, Haemophilus influenzae Rd
caaauugcaaaaaacuu

SEQ ID NO: 2687391 - RNA, 13 nt, Haemophilus influenzae Rd
caaauugcuaaug

SEQ ID NO: 2687392 - RNA, 20 nt, Haemophilus influenzae Rd
caaauuggguucgcaaauaa

SEQ ID NO: 2687393 - RNA, 22 nt, Haemophilus influenzae Rd
caaauuggguucgcaaauaacg

SEQ ID NO: 2687394 - RNA, 24 nt, Haemophilus influenzae Rd
caaauugugucacauaaucaggcu

SEQ ID NO: 2687395 - RNA, 14 nt, Haemophilus influenzae Rd
caaauuuaaaaaag

SEQ ID NO: 2687396 - RNA, 13 nt, Haemophilus influenzae Rd
caaauuuaaauaa

SEQ ID NO: 2687397 - RNA, 20 nt, Haemophilus influenzae Rd
caaauuuauaauagacugaa

SEQ ID NO: 2687398 - RNA, 11 nt, Haemophilus influenzae Rd
caaauuuaucg

SEQ ID NO: 2687399 - RNA, 19 nt, Haemophilus influenzae Rd
caaauuucuccguuagcaa

SEQ ID NO: 2687400 - RNA, 14 nt, Haemophilus influenzae Rd
caaauuucuucacu

SEQ ID NO: 2687401 - RNA, 12 nt, Haemophilus influenzae Rd
caaauuucuugc

SEQ ID NO: 2687402 - RNA, 18 nt, Haemophilus influenzae Rd
caaauuugaucuuagaca

SEQ ID NO: 2687403 - RNA, 20 nt, Haemophilus influenzae Rd
caaauuuuauauauccaaau

SEQ ID NO: 2687404 - RNA, 19 nt, Haemophilus influenzae Rd
caaauuuuccgcauaaaua

SEQ ID NO: 2687405 - RNA, 14 nt, Haemophilus influenzae Rd
caaauuuucguuua

SEQ ID NO: 2687406 - RNA, 13 nt, Haemophilus influenzae Rd
caaauuuugcauu

SEQ ID NO: 2687407 - RNA, 20 nt, Haemophilus influenzae Rd
caaauuuuucuuuucuucua

SEQ ID NO: 2687408 - RNA, 21 nt, Haemophilus influenzae Rd
caaauuuuuguugauaaacau

SEQ ID NO: 2687409 - RNA, 15 nt, Haemophilus influenzae Rd
caacaaaaaacaccu

SEQ ID NO: 2687410 - RNA, 10 nt, Haemophilus influenzae Rd
caacaaaaau

SEQ ID NO: 2687411 - RNA, 12 nt, Haemophilus influenzae Rd
caacaaaagugc

SEQ ID NO: 2687412 - RNA, 15 nt, Haemophilus influenzae Rd
caacaaaagugcggu

SEQ ID NO: 2687413 - RNA, 20 nt, Haemophilus influenzae Rd
caacaaaauaaacacuccaa

SEQ ID NO: 2687414 - RNA, 18 nt, Haemophilus influenzae Rd
caacaaagucaauacaca

SEQ ID NO: 2687415 - RNA, 16 nt, Haemophilus influenzae Rd
caacaaagucuucauc

SEQ ID NO: 2687416 - RNA, 12 nt, Haemophilus influenzae Rd
caacaaauucua

SEQ ID NO: 2687417 - RNA, 14 nt, Haemophilus influenzae Rd
caacaaauuuaaau

SEQ ID NO: 2687418 - RNA, 18 nt, Haemophilus influenzae Rd
caagaucuaaaaacuuuu

SEQ ID NO: 2687419 - RNA, 19 nt, Haemophilus influenzae Rd
caagaugacgaaaugaaau

SEQ ID NO: 2687420 - RNA, 21 nt, Haemophilus influenzae Rd
caagaugguaauuuuggcgaa

SEQ ID NO: 2687421 - RNA, 17 nt, Haemophilus influenzae Rd
caagaugugauauuaaa

SEQ ID NO: 2687422 - RNA, 17 nt, Haemophilus influenzae Rd
caagauucuaaauauug

SEQ ID NO: 2687423 - RNA, 17 nt, Haemophilus influenzae Rd
caagauucugaaagaua

SEQ ID NO: 2687424 - RNA, 17 nt, Haemophilus influenzae Rd
caagauuugcugcugcu

SEQ ID NO: 2687425 - RNA, 14 nt, Haemophilus influenzae Rd
caagauuuuauaca

SEQ ID NO: 2687426 - RNA, 16 nt, Haemophilus influenzae Rd
caagcaagcaaaauua

SEQ ID NO: 2687427 - RNA, 13 nt, Haemophilus influenzae Rd
caagcaagccaca

SEQ ID NO: 2687428 - RNA, 21 nt, Haemophilus influenzae Rd
caagcacugaggcuaauaaua

SEQ ID NO: 2687429 - RNA, 18 nt, Haemophilus influenzae Rd
caagcacuuuauuuaauu

SEQ ID NO: 2687430 - RNA, 15 nt, Haemophilus influenzae Rd
caagcacuuuuccuu

SEQ ID NO: 2687431 - RNA, 16 nt, Haemophilus influenzae Rd
caagcacuuuuccuuu

SEQ ID NO: 2687432 - RNA, 13 nt, Haemophilus influenzae Rd
caagcauucucaa

SEQ ID NO: 2687433 - RNA, 13 nt, Haemophilus influenzae Rd
caagcauuuugaa

SEQ ID NO: 2687434 - RNA, 14 nt, Haemophilus influenzae Rd
caagcauuuuucau

SEQ ID NO: 2687435 - RNA, 18 nt, Haemophilus influenzae Rd
caagcauuuuucauacaa

SEQ ID NO: 2687436 - RNA, 15 nt, Haemophilus influenzae Rd
caagccaauuauuua

SEQ ID NO: 2687437 - RNA, 22 nt, Haemophilus influenzae Rd
caagccacgguuacgaauugca

SEQ ID NO: 2687438 - RNA, 14 nt, Haemophilus influenzae Rd
caagccauguugau

SEQ ID NO: 2687439 - RNA, 14 nt, Haemophilus influenzae Rd
caagccccugaagc

SEQ ID NO: 2687440 - RNA, 11 nt, Haemophilus influenzae Rd
caagccuuugg

SEQ ID NO: 2687441 - RNA, 14 nt, Haemophilus influenzae Rd
caagcgauuuuuau

SEQ ID NO: 2687442 - RNA, 16 nt, Haemophilus influenzae Rd
caagcguuaauccaag

SEQ ID NO: 2687443 - RNA, 20 nt, Haemophilus influenzae Rd
caagcuaauugguaaaauua

SEQ ID NO: 2687444 - RNA, 22 nt, Haemophilus influenzae Rd
caagcuuauguaaauuuaucug

SEQ ID NO: 2687445 - RNA, 19 nt, Haemophilus influenzae Rd
caagcuuguccaugaaaaa

SEQ ID NO: 2687446 - RNA, 19 nt, Haemophilus influenzae Rd
caagcuuuuucuuguucug

SEQ ID NO: 2687447 - RNA, 18 nt, Haemophilus influenzae Rd
caaggaaucgaaauuaaa

SEQ ID NO: 2687448 - RNA, 20 nt, Haemophilus influenzae Rd
caaggaaucgaaauuaaaau

SEQ ID NO: 2687449 - RNA, 22 nt, Haemophilus influenzae Rd
caaggaaucgaaauuaaaauaa

SEQ ID NO: 2687450 - RNA, 20 nt, Haemophilus influenzae Rd
caaggagcuaguuuaguuua

SEQ ID NO: 2687451 - RNA, 19 nt, Haemophilus influenzae Rd
caaggagcuuuauuauugg

SEQ ID NO: 2687452 - RNA, 17 nt, Haemophilus influenzae Rd
caaggccauauuuuccc

SEQ ID NO: 2687453 - RNA, 22 nt, Haemophilus influenzae Rd
caaggcucaucauuaugaaaaa

SEQ ID NO: 2687454 - RNA, 17 nt, Haemophilus influenzae Rd
caaggcucgcgauuaau

SEQ ID NO: 2687455 - RNA, 17 nt, Haemophilus influenzae Rd
caagggauuuaaaaucc

SEQ ID NO: 2687456 - RNA, 14 nt, Haemophilus influenzae Rd
caaggggaaaauau

SEQ ID NO: 2687457 - RNA, 15 nt, Haemophilus influenzae Rd
caaggguaucuaaau

SEQ ID NO: 2687458 - RNA, 21 nt, Haemophilus influenzae Rd
caagguagauugauacaggaa

SEQ ID NO: 2687459 - RNA, 17 nt, Haemophilus influenzae Rd
caaggucgugcucuacc

SEQ ID NO: 2687460 - RNA, 15 nt, Haemophilus influenzae Rd
caagguuauauaaca

SEQ ID NO: 2687461 - RNA, 13 nt, Haemophilus influenzae Rd
caaguaacuuuca

SEQ ID NO: 2687462 - RNA, 16 nt, Haemophilus influenzae Rd
caaguaacuuucacaa

SEQ ID NO: 2687463 - RNA, 20 nt, Haemophilus influenzae Rd
caaguaagucgugaucugca

SEQ ID NO: 2687464 - RNA, 12 nt, Haemophilus influenzae Rd
caaguaauuuaa

SEQ ID NO: 2687465 - RNA, 14 nt, Haemophilus influenzae Rd
caaguaauuuaaaa

SEQ ID NO: 2687466 - RNA, 17 nt, Haemophilus influenzae Rd
caaguaauuuaaaaagu

SEQ ID NO: 2687467 - RNA, 18 nt, Haemophilus influenzae Rd
caaguaauuuaaaaagua

SEQ ID NO: 2687468 - RNA, 14 nt, Haemophilus influenzae Rd
caaguaucuaccau

SEQ ID NO: 2687469 - RNA, 13 nt, Haemophilus influenzae Rd
caaguauuuuccu

SEQ ID NO: 2687470 - RNA, 20 nt, Haemophilus influenzae Rd
caaguauuuuccuucugcca

SEQ ID NO: 2687471 - RNA, 13 nt, Haemophilus influenzae Rd
caagucaaaaacc

SEQ ID NO: 2687472 - RNA, 22 nt, Haemophilus influenzae Rd
caaguccaaguuuuuuaucuuu

SEQ ID NO: 2687473 - RNA, 14 nt, Haemophilus influenzae Rd
caaguccccauuug

SEQ ID NO: 2687474 - RNA, 16 nt, Haemophilus influenzae Rd
caaguccccauuugua

SEQ ID NO: 2687475 - RNA, 19 nt, Haemophilus influenzae Rd
caaguccccauuuguagaa

SEQ ID NO: 2687476 - RNA, 20 nt, Haemophilus influenzae Rd
caaguccccauuuguagaaa

SEQ ID NO: 2687477 - RNA, 17 nt, Haemophilus influenzae Rd
caagucccuguucaaau

SEQ ID NO: 2687478 - RNA, 19 nt, Haemophilus influenzae Rd
caagucugcugaaauacaa

SEQ ID NO: 2687479 - RNA, 20 nt, Haemophilus influenzae Rd
caagucugcugaaauacaaa

SEQ ID NO: 2687480 - RNA, 23 nt, Haemophilus influenzae Rd
caagucugcugaaauacaaagca

SEQ ID NO: 2687481 - RNA, 19 nt, Haemophilus influenzae Rd
caagucuuaaucuuaucaa

SEQ ID NO: 2687482 - RNA, 23 nt, Haemophilus influenzae Rd
caagucuuuuuuuguugguugag

SEQ ID NO: 2687483 - RNA, 12 nt, Haemophilus influenzae Rd
caagugaaauuc

SEQ ID NO: 2687484 - RNA, 15 nt, Haemophilus influenzae Rd
caagugcaguuucag

SEQ ID NO: 2687485 - RNA, 21 nt, Haemophilus influenzae Rd
caagugcaugagcuuugcuuu

SEQ ID NO: 2687486 - RNA, 20 nt, Haemophilus influenzae Rd
caagugcgccaccuuuugua

SEQ ID NO: 2687487 - RNA, 23 nt, Haemophilus influenzae Rd
caagugcgccaccuuuuguagaa

SEQ ID NO: 2687488 - RNA, 21 nt, Haemophilus influenzae Rd
caagugcggucagcauaaaga

SEQ ID NO: 2687489 - RNA, 19 nt, Haemophilus influenzae Rd
caagugcgguugaaaaauu

SEQ ID NO: 2687490 - RNA, 23 nt, Haemophilus influenzae Rd
caagugcuagugguccugucagu

SEQ ID NO: 2687491 - RNA, 19 nt, Haemophilus influenzae Rd
caagugcugguagcaauaa

SEQ ID NO: 2687492 - RNA, 13 nt, Haemophilus influenzae Rd
caagugguaaaau

SEQ ID NO: 2687493 - RNA, 13 nt, Haemophilus influenzae Rd
caaguuaaaaaau

SEQ ID NO: 2687494 - RNA, 17 nt, Haemophilus influenzae Rd
caaguuaaaacuugauu

SEQ ID NO: 2687495 - RNA, 23 nt, Haemophilus influenzae Rd
caaguuaauccuaaauuaugcuc

SEQ ID NO: 2687496 - RNA, 17 nt, Haemophilus influenzae Rd
caaguucauauaaauaa

SEQ ID NO: 2687497 - RNA, 16 nt, Haemophilus influenzae Rd
caaguucugcacgaag

SEQ ID NO: 2687498 - RNA, 15 nt, Haemophilus influenzae Rd
caaguucuucauuua

SEQ ID NO: 2687499 - RNA, 16 nt, Haemophilus influenzae Rd
caaguugaagagaauu

SEQ ID NO: 2687500 - RNA, 18 nt, Haemophilus influenzae Rd
caaguugggauuuaucuu

SEQ ID NO: 2687501 - RNA, 22 nt, Haemophilus influenzae Rd
caaguugggauuuaucuucccc

SEQ ID NO: 2687502 - RNA, 23 nt, Haemophilus influenzae Rd
caaguugggauuuaucuuccccc

SEQ ID NO: 2687503 - RNA, 12 nt, Haemophilus influenzae Rd
caaguuguaaaa

SEQ ID NO: 2687504 - RNA, 12 nt, Haemophilus influenzae Rd
caaguuguaaau

SEQ ID NO: 2687505 - RNA, 15 nt, Haemophilus influenzae Rd
caaguuuaauacaau

SEQ ID NO: 2687506 - RNA, 19 nt, Haemophilus influenzae Rd
caaguuugcaauaaagcuu

SEQ ID NO: 2687507 - RNA, 19 nt, Haemophilus influenzae Rd
caaguuuuaccuucaguuu

SEQ ID NO: 2687508 - RNA, 14 nt, Haemophilus influenzae Rd
caaguuuucacuuc

SEQ ID NO: 2687509 - RNA, 11 nt, Haemophilus influenzae Rd
caaguuuuuua

SEQ ID NO: 2687510 - RNA, 11 nt, Haemophilus influenzae Rd
caauaaaaagu

SEQ ID NO: 2687511 - RNA, 13 nt, Haemophilus influenzae Rd
caauaaaaauaau

SEQ ID NO: 2687512 - RNA, 21 nt, Haemophilus influenzae Rd
caauaaaaauaauguuuuuau

SEQ ID NO: 2687513 - RNA, 16 nt, Haemophilus influenzae Rd
caauaaaaauauauuu

SEQ ID NO: 2687514 - RNA, 23 nt, Haemophilus influenzae Rd
caauaaaacacaacauagcugaa

SEQ ID NO: 2687515 - RNA, 12 nt, Haemophilus influenzae Rd
caauaaaaguaa

SEQ ID NO: 2687516 - RNA, 18 nt, Haemophilus influenzae Rd
caauaaaauaauauauua

SEQ ID NO: 2687517 - RNA, 13 nt, Haemophilus influenzae Rd
caauaaaauguua

SEQ ID NO: 2687518 - RNA, 13 nt, Haemophilus influenzae Rd
caauaaaauuugc

SEQ ID NO: 2687519 - RNA, 16 nt, Haemophilus influenzae Rd
caauaaaauuugcgug

SEQ ID NO: 2687520 - RNA, 16 nt, Haemophilus influenzae Rd
caauaaacagaaauau

SEQ ID NO: 2687521 - RNA, 13 nt, Haemophilus influenzae Rd
caauaaagggaaa

SEQ ID NO: 2687522 - RNA, 15 nt, Haemophilus influenzae Rd
caauaaauucguaca

SEQ ID NO: 2687523 - RNA, 16 nt, Haemophilus influenzae Rd
caauaacaacuggaau

SEQ ID NO: 2687524 - RNA, 19 nt, Haemophilus influenzae Rd
caauccaacguuuuaaucc

SEQ ID NO: 2687525 - RNA, 17 nt, Haemophilus influenzae Rd
caauccagauuaaaaau

SEQ ID NO: 2687526 - RNA, 20 nt, Haemophilus influenzae Rd
caauccagcguaaccaaugg

SEQ ID NO: 2687527 - RNA, 15 nt, Haemophilus influenzae Rd
caauccauaaaauac

SEQ ID NO: 2687528 - RNA, 16 nt, Haemophilus influenzae Rd
caauccauaaaauaca

SEQ ID NO: 2687529 - RNA, 20 nt, Haemophilus influenzae Rd
caaucgguuaaaaguaagca

SEQ ID NO: 2687530 - RNA, 15 nt, Haemophilus influenzae Rd
caaucgguuucacaa

SEQ ID NO: 2687531 - RNA, 17 nt, Haemophilus influenzae Rd
caaucguaagauccaaa

SEQ ID NO: 2687532 - RNA, 13 nt, Haemophilus influenzae Rd
caaucuaaacaca

SEQ ID NO: 2687533 - RNA, 19 nt, Haemophilus influenzae Rd
caaucuccguugggauuuu

SEQ ID NO: 2687534 - RNA, 21 nt, Haemophilus influenzae Rd
caaucuccguugggauuuuuu

SEQ ID NO: 2687535 - RNA, 12 nt, Haemophilus influenzae Rd
caaucucuuuac

SEQ ID NO: 2687536 - RNA, 17 nt, Haemophilus influenzae Rd
caaucuggauuggauuc

SEQ ID NO: 2687537 - RNA, 13 nt, Haemophilus influenzae Rd
caaucuucacaaa

SEQ ID NO: 2687538 - RNA, 19 nt, Haemophilus influenzae Rd
caaucuucacaaauaauau

SEQ ID NO: 2687539 - RNA, 21 nt, Haemophilus influenzae Rd
caaucuucacaaauaauauga

SEQ ID NO: 2687540 - RNA, 19 nt, Haemophilus influenzae Rd
caaucuuguuggaucuucc

SEQ ID NO: 2687541 - RNA, 20 nt, Haemophilus influenzae Rd
caaucuuguuggaucuucca

SEQ ID NO: 2687542 - RNA, 13 nt, Haemophilus influenzae Rd
caaucuuuuucuu

SEQ ID NO: 2687543 - RNA, 15 nt, Haemophilus influenzae Rd
caaugaaauuauugc

SEQ ID NO: 2687544 - RNA, 21 nt, Haemophilus influenzae Rd
caaugaacuuaugugcaccuu

SEQ ID NO: 2687545 - RNA, 17 nt, Haemophilus influenzae Rd
caaugaagauuaacuca

SEQ ID NO: 2687546 - RNA, 18 nt, Haemophilus influenzae Rd
caaugaguguuauugaug

SEQ ID NO: 2687547 - RNA, 16 nt, Haemophilus influenzae Rd
caaugauaccuuguua

SEQ ID NO: 2687548 - RNA, 14 nt, Haemophilus influenzae Rd
caaugauccccauu

SEQ ID NO: 2687549 - RNA, 11 nt, Haemophilus influenzae Rd
caaugauuaau

SEQ ID NO: 2687550 - RNA, 21 nt, Haemophilus influenzae Rd
caaugauugagcgauagaaau

SEQ ID NO: 2687551 - RNA, 19 nt, Haemophilus influenzae Rd
caaugcaaaaguaaauaau

SEQ ID NO: 2687552 - RNA, 14 nt, Haemophilus influenzae Rd
caaugcaaauacaa

SEQ ID NO: 2687553 - RNA, 15 nt, Haemophilus influenzae Rd
caaugcaaauuaacg

SEQ ID NO: 2687554 - RNA, 14 nt, Haemophilus influenzae Rd
caaugcaagcggca

SEQ ID NO: 2687555 - RNA, 15 nt, Haemophilus influenzae Rd
caaugcaauuggcaa

SEQ ID NO: 2687556 - RNA, 19 nt, Haemophilus influenzae Rd
caaugcaccaaaaauccuc

SEQ ID NO: 2687557 - RNA, 14 nt, Haemophilus influenzae Rd
caaugcagaaauac

SEQ ID NO: 2687558 - RNA, 15 nt, Haemophilus influenzae Rd
caaugccaaaaccau

SEQ ID NO: 2687559 - RNA, 14 nt, Haemophilus influenzae Rd
caaugccaaucuaa

SEQ ID NO: 2687560 - RNA, 17 nt, Haemophilus influenzae Rd
caaugccaaucuaaaca

SEQ ID NO: 2687561 - RNA, 18 nt, Haemophilus influenzae Rd
caaugccagcgcuugcac

SEQ ID NO: 2687562 - RNA, 23 nt, Haemophilus influenzae Rd
caaugccaucguggaauggagga

SEQ ID NO: 2687563 - RNA, 15 nt, Haemophilus influenzae Rd
caaugccucuuuuuu

SEQ ID NO: 2687564 - RNA, 22 nt, Haemophilus influenzae Rd
caaugccucuuuuuucauugca

SEQ ID NO: 2687565 - RNA, 17 nt, Haemophilus influenzae Rd
caaugcggagaaaagca

SEQ ID NO: 2687566 - RNA, 13 nt, Haemophilus influenzae Rd
caaugcuauaaaa

SEQ ID NO: 2687567 - RNA, 14 nt, Haemophilus influenzae Rd
caaugcuauaaaac

SEQ ID NO: 2687568 - RNA, 17 nt, Haemophilus influenzae Rd
caaugcuaucaggcuua

SEQ ID NO: 2687569 - RNA, 18 nt, Haemophilus influenzae Rd
caaugcucacuucgcuua

SEQ ID NO: 2687570 - RNA, 18 nt, Haemophilus influenzae Rd
caaugcucucuuuuaauc

SEQ ID NO: 2687571 - RNA, 13 nt, Haemophilus influenzae Rd
caaugcuuccuuc

SEQ ID NO: 2687572 - RNA, 14 nt, Haemophilus influenzae Rd
caaugcuuuaauca

SEQ ID NO: 2687573 - RNA, 15 nt, Haemophilus influenzae Rd
caauggcaaucacaa

SEQ ID NO: 2687574 - RNA, 18 nt, Haemophilus influenzae Rd
caauggcaaucacaguuu

SEQ ID NO: 2687575 - RNA, 20 nt, Haemophilus influenzae Rd
caauggcgguauauucugua

SEQ ID NO: 2687576 - RNA, 14 nt, Haemophilus influenzae Rd
caauggcugaaaaa

SEQ ID NO: 2687577 - RNA, 16 nt, Haemophilus influenzae Rd
caauggcugaaaaauu

SEQ ID NO: 2687578 - RNA, 22 nt, Haemophilus influenzae Rd
caauggcugagguuccccuaaa

SEQ ID NO: 2687579 - RNA, 23 nt, Haemophilus influenzae Rd
caauggcuuuuaauccaagugca

SEQ ID NO: 2687580 - RNA, 21 nt, Haemophilus influenzae Rd
caauggggguuagguaaaaau

SEQ ID NO: 2687581 - RNA, 15 nt, Haemophilus influenzae Rd
caaugguuaauacaa

SEQ ID NO: 2687582 - RNA, 15 nt, Haemophilus influenzae Rd
caaugguuuauaaca

SEQ ID NO: 2687583 - RNA, 23 nt, Haemophilus influenzae Rd
caaugguuuauaacaaguuagau

SEQ ID NO: 2687584 - RNA, 12 nt, Haemophilus influenzae Rd
caauguagaaau

SEQ ID NO: 2687585 - RNA, 17 nt, Haemophilus influenzae Rd
caaugucagaaaagauu

SEQ ID NO: 2687586 - RNA, 18 nt, Haemophilus influenzae Rd
caaugucagaaaagauuu

SEQ ID NO: 2687587 - RNA, 22 nt, Haemophilus influenzae Rd
caaugucagaaaagauuuuuug

SEQ ID NO: 2687588 - RNA, 20 nt, Haemophilus influenzae Rd
caaugugaccaaauaaucgu

SEQ ID NO: 2687589 - RNA, 21 nt, Haemophilus influenzae Rd
caauguuauugccuaauaaaa

SEQ ID NO: 2687590 - RNA, 13 nt, Haemophilus influenzae Rd
caauguuccacca

SEQ ID NO: 2687591 - RNA, 18 nt, Haemophilus influenzae Rd
caauguucgauuuuacuu

SEQ ID NO: 2687592 - RNA, 20 nt, Haemophilus influenzae Rd
caauguucgauuuuacuuuu

SEQ ID NO: 2687593 - RNA, 13 nt, Haemophilus influenzae Rd
caauguugcaaua

SEQ ID NO: 2687594 - RNA, 19 nt, Haemophilus influenzae Rd
caauguuugguauaaauaa

SEQ ID NO: 2687595 - RNA, 13 nt, Haemophilus influenzae Rd
caauuaaagaaau

SEQ ID NO: 2687596 - RNA, 16 nt, Haemophilus influenzae Rd
caauuaaagaaauuuc

SEQ ID NO: 2687597 - RNA, 19 nt, Haemophilus influenzae Rd
caauuaaaguaaacccuuu

SEQ ID NO: 2687598 - RNA, 18 nt, Haemophilus influenzae Rd
caauuaaaucaaaaauua

SEQ ID NO: 2687599 - RNA, 18 nt, Haemophilus influenzae Rd
caauuaaccauaaaaaau

SEQ ID NO: 2687600 - RNA, 14 nt, Haemophilus influenzae Rd
caauuaacuauuua

SEQ ID NO: 2687601 - RNA, 16 nt, Haemophilus influenzae Rd
caauuaagcaauagcg

SEQ ID NO: 2687602 - RNA, 15 nt, Haemophilus influenzae Rd
caauuaaggauuuau

SEQ ID NO: 2687603 - RNA, 23 nt, Haemophilus influenzae Rd
caauuaaggauuuauuuaacaau

SEQ ID NO: 2687604 - RNA, 19 nt, Haemophilus influenzae Rd
caauuaaguagauaacaaa

SEQ ID NO: 2687605 - RNA, 23 nt, Haemophilus influenzae Rd
caauuaauaauaagccgaagaag

SEQ ID NO: 2687606 - RNA, 14 nt, Haemophilus influenzae Rd
caauuaauauaaag

SEQ ID NO: 2687607 - RNA, 22 nt, Haemophilus influenzae Rd
caauuaauauaaaggauuuuau

SEQ ID NO: 2687608 - RNA, 13 nt, Haemophilus influenzae Rd
caauuaaugaacg

SEQ ID NO: 2687609 - RNA, 19 nt, Haemophilus influenzae Rd
caauuaauucguccauucu

SEQ ID NO: 2687610 - RNA, 20 nt, Haemophilus influenzae Rd
caauuacgacauucuuuaga

SEQ ID NO: 2687611 - RNA, 17 nt, Haemophilus influenzae Rd
caauuacguaaucaucc

SEQ ID NO: 2687612 - RNA, 15 nt, Haemophilus influenzae Rd
caauuacuguuugaa

SEQ ID NO: 2687613 - RNA, 22 nt, Haemophilus influenzae Rd
caauuagaugacuggcaaaaau

SEQ ID NO: 2687614 - RNA, 22 nt, Haemophilus influenzae Rd
caauuagaugauuuuaaaauaa

SEQ ID NO: 2687615 - RNA, 18 nt, Haemophilus influenzae Rd
caauuagcugguuuauuu

SEQ ID NO: 2687616 - RNA, 21 nt, Haemophilus influenzae Rd
caauuauccgagagaaaguua

SEQ ID NO: 2687617 - RNA, 19 nt, Haemophilus influenzae Rd
caauuauuggauugaauca

SEQ ID NO: 2687618 - RNA, 13 nt, Haemophilus influenzae Rd
caauuauuggcaa

SEQ ID NO: 2687619 - RNA, 12 nt, Haemophilus influenzae Rd
caauucaaagaa

SEQ ID NO: 2687620 - RNA, 15 nt, Haemophilus influenzae Rd
caauucaaagauuuu

SEQ ID NO: 2687621 - RNA, 18 nt, Haemophilus influenzae Rd
caauucaaagauuuuaaa

SEQ ID NO: 2687622 - RNA, 20 nt, Haemophilus influenzae Rd
caauucaaagauuuuaaaau

SEQ ID NO: 2687623 - RNA, 16 nt, Haemophilus influenzae Rd
caauucaaauuuuugu

SEQ ID NO: 2687624 - RNA, 18 nt, Haemophilus influenzae Rd
caauucacugcaacguua

SEQ ID NO: 2687625 - RNA, 14 nt, Haemophilus influenzae Rd
caauuccuucaaau

SEQ ID NO: 2687626 - RNA, 18 nt, Haemophilus influenzae Rd
caauuccuucaaauucua

SEQ ID NO: 2687627 - RNA, 19 nt, Haemophilus influenzae Rd
caauucuaguucuuccccu

SEQ ID NO: 2687628 - RNA, 13 nt, Haemophilus influenzae Rd
caauucuucuaau

SEQ ID NO: 2687629 - RNA, 15 nt, Haemophilus influenzae Rd
caauucuuguuuaau

SEQ ID NO: 2687630 - RNA, 19 nt, Haemophilus influenzae Rd
cacacuuuguauggcaaau

SEQ ID NO: 2687631 - RNA, 16 nt, Haemophilus influenzae Rd
cacagaaacagaaaua

SEQ ID NO: 2687632 - RNA, 13 nt, Haemophilus influenzae Rd
cacagaaaccaau

SEQ ID NO: 2687633 - RNA, 14 nt, Haemophilus influenzae Rd
cacagaaaccaaua

SEQ ID NO: 2687634 - RNA, 17 nt, Haemophilus influenzae Rd
cacagaaaggacagcca

SEQ ID NO: 2687635 - RNA, 21 nt, Haemophilus influenzae Rd
cacagauuuuuacuucaucaa

SEQ ID NO: 2687636 - RNA, 14 nt, Haemophilus influenzae Rd
cacagauuuuuuau

SEQ ID NO: 2687637 - RNA, 21 nt, Haemophilus influenzae Rd
cacagccaagaucaagcacuu

SEQ ID NO: 2687638 - RNA, 16 nt, Haemophilus influenzae Rd
cacagcccaaaauuca

SEQ ID NO: 2687639 - RNA, 17 nt, Haemophilus influenzae Rd
cacagcccaaaauucag

SEQ ID NO: 2687640 - RNA, 22 nt, Haemophilus influenzae Rd
cacagccgcauuuuuaccuaau

SEQ ID NO: 2687641 - RNA, 19 nt, Haemophilus influenzae Rd
cacagcgcgacuauuugca

SEQ ID NO: 2687642 - RNA, 15 nt, Haemophilus influenzae Rd
cacaggauaaaaacc

SEQ ID NO: 2687643 - RNA, 19 nt, Haemophilus influenzae Rd
cacaggcccaucauuuguu

SEQ ID NO: 2687644 - RNA, 18 nt, Haemophilus influenzae Rd
cacagggcugauaaauuu

SEQ ID NO: 2687645 - RNA, 16 nt, Haemophilus influenzae Rd
cacaguaccuacauuu

SEQ ID NO: 2687646 - RNA, 16 nt, Haemophilus influenzae Rd
cacaguccccauaucu

SEQ ID NO: 2687647 - RNA, 20 nt, Haemophilus influenzae Rd
cacaguccccauaucucugc

SEQ ID NO: 2687648 - RNA, 22 nt, Haemophilus influenzae Rd
cacaguguccagcacuuaauac

SEQ ID NO: 2687649 - RNA, 16 nt, Haemophilus influenzae Rd
cacaguuuccgcaaau

SEQ ID NO: 2687650 - RNA, 21 nt, Haemophilus influenzae Rd
cacaguuuccgcaaaugcuaa

SEQ ID NO: 2687651 - RNA, 13 nt, Haemophilus influenzae Rd
cacaguuuuauuu

SEQ ID NO: 2687652 - RNA, 21 nt, Haemophilus influenzae Rd
cacaguuuuauuuuccaucau

SEQ ID NO: 2687653 - RNA, 20 nt, Haemophilus influenzae Rd
cacauaaagacgcuguuucu

SEQ ID NO: 2687654 - RNA, 14 nt, Haemophilus influenzae Rd
cacauaaaucauuu

SEQ ID NO: 2687655 - RNA, 18 nt, Haemophilus influenzae Rd
cacauaacaaaauggcuu

SEQ ID NO: 2687656 - RNA, 14 nt, Haemophilus influenzae Rd
cacauaaccaaagg

SEQ ID NO: 2687657 - RNA, 19 nt, Haemophilus influenzae Rd
cacauaaguuaccgcuucu

SEQ ID NO: 2687658 - RNA, 14 nt, Haemophilus influenzae Rd
cacauacuuauuca

SEQ ID NO: 2687659 - RNA, 16 nt, Haemophilus influenzae Rd
cacauagcaaaaaacc

SEQ ID NO: 2687660 - RNA, 13 nt, Haemophilus influenzae Rd
cacauauuuuuga

SEQ ID NO: 2687661 - RNA, 22 nt, Haemophilus influenzae Rd
cacaucaaagcguuuuucuaca

SEQ ID NO: 2687662 - RNA, 16 nt, Haemophilus influenzae Rd
cacaucaaauucuaaa

SEQ ID NO: 2687663 - RNA, 14 nt, Haemophilus influenzae Rd
cacaugauauauuu

SEQ ID NO: 2687664 - RNA, 11 nt, Haemophilus influenzae Rd
cacauuacccc

SEQ ID NO: 2687665 - RNA, 23 nt, Haemophilus influenzae Rd
cacauuagugaaugaugccauuu

SEQ ID NO: 2687666 - RNA, 17 nt, Haemophilus influenzae Rd
cacauucuauagaauua

SEQ ID NO: 2687667 - RNA, 23 nt, Haemophilus influenzae Rd
cacauugccauauucgcuuucau

SEQ ID NO: 2687668 - RNA, 13 nt, Haemophilus influenzae Rd
cacauuucuucua

SEQ ID NO: 2687669 - RNA, 21 nt, Haemophilus influenzae Rd
cacauuucuucuaguuuuccu

SEQ ID NO: 2687670 - RNA, 23 nt, Haemophilus influenzae Rd
caccaaaaaugccguuuccaaau

SEQ ID NO: 2687671 - RNA, 16 nt, Haemophilus influenzae Rd
caccaaagcaaaauua

SEQ ID NO: 2687672 - RNA, 11 nt, Haemophilus influenzae Rd
caccaaauaau

SEQ ID NO: 2687673 - RNA, 20 nt, Haemophilus influenzae Rd
caccaaauaauguuaaaucu

SEQ ID NO: 2687674 - RNA, 15 nt, Haemophilus influenzae Rd
caccaaauaucgcaa

SEQ ID NO: 2687675 - RNA, 17 nt, Haemophilus influenzae Rd
caccaaauaucgcaauc

SEQ ID NO: 2687676 - RNA, 21 nt, Haemophilus influenzae Rd
caccaaaugguggcuuuuguu

SEQ ID NO: 2687677 - RNA, 21 nt, Haemophilus influenzae Rd
caccaaauuguucuaggcuuu

SEQ ID NO: 2687678 - RNA, 16 nt, Haemophilus influenzae Rd
caccaacaaauucuaa

SEQ ID NO: 2687679 - RNA, 12 nt, Haemophilus influenzae Rd
caccaagcaauu

SEQ ID NO: 2687680 - RNA, 17 nt, Haemophilus influenzae Rd
caccaagcauuacgccu

SEQ ID NO: 2687681 - RNA, 14 nt, Haemophilus influenzae Rd
caccaauaagccuu

SEQ ID NO: 2687682 - RNA, 23 nt, Haemophilus influenzae Rd
caccaauaauugaugcuaaauua

SEQ ID NO: 2687683 - RNA, 23 nt, Haemophilus influenzae Rd
caccaauuccgucagaauuucau

SEQ ID NO: 2687684 - RNA, 16 nt, Haemophilus influenzae Rd
caccacagaaccagca

SEQ ID NO: 2687685 - RNA, 22 nt, Haemophilus influenzae Rd
caccacccgauaaaugcacauu

SEQ ID NO: 2687686 - RNA, 17 nt, Haemophilus influenzae Rd
caccacccuucuuucaa

SEQ ID NO: 2687687 - RNA, 15 nt, Haemophilus influenzae Rd
caccacgauauuucg

SEQ ID NO: 2687688 - RNA, 16 nt, Haemophilus influenzae Rd
caccacguucauaaac

SEQ ID NO: 2687689 - RNA, 12 nt, Haemophilus influenzae Rd
caccagagaaaa

SEQ ID NO: 2687690 - RNA, 17 nt, Haemophilus influenzae Rd
caccagagugaccacca

SEQ ID NO: 2687691 - RNA, 19 nt, Haemophilus influenzae Rd
caccagugaauaaacacca

SEQ ID NO: 2687692 - RNA, 17 nt, Haemophilus influenzae Rd
caccauaaucaaaauua

SEQ ID NO: 2687693 - RNA, 22 nt, Haemophilus influenzae Rd
caccauaaucaaaauuacgccu

SEQ ID NO: 2687694 - RNA, 16 nt, Haemophilus influenzae Rd
caccauggcaccguuu

SEQ ID NO: 2687695 - RNA, 23 nt, Haemophilus influenzae Rd
caccauuuaaacaccaauucaaa

SEQ ID NO: 2687696 - RNA, 13 nt, Haemophilus influenzae Rd
caccauuuccuuu

SEQ ID NO: 2687697 - RNA, 18 nt, Haemophilus influenzae Rd
caccauuuguaauaguaa

SEQ ID NO: 2687698 - RNA, 17 nt, Haemophilus influenzae Rd
cacccaaaauuucagcu

SEQ ID NO: 2687699 - RNA, 14 nt, Haemophilus influenzae Rd
cacccauuuugauu

SEQ ID NO: 2687700 - RNA, 18 nt, Haemophilus influenzae Rd
cacccgccuuaaucauug

SEQ ID NO: 2687701 - RNA, 20 nt, Haemophilus influenzae Rd
cacccgccuuaaucauugca

SEQ ID NO: 2687702 - RNA, 23 nt, Haemophilus influenzae Rd
cacccuacgauacuuuuaauuaa

SEQ ID NO: 2687703 - RNA, 15 nt, Haemophilus influenzae Rd
caccgauaauaugca

SEQ ID NO: 2687704 - RNA, 14 nt, Haemophilus influenzae Rd
caccgauugccacg

SEQ ID NO: 2687705 - RNA, 18 nt, Haemophilus influenzae Rd
caccgcacuuuccuucua

SEQ ID NO: 2687706 - RNA, 13 nt, Haemophilus influenzae Rd
caccgcacuuugg

SEQ ID NO: 2687707 - RNA, 15 nt, Haemophilus influenzae Rd
caccgcacuuuuuag

SEQ ID NO: 2687708 - RNA, 16 nt, Haemophilus influenzae Rd
caccgcauucuucuuu

SEQ ID NO: 2687709 - RNA, 22 nt, Haemophilus influenzae Rd
caccgcauuguaaaccaaauuu

SEQ ID NO: 2687710 - RNA, 19 nt, Haemophilus influenzae Rd
caccgcuaauaaaaauccu

SEQ ID NO: 2687711 - RNA, 20 nt, Haemophilus influenzae Rd
caccgcuguaaugacagaau

SEQ ID NO: 2687712 - RNA, 14 nt, Haemophilus influenzae Rd
caccgcuucagcaa

SEQ ID NO: 2687713 - RNA, 17 nt, Haemophilus influenzae Rd
caccgcuuugcuugccc

SEQ ID NO: 2687714 - RNA, 22 nt, Haemophilus influenzae Rd
caccguauuuuuuaguuaaaua

SEQ ID NO: 2687715 - RNA, 23 nt, Haemophilus influenzae Rd
caccuaaaaugggucaagauuaa

SEQ ID NO: 2687716 - RNA, 16 nt, Haemophilus influenzae Rd
caccuaaaugagaaaa

SEQ ID NO: 2687717 - RNA, 17 nt, Haemophilus influenzae Rd
caccuaacauaugacag

SEQ ID NO: 2687718 - RNA, 20 nt, Haemophilus influenzae Rd
caccuaagaacugugaggca

SEQ ID NO: 2687719 - RNA, 16 nt, Haemophilus influenzae Rd
caccuaauucuuucac

SEQ ID NO: 2687720 - RNA, 19 nt, Haemophilus influenzae Rd
caccuacgccugcgaugcc

SEQ ID NO: 2687721 - RNA, 20 nt, Haemophilus influenzae Rd
caccucgugcuguuuucaau

SEQ ID NO: 2687722 - RNA, 21 nt, Haemophilus influenzae Rd
caccugaugcuuuaacaccaa

SEQ ID NO: 2687723 - RNA, 22 nt, Haemophilus influenzae Rd
caccugcagguuuugcaaauac

SEQ ID NO: 2687724 - RNA, 16 nt, Haemophilus influenzae Rd
caccuucuuuuggaua

SEQ ID NO: 2687725 - RNA, 18 nt, Haemophilus influenzae Rd
caccuugaauugcauuuu

SEQ ID NO: 2687726 - RNA, 14 nt, Haemophilus influenzae Rd
caccuugagaaaua

SEQ ID NO: 2687727 - RNA, 21 nt, Haemophilus influenzae Rd
caccuuuaggaugugaauaag

SEQ ID NO: 2687728 - RNA, 19 nt, Haemophilus influenzae Rd
caccuuugccucgcaugcg

SEQ ID NO: 2687729 - RNA, 13 nt, Haemophilus influenzae Rd
caccuuuuguaga

SEQ ID NO: 2687730 - RNA, 15 nt, Haemophilus influenzae Rd
caccuuuuguagaaa

SEQ ID NO: 2687731 - RNA, 13 nt, Haemophilus influenzae Rd
caccuuuuuccuu

SEQ ID NO: 2687732 - RNA, 22 nt, Haemophilus influenzae Rd
caccuuuuuccuuuaauugaaa

SEQ ID NO: 2687733 - RNA, 18 nt, Haemophilus influenzae Rd
cacgaauaauuaaaucuu

SEQ ID NO: 2687734 - RNA, 18 nt, Haemophilus influenzae Rd
cacgaccaauauugaaaa

SEQ ID NO: 2687735 - RNA, 16 nt, Haemophilus influenzae Rd
cacuucauauaaauua

SEQ ID NO: 2687736 - RNA, 20 nt, Haemophilus influenzae Rd
cacuucaucacuaaauucuu

SEQ ID NO: 2687737 - RNA, 22 nt, Haemophilus influenzae Rd
cacuucauuaaaaccaauuuuu

SEQ ID NO: 2687738 - RNA, 13 nt, Haemophilus influenzae Rd
cacuuccccaagu

SEQ ID NO: 2687739 - RNA, 24 nt, Haemophilus influenzae Rd
cacuucuaacuaaaaaagcgaauu

SEQ ID NO: 2687740 - RNA, 20 nt, Haemophilus influenzae Rd
cacuucugcauaacuuaaau

SEQ ID NO: 2687741 - RNA, 16 nt, Haemophilus influenzae Rd
cacuucuucaaagauu

SEQ ID NO: 2687742 - RNA, 14 nt, Haemophilus influenzae Rd
cacuucuucuuuaa

SEQ ID NO: 2687743 - RNA, 16 nt, Haemophilus influenzae Rd
cacuucuuguggagau

SEQ ID NO: 2687744 - RNA, 22 nt, Haemophilus influenzae Rd
cacuugaagucuauaaaagaag

SEQ ID NO: 2687745 - RNA, 17 nt, Haemophilus influenzae Rd
cacuugcauauccgcug

SEQ ID NO: 2687746 - RNA, 18 nt, Haemophilus influenzae Rd
cacuuggcgaaaaucauc

SEQ ID NO: 2687747 - RNA, 20 nt, Haemophilus influenzae Rd
cacuuggcgugguucaaaac

SEQ ID NO: 2687748 - RNA, 21 nt, Haemophilus influenzae Rd
cacuugggcugcaugaagaac

SEQ ID NO: 2687749 - RNA, 19 nt, Haemophilus influenzae Rd
cacuuggguaaauauaaau

SEQ ID NO: 2687750 - RNA, 23 nt, Haemophilus influenzae Rd
cacuuggugaucaccgaaauaac

SEQ ID NO: 2687751 - RNA, 14 nt, Haemophilus influenzae Rd
cacuugucauuaaa

SEQ ID NO: 2687752 - RNA, 16 nt, Haemophilus influenzae Rd
cacuugugcaucaaag

SEQ ID NO: 2687753 - RNA, 12 nt, Haemophilus influenzae Rd
cacuuguugauu

SEQ ID NO: 2687754 - RNA, 14 nt, Haemophilus influenzae Rd
cacuuguuuuuagu

SEQ ID NO: 2687755 - RNA, 16 nt, Haemophilus influenzae Rd
cacuuuaaaaauaaac

SEQ ID NO: 2687756 - RNA, 20 nt, Haemophilus influenzae Rd
cacuuuaaacuguugccaua

SEQ ID NO: 2687757 - RNA, 17 nt, Haemophilus influenzae Rd
cacuuuaaagaaauaaa

SEQ ID NO: 2687758 - RNA, 20 nt, Haemophilus influenzae Rd
cacuuuaaagaaauaaauuu

SEQ ID NO: 2687759 - RNA, 21 nt, Haemophilus influenzae Rd
cacuuuaaagaaauaaauuua

SEQ ID NO: 2687760 - RNA, 22 nt, Haemophilus influenzae Rd
cacuuuaaauauuuaaaaagaa

SEQ ID NO: 2687761 - RNA, 18 nt, Haemophilus influenzae Rd
cacuuuaaucgaaaucac

SEQ ID NO: 2687762 - RNA, 17 nt, Haemophilus influenzae Rd
cacuuuauuagaaauau

SEQ ID NO: 2687763 - RNA, 21 nt, Haemophilus influenzae Rd
cacuuuauuagaaauauauuu

SEQ ID NO: 2687764 - RNA, 19 nt, Haemophilus influenzae Rd
cacuuucaacuguucuucu

SEQ ID NO: 2687765 - RNA, 14 nt, Haemophilus influenzae Rd
cacuuucacauaaa

SEQ ID NO: 2687766 - RNA, 16 nt, Haemophilus influenzae Rd
cacuuuccguuuacua

SEQ ID NO: 2687767 - RNA, 22 nt, Haemophilus influenzae Rd
cacuuucuuauuggacugcaua

SEQ ID NO: 2687768 - RNA, 13 nt, Haemophilus influenzae Rd
cacuuugcacuuu

SEQ ID NO: 2687769 - RNA, 19 nt, Haemophilus influenzae Rd
cacuuugcucuaaaagcug

SEQ ID NO: 2687770 - RNA, 23 nt, Haemophilus influenzae Rd
cacuuuggaauauucuuuuuaaa

SEQ ID NO: 2687771 - RNA, 18 nt, Haemophilus influenzae Rd
cacuuuuaauucuuuauc

SEQ ID NO: 2687772 - RNA, 13 nt, Haemophilus influenzae Rd
cacuuuuauauuu

SEQ ID NO: 2687773 - RNA, 15 nt, Haemophilus influenzae Rd
cacuuuuauuauuua

SEQ ID NO: 2687774 - RNA, 16 nt, Haemophilus influenzae Rd
cacuuuuccuuuuauu

SEQ ID NO: 2687775 - RNA, 18 nt, Haemophilus influenzae Rd
cacuuuuuaucuaaaaaa

SEQ ID NO: 2687776 - RNA, 20 nt, Haemophilus influenzae Rd
cacuuuuuauucaaaucgau

SEQ ID NO: 2687777 - RNA, 16 nt, Haemophilus influenzae Rd
cacuuuuuugauaugc

SEQ ID NO: 2687778 - RNA, 20 nt, Haemophilus influenzae Rd
cacuuuuuuguauaaaaauu

SEQ ID NO: 2687779 - RNA, 20 nt, Haemophilus influenzae Rd
cagaaaacggcuuaguuaaa

SEQ ID NO: 2687780 - RNA, 14 nt, Haemophilus influenzae Rd
cagaaaacucgacu

SEQ ID NO: 2687781 - RNA, 21 nt, Haemophilus influenzae Rd
cagaaaagauugcggcagaau

SEQ ID NO: 2687782 - RNA, 15 nt, Haemophilus influenzae Rd
cagaaaagauuuuuu

SEQ ID NO: 2687783 - RNA, 12 nt, Haemophilus influenzae Rd
cagaaaauugca

SEQ ID NO: 2687784 - RNA, 15 nt, Haemophilus influenzae Rd
cagaaacaaauccug

SEQ ID NO: 2687785 - RNA, 17 nt, Haemophilus influenzae Rd
cagaaacagaaauaaca

SEQ ID NO: 2687786 - RNA, 19 nt, Haemophilus influenzae Rd
cagaaacauagauaacuuc

SEQ ID NO: 2687787 - RNA, 16 nt, Haemophilus influenzae Rd
cagaaagacuaauagc

SEQ ID NO: 2687788 - RNA, 11 nt, Haemophilus influenzae Rd
cagaaagagac

SEQ ID NO: 2687789 - RNA, 22 nt, Haemophilus influenzae Rd
cagaaauaccgauaauauguuu

SEQ ID NO: 2687790 - RNA, 19 nt, Haemophilus influenzae Rd
cagaaauauaaucaauuuc

SEQ ID NO: 2687791 - RNA, 15 nt, Haemophilus influenzae Rd
cagaaauaucuucaa

SEQ ID NO: 2687792 - RNA, 17 nt, Haemophilus influenzae Rd
cagaaauauguuuuacc

SEQ ID NO: 2687793 - RNA, 23 nt, Haemophilus influenzae Rd
cagaaauauguuuuaccaccgcu

SEQ ID NO: 2687794 - RNA, 14 nt, Haemophilus influenzae Rd
cagaaauauugucu

SEQ ID NO: 2687795 - RNA, 18 nt, Haemophilus influenzae Rd
cagaaaugaccuucacuu

SEQ ID NO: 2687796 - RNA, 21 nt, Haemophilus influenzae Rd
cagaaauuggcuuguugcugu

SEQ ID NO: 2687797 - RNA, 17 nt, Haemophilus influenzae Rd
cagaacaagcauuuuuc

SEQ ID NO: 2687798 - RNA, 18 nt, Haemophilus influenzae Rd
cagaacaagcauuuuuca

SEQ ID NO: 2687799 - RNA, 17 nt, Haemophilus influenzae Rd
cagaacauauaacccau

SEQ ID NO: 2687800 - RNA, 14 nt, Haemophilus influenzae Rd
cagaaccuaaugca

SEQ ID NO: 2687801 - RNA, 20 nt, Haemophilus influenzae Rd
cagaaccuaaugcaguaacu

SEQ ID NO: 2687802 - RNA, 20 nt, Haemophilus influenzae Rd
cagaaccugucgcaaugaag

SEQ ID NO: 2687803 - RNA, 15 nt, Haemophilus influenzae Rd
cagaacugcuuucuu

SEQ ID NO: 2687804 - RNA, 22 nt, Haemophilus influenzae Rd
cagaacuuuuuauaaucaggaa

SEQ ID NO: 2687805 - RNA, 17 nt, Haemophilus influenzae Rd
cagaagaaucuucuaau

SEQ ID NO: 2687806 - RNA, 22 nt, Haemophilus influenzae Rd
cagaaggaauauucuuuaaaua

SEQ ID NO: 2687807 - RNA, 18 nt, Haemophilus influenzae Rd
cagaaguuaaaacuugaa

SEQ ID NO: 2687808 - RNA, 20 nt, Haemophilus influenzae Rd
cagaaguuaaaacuugaaug

SEQ ID NO: 2687809 - RNA, 17 nt, Haemophilus influenzae Rd
cagaaguuguuuuucuu

SEQ ID NO: 2687810 - RNA, 18 nt, Haemophilus influenzae Rd
cagaaguuguuuuucuuc

SEQ ID NO: 2687811 - RNA, 13 nt, Haemophilus influenzae Rd
cagaauaaagaaa

SEQ ID NO: 2687812 - RNA, 18 nt, Haemophilus influenzae Rd
cagaauaauuaacaaaua

SEQ ID NO: 2687813 - RNA, 19 nt, Haemophilus influenzae Rd
cagaauaauuaacaaauaa

SEQ ID NO: 2687814 - RNA, 22 nt, Haemophilus influenzae Rd
cagaauagccgcaaucacaaaa

SEQ ID NO: 2687815 - RNA, 14 nt, Haemophilus influenzae Rd
cagaaucauuuuca

SEQ ID NO: 2687816 - RNA, 15 nt, Haemophilus influenzae Rd
cagaaugaaucguuu

SEQ ID NO: 2687817 - RNA, 20 nt, Haemophilus influenzae Rd
cagaaugaaucguuuguucu

SEQ ID NO: 2687818 - RNA, 22 nt, Haemophilus influenzae Rd
cagaauuacguaauauucuuua

SEQ ID NO: 2687819 - RNA, 18 nt, Haemophilus influenzae Rd
cagaauuacguuguuguu

SEQ ID NO: 2687820 - RNA, 15 nt, Haemophilus influenzae Rd
cagaauuucaucugu

SEQ ID NO: 2687821 - RNA, 16 nt, Haemophilus influenzae Rd
cagaauuucgucaaaa

SEQ ID NO: 2687822 - RNA, 19 nt, Haemophilus influenzae Rd
cagaauuucgucaaaaaug

SEQ ID NO: 2687823 - RNA, 23 nt, Haemophilus influenzae Rd
cagaauuugagcggugaauucuu

SEQ ID NO: 2687824 - RNA, 15 nt, Haemophilus influenzae Rd
cagaauuuggaucuu

SEQ ID NO: 2687825 - RNA, 20 nt, Haemophilus influenzae Rd
cagacaaguuuaauacaauc

SEQ ID NO: 2687826 - RNA, 21 nt, Haemophilus influenzae Rd
cagacaguagcauucccacgg

SEQ ID NO: 2687827 - RNA, 14 nt, Haemophilus influenzae Rd
cagaccaaaauucu

SEQ ID NO: 2687828 - RNA, 21 nt, Haemophilus influenzae Rd
cagaccaacguaaaaucgccu

SEQ ID NO: 2687829 - RNA, 19 nt, Haemophilus influenzae Rd
cagacgcugcccaaauaac

SEQ ID NO: 2687830 - RNA, 15 nt, Haemophilus influenzae Rd
cagacuagcaucaaa

SEQ ID NO: 2687831 - RNA, 14 nt, Haemophilus influenzae Rd
cagacuagugaaau

SEQ ID NO: 2687832 - RNA, 23 nt, Haemophilus influenzae Rd
cagacuagugaaauauuuacuuc

SEQ ID NO: 2687833 - RNA, 12 nt, Haemophilus influenzae Rd
cagacuauuucu

SEQ ID NO: 2687834 - RNA, 15 nt, Haemophilus influenzae Rd
cagacuauuucugua

SEQ ID NO: 2687835 - RNA, 14 nt, Haemophilus influenzae Rd
cagagaaaaaaaua

SEQ ID NO: 2687836 - RNA, 15 nt, Haemophilus influenzae Rd
cagagaaaaaaauag

SEQ ID NO: 2687837 - RNA, 18 nt, Haemophilus influenzae Rd
cagagauuuagauaauaa

SEQ ID NO: 2687838 - RNA, 17 nt, Haemophilus influenzae Rd
cagagcaccaaauuaaa

SEQ ID NO: 2687839 - RNA, 14 nt, Haemophilus influenzae Rd
cagagccuuuuucu

SEQ ID NO: 2687840 - RNA, 12 nt, Haemophilus influenzae Rd
caggaaaaauaa

SEQ ID NO: 2687841 - RNA, 19 nt, Haemophilus influenzae Rd
caggaaaaccacaagaugg

SEQ ID NO: 2687842 - RNA, 21 nt, Haemophilus influenzae Rd
caggaaagggauuuuuuauac

SEQ ID NO: 2687843 - RNA, 15 nt, Haemophilus influenzae Rd
caggaacauucacac

SEQ ID NO: 2687844 - RNA, 20 nt, Haemophilus influenzae Rd
caggaagcucgguaaaaauc

SEQ ID NO: 2687845 - RNA, 19 nt, Haemophilus influenzae Rd
caggaaucgugacaauaac

SEQ ID NO: 2687846 - RNA, 18 nt, Haemophilus influenzae Rd
caggaauuugcucaauaa

SEQ ID NO: 2687847 - RNA, 22 nt, Haemophilus influenzae Rd
caggagaaaguuguacuauuuu

SEQ ID NO: 2687848 - RNA, 19 nt, Haemophilus influenzae Rd
caggagaaucagaguuaaa

SEQ ID NO: 2687849 - RNA, 13 nt, Haemophilus influenzae Rd
caggaucaaaaau

SEQ ID NO: 2687850 - RNA, 16 nt, Haemophilus influenzae Rd
caggaucaaaaauauc

SEQ ID NO: 2687851 - RNA, 22 nt, Haemophilus influenzae Rd
caggauuaaugcuauaaaucca

SEQ ID NO: 2687852 - RNA, 19 nt, Haemophilus influenzae Rd
caggauuuguuucugucau

SEQ ID NO: 2687853 - RNA, 23 nt, Haemophilus influenzae Rd
caggcaacucaguuuuugaggaa

SEQ ID NO: 2687854 - RNA, 16 nt, Haemophilus influenzae Rd
caggcaagccagacag

SEQ ID NO: 2687855 - RNA, 23 nt, Haemophilus influenzae Rd
caggcgaaaccgccuuugauaau

SEQ ID NO: 2687856 - RNA, 15 nt, Haemophilus influenzae Rd
caggcugugcauaau

SEQ ID NO: 2687857 - RNA, 18 nt, Haemophilus influenzae Rd
caggcuuaacuuucucuc

SEQ ID NO: 2687858 - RNA, 17 nt, Haemophilus influenzae Rd
caggcuuauuaaaaacu

SEQ ID NO: 2687859 - RNA, 19 nt, Haemophilus influenzae Rd
caggcuuauuaaaaacuaa

SEQ ID NO: 2687860 - RNA, 13 nt, Haemophilus influenzae Rd
caggcuucaauuu

SEQ ID NO: 2687861 - RNA, 22 nt, Haemophilus influenzae Rd
caggcuucaauuugagaaauaa

SEQ ID NO: 2687862 - RNA, 21 nt, Haemophilus influenzae Rd
caggcuugaguuucgccagca

SEQ ID NO: 2687863 - RNA, 18 nt, Haemophilus influenzae Rd
caggcuuucacuauuuca

SEQ ID NO: 2687864 - RNA, 14 nt, Haemophilus influenzae Rd
cagggaaaaauuuu

SEQ ID NO: 2687865 - RNA, 22 nt, Haemophilus influenzae Rd
cagggaacgguucgccugauuu

SEQ ID NO: 2687866 - RNA, 21 nt, Haemophilus influenzae Rd
cagggauauugccuaauagaa

SEQ ID NO: 2687867 - RNA, 15 nt, Haemophilus influenzae Rd
cagggauuaagaaaa

SEQ ID NO: 2687868 - RNA, 18 nt, Haemophilus influenzae Rd
cagggauuucaauaaauu

SEQ ID NO: 2687869 - RNA, 14 nt, Haemophilus influenzae Rd
cagggcgaaguaaa

SEQ ID NO: 2687870 - RNA, 20 nt, Haemophilus influenzae Rd
cagggcgaaguaaaaaguca

SEQ ID NO: 2687871 - RNA, 15 nt, Haemophilus influenzae Rd
cagggcugauaaauu

SEQ ID NO: 2687872 - RNA, 17 nt, Haemophilus influenzae Rd
caggguuauuugcaaua

SEQ ID NO: 2687873 - RNA, 21 nt, Haemophilus influenzae Rd
caggguuauuugcaauaaaau

SEQ ID NO: 2687874 - RNA, 15 nt, Haemophilus influenzae Rd
caggguuuucaucau

SEQ ID NO: 2687875 - RNA, 21 nt, Haemophilus influenzae Rd
cagguaauuggugugcaauac

SEQ ID NO: 2687876 - RNA, 21 nt, Haemophilus influenzae Rd
cagguacuuggauugcaugaa

SEQ ID NO: 2687877 - RNA, 15 nt, Haemophilus influenzae Rd
cagguauuucuucaa

SEQ ID NO: 2687878 - RNA, 18 nt, Haemophilus influenzae Rd
caggucgagggucaaaag

SEQ ID NO: 2687879 - RNA, 20 nt, Haemophilus influenzae Rd
caggucgagggucaaaagaa

SEQ ID NO: 2687880 - RNA, 21 nt, Haemophilus influenzae Rd
caggucgagggucaaaagaaa

SEQ ID NO: 2687881 - RNA, 14 nt, Haemophilus influenzae Rd
caggugcuauuuua

SEQ ID NO: 2687882 - RNA, 18 nt, Haemophilus influenzae Rd
caggugcuauuuuauuua

SEQ ID NO: 2687883 - RNA, 21 nt, Haemophilus influenzae Rd
caggugcuauuuuauuuagaa

SEQ ID NO: 2687884 - RNA, 15 nt, Haemophilus influenzae Rd
caggugucacagcaa

SEQ ID NO: 2687885 - RNA, 23 nt, Haemophilus influenzae Rd
caggugucaucacucguugguau

SEQ ID NO: 2687886 - RNA, 19 nt, Haemophilus influenzae Rd
caggugucucugcccauaa

SEQ ID NO: 2687887 - RNA, 22 nt, Haemophilus influenzae Rd
cagguguguuuuucaaaaaaug

SEQ ID NO: 2687888 - RNA, 12 nt, Haemophilus influenzae Rd
cagguugcugau

SEQ ID NO: 2687889 - RNA, 18 nt, Haemophilus influenzae Rd
cagguugcugauaaagau

SEQ ID NO: 2687890 - RNA, 19 nt, Haemophilus influenzae Rd
cagguugcugauaaagaua

SEQ ID NO: 2687891 - RNA, 21 nt, Haemophilus influenzae Rd
cagguuguuuuuguaaaauag

SEQ ID NO: 2687892 - RNA, 12 nt, Haemophilus influenzae Rd
cagguuuuucuu

SEQ ID NO: 2687893 - RNA, 17 nt, Haemophilus influenzae Rd
cagguuuuuuauuucuc

SEQ ID NO: 2687894 - RNA, 21 nt, Haemophilus influenzae Rd
caguaaaacuugcaaaccaac

SEQ ID NO: 2687895 - RNA, 13 nt, Haemophilus influenzae Rd
caguaaacaagua

SEQ ID NO: 2687896 - RNA, 19 nt, Haemophilus influenzae Rd
caguaaaggcacuucaaua

SEQ ID NO: 2687897 - RNA, 14 nt, Haemophilus influenzae Rd
caguaaauuuuucc

SEQ ID NO: 2687898 - RNA, 16 nt, Haemophilus influenzae Rd
caguaacuucugcugc

SEQ ID NO: 2687899 - RNA, 15 nt, Haemophilus influenzae Rd
caguaagaucuucua

SEQ ID NO: 2687900 - RNA, 14 nt, Haemophilus influenzae Rd
caguaagcauauuu

SEQ ID NO: 2687901 - RNA, 19 nt, Haemophilus influenzae Rd
caguacaauuaauuaaaua

SEQ ID NO: 2687902 - RNA, 12 nt, Haemophilus influenzae Rd
caguaccuuuaa

SEQ ID NO: 2687903 - RNA, 16 nt, Haemophilus influenzae Rd
caguaccuuuaauuaa

SEQ ID NO: 2687904 - RNA, 16 nt, Haemophilus influenzae Rd
caguagaaaaucagau

SEQ ID NO: 2687905 - RNA, 16 nt, Haemophilus influenzae Rd
caguagaaucaaggcu

SEQ ID NO: 2687906 - RNA, 18 nt, Haemophilus influenzae Rd
caguagaaucaaggcuuu

SEQ ID NO: 2687907 - RNA, 21 nt, Haemophilus influenzae Rd
caguauaaaccgcauuacuuu

SEQ ID NO: 2687908 - RNA, 20 nt, Haemophilus influenzae Rd
caguauagugcgcauauacu

SEQ ID NO: 2687909 - RNA, 14 nt, Haemophilus influenzae Rd
caguaucaaauaca

SEQ ID NO: 2687910 - RNA, 20 nt, Haemophilus influenzae Rd
caguaucacgcacaccaccu

SEQ ID NO: 2687911 - RNA, 19 nt, Haemophilus influenzae Rd
caguauccgccaaugcuuu

SEQ ID NO: 2687912 - RNA, 12 nt, Haemophilus influenzae Rd
caguaucuggcu

SEQ ID NO: 2687913 - RNA, 16 nt, Haemophilus influenzae Rd
caguaucuggcucaau

SEQ ID NO: 2687914 - RNA, 21 nt, Haemophilus influenzae Rd
caguaugaugauuguuauugu

SEQ ID NO: 2687915 - RNA, 18 nt, Haemophilus influenzae Rd
caguauuaagaacuucua

SEQ ID NO: 2687916 - RNA, 19 nt, Haemophilus influenzae Rd
caguauuaaucugauaaau

SEQ ID NO: 2687917 - RNA, 17 nt, Haemophilus influenzae Rd
caguauuuuauuuugua

SEQ ID NO: 2687918 - RNA, 13 nt, Haemophilus influenzae Rd
caguauuuuuucg

SEQ ID NO: 2687919 - RNA, 21 nt, Haemophilus influenzae Rd
caguauuuuuucgaucuaauc

SEQ ID NO: 2687920 - RNA, 14 nt, Haemophilus influenzae Rd
cagucaaaaaugug

SEQ ID NO: 2687921 - RNA, 15 nt, Haemophilus influenzae Rd
cagucacuucuucaa

SEQ ID NO: 2687922 - RNA, 22 nt, Haemophilus influenzae Rd
cagucaucuaauugauucaaau

SEQ ID NO: 2687923 - RNA, 18 nt, Haemophilus influenzae Rd
cagucgauuacaaaaaca

SEQ ID NO: 2687924 - RNA, 21 nt, Haemophilus influenzae Rd
cagucgcuuuuuuaucuaaac

SEQ ID NO: 2687925 - RNA, 19 nt, Haemophilus influenzae Rd
cagucuaccauuugggaag

SEQ ID NO: 2687926 - RNA, 21 nt, Haemophilus influenzae Rd
cagucuguuuggcuaauaauu

SEQ ID NO: 2687927 - RNA, 14 nt, Haemophilus influenzae Rd
cagucuuacgccaa

SEQ ID NO: 2687928 - RNA, 14 nt, Haemophilus influenzae Rd
cagucuuuuaacac

SEQ ID NO: 2687929 - RNA, 14 nt, Haemophilus influenzae Rd
cagugacguuuauu

SEQ ID NO: 2687930 - RNA, 16 nt, Haemophilus influenzae Rd
cagugacuaaaacaac

SEQ ID NO: 2687931 - RNA, 22 nt, Haemophilus influenzae Rd
cagugaucccagcauaaauaaa

SEQ ID NO: 2687932 - RNA, 13 nt, Haemophilus influenzae Rd
cagugauguaaau

SEQ ID NO: 2687933 - RNA, 22 nt, Haemophilus influenzae Rd
cagugauuuucacauccacaaa

SEQ ID NO: 2687934 - RNA, 15 nt, Haemophilus influenzae Rd
cagugguaaaccuaa

SEQ ID NO: 2687935 - RNA, 19 nt, Haemophilus influenzae Rd
cagugguugcgauuuuugc

SEQ ID NO: 2687936 - RNA, 12 nt, Haemophilus influenzae Rd
cagugucuuaac

SEQ ID NO: 2687937 - RNA, 14 nt, Haemophilus influenzae Rd
caguuaaaacugug

SEQ ID NO: 2687938 - RNA, 13 nt, Haemophilus influenzae Rd
caguuaaauuuuc

SEQ ID NO: 2687939 - RNA, 16 nt, Haemophilus influenzae Rd
caguuaagaaaauaau

SEQ ID NO: 2687940 - RNA, 18 nt, Haemophilus influenzae Rd
caguuaagaaaauaauga

SEQ ID NO: 2687941 - RNA, 20 nt, Haemophilus influenzae Rd
caguuacugccucugccaca

SEQ ID NO: 2687942 - RNA, 23 nt, Haemophilus influenzae Rd
caguuacugccucugccacauca

SEQ ID NO: 2687943 - RNA, 22 nt, Haemophilus influenzae Rd
caguuagaacaacaauacguug

SEQ ID NO: 2687944 - RNA, 14 nt, Haemophilus influenzae Rd
caguuaucgccaau

SEQ ID NO: 2687945 - RNA, 17 nt, Haemophilus influenzae Rd
cauaauuaaacagcaca

SEQ ID NO: 2687946 - RNA, 20 nt, Haemophilus influenzae Rd
cauaauuaaggcugcugaau

SEQ ID NO: 2687947 - RNA, 23 nt, Haemophilus influenzae Rd
cauaauuccuuuuucuacuucuu

SEQ ID NO: 2687948 - RNA, 20 nt, Haemophilus influenzae Rd
cauaauugugggaaaguugg

SEQ ID NO: 2687949 - RNA, 14 nt, Haemophilus influenzae Rd
cauaauuuauauua

SEQ ID NO: 2687950 - RNA, 17 nt, Haemophilus influenzae Rd
cauaauuuauucaaaau

SEQ ID NO: 2687951 - RNA, 21 nt, Haemophilus influenzae Rd
cauaauuucacaauuuuugga

SEQ ID NO: 2687952 - RNA, 19 nt, Haemophilus influenzae Rd
cauaauuucagcaucagaa

SEQ ID NO: 2687953 - RNA, 23 nt, Haemophilus influenzae Rd
cauaauuucagcaucagaaauac

SEQ ID NO: 2687954 - RNA, 14 nt, Haemophilus influenzae Rd
cauaauuugcugug

SEQ ID NO: 2687955 - RNA, 16 nt, Haemophilus influenzae Rd
cauacaaguauuuucc

SEQ ID NO: 2687956 - RNA, 15 nt, Haemophilus influenzae Rd
cauacagaaaccaga

SEQ ID NO: 2687957 - RNA, 18 nt, Haemophilus influenzae Rd
cauacagccugcgauugc

SEQ ID NO: 2687958 - RNA, 15 nt, Haemophilus influenzae Rd
cauacaguaaaaaua

SEQ ID NO: 2687959 - RNA, 18 nt, Haemophilus influenzae Rd
cauacaguaaaaauagaa

SEQ ID NO: 2687960 - RNA, 14 nt, Haemophilus influenzae Rd
cauacaucuaauuu

SEQ ID NO: 2687961 - RNA, 22 nt, Haemophilus influenzae Rd
cauacauucagugguaaucauu

SEQ ID NO: 2687962 - RNA, 19 nt, Haemophilus influenzae Rd
cauaccaaggcauuuuuuc

SEQ ID NO: 2687963 - RNA, 12 nt, Haemophilus influenzae Rd
cauaccaauugc

SEQ ID NO: 2687964 - RNA, 18 nt, Haemophilus influenzae Rd
cauaccaauugcaacuuc

SEQ ID NO: 2687965 - RNA, 20 nt, Haemophilus influenzae Rd
cauaccauuuaaaaguaaaa

SEQ ID NO: 2687966 - RNA, 22 nt, Haemophilus influenzae Rd
cauaccuaaaaaugccccagca

SEQ ID NO: 2687967 - RNA, 18 nt, Haemophilus influenzae Rd
cauacgaccuucaaccau

SEQ ID NO: 2687968 - RNA, 16 nt, Haemophilus influenzae Rd
cauacgcaacuaaauu

SEQ ID NO: 2687969 - RNA, 23 nt, Haemophilus influenzae Rd
cauacguaauacuuuugcuucac

SEQ ID NO: 2687970 - RNA, 22 nt, Haemophilus influenzae Rd
cauacuaugacguuuauuuaca

SEQ ID NO: 2687971 - RNA, 17 nt, Haemophilus influenzae Rd
cauacuauuacccacuu

SEQ ID NO: 2687972 - RNA, 14 nt, Haemophilus influenzae Rd
cauacuuagauaaa

SEQ ID NO: 2687973 - RNA, 16 nt, Haemophilus influenzae Rd
cauacuuagauaaauu

SEQ ID NO: 2687974 - RNA, 12 nt, Haemophilus influenzae Rd
cauacuuuaacu

SEQ ID NO: 2687975 - RNA, 12 nt, Haemophilus influenzae Rd
cauagaaaucac

SEQ ID NO: 2687976 - RNA, 21 nt, Haemophilus influenzae Rd
cauagaaaucacuaaauuuca

SEQ ID NO: 2687977 - RNA, 18 nt, Haemophilus influenzae Rd
cauagaaccgucuuuaaa

SEQ ID NO: 2687978 - RNA, 19 nt, Haemophilus influenzae Rd
cauagaaccgucuuuaaau

SEQ ID NO: 2687979 - RNA, 15 nt, Haemophilus influenzae Rd
cauagaacguuuuuu

SEQ ID NO: 2687980 - RNA, 17 nt, Haemophilus influenzae Rd
cauagaaggcuaguucu

SEQ ID NO: 2687981 - RNA, 14 nt, Haemophilus influenzae Rd
cauagacauuagua

SEQ ID NO: 2687982 - RNA, 16 nt, Haemophilus influenzae Rd
cauagagacuuguaaa

SEQ ID NO: 2687983 - RNA, 15 nt, Haemophilus influenzae Rd
cauagaggaaccaug

SEQ ID NO: 2687984 - RNA, 19 nt, Haemophilus influenzae Rd
cauagauaaaguauaaguu

SEQ ID NO: 2687985 - RNA, 19 nt, Haemophilus influenzae Rd
cauagauaacuucuucauu

SEQ ID NO: 2687986 - RNA, 22 nt, Haemophilus influenzae Rd
cauagauuaucgccuaaaauug

SEQ ID NO: 2687987 - RNA, 14 nt, Haemophilus influenzae Rd
cauagccuuuuucu

SEQ ID NO: 2687988 - RNA, 22 nt, Haemophilus influenzae Rd
cauagcuaaacauccgaauaaa

SEQ ID NO: 2687989 - RNA, 18 nt, Haemophilus influenzae Rd
cauagcugaaaaauaaaa

SEQ ID NO: 2687990 - RNA, 20 nt, Haemophilus influenzae Rd
cauagcugaaaaauaaaaaa

SEQ ID NO: 2687991 - RNA, 14 nt, Haemophilus influenzae Rd
cauaguaaauuuua

SEQ ID NO: 2687992 - RNA, 15 nt, Haemophilus influenzae Rd
cauagucaggugcac

SEQ ID NO: 2687993 - RNA, 20 nt, Haemophilus influenzae Rd
cauagucgcuggaacuucua

SEQ ID NO: 2687994 - RNA, 18 nt, Haemophilus influenzae Rd
cauaguucacuaaaaauc

SEQ ID NO: 2687995 - RNA, 23 nt, Haemophilus influenzae Rd
cauaguuuggcucuucuuuaauu

SEQ ID NO: 2687996 - RNA, 21 nt, Haemophilus influenzae Rd
cauaguuuggcugaaauucua

SEQ ID NO: 2687997 - RNA, 22 nt, Haemophilus influenzae Rd
cauaguuuggcugaaauucuaa

SEQ ID NO: 2687998 - RNA, 23 nt, Haemophilus influenzae Rd
cauaguuuuaugcugcaaaagcu

SEQ ID NO: 2687999 - RNA, 14 nt, Haemophilus influenzae Rd
cauauaaaauaaag

SEQ ID NO: 2688000 - RNA, 20 nt, Haemophilus influenzae Rd
cauauaaaguggaugaccaa

SEQ ID NO: 2688001 - RNA, 14 nt, Haemophilus influenzae Rd
cauauaaauaagaa

SEQ ID NO: 2688002 - RNA, 14 nt, Haemophilus influenzae Rd
cauauaaauuugau

SEQ ID NO: 2688003 - RNA, 23 nt, Haemophilus influenzae Rd
cauauaaccacguaauucuugac

SEQ ID NO: 2688004 - RNA, 13 nt, Haemophilus influenzae Rd
cauauaacccaua

SEQ ID NO: 2688005 - RNA, 16 nt, Haemophilus influenzae Rd
cauauaagauuuuugc

SEQ ID NO: 2688006 - RNA, 21 nt, Haemophilus influenzae Rd
cauauaagcaaagaaauuuaa

SEQ ID NO: 2688007 - RNA, 17 nt, Haemophilus influenzae Rd
cauauaaucuccauaau

SEQ ID NO: 2688008 - RNA, 21 nt, Haemophilus influenzae Rd
cauauacucguucguuauuuu

SEQ ID NO: 2688009 - RNA, 20 nt, Haemophilus influenzae Rd
cauauacuucuuuagcugca

SEQ ID NO: 2688010 - RNA, 17 nt, Haemophilus influenzae Rd
cauauagugaaaaaaua

SEQ ID NO: 2688011 - RNA, 20 nt, Haemophilus influenzae Rd
cauauagugaaaaaauaacc

SEQ ID NO: 2688012 - RNA, 22 nt, Haemophilus influenzae Rd
cauauaucucuaaaaaauaacc

SEQ ID NO: 2688013 - RNA, 17 nt, Haemophilus influenzae Rd
cauaucaauuucauuug

SEQ ID NO: 2688014 - RNA, 19 nt, Haemophilus influenzae Rd
cauaucaauuucauuugca

SEQ ID NO: 2688015 - RNA, 15 nt, Haemophilus influenzae Rd
cauaucacauuuuau

SEQ ID NO: 2688016 - RNA, 23 nt, Haemophilus influenzae Rd
cauaucacgcaccacuucauaua

SEQ ID NO: 2688017 - RNA, 22 nt, Haemophilus influenzae Rd
cauaucagguaauuggugugca

SEQ ID NO: 2688018 - RNA, 22 nt, Haemophilus influenzae Rd
cauaucaucaaccaaaauacaa

SEQ ID NO: 2688019 - RNA, 15 nt, Haemophilus influenzae Rd
cauauccucaacauc

SEQ ID NO: 2688020 - RNA, 14 nt, Haemophilus influenzae Rd
cauaucgagcagac

SEQ ID NO: 2688021 - RNA, 18 nt, Haemophilus influenzae Rd
cauaucgagcagacaaaa

SEQ ID NO: 2688022 - RNA, 22 nt, Haemophilus influenzae Rd
cauaucgauaauuuaacugaau

SEQ ID NO: 2688023 - RNA, 14 nt, Haemophilus influenzae Rd
cauaucugcugcug

SEQ ID NO: 2688024 - RNA, 14 nt, Haemophilus influenzae Rd
cauaucuuccaaag

SEQ ID NO: 2688025 - RNA, 14 nt, Haemophilus influenzae Rd
cauaucuucuucuu

SEQ ID NO: 2688026 - RNA, 14 nt, Haemophilus influenzae Rd
cauaugauuauuua

SEQ ID NO: 2688027 - RNA, 22 nt, Haemophilus influenzae Rd
cauauuaaugcggugcuuuaag

SEQ ID NO: 2688028 - RNA, 23 nt, Haemophilus influenzae Rd
cauauuaaugcggugcuuuaagu

SEQ ID NO: 2688029 - RNA, 16 nt, Haemophilus influenzae Rd
cauauuagaaucaaug

SEQ ID NO: 2688030 - RNA, 13 nt, Haemophilus influenzae Rd
cauauuaguuagu

SEQ ID NO: 2688031 - RNA, 17 nt, Haemophilus influenzae Rd
cauauuaucaauaauua

SEQ ID NO: 2688032 - RNA, 16 nt, Haemophilus influenzae Rd
cauauucauaaaaggc

SEQ ID NO: 2688033 - RNA, 16 nt, Haemophilus influenzae Rd
cauauucccaaggcuc

SEQ ID NO: 2688034 - RNA, 17 nt, Haemophilus influenzae Rd
cauauucccaaggcucc

SEQ ID NO: 2688035 - RNA, 22 nt, Haemophilus influenzae Rd
cauauucgacaggaacauucac

SEQ ID NO: 2688036 - RNA, 23 nt, Haemophilus influenzae Rd
cauauucgcuuucauaaauucau

SEQ ID NO: 2688037 - RNA, 19 nt, Haemophilus influenzae Rd
cauauugaacacucuaauc

SEQ ID NO: 2688038 - RNA, 15 nt, Haemophilus influenzae Rd
cauauugauuuacau

SEQ ID NO: 2688039 - RNA, 18 nt, Haemophilus influenzae Rd
cauauugcuugcauucac

SEQ ID NO: 2688040 - RNA, 18 nt, Haemophilus influenzae Rd
cauauuguuucuucucuu

SEQ ID NO: 2688041 - RNA, 11 nt, Haemophilus influenzae Rd
cauauuuaaaa

SEQ ID NO: 2688042 - RNA, 21 nt, Haemophilus influenzae Rd
cauauuucugcaaauaaagaa

SEQ ID NO: 2688043 - RNA, 12 nt, Haemophilus influenzae Rd
cauauuuuaaau

SEQ ID NO: 2688044 - RNA, 23 nt, Haemophilus influenzae Rd
cauauuuuaaauaauuaaaaaua

SEQ ID NO: 2688045 - RNA, 19 nt, Haemophilus influenzae Rd
cauauuuucccaguaaaua

SEQ ID NO: 2688046 - RNA, 21 nt, Haemophilus influenzae Rd
cauauuuucccaguaaauauc

SEQ ID NO: 2688047 - RNA, 14 nt, Haemophilus influenzae Rd
cauauuuucuaaaa

SEQ ID NO: 2688048 - RNA, 12 nt, Haemophilus influenzae Rd
caucaaaaccau

SEQ ID NO: 2688049 - RNA, 17 nt, Haemophilus influenzae Rd
caucaaaaccauuuuuc

SEQ ID NO: 2688050 - RNA, 16 nt, Haemophilus influenzae Rd
caucuacccacacacc

SEQ ID NO: 2688051 - RNA, 23 nt, Haemophilus influenzae Rd
caucuagauuucuauccauuucu

SEQ ID NO: 2688052 - RNA, 14 nt, Haemophilus influenzae Rd
caucuaguuuuaau

SEQ ID NO: 2688053 - RNA, 19 nt, Haemophilus influenzae Rd
caucuauauuauacuuuca

SEQ ID NO: 2688054 - RNA, 23 nt, Haemophilus influenzae Rd
caucucaaaugugaaaacuacuu

SEQ ID NO: 2688055 - RNA, 20 nt, Haemophilus influenzae Rd
caucucaaggcgauccugau

SEQ ID NO: 2688056 - RNA, 17 nt, Haemophilus influenzae Rd
caucugaacguaagauc

SEQ ID NO: 2688057 - RNA, 20 nt, Haemophilus influenzae Rd
caucugaacguaagaucaga

SEQ ID NO: 2688058 - RNA, 16 nt, Haemophilus influenzae Rd
caucugcauaacgaua

SEQ ID NO: 2688059 - RNA, 20 nt, Haemophilus influenzae Rd
caucugcuggcgugagcgca

SEQ ID NO: 2688060 - RNA, 21 nt, Haemophilus influenzae Rd
caucuggugagugagcauuuc

SEQ ID NO: 2688061 - RNA, 14 nt, Haemophilus influenzae Rd
caucuguaaaccau

SEQ ID NO: 2688062 - RNA, 23 nt, Haemophilus influenzae Rd
caucuguaaaccauuccacgcua

SEQ ID NO: 2688063 - RNA, 20 nt, Haemophilus influenzae Rd
caucuguugugaaugcaaua

SEQ ID NO: 2688064 - RNA, 22 nt, Haemophilus influenzae Rd
caucuguugugaaugcaauauu

SEQ ID NO: 2688065 - RNA, 14 nt, Haemophilus influenzae Rd
caucuuagcuuuuu

SEQ ID NO: 2688066 - RNA, 21 nt, Haemophilus influenzae Rd
caucuuauuugauuaaguaua

SEQ ID NO: 2688067 - RNA, 12 nt, Haemophilus influenzae Rd
caucuucacaaa

SEQ ID NO: 2688068 - RNA, 18 nt, Haemophilus influenzae Rd
caucuucagcauuuaaaa

SEQ ID NO: 2688069 - RNA, 19 nt, Haemophilus influenzae Rd
caucuucagcauuuaaaau

SEQ ID NO: 2688070 - RNA, 12 nt, Haemophilus influenzae Rd
caucuucaucaa

SEQ ID NO: 2688071 - RNA, 13 nt, Haemophilus influenzae Rd
caucuucaucaau

SEQ ID NO: 2688072 - RNA, 17 nt, Haemophilus influenzae Rd
caucuucaucugcauca

SEQ ID NO: 2688073 - RNA, 17 nt, Haemophilus influenzae Rd
caucuucauuaaacuga

SEQ ID NO: 2688074 - RNA, 17 nt, Haemophilus influenzae Rd
caucuucuauucucugu

SEQ ID NO: 2688075 - RNA, 13 nt, Haemophilus influenzae Rd
caucuucuggguu

SEQ ID NO: 2688076 - RNA, 15 nt, Haemophilus influenzae Rd
caucuucuggguuca

SEQ ID NO: 2688077 - RNA, 17 nt, Haemophilus influenzae Rd
caucuucuuuugcccau

SEQ ID NO: 2688078 - RNA, 23 nt, Haemophilus influenzae Rd
caucuugauccauauauugaaca

SEQ ID NO: 2688079 - RNA, 14 nt, Haemophilus influenzae Rd
caucuuuaaacauc

SEQ ID NO: 2688080 - RNA, 15 nt, Haemophilus influenzae Rd
caucuuuauaacaua

SEQ ID NO: 2688081 - RNA, 15 nt, Haemophilus influenzae Rd
caucuuuuaaauaac

SEQ ID NO: 2688082 - RNA, 21 nt, Haemophilus influenzae Rd
caucuuuuggguuaaauaaug

SEQ ID NO: 2688083 - RNA, 14 nt, Haemophilus influenzae Rd
caucuuuuuauaaa

SEQ ID NO: 2688084 - RNA, 22 nt, Haemophilus influenzae Rd
caucuuuuucuguaauauauga

SEQ ID NO: 2688085 - RNA, 20 nt, Haemophilus influenzae Rd
caugaaguuggagauuuuuu

SEQ ID NO: 2688086 - RNA, 15 nt, Haemophilus influenzae Rd
caugaauauugguuu

SEQ ID NO: 2688087 - RNA, 19 nt, Haemophilus influenzae Rd
caugaauauugguuuuauu

SEQ ID NO: 2688088 - RNA, 20 nt, Haemophilus influenzae Rd
caugaauuucuaauuuuugu

SEQ ID NO: 2688089 - RNA, 15 nt, Haemophilus influenzae Rd
caugagcuuugcuuu

SEQ ID NO: 2688090 - RNA, 14 nt, Haemophilus influenzae Rd
caugagguuugcca

SEQ ID NO: 2688091 - RNA, 16 nt, Haemophilus influenzae Rd
caugaguuguuuuuuc

SEQ ID NO: 2688092 - RNA, 22 nt, Haemophilus influenzae Rd
caugauccacauagcaaaaaac

SEQ ID NO: 2688093 - RNA, 22 nt, Haemophilus influenzae Rd
caugaugaugggaugaaaucaa

SEQ ID NO: 2688094 - RNA, 20 nt, Haemophilus influenzae Rd
caugauuuuccaaaauuucu

SEQ ID NO: 2688095 - RNA, 15 nt, Haemophilus influenzae Rd
caugcacaacaugcc

SEQ ID NO: 2688096 - RNA, 22 nt, Haemophilus influenzae Rd
caugccaagcuaauugguaaaa

SEQ ID NO: 2688097 - RNA, 18 nt, Haemophilus influenzae Rd
caugccgcaaucaagcaa

SEQ ID NO: 2688098 - RNA, 20 nt, Haemophilus influenzae Rd
caugccgcaaucaagcaaau

SEQ ID NO: 2688099 - RNA, 15 nt, Haemophilus influenzae Rd
caugccuguucuaau

SEQ ID NO: 2688100 - RNA, 22 nt, Haemophilus influenzae Rd
caugcugagugaaaccugcuug

SEQ ID NO: 2688101 - RNA, 20 nt, Haemophilus influenzae Rd
cauggaacguuuuuuacuug

SEQ ID NO: 2688102 - RNA, 18 nt, Haemophilus influenzae Rd
cauggcgaccauucucua

SEQ ID NO: 2688103 - RNA, 13 nt, Haemophilus influenzae Rd
cauggcuuuuucc

SEQ ID NO: 2688104 - RNA, 16 nt, Haemophilus influenzae Rd
caugggauaaacauuu

SEQ ID NO: 2688105 - RNA, 14 nt, Haemophilus influenzae Rd
caugggcacgauag

SEQ ID NO: 2688106 - RNA, 16 nt, Haemophilus influenzae Rd
caugggcgauaaaaau

SEQ ID NO: 2688107 - RNA, 18 nt, Haemophilus influenzae Rd
caugguuguaauaaugaa

SEQ ID NO: 2688108 - RNA, 18 nt, Haemophilus influenzae Rd
caugguuuguuccaauuc

SEQ ID NO: 2688109 - RNA, 22 nt, Haemophilus influenzae Rd
cauguaaauaguuauuuauucc

SEQ ID NO: 2688110 - RNA, 13 nt, Haemophilus influenzae Rd
cauguacauuaau

SEQ ID NO: 2688111 - RNA, 16 nt, Haemophilus influenzae Rd
cauguacauuaaugua

SEQ ID NO: 2688112 - RNA, 13 nt, Haemophilus influenzae Rd
caugugcagcccu

SEQ ID NO: 2688113 - RNA, 15 nt, Haemophilus influenzae Rd
caugugguaauuaac

SEQ ID NO: 2688114 - RNA, 20 nt, Haemophilus influenzae Rd
cauguuuacuuaaaucuuua

SEQ ID NO: 2688115 - RNA, 12 nt, Haemophilus influenzae Rd
cauuaaaaaaua

SEQ ID NO: 2688116 - RNA, 14 nt, Haemophilus influenzae Rd
cauuaaaaaauaau

SEQ ID NO: 2688117 - RNA, 15 nt, Haemophilus influenzae Rd
cauuaaaaaauaauu

SEQ ID NO: 2688118 - RNA, 16 nt, Haemophilus influenzae Rd
cauuaaaaaauaauuc

SEQ ID NO: 2688119 - RNA, 17 nt, Haemophilus influenzae Rd
cauuaaaacaaagggcu

SEQ ID NO: 2688120 - RNA, 12 nt, Haemophilus influenzae Rd
cauuaaaagaag

SEQ ID NO: 2688121 - RNA, 13 nt, Haemophilus influenzae Rd
cauuaaaauucac

SEQ ID NO: 2688122 - RNA, 19 nt, Haemophilus influenzae Rd
cauuaaacuggaugaaauc

SEQ ID NO: 2688123 - RNA, 20 nt, Haemophilus influenzae Rd
cauuaaacuggaugaaauca

SEQ ID NO: 2688124 - RNA, 19 nt, Haemophilus influenzae Rd
cauuaaacuucuguaaaug

SEQ ID NO: 2688125 - RNA, 21 nt, Haemophilus influenzae Rd
cauuaaacuucuguaaauggc

SEQ ID NO: 2688126 - RNA, 14 nt, Haemophilus influenzae Rd
cauuaaagcaauug

SEQ ID NO: 2688127 - RNA, 15 nt, Haemophilus influenzae Rd
cauuaaagcaauugc

SEQ ID NO: 2688128 - RNA, 19 nt, Haemophilus influenzae Rd
cauuaaauaacucaagcaa

SEQ ID NO: 2688129 - RNA, 15 nt, Haemophilus influenzae Rd
cauuaaauauugagc

SEQ ID NO: 2688130 - RNA, 23 nt, Haemophilus influenzae Rd
cauuaacaaugcggagaaaagca

SEQ ID NO: 2688131 - RNA, 20 nt, Haemophilus influenzae Rd
cauuaaccaacauaaacauu

SEQ ID NO: 2688132 - RNA, 21 nt, Haemophilus influenzae Rd
cauuaaccaacauaaacauug

SEQ ID NO: 2688133 - RNA, 17 nt, Haemophilus influenzae Rd
cauuaaccccauuacca

SEQ ID NO: 2688134 - RNA, 15 nt, Haemophilus influenzae Rd
cauuaacuaaaccau

SEQ ID NO: 2688135 - RNA, 20 nt, Haemophilus influenzae Rd
cauuaacuaaaccauuuaau

SEQ ID NO: 2688136 - RNA, 18 nt, Haemophilus influenzae Rd
cauuaagaaguuauuguu

SEQ ID NO: 2688137 - RNA, 23 nt, Haemophilus influenzae Rd
cauuaagccugcuacagaagcug

SEQ ID NO: 2688138 - RNA, 22 nt, Haemophilus influenzae Rd
cauuaaggcuuuucuuuuauac

SEQ ID NO: 2688139 - RNA, 16 nt, Haemophilus influenzae Rd
cauuaagugcaucaac

SEQ ID NO: 2688140 - RNA, 22 nt, Haemophilus influenzae Rd
cauuaagugcguguauauauuu

SEQ ID NO: 2688141 - RNA, 15 nt, Haemophilus influenzae Rd
cauuaaguuuuuagc

SEQ ID NO: 2688142 - RNA, 19 nt, Haemophilus influenzae Rd
cauuaaguuuuuagcaguu

SEQ ID NO: 2688143 - RNA, 14 nt, Haemophilus influenzae Rd
cauuaauaaucuaa

SEQ ID NO: 2688144 - RNA, 24 nt, Haemophilus influenzae Rd
cauuaauaggaauaacacaccaac

SEQ ID NO: 2688145 - RNA, 15 nt, Haemophilus influenzae Rd
cauuaauaucuuuaa

SEQ ID NO: 2688146 - RNA, 17 nt, Haemophilus influenzae Rd
cauuaauaucuuuaaca

SEQ ID NO: 2688147 - RNA, 15 nt, Haemophilus influenzae Rd
cauuaaucaccauau

SEQ ID NO: 2688148 - RNA, 18 nt, Haemophilus influenzae Rd
cauuaaucggcaauguuu

SEQ ID NO: 2688149 - RNA, 22 nt, Haemophilus influenzae Rd
cauuaaucggcaauguuuuaag

SEQ ID NO: 2688150 - RNA, 19 nt, Haemophilus influenzae Rd
cauuaaugcauugauugcu

SEQ ID NO: 2688151 - RNA, 23 nt, Haemophilus influenzae Rd
cauuaaugcauugauugcuaaau

SEQ ID NO: 2688152 - RNA, 18 nt, Haemophilus influenzae Rd
cauuaaugguauugugau

SEQ ID NO: 2688153 - RNA, 21 nt, Haemophilus influenzae Rd
cauuacacgagcaauggcaau

SEQ ID NO: 2688154 - RNA, 17 nt, Haemophilus influenzae Rd
cauuacgugcaaauaaa

SEQ ID NO: 2688155 - RNA, 18 nt, Haemophilus influenzae Rd
cauuuaagccuacuugac

SEQ ID NO: 2688156 - RNA, 13 nt, Haemophilus influenzae Rd
cauuuaauacuga

SEQ ID NO: 2688157 - RNA, 19 nt, Haemophilus influenzae Rd
cauuuaauccugucaucug

SEQ ID NO: 2688158 - RNA, 22 nt, Haemophilus influenzae Rd
cauuuaauccugucaucuguaa

SEQ ID NO: 2688159 - RNA, 23 nt, Haemophilus influenzae Rd
cauuuaauccugucaucuguaaa

SEQ ID NO: 2688160 - RNA, 19 nt, Haemophilus influenzae Rd
cauuuaaugaugaaacuga

SEQ ID NO: 2688161 - RNA, 15 nt, Haemophilus influenzae Rd
cauuuaauggcugaa

SEQ ID NO: 2688162 - RNA, 14 nt, Haemophilus influenzae Rd
cauuuaauucugag

SEQ ID NO: 2688163 - RNA, 21 nt, Haemophilus influenzae Rd
cauuuacagguuugacauuca

SEQ ID NO: 2688164 - RNA, 20 nt, Haemophilus influenzae Rd
cauuuagagggauaaaaauc

SEQ ID NO: 2688165 - RNA, 22 nt, Haemophilus influenzae Rd
cauuuagugaccacauuucgag

SEQ ID NO: 2688166 - RNA, 14 nt, Haemophilus influenzae Rd
cauuuauaaacuuc

SEQ ID NO: 2688167 - RNA, 13 nt, Haemophilus influenzae Rd
cauuuaucaaaca

SEQ ID NO: 2688168 - RNA, 14 nt, Haemophilus influenzae Rd
cauuuaucaaacaa

SEQ ID NO: 2688169 - RNA, 15 nt, Haemophilus influenzae Rd
cauuuaucuuccaua

SEQ ID NO: 2688170 - RNA, 21 nt, Haemophilus influenzae Rd
cauuuauuaaaaguaaacaau

SEQ ID NO: 2688171 - RNA, 13 nt, Haemophilus influenzae Rd
cauuuauuuaaau

SEQ ID NO: 2688172 - RNA, 14 nt, Haemophilus influenzae Rd
cauuucaauuucac

SEQ ID NO: 2688173 - RNA, 18 nt, Haemophilus influenzae Rd
cauuucaccacuucaucc

SEQ ID NO: 2688174 - RNA, 19 nt, Haemophilus influenzae Rd
cauuucaccacuucaucca

SEQ ID NO: 2688175 - RNA, 14 nt, Haemophilus influenzae Rd
cauuucacuaaaua

SEQ ID NO: 2688176 - RNA, 17 nt, Haemophilus influenzae Rd
cauuucacuaaauaaau

SEQ ID NO: 2688177 - RNA, 22 nt, Haemophilus influenzae Rd
cauuucaguuacguaauauuua

SEQ ID NO: 2688178 - RNA, 19 nt, Haemophilus influenzae Rd
cauuucauaacguuuacga

SEQ ID NO: 2688179 - RNA, 20 nt, Haemophilus influenzae Rd
cauuucaucaggcauugcgc

SEQ ID NO: 2688180 - RNA, 16 nt, Haemophilus influenzae Rd
cauuucaucuacacca

SEQ ID NO: 2688181 - RNA, 13 nt, Haemophilus influenzae Rd
cauuucaucuuca

SEQ ID NO: 2688182 - RNA, 15 nt, Haemophilus influenzae Rd
cauuucaucuucagu

SEQ ID NO: 2688183 - RNA, 23 nt, Haemophilus influenzae Rd
cauuucccucaagacaaauuugu

SEQ ID NO: 2688184 - RNA, 15 nt, Haemophilus influenzae Rd
cauuucccuuagauu

SEQ ID NO: 2688185 - RNA, 13 nt, Haemophilus influenzae Rd
cauuuccugugca

SEQ ID NO: 2688186 - RNA, 19 nt, Haemophilus influenzae Rd
cauuuccugugcauuggcu

SEQ ID NO: 2688187 - RNA, 23 nt, Haemophilus influenzae Rd
cauuuccuuuacauuuaaacuca

SEQ ID NO: 2688188 - RNA, 22 nt, Haemophilus influenzae Rd
cauuuccuuugagccuucaaaa

SEQ ID NO: 2688189 - RNA, 18 nt, Haemophilus influenzae Rd
cauuucgcggacuuuuuu

SEQ ID NO: 2688190 - RNA, 17 nt, Haemophilus influenzae Rd
cauuucgcuugagugau

SEQ ID NO: 2688191 - RNA, 17 nt, Haemophilus influenzae Rd
cauuucgggcaaacgcu

SEQ ID NO: 2688192 - RNA, 22 nt, Haemophilus influenzae Rd
cauuucgucgcuuuucccucuu

SEQ ID NO: 2688193 - RNA, 15 nt, Haemophilus influenzae Rd
cauuucuaaaauaau

SEQ ID NO: 2688194 - RNA, 21 nt, Haemophilus influenzae Rd
cauuucuaaaauaauaucaca

SEQ ID NO: 2688195 - RNA, 12 nt, Haemophilus influenzae Rd
cauuucuaaaua

SEQ ID NO: 2688196 - RNA, 17 nt, Haemophilus influenzae Rd
cauuucuaaugcaauuu

SEQ ID NO: 2688197 - RNA, 21 nt, Haemophilus influenzae Rd
cauuucucgggcugaaauacc

SEQ ID NO: 2688198 - RNA, 19 nt, Haemophilus influenzae Rd
cauuucucuaaaacauugu

SEQ ID NO: 2688199 - RNA, 23 nt, Haemophilus influenzae Rd
cauuucuggagaaccuuggaaau

SEQ ID NO: 2688200 - RNA, 14 nt, Haemophilus influenzae Rd
cauuucuucugaua

SEQ ID NO: 2688201 - RNA, 14 nt, Haemophilus influenzae Rd
cauuugaauuaaua

SEQ ID NO: 2688202 - RNA, 15 nt, Haemophilus influenzae Rd
cauuugaauuaauaa

SEQ ID NO: 2688203 - RNA, 14 nt, Haemophilus influenzae Rd
cauuugaccugcgu

SEQ ID NO: 2688204 - RNA, 17 nt, Haemophilus influenzae Rd
cauuugacgauuaauac

SEQ ID NO: 2688205 - RNA, 18 nt, Haemophilus influenzae Rd
cauuugagaugaaaaaaa

SEQ ID NO: 2688206 - RNA, 14 nt, Haemophilus influenzae Rd
cauuugaugguaaa

SEQ ID NO: 2688207 - RNA, 19 nt, Haemophilus influenzae Rd
cauuugaugguaaaaacuu

SEQ ID NO: 2688208 - RNA, 15 nt, Haemophilus influenzae Rd
cauuugcaaaucaag

SEQ ID NO: 2688209 - RNA, 14 nt, Haemophilus influenzae Rd
cauuugcacccgcu

SEQ ID NO: 2688210 - RNA, 19 nt, Haemophilus influenzae Rd
cauuugcacccgcuuuaau

SEQ ID NO: 2688211 - RNA, 12 nt, Haemophilus influenzae Rd
cauuugcaucau

SEQ ID NO: 2688212 - RNA, 19 nt, Haemophilus influenzae Rd
cauuugccaaaacgcaauu

SEQ ID NO: 2688213 - RNA, 15 nt, Haemophilus influenzae Rd
cauuugcgccaauaa

SEQ ID NO: 2688214 - RNA, 17 nt, Haemophilus influenzae Rd
cauuugcguauuaugga

SEQ ID NO: 2688215 - RNA, 18 nt, Haemophilus influenzae Rd
cauuugcuuuaacccauu

SEQ ID NO: 2688216 - RNA, 15 nt, Haemophilus influenzae Rd
cauuuggaaauguuu

SEQ ID NO: 2688217 - RNA, 15 nt, Haemophilus influenzae Rd
cauuugggaauacca

SEQ ID NO: 2688218 - RNA, 12 nt, Haemophilus influenzae Rd
cauuuguagaaa

SEQ ID NO: 2688219 - RNA, 23 nt, Haemophilus influenzae Rd
cauuuguuaagcucacuugcaua

SEQ ID NO: 2688220 - RNA, 10 nt, Haemophilus influenzae Rd
cauuuuaaaa

SEQ ID NO: 2688221 - RNA, 22 nt, Haemophilus influenzae Rd
cauuuuaaaaggcuuucuaaca

SEQ ID NO: 2688222 - RNA, 19 nt, Haemophilus influenzae Rd
cauuuuaacucagggaaau

SEQ ID NO: 2688223 - RNA, 14 nt, Haemophilus influenzae Rd
cauuuuacaauacc

SEQ ID NO: 2688224 - RNA, 16 nt, Haemophilus influenzae Rd
cauuuuacaauaccaa

SEQ ID NO: 2688225 - RNA, 18 nt, Haemophilus influenzae Rd
cauuuuacagauuuuggu

SEQ ID NO: 2688226 - RNA, 14 nt, Haemophilus influenzae Rd
cauuuuauugaaga

SEQ ID NO: 2688227 - RNA, 23 nt, Haemophilus influenzae Rd
cauuuuauugaagaguaaaacua

SEQ ID NO: 2688228 - RNA, 20 nt, Haemophilus influenzae Rd
cauuuucaccaauuuaucug

SEQ ID NO: 2688229 - RNA, 22 nt, Haemophilus influenzae Rd
cauuuucacugauauagcuaga

SEQ ID NO: 2688230 - RNA, 19 nt, Haemophilus influenzae Rd
cauuuuccaaccaaucagu

SEQ ID NO: 2688231 - RNA, 15 nt, Haemophilus influenzae Rd
cauuuucgcaucaau

SEQ ID NO: 2688232 - RNA, 21 nt, Haemophilus influenzae Rd
cauuuucgguuaaguaaucug

SEQ ID NO: 2688233 - RNA, 23 nt, Haemophilus influenzae Rd
cauuuucugcauccaaacgccac

SEQ ID NO: 2688234 - RNA, 18 nt, Haemophilus influenzae Rd
cauuuucugcucuucauc

SEQ ID NO: 2688235 - RNA, 12 nt, Haemophilus influenzae Rd
cauuuucuucca

SEQ ID NO: 2688236 - RNA, 15 nt, Haemophilus influenzae Rd
cauuuucuuccaaug

SEQ ID NO: 2688237 - RNA, 16 nt, Haemophilus influenzae Rd
cauuuucuuccaaugu

SEQ ID NO: 2688238 - RNA, 14 nt, Haemophilus influenzae Rd
cauuuucuuuuuca

SEQ ID NO: 2688239 - RNA, 22 nt, Haemophilus influenzae Rd
cauuuugagauaaauuuuuagc

SEQ ID NO: 2688240 - RNA, 17 nt, Haemophilus influenzae Rd
cauuuugaggaauaaau

SEQ ID NO: 2688241 - RNA, 19 nt, Haemophilus influenzae Rd
cauuuugaggaauaaauug

SEQ ID NO: 2688242 - RNA, 21 nt, Haemophilus influenzae Rd
cauuuugauggaaggcuaccu

SEQ ID NO: 2688243 - RNA, 13 nt, Haemophilus influenzae Rd
cauuuugcccaau

SEQ ID NO: 2688244 - RNA, 20 nt, Haemophilus influenzae Rd
cauuuugcucaugauuauaa

SEQ ID NO: 2688245 - RNA, 20 nt, Haemophilus influenzae Rd
cauuuuguaagcaacacaga

SEQ ID NO: 2688246 - RNA, 19 nt, Haemophilus influenzae Rd
cauuuugucagauuuauaa

SEQ ID NO: 2688247 - RNA, 18 nt, Haemophilus influenzae Rd
cauuuuguuucuaaauua

SEQ ID NO: 2688248 - RNA, 11 nt, Haemophilus influenzae Rd
cauuuuuaaaa

SEQ ID NO: 2688249 - RNA, 11 nt, Haemophilus influenzae Rd
cauuuuuaaau

SEQ ID NO: 2688250 - RNA, 13 nt, Haemophilus influenzae Rd
cauuuuuaaaugg

SEQ ID NO: 2688251 - RNA, 21 nt, Haemophilus influenzae Rd
cauuuuuaaccgcacuuuuua

SEQ ID NO: 2688252 - RNA, 21 nt, Haemophilus influenzae Rd
cauuuuuaauggauuccauca

SEQ ID NO: 2688253 - RNA, 16 nt, Haemophilus influenzae Rd
cauuuuuaauuuuuag

SEQ ID NO: 2688254 - RNA, 21 nt, Haemophilus influenzae Rd
cauuuuuauuaguaaaauaau

SEQ ID NO: 2688255 - RNA, 23 nt, Haemophilus influenzae Rd
cauuuuucauaaugcgaucuuuu

SEQ ID NO: 2688256 - RNA, 13 nt, Haemophilus influenzae Rd
cauuuuucauuuu

SEQ ID NO: 2688257 - RNA, 14 nt, Haemophilus influenzae Rd
cauuuuucauuuuc

SEQ ID NO: 2688258 - RNA, 13 nt, Haemophilus influenzae Rd
cauuuuucgcaaa

SEQ ID NO: 2688259 - RNA, 20 nt, Haemophilus influenzae Rd
cauuuuugcaauuuaacaua

SEQ ID NO: 2688260 - RNA, 22 nt, Haemophilus influenzae Rd
ccaaguuuuuuaucuuuuucga

SEQ ID NO: 2688261 - RNA, 12 nt, Haemophilus influenzae Rd
ccaauaaaagua

SEQ ID NO: 2688262 - RNA, 20 nt, Haemophilus influenzae Rd
ccaauaaaaguaauuucuuu

SEQ ID NO: 2688263 - RNA, 12 nt, Haemophilus influenzae Rd
ccaauaaaaugu

SEQ ID NO: 2688264 - RNA, 13 nt, Haemophilus influenzae Rd
ccaauaaacauua

SEQ ID NO: 2688265 - RNA, 20 nt, Haemophilus influenzae Rd
ccaauaaacccgaaauauaa

SEQ ID NO: 2688266 - RNA, 14 nt, Haemophilus influenzae Rd
ccaauaauaaagcu

SEQ ID NO: 2688267 - RNA, 22 nt, Haemophilus influenzae Rd
ccaauaauaaagcuccuugaau

SEQ ID NO: 2688268 - RNA, 18 nt, Haemophilus influenzae Rd
ccaauaauugaugcuaaa

SEQ ID NO: 2688269 - RNA, 16 nt, Haemophilus influenzae Rd
ccaauacgauaauuaa

SEQ ID NO: 2688270 - RNA, 20 nt, Haemophilus influenzae Rd
ccaauacgauaauuaaaguc

SEQ ID NO: 2688271 - RNA, 17 nt, Haemophilus influenzae Rd
ccaauacuggcugaaca

SEQ ID NO: 2688272 - RNA, 17 nt, Haemophilus influenzae Rd
ccaauacuguuuggcaa

SEQ ID NO: 2688273 - RNA, 18 nt, Haemophilus influenzae Rd
ccaauaggaagcauuucu

SEQ ID NO: 2688274 - RNA, 21 nt, Haemophilus influenzae Rd
ccaauauaauuuacuguuuaa

SEQ ID NO: 2688275 - RNA, 15 nt, Haemophilus influenzae Rd
ccaauaugaacauua

SEQ ID NO: 2688276 - RNA, 15 nt, Haemophilus influenzae Rd
ccaauauguuuacca

SEQ ID NO: 2688277 - RNA, 21 nt, Haemophilus influenzae Rd
ccaaucacagccgcauuuuua

SEQ ID NO: 2688278 - RNA, 16 nt, Haemophilus influenzae Rd
ccaaucagcaaaacuu

SEQ ID NO: 2688279 - RNA, 17 nt, Haemophilus influenzae Rd
ccaaucaguuuuacgcu

SEQ ID NO: 2688280 - RNA, 15 nt, Haemophilus influenzae Rd
ccaaucauauuucug

SEQ ID NO: 2688281 - RNA, 21 nt, Haemophilus influenzae Rd
ccaauccacucuuuuaauaaa

SEQ ID NO: 2688282 - RNA, 17 nt, Haemophilus influenzae Rd
ccaauccagauuaaaaa

SEQ ID NO: 2688283 - RNA, 16 nt, Haemophilus influenzae Rd
ccaauccauaaaauac

SEQ ID NO: 2688284 - RNA, 14 nt, Haemophilus influenzae Rd
ccaauccuaaaucu

SEQ ID NO: 2688285 - RNA, 14 nt, Haemophilus influenzae Rd
ccaaugagaaaaag

SEQ ID NO: 2688286 - RNA, 23 nt, Haemophilus influenzae Rd
ccaaugaugacgacuagccgcag

SEQ ID NO: 2688287 - RNA, 14 nt, Haemophilus influenzae Rd
ccaaugcaacuugc

SEQ ID NO: 2688288 - RNA, 22 nt, Haemophilus influenzae Rd
ccaaugcacuuguggcuucauc

SEQ ID NO: 2688289 - RNA, 19 nt, Haemophilus influenzae Rd
ccaaugccuugugcauaaa

SEQ ID NO: 2688290 - RNA, 21 nt, Haemophilus influenzae Rd
ccaaugcgagucgcacccgcc

SEQ ID NO: 2688291 - RNA, 18 nt, Haemophilus influenzae Rd
ccaauggcaaucacaaau

SEQ ID NO: 2688292 - RNA, 21 nt, Haemophilus influenzae Rd
ccaauggggguuagguaaaaa

SEQ ID NO: 2688293 - RNA, 15 nt, Haemophilus influenzae Rd
ccaauguuugguaua

SEQ ID NO: 2688294 - RNA, 14 nt, Haemophilus influenzae Rd
ccaauuaaccauaa

SEQ ID NO: 2688295 - RNA, 17 nt, Haemophilus influenzae Rd
ccaauuaaccauaaaaa

SEQ ID NO: 2688296 - RNA, 16 nt, Haemophilus influenzae Rd
ccaauuaagcaauagc

SEQ ID NO: 2688297 - RNA, 23 nt, Haemophilus influenzae Rd
ccaauuaccugaugaaaucauua

SEQ ID NO: 2688298 - RNA, 19 nt, Haemophilus influenzae Rd
ccaauuagcuucaagcugc

SEQ ID NO: 2688299 - RNA, 18 nt, Haemophilus influenzae Rd
ccaauuauuggcaauuuc

SEQ ID NO: 2688300 - RNA, 20 nt, Haemophilus influenzae Rd
ccaauucaaagauuuuaaaa

SEQ ID NO: 2688301 - RNA, 20 nt, Haemophilus influenzae Rd
ccaauuccccagcagaguua

SEQ ID NO: 2688302 - RNA, 18 nt, Haemophilus influenzae Rd
ccaauucuaguucuuccc

SEQ ID NO: 2688303 - RNA, 19 nt, Haemophilus influenzae Rd
ccaauucuaguucuucccc

SEQ ID NO: 2688304 - RNA, 15 nt, Haemophilus influenzae Rd
ccaauucuuuuaaau

SEQ ID NO: 2688305 - RNA, 22 nt, Haemophilus influenzae Rd
ccaauuugcgccacaauauuua

SEQ ID NO: 2688306 - RNA, 16 nt, Haemophilus influenzae Rd
ccaauuugugcgcaug

SEQ ID NO: 2688307 - RNA, 19 nt, Haemophilus influenzae Rd
ccaauuuuucaaaacguuc

SEQ ID NO: 2688308 - RNA, 13 nt, Haemophilus influenzae Rd
ccaauuuuuucau

SEQ ID NO: 2688309 - RNA, 16 nt, Haemophilus influenzae Rd
ccaauuuuuucauaca

SEQ ID NO: 2688310 - RNA, 13 nt, Haemophilus influenzae Rd
ccacaaaaacgag

SEQ ID NO: 2688311 - RNA, 15 nt, Haemophilus influenzae Rd
ccacaaaaacgagcu

SEQ ID NO: 2688312 - RNA, 16 nt, Haemophilus influenzae Rd
ccacaaaaucugcucc

SEQ ID NO: 2688313 - RNA, 21 nt, Haemophilus influenzae Rd
ccacaaaauggcuguuguuuu

SEQ ID NO: 2688314 - RNA, 23 nt, Haemophilus influenzae Rd
ccacaaacuuaccgaucauuucu

SEQ ID NO: 2688315 - RNA, 23 nt, Haemophilus influenzae Rd
ccacaaagguaaaacuuucuagu

SEQ ID NO: 2688316 - RNA, 13 nt, Haemophilus influenzae Rd
ccacaacuuuuuc

SEQ ID NO: 2688317 - RNA, 18 nt, Haemophilus influenzae Rd
ccacaagcaacaauauua

SEQ ID NO: 2688318 - RNA, 18 nt, Haemophilus influenzae Rd
ccacaagcuuguccauga

SEQ ID NO: 2688319 - RNA, 20 nt, Haemophilus influenzae Rd
ccacaaguagauuacacauu

SEQ ID NO: 2688320 - RNA, 21 nt, Haemophilus influenzae Rd
ccacaauaaaauaauauauua

SEQ ID NO: 2688321 - RNA, 15 nt, Haemophilus influenzae Rd
ccacaauacuuauca

SEQ ID NO: 2688322 - RNA, 18 nt, Haemophilus influenzae Rd
ccacaggauaaaaaccag

SEQ ID NO: 2688323 - RNA, 22 nt, Haemophilus influenzae Rd
ccacaguccccauaucucugcc

SEQ ID NO: 2688324 - RNA, 23 nt, Haemophilus influenzae Rd
ccacaguccccauaucucugcca

SEQ ID NO: 2688325 - RNA, 17 nt, Haemophilus influenzae Rd
ccacauaaccaaagggc

SEQ ID NO: 2688326 - RNA, 15 nt, Haemophilus influenzae Rd
ccacauaauaagaaa

SEQ ID NO: 2688327 - RNA, 20 nt, Haemophilus influenzae Rd
ccacauauagugaaaaaaua

SEQ ID NO: 2688328 - RNA, 24 nt, Haemophilus influenzae Rd
ccacaucaaagcguuuuucuacau

SEQ ID NO: 2688329 - RNA, 16 nt, Haemophilus influenzae Rd
ccacaucaucaagcaa

SEQ ID NO: 2688330 - RNA, 13 nt, Haemophilus influenzae Rd
ccacaugaacaag

SEQ ID NO: 2688331 - RNA, 17 nt, Haemophilus influenzae Rd
ccacaugauaaaaaccg

SEQ ID NO: 2688332 - RNA, 16 nt, Haemophilus influenzae Rd
ccacaugggcaucaua

SEQ ID NO: 2688333 - RNA, 19 nt, Haemophilus influenzae Rd
ccacauuauuuggugagau

SEQ ID NO: 2688334 - RNA, 18 nt, Haemophilus influenzae Rd
ccacauuucccuuagauu

SEQ ID NO: 2688335 - RNA, 11 nt, Haemophilus influenzae Rd
ccaccaaaaug

SEQ ID NO: 2688336 - RNA, 21 nt, Haemophilus influenzae Rd
ccaccaauuaaccauaaaaaa

SEQ ID NO: 2688337 - RNA, 15 nt, Haemophilus influenzae Rd
ccaccaauuaauucu

SEQ ID NO: 2688338 - RNA, 16 nt, Haemophilus influenzae Rd
ccaccacaauuaauga

SEQ ID NO: 2688339 - RNA, 17 nt, Haemophilus influenzae Rd
ccaccagagaaaucauc

SEQ ID NO: 2688340 - RNA, 16 nt, Haemophilus influenzae Rd
ccacccaaaauuucag

SEQ ID NO: 2688341 - RNA, 16 nt, Haemophilus influenzae Rd
ccaccccagaauuaag

SEQ ID NO: 2688342 - RNA, 18 nt, Haemophilus influenzae Rd
ccaccgguacagaugcca

SEQ ID NO: 2688343 - RNA, 15 nt, Haemophilus influenzae Rd
ccaccguauugucaa

SEQ ID NO: 2688344 - RNA, 21 nt, Haemophilus influenzae Rd
ccaccuugaauugcauuuucu

SEQ ID NO: 2688345 - RNA, 17 nt, Haemophilus influenzae Rd
ccaccuuuuguagaaaa

SEQ ID NO: 2688346 - RNA, 18 nt, Haemophilus influenzae Rd
ccacgaggucaaucuuua

SEQ ID NO: 2688347 - RNA, 14 nt, Haemophilus influenzae Rd
ccacgauaaauccu

SEQ ID NO: 2688348 - RNA, 15 nt, Haemophilus influenzae Rd
ccacgauaaauccuu

SEQ ID NO: 2688349 - RNA, 17 nt, Haemophilus influenzae Rd
ccacgccagcuacaucu

SEQ ID NO: 2688350 - RNA, 19 nt, Haemophilus influenzae Rd
ccacgcuaaaaucuugcac

SEQ ID NO: 2688351 - RNA, 13 nt, Haemophilus influenzae Rd
ccacggauaaaug

SEQ ID NO: 2688352 - RNA, 24 nt, Haemophilus influenzae Rd
ccacggauaaaugcgugaacugcu

SEQ ID NO: 2688353 - RNA, 15 nt, Haemophilus influenzae Rd
ccacggcuugugauu

SEQ ID NO: 2688354 - RNA, 19 nt, Haemophilus influenzae Rd
ccacgguaaaucugauuca

SEQ ID NO: 2688355 - RNA, 19 nt, Haemophilus influenzae Rd
ccacgguauuuucuuauug

SEQ ID NO: 2688356 - RNA, 16 nt, Haemophilus influenzae Rd
ccacguauuuuuuaau

SEQ ID NO: 2688357 - RNA, 20 nt, Haemophilus influenzae Rd
ccacgucaagugguuuauuu

SEQ ID NO: 2688358 - RNA, 16 nt, Haemophilus influenzae Rd
ccacguccacuucauc

SEQ ID NO: 2688359 - RNA, 16 nt, Haemophilus influenzae Rd
ccacguuuucaacagu

SEQ ID NO: 2688360 - RNA, 24 nt, Haemophilus influenzae Rd
ccacuaaaacacguuugccagaaa

SEQ ID NO: 2688361 - RNA, 19 nt, Haemophilus influenzae Rd
ccacuaacucacauugcca

SEQ ID NO: 2688362 - RNA, 21 nt, Haemophilus influenzae Rd
ccacuaauuucacaccauuuu

SEQ ID NO: 2688363 - RNA, 21 nt, Haemophilus influenzae Rd
ccacuacuaacguuucuaaua

SEQ ID NO: 2688364 - RNA, 17 nt, Haemophilus influenzae Rd
ccacuaguucaucauca

SEQ ID NO: 2688365 - RNA, 19 nt, Haemophilus influenzae Rd
ccaucgcugaaauuaauaa

SEQ ID NO: 2688366 - RNA, 19 nt, Haemophilus influenzae Rd
ccaucgggcuguaaaaaau

SEQ ID NO: 2688367 - RNA, 22 nt, Haemophilus influenzae Rd
ccaucguuaaaccaaauaauga

SEQ ID NO: 2688368 - RNA, 13 nt, Haemophilus influenzae Rd
ccaucuaaaccug

SEQ ID NO: 2688369 - RNA, 22 nt, Haemophilus influenzae Rd
ccaucuaaaguuggcacuucaa

SEQ ID NO: 2688370 - RNA, 16 nt, Haemophilus influenzae Rd
ccaucuaauacgucua

SEQ ID NO: 2688371 - RNA, 18 nt, Haemophilus influenzae Rd
ccaucuaauugugcuaaa

SEQ ID NO: 2688372 - RNA, 21 nt, Haemophilus influenzae Rd
ccaucuaauugugcuaaauaa

SEQ ID NO: 2688373 - RNA, 11 nt, Haemophilus influenzae Rd
ccaucuucaac

SEQ ID NO: 2688374 - RNA, 12 nt, Haemophilus influenzae Rd
ccaucuucuucu

SEQ ID NO: 2688375 - RNA, 18 nt, Haemophilus influenzae Rd
ccaucuuuaauuccaacu

SEQ ID NO: 2688376 - RNA, 22 nt, Haemophilus influenzae Rd
ccaugaacguuugccgaagccu

SEQ ID NO: 2688377 - RNA, 21 nt, Haemophilus influenzae Rd
ccaugaauauugguuuuauuc

SEQ ID NO: 2688378 - RNA, 20 nt, Haemophilus influenzae Rd
ccaugacaagcaaccugugg

SEQ ID NO: 2688379 - RNA, 13 nt, Haemophilus influenzae Rd
ccaugccuguucu

SEQ ID NO: 2688380 - RNA, 15 nt, Haemophilus influenzae Rd
ccaugcuuuggcaua

SEQ ID NO: 2688381 - RNA, 23 nt, Haemophilus influenzae Rd
ccauggaacaggcuacacccacu

SEQ ID NO: 2688382 - RNA, 15 nt, Haemophilus influenzae Rd
ccauggcuuuuuccu

SEQ ID NO: 2688383 - RNA, 21 nt, Haemophilus influenzae Rd
ccauguacauuaauguaauca

SEQ ID NO: 2688384 - RNA, 13 nt, Haemophilus influenzae Rd
ccauuaaaagaag

SEQ ID NO: 2688385 - RNA, 17 nt, Haemophilus influenzae Rd
ccauuaaauaaaaauga

SEQ ID NO: 2688386 - RNA, 21 nt, Haemophilus influenzae Rd
ccauuaaauccugacaaccug

SEQ ID NO: 2688387 - RNA, 18 nt, Haemophilus influenzae Rd
ccauuaaccaacauaaac

SEQ ID NO: 2688388 - RNA, 21 nt, Haemophilus influenzae Rd
ccauuaaccaacauaaacauu

SEQ ID NO: 2688389 - RNA, 17 nt, Haemophilus influenzae Rd
ccauuaacuaaaccauu

SEQ ID NO: 2688390 - RNA, 18 nt, Haemophilus influenzae Rd
ccauuaaugguauuguga

SEQ ID NO: 2688391 - RNA, 15 nt, Haemophilus influenzae Rd
ccauuacaaguauaa

SEQ ID NO: 2688392 - RNA, 21 nt, Haemophilus influenzae Rd
ccauuacguucauauaaauuu

SEQ ID NO: 2688393 - RNA, 20 nt, Haemophilus influenzae Rd
ccauuagucgucuauuuauu

SEQ ID NO: 2688394 - RNA, 21 nt, Haemophilus influenzae Rd
ccauuauuuuucucauaauag

SEQ ID NO: 2688395 - RNA, 20 nt, Haemophilus influenzae Rd
ccauucacauucuuuuaaau

SEQ ID NO: 2688396 - RNA, 18 nt, Haemophilus influenzae Rd
ccauucacguucuuuaau

SEQ ID NO: 2688397 - RNA, 12 nt, Haemophilus influenzae Rd
ccauucacuuuc

SEQ ID NO: 2688398 - RNA, 16 nt, Haemophilus influenzae Rd
ccauucacuuucacau

SEQ ID NO: 2688399 - RNA, 18 nt, Haemophilus influenzae Rd
ccauuccacaagccacau

SEQ ID NO: 2688400 - RNA, 15 nt, Haemophilus influenzae Rd
ccauuccacccauac

SEQ ID NO: 2688401 - RNA, 15 nt, Haemophilus influenzae Rd
ccauucuaaaaaaau

SEQ ID NO: 2688402 - RNA, 19 nt, Haemophilus influenzae Rd
ccauucuaaaaaaauccua

SEQ ID NO: 2688403 - RNA, 15 nt, Haemophilus influenzae Rd
ccauucucuaacgca

SEQ ID NO: 2688404 - RNA, 22 nt, Haemophilus influenzae Rd
ccauucuguaaacuaaaucuug

SEQ ID NO: 2688405 - RNA, 15 nt, Haemophilus influenzae Rd
ccauucuuucaauaa

SEQ ID NO: 2688406 - RNA, 18 nt, Haemophilus influenzae Rd
ccauugaaaggguugcag

SEQ ID NO: 2688407 - RNA, 17 nt, Haemophilus influenzae Rd
ccauugagcauuuuuua

SEQ ID NO: 2688408 - RNA, 22 nt, Haemophilus influenzae Rd
ccauugagcauuuuuuauuaaa

SEQ ID NO: 2688409 - RNA, 12 nt, Haemophilus influenzae Rd
ccauugaugaaa

SEQ ID NO: 2688410 - RNA, 20 nt, Haemophilus influenzae Rd
ccauugcauccacuucaucc

SEQ ID NO: 2688411 - RNA, 16 nt, Haemophilus influenzae Rd
ccauugcguucacuca

SEQ ID NO: 2688412 - RNA, 19 nt, Haemophilus influenzae Rd
ccauugcuagccaauaauc

SEQ ID NO: 2688413 - RNA, 20 nt, Haemophilus influenzae Rd
ccauugcuagccaauaaucu

SEQ ID NO: 2688414 - RNA, 17 nt, Haemophilus influenzae Rd
ccauuggaaaaugcuua

SEQ ID NO: 2688415 - RNA, 22 nt, Haemophilus influenzae Rd
ccauuggaagauuucuucuacu

SEQ ID NO: 2688416 - RNA, 19 nt, Haemophilus influenzae Rd
ccauuggacacaauaauau

SEQ ID NO: 2688417 - RNA, 22 nt, Haemophilus influenzae Rd
ccauuggggcgaccauuacagc

SEQ ID NO: 2688418 - RNA, 14 nt, Haemophilus influenzae Rd
ccauugucauggca

SEQ ID NO: 2688419 - RNA, 22 nt, Haemophilus influenzae Rd
ccauugugccaaauucaguauc

SEQ ID NO: 2688420 - RNA, 12 nt, Haemophilus influenzae Rd
ccauuguuuaau

SEQ ID NO: 2688421 - RNA, 23 nt, Haemophilus influenzae Rd
ccauuguuuguuuuauuuauucu

SEQ ID NO: 2688422 - RNA, 12 nt, Haemophilus influenzae Rd
ccauuuaagccu

SEQ ID NO: 2688423 - RNA, 20 nt, Haemophilus influenzae Rd
ccauuuacggcuuagauaau

SEQ ID NO: 2688424 - RNA, 15 nt, Haemophilus influenzae Rd
ccauuuaucuuccau

SEQ ID NO: 2688425 - RNA, 12 nt, Haemophilus influenzae Rd
ccauuucaauca

SEQ ID NO: 2688426 - RNA, 13 nt, Haemophilus influenzae Rd
ccauuucaccacu

SEQ ID NO: 2688427 - RNA, 11 nt, Haemophilus influenzae Rd
ccauuucuaaa

SEQ ID NO: 2688428 - RNA, 12 nt, Haemophilus influenzae Rd
ccauuucuaaac

SEQ ID NO: 2688429 - RNA, 15 nt, Haemophilus influenzae Rd
ccauuucuuuuugca

SEQ ID NO: 2688430 - RNA, 19 nt, Haemophilus influenzae Rd
ccauuucuuuuugcaggga

SEQ ID NO: 2688431 - RNA, 15 nt, Haemophilus influenzae Rd
ccauuugaauuuuac

SEQ ID NO: 2688432 - RNA, 22 nt, Haemophilus influenzae Rd
ccauuugaauuuuacuucuuca

SEQ ID NO: 2688433 - RNA, 19 nt, Haemophilus influenzae Rd
ccauuuucgcaucaaucac

SEQ ID NO: 2688434 - RNA, 20 nt, Haemophilus influenzae Rd
ccauuuucucugcgauuucu

SEQ ID NO: 2688435 - RNA, 16 nt, Haemophilus influenzae Rd
ccauuuucuuguucuc

SEQ ID NO: 2688436 - RNA, 14 nt, Haemophilus influenzae Rd
ccauuuugaacaag

SEQ ID NO: 2688437 - RNA, 20 nt, Haemophilus influenzae Rd
ccauuuugauugcuacagca

SEQ ID NO: 2688438 - RNA, 11 nt, Haemophilus influenzae Rd
ccauuuugcuc

SEQ ID NO: 2688439 - RNA, 21 nt, Haemophilus influenzae Rd
ccauuuugcucaaaacgaguu

SEQ ID NO: 2688440 - RNA, 20 nt, Haemophilus influenzae Rd
ccauuuuuaaaaauaacaua

SEQ ID NO: 2688441 - RNA, 22 nt, Haemophilus influenzae Rd
ccauuuuuaaguucuacccauu

SEQ ID NO: 2688442 - RNA, 11 nt, Haemophilus influenzae Rd
ccauuuuucaa

SEQ ID NO: 2688443 - RNA, 15 nt, Haemophilus influenzae Rd
ccauuuuucaaaauu

SEQ ID NO: 2688444 - RNA, 14 nt, Haemophilus influenzae Rd
ccauuuuuccagca

SEQ ID NO: 2688445 - RNA, 21 nt, Haemophilus influenzae Rd
ccauuuuuuggaguuguuuaa

SEQ ID NO: 2688446 - RNA, 14 nt, Haemophilus influenzae Rd
ccauuuuuuuugca

SEQ ID NO: 2688447 - RNA, 16 nt, Haemophilus influenzae Rd
cccaaaacaguaauga

SEQ ID NO: 2688448 - RNA, 19 nt, Haemophilus influenzae Rd
cccaaaagcugccaucuga

SEQ ID NO: 2688449 - RNA, 11 nt, Haemophilus influenzae Rd
cccaaauaaag

SEQ ID NO: 2688450 - RNA, 23 nt, Haemophilus influenzae Rd
cccaaauuguugccgccaaucca

SEQ ID NO: 2688451 - RNA, 14 nt, Haemophilus influenzae Rd
cccaaauuuauaau

SEQ ID NO: 2688452 - RNA, 20 nt, Haemophilus influenzae Rd
cccaacauuucacuaaauaa

SEQ ID NO: 2688453 - RNA, 16 nt, Haemophilus influenzae Rd
cccaagauucuaaaua

SEQ ID NO: 2688454 - RNA, 18 nt, Haemophilus influenzae Rd
cccaagauucuaaauauu

SEQ ID NO: 2688455 - RNA, 13 nt, Haemophilus influenzae Rd
cccaagauuuuau

SEQ ID NO: 2688456 - RNA, 18 nt, Haemophilus influenzae Rd
cccaagcuuuuucuuguu

SEQ ID NO: 2688457 - RNA, 12 nt, Haemophilus influenzae Rd
cccaaguugugc

SEQ ID NO: 2688458 - RNA, 12 nt, Haemophilus influenzae Rd
cccaaucacuag

SEQ ID NO: 2688459 - RNA, 20 nt, Haemophilus influenzae Rd
cccaauuagaugauuuuaaa

SEQ ID NO: 2688460 - RNA, 23 nt, Haemophilus influenzae Rd
cccaauuagcugguuuauuuauu

SEQ ID NO: 2688461 - RNA, 15 nt, Haemophilus influenzae Rd
cccaauuauuggauu

SEQ ID NO: 2688462 - RNA, 22 nt, Haemophilus influenzae Rd
cccaauucucugcaucguugcu

SEQ ID NO: 2688463 - RNA, 18 nt, Haemophilus influenzae Rd
cccaauuugcgccacaau

SEQ ID NO: 2688464 - RNA, 13 nt, Haemophilus influenzae Rd
cccacauagcuug

SEQ ID NO: 2688465 - RNA, 14 nt, Haemophilus influenzae Rd
cccaccgcaaaagc

SEQ ID NO: 2688466 - RNA, 15 nt, Haemophilus influenzae Rd
cccacugauuuuucu

SEQ ID NO: 2688467 - RNA, 19 nt, Haemophilus influenzae Rd
cccacuuaucuuaaaaaag

SEQ ID NO: 2688468 - RNA, 11 nt, Haemophilus influenzae Rd
cccagaauggu

SEQ ID NO: 2688469 - RNA, 19 nt, Haemophilus influenzae Rd
cccagaauuaagaucuaaa

SEQ ID NO: 2688470 - RNA, 17 nt, Haemophilus influenzae Rd
cccagcauaaauaaaua

SEQ ID NO: 2688471 - RNA, 23 nt, Haemophilus influenzae Rd
ccgcgcuuagcaauguuuucgcc

SEQ ID NO: 2688472 - RNA, 19 nt, Haemophilus influenzae Rd
ccgcuaaugcccacgucca

SEQ ID NO: 2688473 - RNA, 14 nt, Haemophilus influenzae Rd
ccgcuacaaauaag

SEQ ID NO: 2688474 - RNA, 15 nt, Haemophilus influenzae Rd
ccgcucgccaauaaa

SEQ ID NO: 2688475 - RNA, 22 nt, Haemophilus influenzae Rd
ccgcugcaacaaauaaaucaua

SEQ ID NO: 2688476 - RNA, 17 nt, Haemophilus influenzae Rd
ccgcugcagcuucagca

SEQ ID NO: 2688477 - RNA, 18 nt, Haemophilus influenzae Rd
ccgcugcagcuucagcaa

SEQ ID NO: 2688478 - RNA, 16 nt, Haemophilus influenzae Rd
ccgcugccuugauuug

SEQ ID NO: 2688479 - RNA, 18 nt, Haemophilus influenzae Rd
ccgcuggaaacaaaccac

SEQ ID NO: 2688480 - RNA, 21 nt, Haemophilus influenzae Rd
ccgcuucaaucgcaacacguu

SEQ ID NO: 2688481 - RNA, 20 nt, Haemophilus influenzae Rd
ccgcuucuuucgcagccacu

SEQ ID NO: 2688482 - RNA, 13 nt, Haemophilus influenzae Rd
ccgcuugcaacca

SEQ ID NO: 2688483 - RNA, 22 nt, Haemophilus influenzae Rd
ccgcuuguaauuucauuuuaac

SEQ ID NO: 2688484 - RNA, 15 nt, Haemophilus influenzae Rd
ccgguugugcaguau

SEQ ID NO: 2688485 - RNA, 17 nt, Haemophilus influenzae Rd
ccguaaccgcccagcau

SEQ ID NO: 2688486 - RNA, 19 nt, Haemophilus influenzae Rd
ccguaaugcuuuauuuaaa

SEQ ID NO: 2688487 - RNA, 14 nt, Haemophilus influenzae Rd
ccguagcacuggca

SEQ ID NO: 2688488 - RNA, 23 nt, Haemophilus influenzae Rd
ccguagccguuuugcguugcggu

SEQ ID NO: 2688489 - RNA, 19 nt, Haemophilus influenzae Rd
ccguaucaacuaaaucauc

SEQ ID NO: 2688490 - RNA, 15 nt, Haemophilus influenzae Rd
ccguauugaauaauu

SEQ ID NO: 2688491 - RNA, 11 nt, Haemophilus influenzae Rd
ccguauuuuca

SEQ ID NO: 2688492 - RNA, 18 nt, Haemophilus influenzae Rd
ccgucagccaaauuuuuc

SEQ ID NO: 2688493 - RNA, 23 nt, Haemophilus influenzae Rd
ccgucgcccaaguaucuaccaug

SEQ ID NO: 2688494 - RNA, 16 nt, Haemophilus influenzae Rd
ccgucuaaaaauccug

SEQ ID NO: 2688495 - RNA, 20 nt, Haemophilus influenzae Rd
ccgucuaaaaauccugaaga

SEQ ID NO: 2688496 - RNA, 13 nt, Haemophilus influenzae Rd
ccgucuuuaaaua

SEQ ID NO: 2688497 - RNA, 14 nt, Haemophilus influenzae Rd
ccgucuuuaaauag

SEQ ID NO: 2688498 - RNA, 21 nt, Haemophilus influenzae Rd
ccgugauaacaacucacaaua

SEQ ID NO: 2688499 - RNA, 14 nt, Haemophilus influenzae Rd
ccgugccaaagcau

SEQ ID NO: 2688500 - RNA, 15 nt, Haemophilus influenzae Rd
ccgugcucaauuucu

SEQ ID NO: 2688501 - RNA, 19 nt, Haemophilus influenzae Rd
ccgugggugugaaauauuc

SEQ ID NO: 2688502 - RNA, 13 nt, Haemophilus influenzae Rd
ccguguuuuucac

SEQ ID NO: 2688503 - RNA, 19 nt, Haemophilus influenzae Rd
ccguguuuuucaucaaugc

SEQ ID NO: 2688504 - RNA, 14 nt, Haemophilus influenzae Rd
ccguucuuaucuac

SEQ ID NO: 2688505 - RNA, 21 nt, Haemophilus influenzae Rd
ccguuguguuucaacaaaaau

SEQ ID NO: 2688506 - RNA, 23 nt, Haemophilus influenzae Rd
ccguuuucuacugaaccauagaa

SEQ ID NO: 2688507 - RNA, 14 nt, Haemophilus influenzae Rd
ccguuuucuacuuc

SEQ ID NO: 2688508 - RNA, 15 nt, Haemophilus influenzae Rd
ccguuuuuauuuguu

SEQ ID NO: 2688509 - RNA, 18 nt, Haemophilus influenzae Rd
ccguuuuuucuuuuuccu

SEQ ID NO: 2688510 - RNA, 19 nt, Haemophilus influenzae Rd
ccguuuuuucuuuuuccug

SEQ ID NO: 2688511 - RNA, 19 nt, Haemophilus influenzae Rd
ccuaaaaauuuuaggugcu

SEQ ID NO: 2688512 - RNA, 15 nt, Haemophilus influenzae Rd
ccuaaaauacaaaua

SEQ ID NO: 2688513 - RNA, 13 nt, Haemophilus influenzae Rd
ccuaaaauagagc

SEQ ID NO: 2688514 - RNA, 23 nt, Haemophilus influenzae Rd
ccuaaaauugauuucauauauug

SEQ ID NO: 2688515 - RNA, 19 nt, Haemophilus influenzae Rd
ccuaaacguaacaacgcac

SEQ ID NO: 2688516 - RNA, 17 nt, Haemophilus influenzae Rd
ccuaaauauuuauacac

SEQ ID NO: 2688517 - RNA, 15 nt, Haemophilus influenzae Rd
ccuaaaucuucuuua

SEQ ID NO: 2688518 - RNA, 18 nt, Haemophilus influenzae Rd
ccuaaaucuucuuuacca

SEQ ID NO: 2688519 - RNA, 16 nt, Haemophilus influenzae Rd
ccuaaaucuuuaucaa

SEQ ID NO: 2688520 - RNA, 23 nt, Haemophilus influenzae Rd
ccuaaauuaugcuccauugcaau

SEQ ID NO: 2688521 - RNA, 15 nt, Haemophilus influenzae Rd
ccuaaccaagccaaa

SEQ ID NO: 2688522 - RNA, 15 nt, Haemophilus influenzae Rd
ccuaagauuuuaucu

SEQ ID NO: 2688523 - RNA, 20 nt, Haemophilus influenzae Rd
ccuaagcacaaagaaaaacu

SEQ ID NO: 2688524 - RNA, 22 nt, Haemophilus influenzae Rd
ccuaagcacaaagaaaaacuaa

SEQ ID NO: 2688525 - RNA, 14 nt, Haemophilus influenzae Rd
ccuaauaaaaaaua

SEQ ID NO: 2688526 - RNA, 13 nt, Haemophilus influenzae Rd
ccuaauagaaaaa

SEQ ID NO: 2688527 - RNA, 14 nt, Haemophilus influenzae Rd
ccuaauagaaaaau

SEQ ID NO: 2688528 - RNA, 21 nt, Haemophilus influenzae Rd
ccuaauauugcaccauaacuu

SEQ ID NO: 2688529 - RNA, 12 nt, Haemophilus influenzae Rd
ccuaaucccaua

SEQ ID NO: 2688530 - RNA, 12 nt, Haemophilus influenzae Rd
ccuaaugauuaa

SEQ ID NO: 2688531 - RNA, 13 nt, Haemophilus influenzae Rd
ccuaaugauuaau

SEQ ID NO: 2688532 - RNA, 21 nt, Haemophilus influenzae Rd
ccuaaugcaguaacuucugcu

SEQ ID NO: 2688533 - RNA, 21 nt, Haemophilus influenzae Rd
ccuaauggauauagaaaucau

SEQ ID NO: 2688534 - RNA, 12 nt, Haemophilus influenzae Rd
ccuaauucaaua

SEQ ID NO: 2688535 - RNA, 13 nt, Haemophilus influenzae Rd
ccuaauucaucuu

SEQ ID NO: 2688536 - RNA, 18 nt, Haemophilus influenzae Rd
ccuaauucaucuucuuua

SEQ ID NO: 2688537 - RNA, 17 nt, Haemophilus influenzae Rd
ccuaauuggaaaaguaa

SEQ ID NO: 2688538 - RNA, 14 nt, Haemophilus influenzae Rd
ccuaauuucauaaa

SEQ ID NO: 2688539 - RNA, 18 nt, Haemophilus influenzae Rd
ccuacaacuaaucccacu

SEQ ID NO: 2688540 - RNA, 19 nt, Haemophilus influenzae Rd
ccuacaggcuuccaacaaa

SEQ ID NO: 2688541 - RNA, 20 nt, Haemophilus influenzae Rd
ccuacaucgccuugcauaau

SEQ ID NO: 2688542 - RNA, 16 nt, Haemophilus influenzae Rd
ccuaccggacuugaac

SEQ ID NO: 2688543 - RNA, 15 nt, Haemophilus influenzae Rd
ccuacuuuuuauuuu

SEQ ID NO: 2688544 - RNA, 18 nt, Haemophilus influenzae Rd
ccuacuuuuuauuuuuga

SEQ ID NO: 2688545 - RNA, 14 nt, Haemophilus influenzae Rd
ccuagaguaaguaa

SEQ ID NO: 2688546 - RNA, 18 nt, Haemophilus influenzae Rd
ccuagauugcuuugagcc

SEQ ID NO: 2688547 - RNA, 17 nt, Haemophilus influenzae Rd
ccuagcagcaauagaua

SEQ ID NO: 2688548 - RNA, 20 nt, Haemophilus influenzae Rd
ccuagcgcuguuacuucuuu

SEQ ID NO: 2688549 - RNA, 14 nt, Haemophilus influenzae Rd
ccuaguauuuuugu

SEQ ID NO: 2688550 - RNA, 22 nt, Haemophilus influenzae Rd
ccuagugcaaccacacaagcac

SEQ ID NO: 2688551 - RNA, 13 nt, Haemophilus influenzae Rd
ccuauaaauaaac

SEQ ID NO: 2688552 - RNA, 11 nt, Haemophilus influenzae Rd
ccuauaauagc

SEQ ID NO: 2688553 - RNA, 19 nt, Haemophilus influenzae Rd
ccuauaauuaaaguuacuu

SEQ ID NO: 2688554 - RNA, 18 nt, Haemophilus influenzae Rd
ccuauacuccacuauaaa

SEQ ID NO: 2688555 - RNA, 13 nt, Haemophilus influenzae Rd
ccuauagcccaac

SEQ ID NO: 2688556 - RNA, 13 nt, Haemophilus influenzae Rd
ccuaugaauaagc

SEQ ID NO: 2688557 - RNA, 18 nt, Haemophilus influenzae Rd
ccuaugauuauagauuua

SEQ ID NO: 2688558 - RNA, 15 nt, Haemophilus influenzae Rd
ccuauuaauuuaauu

SEQ ID NO: 2688559 - RNA, 14 nt, Haemophilus influenzae Rd
ccuauuacuuucca

SEQ ID NO: 2688560 - RNA, 23 nt, Haemophilus influenzae Rd
ccuauuagacuuaauuucacauu

SEQ ID NO: 2688561 - RNA, 15 nt, Haemophilus influenzae Rd
ccuauucuaaauuua

SEQ ID NO: 2688562 - RNA, 16 nt, Haemophilus influenzae Rd
ccuauucuaaauuuau

SEQ ID NO: 2688563 - RNA, 15 nt, Haemophilus influenzae Rd
ccuauuuacguaaaa

SEQ ID NO: 2688564 - RNA, 14 nt, Haemophilus influenzae Rd
ccucaacaucaaaa

SEQ ID NO: 2688565 - RNA, 18 nt, Haemophilus influenzae Rd
ccucaaguuuguggagua

SEQ ID NO: 2688566 - RNA, 21 nt, Haemophilus influenzae Rd
ccucaauguucgauuuuacuu

SEQ ID NO: 2688567 - RNA, 16 nt, Haemophilus influenzae Rd
ccucagaagaaauuaa

SEQ ID NO: 2688568 - RNA, 13 nt, Haemophilus influenzae Rd
ccucagagauaau

SEQ ID NO: 2688569 - RNA, 20 nt, Haemophilus influenzae Rd
ccucagauaaucuacaaaac

SEQ ID NO: 2688570 - RNA, 14 nt, Haemophilus influenzae Rd
ccucagauaaugau

SEQ ID NO: 2688571 - RNA, 15 nt, Haemophilus influenzae Rd
ccucaggaacaucac

SEQ ID NO: 2688572 - RNA, 15 nt, Haemophilus influenzae Rd
ccucagguauuucuu

SEQ ID NO: 2688573 - RNA, 12 nt, Haemophilus influenzae Rd
ccuccauuaguu

SEQ ID NO: 2688574 - RNA, 18 nt, Haemophilus influenzae Rd
ccuccgccaagugcgguu

SEQ ID NO: 2688575 - RNA, 19 nt, Haemophilus influenzae Rd
ccuccuaaugcagcagcuu

SEQ ID NO: 2688576 - RNA, 20 nt, Haemophilus influenzae Rd
ccucgaauagcaauaucugc

SEQ ID NO: 2688577 - RNA, 16 nt, Haemophilus influenzae Rd
ccuuucuguaaauaug

SEQ ID NO: 2688578 - RNA, 18 nt, Haemophilus influenzae Rd
ccuuugcugacaauuucu

SEQ ID NO: 2688579 - RNA, 22 nt, Haemophilus influenzae Rd
ccuuuguugucguuauuaugaa

SEQ ID NO: 2688580 - RNA, 14 nt, Haemophilus influenzae Rd
ccuuuuaauaaauu

SEQ ID NO: 2688581 - RNA, 15 nt, Haemophilus influenzae Rd
ccuuuuaauaaauug

SEQ ID NO: 2688582 - RNA, 22 nt, Haemophilus influenzae Rd
ccuuuuaguucguuuuuuagcu

SEQ ID NO: 2688583 - RNA, 16 nt, Haemophilus influenzae Rd
ccuuuuauuucuuaga

SEQ ID NO: 2688584 - RNA, 19 nt, Haemophilus influenzae Rd
ccuuuucauaaaaauugau

SEQ ID NO: 2688585 - RNA, 20 nt, Haemophilus influenzae Rd
ccuuuugcauuauugaacca

SEQ ID NO: 2688586 - RNA, 18 nt, Haemophilus influenzae Rd
ccuuuugccuaaaaccug

SEQ ID NO: 2688587 - RNA, 22 nt, Haemophilus influenzae Rd
ccuuuuucauauucccaaggcu

SEQ ID NO: 2688588 - RNA, 13 nt, Haemophilus influenzae Rd
ccuuuuucuucuu

SEQ ID NO: 2688589 - RNA, 22 nt, Haemophilus influenzae Rd
ccuuuuuguuguauaagauuaa

SEQ ID NO: 2688590 - RNA, 23 nt, Haemophilus influenzae Rd
ccuuuuuguuguauaagauuaau

SEQ ID NO: 2688591 - RNA, 21 nt, Haemophilus influenzae Rd
ccuuuuuuuagaauuaaauuu

SEQ ID NO: 2688592 - RNA, 14 nt, Haemophilus influenzae Rd
cgaaaaaacaagag

SEQ ID NO: 2688593 - RNA, 22 nt, Haemophilus influenzae Rd
cgaaaaaacgcggucuaaauag

SEQ ID NO: 2688594 - RNA, 20 nt, Haemophilus influenzae Rd
cgaaaaaagagguuauauua

SEQ ID NO: 2688595 - RNA, 21 nt, Haemophilus influenzae Rd
cgaaaauaacuucauccauuu

SEQ ID NO: 2688596 - RNA, 22 nt, Haemophilus influenzae Rd
cgaaaaucacgcucuuuuaucu

SEQ ID NO: 2688597 - RNA, 17 nt, Haemophilus influenzae Rd
cgaaaauggcuaaauuc

SEQ ID NO: 2688598 - RNA, 14 nt, Haemophilus influenzae Rd
cgaaaauuaagaaa

SEQ ID NO: 2688599 - RNA, 16 nt, Haemophilus influenzae Rd
cgaaacuugagauuuu

SEQ ID NO: 2688600 - RNA, 18 nt, Haemophilus influenzae Rd
cgaaagcuucauugcuaa

SEQ ID NO: 2688601 - RNA, 22 nt, Haemophilus influenzae Rd
cgaaaggcgagggauuuuaaau

SEQ ID NO: 2688602 - RNA, 18 nt, Haemophilus influenzae Rd
cgaaaggcuacuuuauuu

SEQ ID NO: 2688603 - RNA, 23 nt, Haemophilus influenzae Rd
cgaaauaucgcccuuauuuugug

SEQ ID NO: 2688604 - RNA, 20 nt, Haemophilus influenzae Rd
cgaaaugcggacuuuuucau

SEQ ID NO: 2688605 - RNA, 20 nt, Haemophilus influenzae Rd
cgaaauuaaaauaauaucca

SEQ ID NO: 2688606 - RNA, 22 nt, Haemophilus influenzae Rd
cgaaauuaaaugggacaaagca

SEQ ID NO: 2688607 - RNA, 15 nt, Haemophilus influenzae Rd
cgaaauuuuucgcaa

SEQ ID NO: 2688608 - RNA, 18 nt, Haemophilus influenzae Rd
cgaacagccgcaauggcg

SEQ ID NO: 2688609 - RNA, 19 nt, Haemophilus influenzae Rd
cgaacaucguggucaccaa

SEQ ID NO: 2688610 - RNA, 14 nt, Haemophilus influenzae Rd
cgaaccgagcuaca

SEQ ID NO: 2688611 - RNA, 21 nt, Haemophilus influenzae Rd
cgaaccugauaaguagaaaaa

SEQ ID NO: 2688612 - RNA, 17 nt, Haemophilus influenzae Rd
cgaaccuuucauauaaa

SEQ ID NO: 2688613 - RNA, 17 nt, Haemophilus influenzae Rd
cgaacgugggaauuuuc

SEQ ID NO: 2688614 - RNA, 20 nt, Haemophilus influenzae Rd
cgaacguuucaucacuucaa

SEQ ID NO: 2688615 - RNA, 13 nt, Haemophilus influenzae Rd
cgaacuaauaagc

SEQ ID NO: 2688616 - RNA, 14 nt, Haemophilus influenzae Rd
cgaagaauccacau

SEQ ID NO: 2688617 - RNA, 17 nt, Haemophilus influenzae Rd
cgaagccuaaaucuucu

SEQ ID NO: 2688618 - RNA, 20 nt, Haemophilus influenzae Rd
cgaagccuaaaucuucuuua

SEQ ID NO: 2688619 - RNA, 18 nt, Haemophilus influenzae Rd
cgaagcgcauuuaaauaa

SEQ ID NO: 2688620 - RNA, 22 nt, Haemophilus influenzae Rd
cgaagcucgucuaaaucuuucc

SEQ ID NO: 2688621 - RNA, 23 nt, Haemophilus influenzae Rd
cgaaggcaaaucaccuucaagua

SEQ ID NO: 2688622 - RNA, 20 nt, Haemophilus influenzae Rd
cgaagugaauaauguuuuca

SEQ ID NO: 2688623 - RNA, 21 nt, Haemophilus influenzae Rd
cgaauaaaugcaucauuaaua

SEQ ID NO: 2688624 - RNA, 16 nt, Haemophilus influenzae Rd
cgaauagauuuaaaca

SEQ ID NO: 2688625 - RNA, 16 nt, Haemophilus influenzae Rd
cgaauagccaaaacga

SEQ ID NO: 2688626 - RNA, 18 nt, Haemophilus influenzae Rd
cgaauaggcgaucugcua

SEQ ID NO: 2688627 - RNA, 16 nt, Haemophilus influenzae Rd
cgaauaucgacuaaua

SEQ ID NO: 2688628 - RNA, 12 nt, Haemophilus influenzae Rd
cgaaucaaaauc

SEQ ID NO: 2688629 - RNA, 13 nt, Haemophilus influenzae Rd
cgaaucaaaaucu

SEQ ID NO: 2688630 - RNA, 14 nt, Haemophilus influenzae Rd
cgaauccaaugccu

SEQ ID NO: 2688631 - RNA, 23 nt, Haemophilus influenzae Rd
cgaaugguaacauucauauuggu

SEQ ID NO: 2688632 - RNA, 16 nt, Haemophilus influenzae Rd
cgaauguggcagcaaa

SEQ ID NO: 2688633 - RNA, 17 nt, Haemophilus influenzae Rd
cgaauguggcagcaaag

SEQ ID NO: 2688634 - RNA, 22 nt, Haemophilus influenzae Rd
cgaauguggcagcaaaguuggc

SEQ ID NO: 2688635 - RNA, 21 nt, Haemophilus influenzae Rd
cgaauguuugaucgguuuuau

SEQ ID NO: 2688636 - RNA, 14 nt, Haemophilus influenzae Rd
cgaauuacaucauu

SEQ ID NO: 2688637 - RNA, 21 nt, Haemophilus influenzae Rd
cgaauuagguugaauuuuugu

SEQ ID NO: 2688638 - RNA, 17 nt, Haemophilus influenzae Rd
cgaauugcaucguuuac

SEQ ID NO: 2688639 - RNA, 20 nt, Haemophilus influenzae Rd
cgaauugcaucguuuacauc

SEQ ID NO: 2688640 - RNA, 19 nt, Haemophilus influenzae Rd
cgaauugcgguuucaguuu

SEQ ID NO: 2688641 - RNA, 20 nt, Haemophilus influenzae Rd
cgaauuugugagguuuugag

SEQ ID NO: 2688642 - RNA, 11 nt, Haemophilus influenzae Rd
cgaauuuuuau

SEQ ID NO: 2688643 - RNA, 22 nt, Haemophilus influenzae Rd
cgacaaauuaauaagaaaauca

SEQ ID NO: 2688644 - RNA, 14 nt, Haemophilus influenzae Rd
cgacaacacuugcu

SEQ ID NO: 2688645 - RNA, 17 nt, Haemophilus influenzae Rd
cgacaaugcguaauucu

SEQ ID NO: 2688646 - RNA, 19 nt, Haemophilus influenzae Rd
cgacacuaaaaagcccaaa

SEQ ID NO: 2688647 - RNA, 19 nt, Haemophilus influenzae Rd
cgacaucaaucaaauucaa

SEQ ID NO: 2688648 - RNA, 16 nt, Haemophilus influenzae Rd
cgacaucugguuuugu

SEQ ID NO: 2688649 - RNA, 21 nt, Haemophilus influenzae Rd
cgacaucugguuuugugagua

SEQ ID NO: 2688650 - RNA, 18 nt, Haemophilus influenzae Rd
cgacauucgcauauuuuu

SEQ ID NO: 2688651 - RNA, 22 nt, Haemophilus influenzae Rd
cgacauuuugucgccuuagaua

SEQ ID NO: 2688652 - RNA, 16 nt, Haemophilus influenzae Rd
cgaccaauauugaaaa

SEQ ID NO: 2688653 - RNA, 18 nt, Haemophilus influenzae Rd
cgaccaauauugaaaagu

SEQ ID NO: 2688654 - RNA, 19 nt, Haemophilus influenzae Rd
cgaccauuaaauccugaca

SEQ ID NO: 2688655 - RNA, 15 nt, Haemophilus influenzae Rd
cgaccauuacagcaa

SEQ ID NO: 2688656 - RNA, 20 nt, Haemophilus influenzae Rd
cgaccauuggggcgaccauu

SEQ ID NO: 2688657 - RNA, 18 nt, Haemophilus influenzae Rd
cgaccucgccauuuuuca

SEQ ID NO: 2688658 - RNA, 20 nt, Haemophilus influenzae Rd
cgacgauuuaauagcacaga

SEQ ID NO: 2688659 - RNA, 13 nt, Haemophilus influenzae Rd
cgacgugcuucaa

SEQ ID NO: 2688660 - RNA, 18 nt, Haemophilus influenzae Rd
cgacucaccgcaauaaua

SEQ ID NO: 2688661 - RNA, 15 nt, Haemophilus influenzae Rd
cgacucguccaucaa

SEQ ID NO: 2688662 - RNA, 15 nt, Haemophilus influenzae Rd
cgacugcucacgccg

SEQ ID NO: 2688663 - RNA, 13 nt, Haemophilus influenzae Rd
cgacuuuauauug

SEQ ID NO: 2688664 - RNA, 17 nt, Haemophilus influenzae Rd
cgacuuuguccaaaaau

SEQ ID NO: 2688665 - RNA, 22 nt, Haemophilus influenzae Rd
cgagaaagguguaauuccauau

SEQ ID NO: 2688666 - RNA, 14 nt, Haemophilus influenzae Rd
cgagacauuauuuu

SEQ ID NO: 2688667 - RNA, 23 nt, Haemophilus influenzae Rd
cgagacauuauuuuuacaaauag

SEQ ID NO: 2688668 - RNA, 19 nt, Haemophilus influenzae Rd
cgagaucuucuucauccac

SEQ ID NO: 2688669 - RNA, 15 nt, Haemophilus influenzae Rd
cgagaugcauuuuuu

SEQ ID NO: 2688670 - RNA, 18 nt, Haemophilus influenzae Rd
cgagauuucuuugaugaa

SEQ ID NO: 2688671 - RNA, 18 nt, Haemophilus influenzae Rd
cgagcaacuuggaaugca

SEQ ID NO: 2688672 - RNA, 12 nt, Haemophilus influenzae Rd
cgagcauauuuu

SEQ ID NO: 2688673 - RNA, 20 nt, Haemophilus influenzae Rd
cgagcuuucaugauuaacaa

SEQ ID NO: 2688674 - RNA, 17 nt, Haemophilus influenzae Rd
cgaggacaaucugcugu

SEQ ID NO: 2688675 - RNA, 22 nt, Haemophilus influenzae Rd
cgaggauuugcgaugauaaagu

SEQ ID NO: 2688676 - RNA, 15 nt, Haemophilus influenzae Rd
cgagggauuuuaaau

SEQ ID NO: 2688677 - RNA, 16 nt, Haemophilus influenzae Rd
cgagggauuuuaaauc

SEQ ID NO: 2688678 - RNA, 16 nt, Haemophilus influenzae Rd
cgagggucaaaagaaa

SEQ ID NO: 2688679 - RNA, 18 nt, Haemophilus influenzae Rd
cgagggucaaaagaaaga

SEQ ID NO: 2688680 - RNA, 13 nt, Haemophilus influenzae Rd
cgaguaaaauaaa

SEQ ID NO: 2688681 - RNA, 16 nt, Haemophilus influenzae Rd
cgaguaaucuaauucu

SEQ ID NO: 2688682 - RNA, 21 nt, Haemophilus influenzae Rd
cgcagcaucugccacuucuug

SEQ ID NO: 2688683 - RNA, 21 nt, Haemophilus influenzae Rd
cgcagccuuguucugcagcaa

SEQ ID NO: 2688684 - RNA, 16 nt, Haemophilus influenzae Rd
cgcagcgugaccugcg

SEQ ID NO: 2688685 - RNA, 13 nt, Haemophilus influenzae Rd
cgcagcugggcug

SEQ ID NO: 2688686 - RNA, 16 nt, Haemophilus influenzae Rd
cgcaggugucacagca

SEQ ID NO: 2688687 - RNA, 14 nt, Haemophilus influenzae Rd
cgcaguuaaaacug

SEQ ID NO: 2688688 - RNA, 14 nt, Haemophilus influenzae Rd
cgcauaaaaauucc

SEQ ID NO: 2688689 - RNA, 15 nt, Haemophilus influenzae Rd
cgcauaaauaauaaa

SEQ ID NO: 2688690 - RNA, 20 nt, Haemophilus influenzae Rd
cgcauaauacuugacaacgc

SEQ ID NO: 2688691 - RNA, 22 nt, Haemophilus influenzae Rd
cgcauacguaauacuuuugcuu

SEQ ID NO: 2688692 - RNA, 22 nt, Haemophilus influenzae Rd
cgcaucauucaaugcaacaaua

SEQ ID NO: 2688693 - RNA, 15 nt, Haemophilus influenzae Rd
cgcaucgucuuuacc

SEQ ID NO: 2688694 - RNA, 15 nt, Haemophilus influenzae Rd
cgcauucuucuuuua

SEQ ID NO: 2688695 - RNA, 22 nt, Haemophilus influenzae Rd
cgcauuguaaaccaaauuucuu

SEQ ID NO: 2688696 - RNA, 14 nt, Haemophilus influenzae Rd
cgcauuuaaauaaa

SEQ ID NO: 2688697 - RNA, 22 nt, Haemophilus influenzae Rd
cgcauuuaaauaaaauaacaaa

SEQ ID NO: 2688698 - RNA, 17 nt, Haemophilus influenzae Rd
cgcauuuuacagauuuu

SEQ ID NO: 2688699 - RNA, 16 nt, Haemophilus influenzae Rd
cgcauuuuuuauuuuu

SEQ ID NO: 2688700 - RNA, 20 nt, Haemophilus influenzae Rd
cgccaaucuaagccuaagcc

SEQ ID NO: 2688701 - RNA, 19 nt, Haemophilus influenzae Rd
cgccaaugcuuuuaauuua

SEQ ID NO: 2688702 - RNA, 14 nt, Haemophilus influenzae Rd
cgccacaauauuua

SEQ ID NO: 2688703 - RNA, 17 nt, Haemophilus influenzae Rd
cgccacccacuaaugcg

SEQ ID NO: 2688704 - RNA, 16 nt, Haemophilus influenzae Rd
cgccaccuuuuguaga

SEQ ID NO: 2688705 - RNA, 17 nt, Haemophilus influenzae Rd
cgccacguagauacaua

SEQ ID NO: 2688706 - RNA, 23 nt, Haemophilus influenzae Rd
cgccacguagauacauaacgcca

SEQ ID NO: 2688707 - RNA, 20 nt, Haemophilus influenzae Rd
cgccagaaguuguuuuucuu

SEQ ID NO: 2688708 - RNA, 13 nt, Haemophilus influenzae Rd
cgccagcaccacg

SEQ ID NO: 2688709 - RNA, 16 nt, Haemophilus influenzae Rd
cgccauaaacgcacca

SEQ ID NO: 2688710 - RNA, 19 nt, Haemophilus influenzae Rd
cgccaucaaccauaacaag

SEQ ID NO: 2688711 - RNA, 12 nt, Haemophilus influenzae Rd
cgccaucuaaug

SEQ ID NO: 2688712 - RNA, 13 nt, Haemophilus influenzae Rd
cgccaugccaagc

SEQ ID NO: 2688713 - RNA, 17 nt, Haemophilus influenzae Rd
cgccauuggauacauaa

SEQ ID NO: 2688714 - RNA, 12 nt, Haemophilus influenzae Rd
cgccauuuuuaa

SEQ ID NO: 2688715 - RNA, 12 nt, Haemophilus influenzae Rd
cgcccaagguua

SEQ ID NO: 2688716 - RNA, 20 nt, Haemophilus influenzae Rd
cgcccagagcaccaaauuaa

SEQ ID NO: 2688717 - RNA, 21 nt, Haemophilus influenzae Rd
cgcccccccagcgaccaccaa

SEQ ID NO: 2688718 - RNA, 23 nt, Haemophilus influenzae Rd
cgcccuacgccuaauucaucuuc

SEQ ID NO: 2688719 - RNA, 19 nt, Haemophilus influenzae Rd
cgcccuuuauuuuguuaaa

SEQ ID NO: 2688720 - RNA, 15 nt, Haemophilus influenzae Rd
cgccgugauaacaac

SEQ ID NO: 2688721 - RNA, 19 nt, Haemophilus influenzae Rd
cgccguuaguuuguauuug

SEQ ID NO: 2688722 - RNA, 22 nt, Haemophilus influenzae Rd
cgccuaaacacauaauauuuuu

SEQ ID NO: 2688723 - RNA, 15 nt, Haemophilus influenzae Rd
cgccuaaugcauuga

SEQ ID NO: 2688724 - RNA, 16 nt, Haemophilus influenzae Rd
cgccuaauucaucuuc

SEQ ID NO: 2688725 - RNA, 23 nt, Haemophilus influenzae Rd
cgccuaauugugaguguaaugcg

SEQ ID NO: 2688726 - RNA, 14 nt, Haemophilus influenzae Rd
cgccuaguccgcca

SEQ ID NO: 2688727 - RNA, 20 nt, Haemophilus influenzae Rd
cgccugcuaauggcugaucu

SEQ ID NO: 2688728 - RNA, 21 nt, Haemophilus influenzae Rd
cgccuguuaagccaacuugua

SEQ ID NO: 2688729 - RNA, 17 nt, Haemophilus influenzae Rd
cgccuuaaucauugcaa

SEQ ID NO: 2688730 - RNA, 20 nt, Haemophilus influenzae Rd
cgccuuagccuguucuucca

SEQ ID NO: 2688731 - RNA, 14 nt, Haemophilus influenzae Rd
cgccuuuuuggaaa

SEQ ID NO: 2688732 - RNA, 22 nt, Haemophilus influenzae Rd
cgccuuuuuggaaacgguuaau

SEQ ID NO: 2688733 - RNA, 14 nt, Haemophilus influenzae Rd
cgcgagauaaaauu

SEQ ID NO: 2688734 - RNA, 17 nt, Haemophilus influenzae Rd
cgcgagcacguacaacg

SEQ ID NO: 2688735 - RNA, 16 nt, Haemophilus influenzae Rd
cgcgcccauucauuuu

SEQ ID NO: 2688736 - RNA, 11 nt, Haemophilus influenzae Rd
cgcgcggacgu

SEQ ID NO: 2688737 - RNA, 15 nt, Haemophilus influenzae Rd
cgcguaauaaauaag

SEQ ID NO: 2688738 - RNA, 18 nt, Haemophilus influenzae Rd
cgcguaauaaauaagggc

SEQ ID NO: 2688739 - RNA, 19 nt, Haemophilus influenzae Rd
cgcgugguauucuuuccac

SEQ ID NO: 2688740 - RNA, 21 nt, Haemophilus influenzae Rd
cgcuaaauaagcugaaccauu

SEQ ID NO: 2688741 - RNA, 12 nt, Haemophilus influenzae Rd
cgcuaaaucaua

SEQ ID NO: 2688742 - RNA, 15 nt, Haemophilus influenzae Rd
cgcuaacauaucaau

SEQ ID NO: 2688743 - RNA, 16 nt, Haemophilus influenzae Rd
cgcuaauuuuuuuucu

SEQ ID NO: 2688744 - RNA, 15 nt, Haemophilus influenzae Rd
cgcuauguuuaaaua

SEQ ID NO: 2688745 - RNA, 13 nt, Haemophilus influenzae Rd
cgcuauuuuuaau

SEQ ID NO: 2688746 - RNA, 16 nt, Haemophilus influenzae Rd
cgcuccucugcauucu

SEQ ID NO: 2688747 - RNA, 19 nt, Haemophilus influenzae Rd
cgcucuaacaauauuucac

SEQ ID NO: 2688748 - RNA, 13 nt, Haemophilus influenzae Rd
cgcugaauuauug

SEQ ID NO: 2688749 - RNA, 19 nt, Haemophilus influenzae Rd
cgcugaauuauugucuuuu

SEQ ID NO: 2688750 - RNA, 21 nt, Haemophilus influenzae Rd
cgcugauaaacgccuuuuaaa

SEQ ID NO: 2688751 - RNA, 13 nt, Haemophilus influenzae Rd
cgcugcaaaauca

SEQ ID NO: 2688752 - RNA, 12 nt, Haemophilus influenzae Rd
cgcugcaacaaa

SEQ ID NO: 2688753 - RNA, 15 nt, Haemophilus influenzae Rd
cgcugcaacaaauaa

SEQ ID NO: 2688754 - RNA, 13 nt, Haemophilus influenzae Rd
cgcugcagcuuca

SEQ ID NO: 2688755 - RNA, 15 nt, Haemophilus influenzae Rd
cgcugcucugugcca

SEQ ID NO: 2688756 - RNA, 22 nt, Haemophilus influenzae Rd
cgcuggauaaaugccgccacag

SEQ ID NO: 2688757 - RNA, 15 nt, Haemophilus influenzae Rd
cgcuggcauagcuuc

SEQ ID NO: 2688758 - RNA, 16 nt, Haemophilus influenzae Rd
cgcuggcggcaggcuu

SEQ ID NO: 2688759 - RNA, 15 nt, Haemophilus influenzae Rd
cgcuguuacuucuuu

SEQ ID NO: 2688760 - RNA, 12 nt, Haemophilus influenzae Rd
cgcuguuuugcu

SEQ ID NO: 2688761 - RNA, 22 nt, Haemophilus influenzae Rd
cgcuuaagucagcauaaacaaa

SEQ ID NO: 2688762 - RNA, 12 nt, Haemophilus influenzae Rd
cgcuucauuaaa

SEQ ID NO: 2688763 - RNA, 20 nt, Haemophilus influenzae Rd
cgcuucuuccuguuuaucag

SEQ ID NO: 2688764 - RNA, 13 nt, Haemophilus influenzae Rd
cgcuucuuuaacu

SEQ ID NO: 2688765 - RNA, 19 nt, Haemophilus influenzae Rd
cgcuucuuucgcagccacu

SEQ ID NO: 2688766 - RNA, 14 nt, Haemophilus influenzae Rd
cgcuugcaccaaug

SEQ ID NO: 2688767 - RNA, 19 nt, Haemophilus influenzae Rd
cgcuugcaccaaugcgagu

SEQ ID NO: 2688768 - RNA, 20 nt, Haemophilus influenzae Rd
cgcuugggcuuuuucaaucg

SEQ ID NO: 2688769 - RNA, 22 nt, Haemophilus influenzae Rd
cgcuuggucacugguucaaguc

SEQ ID NO: 2688770 - RNA, 20 nt, Haemophilus influenzae Rd
cgcuuguaauuucauuuuaa

SEQ ID NO: 2688771 - RNA, 17 nt, Haemophilus influenzae Rd
cgcuuguuugacugaau

SEQ ID NO: 2688772 - RNA, 17 nt, Haemophilus influenzae Rd
cgcuuuaacgagaauau

SEQ ID NO: 2688773 - RNA, 14 nt, Haemophilus influenzae Rd
cgcuuuaauagauu

SEQ ID NO: 2688774 - RNA, 17 nt, Haemophilus influenzae Rd
cgcuuuaucaaagaauu

SEQ ID NO: 2688775 - RNA, 14 nt, Haemophilus influenzae Rd
cgcuuuaucuucuu

SEQ ID NO: 2688776 - RNA, 12 nt, Haemophilus influenzae Rd
cgcuuucauaaa

SEQ ID NO: 2688777 - RNA, 13 nt, Haemophilus influenzae Rd
cgcuuugagaaag

SEQ ID NO: 2688778 - RNA, 18 nt, Haemophilus influenzae Rd
cgcuuugagaaagaauau

SEQ ID NO: 2688779 - RNA, 18 nt, Haemophilus influenzae Rd
cgcuuuucccucuuuuuc

SEQ ID NO: 2688780 - RNA, 18 nt, Haemophilus influenzae Rd
cgcuuuugccauauuuaa

SEQ ID NO: 2688781 - RNA, 20 nt, Haemophilus influenzae Rd
cgcuuuuuccucagcaaaag

SEQ ID NO: 2688782 - RNA, 15 nt, Haemophilus influenzae Rd
cggaaaccagcuuuc

SEQ ID NO: 2688783 - RNA, 22 nt, Haemophilus influenzae Rd
cggaaacuacggacuaaauaaa

SEQ ID NO: 2688784 - RNA, 12 nt, Haemophilus influenzae Rd
cggaaauauuuu

SEQ ID NO: 2688785 - RNA, 20 nt, Haemophilus influenzae Rd
cggaaauauuuuaauagaau

SEQ ID NO: 2688786 - RNA, 23 nt, Haemophilus influenzae Rd
cggaaaugaaaccaaauccuuuu

SEQ ID NO: 2688787 - RNA, 15 nt, Haemophilus influenzae Rd
cggaauagccgcgau

SEQ ID NO: 2688788 - RNA, 23 nt, Haemophilus influenzae Rd
cguacaacgugaaguaaauauuu

SEQ ID NO: 2688789 - RNA, 19 nt, Haemophilus influenzae Rd
cguacaauuucaaauaaac

SEQ ID NO: 2688790 - RNA, 18 nt, Haemophilus influenzae Rd
cguacacgcgcaaauuuu

SEQ ID NO: 2688791 - RNA, 18 nt, Haemophilus influenzae Rd
cguacaucgaaaacauaa

SEQ ID NO: 2688792 - RNA, 13 nt, Haemophilus influenzae Rd
cguacauuauuaa

SEQ ID NO: 2688793 - RNA, 17 nt, Haemophilus influenzae Rd
cguagaaaacaauaaaa

SEQ ID NO: 2688794 - RNA, 22 nt, Haemophilus influenzae Rd
cguagaaagaugggugguauca

SEQ ID NO: 2688795 - RNA, 16 nt, Haemophilus influenzae Rd
cguagaguuuuuucac

SEQ ID NO: 2688796 - RNA, 22 nt, Haemophilus influenzae Rd
cguagccuagugcuaaaauaaa

SEQ ID NO: 2688797 - RNA, 23 nt, Haemophilus influenzae Rd
cguagcguaaucacauagauuua

SEQ ID NO: 2688798 - RNA, 15 nt, Haemophilus influenzae Rd
cguaguaaauuuucc

SEQ ID NO: 2688799 - RNA, 15 nt, Haemophilus influenzae Rd
cguaguacaucauuu

SEQ ID NO: 2688800 - RNA, 16 nt, Haemophilus influenzae Rd
cguauaagcuaaagca

SEQ ID NO: 2688801 - RNA, 20 nt, Haemophilus influenzae Rd
cguauaagcuaaagcaauug

SEQ ID NO: 2688802 - RNA, 16 nt, Haemophilus influenzae Rd
cguauaauauuuucuu

SEQ ID NO: 2688803 - RNA, 21 nt, Haemophilus influenzae Rd
cguauaauauuuucuuuuauc

SEQ ID NO: 2688804 - RNA, 15 nt, Haemophilus influenzae Rd
cguauagcgugcuuu

SEQ ID NO: 2688805 - RNA, 18 nt, Haemophilus influenzae Rd
cguaucaacuaaaucauc

SEQ ID NO: 2688806 - RNA, 22 nt, Haemophilus influenzae Rd
cguaucaacuagugcuguugca

SEQ ID NO: 2688807 - RNA, 22 nt, Haemophilus influenzae Rd
cguauuaaaagugcggugauuu

SEQ ID NO: 2688808 - RNA, 14 nt, Haemophilus influenzae Rd
cguauugaauaauu

SEQ ID NO: 2688809 - RNA, 15 nt, Haemophilus influenzae Rd
cguauuuuuuacagu

SEQ ID NO: 2688810 - RNA, 15 nt, Haemophilus influenzae Rd
cguauuuuuuauuac

SEQ ID NO: 2688811 - RNA, 13 nt, Haemophilus influenzae Rd
cgucaaaaucauu

SEQ ID NO: 2688812 - RNA, 18 nt, Haemophilus influenzae Rd
cgucaaaauuaugcugau

SEQ ID NO: 2688813 - RNA, 12 nt, Haemophilus influenzae Rd
cgucaauauccc

SEQ ID NO: 2688814 - RNA, 18 nt, Haemophilus influenzae Rd
cgucaaucaucccuucuu

SEQ ID NO: 2688815 - RNA, 17 nt, Haemophilus influenzae Rd
cgucaauugcuaaaccu

SEQ ID NO: 2688816 - RNA, 17 nt, Haemophilus influenzae Rd
cgucaugccgcaaucaa

SEQ ID NO: 2688817 - RNA, 10 nt, Haemophilus influenzae Rd
cguccacaag

SEQ ID NO: 2688818 - RNA, 14 nt, Haemophilus influenzae Rd
cguccacuucaucg

SEQ ID NO: 2688819 - RNA, 17 nt, Haemophilus influenzae Rd
cguccaguuauaauaac

SEQ ID NO: 2688820 - RNA, 16 nt, Haemophilus influenzae Rd
cguccgcaaccagcag

SEQ ID NO: 2688821 - RNA, 16 nt, Haemophilus influenzae Rd
cguccuacuacagccc

SEQ ID NO: 2688822 - RNA, 11 nt, Haemophilus influenzae Rd
cgucuaaacgg

SEQ ID NO: 2688823 - RNA, 16 nt, Haemophilus influenzae Rd
cgucuaaaucuuucca

SEQ ID NO: 2688824 - RNA, 16 nt, Haemophilus influenzae Rd
cgucuugccauaguac

SEQ ID NO: 2688825 - RNA, 19 nt, Haemophilus influenzae Rd
cgugaaauuagacaaaaau

SEQ ID NO: 2688826 - RNA, 21 nt, Haemophilus influenzae Rd
cgugaauacgcggcggaacag

SEQ ID NO: 2688827 - RNA, 20 nt, Haemophilus influenzae Rd
cgugaauauauuauuaaguc

SEQ ID NO: 2688828 - RNA, 21 nt, Haemophilus influenzae Rd
cgugaaucguuuguaaaagua

SEQ ID NO: 2688829 - RNA, 15 nt, Haemophilus influenzae Rd
cgugaggucugcaau

SEQ ID NO: 2688830 - RNA, 18 nt, Haemophilus influenzae Rd
cgugaggucugcaauaau

SEQ ID NO: 2688831 - RNA, 14 nt, Haemophilus influenzae Rd
cgugaguaaaauau

SEQ ID NO: 2688832 - RNA, 19 nt, Haemophilus influenzae Rd
cgugauauuuuucacgccu

SEQ ID NO: 2688833 - RNA, 14 nt, Haemophilus influenzae Rd
cgugaucugcauca

SEQ ID NO: 2688834 - RNA, 18 nt, Haemophilus influenzae Rd
cgugauuccaaaaauucc

SEQ ID NO: 2688835 - RNA, 13 nt, Haemophilus influenzae Rd
cgugauuuaccaa

SEQ ID NO: 2688836 - RNA, 12 nt, Haemophilus influenzae Rd
cgugauuuuuuu

SEQ ID NO: 2688837 - RNA, 14 nt, Haemophilus influenzae Rd
cgugcaaauaaauu

SEQ ID NO: 2688838 - RNA, 22 nt, Haemophilus influenzae Rd
cgugcaaauaaauuugguacau

SEQ ID NO: 2688839 - RNA, 16 nt, Haemophilus influenzae Rd
cgugcaauaacaagca

SEQ ID NO: 2688840 - RNA, 14 nt, Haemophilus influenzae Rd
cgugcaauagaugu

SEQ ID NO: 2688841 - RNA, 21 nt, Haemophilus influenzae Rd
cgugcaauuaauucuuuugcu

SEQ ID NO: 2688842 - RNA, 12 nt, Haemophilus influenzae Rd
cgugcagacuag

SEQ ID NO: 2688843 - RNA, 21 nt, Haemophilus influenzae Rd
cgugcauuuuuaugauuaauu

SEQ ID NO: 2688844 - RNA, 15 nt, Haemophilus influenzae Rd
cgugcgauaaaauca

SEQ ID NO: 2688845 - RNA, 15 nt, Haemophilus influenzae Rd
cgugcuguuuucaau

SEQ ID NO: 2688846 - RNA, 17 nt, Haemophilus influenzae Rd
cgugggaauuuucccau

SEQ ID NO: 2688847 - RNA, 16 nt, Haemophilus influenzae Rd
cgugggugugaaauau

SEQ ID NO: 2688848 - RNA, 22 nt, Haemophilus influenzae Rd
cgugguuugcaccugcaucaau

SEQ ID NO: 2688849 - RNA, 18 nt, Haemophilus influenzae Rd
cguguaaucgccuugugc

SEQ ID NO: 2688850 - RNA, 23 nt, Haemophilus influenzae Rd
cguguauuuuuaucuaaauuccu

SEQ ID NO: 2688851 - RNA, 23 nt, Haemophilus influenzae Rd
cgugucaaauuaauuaaucaaua

SEQ ID NO: 2688852 - RNA, 17 nt, Haemophilus influenzae Rd
cgugucaguaacuacaa

SEQ ID NO: 2688853 - RNA, 11 nt, Haemophilus influenzae Rd
cgugugcaccc

SEQ ID NO: 2688854 - RNA, 21 nt, Haemophilus influenzae Rd
cgugugcgauucaucacuucu

SEQ ID NO: 2688855 - RNA, 21 nt, Haemophilus influenzae Rd
cguguucaaccacuucagcag

SEQ ID NO: 2688856 - RNA, 16 nt, Haemophilus influenzae Rd
cguuaaaaguuuuuua

SEQ ID NO: 2688857 - RNA, 13 nt, Haemophilus influenzae Rd
cguuaaaugaacg

SEQ ID NO: 2688858 - RNA, 14 nt, Haemophilus influenzae Rd
cguuacauuauuua

SEQ ID NO: 2688859 - RNA, 19 nt, Haemophilus influenzae Rd
cguuacgaacuucagauac

SEQ ID NO: 2688860 - RNA, 21 nt, Haemophilus influenzae Rd
cguuagauacuuuacguaaag

SEQ ID NO: 2688861 - RNA, 18 nt, Haemophilus influenzae Rd
cguuauaacguuuaaaaa

SEQ ID NO: 2688862 - RNA, 21 nt, Haemophilus influenzae Rd
cguuaucaucuguaaaccauu

SEQ ID NO: 2688863 - RNA, 14 nt, Haemophilus influenzae Rd
cguuaucauuggcu

SEQ ID NO: 2688864 - RNA, 17 nt, Haemophilus influenzae Rd
cguuaucgacuuuuuca

SEQ ID NO: 2688865 - RNA, 17 nt, Haemophilus influenzae Rd
cguuauuaugaaauuug

SEQ ID NO: 2688866 - RNA, 12 nt, Haemophilus influenzae Rd
cguuauuuugau

SEQ ID NO: 2688867 - RNA, 17 nt, Haemophilus influenzae Rd
cguuauuuuuuaagcuu

SEQ ID NO: 2688868 - RNA, 19 nt, Haemophilus influenzae Rd
cguuauuuuuuaagcuuua

SEQ ID NO: 2688869 - RNA, 20 nt, Haemophilus influenzae Rd
cguucaaaaagaacggucaa

SEQ ID NO: 2688870 - RNA, 12 nt, Haemophilus influenzae Rd
cguucaauauua

SEQ ID NO: 2688871 - RNA, 23 nt, Haemophilus influenzae Rd
cguucacguaaguaguaaaguuu

SEQ ID NO: 2688872 - RNA, 20 nt, Haemophilus influenzae Rd
cguucacguaauggaauaug

SEQ ID NO: 2688873 - RNA, 11 nt, Haemophilus influenzae Rd
cguucaucuua

SEQ ID NO: 2688874 - RNA, 16 nt, Haemophilus influenzae Rd
cguucaugguuguaau

SEQ ID NO: 2688875 - RNA, 13 nt, Haemophilus influenzae Rd
cguucgauaacaa

SEQ ID NO: 2688876 - RNA, 14 nt, Haemophilus influenzae Rd
cguucgauaacaau

SEQ ID NO: 2688877 - RNA, 15 nt, Haemophilus influenzae Rd
cguucgauaacaauu

SEQ ID NO: 2688878 - RNA, 20 nt, Haemophilus influenzae Rd
cguucgauaacaauuuuugc

SEQ ID NO: 2688879 - RNA, 15 nt, Haemophilus influenzae Rd
cguucgcaaugaaau

SEQ ID NO: 2688880 - RNA, 21 nt, Haemophilus influenzae Rd
cguucgcaaugaaauuuuuga

SEQ ID NO: 2688881 - RNA, 14 nt, Haemophilus influenzae Rd
cguucguuaucauu

SEQ ID NO: 2688882 - RNA, 22 nt, Haemophilus influenzae Rd
cguucuaaagcacguuucauca

SEQ ID NO: 2688883 - RNA, 21 nt, Haemophilus influenzae Rd
cguucuaauguuaauuuuaaa

SEQ ID NO: 2688884 - RNA, 14 nt, Haemophilus influenzae Rd
cguucuaguuuuuc

SEQ ID NO: 2688885 - RNA, 19 nt, Haemophilus influenzae Rd
cguucuuggaaaucuuggc

SEQ ID NO: 2688886 - RNA, 22 nt, Haemophilus influenzae Rd
cguucuuuuaaugcuucugccg

SEQ ID NO: 2688887 - RNA, 12 nt, Haemophilus influenzae Rd
cguucuuuuucc

SEQ ID NO: 2688888 - RNA, 14 nt, Haemophilus influenzae Rd
cguugaaaauaaau

SEQ ID NO: 2688889 - RNA, 13 nt, Haemophilus influenzae Rd
cguugaguaaaua

SEQ ID NO: 2688890 - RNA, 15 nt, Haemophilus influenzae Rd
cguugaucagcaauc

SEQ ID NO: 2688891 - RNA, 19 nt, Haemophilus influenzae Rd
cguugccgaaccugaaauu

SEQ ID NO: 2688892 - RNA, 19 nt, Haemophilus influenzae Rd
cguugcuaccacuugauca

SEQ ID NO: 2688893 - RNA, 19 nt, Haemophilus influenzae Rd
cguuggguuugauuuauac

SEQ ID NO: 2688894 - RNA, 20 nt, Haemophilus influenzae Rd
cuaaauaaggcguaaaacua

SEQ ID NO: 2688895 - RNA, 15 nt, Haemophilus influenzae Rd
cuaaauaauuacgca

SEQ ID NO: 2688896 - RNA, 13 nt, Haemophilus influenzae Rd
cuaaauacuugcu

SEQ ID NO: 2688897 - RNA, 15 nt, Haemophilus influenzae Rd
cuaaauacuugcuua

SEQ ID NO: 2688898 - RNA, 21 nt, Haemophilus influenzae Rd
cuaaauacuugcuuaugcaaa

SEQ ID NO: 2688899 - RNA, 18 nt, Haemophilus influenzae Rd
cuaaauagcuaacaauau

SEQ ID NO: 2688900 - RNA, 19 nt, Haemophilus influenzae Rd
cuaaauagcuaacaauauc

SEQ ID NO: 2688901 - RNA, 15 nt, Haemophilus influenzae Rd
cuaaauauauaucau

SEQ ID NO: 2688902 - RNA, 15 nt, Haemophilus influenzae Rd
cuaaauauauuuuua

SEQ ID NO: 2688903 - RNA, 22 nt, Haemophilus influenzae Rd
cuaaauauucaauccuauuuuu

SEQ ID NO: 2688904 - RNA, 14 nt, Haemophilus influenzae Rd
cuaaauauuuauac

SEQ ID NO: 2688905 - RNA, 14 nt, Haemophilus influenzae Rd
cuaaaucauauuuc

SEQ ID NO: 2688906 - RNA, 22 nt, Haemophilus influenzae Rd
cuaaaucauauuucuucgauuu

SEQ ID NO: 2688907 - RNA, 22 nt, Haemophilus influenzae Rd
cuaaaucaucggguaaauuuag

SEQ ID NO: 2688908 - RNA, 23 nt, Haemophilus influenzae Rd
cuaaaucaucggguaaauuuagc

SEQ ID NO: 2688909 - RNA, 20 nt, Haemophilus influenzae Rd
cuaaauccccugucaauuuu

SEQ ID NO: 2688910 - RNA, 22 nt, Haemophilus influenzae Rd
cuaaauccccugucaauuuuuc

SEQ ID NO: 2688911 - RNA, 14 nt, Haemophilus influenzae Rd
cuaaaucggcuuua

SEQ ID NO: 2688912 - RNA, 22 nt, Haemophilus influenzae Rd
cuaaaucggcuuuaucaucuuu

SEQ ID NO: 2688913 - RNA, 12 nt, Haemophilus influenzae Rd
cuaaaucuaauu

SEQ ID NO: 2688914 - RNA, 21 nt, Haemophilus influenzae Rd
cuaaaucuacguggauuuguu

SEQ ID NO: 2688915 - RNA, 17 nt, Haemophilus influenzae Rd
cuaaaucuguuucauuu

SEQ ID NO: 2688916 - RNA, 19 nt, Haemophilus influenzae Rd
cuaaaucuuaugaaacagc

SEQ ID NO: 2688917 - RNA, 12 nt, Haemophilus influenzae Rd
cuaaaucuuucc

SEQ ID NO: 2688918 - RNA, 15 nt, Haemophilus influenzae Rd
cuaaaucuuuccaga

SEQ ID NO: 2688919 - RNA, 21 nt, Haemophilus influenzae Rd
cuaaaugaaguucacuucauc

SEQ ID NO: 2688920 - RNA, 11 nt, Haemophilus influenzae Rd
cuaaaugaaua

SEQ ID NO: 2688921 - RNA, 17 nt, Haemophilus influenzae Rd
cuaaaugacgugcuaau

SEQ ID NO: 2688922 - RNA, 15 nt, Haemophilus influenzae Rd
cuaaaugagaaaaau

SEQ ID NO: 2688923 - RNA, 16 nt, Haemophilus influenzae Rd
cuaaaugagaaaaauc

SEQ ID NO: 2688924 - RNA, 12 nt, Haemophilus influenzae Rd
cuaaauggcaaa

SEQ ID NO: 2688925 - RNA, 15 nt, Haemophilus influenzae Rd
cuaaauggcaaaauu

SEQ ID NO: 2688926 - RNA, 20 nt, Haemophilus influenzae Rd
cuaaaugugacauuguaaag

SEQ ID NO: 2688927 - RNA, 21 nt, Haemophilus influenzae Rd
cuaaaugugacauuguaaagu

SEQ ID NO: 2688928 - RNA, 21 nt, Haemophilus influenzae Rd
cuaaauuaguuuaaagagauc

SEQ ID NO: 2688929 - RNA, 19 nt, Haemophilus influenzae Rd
cuaaauuaucguuuacuua

SEQ ID NO: 2688930 - RNA, 15 nt, Haemophilus influenzae Rd
cuaaauucaauuuuc

SEQ ID NO: 2688931 - RNA, 17 nt, Haemophilus influenzae Rd
cuaaauucaguaagaaa

SEQ ID NO: 2688932 - RNA, 21 nt, Haemophilus influenzae Rd
cuaaauucaguaagaaaccaa

SEQ ID NO: 2688933 - RNA, 13 nt, Haemophilus influenzae Rd
cuaaauucuaaac

SEQ ID NO: 2688934 - RNA, 19 nt, Haemophilus influenzae Rd
cuaaauugaccgcacuugu

SEQ ID NO: 2688935 - RNA, 20 nt, Haemophilus influenzae Rd
cuaaauuuaguugguaaaga

SEQ ID NO: 2688936 - RNA, 13 nt, Haemophilus influenzae Rd
cuaaauuuauaua

SEQ ID NO: 2688937 - RNA, 21 nt, Haemophilus influenzae Rd
cuaaauuucagcuuaaauacu

SEQ ID NO: 2688938 - RNA, 23 nt, Haemophilus influenzae Rd
cuaaauuucagcuuaaauacuaa

SEQ ID NO: 2688939 - RNA, 13 nt, Haemophilus influenzae Rd
cuaaauuucccau

SEQ ID NO: 2688940 - RNA, 15 nt, Haemophilus influenzae Rd
cuaaauuucccauuu

SEQ ID NO: 2688941 - RNA, 18 nt, Haemophilus influenzae Rd
cuaaauuucccauuuguc

SEQ ID NO: 2688942 - RNA, 17 nt, Haemophilus influenzae Rd
cuaaauuugacuucuug

SEQ ID NO: 2688943 - RNA, 22 nt, Haemophilus influenzae Rd
cuaaauuuuuuugcauuuugga

SEQ ID NO: 2688944 - RNA, 18 nt, Haemophilus influenzae Rd
cuaacaaaugauuagaag

SEQ ID NO: 2688945 - RNA, 18 nt, Haemophilus influenzae Rd
cuaacaauaauuugccaa

SEQ ID NO: 2688946 - RNA, 15 nt, Haemophilus influenzae Rd
cuaacaauagaauug

SEQ ID NO: 2688947 - RNA, 12 nt, Haemophilus influenzae Rd
cuaacaaucgac

SEQ ID NO: 2688948 - RNA, 20 nt, Haemophilus influenzae Rd
cuaacaaucgacuuugucca

SEQ ID NO: 2688949 - RNA, 22 nt, Haemophilus influenzae Rd
cuaacaccauugagcauuuuuu

SEQ ID NO: 2688950 - RNA, 16 nt, Haemophilus influenzae Rd
cuaacagggcauaaau

SEQ ID NO: 2688951 - RNA, 14 nt, Haemophilus influenzae Rd
cuaacauaaugccu

SEQ ID NO: 2688952 - RNA, 21 nt, Haemophilus influenzae Rd
cuaacauaaugcgauguaauu

SEQ ID NO: 2688953 - RNA, 16 nt, Haemophilus influenzae Rd
cuaacauaauuguguu

SEQ ID NO: 2688954 - RNA, 22 nt, Haemophilus influenzae Rd
cuaacauugcaucagccaccuu

SEQ ID NO: 2688955 - RNA, 16 nt, Haemophilus influenzae Rd
cuaaccaaagcgucca

SEQ ID NO: 2688956 - RNA, 18 nt, Haemophilus influenzae Rd
cuaacccccuuaauucua

SEQ ID NO: 2688957 - RNA, 23 nt, Haemophilus influenzae Rd
cuaaccccuuuucugacauuucg

SEQ ID NO: 2688958 - RNA, 16 nt, Haemophilus influenzae Rd
cuaaccgacugagcua

SEQ ID NO: 2688959 - RNA, 15 nt, Haemophilus influenzae Rd
cuaaccgcacuuugg

SEQ ID NO: 2688960 - RNA, 20 nt, Haemophilus influenzae Rd
cuaaccgcacuuuuuaauaa

SEQ ID NO: 2688961 - RNA, 16 nt, Haemophilus influenzae Rd
cuaaccgcacuuuuuc

SEQ ID NO: 2688962 - RNA, 24 nt, Haemophilus influenzae Rd
cuaacgacccaauuagaugauuuu

SEQ ID NO: 2688963 - RNA, 20 nt, Haemophilus influenzae Rd
cuaacgccauuggauacaua

SEQ ID NO: 2688964 - RNA, 16 nt, Haemophilus influenzae Rd
cuaacgcuuuuaaacg

SEQ ID NO: 2688965 - RNA, 17 nt, Haemophilus influenzae Rd
cuaacgcuuuuaaacgu

SEQ ID NO: 2688966 - RNA, 15 nt, Haemophilus influenzae Rd
cuaacggcaaauaac

SEQ ID NO: 2688967 - RNA, 15 nt, Haemophilus influenzae Rd
cuaacguuuauauug

SEQ ID NO: 2688968 - RNA, 12 nt, Haemophilus influenzae Rd
cuaacuaaaaaa

SEQ ID NO: 2688969 - RNA, 22 nt, Haemophilus influenzae Rd
cuaacuaaaauaguugaaauuu

SEQ ID NO: 2688970 - RNA, 14 nt, Haemophilus influenzae Rd
cuaacucaaaauac

SEQ ID NO: 2688971 - RNA, 22 nt, Haemophilus influenzae Rd
cuaacucaaaauacucacaagu

SEQ ID NO: 2688972 - RNA, 13 nt, Haemophilus influenzae Rd
cuaacucacauug

SEQ ID NO: 2688973 - RNA, 22 nt, Haemophilus influenzae Rd
cuaacugaucuaaauguugaua

SEQ ID NO: 2688974 - RNA, 15 nt, Haemophilus influenzae Rd
cuaacuucuuccacu

SEQ ID NO: 2688975 - RNA, 18 nt, Haemophilus influenzae Rd
cuaagaaaauagaagcca

SEQ ID NO: 2688976 - RNA, 23 nt, Haemophilus influenzae Rd
cuaagaaaauagaagccaaauca

SEQ ID NO: 2688977 - RNA, 14 nt, Haemophilus influenzae Rd
cuaagauugacaac

SEQ ID NO: 2688978 - RNA, 19 nt, Haemophilus influenzae Rd
cuaagauuuuaucuaacuc

SEQ ID NO: 2688979 - RNA, 21 nt, Haemophilus influenzae Rd
cuaagcacaaagaaaaacuaa

SEQ ID NO: 2688980 - RNA, 16 nt, Haemophilus influenzae Rd
cuaagccuaagccaaa

SEQ ID NO: 2688981 - RNA, 17 nt, Haemophilus influenzae Rd
cuaagcuuaauauguuc

SEQ ID NO: 2688982 - RNA, 14 nt, Haemophilus influenzae Rd
cuaaggcgacaaaa

SEQ ID NO: 2688983 - RNA, 15 nt, Haemophilus influenzae Rd
cuaagguauaaauaa

SEQ ID NO: 2688984 - RNA, 22 nt, Haemophilus influenzae Rd
cuaagguauaaauaauuuucuu

SEQ ID NO: 2688985 - RNA, 19 nt, Haemophilus influenzae Rd
cuaagguuuccauaauguu

SEQ ID NO: 2688986 - RNA, 19 nt, Haemophilus influenzae Rd
cuaaguaagucgcaucaac

SEQ ID NO: 2688987 - RNA, 14 nt, Haemophilus influenzae Rd
cuaaguacaaaaga

SEQ ID NO: 2688988 - RNA, 15 nt, Haemophilus influenzae Rd
cuaaguacaaaagag

SEQ ID NO: 2688989 - RNA, 17 nt, Haemophilus influenzae Rd
cuaaguacaaaagagcg

SEQ ID NO: 2688990 - RNA, 14 nt, Haemophilus influenzae Rd
cuaaguagggcuau

SEQ ID NO: 2688991 - RNA, 21 nt, Haemophilus influenzae Rd
cuaaguauuaagccaaaaccu

SEQ ID NO: 2688992 - RNA, 20 nt, Haemophilus influenzae Rd
cuaaguauucaugauguaau

SEQ ID NO: 2688993 - RNA, 15 nt, Haemophilus influenzae Rd
cuaaguucuaaaauu

SEQ ID NO: 2688994 - RNA, 15 nt, Haemophilus influenzae Rd
cuaaguucuauaauu

SEQ ID NO: 2688995 - RNA, 20 nt, Haemophilus influenzae Rd
cuaaguucuauaauuuuaga

SEQ ID NO: 2688996 - RNA, 13 nt, Haemophilus influenzae Rd
cuaauaaaaaaua

SEQ ID NO: 2688997 - RNA, 23 nt, Haemophilus influenzae Rd
cuaauaaaaaauaaagugcgguc

SEQ ID NO: 2688998 - RNA, 12 nt, Haemophilus influenzae Rd
cuaauaaaaauc

SEQ ID NO: 2688999 - RNA, 15 nt, Haemophilus influenzae Rd
cuacaccaaaaccaa

SEQ ID NO: 2689000 - RNA, 14 nt, Haemophilus influenzae Rd
cuacacccacugau

SEQ ID NO: 2689001 - RNA, 23 nt, Haemophilus influenzae Rd
cuacacccucaguuaccauacag

SEQ ID NO: 2689002 - RNA, 19 nt, Haemophilus influenzae Rd
cuacaccgauuucuuuaca

SEQ ID NO: 2689003 - RNA, 17 nt, Haemophilus influenzae Rd
cuacaccuucuuuaccu

SEQ ID NO: 2689004 - RNA, 15 nt, Haemophilus influenzae Rd
cuacacggagauauu

SEQ ID NO: 2689005 - RNA, 22 nt, Haemophilus influenzae Rd
cuacagaaagaaugucaucuaa

SEQ ID NO: 2689006 - RNA, 20 nt, Haemophilus influenzae Rd
cuacagaagugcguucauau

SEQ ID NO: 2689007 - RNA, 12 nt, Haemophilus influenzae Rd
cuacagcaaauc

SEQ ID NO: 2689008 - RNA, 14 nt, Haemophilus influenzae Rd
cuacagcaaauccu

SEQ ID NO: 2689009 - RNA, 17 nt, Haemophilus influenzae Rd
cuacagcuggagaguga

SEQ ID NO: 2689010 - RNA, 20 nt, Haemophilus influenzae Rd
cuacaggcuuccaacaaaau

SEQ ID NO: 2689011 - RNA, 16 nt, Haemophilus influenzae Rd
cuacagugacuaaaac

SEQ ID NO: 2689012 - RNA, 22 nt, Haemophilus influenzae Rd
cuacauaaaacgaacaauuucu

SEQ ID NO: 2689013 - RNA, 20 nt, Haemophilus influenzae Rd
cuacauaaacuuuacggaua

SEQ ID NO: 2689014 - RNA, 15 nt, Haemophilus influenzae Rd
cuacaucgccuugca

SEQ ID NO: 2689015 - RNA, 22 nt, Haemophilus influenzae Rd
cuacauggauuugcaauccagu

SEQ ID NO: 2689016 - RNA, 14 nt, Haemophilus influenzae Rd
cuacauuaaaagau

SEQ ID NO: 2689017 - RNA, 15 nt, Haemophilus influenzae Rd
cuacauuaaucacca

SEQ ID NO: 2689018 - RNA, 14 nt, Haemophilus influenzae Rd
cuacauucaucaaa

SEQ ID NO: 2689019 - RNA, 14 nt, Haemophilus influenzae Rd
cuaccaauauucuu

SEQ ID NO: 2689020 - RNA, 23 nt, Haemophilus influenzae Rd
cuaccaauauucuuuaaaacauu

SEQ ID NO: 2689021 - RNA, 17 nt, Haemophilus influenzae Rd
cuaccaauucaaaaacc

SEQ ID NO: 2689022 - RNA, 18 nt, Haemophilus influenzae Rd
cuaccaauucaaaaacca

SEQ ID NO: 2689023 - RNA, 16 nt, Haemophilus influenzae Rd
cuaccaauuccaccac

SEQ ID NO: 2689024 - RNA, 19 nt, Haemophilus influenzae Rd
cuaccacguuuucaacagu

SEQ ID NO: 2689025 - RNA, 13 nt, Haemophilus influenzae Rd
cuaccauuuaucu

SEQ ID NO: 2689026 - RNA, 13 nt, Haemophilus influenzae Rd
cuacccacacacc

SEQ ID NO: 2689027 - RNA, 19 nt, Haemophilus influenzae Rd
cuaccgcacuuagauuuga

SEQ ID NO: 2689028 - RNA, 15 nt, Haemophilus influenzae Rd
cuaccgcauuuuuaa

SEQ ID NO: 2689029 - RNA, 18 nt, Haemophilus influenzae Rd
cuaccuaaaauaaauuuu

SEQ ID NO: 2689030 - RNA, 18 nt, Haemophilus influenzae Rd
cuaccugauaccaccaca

SEQ ID NO: 2689031 - RNA, 23 nt, Haemophilus influenzae Rd
cuaccugcuguaacguuaaauga

SEQ ID NO: 2689032 - RNA, 19 nt, Haemophilus influenzae Rd
cuaccuucaaccacccaua

SEQ ID NO: 2689033 - RNA, 16 nt, Haemophilus influenzae Rd
cuacgaaccgagcggu

SEQ ID NO: 2689034 - RNA, 20 nt, Haemophilus influenzae Rd
cuacgaauugguucuaaaua

SEQ ID NO: 2689035 - RNA, 19 nt, Haemophilus influenzae Rd
cuacgccuaauucaucuuc

SEQ ID NO: 2689036 - RNA, 17 nt, Haemophilus influenzae Rd
cuacggacuaaauaaau

SEQ ID NO: 2689037 - RNA, 19 nt, Haemophilus influenzae Rd
cuacggcguagaaugcaaa

SEQ ID NO: 2689038 - RNA, 16 nt, Haemophilus influenzae Rd
cuacggucgcaccacc

SEQ ID NO: 2689039 - RNA, 21 nt, Haemophilus influenzae Rd
cuacguaaggaucuuuuucuu

SEQ ID NO: 2689040 - RNA, 20 nt, Haemophilus influenzae Rd
cuacguaauuuaauuuauca

SEQ ID NO: 2689041 - RNA, 15 nt, Haemophilus influenzae Rd
cuacguguagaagcg

SEQ ID NO: 2689042 - RNA, 17 nt, Haemophilus influenzae Rd
cuacguguucaucaucg

SEQ ID NO: 2689043 - RNA, 16 nt, Haemophilus influenzae Rd
cuacuacgcuaacacu

SEQ ID NO: 2689044 - RNA, 18 nt, Haemophilus influenzae Rd
cuacuaucauccgcuugu

SEQ ID NO: 2689045 - RNA, 19 nt, Haemophilus influenzae Rd
cuacucguagaguuuuuuc

SEQ ID NO: 2689046 - RNA, 22 nt, Haemophilus influenzae Rd
cuacucguagaguuuuuucacu

SEQ ID NO: 2689047 - RNA, 20 nt, Haemophilus influenzae Rd
cuacugcgugacaacggggc

SEQ ID NO: 2689048 - RNA, 15 nt, Haemophilus influenzae Rd
cuacugcuucauaaa

SEQ ID NO: 2689049 - RNA, 19 nt, Haemophilus influenzae Rd
cuacugcuucauaaaaacc

SEQ ID NO: 2689050 - RNA, 21 nt, Haemophilus influenzae Rd
cuacuggugaaauuaauuuag

SEQ ID NO: 2689051 - RNA, 14 nt, Haemophilus influenzae Rd
cuacuguuaauuug

SEQ ID NO: 2689052 - RNA, 11 nt, Haemophilus influenzae Rd
cuacuucuucc

SEQ ID NO: 2689053 - RNA, 11 nt, Haemophilus influenzae Rd
cuacuuuauuc

SEQ ID NO: 2689054 - RNA, 13 nt, Haemophilus influenzae Rd
cuacuuucuauua

SEQ ID NO: 2689055 - RNA, 16 nt, Haemophilus influenzae Rd
cuacuuuggauuggau

SEQ ID NO: 2689056 - RNA, 21 nt, Haemophilus influenzae Rd
cuacuuuugacgcagcaucug

SEQ ID NO: 2689057 - RNA, 12 nt, Haemophilus influenzae Rd
cuacuuuugugc

SEQ ID NO: 2689058 - RNA, 14 nt, Haemophilus influenzae Rd
cuacuuuuuuugcg

SEQ ID NO: 2689059 - RNA, 13 nt, Haemophilus influenzae Rd
cuagaaaacucau

SEQ ID NO: 2689060 - RNA, 22 nt, Haemophilus influenzae Rd
cuagagauauaagaaauaaucg

SEQ ID NO: 2689061 - RNA, 14 nt, Haemophilus influenzae Rd
cuagaguaaguaac

SEQ ID NO: 2689062 - RNA, 14 nt, Haemophilus influenzae Rd
cuagauaacuagac

SEQ ID NO: 2689063 - RNA, 22 nt, Haemophilus influenzae Rd
cuagauaaugaugaaugcuuuu

SEQ ID NO: 2689064 - RNA, 15 nt, Haemophilus influenzae Rd
cuagaugaugaaauu

SEQ ID NO: 2689065 - RNA, 20 nt, Haemophilus influenzae Rd
cuagauuucuauccauuucu

SEQ ID NO: 2689066 - RNA, 22 nt, Haemophilus influenzae Rd
cuagauuuuuuacucaaagaaa

SEQ ID NO: 2689067 - RNA, 15 nt, Haemophilus influenzae Rd
cuagcaucaaaauaa

SEQ ID NO: 2689068 - RNA, 18 nt, Haemophilus influenzae Rd
cuagcaucaaaauaaaua

SEQ ID NO: 2689069 - RNA, 23 nt, Haemophilus influenzae Rd
cuagcaucaaaauaaauaaaaua

SEQ ID NO: 2689070 - RNA, 15 nt, Haemophilus influenzae Rd
cuagccauaaauaaa

SEQ ID NO: 2689071 - RNA, 16 nt, Haemophilus influenzae Rd
cuagcgggauaagauu

SEQ ID NO: 2689072 - RNA, 18 nt, Haemophilus influenzae Rd
cuagcguaagcaccuuca

SEQ ID NO: 2689073 - RNA, 18 nt, Haemophilus influenzae Rd
cuagcucucguuguucuu

SEQ ID NO: 2689074 - RNA, 15 nt, Haemophilus influenzae Rd
cuagcuuaacaacaa

SEQ ID NO: 2689075 - RNA, 15 nt, Haemophilus influenzae Rd
cuaggcaucaaaauu

SEQ ID NO: 2689076 - RNA, 15 nt, Haemophilus influenzae Rd
cuaggcuuucaccaa

SEQ ID NO: 2689077 - RNA, 14 nt, Haemophilus influenzae Rd
cuagggauuaagaa

SEQ ID NO: 2689078 - RNA, 19 nt, Haemophilus influenzae Rd
cuagguacguuuuguuuua

SEQ ID NO: 2689079 - RNA, 12 nt, Haemophilus influenzae Rd
cuaguaaaacua

SEQ ID NO: 2689080 - RNA, 14 nt, Haemophilus influenzae Rd
cuaguaaaacuaau

SEQ ID NO: 2689081 - RNA, 22 nt, Haemophilus influenzae Rd
cuaguauagauaugugaauaaa

SEQ ID NO: 2689082 - RNA, 21 nt, Haemophilus influenzae Rd
cuagucauauugauuucucug

SEQ ID NO: 2689083 - RNA, 14 nt, Haemophilus influenzae Rd
cuagucccgcuuuu

SEQ ID NO: 2689084 - RNA, 18 nt, Haemophilus influenzae Rd
cuagucguucuugaugau

SEQ ID NO: 2689085 - RNA, 20 nt, Haemophilus influenzae Rd
cuagugaaauauuuacuuca

SEQ ID NO: 2689086 - RNA, 15 nt, Haemophilus influenzae Rd
cuagugcaaccacac

SEQ ID NO: 2689087 - RNA, 12 nt, Haemophilus influenzae Rd
cuagugcuaaaa

SEQ ID NO: 2689088 - RNA, 15 nt, Haemophilus influenzae Rd
cuagugcuaaaauaa

SEQ ID NO: 2689089 - RNA, 16 nt, Haemophilus influenzae Rd
cuagugcuaaaauaaa

SEQ ID NO: 2689090 - RNA, 16 nt, Haemophilus influenzae Rd
cuaguucuuccuuggu

SEQ ID NO: 2689091 - RNA, 20 nt, Haemophilus influenzae Rd
cuaguugcgguggugaaaau

SEQ ID NO: 2689092 - RNA, 13 nt, Haemophilus influenzae Rd
cuaguuuuuuccc

SEQ ID NO: 2689093 - RNA, 21 nt, Haemophilus influenzae Rd
cuauaagaaaauuaucuggca

SEQ ID NO: 2689094 - RNA, 21 nt, Haemophilus influenzae Rd
cuauaauagcuuccauuuuuu

SEQ ID NO: 2689095 - RNA, 22 nt, Haemophilus influenzae Rd
cuauaauuagaucauaaaaaaa

SEQ ID NO: 2689096 - RNA, 18 nt, Haemophilus influenzae Rd
cuauaauuucgccauuuu

SEQ ID NO: 2689097 - RNA, 22 nt, Haemophilus influenzae Rd
cuauaauuucgccauuuuuucc

SEQ ID NO: 2689098 - RNA, 18 nt, Haemophilus influenzae Rd
cuauaauuuuagaacuua

SEQ ID NO: 2689099 - RNA, 12 nt, Haemophilus influenzae Rd
cuauacuaauuu

SEQ ID NO: 2689100 - RNA, 23 nt, Haemophilus influenzae Rd
cuauaguagaauguaaauuauuu

SEQ ID NO: 2689101 - RNA, 15 nt, Haemophilus influenzae Rd
cuauauacauuaaca

SEQ ID NO: 2689102 - RNA, 18 nt, Haemophilus influenzae Rd
cuauauccaaaucaaaaa

SEQ ID NO: 2689103 - RNA, 18 nt, Haemophilus influenzae Rd
cuauaucuuuaaauucua

SEQ ID NO: 2689104 - RNA, 15 nt, Haemophilus influenzae Rd
cuauaugauauauaa

SEQ ID NO: 2689105 - RNA, 13 nt, Haemophilus influenzae Rd
cucacaacaaaga

SEQ ID NO: 2689106 - RNA, 20 nt, Haemophilus influenzae Rd
cucacaagucuguaauuuua

SEQ ID NO: 2689107 - RNA, 22 nt, Haemophilus influenzae Rd
cucacaauaauaggcgaaucaa

SEQ ID NO: 2689108 - RNA, 23 nt, Haemophilus influenzae Rd
cucacaauugauguaaaagauaa

SEQ ID NO: 2689109 - RNA, 18 nt, Haemophilus influenzae Rd
cucacauccauuccugca

SEQ ID NO: 2689110 - RNA, 15 nt, Haemophilus influenzae Rd
cucacauugccauuu

SEQ ID NO: 2689111 - RNA, 18 nt, Haemophilus influenzae Rd
cucacauugccauuuuuc

SEQ ID NO: 2689112 - RNA, 15 nt, Haemophilus influenzae Rd
cucaccauuuugccc

SEQ ID NO: 2689113 - RNA, 13 nt, Haemophilus influenzae Rd
cucacgaguuaag

SEQ ID NO: 2689114 - RNA, 23 nt, Haemophilus influenzae Rd
cucacuacggcuggugcuacuug

SEQ ID NO: 2689115 - RNA, 16 nt, Haemophilus influenzae Rd
cucacuauaacuuuuc

SEQ ID NO: 2689116 - RNA, 22 nt, Haemophilus influenzae Rd
cucacucguggaauuucauaaa

SEQ ID NO: 2689117 - RNA, 13 nt, Haemophilus influenzae Rd
cucacuuuauaua

SEQ ID NO: 2689118 - RNA, 19 nt, Haemophilus influenzae Rd
cucagagauaaucgcaagg

SEQ ID NO: 2689119 - RNA, 14 nt, Haemophilus influenzae Rd
cucagauaaugaua

SEQ ID NO: 2689120 - RNA, 22 nt, Haemophilus influenzae Rd
cucagcaaaagacgaagaaaca

SEQ ID NO: 2689121 - RNA, 14 nt, Haemophilus influenzae Rd
cucagcaagcuggc

SEQ ID NO: 2689122 - RNA, 16 nt, Haemophilus influenzae Rd
cucagcaagcuggcuu

SEQ ID NO: 2689123 - RNA, 15 nt, Haemophilus influenzae Rd
cucagcaauuuucuu

SEQ ID NO: 2689124 - RNA, 14 nt, Haemophilus influenzae Rd
cucagccaaacugc

SEQ ID NO: 2689125 - RNA, 14 nt, Haemophilus influenzae Rd
cucagggaaaugua

SEQ ID NO: 2689126 - RNA, 22 nt, Haemophilus influenzae Rd
cucaggugugccaucacagucu

SEQ ID NO: 2689127 - RNA, 17 nt, Haemophilus influenzae Rd
cucagucgguagagcag

SEQ ID NO: 2689128 - RNA, 22 nt, Haemophilus influenzae Rd
cucagucgguagagcaggggau

SEQ ID NO: 2689129 - RNA, 22 nt, Haemophilus influenzae Rd
cucaguugguagagcacgaccu

SEQ ID NO: 2689130 - RNA, 17 nt, Haemophilus influenzae Rd
cucauaagcauuuugau

SEQ ID NO: 2689131 - RNA, 21 nt, Haemophilus influenzae Rd
cucauaagcauuuugauaauu

SEQ ID NO: 2689132 - RNA, 20 nt, Haemophilus influenzae Rd
cucauaccaaggcauuuuuu

SEQ ID NO: 2689133 - RNA, 14 nt, Haemophilus influenzae Rd
cucaucaacaaaau

SEQ ID NO: 2689134 - RNA, 13 nt, Haemophilus influenzae Rd
cucaucauauaac

SEQ ID NO: 2689135 - RNA, 17 nt, Haemophilus influenzae Rd
cucauccaaucaucaga

SEQ ID NO: 2689136 - RNA, 22 nt, Haemophilus influenzae Rd
cucaucgcgccaacgaaaucau

SEQ ID NO: 2689137 - RNA, 18 nt, Haemophilus influenzae Rd
cucaucguaucaauuuua

SEQ ID NO: 2689138 - RNA, 22 nt, Haemophilus influenzae Rd
cucaucguaucaauuuuauuga

SEQ ID NO: 2689139 - RNA, 23 nt, Haemophilus influenzae Rd
cucaucugaauuuaaacuuagga

SEQ ID NO: 2689140 - RNA, 15 nt, Haemophilus influenzae Rd
cucaucuuuuuuaag

SEQ ID NO: 2689141 - RNA, 23 nt, Haemophilus influenzae Rd
cucauucaucaaaucauuuuuug

SEQ ID NO: 2689142 - RNA, 15 nt, Haemophilus influenzae Rd
cucauugaacuguuu

SEQ ID NO: 2689143 - RNA, 20 nt, Haemophilus influenzae Rd
cucauugcugcuuuaauuuc

SEQ ID NO: 2689144 - RNA, 21 nt, Haemophilus influenzae Rd
cucauuuaaccguaauuucaa

SEQ ID NO: 2689145 - RNA, 22 nt, Haemophilus influenzae Rd
cucauuuaaccguaauuucaaa

SEQ ID NO: 2689146 - RNA, 12 nt, Haemophilus influenzae Rd
cucauuuugcuc

SEQ ID NO: 2689147 - RNA, 14 nt, Haemophilus influenzae Rd
cuccaaaaguugga

SEQ ID NO: 2689148 - RNA, 19 nt, Haemophilus influenzae Rd
cuccaaauauaaaauaaaa

SEQ ID NO: 2689149 - RNA, 14 nt, Haemophilus influenzae Rd
cuccaacuucaugu

SEQ ID NO: 2689150 - RNA, 13 nt, Haemophilus influenzae Rd
cuccaaucaucau

SEQ ID NO: 2689151 - RNA, 21 nt, Haemophilus influenzae Rd
cuccacgagacacacuaauca

SEQ ID NO: 2689152 - RNA, 17 nt, Haemophilus influenzae Rd
cuccagacugcauugca

SEQ ID NO: 2689153 - RNA, 18 nt, Haemophilus influenzae Rd
cuccauugcaauuucagc

SEQ ID NO: 2689154 - RNA, 19 nt, Haemophilus influenzae Rd
cuccauugcaauuucagcu

SEQ ID NO: 2689155 - RNA, 14 nt, Haemophilus influenzae Rd
cucccaaaaacuaa

SEQ ID NO: 2689156 - RNA, 21 nt, Haemophilus influenzae Rd
cucccaaagaagcuuuccauc

SEQ ID NO: 2689157 - RNA, 19 nt, Haemophilus influenzae Rd
cucccacaugggcaucaua

SEQ ID NO: 2689158 - RNA, 13 nt, Haemophilus influenzae Rd
cucccauggccaa

SEQ ID NO: 2689159 - RNA, 14 nt, Haemophilus influenzae Rd
cuccccuuaacuaa

SEQ ID NO: 2689160 - RNA, 14 nt, Haemophilus influenzae Rd
cucccgccccacuu

SEQ ID NO: 2689161 - RNA, 23 nt, Haemophilus influenzae Rd
cuccuacaucgccuugcauaauu

SEQ ID NO: 2689162 - RNA, 14 nt, Haemophilus influenzae Rd
cuccuauuaguauu

SEQ ID NO: 2689163 - RNA, 18 nt, Haemophilus influenzae Rd
cuccucugcauucugaau

SEQ ID NO: 2689164 - RNA, 19 nt, Haemophilus influenzae Rd
cuccuuaauuucauuaaua

SEQ ID NO: 2689165 - RNA, 20 nt, Haemophilus influenzae Rd
cucgaacauucccuuuccaa

SEQ ID NO: 2689166 - RNA, 15 nt, Haemophilus influenzae Rd
cucgaaguuuugcua

SEQ ID NO: 2689167 - RNA, 15 nt, Haemophilus influenzae Rd
cucgaauauaaggua

SEQ ID NO: 2689168 - RNA, 11 nt, Haemophilus influenzae Rd
cucgaauauug

SEQ ID NO: 2689169 - RNA, 14 nt, Haemophilus influenzae Rd
cucgaauucguuuu

SEQ ID NO: 2689170 - RNA, 23 nt, Haemophilus influenzae Rd
cucgaauucguuuuucaaacuga

SEQ ID NO: 2689171 - RNA, 13 nt, Haemophilus influenzae Rd
cucgacuuuugca

SEQ ID NO: 2689172 - RNA, 21 nt, Haemophilus influenzae Rd
cucgagcauaaacuaaaauau

SEQ ID NO: 2689173 - RNA, 15 nt, Haemophilus influenzae Rd
cucgaggcaccauuu

SEQ ID NO: 2689174 - RNA, 14 nt, Haemophilus influenzae Rd
cucgaugagaaaug

SEQ ID NO: 2689175 - RNA, 15 nt, Haemophilus influenzae Rd
cucgccaaaucucaa

SEQ ID NO: 2689176 - RNA, 20 nt, Haemophilus influenzae Rd
cucgccaauagguugcaaau

SEQ ID NO: 2689177 - RNA, 23 nt, Haemophilus influenzae Rd
cucgccaauagguugcaaaucga

SEQ ID NO: 2689178 - RNA, 16 nt, Haemophilus influenzae Rd
cucgccauaauaaaaa

SEQ ID NO: 2689179 - RNA, 21 nt, Haemophilus influenzae Rd
cucgcucgccaagaauaaaau

SEQ ID NO: 2689180 - RNA, 21 nt, Haemophilus influenzae Rd
cucgcugaauuauugucuuuu

SEQ ID NO: 2689181 - RNA, 18 nt, Haemophilus influenzae Rd
cucggaaagcaaaauaga

SEQ ID NO: 2689182 - RNA, 19 nt, Haemophilus influenzae Rd
cucgggcugaaauaccuuc

SEQ ID NO: 2689183 - RNA, 20 nt, Haemophilus influenzae Rd
cucguaaaaucgccugauaa

SEQ ID NO: 2689184 - RNA, 19 nt, Haemophilus influenzae Rd
cucguaaagaucauucaca

SEQ ID NO: 2689185 - RNA, 14 nt, Haemophilus influenzae Rd
cucguaugcugaga

SEQ ID NO: 2689186 - RNA, 21 nt, Haemophilus influenzae Rd
cucguccaaauucauuuuuua

SEQ ID NO: 2689187 - RNA, 22 nt, Haemophilus influenzae Rd
cucguccgcauuuggugggcaa

SEQ ID NO: 2689188 - RNA, 14 nt, Haemophilus influenzae Rd
cucgugauuaucua

SEQ ID NO: 2689189 - RNA, 18 nt, Haemophilus influenzae Rd
cucgugauuaucuaaauu

SEQ ID NO: 2689190 - RNA, 17 nt, Haemophilus influenzae Rd
cucguuauuauuaagug

SEQ ID NO: 2689191 - RNA, 18 nt, Haemophilus influenzae Rd
cucguuauuauuaaguga

SEQ ID NO: 2689192 - RNA, 16 nt, Haemophilus influenzae Rd
cucguuucauaugcca

SEQ ID NO: 2689193 - RNA, 21 nt, Haemophilus influenzae Rd
cucuaaaagcuguuuacuuuu

SEQ ID NO: 2689194 - RNA, 14 nt, Haemophilus influenzae Rd
cucuaaaucuaauu

SEQ ID NO: 2689195 - RNA, 16 nt, Haemophilus influenzae Rd
cucuaacaauauuuca

SEQ ID NO: 2689196 - RNA, 20 nt, Haemophilus influenzae Rd
cucuaacgcauucaaaucua

SEQ ID NO: 2689197 - RNA, 12 nt, Haemophilus influenzae Rd
cucuaauuccac

SEQ ID NO: 2689198 - RNA, 21 nt, Haemophilus influenzae Rd
cucuaauugauggcgugaaau

SEQ ID NO: 2689199 - RNA, 17 nt, Haemophilus influenzae Rd
cucuacauuuacaucua

SEQ ID NO: 2689200 - RNA, 12 nt, Haemophilus influenzae Rd
cucuaccaucua

SEQ ID NO: 2689201 - RNA, 13 nt, Haemophilus influenzae Rd
cucuaccgacuga

SEQ ID NO: 2689202 - RNA, 17 nt, Haemophilus influenzae Rd
cucuaccgacugagcua

SEQ ID NO: 2689203 - RNA, 20 nt, Haemophilus influenzae Rd
cucuagcucucguuguucuu

SEQ ID NO: 2689204 - RNA, 15 nt, Haemophilus influenzae Rd
cucuaucuaaaauau

SEQ ID NO: 2689205 - RNA, 20 nt, Haemophilus influenzae Rd
cucuauggcccgauauuuug

SEQ ID NO: 2689206 - RNA, 15 nt, Haemophilus influenzae Rd
cucuauuaauuuuaa

SEQ ID NO: 2689207 - RNA, 20 nt, Haemophilus influenzae Rd
cucuauuugucggaaaauaa

SEQ ID NO: 2689208 - RNA, 13 nt, Haemophilus influenzae Rd
cucucaaaaauca

SEQ ID NO: 2689209 - RNA, 14 nt, Haemophilus influenzae Rd
cucucaaaaaucaa

SEQ ID NO: 2689210 - RNA, 13 nt, Haemophilus influenzae Rd
cugauauaguggc

SEQ ID NO: 2689211 - RNA, 16 nt, Haemophilus influenzae Rd
cugauauaguggcuuu

SEQ ID NO: 2689212 - RNA, 15 nt, Haemophilus influenzae Rd
cugaucaauuuaauc

SEQ ID NO: 2689213 - RNA, 17 nt, Haemophilus influenzae Rd
cugaucaauuuaaucaa

SEQ ID NO: 2689214 - RNA, 21 nt, Haemophilus influenzae Rd
cugauccacgguauuuucuua

SEQ ID NO: 2689215 - RNA, 14 nt, Haemophilus influenzae Rd
cugauccacuuaca

SEQ ID NO: 2689216 - RNA, 17 nt, Haemophilus influenzae Rd
cugauccacuuacauua

SEQ ID NO: 2689217 - RNA, 14 nt, Haemophilus influenzae Rd
cugaugaaaucauu

SEQ ID NO: 2689218 - RNA, 14 nt, Haemophilus influenzae Rd
cugaugauggccau

SEQ ID NO: 2689219 - RNA, 16 nt, Haemophilus influenzae Rd
cugauguuugaggauc

SEQ ID NO: 2689220 - RNA, 20 nt, Haemophilus influenzae Rd
cugauuagcagguuuuuuau

SEQ ID NO: 2689221 - RNA, 19 nt, Haemophilus influenzae Rd
cugauucauugcauuuuua

SEQ ID NO: 2689222 - RNA, 22 nt, Haemophilus influenzae Rd
cugauucauugcauuuuuauaa

SEQ ID NO: 2689223 - RNA, 13 nt, Haemophilus influenzae Rd
cugauucgccaaa

SEQ ID NO: 2689224 - RNA, 18 nt, Haemophilus influenzae Rd
cugauucuaaugccauug

SEQ ID NO: 2689225 - RNA, 14 nt, Haemophilus influenzae Rd
cugauucuucauaa

SEQ ID NO: 2689226 - RNA, 20 nt, Haemophilus influenzae Rd
cugauucuucgccauuuucu

SEQ ID NO: 2689227 - RNA, 14 nt, Haemophilus influenzae Rd
cugauugagaaaau

SEQ ID NO: 2689228 - RNA, 14 nt, Haemophilus influenzae Rd
cugauuguccaaag

SEQ ID NO: 2689229 - RNA, 14 nt, Haemophilus influenzae Rd
cugauuuaaaaaaa

SEQ ID NO: 2689230 - RNA, 19 nt, Haemophilus influenzae Rd
cugauuuaaucauuacuua

SEQ ID NO: 2689231 - RNA, 19 nt, Haemophilus influenzae Rd
cugauuuagguuucaauuu

SEQ ID NO: 2689232 - RNA, 12 nt, Haemophilus influenzae Rd
cugauuuugugg

SEQ ID NO: 2689233 - RNA, 18 nt, Haemophilus influenzae Rd
cugauuuuucuuuuucag

SEQ ID NO: 2689234 - RNA, 21 nt, Haemophilus influenzae Rd
cugauuuuucuuuuucaguuu

SEQ ID NO: 2689235 - RNA, 13 nt, Haemophilus influenzae Rd
cugauuuuuuaaa

SEQ ID NO: 2689236 - RNA, 16 nt, Haemophilus influenzae Rd
cugauuuuuuaaagua

SEQ ID NO: 2689237 - RNA, 17 nt, Haemophilus influenzae Rd
cugcaaagccuucaccu

SEQ ID NO: 2689238 - RNA, 20 nt, Haemophilus influenzae Rd
cugcaaauaaagaagaaaau

SEQ ID NO: 2689239 - RNA, 19 nt, Haemophilus influenzae Rd
cugcaacaaauaaaucaua

SEQ ID NO: 2689240 - RNA, 18 nt, Haemophilus influenzae Rd
cugcaaggauauuuccau

SEQ ID NO: 2689241 - RNA, 19 nt, Haemophilus influenzae Rd
cugcaagugcgguaaaauu

SEQ ID NO: 2689242 - RNA, 22 nt, Haemophilus influenzae Rd
cugcaauaucaaucccacuugu

SEQ ID NO: 2689243 - RNA, 23 nt, Haemophilus influenzae Rd
cugcaauuguugcaccaauaauu

SEQ ID NO: 2689244 - RNA, 15 nt, Haemophilus influenzae Rd
cugcacaagcaccac

SEQ ID NO: 2689245 - RNA, 19 nt, Haemophilus influenzae Rd
cugcacaaucaaaccaaua

SEQ ID NO: 2689246 - RNA, 21 nt, Haemophilus influenzae Rd
cugcacaaucaaaccaauaaa

SEQ ID NO: 2689247 - RNA, 18 nt, Haemophilus influenzae Rd
cugcacccuaauucauua

SEQ ID NO: 2689248 - RNA, 17 nt, Haemophilus influenzae Rd
cugcaccguugaaugcu

SEQ ID NO: 2689249 - RNA, 19 nt, Haemophilus influenzae Rd
cugcaccuuaaaggcugaa

SEQ ID NO: 2689250 - RNA, 16 nt, Haemophilus influenzae Rd
cugcacgaauaauuaa

SEQ ID NO: 2689251 - RNA, 15 nt, Haemophilus influenzae Rd
cugcacuuuaacagu

SEQ ID NO: 2689252 - RNA, 23 nt, Haemophilus influenzae Rd
cugcagcaagaucaauauaaccu

SEQ ID NO: 2689253 - RNA, 15 nt, Haemophilus influenzae Rd
cugcagcaggaagaa

SEQ ID NO: 2689254 - RNA, 14 nt, Haemophilus influenzae Rd
cugcagcugcugcu

SEQ ID NO: 2689255 - RNA, 23 nt, Haemophilus influenzae Rd
cugcagcugcugcuuuaacaauu

SEQ ID NO: 2689256 - RNA, 14 nt, Haemophilus influenzae Rd
cugcagguaauaca

SEQ ID NO: 2689257 - RNA, 20 nt, Haemophilus influenzae Rd
cugcagguaauacacuuuca

SEQ ID NO: 2689258 - RNA, 23 nt, Haemophilus influenzae Rd
cugcaguuacugccucugccaca

SEQ ID NO: 2689259 - RNA, 21 nt, Haemophilus influenzae Rd
cugcauaaagcucagccaaac

SEQ ID NO: 2689260 - RNA, 19 nt, Haemophilus influenzae Rd
cugcauaacgauaacugaa

SEQ ID NO: 2689261 - RNA, 15 nt, Haemophilus influenzae Rd
cugcauauucauaaa

SEQ ID NO: 2689262 - RNA, 21 nt, Haemophilus influenzae Rd
cugcaucaauaauucauuaga

SEQ ID NO: 2689263 - RNA, 16 nt, Haemophilus influenzae Rd
cugcaucgcuaagaca

SEQ ID NO: 2689264 - RNA, 19 nt, Haemophilus influenzae Rd
cugcaucgcuaagacaccu

SEQ ID NO: 2689265 - RNA, 14 nt, Haemophilus influenzae Rd
cugcaucuuguuua

SEQ ID NO: 2689266 - RNA, 14 nt, Haemophilus influenzae Rd
cugcauuugauuuc

SEQ ID NO: 2689267 - RNA, 21 nt, Haemophilus influenzae Rd
cugcauuugauuucagaacau

SEQ ID NO: 2689268 - RNA, 23 nt, Haemophilus influenzae Rd
cugccacaagauuacguguaguu

SEQ ID NO: 2689269 - RNA, 15 nt, Haemophilus influenzae Rd
cugccacugcgcccg

SEQ ID NO: 2689270 - RNA, 18 nt, Haemophilus influenzae Rd
cugccaguagaaaaucag

SEQ ID NO: 2689271 - RNA, 14 nt, Haemophilus influenzae Rd
cugccauccgcaau

SEQ ID NO: 2689272 - RNA, 20 nt, Haemophilus influenzae Rd
cugccauccgcaauuaaucc

SEQ ID NO: 2689273 - RNA, 12 nt, Haemophilus influenzae Rd
cugcccaaauaa

SEQ ID NO: 2689274 - RNA, 14 nt, Haemophilus influenzae Rd
cugcccaaguugug

SEQ ID NO: 2689275 - RNA, 14 nt, Haemophilus influenzae Rd
cugcccauaagaaa

SEQ ID NO: 2689276 - RNA, 22 nt, Haemophilus influenzae Rd
cugcccgucaugccgcaaucaa

SEQ ID NO: 2689277 - RNA, 15 nt, Haemophilus influenzae Rd
cugccgucccccagu

SEQ ID NO: 2689278 - RNA, 18 nt, Haemophilus influenzae Rd
cugccuuuuucuucuuuc

SEQ ID NO: 2689279 - RNA, 23 nt, Haemophilus influenzae Rd
cugccuuuuucuucuuucauuug

SEQ ID NO: 2689280 - RNA, 21 nt, Haemophilus influenzae Rd
cugcgaccacguuugccuuuu

SEQ ID NO: 2689281 - RNA, 18 nt, Haemophilus influenzae Rd
cugcgauacguuucauau

SEQ ID NO: 2689282 - RNA, 15 nt, Haemophilus influenzae Rd
cugcgcacuuuugga

SEQ ID NO: 2689283 - RNA, 12 nt, Haemophilus influenzae Rd
cugcgccaauau

SEQ ID NO: 2689284 - RNA, 22 nt, Haemophilus influenzae Rd
cugcggauuauagaauuuaguc

SEQ ID NO: 2689285 - RNA, 16 nt, Haemophilus influenzae Rd
cugcgggucuuguucc

SEQ ID NO: 2689286 - RNA, 16 nt, Haemophilus influenzae Rd
cugcuaaaucuguuuc

SEQ ID NO: 2689287 - RNA, 13 nt, Haemophilus influenzae Rd
cugcuacuuuuga

SEQ ID NO: 2689288 - RNA, 16 nt, Haemophilus influenzae Rd
cugcuacuuuugacgc

SEQ ID NO: 2689289 - RNA, 22 nt, Haemophilus influenzae Rd
cugcuaggacauagccuuuuuc

SEQ ID NO: 2689290 - RNA, 21 nt, Haemophilus influenzae Rd
cugcucacgccgugauaacaa

SEQ ID NO: 2689291 - RNA, 20 nt, Haemophilus influenzae Rd
cugcucuaccgacugagcua

SEQ ID NO: 2689292 - RNA, 20 nt, Haemophilus influenzae Rd
cugcucugcaccauccauca

SEQ ID NO: 2689293 - RNA, 21 nt, Haemophilus influenzae Rd
cugcucugcaccauccaucaa

SEQ ID NO: 2689294 - RNA, 13 nt, Haemophilus influenzae Rd
cugcucugugcca

SEQ ID NO: 2689295 - RNA, 20 nt, Haemophilus influenzae Rd
cugcucuucaucaaaaugaa

SEQ ID NO: 2689296 - RNA, 19 nt, Haemophilus influenzae Rd
cugcucuuuaggaucacua

SEQ ID NO: 2689297 - RNA, 20 nt, Haemophilus influenzae Rd
cugcugacgguucaguuuca

SEQ ID NO: 2689298 - RNA, 19 nt, Haemophilus influenzae Rd
cugcugcaagauuugcugc

SEQ ID NO: 2689299 - RNA, 22 nt, Haemophilus influenzae Rd
cugcugcaguuacugccucugc

SEQ ID NO: 2689300 - RNA, 23 nt, Haemophilus influenzae Rd
cugcuggguuugcacuuuaaaaa

SEQ ID NO: 2689301 - RNA, 20 nt, Haemophilus influenzae Rd
cugcuguaacguuaaaugaa

SEQ ID NO: 2689302 - RNA, 12 nt, Haemophilus influenzae Rd
cugcuguuuuac

SEQ ID NO: 2689303 - RNA, 14 nt, Haemophilus influenzae Rd
cugcuucauaaaaa

SEQ ID NO: 2689304 - RNA, 16 nt, Haemophilus influenzae Rd
cugcuucguuuucugc

SEQ ID NO: 2689305 - RNA, 17 nt, Haemophilus influenzae Rd
cugcuucguuuucugcu

SEQ ID NO: 2689306 - RNA, 13 nt, Haemophilus influenzae Rd
cugcuucuuuauc

SEQ ID NO: 2689307 - RNA, 21 nt, Haemophilus influenzae Rd
cugcuugcacugcuaauucca

SEQ ID NO: 2689308 - RNA, 15 nt, Haemophilus influenzae Rd
cugcuugcgcuugug

SEQ ID NO: 2689309 - RNA, 17 nt, Haemophilus influenzae Rd
cugcuugcgcuugugcu

SEQ ID NO: 2689310 - RNA, 17 nt, Haemophilus influenzae Rd
cugcuugguaauaauca

SEQ ID NO: 2689311 - RNA, 22 nt, Haemophilus influenzae Rd
cugcuuguaaccaauaaaggga

SEQ ID NO: 2689312 - RNA, 22 nt, Haemophilus influenzae Rd
cugcuuuaauaaacggauugca

SEQ ID NO: 2689313 - RNA, 19 nt, Haemophilus influenzae Rd
cugcuuuaauucgugcaaa

SEQ ID NO: 2689314 - RNA, 14 nt, Haemophilus influenzae Rd
cugcuuuauuuucu

SEQ ID NO: 2689315 - RNA, 20 nt, Haemophilus influenzae Rd
cuguugggauagauuuuuua

SEQ ID NO: 2689316 - RNA, 23 nt, Haemophilus influenzae Rd
cuguugggguugcgccuaaacca

SEQ ID NO: 2689317 - RNA, 15 nt, Haemophilus influenzae Rd
cuguugguuaaaaau

SEQ ID NO: 2689318 - RNA, 20 nt, Haemophilus influenzae Rd
cuguuuaaaucuaagccuug

SEQ ID NO: 2689319 - RNA, 20 nt, Haemophilus influenzae Rd
cuguuuaguguguccccccg

SEQ ID NO: 2689320 - RNA, 13 nt, Haemophilus influenzae Rd
cuguuuaucaaua

SEQ ID NO: 2689321 - RNA, 21 nt, Haemophilus influenzae Rd
cuguuucaaugucuuuuucuu

SEQ ID NO: 2689322 - RNA, 18 nt, Haemophilus influenzae Rd
cuguuucacgaucauaaa

SEQ ID NO: 2689323 - RNA, 15 nt, Haemophilus influenzae Rd
cuguuucaguuaucu

SEQ ID NO: 2689324 - RNA, 13 nt, Haemophilus influenzae Rd
cuguuucuaauuc

SEQ ID NO: 2689325 - RNA, 14 nt, Haemophilus influenzae Rd
cuguuucuaauucg

SEQ ID NO: 2689326 - RNA, 18 nt, Haemophilus influenzae Rd
cuguuucuuuucaucuuc

SEQ ID NO: 2689327 - RNA, 16 nt, Haemophilus influenzae Rd
cuguuugauaacuuua

SEQ ID NO: 2689328 - RNA, 19 nt, Haemophilus influenzae Rd
cuguuugauaacuuuaagu

SEQ ID NO: 2689329 - RNA, 19 nt, Haemophilus influenzae Rd
cuguuugcguuucagcagg

SEQ ID NO: 2689330 - RNA, 16 nt, Haemophilus influenzae Rd
cuguuugugcacagau

SEQ ID NO: 2689331 - RNA, 17 nt, Haemophilus influenzae Rd
cuguuugugcacagauu

SEQ ID NO: 2689332 - RNA, 16 nt, Haemophilus influenzae Rd
cuguuuguuuuuucua

SEQ ID NO: 2689333 - RNA, 15 nt, Haemophilus influenzae Rd
cuguuuuaugcuaaa

SEQ ID NO: 2689334 - RNA, 15 nt, Haemophilus influenzae Rd
cuguuuucauuauau

SEQ ID NO: 2689335 - RNA, 19 nt, Haemophilus influenzae Rd
cuguuuucauuauauuuaa

SEQ ID NO: 2689336 - RNA, 14 nt, Haemophilus influenzae Rd
cuguuuuuccauuc

SEQ ID NO: 2689337 - RNA, 17 nt, Haemophilus influenzae Rd
cuuaaaaaagugaaaga

SEQ ID NO: 2689338 - RNA, 13 nt, Haemophilus influenzae Rd
cuuaaaaauaaag

SEQ ID NO: 2689339 - RNA, 22 nt, Haemophilus influenzae Rd
cuuaaaccaaauugauucauuu

SEQ ID NO: 2689340 - RNA, 23 nt, Haemophilus influenzae Rd
cuuaaaccaaauugauucauuug

SEQ ID NO: 2689341 - RNA, 22 nt, Haemophilus influenzae Rd
cuuaaacuaaaugaaguucacu

SEQ ID NO: 2689342 - RNA, 23 nt, Haemophilus influenzae Rd
cuuaaagaauuucuuucgcuuuu

SEQ ID NO: 2689343 - RNA, 20 nt, Haemophilus influenzae Rd
cuuaaagcaaucaaaaauga

SEQ ID NO: 2689344 - RNA, 23 nt, Haemophilus influenzae Rd
cuuaaagcaaucaaaaaugaaag

SEQ ID NO: 2689345 - RNA, 21 nt, Haemophilus influenzae Rd
cuuaaaguuaucaaacaguuc

SEQ ID NO: 2689346 - RNA, 13 nt, Haemophilus influenzae Rd
cuuaaauaguuaa

SEQ ID NO: 2689347 - RNA, 23 nt, Haemophilus influenzae Rd
cuuaaauaguuaauugauuuaaa

SEQ ID NO: 2689348 - RNA, 17 nt, Haemophilus influenzae Rd
cuuaaauauaucaagca

SEQ ID NO: 2689349 - RNA, 17 nt, Haemophilus influenzae Rd
cuuaaaugggaaacuga

SEQ ID NO: 2689350 - RNA, 20 nt, Haemophilus influenzae Rd
cuuaaauuagcguaaacauu

SEQ ID NO: 2689351 - RNA, 14 nt, Haemophilus influenzae Rd
cuuaaauucauaau

SEQ ID NO: 2689352 - RNA, 15 nt, Haemophilus influenzae Rd
cuuaaauuuuuauaa

SEQ ID NO: 2689353 - RNA, 17 nt, Haemophilus influenzae Rd
cuuaacaacaaagucaa

SEQ ID NO: 2689354 - RNA, 12 nt, Haemophilus influenzae Rd
cuuaacauuuuc

SEQ ID NO: 2689355 - RNA, 13 nt, Haemophilus influenzae Rd
cuuaaccaucaca

SEQ ID NO: 2689356 - RNA, 18 nt, Haemophilus influenzae Rd
cuuaaccaucacaaagga

SEQ ID NO: 2689357 - RNA, 15 nt, Haemophilus influenzae Rd
cuuaacuaauuguuu

SEQ ID NO: 2689358 - RNA, 17 nt, Haemophilus influenzae Rd
cuuaagguuuauagaug

SEQ ID NO: 2689359 - RNA, 20 nt, Haemophilus influenzae Rd
cuuaagucagcauaaacaaa

SEQ ID NO: 2689360 - RNA, 14 nt, Haemophilus influenzae Rd
cuuaauaaauauug

SEQ ID NO: 2689361 - RNA, 16 nt, Haemophilus influenzae Rd
cuuaauaaauauugau

SEQ ID NO: 2689362 - RNA, 20 nt, Haemophilus influenzae Rd
cuuaauaauggauuaauucg

SEQ ID NO: 2689363 - RNA, 17 nt, Haemophilus influenzae Rd
cuuaauagagaauaauu

SEQ ID NO: 2689364 - RNA, 20 nt, Haemophilus influenzae Rd
cuuaauagcugggcaaaauc

SEQ ID NO: 2689365 - RNA, 21 nt, Haemophilus influenzae Rd
cuuaauagcugggcaaaauca

SEQ ID NO: 2689366 - RNA, 22 nt, Haemophilus influenzae Rd
cuuaauaggugcuuaacugaaa

SEQ ID NO: 2689367 - RNA, 14 nt, Haemophilus influenzae Rd
cuuaauauguucuu

SEQ ID NO: 2689368 - RNA, 20 nt, Haemophilus influenzae Rd
cuuaaucacugaauuucauu

SEQ ID NO: 2689369 - RNA, 13 nt, Haemophilus influenzae Rd
cuuaaucauugca

SEQ ID NO: 2689370 - RNA, 14 nt, Haemophilus influenzae Rd
cuuaaugcaaaauc

SEQ ID NO: 2689371 - RNA, 17 nt, Haemophilus influenzae Rd
cuuaaugcaaaaucuuu

SEQ ID NO: 2689372 - RNA, 21 nt, Haemophilus influenzae Rd
cuuaauggcuugcucuguauu

SEQ ID NO: 2689373 - RNA, 15 nt, Haemophilus influenzae Rd
cuuaauuaaagauag

SEQ ID NO: 2689374 - RNA, 22 nt, Haemophilus influenzae Rd
cuuaauuaacgggcuuaaacuu

SEQ ID NO: 2689375 - RNA, 13 nt, Haemophilus influenzae Rd
cuuaauuaagaua

SEQ ID NO: 2689376 - RNA, 18 nt, Haemophilus influenzae Rd
cuuaauuaaucuuuuuuc

SEQ ID NO: 2689377 - RNA, 16 nt, Haemophilus influenzae Rd
cuuaauucuaagguua

SEQ ID NO: 2689378 - RNA, 16 nt, Haemophilus influenzae Rd
cuuaauucuugccaua

SEQ ID NO: 2689379 - RNA, 13 nt, Haemophilus influenzae Rd
cuuaauuuaauua

SEQ ID NO: 2689380 - RNA, 23 nt, Haemophilus influenzae Rd
cuuaauuuaauuauguauuuucu

SEQ ID NO: 2689381 - RNA, 16 nt, Haemophilus influenzae Rd
cuuaauuucuuaauua

SEQ ID NO: 2689382 - RNA, 14 nt, Haemophilus influenzae Rd
cuuaauuuuuuaac

SEQ ID NO: 2689383 - RNA, 16 nt, Haemophilus influenzae Rd
cuuaauuuuuuaaccg

SEQ ID NO: 2689384 - RNA, 18 nt, Haemophilus influenzae Rd
cuuacauugcuuaacauu

SEQ ID NO: 2689385 - RNA, 15 nt, Haemophilus influenzae Rd
cuuacccaguaaaac

SEQ ID NO: 2689386 - RNA, 21 nt, Haemophilus influenzae Rd
cuuaccuaaaaauuuaaauau

SEQ ID NO: 2689387 - RNA, 14 nt, Haemophilus influenzae Rd
cuuaccuuccacuu

SEQ ID NO: 2689388 - RNA, 15 nt, Haemophilus influenzae Rd
cuuacucauuuauca

SEQ ID NO: 2689389 - RNA, 18 nt, Haemophilus influenzae Rd
cuuacuucuacuucuugu

SEQ ID NO: 2689390 - RNA, 21 nt, Haemophilus influenzae Rd
cuuacuuuauacuaaaaguac

SEQ ID NO: 2689391 - RNA, 19 nt, Haemophilus influenzae Rd
cuuacuuuauuuuuaagug

SEQ ID NO: 2689392 - RNA, 15 nt, Haemophilus influenzae Rd
cuuacuuuuuguuug

SEQ ID NO: 2689393 - RNA, 18 nt, Haemophilus influenzae Rd
cuuagacaaauuaaauua

SEQ ID NO: 2689394 - RNA, 16 nt, Haemophilus influenzae Rd
cuuagauuugaaccuu

SEQ ID NO: 2689395 - RNA, 13 nt, Haemophilus influenzae Rd
cuuagauuuucuu

SEQ ID NO: 2689396 - RNA, 13 nt, Haemophilus influenzae Rd
cuuagcuucaucu

SEQ ID NO: 2689397 - RNA, 14 nt, Haemophilus influenzae Rd
cuuagcuuuuuucu

SEQ ID NO: 2689398 - RNA, 16 nt, Haemophilus influenzae Rd
cuuagcuuuuuucuua

SEQ ID NO: 2689399 - RNA, 17 nt, Haemophilus influenzae Rd
cuuagggucgcaacuaa

SEQ ID NO: 2689400 - RNA, 20 nt, Haemophilus influenzae Rd
cuuaguauuuuauuuaagcu

SEQ ID NO: 2689401 - RNA, 12 nt, Haemophilus influenzae Rd
cuuaguccuuuu

SEQ ID NO: 2689402 - RNA, 22 nt, Haemophilus influenzae Rd
cuuagucggcgacgauuuaaua

SEQ ID NO: 2689403 - RNA, 14 nt, Haemophilus influenzae Rd
cuuaguuaaauaua

SEQ ID NO: 2689404 - RNA, 20 nt, Haemophilus influenzae Rd
cuuaguuccaccacccuucu

SEQ ID NO: 2689405 - RNA, 15 nt, Haemophilus influenzae Rd
cuuaguuuuaauucu

SEQ ID NO: 2689406 - RNA, 12 nt, Haemophilus influenzae Rd
cuuauaaauuua

SEQ ID NO: 2689407 - RNA, 21 nt, Haemophilus influenzae Rd
cuuauaagcuguauuacuuau

SEQ ID NO: 2689408 - RNA, 13 nt, Haemophilus influenzae Rd
cuuauacaaaacu

SEQ ID NO: 2689409 - RNA, 14 nt, Haemophilus influenzae Rd
cuuauacaaaacua

SEQ ID NO: 2689410 - RNA, 19 nt, Haemophilus influenzae Rd
cuuauacgaguaaaaaauc

SEQ ID NO: 2689411 - RNA, 14 nt, Haemophilus influenzae Rd
cuuauauauaaaau

SEQ ID NO: 2689412 - RNA, 18 nt, Haemophilus influenzae Rd
cuuauauauaaaauauau

SEQ ID NO: 2689413 - RNA, 16 nt, Haemophilus influenzae Rd
cuuauauuauuuagau

SEQ ID NO: 2689414 - RNA, 14 nt, Haemophilus influenzae Rd
cuuauauucagacu

SEQ ID NO: 2689415 - RNA, 13 nt, Haemophilus influenzae Rd
cuuauauuuuuga

SEQ ID NO: 2689416 - RNA, 21 nt, Haemophilus influenzae Rd
cuuaucaaucaagaauuccau

SEQ ID NO: 2689417 - RNA, 23 nt, Haemophilus influenzae Rd
cuuaucccauaccguauuuuuuu

SEQ ID NO: 2689418 - RNA, 16 nt, Haemophilus influenzae Rd
cuuauccugccuugca

SEQ ID NO: 2689419 - RNA, 15 nt, Haemophilus influenzae Rd
cuuaucgcaaucacg

SEQ ID NO: 2689420 - RNA, 14 nt, Haemophilus influenzae Rd
cuuaucuaaaaaga

SEQ ID NO: 2689421 - RNA, 22 nt, Haemophilus influenzae Rd
cuucgcgagaauuaccacaaga

SEQ ID NO: 2689422 - RNA, 20 nt, Haemophilus influenzae Rd
cuucgcuaauuuuuuuccaa

SEQ ID NO: 2689423 - RNA, 19 nt, Haemophilus influenzae Rd
cuucgcuccaaucaucauc

SEQ ID NO: 2689424 - RNA, 13 nt, Haemophilus influenzae Rd
cuucgggcaccau

SEQ ID NO: 2689425 - RNA, 14 nt, Haemophilus influenzae Rd
cuucgucaucauca

SEQ ID NO: 2689426 - RNA, 20 nt, Haemophilus influenzae Rd
cuucguuuucugcuucagau

SEQ ID NO: 2689427 - RNA, 18 nt, Haemophilus influenzae Rd
cuucuaaaaccaauaauc

SEQ ID NO: 2689428 - RNA, 12 nt, Haemophilus influenzae Rd
cuucuaaaagau

SEQ ID NO: 2689429 - RNA, 15 nt, Haemophilus influenzae Rd
cuucuaaaggcuaaa

SEQ ID NO: 2689430 - RNA, 18 nt, Haemophilus influenzae Rd
cuucuaacgccauuggau

SEQ ID NO: 2689431 - RNA, 12 nt, Haemophilus influenzae Rd
cuucuaauucug

SEQ ID NO: 2689432 - RNA, 20 nt, Haemophilus influenzae Rd
cuucuaauucugcacgacgu

SEQ ID NO: 2689433 - RNA, 12 nt, Haemophilus influenzae Rd
cuucuaauucuu

SEQ ID NO: 2689434 - RNA, 13 nt, Haemophilus influenzae Rd
cuucuaauucuuc

SEQ ID NO: 2689435 - RNA, 14 nt, Haemophilus influenzae Rd
cuucuaauucuucc

SEQ ID NO: 2689436 - RNA, 21 nt, Haemophilus influenzae Rd
cuucuaauuugccaucacuca

SEQ ID NO: 2689437 - RNA, 16 nt, Haemophilus influenzae Rd
cuucuaauuuuaaaac

SEQ ID NO: 2689438 - RNA, 14 nt, Haemophilus influenzae Rd
cuucuacaccuucu

SEQ ID NO: 2689439 - RNA, 17 nt, Haemophilus influenzae Rd
cuucuacgccuaaugca

SEQ ID NO: 2689440 - RNA, 20 nt, Haemophilus influenzae Rd
cuucuauguuugcaucaauc

SEQ ID NO: 2689441 - RNA, 22 nt, Haemophilus influenzae Rd
cuucucgcccaacagauuuaau

SEQ ID NO: 2689442 - RNA, 19 nt, Haemophilus influenzae Rd
cuucucuuuuuauuuuacu

SEQ ID NO: 2689443 - RNA, 21 nt, Haemophilus influenzae Rd
cuucugaacgcgcgccaauaa

SEQ ID NO: 2689444 - RNA, 20 nt, Haemophilus influenzae Rd
cuucugcaggaaaaauaaau

SEQ ID NO: 2689445 - RNA, 14 nt, Haemophilus influenzae Rd
cuucugccauauca

SEQ ID NO: 2689446 - RNA, 20 nt, Haemophilus influenzae Rd
cuucugcggucaucucuugu

SEQ ID NO: 2689447 - RNA, 23 nt, Haemophilus influenzae Rd
cuucugcuugguaauaaucaauu

SEQ ID NO: 2689448 - RNA, 21 nt, Haemophilus influenzae Rd
cuucugcuuuacguuuugcuu

SEQ ID NO: 2689449 - RNA, 15 nt, Haemophilus influenzae Rd
cuucugggucuuuuu

SEQ ID NO: 2689450 - RNA, 18 nt, Haemophilus influenzae Rd
cuucugggucuuuuugug

SEQ ID NO: 2689451 - RNA, 20 nt, Haemophilus influenzae Rd
cuucuguaagcagcuaacaa

SEQ ID NO: 2689452 - RNA, 23 nt, Haemophilus influenzae Rd
cuucuguuaaacgcauauuuugu

SEQ ID NO: 2689453 - RNA, 16 nt, Haemophilus influenzae Rd
cuucuguugcuucaau

SEQ ID NO: 2689454 - RNA, 22 nt, Haemophilus influenzae Rd
cuucuguugcuucaauuguugu

SEQ ID NO: 2689455 - RNA, 19 nt, Haemophilus influenzae Rd
cuucuguugggaauaauuc

SEQ ID NO: 2689456 - RNA, 15 nt, Haemophilus influenzae Rd
cuucuguuuucaaua

SEQ ID NO: 2689457 - RNA, 18 nt, Haemophilus influenzae Rd
cuucuguuuugccugcuu

SEQ ID NO: 2689458 - RNA, 19 nt, Haemophilus influenzae Rd
cuucuuacguuuaaauuua

SEQ ID NO: 2689459 - RNA, 12 nt, Haemophilus influenzae Rd
cuucuucaauug

SEQ ID NO: 2689460 - RNA, 15 nt, Haemophilus influenzae Rd
cuucuucaucgcuca

SEQ ID NO: 2689461 - RNA, 16 nt, Haemophilus influenzae Rd
cuucuuccacuuuuug

SEQ ID NO: 2689462 - RNA, 10 nt, Haemophilus influenzae Rd
cuucuuccca

SEQ ID NO: 2689463 - RNA, 11 nt, Haemophilus influenzae Rd
cuucuucccaa

SEQ ID NO: 2689464 - RNA, 17 nt, Haemophilus influenzae Rd
cuucuucgcuccaauca

SEQ ID NO: 2689465 - RNA, 22 nt, Haemophilus influenzae Rd
cuucuucgcuccaaucaucauc

SEQ ID NO: 2689466 - RNA, 22 nt, Haemophilus influenzae Rd
cuucuucggcgaggcauucauu

SEQ ID NO: 2689467 - RNA, 20 nt, Haemophilus influenzae Rd
cuucuucuuggcaauauuua

SEQ ID NO: 2689468 - RNA, 17 nt, Haemophilus influenzae Rd
cuucuugcagggcuuug

SEQ ID NO: 2689469 - RNA, 14 nt, Haemophilus influenzae Rd
cuucuuguggagau

SEQ ID NO: 2689470 - RNA, 20 nt, Haemophilus influenzae Rd
cuucuuuaauuucuucaacu

SEQ ID NO: 2689471 - RNA, 22 nt, Haemophilus influenzae Rd
cuucuuuauuugagccaauaac

SEQ ID NO: 2689472 - RNA, 22 nt, Haemophilus influenzae Rd
cuucuuugauauaaauuguuuu

SEQ ID NO: 2689473 - RNA, 13 nt, Haemophilus influenzae Rd
cuucuuuguuucc

SEQ ID NO: 2689474 - RNA, 21 nt, Haemophilus influenzae Rd
cuucuuuuagugguucagauu

SEQ ID NO: 2689475 - RNA, 19 nt, Haemophilus influenzae Rd
cuucuuuuggauacacaaa

SEQ ID NO: 2689476 - RNA, 19 nt, Haemophilus influenzae Rd
cuugaagucuauaaaagaa

SEQ ID NO: 2689477 - RNA, 23 nt, Haemophilus influenzae Rd
cuugaagucuauaaaagaaggga

SEQ ID NO: 2689478 - RNA, 20 nt, Haemophilus influenzae Rd
cuugaaguuugauuccguuu

SEQ ID NO: 2689479 - RNA, 21 nt, Haemophilus influenzae Rd
cuugaaugucuuaaagauaaa

SEQ ID NO: 2689480 - RNA, 15 nt, Haemophilus influenzae Rd
cuugaauugauaaag

SEQ ID NO: 2689481 - RNA, 18 nt, Haemophilus influenzae Rd
cuugaauugcauuuucuu

SEQ ID NO: 2689482 - RNA, 19 nt, Haemophilus influenzae Rd
cuugaccagagccaaauac

SEQ ID NO: 2689483 - RNA, 13 nt, Haemophilus influenzae Rd
cuugaccuucaau

SEQ ID NO: 2689484 - RNA, 15 nt, Haemophilus influenzae Rd
cuugaccuuucaaua

SEQ ID NO: 2689485 - RNA, 15 nt, Haemophilus influenzae Rd
cuugacguuguucuu

SEQ ID NO: 2689486 - RNA, 21 nt, Haemophilus influenzae Rd
cuugacguuguucuucuguua

SEQ ID NO: 2689487 - RNA, 15 nt, Haemophilus influenzae Rd
cuugacuaucuguuu

SEQ ID NO: 2689488 - RNA, 21 nt, Haemophilus influenzae Rd
cuugaguuucgccagcaccac

SEQ ID NO: 2689489 - RNA, 23 nt, Haemophilus influenzae Rd
cuugauaaaaaugagauuauuuc

SEQ ID NO: 2689490 - RNA, 20 nt, Haemophilus influenzae Rd
cuugauaaguaggcaaaauc

SEQ ID NO: 2689491 - RNA, 21 nt, Haemophilus influenzae Rd
cuugauacauuucuaaaauaa

SEQ ID NO: 2689492 - RNA, 21 nt, Haemophilus influenzae Rd
cuugauauaaguucuaaauaa

SEQ ID NO: 2689493 - RNA, 24 nt, Haemophilus influenzae Rd
cuugauauaaguucuaaauaaacu

SEQ ID NO: 2689494 - RNA, 16 nt, Haemophilus influenzae Rd
cuugauccauauauug

SEQ ID NO: 2689495 - RNA, 23 nt, Haemophilus influenzae Rd
cuugauccccauacaaguauuuu

SEQ ID NO: 2689496 - RNA, 12 nt, Haemophilus influenzae Rd
cuugaucuacag

SEQ ID NO: 2689497 - RNA, 13 nt, Haemophilus influenzae Rd
cuugaucuacaga

SEQ ID NO: 2689498 - RNA, 17 nt, Haemophilus influenzae Rd
cuugaucuacagaagug

SEQ ID NO: 2689499 - RNA, 18 nt, Haemophilus influenzae Rd
cuugauguuuuugaagua

SEQ ID NO: 2689500 - RNA, 15 nt, Haemophilus influenzae Rd
cuugauuaacaucuu

SEQ ID NO: 2689501 - RNA, 20 nt, Haemophilus influenzae Rd
cuugauuauuuaauuucaaa

SEQ ID NO: 2689502 - RNA, 23 nt, Haemophilus influenzae Rd
cuugauuauuuaauuucaaaauc

SEQ ID NO: 2689503 - RNA, 12 nt, Haemophilus influenzae Rd
cuugauuauuuu

SEQ ID NO: 2689504 - RNA, 18 nt, Haemophilus influenzae Rd
cuugauugcacuucaccg

SEQ ID NO: 2689505 - RNA, 19 nt, Haemophilus influenzae Rd
cuugauuucaguagaauca

SEQ ID NO: 2689506 - RNA, 20 nt, Haemophilus influenzae Rd
cuugauuucaguagaaucaa

SEQ ID NO: 2689507 - RNA, 18 nt, Haemophilus influenzae Rd
cuugcaagggauuugaaa

SEQ ID NO: 2689508 - RNA, 20 nt, Haemophilus influenzae Rd
cuugcaaucacgcucaaucu

SEQ ID NO: 2689509 - RNA, 13 nt, Haemophilus influenzae Rd
cuugcacaauuug

SEQ ID NO: 2689510 - RNA, 16 nt, Haemophilus influenzae Rd
cuugcaccaccaauua

SEQ ID NO: 2689511 - RNA, 19 nt, Haemophilus influenzae Rd
cuugcagauugcugacaaa

SEQ ID NO: 2689512 - RNA, 23 nt, Haemophilus influenzae Rd
cuugcagggcuuuguauuuugug

SEQ ID NO: 2689513 - RNA, 20 nt, Haemophilus influenzae Rd
cuugcauaauuccuuuuucu

SEQ ID NO: 2689514 - RNA, 22 nt, Haemophilus influenzae Rd
cuugcauauuugcgauugcugu

SEQ ID NO: 2689515 - RNA, 17 nt, Haemophilus influenzae Rd
cuugcauucacaaaagu

SEQ ID NO: 2689516 - RNA, 16 nt, Haemophilus influenzae Rd
cuugcauuuacauaaa

SEQ ID NO: 2689517 - RNA, 23 nt, Haemophilus influenzae Rd
cuugccaauugaauuaaaaguag

SEQ ID NO: 2689518 - RNA, 15 nt, Haemophilus influenzae Rd
cuugccacagguaaa

SEQ ID NO: 2689519 - RNA, 21 nt, Haemophilus influenzae Rd
cuugccacagguaaagaacca

SEQ ID NO: 2689520 - RNA, 13 nt, Haemophilus influenzae Rd
cuugccagauuuu

SEQ ID NO: 2689521 - RNA, 17 nt, Haemophilus influenzae Rd
cuugcccaauauaacaa

SEQ ID NO: 2689522 - RNA, 17 nt, Haemophilus influenzae Rd
cuugcccaucuugccaa

SEQ ID NO: 2689523 - RNA, 17 nt, Haemophilus influenzae Rd
cuugccgcacuuuuuau

SEQ ID NO: 2689524 - RNA, 16 nt, Haemophilus influenzae Rd
cuugccgcuuccacac

SEQ ID NO: 2689525 - RNA, 18 nt, Haemophilus influenzae Rd
cuugcgauaucuucuaau

SEQ ID NO: 2689526 - RNA, 14 nt, Haemophilus influenzae Rd
cuuuaauuuguuuu

SEQ ID NO: 2689527 - RNA, 18 nt, Haemophilus influenzae Rd
cuuuaauuuguuuuucga

SEQ ID NO: 2689528 - RNA, 18 nt, Haemophilus influenzae Rd
cuuuaauuuuaucuaauc

SEQ ID NO: 2689529 - RNA, 19 nt, Haemophilus influenzae Rd
cuuuaauuuuaucuaauca

SEQ ID NO: 2689530 - RNA, 23 nt, Haemophilus influenzae Rd
cuuuacaaugaguguuauugaug

SEQ ID NO: 2689531 - RNA, 15 nt, Haemophilus influenzae Rd
cuuuacauuuaaacu

SEQ ID NO: 2689532 - RNA, 20 nt, Haemophilus influenzae Rd
cuuuacauuuggcaaaauaa

SEQ ID NO: 2689533 - RNA, 20 nt, Haemophilus influenzae Rd
cuuuaccauugcguucacuc

SEQ ID NO: 2689534 - RNA, 20 nt, Haemophilus influenzae Rd
cuuuacccuauuacuuucca

SEQ ID NO: 2689535 - RNA, 19 nt, Haemophilus influenzae Rd
cuuuaccgcaaucuucaca

SEQ ID NO: 2689536 - RNA, 13 nt, Haemophilus influenzae Rd
cuuuacggauaau

SEQ ID NO: 2689537 - RNA, 20 nt, Haemophilus influenzae Rd
cuuuacggauaauuucccua

SEQ ID NO: 2689538 - RNA, 16 nt, Haemophilus influenzae Rd
cuuuacgggauuuuuu

SEQ ID NO: 2689539 - RNA, 14 nt, Haemophilus influenzae Rd
cuuuacguaaagua

SEQ ID NO: 2689540 - RNA, 20 nt, Haemophilus influenzae Rd
cuuuacguaaaguaaaugcu

SEQ ID NO: 2689541 - RNA, 14 nt, Haemophilus influenzae Rd
cuuuacuaaagugg

SEQ ID NO: 2689542 - RNA, 17 nt, Haemophilus influenzae Rd
cuuuacuguucaaauaa

SEQ ID NO: 2689543 - RNA, 21 nt, Haemophilus influenzae Rd
cuuuacuuuuuaauaaaucaa

SEQ ID NO: 2689544 - RNA, 18 nt, Haemophilus influenzae Rd
cuuuagaaaguuuugcaa

SEQ ID NO: 2689545 - RNA, 20 nt, Haemophilus influenzae Rd
cuuuagacaacaacuuuucu

SEQ ID NO: 2689546 - RNA, 13 nt, Haemophilus influenzae Rd
cuuuagcccacca

SEQ ID NO: 2689547 - RNA, 17 nt, Haemophilus influenzae Rd
cuuuagcccaccaauua

SEQ ID NO: 2689548 - RNA, 20 nt, Haemophilus influenzae Rd
cuuuaguguauaacaaauag

SEQ ID NO: 2689549 - RNA, 22 nt, Haemophilus influenzae Rd
cuuuaguuuuagggaagauuaa

SEQ ID NO: 2689550 - RNA, 12 nt, Haemophilus influenzae Rd
cuuuauaaauga

SEQ ID NO: 2689551 - RNA, 19 nt, Haemophilus influenzae Rd
cuuuauagccuauaauuaa

SEQ ID NO: 2689552 - RNA, 21 nt, Haemophilus influenzae Rd
cuuuauaguuguaggugggcu

SEQ ID NO: 2689553 - RNA, 13 nt, Haemophilus influenzae Rd
cuuuaucaaagaa

SEQ ID NO: 2689554 - RNA, 15 nt, Haemophilus influenzae Rd
cuuuaucauaacuau

SEQ ID NO: 2689555 - RNA, 19 nt, Haemophilus influenzae Rd
cuuuaucuauugauucuaa

SEQ ID NO: 2689556 - RNA, 23 nt, Haemophilus influenzae Rd
cuuuaucuauugauucuaaaaac

SEQ ID NO: 2689557 - RNA, 15 nt, Haemophilus influenzae Rd
cuuuaugaauuacca

SEQ ID NO: 2689558 - RNA, 15 nt, Haemophilus influenzae Rd
cuuuaugacuauuuu

SEQ ID NO: 2689559 - RNA, 12 nt, Haemophilus influenzae Rd
cuuuauuacagu

SEQ ID NO: 2689560 - RNA, 13 nt, Haemophilus influenzae Rd
cuuuauuacuuuu

SEQ ID NO: 2689561 - RNA, 22 nt, Haemophilus influenzae Rd
cuuuauucaaccguacacgcgc

SEQ ID NO: 2689562 - RNA, 15 nt, Haemophilus influenzae Rd
cuuuauucuuuagug

SEQ ID NO: 2689563 - RNA, 19 nt, Haemophilus influenzae Rd
cuuuauuuaaauuaaaaag

SEQ ID NO: 2689564 - RNA, 21 nt, Haemophilus influenzae Rd
cuuuauuuaauucacgaaugu

SEQ ID NO: 2689565 - RNA, 22 nt, Haemophilus influenzae Rd
cuuuauuucauaucucacaaua

SEQ ID NO: 2689566 - RNA, 22 nt, Haemophilus influenzae Rd
cuuuauuugcaccuuguaacca

SEQ ID NO: 2689567 - RNA, 20 nt, Haemophilus influenzae Rd
cuuuauuugucagauuuacc

SEQ ID NO: 2689568 - RNA, 14 nt, Haemophilus influenzae Rd
cuuuauuuugcaac

SEQ ID NO: 2689569 - RNA, 18 nt, Haemophilus influenzae Rd
cuuucaacuguucuucug

SEQ ID NO: 2689570 - RNA, 18 nt, Haemophilus influenzae Rd
cuuucaauaauuuuucuu

SEQ ID NO: 2689571 - RNA, 10 nt, Haemophilus influenzae Rd
cuuucaauuu

SEQ ID NO: 2689572 - RNA, 19 nt, Haemophilus influenzae Rd
cuuucacaacuggacgcuc

SEQ ID NO: 2689573 - RNA, 22 nt, Haemophilus influenzae Rd
cuuucaccaaauaauguuaaau

SEQ ID NO: 2689574 - RNA, 15 nt, Haemophilus influenzae Rd
cuuucauaaagauaa

SEQ ID NO: 2689575 - RNA, 17 nt, Haemophilus influenzae Rd
cuuucauaaauucaucu

SEQ ID NO: 2689576 - RNA, 17 nt, Haemophilus influenzae Rd
cuuucauauaaauaaga

SEQ ID NO: 2689577 - RNA, 19 nt, Haemophilus influenzae Rd
cuuucauccucucgccaaa

SEQ ID NO: 2689578 - RNA, 21 nt, Haemophilus influenzae Rd
cuuucauucguauaaauauuu

SEQ ID NO: 2689579 - RNA, 16 nt, Haemophilus influenzae Rd
cuuucauuuuccaacc

SEQ ID NO: 2689580 - RNA, 12 nt, Haemophilus influenzae Rd
cuuuccaaucau

SEQ ID NO: 2689581 - RNA, 23 nt, Haemophilus influenzae Rd
cuuuccaccccagaauuaagauc

SEQ ID NO: 2689582 - RNA, 21 nt, Haemophilus influenzae Rd
cuuuccauuuuuuucuauuua

SEQ ID NO: 2689583 - RNA, 19 nt, Haemophilus influenzae Rd
cuuuccccccuuagcucag

SEQ ID NO: 2689584 - RNA, 19 nt, Haemophilus influenzae Rd
cuuucccgcaacuuuugca

SEQ ID NO: 2689585 - RNA, 20 nt, Haemophilus influenzae Rd
cuuucccgcaacuuuugcaa

SEQ ID NO: 2689586 - RNA, 17 nt, Haemophilus influenzae Rd
cuuuccuucuaacauuu

SEQ ID NO: 2689587 - RNA, 19 nt, Haemophilus influenzae Rd
cuuucgaguaguaauaagc

SEQ ID NO: 2689588 - RNA, 20 nt, Haemophilus influenzae Rd
cuuucgccgaguaaauucac

SEQ ID NO: 2689589 - RNA, 17 nt, Haemophilus influenzae Rd
cuuucgcguaauaacaa

SEQ ID NO: 2689590 - RNA, 22 nt, Haemophilus influenzae Rd
cuuucggacuuugauaauacac

SEQ ID NO: 2689591 - RNA, 13 nt, Haemophilus influenzae Rd
cuuucggugcauu

SEQ ID NO: 2689592 - RNA, 16 nt, Haemophilus influenzae Rd
cuuucuaacuuuuaau

SEQ ID NO: 2689593 - RNA, 17 nt, Haemophilus influenzae Rd
cuuucuacgacauuuuu

SEQ ID NO: 2689594 - RNA, 18 nt, Haemophilus influenzae Rd
cuuucuacgacauuuuua

SEQ ID NO: 2689595 - RNA, 14 nt, Haemophilus influenzae Rd
cuuucuauuaaaaa

SEQ ID NO: 2689596 - RNA, 15 nt, Haemophilus influenzae Rd
cuuucuauuaaaaaa

SEQ ID NO: 2689597 - RNA, 13 nt, Haemophilus influenzae Rd
cuuucuuauauuc

SEQ ID NO: 2689598 - RNA, 23 nt, Haemophilus influenzae Rd
cuuucuucagccauuccaaugau

SEQ ID NO: 2689599 - RNA, 23 nt, Haemophilus influenzae Rd
cuuucuucgaugggccuucaacu

SEQ ID NO: 2689600 - RNA, 17 nt, Haemophilus influenzae Rd
cuuucuuguauugccac

SEQ ID NO: 2689601 - RNA, 15 nt, Haemophilus influenzae Rd
cuuucuuuucaauuu

SEQ ID NO: 2689602 - RNA, 13 nt, Haemophilus influenzae Rd
cuuucuuuuucaa

SEQ ID NO: 2689603 - RNA, 20 nt, Haemophilus influenzae Rd
cuuucuuuuuguuuaaaagc

SEQ ID NO: 2689604 - RNA, 14 nt, Haemophilus influenzae Rd
cuuugaaacggcga

SEQ ID NO: 2689605 - RNA, 17 nt, Haemophilus influenzae Rd
cuuugaauguaaaaaau

SEQ ID NO: 2689606 - RNA, 15 nt, Haemophilus influenzae Rd
cuuugacuaaaucau

SEQ ID NO: 2689607 - RNA, 16 nt, Haemophilus influenzae Rd
cuuugacuaaaucaug

SEQ ID NO: 2689608 - RNA, 18 nt, Haemophilus influenzae Rd
cuuugagccguuauauuu

SEQ ID NO: 2689609 - RNA, 23 nt, Haemophilus influenzae Rd
cuuugagccguuauauuuccuuc

SEQ ID NO: 2689610 - RNA, 15 nt, Haemophilus influenzae Rd
cuuugagccuucaaa

SEQ ID NO: 2689611 - RNA, 16 nt, Haemophilus influenzae Rd
cuuugaguaaaaaauc

SEQ ID NO: 2689612 - RNA, 22 nt, Haemophilus influenzae Rd
cuuugauucgcuuggaguucuu

SEQ ID NO: 2689613 - RNA, 14 nt, Haemophilus influenzae Rd
cuuugcagugcauu

SEQ ID NO: 2689614 - RNA, 22 nt, Haemophilus influenzae Rd
cuuugccaauuccuuguacuuc

SEQ ID NO: 2689615 - RNA, 19 nt, Haemophilus influenzae Rd
cuuugccacaggauaaaaa

SEQ ID NO: 2689616 - RNA, 16 nt, Haemophilus influenzae Rd
cuuugccuguuugugc

SEQ ID NO: 2689617 - RNA, 21 nt, Haemophilus influenzae Rd
cuuugccuugaugcucugcau

SEQ ID NO: 2689618 - RNA, 14 nt, Haemophilus influenzae Rd
cuuugcgaguuuca

SEQ ID NO: 2689619 - RNA, 21 nt, Haemophilus influenzae Rd
cuuugcugacaauuucuaaaa

SEQ ID NO: 2689620 - RNA, 16 nt, Haemophilus influenzae Rd
cuuuggcaaaaaauac

SEQ ID NO: 2689621 - RNA, 14 nt, Haemophilus influenzae Rd
cuuugguaaaagaa

SEQ ID NO: 2689622 - RNA, 19 nt, Haemophilus influenzae Rd
cuuugguuuaguuuacuuu

SEQ ID NO: 2689623 - RNA, 17 nt, Haemophilus influenzae Rd
cuuuguaaguuggauuc

SEQ ID NO: 2689624 - RNA, 13 nt, Haemophilus influenzae Rd
cuuuguacugcca

SEQ ID NO: 2689625 - RNA, 14 nt, Haemophilus influenzae Rd
cuuuguauggcaaa

SEQ ID NO: 2689626 - RNA, 14 nt, Haemophilus influenzae Rd
cuuuguauuuugug

SEQ ID NO: 2689627 - RNA, 18 nt, Haemophilus influenzae Rd
cuuugugccauuucuaaa

SEQ ID NO: 2689628 - RNA, 13 nt, Haemophilus influenzae Rd
cuuuguucauuuu

SEQ ID NO: 2689629 - RNA, 18 nt, Haemophilus influenzae Rd
cuuuguugaaugccauuc

SEQ ID NO: 2689630 - RNA, 23 nt, Haemophilus influenzae Rd
cuuuguuuuauagccuucugcca

SEQ ID NO: 2689631 - RNA, 17 nt, Haemophilus influenzae Rd
cuuuuuuauucuccaaa

SEQ ID NO: 2689632 - RNA, 19 nt, Haemophilus influenzae Rd
cuuuuuucgcaccaaugcc

SEQ ID NO: 2689633 - RNA, 17 nt, Haemophilus influenzae Rd
cuuuuuucucaauaccu

SEQ ID NO: 2689634 - RNA, 22 nt, Haemophilus influenzae Rd
cuuuuuugauacuaacucaaaa

SEQ ID NO: 2689635 - RNA, 11 nt, Haemophilus influenzae Rd
cuuuuuuucau

SEQ ID NO: 2689636 - RNA, 22 nt, Haemophilus influenzae Rd
cuuuuuuucuucucguuuuuua

SEQ ID NO: 2689637 - RNA, 14 nt, Haemophilus influenzae Rd
cuuuuuuuuguuuu

SEQ ID NO: 2689638 - RNA, 23 nt, Haemophilus influenzae Rd
cuuuuuuuuuugcucaaaaucaa

SEQ ID NO: 2689639 - RNA, 12 nt, Haemophilus influenzae Rd
gaaaaaacaaga

SEQ ID NO: 2689640 - RNA, 14 nt, Haemophilus influenzae Rd
gaaaaagcuuccuu

SEQ ID NO: 2689641 - RNA, 19 nt, Haemophilus influenzae Rd
gaaaaaguuagacuaugaa

SEQ ID NO: 2689642 - RNA, 21 nt, Haemophilus influenzae Rd
gaaaaaucaggguuauuugca

SEQ ID NO: 2689643 - RNA, 19 nt, Haemophilus influenzae Rd
gaaaaaucgucaaaaucau

SEQ ID NO: 2689644 - RNA, 21 nt, Haemophilus influenzae Rd
gaaaaaucuuuaccaaaaaau

SEQ ID NO: 2689645 - RNA, 14 nt, Haemophilus influenzae Rd
gaaaaauggacaga

SEQ ID NO: 2689646 - RNA, 15 nt, Haemophilus influenzae Rd
gaaaaauguuuaccu

SEQ ID NO: 2689647 - RNA, 24 nt, Haemophilus influenzae Rd
gaaaaauuuaaucguuuaggaauu

SEQ ID NO: 2689648 - RNA, 22 nt, Haemophilus influenzae Rd
gaaaacacguccgcaaccagca

SEQ ID NO: 2689649 - RNA, 19 nt, Haemophilus influenzae Rd
gaaaacagcggucaaaaua

SEQ ID NO: 2689650 - RNA, 15 nt, Haemophilus influenzae Rd
gaaaaccaaaacaua

SEQ ID NO: 2689651 - RNA, 16 nt, Haemophilus influenzae Rd
gaaaaccgcagcuaau

SEQ ID NO: 2689652 - RNA, 17 nt, Haemophilus influenzae Rd
gaaaacguagguaguuu

SEQ ID NO: 2689653 - RNA, 21 nt, Haemophilus influenzae Rd
gaaaacguagguaguuuucaa

SEQ ID NO: 2689654 - RNA, 11 nt, Haemophilus influenzae Rd
gaaaagaaaac

SEQ ID NO: 2689655 - RNA, 10 nt, Haemophilus influenzae Rd
gaaaagaaau

SEQ ID NO: 2689656 - RNA, 13 nt, Haemophilus influenzae Rd
gaaaagaauaaua

SEQ ID NO: 2689657 - RNA, 14 nt, Haemophilus influenzae Rd
gaaaagcauggauu

SEQ ID NO: 2689658 - RNA, 16 nt, Haemophilus influenzae Rd
gaaaaguaaaugauaa

SEQ ID NO: 2689659 - RNA, 10 nt, Haemophilus influenzae Rd
gaaaauaaua

SEQ ID NO: 2689660 - RNA, 17 nt, Haemophilus influenzae Rd
gaaaauacguacauugu

SEQ ID NO: 2689661 - RNA, 18 nt, Haemophilus influenzae Rd
gaaaauacguacauuguc

SEQ ID NO: 2689662 - RNA, 16 nt, Haemophilus influenzae Rd
gaaaauagaauuugca

SEQ ID NO: 2689663 - RNA, 20 nt, Haemophilus influenzae Rd
gaaaauagcacagccaagug

SEQ ID NO: 2689664 - RNA, 19 nt, Haemophilus influenzae Rd
gaaaauauuauguuuuccc

SEQ ID NO: 2689665 - RNA, 14 nt, Haemophilus influenzae Rd
gaaaaucaaaagaa

SEQ ID NO: 2689666 - RNA, 15 nt, Haemophilus influenzae Rd
gaaaaucaaagauau

SEQ ID NO: 2689667 - RNA, 22 nt, Haemophilus influenzae Rd
gaaaaucaccgcacuuuuauug

SEQ ID NO: 2689668 - RNA, 17 nt, Haemophilus influenzae Rd
gaaaaucaucauauuca

SEQ ID NO: 2689669 - RNA, 18 nt, Haemophilus influenzae Rd
gaaaaucgaucuaaucuu

SEQ ID NO: 2689670 - RNA, 15 nt, Haemophilus influenzae Rd
gaaaaucgcaauaaa

SEQ ID NO: 2689671 - RNA, 20 nt, Haemophilus influenzae Rd
gaaaaucgcaauaaauuuau

SEQ ID NO: 2689672 - RNA, 21 nt, Haemophilus influenzae Rd
gaaaaucguauucucauuuua

SEQ ID NO: 2689673 - RNA, 15 nt, Haemophilus influenzae Rd
gaaaaugcuuauaaa

SEQ ID NO: 2689674 - RNA, 16 nt, Haemophilus influenzae Rd
gaaaaugcuuauaaaa

SEQ ID NO: 2689675 - RNA, 17 nt, Haemophilus influenzae Rd
gaaaauguugguuaaaa

SEQ ID NO: 2689676 - RNA, 18 nt, Haemophilus influenzae Rd
gaaaauuaagaaaauaau

SEQ ID NO: 2689677 - RNA, 19 nt, Haemophilus influenzae Rd
gaaaauuaagaaaauaaua

SEQ ID NO: 2689678 - RNA, 20 nt, Haemophilus influenzae Rd
gaaaauuaagaaaauaauau

SEQ ID NO: 2689679 - RNA, 13 nt, Haemophilus influenzae Rd
gaaaauuaucugc

SEQ ID NO: 2689680 - RNA, 21 nt, Haemophilus influenzae Rd
gaaaauuaucuggcaaucgcc

SEQ ID NO: 2689681 - RNA, 21 nt, Haemophilus influenzae Rd
gaaaauuauugugagauauga

SEQ ID NO: 2689682 - RNA, 15 nt, Haemophilus influenzae Rd
gaaaauucaaaucuu

SEQ ID NO: 2689683 - RNA, 20 nt, Haemophilus influenzae Rd
gaaaauucucuucaacuugc

SEQ ID NO: 2689684 - RNA, 12 nt, Haemophilus influenzae Rd
gaaaauucuucu

SEQ ID NO: 2689685 - RNA, 15 nt, Haemophilus influenzae Rd
gaaaauugcaccuuc

SEQ ID NO: 2689686 - RNA, 22 nt, Haemophilus influenzae Rd
gaaaauugcaccuucuuuugga

SEQ ID NO: 2689687 - RNA, 23 nt, Haemophilus influenzae Rd
gaaaauugcaccuucuuuuggau

SEQ ID NO: 2689688 - RNA, 13 nt, Haemophilus influenzae Rd
gaaaauuuugcca

SEQ ID NO: 2689689 - RNA, 14 nt, Haemophilus influenzae Rd
gaaaauuuugccaa

SEQ ID NO: 2689690 - RNA, 22 nt, Haemophilus influenzae Rd
gaaacaaucuguggcguauuua

SEQ ID NO: 2689691 - RNA, 15 nt, Haemophilus influenzae Rd
gaaacagcuaaaaau

SEQ ID NO: 2689692 - RNA, 16 nt, Haemophilus influenzae Rd
gaaacauuuuucccug

SEQ ID NO: 2689693 - RNA, 17 nt, Haemophilus influenzae Rd
gaaacauuuuucccugu

SEQ ID NO: 2689694 - RNA, 11 nt, Haemophilus influenzae Rd
gaaaccaacag

SEQ ID NO: 2689695 - RNA, 17 nt, Haemophilus influenzae Rd
gaaaccaacgaaaauag

SEQ ID NO: 2689696 - RNA, 18 nt, Haemophilus influenzae Rd
gaaaccaacuuugaccau

SEQ ID NO: 2689697 - RNA, 15 nt, Haemophilus influenzae Rd
gaaaccagcuuucca

SEQ ID NO: 2689698 - RNA, 18 nt, Haemophilus influenzae Rd
gaaaccauugaugaaaug

SEQ ID NO: 2689699 - RNA, 18 nt, Haemophilus influenzae Rd
gaaaccucccaaaaacua

SEQ ID NO: 2689700 - RNA, 14 nt, Haemophilus influenzae Rd
gaaaccuuguaaau

SEQ ID NO: 2689701 - RNA, 18 nt, Haemophilus influenzae Rd
gaaaccuuuuucuuccau

SEQ ID NO: 2689702 - RNA, 19 nt, Haemophilus influenzae Rd
gaaaccuuuuucuuccauu

SEQ ID NO: 2689703 - RNA, 16 nt, Haemophilus influenzae Rd
gaaacgagcauauuuu

SEQ ID NO: 2689704 - RNA, 20 nt, Haemophilus influenzae Rd
gaaacguaaaauaucuuucu

SEQ ID NO: 2689705 - RNA, 21 nt, Haemophilus influenzae Rd
gaaacuaugcagaaucagaau

SEQ ID NO: 2689706 - RNA, 15 nt, Haemophilus influenzae Rd
gaaacugaaccagcc

SEQ ID NO: 2689707 - RNA, 14 nt, Haemophilus influenzae Rd
gaaacuguuuuggc

SEQ ID NO: 2689708 - RNA, 21 nt, Haemophilus influenzae Rd
gaaacuugagauuuuuugacc

SEQ ID NO: 2689709 - RNA, 14 nt, Haemophilus influenzae Rd
gaaacuuucaaaau

SEQ ID NO: 2689710 - RNA, 21 nt, Haemophilus influenzae Rd
gaaagaauauaaauaaaacaa

SEQ ID NO: 2689711 - RNA, 22 nt, Haemophilus influenzae Rd
gaaagagacucuguuccacagg

SEQ ID NO: 2689712 - RNA, 16 nt, Haemophilus influenzae Rd
gaaagaguaagcaagu

SEQ ID NO: 2689713 - RNA, 15 nt, Haemophilus influenzae Rd
gaaagauuacauucu

SEQ ID NO: 2689714 - RNA, 18 nt, Haemophilus influenzae Rd
gaaagcaugaauaaaaau

SEQ ID NO: 2689715 - RNA, 14 nt, Haemophilus influenzae Rd
gaaagcauugcugg

SEQ ID NO: 2689716 - RNA, 18 nt, Haemophilus influenzae Rd
gaaagccuuuuaaaauga

SEQ ID NO: 2689717 - RNA, 22 nt, Haemophilus influenzae Rd
gaaagcgaaaucgcacucacaa

SEQ ID NO: 2689718 - RNA, 14 nt, Haemophilus influenzae Rd
gaaagcguaagcac

SEQ ID NO: 2689719 - RNA, 23 nt, Haemophilus influenzae Rd
gaaagggauuuuuuauacuuguu

SEQ ID NO: 2689720 - RNA, 18 nt, Haemophilus influenzae Rd
gaaagggcgugauaccaa

SEQ ID NO: 2689721 - RNA, 20 nt, Haemophilus influenzae Rd
gaaagggcgugauaccaaug

SEQ ID NO: 2689722 - RNA, 19 nt, Haemophilus influenzae Rd
gaaaguaauggaagaauag

SEQ ID NO: 2689723 - RNA, 13 nt, Haemophilus influenzae Rd
gaaaguaauugca

SEQ ID NO: 2689724 - RNA, 16 nt, Haemophilus influenzae Rd
gaaaguagauauuucu

SEQ ID NO: 2689725 - RNA, 22 nt, Haemophilus influenzae Rd
gaaaguauuaaauauaaugaaa

SEQ ID NO: 2689726 - RNA, 19 nt, Haemophilus influenzae Rd
gaaagucccgugagcauuu

SEQ ID NO: 2689727 - RNA, 19 nt, Haemophilus influenzae Rd
gaaagucgauucaaauaac

SEQ ID NO: 2689728 - RNA, 14 nt, Haemophilus influenzae Rd
gaaaguuaaucaaa

SEQ ID NO: 2689729 - RNA, 15 nt, Haemophilus influenzae Rd
gaaaguucuuuuuug

SEQ ID NO: 2689730 - RNA, 17 nt, Haemophilus influenzae Rd
gaaaguugaauauuuug

SEQ ID NO: 2689731 - RNA, 19 nt, Haemophilus influenzae Rd
gaaaguuggccaauuugca

SEQ ID NO: 2689732 - RNA, 23 nt, Haemophilus influenzae Rd
gaaaguuugcuuagugaaaagaa

SEQ ID NO: 2689733 - RNA, 14 nt, Haemophilus influenzae Rd
gaaauaaccuagaa

SEQ ID NO: 2689734 - RNA, 20 nt, Haemophilus influenzae Rd
gaaauaauauucaaaacauu

SEQ ID NO: 2689735 - RNA, 19 nt, Haemophilus influenzae Rd
gaaauaaucguuuuuccac

SEQ ID NO: 2689736 - RNA, 17 nt, Haemophilus influenzae Rd
gaacuuuuaaaacacgc

SEQ ID NO: 2689737 - RNA, 19 nt, Haemophilus influenzae Rd
gaagaaacaaccagcgcac

SEQ ID NO: 2689738 - RNA, 15 nt, Haemophilus influenzae Rd
gaagaacaaggggaa

SEQ ID NO: 2689739 - RNA, 13 nt, Haemophilus influenzae Rd
gaagaacguaaau

SEQ ID NO: 2689740 - RNA, 12 nt, Haemophilus influenzae Rd
gaagaaguaaaa

SEQ ID NO: 2689741 - RNA, 13 nt, Haemophilus influenzae Rd
gaagaauacaagc

SEQ ID NO: 2689742 - RNA, 13 nt, Haemophilus influenzae Rd
gaagaaucuugcg

SEQ ID NO: 2689743 - RNA, 22 nt, Haemophilus influenzae Rd
gaagagauuauuugcauauaaa

SEQ ID NO: 2689744 - RNA, 18 nt, Haemophilus influenzae Rd
gaagaguaaaacuaauuu

SEQ ID NO: 2689745 - RNA, 16 nt, Haemophilus influenzae Rd
gaagaugaaagugcgg

SEQ ID NO: 2689746 - RNA, 15 nt, Haemophilus influenzae Rd
gaagauuaauugcua

SEQ ID NO: 2689747 - RNA, 15 nt, Haemophilus influenzae Rd
gaagauuacuuucau

SEQ ID NO: 2689748 - RNA, 22 nt, Haemophilus influenzae Rd
gaagauuuacccaacaaauuua

SEQ ID NO: 2689749 - RNA, 18 nt, Haemophilus influenzae Rd
gaagcaacaaucacugua

SEQ ID NO: 2689750 - RNA, 21 nt, Haemophilus influenzae Rd
gaagcacuggugugacuaauc

SEQ ID NO: 2689751 - RNA, 12 nt, Haemophilus influenzae Rd
gaagcagcuggc

SEQ ID NO: 2689752 - RNA, 21 nt, Haemophilus influenzae Rd
gaagcagcuggcgguuugaaa

SEQ ID NO: 2689753 - RNA, 13 nt, Haemophilus influenzae Rd
gaagccaaaucau

SEQ ID NO: 2689754 - RNA, 14 nt, Haemophilus influenzae Rd
gaagcguaaaagua

SEQ ID NO: 2689755 - RNA, 18 nt, Haemophilus influenzae Rd
gaagcuaagaaaauccaa

SEQ ID NO: 2689756 - RNA, 16 nt, Haemophilus influenzae Rd
gaagcuaauucuucua

SEQ ID NO: 2689757 - RNA, 16 nt, Haemophilus influenzae Rd
gaagcugaauaaaaga

SEQ ID NO: 2689758 - RNA, 18 nt, Haemophilus influenzae Rd
gaagguucgaauccuuca

SEQ ID NO: 2689759 - RNA, 20 nt, Haemophilus influenzae Rd
gaagguuucgcauaaaaauu

SEQ ID NO: 2689760 - RNA, 13 nt, Haemophilus influenzae Rd
gaaguaaaaaaau

SEQ ID NO: 2689761 - RNA, 23 nt, Haemophilus influenzae Rd
gaaguaaaauagcugauaauaaa

SEQ ID NO: 2689762 - RNA, 17 nt, Haemophilus influenzae Rd
gaagucagcaauacccg

SEQ ID NO: 2689763 - RNA, 18 nt, Haemophilus influenzae Rd
gaagugcguucauauuug

SEQ ID NO: 2689764 - RNA, 22 nt, Haemophilus influenzae Rd
gaaguuaaaacuugaauggcua

SEQ ID NO: 2689765 - RNA, 16 nt, Haemophilus influenzae Rd
gaaguugcauaacuuc

SEQ ID NO: 2689766 - RNA, 21 nt, Haemophilus influenzae Rd
gaaguuggagauuuuuuagga

SEQ ID NO: 2689767 - RNA, 17 nt, Haemophilus influenzae Rd
gaaguuuuacugauucu

SEQ ID NO: 2689768 - RNA, 12 nt, Haemophilus influenzae Rd
gaaguuuuccau

SEQ ID NO: 2689769 - RNA, 12 nt, Haemophilus influenzae Rd
gaaguuuugcua

SEQ ID NO: 2689770 - RNA, 14 nt, Haemophilus influenzae Rd
gaauaaaaaagccu

SEQ ID NO: 2689771 - RNA, 21 nt, Haemophilus influenzae Rd
gaauaaaagauuuugcagaua

SEQ ID NO: 2689772 - RNA, 13 nt, Haemophilus influenzae Rd
gaauaaaagucag

SEQ ID NO: 2689773 - RNA, 15 nt, Haemophilus influenzae Rd
gaauaaaagucagua

SEQ ID NO: 2689774 - RNA, 23 nt, Haemophilus influenzae Rd
gaauaaaccaaugagaaaaaguc

SEQ ID NO: 2689775 - RNA, 23 nt, Haemophilus influenzae Rd
gaauaaaucacccggcacauaaa

SEQ ID NO: 2689776 - RNA, 12 nt, Haemophilus influenzae Rd
gaauaaaugacc

SEQ ID NO: 2689777 - RNA, 20 nt, Haemophilus influenzae Rd
gaauaaaugcaucauuaaua

SEQ ID NO: 2689778 - RNA, 17 nt, Haemophilus influenzae Rd
gaauaaauuaaaaaaau

SEQ ID NO: 2689779 - RNA, 13 nt, Haemophilus influenzae Rd
gaauaacaacaaa

SEQ ID NO: 2689780 - RNA, 18 nt, Haemophilus influenzae Rd
gaauaacacaccaacaac

SEQ ID NO: 2689781 - RNA, 17 nt, Haemophilus influenzae Rd
gaauaacaugcaaaaua

SEQ ID NO: 2689782 - RNA, 16 nt, Haemophilus influenzae Rd
gaauaacccuuguaac

SEQ ID NO: 2689783 - RNA, 17 nt, Haemophilus influenzae Rd
gaauaacuuuaauuuuc

SEQ ID NO: 2689784 - RNA, 13 nt, Haemophilus influenzae Rd
gaauaauaaauug

SEQ ID NO: 2689785 - RNA, 12 nt, Haemophilus influenzae Rd
gaauaauaacgu

SEQ ID NO: 2689786 - RNA, 12 nt, Haemophilus influenzae Rd
gaauaauaaugc

SEQ ID NO: 2689787 - RNA, 18 nt, Haemophilus influenzae Rd
gaauaauauuaaagaaaa

SEQ ID NO: 2689788 - RNA, 19 nt, Haemophilus influenzae Rd
gaauaauccccuaaacuaa

SEQ ID NO: 2689789 - RNA, 20 nt, Haemophilus influenzae Rd
gaauaauccccuaaacuaag

SEQ ID NO: 2689790 - RNA, 15 nt, Haemophilus influenzae Rd
gaauaauccuucuuc

SEQ ID NO: 2689791 - RNA, 14 nt, Haemophilus influenzae Rd
gaauaauucaaaac

SEQ ID NO: 2689792 - RNA, 22 nt, Haemophilus influenzae Rd
gaauacauccauaacuaaaagg

SEQ ID NO: 2689793 - RNA, 23 nt, Haemophilus influenzae Rd
gaauacauccauaacuaaaagga

SEQ ID NO: 2689794 - RNA, 22 nt, Haemophilus influenzae Rd
gaauaccugauuucgcagcugg

SEQ ID NO: 2689795 - RNA, 15 nt, Haemophilus influenzae Rd
gaauacgaucugcau

SEQ ID NO: 2689796 - RNA, 16 nt, Haemophilus influenzae Rd
gaauacgaucugcauc

SEQ ID NO: 2689797 - RNA, 21 nt, Haemophilus influenzae Rd
gaauacgcccauugaaauaac

SEQ ID NO: 2689798 - RNA, 18 nt, Haemophilus influenzae Rd
gaauacucgcggaucacu

SEQ ID NO: 2689799 - RNA, 23 nt, Haemophilus influenzae Rd
gaauacucgcggaucacuuucug

SEQ ID NO: 2689800 - RNA, 17 nt, Haemophilus influenzae Rd
gaauagcaaauacgccu

SEQ ID NO: 2689801 - RNA, 16 nt, Haemophilus influenzae Rd
gaauagcaauaucugc

SEQ ID NO: 2689802 - RNA, 17 nt, Haemophilus influenzae Rd
gaauagcucaguuggua

SEQ ID NO: 2689803 - RNA, 23 nt, Haemophilus influenzae Rd
gaauagcucaguugguagagcac

SEQ ID NO: 2689804 - RNA, 22 nt, Haemophilus influenzae Rd
gaauauauucaugaaucguuuu

SEQ ID NO: 2689805 - RNA, 23 nt, Haemophilus influenzae Rd
gaauaucaaggagcuaguuuagu

SEQ ID NO: 2689806 - RNA, 14 nt, Haemophilus influenzae Rd
gaauaucaucagaa

SEQ ID NO: 2689807 - RNA, 14 nt, Haemophilus influenzae Rd
gaauaucaucuaga

SEQ ID NO: 2689808 - RNA, 18 nt, Haemophilus influenzae Rd
gaauauccaaacuuucug

SEQ ID NO: 2689809 - RNA, 20 nt, Haemophilus influenzae Rd
gaauaucuaaaugacgugcu

SEQ ID NO: 2689810 - RNA, 20 nt, Haemophilus influenzae Rd
gaauaucuacgccuaauugu

SEQ ID NO: 2689811 - RNA, 18 nt, Haemophilus influenzae Rd
gaauaucugucauuguaa

SEQ ID NO: 2689812 - RNA, 17 nt, Haemophilus influenzae Rd
gaauaucuuccacaaca

SEQ ID NO: 2689813 - RNA, 21 nt, Haemophilus influenzae Rd
gaauaucuuguuuuacuucau

SEQ ID NO: 2689814 - RNA, 17 nt, Haemophilus influenzae Rd
gaauaucuuugacuaaa

SEQ ID NO: 2689815 - RNA, 18 nt, Haemophilus influenzae Rd
gaauaucuuugacuaaau

SEQ ID NO: 2689816 - RNA, 21 nt, Haemophilus influenzae Rd
gaauaucuuugacuaaaucau

SEQ ID NO: 2689817 - RNA, 16 nt, Haemophilus influenzae Rd
gaauauucuuuaaaua

SEQ ID NO: 2689818 - RNA, 21 nt, Haemophilus influenzae Rd
gaauauucuuuaaauauucaa

SEQ ID NO: 2689819 - RNA, 21 nt, Haemophilus influenzae Rd
gaauauugguagcuaaaaaua

SEQ ID NO: 2689820 - RNA, 18 nt, Haemophilus influenzae Rd
gaauauugguuuuauuca

SEQ ID NO: 2689821 - RNA, 14 nt, Haemophilus influenzae Rd
gaauauuuccacug

SEQ ID NO: 2689822 - RNA, 12 nt, Haemophilus influenzae Rd
gaauauuuggga

SEQ ID NO: 2689823 - RNA, 19 nt, Haemophilus influenzae Rd
gaauauuugggaaauggcu

SEQ ID NO: 2689824 - RNA, 16 nt, Haemophilus influenzae Rd
gaaucaaggcuggaau

SEQ ID NO: 2689825 - RNA, 15 nt, Haemophilus influenzae Rd
gaaucaaggcuuugu

SEQ ID NO: 2689826 - RNA, 19 nt, Haemophilus influenzae Rd
gaaucaauuuuuucuccac

SEQ ID NO: 2689827 - RNA, 17 nt, Haemophilus influenzae Rd
gaaucacaacuugacca

SEQ ID NO: 2689828 - RNA, 18 nt, Haemophilus influenzae Rd
gaaucagaguuaaaaguc

SEQ ID NO: 2689829 - RNA, 13 nt, Haemophilus influenzae Rd
gaaucauuuucac

SEQ ID NO: 2689830 - RNA, 16 nt, Haemophilus influenzae Rd
gaaucauuuucaccaa

SEQ ID NO: 2689831 - RNA, 17 nt, Haemophilus influenzae Rd
gaaucauuuucaccaau

SEQ ID NO: 2689832 - RNA, 23 nt, Haemophilus influenzae Rd
gaaucauuuucaccaauuuaucu

SEQ ID NO: 2689833 - RNA, 19 nt, Haemophilus influenzae Rd
gaauccaaaauuacuuuuc

SEQ ID NO: 2689834 - RNA, 18 nt, Haemophilus influenzae Rd
gaaucgaaauuaaaauaa

SEQ ID NO: 2689835 - RNA, 14 nt, Haemophilus influenzae Rd
gaaucgugacaaua

SEQ ID NO: 2689836 - RNA, 15 nt, Haemophilus influenzae Rd
gaaucguuuguaaaa

SEQ ID NO: 2689837 - RNA, 15 nt, Haemophilus influenzae Rd
gaaugaaguuagaaa

SEQ ID NO: 2689838 - RNA, 22 nt, Haemophilus influenzae Rd
gaaugaucugcaccccaaaagc

SEQ ID NO: 2689839 - RNA, 11 nt, Haemophilus influenzae Rd
gaaugauucaa

SEQ ID NO: 2689840 - RNA, 16 nt, Haemophilus influenzae Rd
gaaugauucaauuuga

SEQ ID NO: 2689841 - RNA, 17 nt, Haemophilus influenzae Rd
gaaugccauuaaacuuc

SEQ ID NO: 2689842 - RNA, 19 nt, Haemophilus influenzae Rd
gaccaccaauguuggcaag

SEQ ID NO: 2689843 - RNA, 16 nt, Haemophilus influenzae Rd
gaccaccagaaaguuu

SEQ ID NO: 2689844 - RNA, 17 nt, Haemophilus influenzae Rd
gaccagagccaaauaca

SEQ ID NO: 2689845 - RNA, 21 nt, Haemophilus influenzae Rd
gaccaucgggcuguaaaaaau

SEQ ID NO: 2689846 - RNA, 16 nt, Haemophilus influenzae Rd
gaccaucuaaaccugu

SEQ ID NO: 2689847 - RNA, 15 nt, Haemophilus influenzae Rd
gaccauuaaucacac

SEQ ID NO: 2689848 - RNA, 21 nt, Haemophilus influenzae Rd
gaccauuacagcaagcaucgc

SEQ ID NO: 2689849 - RNA, 17 nt, Haemophilus influenzae Rd
gaccauuggugaaagga

SEQ ID NO: 2689850 - RNA, 17 nt, Haemophilus influenzae Rd
gaccgauuucuaccauu

SEQ ID NO: 2689851 - RNA, 21 nt, Haemophilus influenzae Rd
gaccgcccucuugcacaauuu

SEQ ID NO: 2689852 - RNA, 18 nt, Haemophilus influenzae Rd
gaccgcuuguuuauuauu

SEQ ID NO: 2689853 - RNA, 19 nt, Haemophilus influenzae Rd
gaccguauugucugcaacg

SEQ ID NO: 2689854 - RNA, 15 nt, Haemophilus influenzae Rd
gaccguuaauacuug

SEQ ID NO: 2689855 - RNA, 20 nt, Haemophilus influenzae Rd
gaccguuuaacgcagccgcu

SEQ ID NO: 2689856 - RNA, 14 nt, Haemophilus influenzae Rd
gaccguuuuuucuu

SEQ ID NO: 2689857 - RNA, 21 nt, Haemophilus influenzae Rd
gaccguuuuuucuuuuuccug

SEQ ID NO: 2689858 - RNA, 22 nt, Haemophilus influenzae Rd
gaccguuuuuucuuuuuccuga

SEQ ID NO: 2689859 - RNA, 16 nt, Haemophilus influenzae Rd
gaccugcagaaaggcg

SEQ ID NO: 2689860 - RNA, 15 nt, Haemophilus influenzae Rd
gaccugcagagaaga

SEQ ID NO: 2689861 - RNA, 15 nt, Haemophilus influenzae Rd
gaccuguacuugcuu

SEQ ID NO: 2689862 - RNA, 19 nt, Haemophilus influenzae Rd
gaccuucaauugugccgua

SEQ ID NO: 2689863 - RNA, 18 nt, Haemophilus influenzae Rd
gaccuucugcaucaguau

SEQ ID NO: 2689864 - RNA, 13 nt, Haemophilus influenzae Rd
gaccuugaaguuu

SEQ ID NO: 2689865 - RNA, 14 nt, Haemophilus influenzae Rd
gaccuugcaaauuu

SEQ ID NO: 2689866 - RNA, 23 nt, Haemophilus influenzae Rd
gacgaaaugaaauuaauaagccc

SEQ ID NO: 2689867 - RNA, 22 nt, Haemophilus influenzae Rd
gacgaacgugggaauuuuccca

SEQ ID NO: 2689868 - RNA, 13 nt, Haemophilus influenzae Rd
gacgagcuguugc

SEQ ID NO: 2689869 - RNA, 20 nt, Haemophilus influenzae Rd
gacgauagcggcgaaugugg

SEQ ID NO: 2689870 - RNA, 22 nt, Haemophilus influenzae Rd
gacgauuaauaccaauaauaau

SEQ ID NO: 2689871 - RNA, 23 nt, Haemophilus influenzae Rd
gacgauuuaauagcacagaaaag

SEQ ID NO: 2689872 - RNA, 16 nt, Haemophilus influenzae Rd
gacgauuugacguaaa

SEQ ID NO: 2689873 - RNA, 17 nt, Haemophilus influenzae Rd
gacgauuuuagagguga

SEQ ID NO: 2689874 - RNA, 23 nt, Haemophilus influenzae Rd
gacgcacuguugugaaguuuuuu

SEQ ID NO: 2689875 - RNA, 23 nt, Haemophilus influenzae Rd
gacgcauuacgccuucagaaaga

SEQ ID NO: 2689876 - RNA, 20 nt, Haemophilus influenzae Rd
gacgccaaauaugaacuugu

SEQ ID NO: 2689877 - RNA, 16 nt, Haemophilus influenzae Rd
gacgcccgcagaacuu

SEQ ID NO: 2689878 - RNA, 17 nt, Haemophilus influenzae Rd
gacggcuucagaaaaua

SEQ ID NO: 2689879 - RNA, 17 nt, Haemophilus influenzae Rd
gacggugcgauggggac

SEQ ID NO: 2689880 - RNA, 20 nt, Haemophilus influenzae Rd
gacgguucaguuucaagcac

SEQ ID NO: 2689881 - RNA, 16 nt, Haemophilus influenzae Rd
gacguaaaaguuuucc

SEQ ID NO: 2689882 - RNA, 12 nt, Haemophilus influenzae Rd
gacguaaugcuc

SEQ ID NO: 2689883 - RNA, 20 nt, Haemophilus influenzae Rd
gacguacaauuucaaauaaa

SEQ ID NO: 2689884 - RNA, 13 nt, Haemophilus influenzae Rd
gacgugcuaauuc

SEQ ID NO: 2689885 - RNA, 19 nt, Haemophilus influenzae Rd
gacguugucacguaauaca

SEQ ID NO: 2689886 - RNA, 12 nt, Haemophilus influenzae Rd
gacguuguucuu

SEQ ID NO: 2689887 - RNA, 14 nt, Haemophilus influenzae Rd
gacguuuauuuuua

SEQ ID NO: 2689888 - RNA, 15 nt, Haemophilus influenzae Rd
gacguuucaaaaaua

SEQ ID NO: 2689889 - RNA, 11 nt, Haemophilus influenzae Rd
gacguuuuaag

SEQ ID NO: 2689890 - RNA, 11 nt, Haemophilus influenzae Rd
gacuaaaacca

SEQ ID NO: 2689891 - RNA, 15 nt, Haemophilus influenzae Rd
gacuaaacaaauaaa

SEQ ID NO: 2689892 - RNA, 21 nt, Haemophilus influenzae Rd
gacuaaacaaauaaaaagugg

SEQ ID NO: 2689893 - RNA, 19 nt, Haemophilus influenzae Rd
gacuaaacaacuaacuaag

SEQ ID NO: 2689894 - RNA, 16 nt, Haemophilus influenzae Rd
gacuaaacuuuuaauu

SEQ ID NO: 2689895 - RNA, 12 nt, Haemophilus influenzae Rd
gacuaaauaaau

SEQ ID NO: 2689896 - RNA, 16 nt, Haemophilus influenzae Rd
gacuaaauaaaucaca

SEQ ID NO: 2689897 - RNA, 14 nt, Haemophilus influenzae Rd
gacuaaauuagaau

SEQ ID NO: 2689898 - RNA, 22 nt, Haemophilus influenzae Rd
gacuaaguucgguauucaaucg

SEQ ID NO: 2689899 - RNA, 15 nt, Haemophilus influenzae Rd
gacuaauucguuucu

SEQ ID NO: 2689900 - RNA, 14 nt, Haemophilus influenzae Rd
gacuacaaacaaau

SEQ ID NO: 2689901 - RNA, 18 nt, Haemophilus influenzae Rd
gacuacaaacaaauuuuu

SEQ ID NO: 2689902 - RNA, 18 nt, Haemophilus influenzae Rd
gacuagcaucaaaauaaa

SEQ ID NO: 2689903 - RNA, 19 nt, Haemophilus influenzae Rd
gacuauuaaguucaaauuu

SEQ ID NO: 2689904 - RNA, 12 nt, Haemophilus influenzae Rd
gacuauuacaau

SEQ ID NO: 2689905 - RNA, 18 nt, Haemophilus influenzae Rd
gacuauuucuguauuuuu

SEQ ID NO: 2689906 - RNA, 17 nt, Haemophilus influenzae Rd
gacuauuuuuuucucug

SEQ ID NO: 2689907 - RNA, 20 nt, Haemophilus influenzae Rd
gacucguccaucaaaaaaau

SEQ ID NO: 2689908 - RNA, 15 nt, Haemophilus influenzae Rd
gacugaguucuguca

SEQ ID NO: 2689909 - RNA, 14 nt, Haemophilus influenzae Rd
gacugcuacuuuug

SEQ ID NO: 2689910 - RNA, 13 nt, Haemophilus influenzae Rd
gacuggcaaaaau

SEQ ID NO: 2689911 - RNA, 15 nt, Haemophilus influenzae Rd
gacuggcaaaaaugu

SEQ ID NO: 2689912 - RNA, 21 nt, Haemophilus influenzae Rd
gacuggcuugugaaauaaaau

SEQ ID NO: 2689913 - RNA, 13 nt, Haemophilus influenzae Rd
gacuuaaauuugg

SEQ ID NO: 2689914 - RNA, 18 nt, Haemophilus influenzae Rd
gacuuaauaauauauuca

SEQ ID NO: 2689915 - RNA, 16 nt, Haemophilus influenzae Rd
gacuugcacaauuacu

SEQ ID NO: 2689916 - RNA, 24 nt, Haemophilus influenzae Rd
gacuugcacaauuacuucuuacaa

SEQ ID NO: 2689917 - RNA, 16 nt, Haemophilus influenzae Rd
gacuugugcaagaaau

SEQ ID NO: 2689918 - RNA, 21 nt, Haemophilus influenzae Rd
gacuuguuucauaaaaaaugc

SEQ ID NO: 2689919 - RNA, 23 nt, Haemophilus influenzae Rd
gacuuuaccauugcguucacuca

SEQ ID NO: 2689920 - RNA, 20 nt, Haemophilus influenzae Rd
gacuuuuuucuuaaauauau

SEQ ID NO: 2689921 - RNA, 20 nt, Haemophilus influenzae Rd
gagaaaaaucgucaaaauca

SEQ ID NO: 2689922 - RNA, 22 nt, Haemophilus influenzae Rd
gagaaaaaucuuuaccaaaaaa

SEQ ID NO: 2689923 - RNA, 14 nt, Haemophilus influenzae Rd
gagaacguaaauuc

SEQ ID NO: 2689924 - RNA, 19 nt, Haemophilus influenzae Rd
gagaagcugaauaaaagag

SEQ ID NO: 2689925 - RNA, 17 nt, Haemophilus influenzae Rd
gagaaguuuaagaaaag

SEQ ID NO: 2689926 - RNA, 16 nt, Haemophilus influenzae Rd
gagaauaaguaguuac

SEQ ID NO: 2689927 - RNA, 14 nt, Haemophilus influenzae Rd
gagaauuuuuucuu

SEQ ID NO: 2689928 - RNA, 14 nt, Haemophilus influenzae Rd
gagauaaaacuugc

SEQ ID NO: 2689929 - RNA, 16 nt, Haemophilus influenzae Rd
gagauaaauaaauuca

SEQ ID NO: 2689930 - RNA, 15 nt, Haemophilus influenzae Rd
gagauauaaggcaca

SEQ ID NO: 2689931 - RNA, 17 nt, Haemophilus influenzae Rd
gagaucacuguaaauaa

SEQ ID NO: 2689932 - RNA, 16 nt, Haemophilus influenzae Rd
gagauuguaugaaaaa

SEQ ID NO: 2689933 - RNA, 19 nt, Haemophilus influenzae Rd
gagauuuaauccguuaauu

SEQ ID NO: 2689934 - RNA, 20 nt, Haemophilus influenzae Rd
gagauuuauuuugguauuuu

SEQ ID NO: 2689935 - RNA, 14 nt, Haemophilus influenzae Rd
gagauuuuuugacc

SEQ ID NO: 2689936 - RNA, 11 nt, Haemophilus influenzae Rd
gagcaaaucaa

SEQ ID NO: 2689937 - RNA, 23 nt, Haemophilus influenzae Rd
gagcaaaucaaaaccuuucugua

SEQ ID NO: 2689938 - RNA, 23 nt, Haemophilus influenzae Rd
gagcaaauuacccaaaugaugaa

SEQ ID NO: 2689939 - RNA, 20 nt, Haemophilus influenzae Rd
gagcaaauuuaaauaauaaa

SEQ ID NO: 2689940 - RNA, 13 nt, Haemophilus influenzae Rd
gagcaauauaauc

SEQ ID NO: 2689941 - RNA, 13 nt, Haemophilus influenzae Rd
gagcaaucuuuuu

SEQ ID NO: 2689942 - RNA, 15 nt, Haemophilus influenzae Rd
gagcaccaaauuaaa

SEQ ID NO: 2689943 - RNA, 22 nt, Haemophilus influenzae Rd
gagcaggcacaacgguugaaau

SEQ ID NO: 2689944 - RNA, 21 nt, Haemophilus influenzae Rd
gagcaguaugaugauuguuau

SEQ ID NO: 2689945 - RNA, 16 nt, Haemophilus influenzae Rd
gagcauaaacuaaaau

SEQ ID NO: 2689946 - RNA, 15 nt, Haemophilus influenzae Rd
gagcauauuuuccau

SEQ ID NO: 2689947 - RNA, 18 nt, Haemophilus influenzae Rd
gauaaguauaacuuaaau

SEQ ID NO: 2689948 - RNA, 19 nt, Haemophilus influenzae Rd
gauaaguggggaaaaauau

SEQ ID NO: 2689949 - RNA, 17 nt, Haemophilus influenzae Rd
gauaaguucauaaaagg

SEQ ID NO: 2689950 - RNA, 18 nt, Haemophilus influenzae Rd
gauaauagacauagaaag

SEQ ID NO: 2689951 - RNA, 15 nt, Haemophilus influenzae Rd
gauaauaucgcccgc

SEQ ID NO: 2689952 - RNA, 13 nt, Haemophilus influenzae Rd
gauaauaugcauc

SEQ ID NO: 2689953 - RNA, 15 nt, Haemophilus influenzae Rd
gauaauaugcaucac

SEQ ID NO: 2689954 - RNA, 22 nt, Haemophilus influenzae Rd
gauaauaugcaucacuugugcu

SEQ ID NO: 2689955 - RNA, 17 nt, Haemophilus influenzae Rd
gauaauauguuuugcca

SEQ ID NO: 2689956 - RNA, 20 nt, Haemophilus influenzae Rd
gauaauauuuuugccaauuu

SEQ ID NO: 2689957 - RNA, 20 nt, Haemophilus influenzae Rd
gauaaucagcccaagcuuuu

SEQ ID NO: 2689958 - RNA, 19 nt, Haemophilus influenzae Rd
gauaauccagcuacauuca

SEQ ID NO: 2689959 - RNA, 20 nt, Haemophilus influenzae Rd
gauaaucgaucuuuuuuuug

SEQ ID NO: 2689960 - RNA, 15 nt, Haemophilus influenzae Rd
gauaaucgcaaguag

SEQ ID NO: 2689961 - RNA, 19 nt, Haemophilus influenzae Rd
gauaaucuaaaaaaccuug

SEQ ID NO: 2689962 - RNA, 20 nt, Haemophilus influenzae Rd
gauaaucuacaaaacauaau

SEQ ID NO: 2689963 - RNA, 20 nt, Haemophilus influenzae Rd
gauaaucugauugagaaaau

SEQ ID NO: 2689964 - RNA, 17 nt, Haemophilus influenzae Rd
gauaaugaugaaugcuu

SEQ ID NO: 2689965 - RNA, 16 nt, Haemophilus influenzae Rd
gauaauguuagacauu

SEQ ID NO: 2689966 - RNA, 15 nt, Haemophilus influenzae Rd
gauaauuaaagucag

SEQ ID NO: 2689967 - RNA, 21 nt, Haemophilus influenzae Rd
gauaauuggauacauuccauc

SEQ ID NO: 2689968 - RNA, 20 nt, Haemophilus influenzae Rd
gauaauuucccuaaaaucuu

SEQ ID NO: 2689969 - RNA, 12 nt, Haemophilus influenzae Rd
gauacaagaaag

SEQ ID NO: 2689970 - RNA, 17 nt, Haemophilus influenzae Rd
gauacaagcggcugaca

SEQ ID NO: 2689971 - RNA, 17 nt, Haemophilus influenzae Rd
gauacaaucgguuaaaa

SEQ ID NO: 2689972 - RNA, 18 nt, Haemophilus influenzae Rd
gauacaaucgguuaaaag

SEQ ID NO: 2689973 - RNA, 11 nt, Haemophilus influenzae Rd
gauacagaagg

SEQ ID NO: 2689974 - RNA, 20 nt, Haemophilus influenzae Rd
gauaccaagcauauuugcug

SEQ ID NO: 2689975 - RNA, 16 nt, Haemophilus influenzae Rd
gauaccaauaaucaau

SEQ ID NO: 2689976 - RNA, 14 nt, Haemophilus influenzae Rd
gauaccacauucca

SEQ ID NO: 2689977 - RNA, 21 nt, Haemophilus influenzae Rd
gauaccaccacagaaccagca

SEQ ID NO: 2689978 - RNA, 13 nt, Haemophilus influenzae Rd
gauaccgauaaaa

SEQ ID NO: 2689979 - RNA, 17 nt, Haemophilus influenzae Rd
gauaccgauaaaaccua

SEQ ID NO: 2689980 - RNA, 18 nt, Haemophilus influenzae Rd
gauacuaacucaaaauac

SEQ ID NO: 2689981 - RNA, 12 nt, Haemophilus influenzae Rd
gauacuuucuug

SEQ ID NO: 2689982 - RNA, 21 nt, Haemophilus influenzae Rd
gauacuuuuaauuaaauacaa

SEQ ID NO: 2689983 - RNA, 22 nt, Haemophilus influenzae Rd
gauacuuuuaauuaaauacaaa

SEQ ID NO: 2689984 - RNA, 18 nt, Haemophilus influenzae Rd
gauacuuuuacgcuugga

SEQ ID NO: 2689985 - RNA, 16 nt, Haemophilus influenzae Rd
gauagaaacgaguugu

SEQ ID NO: 2689986 - RNA, 20 nt, Haemophilus influenzae Rd
gauagcaaugccaaucuaaa

SEQ ID NO: 2689987 - RNA, 23 nt, Haemophilus influenzae Rd
gauagcacuuguuuuuagugguu

SEQ ID NO: 2689988 - RNA, 16 nt, Haemophilus influenzae Rd
gauagcccgccuaaua

SEQ ID NO: 2689989 - RNA, 18 nt, Haemophilus influenzae Rd
gauagccucuucuuuuga

SEQ ID NO: 2689990 - RNA, 20 nt, Haemophilus influenzae Rd
gauagcugugguaaauaauu

SEQ ID NO: 2689991 - RNA, 23 nt, Haemophilus influenzae Rd
gauagcugugguaaauaauuuuc

SEQ ID NO: 2689992 - RNA, 14 nt, Haemophilus influenzae Rd
gauagcuuuuguug

SEQ ID NO: 2689993 - RNA, 23 nt, Haemophilus influenzae Rd
gauaggcguuagccgauuuaccu

SEQ ID NO: 2689994 - RNA, 16 nt, Haemophilus influenzae Rd
gauaguaaaaaaucaa

SEQ ID NO: 2689995 - RNA, 19 nt, Haemophilus influenzae Rd
gauaguagagucauuuaca

SEQ ID NO: 2689996 - RNA, 17 nt, Haemophilus influenzae Rd
gauagucaccaucacaa

SEQ ID NO: 2689997 - RNA, 20 nt, Haemophilus influenzae Rd
gauagugaguugauuuaaau

SEQ ID NO: 2689998 - RNA, 21 nt, Haemophilus influenzae Rd
gauagugaguugauuuaaauu

SEQ ID NO: 2689999 - RNA, 22 nt, Haemophilus influenzae Rd
gauagugccaaucaagauaacu

SEQ ID NO: 2690000 - RNA, 20 nt, Haemophilus influenzae Rd
gauaguggaauaaugaaaua

SEQ ID NO: 2690001 - RNA, 16 nt, Haemophilus influenzae Rd
gauaguuaauggcaau

SEQ ID NO: 2690002 - RNA, 12 nt, Haemophilus influenzae Rd
gauauaaacuga

SEQ ID NO: 2690003 - RNA, 20 nt, Haemophilus influenzae Rd
gauauaacuugauguuuuug

SEQ ID NO: 2690004 - RNA, 17 nt, Haemophilus influenzae Rd
gauauaagaaauaaucg

SEQ ID NO: 2690005 - RNA, 15 nt, Haemophilus influenzae Rd
gauauaaguucuaaa

SEQ ID NO: 2690006 - RNA, 16 nt, Haemophilus influenzae Rd
gauauaaguucuaaau

SEQ ID NO: 2690007 - RNA, 21 nt, Haemophilus influenzae Rd
gauauaaguucuaaauaaacu

SEQ ID NO: 2690008 - RNA, 21 nt, Haemophilus influenzae Rd
gauauagcuagaaagcaaugu

SEQ ID NO: 2690009 - RNA, 18 nt, Haemophilus influenzae Rd
gauauauuaacuugcuau

SEQ ID NO: 2690010 - RNA, 18 nt, Haemophilus influenzae Rd
gauauauugguuugcuua

SEQ ID NO: 2690011 - RNA, 21 nt, Haemophilus influenzae Rd
gauauauugguuugcuuaaaa

SEQ ID NO: 2690012 - RNA, 10 nt, Haemophilus influenzae Rd
gauauccauu

SEQ ID NO: 2690013 - RNA, 11 nt, Haemophilus influenzae Rd
gauaugccacc

SEQ ID NO: 2690014 - RNA, 17 nt, Haemophilus influenzae Rd
gauauggauauuccagc

SEQ ID NO: 2690015 - RNA, 19 nt, Haemophilus influenzae Rd
gauauggcguucacguaau

SEQ ID NO: 2690016 - RNA, 22 nt, Haemophilus influenzae Rd
gauauguuaauaagcccaacuu

SEQ ID NO: 2690017 - RNA, 14 nt, Haemophilus influenzae Rd
gauauuaaacaguc

SEQ ID NO: 2690018 - RNA, 13 nt, Haemophilus influenzae Rd
gauauuacuuaua

SEQ ID NO: 2690019 - RNA, 15 nt, Haemophilus influenzae Rd
gauauuacuuauaag

SEQ ID NO: 2690020 - RNA, 19 nt, Haemophilus influenzae Rd
gauauuauuauuaaaucca

SEQ ID NO: 2690021 - RNA, 13 nt, Haemophilus influenzae Rd
gauauuccaaggu

SEQ ID NO: 2690022 - RNA, 23 nt, Haemophilus influenzae Rd
gauauugccuaauagaaaaaugc

SEQ ID NO: 2690023 - RNA, 13 nt, Haemophilus influenzae Rd
gauauuuaaaauc

SEQ ID NO: 2690024 - RNA, 21 nt, Haemophilus influenzae Rd
gauauuuaacaucaugaaaug

SEQ ID NO: 2690025 - RNA, 22 nt, Haemophilus influenzae Rd
gauauuucaauuuaagcccugc

SEQ ID NO: 2690026 - RNA, 13 nt, Haemophilus influenzae Rd
gaucaaaaauauc

SEQ ID NO: 2690027 - RNA, 20 nt, Haemophilus influenzae Rd
gaucaaaucaaauuuuccuu

SEQ ID NO: 2690028 - RNA, 17 nt, Haemophilus influenzae Rd
gaucaagccacugauua

SEQ ID NO: 2690029 - RNA, 22 nt, Haemophilus influenzae Rd
gaucaccaagacuauuaaguuc

SEQ ID NO: 2690030 - RNA, 21 nt, Haemophilus influenzae Rd
gaucaccauaaucaaaauuac

SEQ ID NO: 2690031 - RNA, 20 nt, Haemophilus influenzae Rd
gaucacccauuaaauaaaaa

SEQ ID NO: 2690032 - RNA, 22 nt, Haemophilus influenzae Rd
gaucacgcaaaggaacaauuuc

SEQ ID NO: 2690033 - RNA, 18 nt, Haemophilus influenzae Rd
gaucacuaauugcauuaa

SEQ ID NO: 2690034 - RNA, 23 nt, Haemophilus influenzae Rd
gaucagagccucuuggauuuucu

SEQ ID NO: 2690035 - RNA, 19 nt, Haemophilus influenzae Rd
gaucagcacgauaaccauc

SEQ ID NO: 2690036 - RNA, 23 nt, Haemophilus influenzae Rd
gaucauaaaaaaauguagagaua

SEQ ID NO: 2690037 - RNA, 21 nt, Haemophilus influenzae Rd
gaucauagaaccgucuuuaaa

SEQ ID NO: 2690038 - RNA, 22 nt, Haemophilus influenzae Rd
gaucauagaaccgucuuuaaau

SEQ ID NO: 2690039 - RNA, 17 nt, Haemophilus influenzae Rd
gaucaucacgacaucaa

SEQ ID NO: 2690040 - RNA, 19 nt, Haemophilus influenzae Rd
gaucaugguuguaauaaug

SEQ ID NO: 2690041 - RNA, 21 nt, Haemophilus influenzae Rd
gaucauuuggaucuaaaaaau

SEQ ID NO: 2690042 - RNA, 17 nt, Haemophilus influenzae Rd
gaucauuuuuaaccgca

SEQ ID NO: 2690043 - RNA, 20 nt, Haemophilus influenzae Rd
gauccaaagacuaaaaccac

SEQ ID NO: 2690044 - RNA, 14 nt, Haemophilus influenzae Rd
gauccacacuucau

SEQ ID NO: 2690045 - RNA, 21 nt, Haemophilus influenzae Rd
gauccacauagcaaaaaaccu

SEQ ID NO: 2690046 - RNA, 15 nt, Haemophilus influenzae Rd
gauccauuaauaacu

SEQ ID NO: 2690047 - RNA, 13 nt, Haemophilus influenzae Rd
gauccauuacaaa

SEQ ID NO: 2690048 - RNA, 23 nt, Haemophilus influenzae Rd
gauccgcaauauagucaaauaac

SEQ ID NO: 2690049 - RNA, 17 nt, Haemophilus influenzae Rd
gauccgugaacugaguu

SEQ ID NO: 2690050 - RNA, 13 nt, Haemophilus influenzae Rd
gaucgaaauuagg

SEQ ID NO: 2690051 - RNA, 15 nt, Haemophilus influenzae Rd
gauucgccuugcuuu

SEQ ID NO: 2690052 - RNA, 21 nt, Haemophilus influenzae Rd
gauucgccuugcuuuuaauaa

SEQ ID NO: 2690053 - RNA, 20 nt, Haemophilus influenzae Rd
gauucguuguaccaaucaaa

SEQ ID NO: 2690054 - RNA, 22 nt, Haemophilus influenzae Rd
gauucuguuguccagucaucau

SEQ ID NO: 2690055 - RNA, 19 nt, Haemophilus influenzae Rd
gauucuucauaaauaccgc

SEQ ID NO: 2690056 - RNA, 15 nt, Haemophilus influenzae Rd
gauugaacuugaauu

SEQ ID NO: 2690057 - RNA, 19 nt, Haemophilus influenzae Rd
gauugaacuugaauugaag

SEQ ID NO: 2690058 - RNA, 18 nt, Haemophilus influenzae Rd
gauugaccgcccaacauu

SEQ ID NO: 2690059 - RNA, 19 nt, Haemophilus influenzae Rd
gauugaccucguggcaaaa

SEQ ID NO: 2690060 - RNA, 18 nt, Haemophilus influenzae Rd
gauugacuuguuuuaaaa

SEQ ID NO: 2690061 - RNA, 13 nt, Haemophilus influenzae Rd
gauugagaaaaug

SEQ ID NO: 2690062 - RNA, 21 nt, Haemophilus influenzae Rd
gauugagcgauagaaauaaag

SEQ ID NO: 2690063 - RNA, 15 nt, Haemophilus influenzae Rd
gauugauauuuggau

SEQ ID NO: 2690064 - RNA, 14 nt, Haemophilus influenzae Rd
gauugcaccaaauu

SEQ ID NO: 2690065 - RNA, 13 nt, Haemophilus influenzae Rd
gauugcaugaaau

SEQ ID NO: 2690066 - RNA, 11 nt, Haemophilus influenzae Rd
gauugcgaaua

SEQ ID NO: 2690067 - RNA, 19 nt, Haemophilus influenzae Rd
gauugcuaaauaaauuccu

SEQ ID NO: 2690068 - RNA, 20 nt, Haemophilus influenzae Rd
gauugcuacagcaaauccuu

SEQ ID NO: 2690069 - RNA, 18 nt, Haemophilus influenzae Rd
gauugcugacaaauuugu

SEQ ID NO: 2690070 - RNA, 19 nt, Haemophilus influenzae Rd
gauuguccaaagaauaaua

SEQ ID NO: 2690071 - RNA, 12 nt, Haemophilus influenzae Rd
gauuguucggua

SEQ ID NO: 2690072 - RNA, 17 nt, Haemophilus influenzae Rd
gauuguuguaauccauu

SEQ ID NO: 2690073 - RNA, 20 nt, Haemophilus influenzae Rd
gauuuaaaaaaacguuaaau

SEQ ID NO: 2690074 - RNA, 15 nt, Haemophilus influenzae Rd
gauuuaaaaucccuc

SEQ ID NO: 2690075 - RNA, 12 nt, Haemophilus influenzae Rd
gauuuaauacca

SEQ ID NO: 2690076 - RNA, 17 nt, Haemophilus influenzae Rd
gauuuaauagcacagaa

SEQ ID NO: 2690077 - RNA, 18 nt, Haemophilus influenzae Rd
gauuuaauagcacagaaa

SEQ ID NO: 2690078 - RNA, 15 nt, Haemophilus influenzae Rd
gauuuacagaacaaa

SEQ ID NO: 2690079 - RNA, 16 nt, Haemophilus influenzae Rd
gauuuacccaacaaau

SEQ ID NO: 2690080 - RNA, 22 nt, Haemophilus influenzae Rd
gauuuacgcaaccaucuuuaau

SEQ ID NO: 2690081 - RNA, 13 nt, Haemophilus influenzae Rd
gauuuacuuuaau

SEQ ID NO: 2690082 - RNA, 20 nt, Haemophilus influenzae Rd
gauuuagauaauaaaaaaac

SEQ ID NO: 2690083 - RNA, 14 nt, Haemophilus influenzae Rd
gauuuagccaguaa

SEQ ID NO: 2690084 - RNA, 15 nt, Haemophilus influenzae Rd
gauuuaggcauugcu

SEQ ID NO: 2690085 - RNA, 17 nt, Haemophilus influenzae Rd
gauuuaggcauugcugu

SEQ ID NO: 2690086 - RNA, 20 nt, Haemophilus influenzae Rd
gauuuaguucaaggacugag

SEQ ID NO: 2690087 - RNA, 20 nt, Haemophilus influenzae Rd
gauuuaguuggguauucacu

SEQ ID NO: 2690088 - RNA, 15 nt, Haemophilus influenzae Rd
gauuuauuauuuaau

SEQ ID NO: 2690089 - RNA, 16 nt, Haemophilus influenzae Rd
gauuuauuucugaagg

SEQ ID NO: 2690090 - RNA, 13 nt, Haemophilus influenzae Rd
gauuucaacgaau

SEQ ID NO: 2690091 - RNA, 20 nt, Haemophilus influenzae Rd
gauuucaguaucaauaccaa

SEQ ID NO: 2690092 - RNA, 18 nt, Haemophilus influenzae Rd
gauuucauuggcgguuuu

SEQ ID NO: 2690093 - RNA, 15 nt, Haemophilus influenzae Rd
gauuuccacuuuuuc

SEQ ID NO: 2690094 - RNA, 18 nt, Haemophilus influenzae Rd
gauuucgugcaauaacaa

SEQ ID NO: 2690095 - RNA, 24 nt, Haemophilus influenzae Rd
gauuucgugcaauaacaagcacaa

SEQ ID NO: 2690096 - RNA, 17 nt, Haemophilus influenzae Rd
gauuucuacacuuaaau

SEQ ID NO: 2690097 - RNA, 16 nt, Haemophilus influenzae Rd
gauuucuguuaaaucu

SEQ ID NO: 2690098 - RNA, 15 nt, Haemophilus influenzae Rd
gauuucuuaugaaaa

SEQ ID NO: 2690099 - RNA, 16 nt, Haemophilus influenzae Rd
gauuucuuaugaaaaa

SEQ ID NO: 2690100 - RNA, 22 nt, Haemophilus influenzae Rd
gauuugagcccuaagucauaua

SEQ ID NO: 2690101 - RNA, 12 nt, Haemophilus influenzae Rd
gauuugccaaaa

SEQ ID NO: 2690102 - RNA, 20 nt, Haemophilus influenzae Rd
gauuugcuuggaauaaauua

SEQ ID NO: 2690103 - RNA, 22 nt, Haemophilus influenzae Rd
gauuuuaaaacacgaaaaaaac

SEQ ID NO: 2690104 - RNA, 15 nt, Haemophilus influenzae Rd
gauuuuaaaauaaau

SEQ ID NO: 2690105 - RNA, 20 nt, Haemophilus influenzae Rd
gauuuuaaauucuccccgau

SEQ ID NO: 2690106 - RNA, 15 nt, Haemophilus influenzae Rd
gauuuuaauguaaua

SEQ ID NO: 2690107 - RNA, 16 nt, Haemophilus influenzae Rd
gauuuuaauugugcaa

SEQ ID NO: 2690108 - RNA, 16 nt, Haemophilus influenzae Rd
gauuuuacuuguuuau

SEQ ID NO: 2690109 - RNA, 22 nt, Haemophilus influenzae Rd
gauuuuaguuucuaauucuucc

SEQ ID NO: 2690110 - RNA, 16 nt, Haemophilus influenzae Rd
gauuuuauuuaauaua

SEQ ID NO: 2690111 - RNA, 23 nt, Haemophilus influenzae Rd
gauuuuauuucgcuauuguuaaa

SEQ ID NO: 2690112 - RNA, 18 nt, Haemophilus influenzae Rd
gauuuucacuaauuugcu

SEQ ID NO: 2690113 - RNA, 14 nt, Haemophilus influenzae Rd
gauuuuccaaaauu

SEQ ID NO: 2690114 - RNA, 12 nt, Haemophilus influenzae Rd
gauuuucuuauu

SEQ ID NO: 2690115 - RNA, 17 nt, Haemophilus influenzae Rd
gauuuugccagauuuuu

SEQ ID NO: 2690116 - RNA, 20 nt, Haemophilus influenzae Rd
gauuuugccgagaauaaagg

SEQ ID NO: 2690117 - RNA, 14 nt, Haemophilus influenzae Rd
gauuuuguaauaaa

SEQ ID NO: 2690118 - RNA, 15 nt, Haemophilus influenzae Rd
gauuuuuaaaucaau

SEQ ID NO: 2690119 - RNA, 20 nt, Haemophilus influenzae Rd
gauuuuucuuuuucaguuuu

SEQ ID NO: 2690120 - RNA, 19 nt, Haemophilus influenzae Rd
gauuuuugacgagauuuuu

SEQ ID NO: 2690121 - RNA, 20 nt, Haemophilus influenzae Rd
gauuuuugaggggaauuuuu

SEQ ID NO: 2690122 - RNA, 16 nt, Haemophilus influenzae Rd
gauuuuugauaaaaaa

SEQ ID NO: 2690123 - RNA, 16 nt, Haemophilus influenzae Rd
gauuuuuucuaaucca

SEQ ID NO: 2690124 - RNA, 18 nt, Haemophilus influenzae Rd
gauuuuuucuaauccaga

SEQ ID NO: 2690125 - RNA, 17 nt, Haemophilus influenzae Rd
gauuuuuuuaugagcaa

SEQ ID NO: 2690126 - RNA, 15 nt, Haemophilus influenzae Rd
gauuuuuuucagaaa

SEQ ID NO: 2690127 - RNA, 19 nt, Haemophilus influenzae Rd
gcaaaaaaucuuuuauucu

SEQ ID NO: 2690128 - RNA, 22 nt, Haemophilus influenzae Rd
gcaaaaaaucuuuuauucugca

SEQ ID NO: 2690129 - RNA, 19 nt, Haemophilus influenzae Rd
gcaaaaacccucaagaaac

SEQ ID NO: 2690130 - RNA, 20 nt, Haemophilus influenzae Rd
gcaaaaacccucaagaaacu

SEQ ID NO: 2690131 - RNA, 13 nt, Haemophilus influenzae Rd
gcaaaaauacuaa

SEQ ID NO: 2690132 - RNA, 11 nt, Haemophilus influenzae Rd
gcaaaagaaau

SEQ ID NO: 2690133 - RNA, 13 nt, Haemophilus influenzae Rd
gcaaaagcaauaa

SEQ ID NO: 2690134 - RNA, 14 nt, Haemophilus influenzae Rd
gcaaaagccaauaa

SEQ ID NO: 2690135 - RNA, 16 nt, Haemophilus influenzae Rd
gcaaaagccaauaaga

SEQ ID NO: 2690136 - RNA, 16 nt, Haemophilus influenzae Rd
gcaaaagguaaaaauu

SEQ ID NO: 2690137 - RNA, 17 nt, Haemophilus influenzae Rd
gcaaaaguaagcaaaua

SEQ ID NO: 2690138 - RNA, 12 nt, Haemophilus influenzae Rd
gcaaaagugcuu

SEQ ID NO: 2690139 - RNA, 11 nt, Haemophilus influenzae Rd
gcaaaauaauc

SEQ ID NO: 2690140 - RNA, 15 nt, Haemophilus influenzae Rd
gcaaaauauucuauu

SEQ ID NO: 2690141 - RNA, 13 nt, Haemophilus influenzae Rd
gcaaaaucaaagu

SEQ ID NO: 2690142 - RNA, 15 nt, Haemophilus influenzae Rd
gcaaaaucauauuga

SEQ ID NO: 2690143 - RNA, 16 nt, Haemophilus influenzae Rd
gcaaaaucaucaaaca

SEQ ID NO: 2690144 - RNA, 18 nt, Haemophilus influenzae Rd
gcaaaaugggccucuuua

SEQ ID NO: 2690145 - RNA, 15 nt, Haemophilus influenzae Rd
gcaaacaaaauaaau

SEQ ID NO: 2690146 - RNA, 17 nt, Haemophilus influenzae Rd
gcaaacaaaauaaauga

SEQ ID NO: 2690147 - RNA, 14 nt, Haemophilus influenzae Rd
gcaaacaaguuucu

SEQ ID NO: 2690148 - RNA, 14 nt, Haemophilus influenzae Rd
gcaaacagcaauaa

SEQ ID NO: 2690149 - RNA, 22 nt, Haemophilus influenzae Rd
gcaaacauaccacuucagaauu

SEQ ID NO: 2690150 - RNA, 13 nt, Haemophilus influenzae Rd
gcaaacaucauca

SEQ ID NO: 2690151 - RNA, 14 nt, Haemophilus influenzae Rd
gcaaacaucaucac

SEQ ID NO: 2690152 - RNA, 15 nt, Haemophilus influenzae Rd
gcaaacgcucuuuaa

SEQ ID NO: 2690153 - RNA, 17 nt, Haemophilus influenzae Rd
gcaaagaaauuuuaauc

SEQ ID NO: 2690154 - RNA, 16 nt, Haemophilus influenzae Rd
gcaaagaauuaaaaua

SEQ ID NO: 2690155 - RNA, 16 nt, Haemophilus influenzae Rd
gcaaagcaaaaucaaa

SEQ ID NO: 2690156 - RNA, 18 nt, Haemophilus influenzae Rd
gcaaaggaacaauuucua

SEQ ID NO: 2690157 - RNA, 19 nt, Haemophilus influenzae Rd
gcacagaaaagauugcggc

SEQ ID NO: 2690158 - RNA, 18 nt, Haemophilus influenzae Rd
gcacagggcugauaaauu

SEQ ID NO: 2690159 - RNA, 16 nt, Haemophilus influenzae Rd
gcacaguuuccgcaaa

SEQ ID NO: 2690160 - RNA, 14 nt, Haemophilus influenzae Rd
gcacauaaagacgc

SEQ ID NO: 2690161 - RNA, 17 nt, Haemophilus influenzae Rd
gcacauaaguaaaauag

SEQ ID NO: 2690162 - RNA, 21 nt, Haemophilus influenzae Rd
gcacaucaaauucuaaaacaa

SEQ ID NO: 2690163 - RNA, 19 nt, Haemophilus influenzae Rd
gcacauuaaucauuucaau

SEQ ID NO: 2690164 - RNA, 17 nt, Haemophilus influenzae Rd
gcacauuuuuaccaauu

SEQ ID NO: 2690165 - RNA, 21 nt, Haemophilus influenzae Rd
gcaccaccuuuauuaaagccu

SEQ ID NO: 2690166 - RNA, 18 nt, Haemophilus influenzae Rd
gcaccacgaccuaagaaa

SEQ ID NO: 2690167 - RNA, 13 nt, Haemophilus influenzae Rd
gcaccagaugcaa

SEQ ID NO: 2690168 - RNA, 23 nt, Haemophilus influenzae Rd
gcaccagugguugcgauuuuugc

SEQ ID NO: 2690169 - RNA, 22 nt, Haemophilus influenzae Rd
gcaccauaacuuaugaauaaua

SEQ ID NO: 2690170 - RNA, 17 nt, Haemophilus influenzae Rd
gcaccauccaucaaauc

SEQ ID NO: 2690171 - RNA, 21 nt, Haemophilus influenzae Rd
gcaccaucguuaaaccaaaua

SEQ ID NO: 2690172 - RNA, 13 nt, Haemophilus influenzae Rd
gcaccauuuaaac

SEQ ID NO: 2690173 - RNA, 20 nt, Haemophilus influenzae Rd
gcacccacuucgauauuuuc

SEQ ID NO: 2690174 - RNA, 18 nt, Haemophilus influenzae Rd
gcacccaucacauuuuca

SEQ ID NO: 2690175 - RNA, 13 nt, Haemophilus influenzae Rd
gcaccgaaugugg

SEQ ID NO: 2690176 - RNA, 21 nt, Haemophilus influenzae Rd
gcaccuaaaauuuuuaggugc

SEQ ID NO: 2690177 - RNA, 15 nt, Haemophilus influenzae Rd
gcaccuucaccacuu

SEQ ID NO: 2690178 - RNA, 15 nt, Haemophilus influenzae Rd
gcaccuucagccacu

SEQ ID NO: 2690179 - RNA, 16 nt, Haemophilus influenzae Rd
gcaccuucagccacua

SEQ ID NO: 2690180 - RNA, 14 nt, Haemophilus influenzae Rd
gcaccuuguaacca

SEQ ID NO: 2690181 - RNA, 18 nt, Haemophilus influenzae Rd
gcaccuuguaaccaagcu

SEQ ID NO: 2690182 - RNA, 20 nt, Haemophilus influenzae Rd
gcacgaccuguggucacuac

SEQ ID NO: 2690183 - RNA, 22 nt, Haemophilus influenzae Rd
gcacgagcaggaaaaccacaag

SEQ ID NO: 2690184 - RNA, 16 nt, Haemophilus influenzae Rd
gcacgggaaauccagc

SEQ ID NO: 2690185 - RNA, 14 nt, Haemophilus influenzae Rd
gcacguaaugcaag

SEQ ID NO: 2690186 - RNA, 17 nt, Haemophilus influenzae Rd
gcacguaguaaauuuuc

SEQ ID NO: 2690187 - RNA, 19 nt, Haemophilus influenzae Rd
gcacguuaauuaccacaug

SEQ ID NO: 2690188 - RNA, 20 nt, Haemophilus influenzae Rd
gcacuaguucagcgauuuua

SEQ ID NO: 2690189 - RNA, 20 nt, Haemophilus influenzae Rd
gcacuccaaaaguuggauua

SEQ ID NO: 2690190 - RNA, 17 nt, Haemophilus influenzae Rd
gcacucuaauaagugag

SEQ ID NO: 2690191 - RNA, 13 nt, Haemophilus influenzae Rd
gcacugaaauauc

SEQ ID NO: 2690192 - RNA, 13 nt, Haemophilus influenzae Rd
gcacugaaauuca

SEQ ID NO: 2690193 - RNA, 18 nt, Haemophilus influenzae Rd
gcacugaaauucauucaa

SEQ ID NO: 2690194 - RNA, 19 nt, Haemophilus influenzae Rd
gcacugauuuuuuuauaau

SEQ ID NO: 2690195 - RNA, 15 nt, Haemophilus influenzae Rd
gcacuguaauaaagu

SEQ ID NO: 2690196 - RNA, 21 nt, Haemophilus influenzae Rd
gcacuguugugaaguuuuuua

SEQ ID NO: 2690197 - RNA, 19 nt, Haemophilus influenzae Rd
gcacuguuucaguuaucuc

SEQ ID NO: 2690198 - RNA, 17 nt, Haemophilus influenzae Rd
gcacuuaauaaauauug

SEQ ID NO: 2690199 - RNA, 22 nt, Haemophilus influenzae Rd
gcacuuaaucacugaauuucau

SEQ ID NO: 2690200 - RNA, 16 nt, Haemophilus influenzae Rd
gcacuuagauuugaac

SEQ ID NO: 2690201 - RNA, 23 nt, Haemophilus influenzae Rd
gcacuuauuugacuuaaaugaag

SEQ ID NO: 2690202 - RNA, 22 nt, Haemophilus influenzae Rd
gcacuucaauagauaaaucaaa

SEQ ID NO: 2690203 - RNA, 16 nt, Haemophilus influenzae Rd
gcacuucaauuucacc

SEQ ID NO: 2690204 - RNA, 14 nt, Haemophilus influenzae Rd
gcacuuccucaaug

SEQ ID NO: 2690205 - RNA, 22 nt, Haemophilus influenzae Rd
gcacuugccacaacugaagcuu

SEQ ID NO: 2690206 - RNA, 19 nt, Haemophilus influenzae Rd
gcacuuggguaaauauaaa

SEQ ID NO: 2690207 - RNA, 20 nt, Haemophilus influenzae Rd
gcacuuguggcggguuucuu

SEQ ID NO: 2690208 - RNA, 15 nt, Haemophilus influenzae Rd
gcacuuguugauuga

SEQ ID NO: 2690209 - RNA, 15 nt, Haemophilus influenzae Rd
gcacuuuaaauauuu

SEQ ID NO: 2690210 - RNA, 21 nt, Haemophilus influenzae Rd
gcacuuuaaucugugccuuaa

SEQ ID NO: 2690211 - RNA, 14 nt, Haemophilus influenzae Rd
gcacuuuauuagaa

SEQ ID NO: 2690212 - RNA, 15 nt, Haemophilus influenzae Rd
gcacuuuauuagaaa

SEQ ID NO: 2690213 - RNA, 18 nt, Haemophilus influenzae Rd
gcacuuuauuagaaauau

SEQ ID NO: 2690214 - RNA, 13 nt, Haemophilus influenzae Rd
gcacuuuauucaa

SEQ ID NO: 2690215 - RNA, 14 nt, Haemophilus influenzae Rd
gcacuuucaucuac

SEQ ID NO: 2690216 - RNA, 23 nt, Haemophilus influenzae Rd
gcacuuucgcggaauuucagaaa

SEQ ID NO: 2690217 - RNA, 14 nt, Haemophilus influenzae Rd
gcacuuugauuuug

SEQ ID NO: 2690218 - RNA, 13 nt, Haemophilus influenzae Rd
gcacuuuggguug

SEQ ID NO: 2690219 - RNA, 14 nt, Haemophilus influenzae Rd
gcacuuuuauccac

SEQ ID NO: 2690220 - RNA, 13 nt, Haemophilus influenzae Rd
gcacuuuucuuua

SEQ ID NO: 2690221 - RNA, 20 nt, Haemophilus influenzae Rd
gcacuuuuggauaaaguauu

SEQ ID NO: 2690222 - RNA, 21 nt, Haemophilus influenzae Rd
gcacuuuuuaauaaaauguuu

SEQ ID NO: 2690223 - RNA, 21 nt, Haemophilus influenzae Rd
gcacuuuuuagucaaaaguau

SEQ ID NO: 2690224 - RNA, 17 nt, Haemophilus influenzae Rd
gcacuuuuuauauuuuu

SEQ ID NO: 2690225 - RNA, 22 nt, Haemophilus influenzae Rd
gcacuuuuuaucuaaaaaagag

SEQ ID NO: 2690226 - RNA, 16 nt, Haemophilus influenzae Rd
gcacuuuuuauuagau

SEQ ID NO: 2690227 - RNA, 15 nt, Haemophilus influenzae Rd
gcacuuuuuauucaa

SEQ ID NO: 2690228 - RNA, 18 nt, Haemophilus influenzae Rd
gcacuuuuugaaagacug

SEQ ID NO: 2690229 - RNA, 22 nt, Haemophilus influenzae Rd
gcacuuuuuguuuuauaagacu

SEQ ID NO: 2690230 - RNA, 14 nt, Haemophilus influenzae Rd
gcacuuuuuuaucg

SEQ ID NO: 2690231 - RNA, 21 nt, Haemophilus influenzae Rd
gcacuuuuuucagucuauuau

SEQ ID NO: 2690232 - RNA, 14 nt, Haemophilus influenzae Rd
gcacuuuuuuucuu

SEQ ID NO: 2690233 - RNA, 18 nt, Haemophilus influenzae Rd
gcagaaaacucgacuuuu

SEQ ID NO: 2690234 - RNA, 14 nt, Haemophilus influenzae Rd
gcagaaucagaaua

SEQ ID NO: 2690235 - RNA, 17 nt, Haemophilus influenzae Rd
gcagauccuuucacaaa

SEQ ID NO: 2690236 - RNA, 21 nt, Haemophilus influenzae Rd
gcagaucgcuauuuaauaauu

SEQ ID NO: 2690237 - RNA, 21 nt, Haemophilus influenzae Rd
gcagauuaauuuuuuauaaaa

SEQ ID NO: 2690238 - RNA, 14 nt, Haemophilus influenzae Rd
gcagauuauugcac

SEQ ID NO: 2690239 - RNA, 19 nt, Haemophilus influenzae Rd
gcagauuauugcacuaaua

SEQ ID NO: 2690240 - RNA, 22 nt, Haemophilus influenzae Rd
gcagauuauugcacuaauaaau

SEQ ID NO: 2690241 - RNA, 12 nt, Haemophilus influenzae Rd
gcagauugcuga

SEQ ID NO: 2690242 - RNA, 22 nt, Haemophilus influenzae Rd
gcagauuuuuuaugaccaaaua

SEQ ID NO: 2690243 - RNA, 17 nt, Haemophilus influenzae Rd
gcagauuuuuuuauaaa

SEQ ID NO: 2690244 - RNA, 23 nt, Haemophilus influenzae Rd
gcagauuuuuuuaugagcaaaua

SEQ ID NO: 2690245 - RNA, 18 nt, Haemophilus influenzae Rd
gcagauuuuuuuauugau

SEQ ID NO: 2690246 - RNA, 19 nt, Haemophilus influenzae Rd
gcagcagcuucuucuuccu

SEQ ID NO: 2690247 - RNA, 14 nt, Haemophilus influenzae Rd
gcagcccaaauaaa

SEQ ID NO: 2690248 - RNA, 15 nt, Haemophilus influenzae Rd
gcagcccaaauaaag

SEQ ID NO: 2690249 - RNA, 22 nt, Haemophilus influenzae Rd
gcagccgcuuuuacguaugaca

SEQ ID NO: 2690250 - RNA, 14 nt, Haemophilus influenzae Rd
gcagccuuguucug

SEQ ID NO: 2690251 - RNA, 18 nt, Haemophilus influenzae Rd
gcagcguuugcugccucu

SEQ ID NO: 2690252 - RNA, 21 nt, Haemophilus influenzae Rd
gcagcuaaaagugcggcuuca

SEQ ID NO: 2690253 - RNA, 23 nt, Haemophilus influenzae Rd
gcagcuucagcaaguucugcacg

SEQ ID NO: 2690254 - RNA, 15 nt, Haemophilus influenzae Rd
gcaggaaaggcauua

SEQ ID NO: 2690255 - RNA, 16 nt, Haemophilus influenzae Rd
gcaggagaaagcuugc

SEQ ID NO: 2690256 - RNA, 22 nt, Haemophilus influenzae Rd
gcaggcacaacgguugaaauug

SEQ ID NO: 2690257 - RNA, 13 nt, Haemophilus influenzae Rd
gcaggcuuaacac

SEQ ID NO: 2690258 - RNA, 22 nt, Haemophilus influenzae Rd
gcagggauauugccuaauagaa

SEQ ID NO: 2690259 - RNA, 19 nt, Haemophilus influenzae Rd
gcagguaauacacuuucac

SEQ ID NO: 2690260 - RNA, 13 nt, Haemophilus influenzae Rd
gcagguuuugcaa

SEQ ID NO: 2690261 - RNA, 14 nt, Haemophilus influenzae Rd
gcagguuuugcaaa

SEQ ID NO: 2690262 - RNA, 22 nt, Haemophilus influenzae Rd
gcauuguuaucuaaauaauuuc

SEQ ID NO: 2690263 - RNA, 13 nt, Haemophilus influenzae Rd
gcauuuaaauaaa

SEQ ID NO: 2690264 - RNA, 14 nt, Haemophilus influenzae Rd
gcauuuaaauaaaa

SEQ ID NO: 2690265 - RNA, 15 nt, Haemophilus influenzae Rd
gcauuuaaauaagga

SEQ ID NO: 2690266 - RNA, 16 nt, Haemophilus influenzae Rd
gcauuuagagcaagca

SEQ ID NO: 2690267 - RNA, 17 nt, Haemophilus influenzae Rd
gcauuuagagcaagcaa

SEQ ID NO: 2690268 - RNA, 15 nt, Haemophilus influenzae Rd
gcauuucuaaauaaa

SEQ ID NO: 2690269 - RNA, 12 nt, Haemophilus influenzae Rd
gcauuugcauau

SEQ ID NO: 2690270 - RNA, 15 nt, Haemophilus influenzae Rd
gcauuugcuaagauu

SEQ ID NO: 2690271 - RNA, 18 nt, Haemophilus influenzae Rd
gcauuugcucaauaccua

SEQ ID NO: 2690272 - RNA, 22 nt, Haemophilus influenzae Rd
gcauuuucucguccaccacugg

SEQ ID NO: 2690273 - RNA, 13 nt, Haemophilus influenzae Rd
gcauuuucuuuuu

SEQ ID NO: 2690274 - RNA, 16 nt, Haemophilus influenzae Rd
gcauuuuguaagcaac

SEQ ID NO: 2690275 - RNA, 21 nt, Haemophilus influenzae Rd
gcauuuuguaagcaacacaga

SEQ ID NO: 2690276 - RNA, 15 nt, Haemophilus influenzae Rd
gcauuuuuaauuuuu

SEQ ID NO: 2690277 - RNA, 16 nt, Haemophilus influenzae Rd
gcauuuuuaugauuaa

SEQ ID NO: 2690278 - RNA, 20 nt, Haemophilus influenzae Rd
gcauuuuugcaauuuaacau

SEQ ID NO: 2690279 - RNA, 14 nt, Haemophilus influenzae Rd
gcauuuuuuauaaa

SEQ ID NO: 2690280 - RNA, 15 nt, Haemophilus influenzae Rd
gcauuuuuuauaaau

SEQ ID NO: 2690281 - RNA, 14 nt, Haemophilus influenzae Rd
gcauuuuuuauaag

SEQ ID NO: 2690282 - RNA, 13 nt, Haemophilus influenzae Rd
gccaaaaaagccc

SEQ ID NO: 2690283 - RNA, 14 nt, Haemophilus influenzae Rd
gccaaaaauuaaua

SEQ ID NO: 2690284 - RNA, 19 nt, Haemophilus influenzae Rd
gccaaaaauuaauacugaa

SEQ ID NO: 2690285 - RNA, 20 nt, Haemophilus influenzae Rd
gccaaaaauuaauacugaaa

SEQ ID NO: 2690286 - RNA, 13 nt, Haemophilus influenzae Rd
gccaaaaauugca

SEQ ID NO: 2690287 - RNA, 21 nt, Haemophilus influenzae Rd
gccaaaguguggcuuuuuuuc

SEQ ID NO: 2690288 - RNA, 21 nt, Haemophilus influenzae Rd
gccaaaucaucggcuacaggu

SEQ ID NO: 2690289 - RNA, 17 nt, Haemophilus influenzae Rd
gccaaaucaucuagcau

SEQ ID NO: 2690290 - RNA, 11 nt, Haemophilus influenzae Rd
gccaaaucuca

SEQ ID NO: 2690291 - RNA, 13 nt, Haemophilus influenzae Rd
gccaaauuuaaaa

SEQ ID NO: 2690292 - RNA, 14 nt, Haemophilus influenzae Rd
gccaaauuuaaaaa

SEQ ID NO: 2690293 - RNA, 20 nt, Haemophilus influenzae Rd
gccaacguaagcaccaaugu

SEQ ID NO: 2690294 - RNA, 17 nt, Haemophilus influenzae Rd
gccaacucgaacaugaa

SEQ ID NO: 2690295 - RNA, 19 nt, Haemophilus influenzae Rd
gccaacuuagauuuucuua

SEQ ID NO: 2690296 - RNA, 22 nt, Haemophilus influenzae Rd
gccaacuuguaagcguaaugca

SEQ ID NO: 2690297 - RNA, 12 nt, Haemophilus influenzae Rd
gccaagacagua

SEQ ID NO: 2690298 - RNA, 21 nt, Haemophilus influenzae Rd
gccaaguacaauuaaauccau

SEQ ID NO: 2690299 - RNA, 21 nt, Haemophilus influenzae Rd
gccaagugcggucagcauaaa

SEQ ID NO: 2690300 - RNA, 15 nt, Haemophilus influenzae Rd
gccaauaaaauguua

SEQ ID NO: 2690301 - RNA, 11 nt, Haemophilus influenzae Rd
gccaauacuua

SEQ ID NO: 2690302 - RNA, 23 nt, Haemophilus influenzae Rd
gccaauacuuagcgugcuaauuc

SEQ ID NO: 2690303 - RNA, 13 nt, Haemophilus influenzae Rd
gccaaucacaaug

SEQ ID NO: 2690304 - RNA, 15 nt, Haemophilus influenzae Rd
gccaaucuaaacaca

SEQ ID NO: 2690305 - RNA, 20 nt, Haemophilus influenzae Rd
gccaaucuaagccuaagcca

SEQ ID NO: 2690306 - RNA, 20 nt, Haemophilus influenzae Rd
gccaaugccaaauuucuccg

SEQ ID NO: 2690307 - RNA, 21 nt, Haemophilus influenzae Rd
gccaaugcuuuuaauuuagcg

SEQ ID NO: 2690308 - RNA, 20 nt, Haemophilus influenzae Rd
gccaauggaaauaccaugga

SEQ ID NO: 2690309 - RNA, 14 nt, Haemophilus influenzae Rd
gccacaacugaagc

SEQ ID NO: 2690310 - RNA, 14 nt, Haemophilus influenzae Rd
gccacaggauaaaa

SEQ ID NO: 2690311 - RNA, 14 nt, Haemophilus influenzae Rd
gccacauaauaaga

SEQ ID NO: 2690312 - RNA, 17 nt, Haemophilus influenzae Rd
gccacauaauaagaaag

SEQ ID NO: 2690313 - RNA, 21 nt, Haemophilus influenzae Rd
gccacaucaucguuuuuucug

SEQ ID NO: 2690314 - RNA, 12 nt, Haemophilus influenzae Rd
gccaccaaaaug

SEQ ID NO: 2690315 - RNA, 15 nt, Haemophilus influenzae Rd
gccaccuuuuaccaa

SEQ ID NO: 2690316 - RNA, 18 nt, Haemophilus influenzae Rd
gccaccuuuuguagaaaa

SEQ ID NO: 2690317 - RNA, 12 nt, Haemophilus influenzae Rd
gccacgguaaau

SEQ ID NO: 2690318 - RNA, 16 nt, Haemophilus influenzae Rd
gccacucuaaguuuaa

SEQ ID NO: 2690319 - RNA, 22 nt, Haemophilus influenzae Rd
gccacugcgcccgcugcauccg

SEQ ID NO: 2690320 - RNA, 15 nt, Haemophilus influenzae Rd
gccacuggugcugaa

SEQ ID NO: 2690321 - RNA, 23 nt, Haemophilus influenzae Rd
gccacuguugugaaguuuuuuaa

SEQ ID NO: 2690322 - RNA, 20 nt, Haemophilus influenzae Rd
gccacuuaauccuuucacua

SEQ ID NO: 2690323 - RNA, 16 nt, Haemophilus influenzae Rd
gccacuucuucaaaga

SEQ ID NO: 2690324 - RNA, 22 nt, Haemophilus influenzae Rd
gccacuugugcaucaaagcguu

SEQ ID NO: 2690325 - RNA, 17 nt, Haemophilus influenzae Rd
gccagaaagcagguuuu

SEQ ID NO: 2690326 - RNA, 20 nt, Haemophilus influenzae Rd
gccagaaagcagguuuuucu

SEQ ID NO: 2690327 - RNA, 22 nt, Haemophilus influenzae Rd
gccagaaguuguuuuucuuccg

SEQ ID NO: 2690328 - RNA, 19 nt, Haemophilus influenzae Rd
gccagacagcguuauugua

SEQ ID NO: 2690329 - RNA, 21 nt, Haemophilus influenzae Rd
gccagauacaaauaacacaga

SEQ ID NO: 2690330 - RNA, 13 nt, Haemophilus influenzae Rd
gccagcaccacgu

SEQ ID NO: 2690331 - RNA, 23 nt, Haemophilus influenzae Rd
gccaguaacuuucuucaauaauu

SEQ ID NO: 2690332 - RNA, 18 nt, Haemophilus influenzae Rd
gccaguaagaucuucuac

SEQ ID NO: 2690333 - RNA, 21 nt, Haemophilus influenzae Rd
gccaguaagaucuucuacugu

SEQ ID NO: 2690334 - RNA, 15 nt, Haemophilus influenzae Rd
gccagucaucuaauu

SEQ ID NO: 2690335 - RNA, 21 nt, Haemophilus influenzae Rd
gccagucauuuuuuacauuaa

SEQ ID NO: 2690336 - RNA, 23 nt, Haemophilus influenzae Rd
gccagugauuuuugcaacuucag

SEQ ID NO: 2690337 - RNA, 19 nt, Haemophilus influenzae Rd
gccaguuuagaaagcacuu

SEQ ID NO: 2690338 - RNA, 15 nt, Haemophilus influenzae Rd
gccaguuucuuggga

SEQ ID NO: 2690339 - RNA, 15 nt, Haemophilus influenzae Rd
gccauaaaaaauuaa

SEQ ID NO: 2690340 - RNA, 15 nt, Haemophilus influenzae Rd
gccauaaaauagccc

SEQ ID NO: 2690341 - RNA, 21 nt, Haemophilus influenzae Rd
gccauaaaucgccuucacaua

SEQ ID NO: 2690342 - RNA, 16 nt, Haemophilus influenzae Rd
gccauagaaaauagaa

SEQ ID NO: 2690343 - RNA, 19 nt, Haemophilus influenzae Rd
gccauauuuucccaguaaa

SEQ ID NO: 2690344 - RNA, 22 nt, Haemophilus influenzae Rd
gccaucaauaacugaucgccau

SEQ ID NO: 2690345 - RNA, 17 nt, Haemophilus influenzae Rd
gccaucacagucuuuua

SEQ ID NO: 2690346 - RNA, 23 nt, Haemophilus influenzae Rd
gccaucacuauauaaugcacuau

SEQ ID NO: 2690347 - RNA, 20 nt, Haemophilus influenzae Rd
gccaucauagauaaauauau

SEQ ID NO: 2690348 - RNA, 21 nt, Haemophilus influenzae Rd
gccauccaaaacuaauaaaag

SEQ ID NO: 2690349 - RNA, 16 nt, Haemophilus influenzae Rd
gccauccgcaauuaau

SEQ ID NO: 2690350 - RNA, 22 nt, Haemophilus influenzae Rd
gccaucgcugaaauuaauaaga

SEQ ID NO: 2690351 - RNA, 14 nt, Haemophilus influenzae Rd
gccauggcuuuuuc

SEQ ID NO: 2690352 - RNA, 15 nt, Haemophilus influenzae Rd
gccauuaaacuucug

SEQ ID NO: 2690353 - RNA, 13 nt, Haemophilus influenzae Rd
gccauuauccaca

SEQ ID NO: 2690354 - RNA, 19 nt, Haemophilus influenzae Rd
gccauucacauucuuuuaa

SEQ ID NO: 2690355 - RNA, 15 nt, Haemophilus influenzae Rd
gccauucguucccaa

SEQ ID NO: 2690356 - RNA, 19 nt, Haemophilus influenzae Rd
gccauucguucccaaauau

SEQ ID NO: 2690357 - RNA, 15 nt, Haemophilus influenzae Rd
gccauugcuaaauuu

SEQ ID NO: 2690358 - RNA, 14 nt, Haemophilus influenzae Rd
gccauugugauguu

SEQ ID NO: 2690359 - RNA, 13 nt, Haemophilus influenzae Rd
gccauuucccaua

SEQ ID NO: 2690360 - RNA, 14 nt, Haemophilus influenzae Rd
gccauuuuuaaaaa

SEQ ID NO: 2690361 - RNA, 15 nt, Haemophilus influenzae Rd
gccauuuuucaaaau

SEQ ID NO: 2690362 - RNA, 15 nt, Haemophilus influenzae Rd
gcccaaaugcaacaa

SEQ ID NO: 2690363 - RNA, 22 nt, Haemophilus influenzae Rd
gcccaacauuucacuaaauaaa

SEQ ID NO: 2690364 - RNA, 21 nt, Haemophilus influenzae Rd
gcccaaccaaaccugcccuug

SEQ ID NO: 2690365 - RNA, 17 nt, Haemophilus influenzae Rd
gcccaaguugugccaau

SEQ ID NO: 2690366 - RNA, 21 nt, Haemophilus influenzae Rd
gcccaauaaaaguaauuucuu

SEQ ID NO: 2690367 - RNA, 16 nt, Haemophilus influenzae Rd
gcgaaaccuuuuucuu

SEQ ID NO: 2690368 - RNA, 17 nt, Haemophilus influenzae Rd
gcgaaacuugagauuuu

SEQ ID NO: 2690369 - RNA, 19 nt, Haemophilus influenzae Rd
gcgaaauaucgcccuuauu

SEQ ID NO: 2690370 - RNA, 23 nt, Haemophilus influenzae Rd
gcgaaccugauaaguagaaaaau

SEQ ID NO: 2690371 - RNA, 15 nt, Haemophilus influenzae Rd
gcgaaccuucacuua

SEQ ID NO: 2690372 - RNA, 17 nt, Haemophilus influenzae Rd
gcgaaguuuaauucuuc

SEQ ID NO: 2690373 - RNA, 20 nt, Haemophilus influenzae Rd
gcgaauagcuucugccagca

SEQ ID NO: 2690374 - RNA, 22 nt, Haemophilus influenzae Rd
gcgaauagcuucugccagcaug

SEQ ID NO: 2690375 - RNA, 21 nt, Haemophilus influenzae Rd
gcgaauuaaacggcucacauc

SEQ ID NO: 2690376 - RNA, 11 nt, Haemophilus influenzae Rd
gcgaauuucuu

SEQ ID NO: 2690377 - RNA, 18 nt, Haemophilus influenzae Rd
gcgaauuugguuuugcuc

SEQ ID NO: 2690378 - RNA, 17 nt, Haemophilus influenzae Rd
gcgaauuuuuauuuucu

SEQ ID NO: 2690379 - RNA, 23 nt, Haemophilus influenzae Rd
gcgacaaguuugauccacaaaua

SEQ ID NO: 2690380 - RNA, 18 nt, Haemophilus influenzae Rd
gcgacagaggggauaaaa

SEQ ID NO: 2690381 - RNA, 21 nt, Haemophilus influenzae Rd
gcgacagaggggauaaaauaa

SEQ ID NO: 2690382 - RNA, 13 nt, Haemophilus influenzae Rd
gcgacauuaagug

SEQ ID NO: 2690383 - RNA, 15 nt, Haemophilus influenzae Rd
gcgaccauucucuaa

SEQ ID NO: 2690384 - RNA, 16 nt, Haemophilus influenzae Rd
gcgacggcaucaaacc

SEQ ID NO: 2690385 - RNA, 22 nt, Haemophilus influenzae Rd
gcgacggcaucaaaccaaccac

SEQ ID NO: 2690386 - RNA, 14 nt, Haemophilus influenzae Rd
gcgacuuucccugc

SEQ ID NO: 2690387 - RNA, 20 nt, Haemophilus influenzae Rd
gcgagaaaaacgaauuaaug

SEQ ID NO: 2690388 - RNA, 13 nt, Haemophilus influenzae Rd
gcgaguaaaauaa

SEQ ID NO: 2690389 - RNA, 18 nt, Haemophilus influenzae Rd
gcgaguaagggcaaaaaa

SEQ ID NO: 2690390 - RNA, 14 nt, Haemophilus influenzae Rd
gcgauaauuugcau

SEQ ID NO: 2690391 - RNA, 21 nt, Haemophilus influenzae Rd
gcgauaguguucgcaauuaau

SEQ ID NO: 2690392 - RNA, 19 nt, Haemophilus influenzae Rd
gcgauauugaccauuucau

SEQ ID NO: 2690393 - RNA, 17 nt, Haemophilus influenzae Rd
gcgaucaccauaaucaa

SEQ ID NO: 2690394 - RNA, 20 nt, Haemophilus influenzae Rd
gcgaucauuacuuuaaagcc

SEQ ID NO: 2690395 - RNA, 21 nt, Haemophilus influenzae Rd
gcgaucuaaaucauuuauaua

SEQ ID NO: 2690396 - RNA, 13 nt, Haemophilus influenzae Rd
gcgaucuguuuua

SEQ ID NO: 2690397 - RNA, 15 nt, Haemophilus influenzae Rd
gcgauguuauuuguu

SEQ ID NO: 2690398 - RNA, 17 nt, Haemophilus influenzae Rd
gcgauuuccaagcuggc

SEQ ID NO: 2690399 - RNA, 19 nt, Haemophilus influenzae Rd
gcgauuuuuauauaaauaa

SEQ ID NO: 2690400 - RNA, 20 nt, Haemophilus influenzae Rd
gcgauuuuuauauaaauaac

SEQ ID NO: 2690401 - RNA, 14 nt, Haemophilus influenzae Rd
gcgauuuuugcacg

SEQ ID NO: 2690402 - RNA, 19 nt, Haemophilus influenzae Rd
gcgcaacuucacgauuucu

SEQ ID NO: 2690403 - RNA, 19 nt, Haemophilus influenzae Rd
gcgcacuuuuggauaaagu

SEQ ID NO: 2690404 - RNA, 20 nt, Haemophilus influenzae Rd
gcgccgauaacaccgcuaau

SEQ ID NO: 2690405 - RNA, 18 nt, Haemophilus influenzae Rd
gcgcgugugaaauuccuu

SEQ ID NO: 2690406 - RNA, 14 nt, Haemophilus influenzae Rd
gcgcuaaaucauaa

SEQ ID NO: 2690407 - RNA, 16 nt, Haemophilus influenzae Rd
gcgcuugugcuggagu

SEQ ID NO: 2690408 - RNA, 18 nt, Haemophilus influenzae Rd
gcggauuaagauggcuau

SEQ ID NO: 2690409 - RNA, 22 nt, Haemophilus influenzae Rd
gcggcagaauuucgucaaaaau

SEQ ID NO: 2690410 - RNA, 17 nt, Haemophilus influenzae Rd
gcggcuauggcagccgc

SEQ ID NO: 2690411 - RNA, 22 nt, Haemophilus influenzae Rd
gcgguaaaauuuuuagugauuu

SEQ ID NO: 2690412 - RNA, 14 nt, Haemophilus influenzae Rd
gcgguaauuauaga

SEQ ID NO: 2690413 - RNA, 16 nt, Haemophilus influenzae Rd
gcggucagcauaaaga

SEQ ID NO: 2690414 - RNA, 18 nt, Haemophilus influenzae Rd
gcggucaucuacccacac

SEQ ID NO: 2690415 - RNA, 16 nt, Haemophilus influenzae Rd
gcggucugaaaaucaa

SEQ ID NO: 2690416 - RNA, 13 nt, Haemophilus influenzae Rd
gcggucuuuuuuu

SEQ ID NO: 2690417 - RNA, 14 nt, Haemophilus influenzae Rd
gcggugaaauuuua

SEQ ID NO: 2690418 - RNA, 14 nt, Haemophilus influenzae Rd
gcgguuaaaauuuc

SEQ ID NO: 2690419 - RNA, 21 nt, Haemophilus influenzae Rd
gcgguuaaauauuucaguauu

SEQ ID NO: 2690420 - RNA, 15 nt, Haemophilus influenzae Rd
gcgguucuucuuuua

SEQ ID NO: 2690421 - RNA, 23 nt, Haemophilus influenzae Rd
gcgguucuucuuuuaauaauaga

SEQ ID NO: 2690422 - RNA, 18 nt, Haemophilus influenzae Rd
gcgguucuuguuuuaaau

SEQ ID NO: 2690423 - RNA, 11 nt, Haemophilus influenzae Rd
gcgguugaaau

SEQ ID NO: 2690424 - RNA, 14 nt, Haemophilus influenzae Rd
gcgguugauuuucc

SEQ ID NO: 2690425 - RNA, 17 nt, Haemophilus influenzae Rd
gcguaaaacuauuaucu

SEQ ID NO: 2690426 - RNA, 13 nt, Haemophilus influenzae Rd
gcguaaaccuaca

SEQ ID NO: 2690427 - RNA, 20 nt, Haemophilus influenzae Rd
gcguaaaccuacacccacug

SEQ ID NO: 2690428 - RNA, 18 nt, Haemophilus influenzae Rd
gcguaaagggaagugaua

SEQ ID NO: 2690429 - RNA, 20 nt, Haemophilus influenzae Rd
gcguaaaguuuuaaaccaag

SEQ ID NO: 2690430 - RNA, 11 nt, Haemophilus influenzae Rd
gcguaaaucag

SEQ ID NO: 2690431 - RNA, 12 nt, Haemophilus influenzae Rd
gcguaauguuua

SEQ ID NO: 2690432 - RNA, 14 nt, Haemophilus influenzae Rd
gcguacaacgugaa

SEQ ID NO: 2690433 - RNA, 14 nt, Haemophilus influenzae Rd
gcguaccaaauucc

SEQ ID NO: 2690434 - RNA, 18 nt, Haemophilus influenzae Rd
gcguagaaugcaaacauu

SEQ ID NO: 2690435 - RNA, 19 nt, Haemophilus influenzae Rd
gcguaucacuuaaaccaaa

SEQ ID NO: 2690436 - RNA, 13 nt, Haemophilus influenzae Rd
gcgucauuuaauu

SEQ ID NO: 2690437 - RNA, 13 nt, Haemophilus influenzae Rd
gcgugaaauauug

SEQ ID NO: 2690438 - RNA, 16 nt, Haemophilus influenzae Rd
gcgugaauauaagaaa

SEQ ID NO: 2690439 - RNA, 18 nt, Haemophilus influenzae Rd
gcgugagcgauagccaaa

SEQ ID NO: 2690440 - RNA, 15 nt, Haemophilus influenzae Rd
gcguggauaaucgau

SEQ ID NO: 2690441 - RNA, 16 nt, Haemophilus influenzae Rd
gcgugguucaaaacca

SEQ ID NO: 2690442 - RNA, 16 nt, Haemophilus influenzae Rd
gcguguguuuguaaac

SEQ ID NO: 2690443 - RNA, 19 nt, Haemophilus influenzae Rd
gcguguuucgcgugauuua

SEQ ID NO: 2690444 - RNA, 12 nt, Haemophilus influenzae Rd
gcguuaaaucac

SEQ ID NO: 2690445 - RNA, 14 nt, Haemophilus influenzae Rd
gcguuaaaucacaa

SEQ ID NO: 2690446 - RNA, 18 nt, Haemophilus influenzae Rd
gcguuaaguaauuuuuca

SEQ ID NO: 2690447 - RNA, 18 nt, Haemophilus influenzae Rd
gcguuagccgauuuaccu

SEQ ID NO: 2690448 - RNA, 13 nt, Haemophilus influenzae Rd
gcguucaaaaaga

SEQ ID NO: 2690449 - RNA, 15 nt, Haemophilus influenzae Rd
gcguucaauaugcaa

SEQ ID NO: 2690450 - RNA, 22 nt, Haemophilus influenzae Rd
gcguucacguaauggaauaugg

SEQ ID NO: 2690451 - RNA, 15 nt, Haemophilus influenzae Rd
gcguucauaucuuua

SEQ ID NO: 2690452 - RNA, 15 nt, Haemophilus influenzae Rd
gcguugaaaauaaau

SEQ ID NO: 2690453 - RNA, 16 nt, Haemophilus influenzae Rd
gcguugaaaauaaauu

SEQ ID NO: 2690454 - RNA, 15 nt, Haemophilus influenzae Rd
gcguugucaucagaa

SEQ ID NO: 2690455 - RNA, 20 nt, Haemophilus influenzae Rd
gcguuuaacugcuuuuuucc

SEQ ID NO: 2690456 - RNA, 22 nt, Haemophilus influenzae Rd
gcguuuaggagaagauuuauau

SEQ ID NO: 2690457 - RNA, 20 nt, Haemophilus influenzae Rd
gcguuuuacaccaacacuug

SEQ ID NO: 2690458 - RNA, 13 nt, Haemophilus influenzae Rd
gcguuuuucuuaa

SEQ ID NO: 2690459 - RNA, 19 nt, Haemophilus influenzae Rd
gcguuuuuuaauucuucga

SEQ ID NO: 2690460 - RNA, 23 nt, Haemophilus influenzae Rd
gcguuuuuuauaaacuucugcaa

SEQ ID NO: 2690461 - RNA, 11 nt, Haemophilus influenzae Rd
gcuaaaaaaac

SEQ ID NO: 2690462 - RNA, 15 nt, Haemophilus influenzae Rd
gcuaaaaagaaauaa

SEQ ID NO: 2690463 - RNA, 17 nt, Haemophilus influenzae Rd
gcuaaaaagaaauaaaa

SEQ ID NO: 2690464 - RNA, 13 nt, Haemophilus influenzae Rd
gcuaaaacagaag

SEQ ID NO: 2690465 - RNA, 14 nt, Haemophilus influenzae Rd
gcuaaaaucuugca

SEQ ID NO: 2690466 - RNA, 22 nt, Haemophilus influenzae Rd
gcuaaaggaauggcaaagaaua

SEQ ID NO: 2690467 - RNA, 20 nt, Haemophilus influenzae Rd
gcuaaaguucucaaaaaguu

SEQ ID NO: 2690468 - RNA, 21 nt, Haemophilus influenzae Rd
gcuaaaguucucaaaaaguua

SEQ ID NO: 2690469 - RNA, 16 nt, Haemophilus influenzae Rd
gcuaaauaaauuccua

SEQ ID NO: 2690470 - RNA, 18 nt, Haemophilus influenzae Rd
gcuaaaucaccuaaaucu

SEQ ID NO: 2690471 - RNA, 21 nt, Haemophilus influenzae Rd
gcuaaaucaccuaaaucuuua

SEQ ID NO: 2690472 - RNA, 18 nt, Haemophilus influenzae Rd
gcuaaaucuuauuaauaa

SEQ ID NO: 2690473 - RNA, 13 nt, Haemophilus influenzae Rd
gcucuauuuaucc

SEQ ID NO: 2690474 - RNA, 17 nt, Haemophilus influenzae Rd
gcucucgaguaucaaaa

SEQ ID NO: 2690475 - RNA, 14 nt, Haemophilus influenzae Rd
gcucucguuguucu

SEQ ID NO: 2690476 - RNA, 14 nt, Haemophilus influenzae Rd
gcucugaucacaau

SEQ ID NO: 2690477 - RNA, 17 nt, Haemophilus influenzae Rd
gcucugaucacaaugag

SEQ ID NO: 2690478 - RNA, 15 nt, Haemophilus influenzae Rd
gcucugccacggcuu

SEQ ID NO: 2690479 - RNA, 18 nt, Haemophilus influenzae Rd
gcucugcuagucguucuu

SEQ ID NO: 2690480 - RNA, 15 nt, Haemophilus influenzae Rd
gcucuucagcuucuu

SEQ ID NO: 2690481 - RNA, 17 nt, Haemophilus influenzae Rd
gcucuucagcuucuuca

SEQ ID NO: 2690482 - RNA, 19 nt, Haemophilus influenzae Rd
gcucuucaucaaaaugaaa

SEQ ID NO: 2690483 - RNA, 18 nt, Haemophilus influenzae Rd
gcucuucuuuaauuucuu

SEQ ID NO: 2690484 - RNA, 20 nt, Haemophilus influenzae Rd
gcucuucuuuaauuucuuca

SEQ ID NO: 2690485 - RNA, 18 nt, Haemophilus influenzae Rd
gcucuuguagcacauaaa

SEQ ID NO: 2690486 - RNA, 23 nt, Haemophilus influenzae Rd
gcucuuuaacaauauaucagaca

SEQ ID NO: 2690487 - RNA, 15 nt, Haemophilus influenzae Rd
gcucuuuaauuguuu

SEQ ID NO: 2690488 - RNA, 16 nt, Haemophilus influenzae Rd
gcucuuucaaauaauu

SEQ ID NO: 2690489 - RNA, 14 nt, Haemophilus influenzae Rd
gcugaaaaauaaaa

SEQ ID NO: 2690490 - RNA, 17 nt, Haemophilus influenzae Rd
gcugaaaaauaaaaaau

SEQ ID NO: 2690491 - RNA, 14 nt, Haemophilus influenzae Rd
gcugaaagaaauuu

SEQ ID NO: 2690492 - RNA, 16 nt, Haemophilus influenzae Rd
gcugaaauaccuucuu

SEQ ID NO: 2690493 - RNA, 21 nt, Haemophilus influenzae Rd
gcugaaaugaaguaauaaucu

SEQ ID NO: 2690494 - RNA, 14 nt, Haemophilus influenzae Rd
gcugaaauuuagug

SEQ ID NO: 2690495 - RNA, 20 nt, Haemophilus influenzae Rd
gcugaaauuuagugauuucu

SEQ ID NO: 2690496 - RNA, 23 nt, Haemophilus influenzae Rd
gcugaaauuuagugauuucuaug

SEQ ID NO: 2690497 - RNA, 17 nt, Haemophilus influenzae Rd
gcugaagucguuucauc

SEQ ID NO: 2690498 - RNA, 14 nt, Haemophilus influenzae Rd
gcugaauaaaagag

SEQ ID NO: 2690499 - RNA, 18 nt, Haemophilus influenzae Rd
gcugaauaucagaagaau

SEQ ID NO: 2690500 - RNA, 21 nt, Haemophilus influenzae Rd
gcugaaugugcgguagauuuu

SEQ ID NO: 2690501 - RNA, 23 nt, Haemophilus influenzae Rd
gcugacaaauuuguugaucugca

SEQ ID NO: 2690502 - RNA, 20 nt, Haemophilus influenzae Rd
gcugacacgguaguaaauaa

SEQ ID NO: 2690503 - RNA, 18 nt, Haemophilus influenzae Rd
gcugaccacuuucaauuu

SEQ ID NO: 2690504 - RNA, 16 nt, Haemophilus influenzae Rd
gcugacguacaauuuc

SEQ ID NO: 2690505 - RNA, 17 nt, Haemophilus influenzae Rd
gcugacguacaauuuca

SEQ ID NO: 2690506 - RNA, 13 nt, Haemophilus influenzae Rd
gcugacuuaaugc

SEQ ID NO: 2690507 - RNA, 17 nt, Haemophilus influenzae Rd
gcugaguacacaaaacu

SEQ ID NO: 2690508 - RNA, 18 nt, Haemophilus influenzae Rd
gcugaguaccaaaaggug

SEQ ID NO: 2690509 - RNA, 19 nt, Haemophilus influenzae Rd
gcugauaaauuccuuccaa

SEQ ID NO: 2690510 - RNA, 23 nt, Haemophilus influenzae Rd
gcugauaaauuccuuccaacaau

SEQ ID NO: 2690511 - RNA, 15 nt, Haemophilus influenzae Rd
gcugauaaauuucua

SEQ ID NO: 2690512 - RNA, 14 nt, Haemophilus influenzae Rd
gcugauauuuaaaa

SEQ ID NO: 2690513 - RNA, 21 nt, Haemophilus influenzae Rd
gcugaucuacacgaauuaguu

SEQ ID NO: 2690514 - RNA, 17 nt, Haemophilus influenzae Rd
gcugaucuugguagaaa

SEQ ID NO: 2690515 - RNA, 13 nt, Haemophilus influenzae Rd
gcugauucacgau

SEQ ID NO: 2690516 - RNA, 14 nt, Haemophilus influenzae Rd
gcugauucuaaugc

SEQ ID NO: 2690517 - RNA, 16 nt, Haemophilus influenzae Rd
gcugauuuuaaauauc

SEQ ID NO: 2690518 - RNA, 15 nt, Haemophilus influenzae Rd
gcugcaacaaauaaa

SEQ ID NO: 2690519 - RNA, 16 nt, Haemophilus influenzae Rd
gcugcaacaaauaaau

SEQ ID NO: 2690520 - RNA, 16 nt, Haemophilus influenzae Rd
gcugcaauucaacaac

SEQ ID NO: 2690521 - RNA, 20 nt, Haemophilus influenzae Rd
gcugcauuucaauuucacug

SEQ ID NO: 2690522 - RNA, 21 nt, Haemophilus influenzae Rd
gcugccuucaaugggcaucca

SEQ ID NO: 2690523 - RNA, 14 nt, Haemophilus influenzae Rd
gcugcgaauugcaa

SEQ ID NO: 2690524 - RNA, 13 nt, Haemophilus influenzae Rd
gcugcgaugcaua

SEQ ID NO: 2690525 - RNA, 17 nt, Haemophilus influenzae Rd
gcugcuuguaaccaaua

SEQ ID NO: 2690526 - RNA, 22 nt, Haemophilus influenzae Rd
gcugcuuuaauuucauucaaca

SEQ ID NO: 2690527 - RNA, 21 nt, Haemophilus influenzae Rd
gcugcuuugagguaaaagugc

SEQ ID NO: 2690528 - RNA, 21 nt, Haemophilus influenzae Rd
gcuggaucggcuauuucagcu

SEQ ID NO: 2690529 - RNA, 21 nt, Haemophilus influenzae Rd
gcuggauuaucuauaucuuua

SEQ ID NO: 2690530 - RNA, 22 nt, Haemophilus influenzae Rd
gcuggauucauuugcaaaucaa

SEQ ID NO: 2690531 - RNA, 17 nt, Haemophilus influenzae Rd
gcuggcguuuacuuggc

SEQ ID NO: 2690532 - RNA, 17 nt, Haemophilus influenzae Rd
gcuggcuuucuuuuuca

SEQ ID NO: 2690533 - RNA, 21 nt, Haemophilus influenzae Rd
gcuggcuuucuuuuucaaguu

SEQ ID NO: 2690534 - RNA, 22 nt, Haemophilus influenzae Rd
gcuggcuuucuuuuucaaguuc

SEQ ID NO: 2690535 - RNA, 13 nt, Haemophilus influenzae Rd
gcuggguaagaag

SEQ ID NO: 2690536 - RNA, 15 nt, Haemophilus influenzae Rd
gcuggguuugcacuu

SEQ ID NO: 2690537 - RNA, 11 nt, Haemophilus influenzae Rd
gcuggucacuu

SEQ ID NO: 2690538 - RNA, 14 nt, Haemophilus influenzae Rd
gcugguuaaauuaa

SEQ ID NO: 2690539 - RNA, 17 nt, Haemophilus influenzae Rd
gcugguuuuagcggcgc

SEQ ID NO: 2690540 - RNA, 17 nt, Haemophilus influenzae Rd
gcuguaaugacagaauc

SEQ ID NO: 2690541 - RNA, 21 nt, Haemophilus influenzae Rd
gcuguaaugacagaaucuaaa

SEQ ID NO: 2690542 - RNA, 12 nt, Haemophilus influenzae Rd
gcuguaaugauc

SEQ ID NO: 2690543 - RNA, 15 nt, Haemophilus influenzae Rd
gcuguacaaagcacg

SEQ ID NO: 2690544 - RNA, 16 nt, Haemophilus influenzae Rd
gcuguagaaauuaaua

SEQ ID NO: 2690545 - RNA, 22 nt, Haemophilus influenzae Rd
gcuguaguagauaacaacuaaa

SEQ ID NO: 2690546 - RNA, 14 nt, Haemophilus influenzae Rd
gcuguauauuuuua

SEQ ID NO: 2690547 - RNA, 18 nt, Haemophilus influenzae Rd
gcugucaaacgaaaaaaa

SEQ ID NO: 2690548 - RNA, 19 nt, Haemophilus influenzae Rd
gcugucaaacgaaaaaaau

SEQ ID NO: 2690549 - RNA, 16 nt, Haemophilus influenzae Rd
gcugucuaauuuuuua

SEQ ID NO: 2690550 - RNA, 17 nt, Haemophilus influenzae Rd
gcuguugcaaugacagu

SEQ ID NO: 2690551 - RNA, 14 nt, Haemophilus influenzae Rd
gcuguuuaaaucua

SEQ ID NO: 2690552 - RNA, 20 nt, Haemophilus influenzae Rd
gcuguuucgcaucaaagaau

SEQ ID NO: 2690553 - RNA, 16 nt, Haemophilus influenzae Rd
gcuuaaaaaagugaaa

SEQ ID NO: 2690554 - RNA, 18 nt, Haemophilus influenzae Rd
gcuuaaaaaccccgcuaa

SEQ ID NO: 2690555 - RNA, 17 nt, Haemophilus influenzae Rd
gcuuaaagcaaucaaaa

SEQ ID NO: 2690556 - RNA, 21 nt, Haemophilus influenzae Rd
gcuuaaagcaaucaaaaauga

SEQ ID NO: 2690557 - RNA, 18 nt, Haemophilus influenzae Rd
gcuuaaaugaucagcuaa

SEQ ID NO: 2690558 - RNA, 18 nt, Haemophilus influenzae Rd
gcuuaaugcgcccuuuaa

SEQ ID NO: 2690559 - RNA, 19 nt, Haemophilus influenzae Rd
gcuuaauggaccaauuggu

SEQ ID NO: 2690560 - RNA, 14 nt, Haemophilus influenzae Rd
gcuuagauaauaaa

SEQ ID NO: 2690561 - RNA, 15 nt, Haemophilus influenzae Rd
gcuuagauaauaaaa

SEQ ID NO: 2690562 - RNA, 19 nt, Haemophilus influenzae Rd
gcuuagggucgcaacuaaa

SEQ ID NO: 2690563 - RNA, 18 nt, Haemophilus influenzae Rd
gcuuagugaaaagaaaac

SEQ ID NO: 2690564 - RNA, 18 nt, Haemophilus influenzae Rd
gcuuauacgaguaaaaaa

SEQ ID NO: 2690565 - RNA, 22 nt, Haemophilus influenzae Rd
gcuuauacgaguaaaaaaucua

SEQ ID NO: 2690566 - RNA, 15 nt, Haemophilus influenzae Rd
gcuuauccuauaaaa

SEQ ID NO: 2690567 - RNA, 15 nt, Haemophilus influenzae Rd
gcuuauguaaauuua

SEQ ID NO: 2690568 - RNA, 18 nt, Haemophilus influenzae Rd
gcuuauguaaauuuaucu

SEQ ID NO: 2690569 - RNA, 13 nt, Haemophilus influenzae Rd
gcuuauuuuguug

SEQ ID NO: 2690570 - RNA, 13 nt, Haemophilus influenzae Rd
gcuucaaucgcaa

SEQ ID NO: 2690571 - RNA, 13 nt, Haemophilus influenzae Rd
gcuucaucaaauu

SEQ ID NO: 2690572 - RNA, 21 nt, Haemophilus influenzae Rd
gcuucauuuugagauaaauuu

SEQ ID NO: 2690573 - RNA, 13 nt, Haemophilus influenzae Rd
gcuuccaacaaaa

SEQ ID NO: 2690574 - RNA, 18 nt, Haemophilus influenzae Rd
gcuucgccagcagugcca

SEQ ID NO: 2690575 - RNA, 23 nt, Haemophilus influenzae Rd
gcuucgccagcagugccaaccac

SEQ ID NO: 2690576 - RNA, 18 nt, Haemophilus influenzae Rd
gcuucgccuucagcaauu

SEQ ID NO: 2690577 - RNA, 15 nt, Haemophilus influenzae Rd
gcuucggccuauuaa

SEQ ID NO: 2690578 - RNA, 19 nt, Haemophilus influenzae Rd
gcuucgggcaccauuuaaa

SEQ ID NO: 2690579 - RNA, 19 nt, Haemophilus influenzae Rd
ggcuacgaaccgagcgguc

SEQ ID NO: 2690580 - RNA, 19 nt, Haemophilus influenzae Rd
ggcuacuuuauuuacccaa

SEQ ID NO: 2690581 - RNA, 17 nt, Haemophilus influenzae Rd
ggcuaguuuguuuauga

SEQ ID NO: 2690582 - RNA, 14 nt, Haemophilus influenzae Rd
ggcuauuuaagccu

SEQ ID NO: 2690583 - RNA, 21 nt, Haemophilus influenzae Rd
ggcucaaaucuacuaaaauaa

SEQ ID NO: 2690584 - RNA, 15 nt, Haemophilus influenzae Rd
ggcucgcucuucagc

SEQ ID NO: 2690585 - RNA, 15 nt, Haemophilus influenzae Rd
ggcugaaaaauucaa

SEQ ID NO: 2690586 - RNA, 19 nt, Haemophilus influenzae Rd
ggcugaaagcgaaaucgca

SEQ ID NO: 2690587 - RNA, 18 nt, Haemophilus influenzae Rd
ggcugaauccgaaauuaa

SEQ ID NO: 2690588 - RNA, 11 nt, Haemophilus influenzae Rd
ggcugauaguc

SEQ ID NO: 2690589 - RNA, 16 nt, Haemophilus influenzae Rd
ggcuuaacacaugcaa

SEQ ID NO: 2690590 - RNA, 14 nt, Haemophilus influenzae Rd
ggcuuagaagugcg

SEQ ID NO: 2690591 - RNA, 16 nt, Haemophilus influenzae Rd
ggcuuagauaauaaaa

SEQ ID NO: 2690592 - RNA, 17 nt, Haemophilus influenzae Rd
ggcuuaguuaaauauaa

SEQ ID NO: 2690593 - RNA, 17 nt, Haemophilus influenzae Rd
ggcuuauuaaaaacuaa

SEQ ID NO: 2690594 - RNA, 15 nt, Haemophilus influenzae Rd
ggcuucagaaaauaa

SEQ ID NO: 2690595 - RNA, 15 nt, Haemophilus influenzae Rd
ggcuucauuugcuuc

SEQ ID NO: 2690596 - RNA, 11 nt, Haemophilus influenzae Rd
ggcuucuuuuc

SEQ ID NO: 2690597 - RNA, 15 nt, Haemophilus influenzae Rd
ggcuugccguuuagu

SEQ ID NO: 2690598 - RNA, 19 nt, Haemophilus influenzae Rd
ggcuugugggauaaauuca

SEQ ID NO: 2690599 - RNA, 18 nt, Haemophilus influenzae Rd
ggcuuguugaaauuccuc

SEQ ID NO: 2690600 - RNA, 15 nt, Haemophilus influenzae Rd
ggcuuucuuuuucaa

SEQ ID NO: 2690601 - RNA, 21 nt, Haemophilus influenzae Rd
ggcuuuucucaaaacaucuuu

SEQ ID NO: 2690602 - RNA, 12 nt, Haemophilus influenzae Rd
ggcuuuucugau

SEQ ID NO: 2690603 - RNA, 21 nt, Haemophilus influenzae Rd
ggcuuuuuuaauuacucacua

SEQ ID NO: 2690604 - RNA, 12 nt, Haemophilus influenzae Rd
ggcuuuuuugcc

SEQ ID NO: 2690605 - RNA, 17 nt, Haemophilus influenzae Rd
gggaaagucgcaguauu

SEQ ID NO: 2690606 - RNA, 20 nt, Haemophilus influenzae Rd
gggaaauauugcucucccuu

SEQ ID NO: 2690607 - RNA, 21 nt, Haemophilus influenzae Rd
gggaauaccacaguccccaua

SEQ ID NO: 2690608 - RNA, 13 nt, Haemophilus influenzae Rd
gggaaucuggcuu

SEQ ID NO: 2690609 - RNA, 21 nt, Haemophilus influenzae Rd
gggacgaugauccaaaaauau

SEQ ID NO: 2690610 - RNA, 20 nt, Haemophilus influenzae Rd
gggacugccacggcuugcca

SEQ ID NO: 2690611 - RNA, 18 nt, Haemophilus influenzae Rd
gggacuuuaucgaggaca

SEQ ID NO: 2690612 - RNA, 19 nt, Haemophilus influenzae Rd
gggauaaggcagaaaugaa

SEQ ID NO: 2690613 - RNA, 14 nt, Haemophilus influenzae Rd
gggauaauuucuuu

SEQ ID NO: 2690614 - RNA, 21 nt, Haemophilus influenzae Rd
gggauauugccuaauagaaaa

SEQ ID NO: 2690615 - RNA, 14 nt, Haemophilus influenzae Rd
gggauuaagaaaau

SEQ ID NO: 2690616 - RNA, 18 nt, Haemophilus influenzae Rd
gggauuucaauaaauuca

SEQ ID NO: 2690617 - RNA, 13 nt, Haemophilus influenzae Rd
gggauuugaaaau

SEQ ID NO: 2690618 - RNA, 20 nt, Haemophilus influenzae Rd
gggauuuuuuauuuugugau

SEQ ID NO: 2690619 - RNA, 14 nt, Haemophilus influenzae Rd
gggcaaaagguaaa

SEQ ID NO: 2690620 - RNA, 19 nt, Haemophilus influenzae Rd
gggcaccauuuaaacacca

SEQ ID NO: 2690621 - RNA, 18 nt, Haemophilus influenzae Rd
gggcacuacucggaaagc

SEQ ID NO: 2690622 - RNA, 23 nt, Haemophilus influenzae Rd
gggcagaauuaaaucugcccuuu

SEQ ID NO: 2690623 - RNA, 23 nt, Haemophilus influenzae Rd
gggcagauuuaauucugcccuuu

SEQ ID NO: 2690624 - RNA, 15 nt, Haemophilus influenzae Rd
gggcagugauguaaa

SEQ ID NO: 2690625 - RNA, 20 nt, Haemophilus influenzae Rd
gggccaaauaauacaucugc

SEQ ID NO: 2690626 - RNA, 15 nt, Haemophilus influenzae Rd
gggcgaaguaaaaag

SEQ ID NO: 2690627 - RNA, 12 nt, Haemophilus influenzae Rd
gggcgguuaaaa

SEQ ID NO: 2690628 - RNA, 22 nt, Haemophilus influenzae Rd
gggcguauuuuacggauuuaua

SEQ ID NO: 2690629 - RNA, 15 nt, Haemophilus influenzae Rd
gggcugaagcccacc

SEQ ID NO: 2690630 - RNA, 18 nt, Haemophilus influenzae Rd
gggcuucucaaaugaaau

SEQ ID NO: 2690631 - RNA, 15 nt, Haemophilus influenzae Rd
gggcuuuagcccacc

SEQ ID NO: 2690632 - RNA, 16 nt, Haemophilus influenzae Rd
gggcuuuguauuuugu

SEQ ID NO: 2690633 - RNA, 20 nt, Haemophilus influenzae Rd
gggcuuuuuuuuauucagua

SEQ ID NO: 2690634 - RNA, 20 nt, Haemophilus influenzae Rd
ggggacgcaccuuuugaaaa

SEQ ID NO: 2690635 - RNA, 20 nt, Haemophilus influenzae Rd
gggguaucgacaguugccau

SEQ ID NO: 2690636 - RNA, 22 nt, Haemophilus influenzae Rd
ggguaaaccaaacgagaaaauu

SEQ ID NO: 2690637 - RNA, 16 nt, Haemophilus influenzae Rd
ggguaaucaaauucaa

SEQ ID NO: 2690638 - RNA, 12 nt, Haemophilus influenzae Rd
gggugguaaaaa

SEQ ID NO: 2690639 - RNA, 20 nt, Haemophilus influenzae Rd
ggguuguggugucugaacuc

SEQ ID NO: 2690640 - RNA, 22 nt, Haemophilus influenzae Rd
ggguuuacaucuugcguuaaau

SEQ ID NO: 2690641 - RNA, 21 nt, Haemophilus influenzae Rd
gguaaaaaucguacaucgaaa

SEQ ID NO: 2690642 - RNA, 19 nt, Haemophilus influenzae Rd
gguaaaaauuaucaucauu

SEQ ID NO: 2690643 - RNA, 16 nt, Haemophilus influenzae Rd
gguaaaaauucuuuuu

SEQ ID NO: 2690644 - RNA, 14 nt, Haemophilus influenzae Rd
gguaaaauaaugca

SEQ ID NO: 2690645 - RNA, 15 nt, Haemophilus influenzae Rd
gguaaauaaaaauga

SEQ ID NO: 2690646 - RNA, 12 nt, Haemophilus influenzae Rd
gguaacaacugc

SEQ ID NO: 2690647 - RNA, 13 nt, Haemophilus influenzae Rd
gguaacaacugcu

SEQ ID NO: 2690648 - RNA, 17 nt, Haemophilus influenzae Rd
gguaagaagugaaauua

SEQ ID NO: 2690649 - RNA, 19 nt, Haemophilus influenzae Rd
gguaagaagugaaauuacu

SEQ ID NO: 2690650 - RNA, 14 nt, Haemophilus influenzae Rd
gguaaggauugacc

SEQ ID NO: 2690651 - RNA, 19 nt, Haemophilus influenzae Rd
gguaaguugugaguaaacc

SEQ ID NO: 2690652 - RNA, 14 nt, Haemophilus influenzae Rd
gguaauaaaucaaa

SEQ ID NO: 2690653 - RNA, 22 nt, Haemophilus influenzae Rd
gguaaucuuucacugcauuuuc

SEQ ID NO: 2690654 - RNA, 18 nt, Haemophilus influenzae Rd
gguaauuauagagaaaua

SEQ ID NO: 2690655 - RNA, 19 nt, Haemophilus influenzae Rd
gguaauuuaauuaaucauu

SEQ ID NO: 2690656 - RNA, 13 nt, Haemophilus influenzae Rd
gguacaaauuuag

SEQ ID NO: 2690657 - RNA, 14 nt, Haemophilus influenzae Rd
gguacaucuggaua

SEQ ID NO: 2690658 - RNA, 21 nt, Haemophilus influenzae Rd
gguagacacaagggauuuaaa

SEQ ID NO: 2690659 - RNA, 15 nt, Haemophilus influenzae Rd
gguagauugauacag

SEQ ID NO: 2690660 - RNA, 23 nt, Haemophilus influenzae Rd
gguagauuuucaucguuaauuaa

SEQ ID NO: 2690661 - RNA, 21 nt, Haemophilus influenzae Rd
gguagcaauaaccaauaacga

SEQ ID NO: 2690662 - RNA, 18 nt, Haemophilus influenzae Rd
gguaguuuauaaaaaaau

SEQ ID NO: 2690663 - RNA, 23 nt, Haemophilus influenzae Rd
gguaugguuuuccaaaaaccaac

SEQ ID NO: 2690664 - RNA, 12 nt, Haemophilus influenzae Rd
gguauuuauuau

SEQ ID NO: 2690665 - RNA, 23 nt, Haemophilus influenzae Rd
gguauuucuauuguuuuuuucua

SEQ ID NO: 2690666 - RNA, 22 nt, Haemophilus influenzae Rd
gguauuuucuuauugaagaaag

SEQ ID NO: 2690667 - RNA, 22 nt, Haemophilus influenzae Rd
ggucaacauaaagauuaaaauc

SEQ ID NO: 2690668 - RNA, 13 nt, Haemophilus influenzae Rd
ggucgcaccaccu

SEQ ID NO: 2690669 - RNA, 20 nt, Haemophilus influenzae Rd
ggucugaaaaucaaaagaaa

SEQ ID NO: 2690670 - RNA, 17 nt, Haemophilus influenzae Rd
ggucugacgugaacuuu

SEQ ID NO: 2690671 - RNA, 22 nt, Haemophilus influenzae Rd
ggucugcaauaauaucugcuuu

SEQ ID NO: 2690672 - RNA, 19 nt, Haemophilus influenzae Rd
ggugaaaggaaacgcccau

SEQ ID NO: 2690673 - RNA, 10 nt, Haemophilus influenzae Rd
ggugaaauuu

SEQ ID NO: 2690674 - RNA, 12 nt, Haemophilus influenzae Rd
ggugagugagca

SEQ ID NO: 2690675 - RNA, 18 nt, Haemophilus influenzae Rd
ggugauccauuaauaacu

SEQ ID NO: 2690676 - RNA, 17 nt, Haemophilus influenzae Rd
ggugcaaccauaucgua

SEQ ID NO: 2690677 - RNA, 18 nt, Haemophilus influenzae Rd
ggugcaauaaaaucauua

SEQ ID NO: 2690678 - RNA, 15 nt, Haemophilus influenzae Rd
ggugcaauuugaaaa

SEQ ID NO: 2690679 - RNA, 17 nt, Haemophilus influenzae Rd
ggugcauugucuuuuac

SEQ ID NO: 2690680 - RNA, 17 nt, Haemophilus influenzae Rd
ggugccguuugugcuaa

SEQ ID NO: 2690681 - RNA, 16 nt, Haemophilus influenzae Rd
ggugcuacuugagcuu

SEQ ID NO: 2690682 - RNA, 16 nt, Haemophilus influenzae Rd
ggugcuauuuuauuua

SEQ ID NO: 2690683 - RNA, 15 nt, Haemophilus influenzae Rd
ggugcugcaacuggg

SEQ ID NO: 2690684 - RNA, 20 nt, Haemophilus influenzae Rd
gguggaagucugcuacaagu

SEQ ID NO: 2690685 - RNA, 13 nt, Haemophilus influenzae Rd
guaacugauuuug

SEQ ID NO: 2690686 - RNA, 14 nt, Haemophilus influenzae Rd
guaacugauuuugc

SEQ ID NO: 2690687 - RNA, 16 nt, Haemophilus influenzae Rd
guaacugauuuugcua

SEQ ID NO: 2690688 - RNA, 18 nt, Haemophilus influenzae Rd
guaacuuguguauaacug

SEQ ID NO: 2690689 - RNA, 14 nt, Haemophilus influenzae Rd
guaacuuucacaac

SEQ ID NO: 2690690 - RNA, 12 nt, Haemophilus influenzae Rd
guaagaaauaac

SEQ ID NO: 2690691 - RNA, 19 nt, Haemophilus influenzae Rd
guaagcaauuuucugcaga

SEQ ID NO: 2690692 - RNA, 23 nt, Haemophilus influenzae Rd
guaagcauuaaaaauuuaaaagc

SEQ ID NO: 2690693 - RNA, 20 nt, Haemophilus influenzae Rd
guaaggcgagauuaaagcgu

SEQ ID NO: 2690694 - RNA, 16 nt, Haemophilus influenzae Rd
guaaggguaucacaaa

SEQ ID NO: 2690695 - RNA, 13 nt, Haemophilus influenzae Rd
guaagguaauguu

SEQ ID NO: 2690696 - RNA, 17 nt, Haemophilus influenzae Rd
guaaguacgauaaacac

SEQ ID NO: 2690697 - RNA, 14 nt, Haemophilus influenzae Rd
guaagucgcaucaa

SEQ ID NO: 2690698 - RNA, 18 nt, Haemophilus influenzae Rd
guaagucgugaucugcau

SEQ ID NO: 2690699 - RNA, 16 nt, Haemophilus influenzae Rd
guaaguggcauaaaga

SEQ ID NO: 2690700 - RNA, 22 nt, Haemophilus influenzae Rd
guaaguuaaaccaacaacugca

SEQ ID NO: 2690701 - RNA, 14 nt, Haemophilus influenzae Rd
guaaguuugcuaau

SEQ ID NO: 2690702 - RNA, 13 nt, Haemophilus influenzae Rd
guaauaaaaagca

SEQ ID NO: 2690703 - RNA, 13 nt, Haemophilus influenzae Rd
guaauaaauaagg

SEQ ID NO: 2690704 - RNA, 12 nt, Haemophilus influenzae Rd
guaauaaaucaa

SEQ ID NO: 2690705 - RNA, 13 nt, Haemophilus influenzae Rd
guaauaaaucaaa

SEQ ID NO: 2690706 - RNA, 12 nt, Haemophilus influenzae Rd
guaauaaauccu

SEQ ID NO: 2690707 - RNA, 18 nt, Haemophilus influenzae Rd
guaauaaguauuuugcag

SEQ ID NO: 2690708 - RNA, 15 nt, Haemophilus influenzae Rd
guaauaaguuuucau

SEQ ID NO: 2690709 - RNA, 13 nt, Haemophilus influenzae Rd
guaauaauagguu

SEQ ID NO: 2690710 - RNA, 23 nt, Haemophilus influenzae Rd
guaauaaucaauuaaugggcuag

SEQ ID NO: 2690711 - RNA, 22 nt, Haemophilus influenzae Rd
guaauaauccugguauuuacaa

SEQ ID NO: 2690712 - RNA, 14 nt, Haemophilus influenzae Rd
guaauaaucuucuu

SEQ ID NO: 2690713 - RNA, 19 nt, Haemophilus influenzae Rd
guaauaaugaauauauuca

SEQ ID NO: 2690714 - RNA, 16 nt, Haemophilus influenzae Rd
guaauacaaaauaugc

SEQ ID NO: 2690715 - RNA, 18 nt, Haemophilus influenzae Rd
guaauacaccaauaauua

SEQ ID NO: 2690716 - RNA, 16 nt, Haemophilus influenzae Rd
guaauacuuuugcuuc

SEQ ID NO: 2690717 - RNA, 16 nt, Haemophilus influenzae Rd
guaauacuuuuuauuu

SEQ ID NO: 2690718 - RNA, 16 nt, Haemophilus influenzae Rd
guaauagcuucuuuua

SEQ ID NO: 2690719 - RNA, 13 nt, Haemophilus influenzae Rd
guaauauauucua

SEQ ID NO: 2690720 - RNA, 13 nt, Haemophilus influenzae Rd
guaauauguaaua

SEQ ID NO: 2690721 - RNA, 20 nt, Haemophilus influenzae Rd
guaauauuuaccgcuuucaa

SEQ ID NO: 2690722 - RNA, 22 nt, Haemophilus influenzae Rd
guaauauuuucccucuuuaucu

SEQ ID NO: 2690723 - RNA, 13 nt, Haemophilus influenzae Rd
guaaucaaauuca

SEQ ID NO: 2690724 - RNA, 13 nt, Haemophilus influenzae Rd
guaaucauuaagc

SEQ ID NO: 2690725 - RNA, 17 nt, Haemophilus influenzae Rd
guaaucguagaaaucaa

SEQ ID NO: 2690726 - RNA, 13 nt, Haemophilus influenzae Rd
guaaucuugugcu

SEQ ID NO: 2690727 - RNA, 19 nt, Haemophilus influenzae Rd
guaaucuuuacccauugcu

SEQ ID NO: 2690728 - RNA, 15 nt, Haemophilus influenzae Rd
guaaugcacuuucau

SEQ ID NO: 2690729 - RNA, 21 nt, Haemophilus influenzae Rd
guaaugcuucuguugcuucaa

SEQ ID NO: 2690730 - RNA, 17 nt, Haemophilus influenzae Rd
guaaugcuuuauuuaaa

SEQ ID NO: 2690731 - RNA, 16 nt, Haemophilus influenzae Rd
guaaugguuugcuggu

SEQ ID NO: 2690732 - RNA, 14 nt, Haemophilus influenzae Rd
guaauguaauaacg

SEQ ID NO: 2690733 - RNA, 15 nt, Haemophilus influenzae Rd
guaauguaauaacgu

SEQ ID NO: 2690734 - RNA, 23 nt, Haemophilus influenzae Rd
guaaugucuuuaggauuguugau

SEQ ID NO: 2690735 - RNA, 14 nt, Haemophilus influenzae Rd
guaauguuaucgac

SEQ ID NO: 2690736 - RNA, 12 nt, Haemophilus influenzae Rd
guaauuaaaaau

SEQ ID NO: 2690737 - RNA, 18 nt, Haemophilus influenzae Rd
guaauuaaaaauaaccgc

SEQ ID NO: 2690738 - RNA, 18 nt, Haemophilus influenzae Rd
guaauuaagguuucuucu

SEQ ID NO: 2690739 - RNA, 18 nt, Haemophilus influenzae Rd
guaauugagcguccacuu

SEQ ID NO: 2690740 - RNA, 21 nt, Haemophilus influenzae Rd
guaauugagcguccacuucuu

SEQ ID NO: 2690741 - RNA, 21 nt, Haemophilus influenzae Rd
guaauugcccaauaaaaguaa

SEQ ID NO: 2690742 - RNA, 12 nt, Haemophilus influenzae Rd
guaauuguugaa

SEQ ID NO: 2690743 - RNA, 16 nt, Haemophilus influenzae Rd
guaauuuaauuuauca

SEQ ID NO: 2690744 - RNA, 14 nt, Haemophilus influenzae Rd
guaauuuaucgcca

SEQ ID NO: 2690745 - RNA, 18 nt, Haemophilus influenzae Rd
guaauuucauaucuucuu

SEQ ID NO: 2690746 - RNA, 22 nt, Haemophilus influenzae Rd
guaauuucaucuuuuaaauaac

SEQ ID NO: 2690747 - RNA, 14 nt, Haemophilus influenzae Rd
guaauuucucacca

SEQ ID NO: 2690748 - RNA, 10 nt, Haemophilus influenzae Rd
guaauuugcg

SEQ ID NO: 2690749 - RNA, 22 nt, Haemophilus influenzae Rd
guaauuugcgucuuaaauuaga

SEQ ID NO: 2690750 - RNA, 18 nt, Haemophilus influenzae Rd
guaauuuggggcuaauuu

SEQ ID NO: 2690751 - RNA, 17 nt, Haemophilus influenzae Rd
guaauuuguuagaucaa

SEQ ID NO: 2690752 - RNA, 15 nt, Haemophilus influenzae Rd
guaauuuuaaaacca

SEQ ID NO: 2690753 - RNA, 13 nt, Haemophilus influenzae Rd
guaauuuuuucuc

SEQ ID NO: 2690754 - RNA, 14 nt, Haemophilus influenzae Rd
guacaacagcaaua

SEQ ID NO: 2690755 - RNA, 12 nt, Haemophilus influenzae Rd
guacaagugcua

SEQ ID NO: 2690756 - RNA, 20 nt, Haemophilus influenzae Rd
guacacggccguaaugaauu

SEQ ID NO: 2690757 - RNA, 13 nt, Haemophilus influenzae Rd
guacagaugccaa

SEQ ID NO: 2690758 - RNA, 15 nt, Haemophilus influenzae Rd
guacaucauuugcaa

SEQ ID NO: 2690759 - RNA, 22 nt, Haemophilus influenzae Rd
guacaucgaaaacauaauccgc

SEQ ID NO: 2690760 - RNA, 20 nt, Haemophilus influenzae Rd
guacaucuaaguauucauga

SEQ ID NO: 2690761 - RNA, 20 nt, Haemophilus influenzae Rd
guacauguugggcuaaaaau

SEQ ID NO: 2690762 - RNA, 19 nt, Haemophilus influenzae Rd
guaccaacggggcaaggcu

SEQ ID NO: 2690763 - RNA, 16 nt, Haemophilus influenzae Rd
guaccauugugccaaa

SEQ ID NO: 2690764 - RNA, 20 nt, Haemophilus influenzae Rd
guacccgugccuaauucacu

SEQ ID NO: 2690765 - RNA, 19 nt, Haemophilus influenzae Rd
guaccuuuaaauucuucga

SEQ ID NO: 2690766 - RNA, 23 nt, Haemophilus influenzae Rd
guaccuuuaauuaaagccacaua

SEQ ID NO: 2690767 - RNA, 12 nt, Haemophilus influenzae Rd
guacgagaaaaa

SEQ ID NO: 2690768 - RNA, 13 nt, Haemophilus influenzae Rd
guacgagaaaaau

SEQ ID NO: 2690769 - RNA, 17 nt, Haemophilus influenzae Rd
guacgauugcaauaauc

SEQ ID NO: 2690770 - RNA, 17 nt, Haemophilus influenzae Rd
guacgucuuuuggcguu

SEQ ID NO: 2690771 - RNA, 21 nt, Haemophilus influenzae Rd
guacuaauuguuguaaaauag

SEQ ID NO: 2690772 - RNA, 14 nt, Haemophilus influenzae Rd
guacucgaaaaggc

SEQ ID NO: 2690773 - RNA, 17 nt, Haemophilus influenzae Rd
guacucgaauuauuuua

SEQ ID NO: 2690774 - RNA, 17 nt, Haemophilus influenzae Rd
guacuguggauaauuca

SEQ ID NO: 2690775 - RNA, 15 nt, Haemophilus influenzae Rd
guagaaaacaauaaa

SEQ ID NO: 2690776 - RNA, 16 nt, Haemophilus influenzae Rd
guagaaaacaauaaaa

SEQ ID NO: 2690777 - RNA, 18 nt, Haemophilus influenzae Rd
guagaaaacaauaaaaaa

SEQ ID NO: 2690778 - RNA, 19 nt, Haemophilus influenzae Rd
guagagcagggauuuucau

SEQ ID NO: 2690779 - RNA, 22 nt, Haemophilus influenzae Rd
guagauaaaauauucaaacagg

SEQ ID NO: 2690780 - RNA, 21 nt, Haemophilus influenzae Rd
guagaucgacuccacuuugcu

SEQ ID NO: 2690781 - RNA, 12 nt, Haemophilus influenzae Rd
guagauuuucau

SEQ ID NO: 2690782 - RNA, 13 nt, Haemophilus influenzae Rd
guagcaauaacca

SEQ ID NO: 2690783 - RNA, 18 nt, Haemophilus influenzae Rd
guagcacauaaagacgcu

SEQ ID NO: 2690784 - RNA, 14 nt, Haemophilus influenzae Rd
guagcacuuuccau

SEQ ID NO: 2690785 - RNA, 22 nt, Haemophilus influenzae Rd
guagcaggagaaagcuugcuuu

SEQ ID NO: 2690786 - RNA, 13 nt, Haemophilus influenzae Rd
guagccaauuuug

SEQ ID NO: 2690787 - RNA, 13 nt, Haemophilus influenzae Rd
guagccauuuuca

SEQ ID NO: 2690788 - RNA, 17 nt, Haemophilus influenzae Rd
guagccuaguauuuuug

SEQ ID NO: 2690789 - RNA, 15 nt, Haemophilus influenzae Rd
guagcguaaaccuug

SEQ ID NO: 2690790 - RNA, 15 nt, Haemophilus influenzae Rd
guaggcauaaugccu

SEQ ID NO: 2690791 - RNA, 15 nt, Haemophilus influenzae Rd
guaguacaucauuug

SEQ ID NO: 2690792 - RNA, 15 nt, Haemophilus influenzae Rd
guccaaagaauaaua

SEQ ID NO: 2690793 - RNA, 14 nt, Haemophilus influenzae Rd
guccaauuucaucc

SEQ ID NO: 2690794 - RNA, 19 nt, Haemophilus influenzae Rd
guccacaagccauauuuua

SEQ ID NO: 2690795 - RNA, 12 nt, Haemophilus influenzae Rd
guccacagcaaa

SEQ ID NO: 2690796 - RNA, 13 nt, Haemophilus influenzae Rd
guccaccacuggg

SEQ ID NO: 2690797 - RNA, 18 nt, Haemophilus influenzae Rd
guccacuucuuccgcugu

SEQ ID NO: 2690798 - RNA, 17 nt, Haemophilus influenzae Rd
guccaugcguuuuauuu

SEQ ID NO: 2690799 - RNA, 20 nt, Haemophilus influenzae Rd
guccccauaucucugccauc

SEQ ID NO: 2690800 - RNA, 18 nt, Haemophilus influenzae Rd
gucccgcauauaaaauaa

SEQ ID NO: 2690801 - RNA, 21 nt, Haemophilus influenzae Rd
gucccgcuuuugccauauuua

SEQ ID NO: 2690802 - RNA, 21 nt, Haemophilus influenzae Rd
gucccugcccuugauauucaa

SEQ ID NO: 2690803 - RNA, 15 nt, Haemophilus influenzae Rd
guccgccauuuuuaa

SEQ ID NO: 2690804 - RNA, 24 nt, Haemophilus influenzae Rd
guccuucaaauucuuuauaaauaa

SEQ ID NO: 2690805 - RNA, 21 nt, Haemophilus influenzae Rd
guccuucauugauggaauaaa

SEQ ID NO: 2690806 - RNA, 11 nt, Haemophilus influenzae Rd
guccuugauuu

SEQ ID NO: 2690807 - RNA, 13 nt, Haemophilus influenzae Rd
gucgaaauuuuuc

SEQ ID NO: 2690808 - RNA, 15 nt, Haemophilus influenzae Rd
gucgaaucugaguau

SEQ ID NO: 2690809 - RNA, 18 nt, Haemophilus influenzae Rd
gucgagggucaaaagaaa

SEQ ID NO: 2690810 - RNA, 14 nt, Haemophilus influenzae Rd
gucgaguuuuucaa

SEQ ID NO: 2690811 - RNA, 15 nt, Haemophilus influenzae Rd
gucgauucaaauaac

SEQ ID NO: 2690812 - RNA, 20 nt, Haemophilus influenzae Rd
gucgcaccaccuuuauuaaa

SEQ ID NO: 2690813 - RNA, 19 nt, Haemophilus influenzae Rd
gucgcagccuuguucugca

SEQ ID NO: 2690814 - RNA, 20 nt, Haemophilus influenzae Rd
gucgcaucaacaacuaaaua

SEQ ID NO: 2690815 - RNA, 20 nt, Haemophilus influenzae Rd
gucgcuucuaauucugcacg

SEQ ID NO: 2690816 - RNA, 19 nt, Haemophilus influenzae Rd
gucgcuuucuuauauucaa

SEQ ID NO: 2690817 - RNA, 22 nt, Haemophilus influenzae Rd
gucgcuuuuuccucagcaaaag

SEQ ID NO: 2690818 - RNA, 14 nt, Haemophilus influenzae Rd
gucgguuuuuucau

SEQ ID NO: 2690819 - RNA, 13 nt, Haemophilus influenzae Rd
gucguuagcucag

SEQ ID NO: 2690820 - RNA, 13 nt, Haemophilus influenzae Rd
gucguuauucauc

SEQ ID NO: 2690821 - RNA, 13 nt, Haemophilus influenzae Rd
gucguuauuuuuu

SEQ ID NO: 2690822 - RNA, 20 nt, Haemophilus influenzae Rd
gucguuuugauuuaggcauu

SEQ ID NO: 2690823 - RNA, 16 nt, Haemophilus influenzae Rd
gucuaaaugugcccag

SEQ ID NO: 2690824 - RNA, 16 nt, Haemophilus influenzae Rd
gucuaagguuuccaua

SEQ ID NO: 2690825 - RNA, 18 nt, Haemophilus influenzae Rd
gucuaagguuuccauaau

SEQ ID NO: 2690826 - RNA, 19 nt, Haemophilus influenzae Rd
gucuaagguuuccauaaug

SEQ ID NO: 2690827 - RNA, 18 nt, Haemophilus influenzae Rd
gucuaaugccgccuuauc

SEQ ID NO: 2690828 - RNA, 18 nt, Haemophilus influenzae Rd
gucuaauuuuuuauucaa

SEQ ID NO: 2690829 - RNA, 15 nt, Haemophilus influenzae Rd
gucuacaagaaacca

SEQ ID NO: 2690830 - RNA, 12 nt, Haemophilus influenzae Rd
gucuauuauaaa

SEQ ID NO: 2690831 - RNA, 15 nt, Haemophilus influenzae Rd
gucuauuauaaauuu

SEQ ID NO: 2690832 - RNA, 13 nt, Haemophilus influenzae Rd
gucucaaauuuuu

SEQ ID NO: 2690833 - RNA, 18 nt, Haemophilus influenzae Rd
gucucaaauuuuucacag

SEQ ID NO: 2690834 - RNA, 17 nt, Haemophilus influenzae Rd
gucucaguaacgauguu

SEQ ID NO: 2690835 - RNA, 14 nt, Haemophilus influenzae Rd
gucucgcccagagc

SEQ ID NO: 2690836 - RNA, 15 nt, Haemophilus influenzae Rd
gucucgguuugcuuu

SEQ ID NO: 2690837 - RNA, 14 nt, Haemophilus influenzae Rd
gucucgucaggcaa

SEQ ID NO: 2690838 - RNA, 17 nt, Haemophilus influenzae Rd
gucugcaauaauaucug

SEQ ID NO: 2690839 - RNA, 16 nt, Haemophilus influenzae Rd
gucugcacgaauaauu

SEQ ID NO: 2690840 - RNA, 20 nt, Haemophilus influenzae Rd
gucugcacgaauaauuaaau

SEQ ID NO: 2690841 - RNA, 18 nt, Haemophilus influenzae Rd
gucugcgccuaaaauauu

SEQ ID NO: 2690842 - RNA, 17 nt, Haemophilus influenzae Rd
gucugcuaaugcccaag

SEQ ID NO: 2690843 - RNA, 20 nt, Haemophilus influenzae Rd
gucugcugaaauacaaagca

SEQ ID NO: 2690844 - RNA, 17 nt, Haemophilus influenzae Rd
gucuguugcaaauuuuu

SEQ ID NO: 2690845 - RNA, 19 nt, Haemophilus influenzae Rd
gucuguugcaaauuuuuca

SEQ ID NO: 2690846 - RNA, 21 nt, Haemophilus influenzae Rd
gucuguugcaaauuuuucauu

SEQ ID NO: 2690847 - RNA, 12 nt, Haemophilus influenzae Rd
gucuguuucuuc

SEQ ID NO: 2690848 - RNA, 13 nt, Haemophilus influenzae Rd
gucuuaauuuuuu

SEQ ID NO: 2690849 - RNA, 23 nt, Haemophilus influenzae Rd
gucuugaaaaccggcgaggguuu

SEQ ID NO: 2690850 - RNA, 14 nt, Haemophilus influenzae Rd
gucuugcuuuuuaa

SEQ ID NO: 2690851 - RNA, 14 nt, Haemophilus influenzae Rd
gucuuuaaauagau

SEQ ID NO: 2690852 - RNA, 20 nt, Haemophilus influenzae Rd
gucuuuuaacacauaagcac

SEQ ID NO: 2690853 - RNA, 19 nt, Haemophilus influenzae Rd
gucuuuuuaauuuaaauaa

SEQ ID NO: 2690854 - RNA, 14 nt, Haemophilus influenzae Rd
gucuuuuuuuguug

SEQ ID NO: 2690855 - RNA, 19 nt, Haemophilus influenzae Rd
gugaaaaaauaaccacuag

SEQ ID NO: 2690856 - RNA, 18 nt, Haemophilus influenzae Rd
gugaaaacuacuuuccaa

SEQ ID NO: 2690857 - RNA, 23 nt, Haemophilus influenzae Rd
gugaaaaucuguugaaucucagc

SEQ ID NO: 2690858 - RNA, 23 nt, Haemophilus influenzae Rd
gugaaagaagauuuauauaccuu

SEQ ID NO: 2690859 - RNA, 17 nt, Haemophilus influenzae Rd
gugaacuuucaauaauc

SEQ ID NO: 2690860 - RNA, 20 nt, Haemophilus influenzae Rd
gugaagugauucguaguaag

SEQ ID NO: 2690861 - RNA, 23 nt, Haemophilus influenzae Rd
gugaaguuuuuuaaguuuccaag

SEQ ID NO: 2690862 - RNA, 15 nt, Haemophilus influenzae Rd
gugaauauaagaaau

SEQ ID NO: 2690863 - RNA, 16 nt, Haemophilus influenzae Rd
gugaaugacuuucacu

SEQ ID NO: 2690864 - RNA, 17 nt, Haemophilus influenzae Rd
gugaaugaugccauuuu

SEQ ID NO: 2690865 - RNA, 12 nt, Haemophilus influenzae Rd
gugaauuuauca

SEQ ID NO: 2690866 - RNA, 14 nt, Haemophilus influenzae Rd
gugaauuuaucauc

SEQ ID NO: 2690867 - RNA, 23 nt, Haemophilus influenzae Rd
gugaccacggauaaaugcgugaa

SEQ ID NO: 2690868 - RNA, 22 nt, Haemophilus influenzae Rd
gugacuuuaguuggaucuaaga

SEQ ID NO: 2690869 - RNA, 18 nt, Haemophilus influenzae Rd
gugagcuaagcauuucag

SEQ ID NO: 2690870 - RNA, 19 nt, Haemophilus influenzae Rd
gugagcuaagcauuucagu

SEQ ID NO: 2690871 - RNA, 22 nt, Haemophilus influenzae Rd
gugagcuuguuggaaaaaugcu

SEQ ID NO: 2690872 - RNA, 21 nt, Haemophilus influenzae Rd
gugaguaaaauacgaauaaac

SEQ ID NO: 2690873 - RNA, 14 nt, Haemophilus influenzae Rd
gugagucuugcuuu

SEQ ID NO: 2690874 - RNA, 15 nt, Haemophilus influenzae Rd
gugaguugauuuaaa

SEQ ID NO: 2690875 - RNA, 20 nt, Haemophilus influenzae Rd
gugauaauuaaggucuuaca

SEQ ID NO: 2690876 - RNA, 14 nt, Haemophilus influenzae Rd
gugauauuaaacag

SEQ ID NO: 2690877 - RNA, 16 nt, Haemophilus influenzae Rd
gugauauuucacuaaa

SEQ ID NO: 2690878 - RNA, 14 nt, Haemophilus influenzae Rd
gugaugaaacaauc

SEQ ID NO: 2690879 - RNA, 18 nt, Haemophilus influenzae Rd
gugaugaguucugucacu

SEQ ID NO: 2690880 - RNA, 16 nt, Haemophilus influenzae Rd
gugaugggaaacugaa

SEQ ID NO: 2690881 - RNA, 18 nt, Haemophilus influenzae Rd
gugauguaaauuuucagc

SEQ ID NO: 2690882 - RNA, 22 nt, Haemophilus influenzae Rd
gugauugugguauugauucaau

SEQ ID NO: 2690883 - RNA, 13 nt, Haemophilus influenzae Rd
gugauuucaauuc

SEQ ID NO: 2690884 - RNA, 17 nt, Haemophilus influenzae Rd
gugauuucgcugcgaug

SEQ ID NO: 2690885 - RNA, 16 nt, Haemophilus influenzae Rd
gugauuuuagaaaaau

SEQ ID NO: 2690886 - RNA, 17 nt, Haemophilus influenzae Rd
gugauuuuaguuucuaa

SEQ ID NO: 2690887 - RNA, 15 nt, Haemophilus influenzae Rd
gugauuuuuuuauuu

SEQ ID NO: 2690888 - RNA, 19 nt, Haemophilus influenzae Rd
gugcaaaacuagucauauu

SEQ ID NO: 2690889 - RNA, 19 nt, Haemophilus influenzae Rd
gugcaaaguuaccauuuau

SEQ ID NO: 2690890 - RNA, 16 nt, Haemophilus influenzae Rd
gugcaacgugugccag

SEQ ID NO: 2690891 - RNA, 17 nt, Haemophilus influenzae Rd
gugcaacuaugguaaaa

SEQ ID NO: 2690892 - RNA, 11 nt, Haemophilus influenzae Rd
gugcaacugcu

SEQ ID NO: 2690893 - RNA, 20 nt, Haemophilus influenzae Rd
gugcaauaacaagcacaaga

SEQ ID NO: 2690894 - RNA, 20 nt, Haemophilus influenzae Rd
gugcaaucagcaacauuauu

SEQ ID NO: 2690895 - RNA, 13 nt, Haemophilus influenzae Rd
gugcaauuugaaa

SEQ ID NO: 2690896 - RNA, 16 nt, Haemophilus influenzae Rd
gugcaauuugaucuuc

SEQ ID NO: 2690897 - RNA, 18 nt, Haemophilus influenzae Rd
gugcagaauuuggaucuu

SEQ ID NO: 2690898 - RNA, 18 nt, Haemophilus influenzae Rd
guuaauuuuaaauuuucu

SEQ ID NO: 2690899 - RNA, 12 nt, Haemophilus influenzae Rd
guuaauuuucac

SEQ ID NO: 2690900 - RNA, 16 nt, Haemophilus influenzae Rd
guuacaaacaaucuua

SEQ ID NO: 2690901 - RNA, 19 nt, Haemophilus influenzae Rd
guuacaaacaaucuuaacu

SEQ ID NO: 2690902 - RNA, 19 nt, Haemophilus influenzae Rd
guuacaucauccuuaccuu

SEQ ID NO: 2690903 - RNA, 22 nt, Haemophilus influenzae Rd
guuacaucauccuuaccuucca

SEQ ID NO: 2690904 - RNA, 21 nt, Haemophilus influenzae Rd
guuaccaauaacuaaaaauac

SEQ ID NO: 2690905 - RNA, 19 nt, Haemophilus influenzae Rd
guuaccgacaaccauauua

SEQ ID NO: 2690906 - RNA, 15 nt, Haemophilus influenzae Rd
guuaccuuuuccaau

SEQ ID NO: 2690907 - RNA, 20 nt, Haemophilus influenzae Rd
guuacgaauugcaauaacca

SEQ ID NO: 2690908 - RNA, 21 nt, Haemophilus influenzae Rd
guuacgaauugcaauaaccac

SEQ ID NO: 2690909 - RNA, 13 nt, Haemophilus influenzae Rd
guuacggcuaaau

SEQ ID NO: 2690910 - RNA, 14 nt, Haemophilus influenzae Rd
guuacguuucacua

SEQ ID NO: 2690911 - RNA, 15 nt, Haemophilus influenzae Rd
guuacuuauuuagca

SEQ ID NO: 2690912 - RNA, 17 nt, Haemophilus influenzae Rd
guuagcggauaaaauaa

SEQ ID NO: 2690913 - RNA, 21 nt, Haemophilus influenzae Rd
guuauaaaagaagaaugcggu

SEQ ID NO: 2690914 - RNA, 19 nt, Haemophilus influenzae Rd
guuauaaacccaucauaaa

SEQ ID NO: 2690915 - RNA, 18 nt, Haemophilus influenzae Rd
guuauaaauaaaaaaccg

SEQ ID NO: 2690916 - RNA, 16 nt, Haemophilus influenzae Rd
guuauaacguuuaaaa

SEQ ID NO: 2690917 - RNA, 19 nt, Haemophilus influenzae Rd
guuauaaguuuuuugccaa

SEQ ID NO: 2690918 - RNA, 20 nt, Haemophilus influenzae Rd
guuauaaguuuuuugccaaa

SEQ ID NO: 2690919 - RNA, 13 nt, Haemophilus influenzae Rd
guuauaauaacca

SEQ ID NO: 2690920 - RNA, 19 nt, Haemophilus influenzae Rd
guuauaccacauaaaugug

SEQ ID NO: 2690921 - RNA, 21 nt, Haemophilus influenzae Rd
guuauauaaacaauuccccuu

SEQ ID NO: 2690922 - RNA, 19 nt, Haemophilus influenzae Rd
guuauauucagcaaaauca

SEQ ID NO: 2690923 - RNA, 19 nt, Haemophilus influenzae Rd
guuaucaucuguaaaccau

SEQ ID NO: 2690924 - RNA, 15 nt, Haemophilus influenzae Rd
guuauccaucaagaa

SEQ ID NO: 2690925 - RNA, 18 nt, Haemophilus influenzae Rd
guuauccauccagaaaau

SEQ ID NO: 2690926 - RNA, 15 nt, Haemophilus influenzae Rd
guuaucgacuuccac

SEQ ID NO: 2690927 - RNA, 17 nt, Haemophilus influenzae Rd
guuaucgacuuuuucac

SEQ ID NO: 2690928 - RNA, 14 nt, Haemophilus influenzae Rd
guuaucgccaauaa

SEQ ID NO: 2690929 - RNA, 14 nt, Haemophilus influenzae Rd
guuaucuguauaaa

SEQ ID NO: 2690930 - RNA, 16 nt, Haemophilus influenzae Rd
guuaugaaauugcugu

SEQ ID NO: 2690931 - RNA, 17 nt, Haemophilus influenzae Rd
guuaugaaauugcugua

SEQ ID NO: 2690932 - RNA, 14 nt, Haemophilus influenzae Rd
guuaugaagcccua

SEQ ID NO: 2690933 - RNA, 17 nt, Haemophilus influenzae Rd
guuaugagccaagaaug

SEQ ID NO: 2690934 - RNA, 11 nt, Haemophilus influenzae Rd
guuauguugcc

SEQ ID NO: 2690935 - RNA, 17 nt, Haemophilus influenzae Rd
guuauuaaauaaaccgc

SEQ ID NO: 2690936 - RNA, 15 nt, Haemophilus influenzae Rd
guuauuacuucacca

SEQ ID NO: 2690937 - RNA, 17 nt, Haemophilus influenzae Rd
guuauugauaaaaauau

SEQ ID NO: 2690938 - RNA, 12 nt, Haemophilus influenzae Rd
guuauugccuaa

SEQ ID NO: 2690939 - RNA, 23 nt, Haemophilus influenzae Rd
guuauugucugcuccaaauaauc

SEQ ID NO: 2690940 - RNA, 14 nt, Haemophilus influenzae Rd
guuauuucuugcca

SEQ ID NO: 2690941 - RNA, 22 nt, Haemophilus influenzae Rd
guuauuugagcaagaugaauua

SEQ ID NO: 2690942 - RNA, 12 nt, Haemophilus influenzae Rd
guuauuugcaaa

SEQ ID NO: 2690943 - RNA, 19 nt, Haemophilus influenzae Rd
guucaaaaauuucgcuauu

SEQ ID NO: 2690944 - RNA, 13 nt, Haemophilus influenzae Rd
guucaaacaucac

SEQ ID NO: 2690945 - RNA, 16 nt, Haemophilus influenzae Rd
guucaaacaucacgcc

SEQ ID NO: 2690946 - RNA, 11 nt, Haemophilus influenzae Rd
guucaaauaag

SEQ ID NO: 2690947 - RNA, 12 nt, Haemophilus influenzae Rd
guucaaauaagc

SEQ ID NO: 2690948 - RNA, 13 nt, Haemophilus influenzae Rd
guucaaauaagcg

SEQ ID NO: 2690949 - RNA, 22 nt, Haemophilus influenzae Rd
guucaaaugaaagaagaaaaag

SEQ ID NO: 2690950 - RNA, 13 nt, Haemophilus influenzae Rd
guucaaauuucuu

SEQ ID NO: 2690951 - RNA, 21 nt, Haemophilus influenzae Rd
guucaaauuucuucacugugc

SEQ ID NO: 2690952 - RNA, 14 nt, Haemophilus influenzae Rd
guucaacaaguaaa

SEQ ID NO: 2690953 - RNA, 19 nt, Haemophilus influenzae Rd
guucaaccacuucagcaga

SEQ ID NO: 2690954 - RNA, 17 nt, Haemophilus influenzae Rd
guucaacccauuuucca

SEQ ID NO: 2690955 - RNA, 22 nt, Haemophilus influenzae Rd
guucaacccauuuuccauuggu

SEQ ID NO: 2690956 - RNA, 16 nt, Haemophilus influenzae Rd
guucaagcaacguaaa

SEQ ID NO: 2690957 - RNA, 20 nt, Haemophilus influenzae Rd
guucaaggacugaguucugu

SEQ ID NO: 2690958 - RNA, 15 nt, Haemophilus influenzae Rd
guucaauaaaaauau

SEQ ID NO: 2690959 - RNA, 17 nt, Haemophilus influenzae Rd
guucaauaauauuaucc

SEQ ID NO: 2690960 - RNA, 12 nt, Haemophilus influenzae Rd
guucaauaaugu

SEQ ID NO: 2690961 - RNA, 14 nt, Haemophilus influenzae Rd
guucaauaugcaaa

SEQ ID NO: 2690962 - RNA, 18 nt, Haemophilus influenzae Rd
guucaauuuuaauugguu

SEQ ID NO: 2690963 - RNA, 16 nt, Haemophilus influenzae Rd
guucacagagaauaaa

SEQ ID NO: 2690964 - RNA, 19 nt, Haemophilus influenzae Rd
guucacagagaauaaauca

SEQ ID NO: 2690965 - RNA, 20 nt, Haemophilus influenzae Rd
guucaccgggcgauaaaauc

SEQ ID NO: 2690966 - RNA, 22 nt, Haemophilus influenzae Rd
guucacggcgggugucgugaaa

SEQ ID NO: 2690967 - RNA, 15 nt, Haemophilus influenzae Rd
guucacguaaguagu

SEQ ID NO: 2690968 - RNA, 15 nt, Haemophilus influenzae Rd
guucagaaagagacu

SEQ ID NO: 2690969 - RNA, 17 nt, Haemophilus influenzae Rd
guucagauuucuucgcc

SEQ ID NO: 2690970 - RNA, 15 nt, Haemophilus influenzae Rd
guucagcaacaucau

SEQ ID NO: 2690971 - RNA, 12 nt, Haemophilus influenzae Rd
guucagccacuu

SEQ ID NO: 2690972 - RNA, 15 nt, Haemophilus influenzae Rd
guucagcgauuuuaa

SEQ ID NO: 2690973 - RNA, 21 nt, Haemophilus influenzae Rd
guucaucgccgugauaauauc

SEQ ID NO: 2690974 - RNA, 16 nt, Haemophilus influenzae Rd
guucaucgugagcaua

SEQ ID NO: 2690975 - RNA, 12 nt, Haemophilus influenzae Rd
guucauuauuaa

SEQ ID NO: 2690976 - RNA, 18 nt, Haemophilus influenzae Rd
guucauucgguacgccau

SEQ ID NO: 2690977 - RNA, 12 nt, Haemophilus influenzae Rd
guucauuuguug

SEQ ID NO: 2690978 - RNA, 23 nt, Haemophilus influenzae Rd
guuccaauaggaaacuacuuucu

SEQ ID NO: 2690979 - RNA, 17 nt, Haemophilus influenzae Rd
guuccaccuugaauaau

SEQ ID NO: 2690980 - RNA, 15 nt, Haemophilus influenzae Rd
guuccacgagaaaag

SEQ ID NO: 2690981 - RNA, 15 nt, Haemophilus influenzae Rd
guuccccuaaaaaau

SEQ ID NO: 2690982 - RNA, 17 nt, Haemophilus influenzae Rd
guuccguucuaaagauu

SEQ ID NO: 2690983 - RNA, 20 nt, Haemophilus influenzae Rd
guucgagaaacuuucaaaau

SEQ ID NO: 2690984 - RNA, 20 nt, Haemophilus influenzae Rd
guucgauaacaauuuuugca

SEQ ID NO: 2690985 - RNA, 15 nt, Haemophilus influenzae Rd
guucgauuucaucuu

SEQ ID NO: 2690986 - RNA, 13 nt, Haemophilus influenzae Rd
guucgcaaauaac

SEQ ID NO: 2690987 - RNA, 16 nt, Haemophilus influenzae Rd
guucgguuaaagaagc

SEQ ID NO: 2690988 - RNA, 13 nt, Haemophilus influenzae Rd
guucguuuaaauu

SEQ ID NO: 2690989 - RNA, 17 nt, Haemophilus influenzae Rd
guucuaaaauuauagaa

SEQ ID NO: 2690990 - RNA, 20 nt, Haemophilus influenzae Rd
guucuaaagcacguuucauc

SEQ ID NO: 2690991 - RNA, 13 nt, Haemophilus influenzae Rd
guucuaaauaaac

SEQ ID NO: 2690992 - RNA, 13 nt, Haemophilus influenzae Rd
guucuaauugcug

SEQ ID NO: 2690993 - RNA, 17 nt, Haemophilus influenzae Rd
guucuacaccuucccaa

SEQ ID NO: 2690994 - RNA, 14 nt, Haemophilus influenzae Rd
guucuacguaauuu

SEQ ID NO: 2690995 - RNA, 17 nt, Haemophilus influenzae Rd
guucuacuuguucaaaa

SEQ ID NO: 2690996 - RNA, 11 nt, Haemophilus influenzae Rd
guucuacuuuu

SEQ ID NO: 2690997 - RNA, 14 nt, Haemophilus influenzae Rd
guucuacuuuuuuu

SEQ ID NO: 2690998 - RNA, 14 nt, Haemophilus influenzae Rd
guucuaguuuuucc

SEQ ID NO: 2690999 - RNA, 19 nt, Haemophilus influenzae Rd
guucuauauuuugaauaau

SEQ ID NO: 2691000 - RNA, 16 nt, Haemophilus influenzae Rd
guucugacacuucccc

SEQ ID NO: 2691001 - RNA, 15 nt, Haemophilus influenzae Rd
guucugcaguuucug

SEQ ID NO: 2691002 - RNA, 12 nt, Haemophilus influenzae Rd
guucuucaaauu

SEQ ID NO: 2691003 - RNA, 19 nt, Haemophilus influenzae Rd
guucuuccgucaauauccc

SEQ ID NO: 2691004 - RNA, 21 nt, Haemophilus influenzae Rd
guucuuccgucaauaucccaa

SEQ ID NO: 2691005 - RNA, 22 nt, Haemophilus influenzae Rd
guuuccuucgccauuuuuaacc

SEQ ID NO: 2691006 - RNA, 19 nt, Haemophilus influenzae Rd
guuucgagcgugaagauau

SEQ ID NO: 2691007 - RNA, 21 nt, Haemophilus influenzae Rd
guuucgauaaaaaagccacca

SEQ ID NO: 2691008 - RNA, 15 nt, Haemophilus influenzae Rd
guuucgauauuaaua

SEQ ID NO: 2691009 - RNA, 15 nt, Haemophilus influenzae Rd
guuucuaaaauaaac

SEQ ID NO: 2691010 - RNA, 19 nt, Haemophilus influenzae Rd
guuucuaaacguuuuugaa

SEQ ID NO: 2691011 - RNA, 15 nt, Haemophilus influenzae Rd
guuucuaaaugaaua

SEQ ID NO: 2691012 - RNA, 17 nt, Haemophilus influenzae Rd
guuucuaaaugaauaaa

SEQ ID NO: 2691013 - RNA, 19 nt, Haemophilus influenzae Rd
guuucuaaaugaauaaaac

SEQ ID NO: 2691014 - RNA, 15 nt, Haemophilus influenzae Rd
guuucuaauucuucc

SEQ ID NO: 2691015 - RNA, 16 nt, Haemophilus influenzae Rd
guuucuaauucuucca

SEQ ID NO: 2691016 - RNA, 19 nt, Haemophilus influenzae Rd
guuucuacucguagaguuu

SEQ ID NO: 2691017 - RNA, 16 nt, Haemophilus influenzae Rd
guuucugguuccauua

SEQ ID NO: 2691018 - RNA, 14 nt, Haemophilus influenzae Rd
guuucuugcccaau

SEQ ID NO: 2691019 - RNA, 14 nt, Haemophilus influenzae Rd
guuucuugggauuu

SEQ ID NO: 2691020 - RNA, 12 nt, Haemophilus influenzae Rd
guuucuuuaaau

SEQ ID NO: 2691021 - RNA, 20 nt, Haemophilus influenzae Rd
guuucuuuuaucgagaaaau

SEQ ID NO: 2691022 - RNA, 15 nt, Haemophilus influenzae Rd
guuucuuuucaucuu

SEQ ID NO: 2691023 - RNA, 14 nt, Haemophilus influenzae Rd
guuugaaaagaaau

SEQ ID NO: 2691024 - RNA, 17 nt, Haemophilus influenzae Rd
guuugaacaaauucagc

SEQ ID NO: 2691025 - RNA, 21 nt, Haemophilus influenzae Rd
guuugacagcaauauauaaau

SEQ ID NO: 2691026 - RNA, 13 nt, Haemophilus influenzae Rd
guuugacauucag

SEQ ID NO: 2691027 - RNA, 20 nt, Haemophilus influenzae Rd
guuugaggaucacacaaaau

SEQ ID NO: 2691028 - RNA, 17 nt, Haemophilus influenzae Rd
guuugauaacuuuaagu

SEQ ID NO: 2691029 - RNA, 23 nt, Haemophilus influenzae Rd
guuugauccacaaauaauaaucu

SEQ ID NO: 2691030 - RNA, 14 nt, Haemophilus influenzae Rd
guuugaucgguuuu

SEQ ID NO: 2691031 - RNA, 22 nt, Haemophilus influenzae Rd
guuugauuuauacgugaaccaa

SEQ ID NO: 2691032 - RNA, 23 nt, Haemophilus influenzae Rd
guuugccaucuaaaaaacccgcu

SEQ ID NO: 2691033 - RNA, 16 nt, Haemophilus influenzae Rd
guuugccgaagccuaa

SEQ ID NO: 2691034 - RNA, 21 nt, Haemophilus influenzae Rd
guuugccguaauaacauuccg

SEQ ID NO: 2691035 - RNA, 14 nt, Haemophilus influenzae Rd
guuugcuaauuuau

SEQ ID NO: 2691036 - RNA, 14 nt, Haemophilus influenzae Rd
guuugcuaccuuca

SEQ ID NO: 2691037 - RNA, 19 nt, Haemophilus influenzae Rd
guuugcuaccuucaaccac

SEQ ID NO: 2691038 - RNA, 15 nt, Haemophilus influenzae Rd
guuuggagauaaaua

SEQ ID NO: 2691039 - RNA, 17 nt, Haemophilus influenzae Rd
guuuggagauaaauaaa

SEQ ID NO: 2691040 - RNA, 16 nt, Haemophilus influenzae Rd
guuuggcaauggcuga

SEQ ID NO: 2691041 - RNA, 22 nt, Haemophilus influenzae Rd
guuuggcuaauugugcauuguu

SEQ ID NO: 2691042 - RNA, 16 nt, Haemophilus influenzae Rd
guuuguaaacgccauc

SEQ ID NO: 2691043 - RNA, 13 nt, Haemophilus influenzae Rd
guuuguaauaaau

SEQ ID NO: 2691044 - RNA, 20 nt, Haemophilus influenzae Rd
guuuguaauccugcauuuuc

SEQ ID NO: 2691045 - RNA, 14 nt, Haemophilus influenzae Rd
guuuguauaagcca

SEQ ID NO: 2691046 - RNA, 14 nt, Haemophilus influenzae Rd
guuuguauuugagc

SEQ ID NO: 2691047 - RNA, 17 nt, Haemophilus influenzae Rd
guuuguuaaaugaaaag

SEQ ID NO: 2691048 - RNA, 15 nt, Haemophilus influenzae Rd
guuuguuaugaaauu

SEQ ID NO: 2691049 - RNA, 19 nt, Haemophilus influenzae Rd
guuuguuaugaaauugcug

SEQ ID NO: 2691050 - RNA, 16 nt, Haemophilus influenzae Rd
guuuguuccaauucug

SEQ ID NO: 2691051 - RNA, 17 nt, Haemophilus influenzae Rd
guuuguuucucaaguuu

SEQ ID NO: 2691052 - RNA, 15 nt, Haemophilus influenzae Rd
guuuguuugcugcac

SEQ ID NO: 2691053 - RNA, 13 nt, Haemophilus influenzae Rd
guuuuaaaaucuc

SEQ ID NO: 2691054 - RNA, 10 nt, Haemophilus influenzae Rd
guuuuaaccg

SEQ ID NO: 2691055 - RNA, 18 nt, Haemophilus influenzae Rd
guuuuaaccgcuccuuua

SEQ ID NO: 2691056 - RNA, 14 nt, Haemophilus influenzae Rd
guuuuaagguuuuu

SEQ ID NO: 2691057 - RNA, 20 nt, Haemophilus influenzae Rd
guuuuaagucuaguaacugu

SEQ ID NO: 2691058 - RNA, 17 nt, Haemophilus influenzae Rd
guuuuaaguucaacacc

SEQ ID NO: 2691059 - RNA, 20 nt, Haemophilus influenzae Rd
guuuuaaguucaacaccuaa

SEQ ID NO: 2691060 - RNA, 23 nt, Haemophilus influenzae Rd
guuuuaauccuuccaaauccauc

SEQ ID NO: 2691061 - RNA, 12 nt, Haemophilus influenzae Rd
guuuuaauuuug

SEQ ID NO: 2691062 - RNA, 16 nt, Haemophilus influenzae Rd
guuuuacauauaaaga

SEQ ID NO: 2691063 - RNA, 17 nt, Haemophilus influenzae Rd
guuuuaccuucaguuuu

SEQ ID NO: 2691064 - RNA, 22 nt, Haemophilus influenzae Rd
guuuuacgccauucuuuauucg

SEQ ID NO: 2691065 - RNA, 19 nt, Haemophilus influenzae Rd
guuuuacugauucuucgcc

SEQ ID NO: 2691066 - RNA, 15 nt, Haemophilus influenzae Rd
guuuuacuucauccc

SEQ ID NO: 2691067 - RNA, 13 nt, Haemophilus influenzae Rd
guuuuauaagcaa

SEQ ID NO: 2691068 - RNA, 20 nt, Haemophilus influenzae Rd
guuuuauacaguuagaacaa

SEQ ID NO: 2691069 - RNA, 14 nt, Haemophilus influenzae Rd
guuuuauauucauu

SEQ ID NO: 2691070 - RNA, 22 nt, Haemophilus influenzae Rd
guuuuauauucauuuaaaacaa

SEQ ID NO: 2691071 - RNA, 21 nt, Haemophilus influenzae Rd
guuuuaucagaaugauuaucu

SEQ ID NO: 2691072 - RNA, 20 nt, Haemophilus influenzae Rd
guuuuaucgagauuucuuug

SEQ ID NO: 2691073 - RNA, 13 nt, Haemophilus influenzae Rd
guuuuaugcuaaa

SEQ ID NO: 2691074 - RNA, 13 nt, Haemophilus influenzae Rd
guuuuauuuauca

SEQ ID NO: 2691075 - RNA, 22 nt, Haemophilus influenzae Rd
guuuuauuugagaaaaauguua

SEQ ID NO: 2691076 - RNA, 18 nt, Haemophilus influenzae Rd
guuuuauuuucaaauuca

SEQ ID NO: 2691077 - RNA, 19 nt, Haemophilus influenzae Rd
guuuucaauaucaaagaaa

SEQ ID NO: 2691078 - RNA, 21 nt, Haemophilus influenzae Rd
guuuucaauuuuaaaauuugu

SEQ ID NO: 2691079 - RNA, 12 nt, Haemophilus influenzae Rd
guuuucacaauc

SEQ ID NO: 2691080 - RNA, 20 nt, Haemophilus influenzae Rd
guuuucaucuaagugaauga

SEQ ID NO: 2691081 - RNA, 14 nt, Haemophilus influenzae Rd
guuuuccaaaaacc

SEQ ID NO: 2691082 - RNA, 19 nt, Haemophilus influenzae Rd
guuuuccguuaaaaguuuu

SEQ ID NO: 2691083 - RNA, 17 nt, Haemophilus influenzae Rd
guuuuccuuucuuuccg

SEQ ID NO: 2691084 - RNA, 22 nt, Haemophilus influenzae Rd
guuuucgauuuaacacuuuuuc

SEQ ID NO: 2691085 - RNA, 20 nt, Haemophilus influenzae Rd
guuuucgcaauaucaucauc

SEQ ID NO: 2691086 - RNA, 15 nt, Haemophilus influenzae Rd
guuuucgucacaaug

SEQ ID NO: 2691087 - RNA, 17 nt, Haemophilus influenzae Rd
guuuucuacugaaccau

SEQ ID NO: 2691088 - RNA, 17 nt, Haemophilus influenzae Rd
guuuucugaacuaaaau

SEQ ID NO: 2691089 - RNA, 20 nt, Haemophilus influenzae Rd
guuuucugauuuaaaaccgu

SEQ ID NO: 2691090 - RNA, 19 nt, Haemophilus influenzae Rd
guuuucugguacaaauuua

SEQ ID NO: 2691091 - RNA, 14 nt, Haemophilus influenzae Rd
guuuucuuuugccc

SEQ ID NO: 2691092 - RNA, 17 nt, Haemophilus influenzae Rd
guuuucuuuugcccuua

SEQ ID NO: 2691093 - RNA, 21 nt, Haemophilus influenzae Rd
guuuugauaaccuaucaucug

SEQ ID NO: 2691094 - RNA, 23 nt, Haemophilus influenzae Rd
guuuugccgcaaacaucaucacc

SEQ ID NO: 2691095 - RNA, 21 nt, Haemophilus influenzae Rd
guuuugcgccuucaagccuug

SEQ ID NO: 2691096 - RNA, 14 nt, Haemophilus influenzae Rd
guuuuggcauuuuc

SEQ ID NO: 2691097 - RNA, 21 nt, Haemophilus influenzae Rd
guuuuggcauuuucaaucccu

SEQ ID NO: 2691098 - RNA, 18 nt, Haemophilus influenzae Rd
guuuugucugaaauuuuu

SEQ ID NO: 2691099 - RNA, 18 nt, Haemophilus influenzae Rd
guuuugugaguaaaauac

SEQ ID NO: 2691100 - RNA, 15 nt, Haemophilus influenzae Rd
guuuuguucauccuu

SEQ ID NO: 2691101 - RNA, 15 nt, Haemophilus influenzae Rd
guuuuguucaucuaa

SEQ ID NO: 2691102 - RNA, 16 nt, Haemophilus influenzae Rd
guuuuguucaucuaac

SEQ ID NO: 2691103 - RNA, 18 nt, Haemophilus influenzae Rd
guuuuguucaucuaacac

SEQ ID NO: 2691104 - RNA, 16 nt, Haemophilus influenzae Rd
guuuuuaaucguccaa

SEQ ID NO: 2691105 - RNA, 11 nt, Haemophilus influenzae Rd
guuuuuauuau

SEQ ID NO: 2691106 - RNA, 20 nt, Haemophilus influenzae Rd
guuuuucaaaaauuuuugca

SEQ ID NO: 2691107 - RNA, 18 nt, Haemophilus influenzae Rd
guuuuucacccaucuaaa

SEQ ID NO: 2691108 - RNA, 23 nt, Haemophilus influenzae Rd
guuuuucacccaucuaaacuuau

SEQ ID NO: 2691109 - RNA, 22 nt, Haemophilus influenzae Rd
guuuuucacgauauugcacaau

SEQ ID NO: 2691110 - RNA, 23 nt, Haemophilus influenzae Rd
uaaaacuaauuugcacacuuaaa

SEQ ID NO: 2691111 - RNA, 14 nt, Haemophilus influenzae Rd
uaaaacuauaaaaa

SEQ ID NO: 2691112 - RNA, 15 nt, Haemophilus influenzae Rd
uaaaacuauaaaaau

SEQ ID NO: 2691113 - RNA, 21 nt, Haemophilus influenzae Rd
uaaaacugugcccgcagcaau

SEQ ID NO: 2691114 - RNA, 22 nt, Haemophilus influenzae Rd
uaaaacugugcccgcagcaauu

SEQ ID NO: 2691115 - RNA, 22 nt, Haemophilus influenzae Rd
uaaaacuuacccaguaaaacuu

SEQ ID NO: 2691116 - RNA, 18 nt, Haemophilus influenzae Rd
uaaaacuugacguuguuc

SEQ ID NO: 2691117 - RNA, 23 nt, Haemophilus influenzae Rd
uaaaacuugacguuguucuucug

SEQ ID NO: 2691118 - RNA, 13 nt, Haemophilus influenzae Rd
uaaaacuuuauuu

SEQ ID NO: 2691119 - RNA, 16 nt, Haemophilus influenzae Rd
uaaaacuuuauuuuau

SEQ ID NO: 2691120 - RNA, 17 nt, Haemophilus influenzae Rd
uaaaacuuuauuuuauu

SEQ ID NO: 2691121 - RNA, 22 nt, Haemophilus influenzae Rd
uaaaagaaagggcaucaaugau

SEQ ID NO: 2691122 - RNA, 14 nt, Haemophilus influenzae Rd
uaaaagagugcggu

SEQ ID NO: 2691123 - RNA, 19 nt, Haemophilus influenzae Rd
uaaaagauaaacaaaccua

SEQ ID NO: 2691124 - RNA, 21 nt, Haemophilus influenzae Rd
uaaaagauaaacaaaccuaaa

SEQ ID NO: 2691125 - RNA, 24 nt, Haemophilus influenzae Rd
uaaaagcaaggcgaaucgaaagau

SEQ ID NO: 2691126 - RNA, 15 nt, Haemophilus influenzae Rd
uaaaagcaauaaucc

SEQ ID NO: 2691127 - RNA, 17 nt, Haemophilus influenzae Rd
uaaaagcaccgcauugu

SEQ ID NO: 2691128 - RNA, 18 nt, Haemophilus influenzae Rd
uaaaagcaccgcauugua

SEQ ID NO: 2691129 - RNA, 14 nt, Haemophilus influenzae Rd
uaaaagcaccuaaa

SEQ ID NO: 2691130 - RNA, 22 nt, Haemophilus influenzae Rd
uaaaagcuuccauaauacucac

SEQ ID NO: 2691131 - RNA, 14 nt, Haemophilus influenzae Rd
uaaaaggacuaaac

SEQ ID NO: 2691132 - RNA, 18 nt, Haemophilus influenzae Rd
uaaaaggcaaagcaaaau

SEQ ID NO: 2691133 - RNA, 20 nt, Haemophilus influenzae Rd
uaaaaggcaaagcaaaauca

SEQ ID NO: 2691134 - RNA, 16 nt, Haemophilus influenzae Rd
uaaaaggcuuucuaac

SEQ ID NO: 2691135 - RNA, 14 nt, Haemophilus influenzae Rd
uaaaaguaagcaau

SEQ ID NO: 2691136 - RNA, 15 nt, Haemophilus influenzae Rd
uaaaaguaagcaauu

SEQ ID NO: 2691137 - RNA, 23 nt, Haemophilus influenzae Rd
uaaaaguaagcaauuuucugcag

SEQ ID NO: 2691138 - RNA, 15 nt, Haemophilus influenzae Rd
uaaaaguaucuugcu

SEQ ID NO: 2691139 - RNA, 22 nt, Haemophilus influenzae Rd
uaaaaguccgcugcucuaccga

SEQ ID NO: 2691140 - RNA, 23 nt, Haemophilus influenzae Rd
uaaaagugcggcuucauuuugag

SEQ ID NO: 2691141 - RNA, 18 nt, Haemophilus influenzae Rd
uaaaagugcgguaaaaaa

SEQ ID NO: 2691142 - RNA, 19 nt, Haemophilus influenzae Rd
uaaaagugcgguaaaaauu

SEQ ID NO: 2691143 - RNA, 19 nt, Haemophilus influenzae Rd
uaaaagugcggugauuuuu

SEQ ID NO: 2691144 - RNA, 20 nt, Haemophilus influenzae Rd
uaaaagugcgguugauuuuc

SEQ ID NO: 2691145 - RNA, 16 nt, Haemophilus influenzae Rd
uaaaaguguauaaaua

SEQ ID NO: 2691146 - RNA, 14 nt, Haemophilus influenzae Rd
uaaaaguuggcuua

SEQ ID NO: 2691147 - RNA, 19 nt, Haemophilus influenzae Rd
uaaaaguuugacuauucua

SEQ ID NO: 2691148 - RNA, 15 nt, Haemophilus influenzae Rd
uaaaauaaaagaauu

SEQ ID NO: 2691149 - RNA, 17 nt, Haemophilus influenzae Rd
uaaaauaaaagaauuuu

SEQ ID NO: 2691150 - RNA, 23 nt, Haemophilus influenzae Rd
uaaaauaaaagaauuuuuaaccg

SEQ ID NO: 2691151 - RNA, 12 nt, Haemophilus influenzae Rd
uaaaauaaaauu

SEQ ID NO: 2691152 - RNA, 14 nt, Haemophilus influenzae Rd
uaaaauaacaaaaa

SEQ ID NO: 2691153 - RNA, 15 nt, Haemophilus influenzae Rd
uaaaauaaugcaaaa

SEQ ID NO: 2691154 - RNA, 18 nt, Haemophilus influenzae Rd
uaaaauacaaauacauuu

SEQ ID NO: 2691155 - RNA, 17 nt, Haemophilus influenzae Rd
uaaaauacccauaaaau

SEQ ID NO: 2691156 - RNA, 16 nt, Haemophilus influenzae Rd
uaaaauacgaauaaac

SEQ ID NO: 2691157 - RNA, 16 nt, Haemophilus influenzae Rd
uaaaauacuuucagaa

SEQ ID NO: 2691158 - RNA, 18 nt, Haemophilus influenzae Rd
uaaaauagaaugaaaaac

SEQ ID NO: 2691159 - RNA, 22 nt, Haemophilus influenzae Rd
uaaaauagaaugaaaaacauuc

SEQ ID NO: 2691160 - RNA, 18 nt, Haemophilus influenzae Rd
uaaaauagacaauauuga

SEQ ID NO: 2691161 - RNA, 19 nt, Haemophilus influenzae Rd
uaaaauagagcaaauauaa

SEQ ID NO: 2691162 - RNA, 21 nt, Haemophilus influenzae Rd
uaaaauagagcaaauauaaau

SEQ ID NO: 2691163 - RNA, 17 nt, Haemophilus influenzae Rd
uaaaauagccuaaauau

SEQ ID NO: 2691164 - RNA, 19 nt, Haemophilus influenzae Rd
uaaaauagccuaaauauuu

SEQ ID NO: 2691165 - RNA, 21 nt, Haemophilus influenzae Rd
uaaaauagccuaaauauuuau

SEQ ID NO: 2691166 - RNA, 16 nt, Haemophilus influenzae Rd
uaaaauagcuaacaaa

SEQ ID NO: 2691167 - RNA, 21 nt, Haemophilus influenzae Rd
uaaaauagcuaacaaauuuaa

SEQ ID NO: 2691168 - RNA, 22 nt, Haemophilus influenzae Rd
uaaaauagcuaacaaauuuaau

SEQ ID NO: 2691169 - RNA, 23 nt, Haemophilus influenzae Rd
uaaaauagcuaacaaauuuaaua

SEQ ID NO: 2691170 - RNA, 16 nt, Haemophilus influenzae Rd
uaaaauaguuuucaca

SEQ ID NO: 2691171 - RNA, 17 nt, Haemophilus influenzae Rd
uaaaauaguuuuuauua

SEQ ID NO: 2691172 - RNA, 23 nt, Haemophilus influenzae Rd
uaaaauauaacauuuauuuuucu

SEQ ID NO: 2691173 - RNA, 23 nt, Haemophilus influenzae Rd
uaaaauauauuaauuauuuuaga

SEQ ID NO: 2691174 - RNA, 18 nt, Haemophilus influenzae Rd
uaaaauauccacauaacc

SEQ ID NO: 2691175 - RNA, 12 nt, Haemophilus influenzae Rd
uaaaauaucuug

SEQ ID NO: 2691176 - RNA, 12 nt, Haemophilus influenzae Rd
uaaaauauuaag

SEQ ID NO: 2691177 - RNA, 22 nt, Haemophilus influenzae Rd
uaaaauauuaagugcaacugcu

SEQ ID NO: 2691178 - RNA, 16 nt, Haemophilus influenzae Rd
uaaaauauuuggcuga

SEQ ID NO: 2691179 - RNA, 14 nt, Haemophilus influenzae Rd
uaaaauauuuuccc

SEQ ID NO: 2691180 - RNA, 15 nt, Haemophilus influenzae Rd
uaaaauauuuucccc

SEQ ID NO: 2691181 - RNA, 18 nt, Haemophilus influenzae Rd
uaaaaucaaaauagcuuu

SEQ ID NO: 2691182 - RNA, 14 nt, Haemophilus influenzae Rd
uaaaaucaaccgca

SEQ ID NO: 2691183 - RNA, 17 nt, Haemophilus influenzae Rd
uaaaaucacauaaaaaa

SEQ ID NO: 2691184 - RNA, 23 nt, Haemophilus influenzae Rd
uaaaaucauuauccaacauuaau

SEQ ID NO: 2691185 - RNA, 20 nt, Haemophilus influenzae Rd
uaaaaucuauuugaaaucuu

SEQ ID NO: 2691186 - RNA, 18 nt, Haemophilus influenzae Rd
uaaaaucucucaaaaauc

SEQ ID NO: 2691187 - RNA, 19 nt, Haemophilus influenzae Rd
uaaaaucuugguuuaaauu

SEQ ID NO: 2691188 - RNA, 15 nt, Haemophilus influenzae Rd
uaaaaucuuuggauu

SEQ ID NO: 2691189 - RNA, 15 nt, Haemophilus influenzae Rd
uaaaaugaacaaaaa

SEQ ID NO: 2691190 - RNA, 16 nt, Haemophilus influenzae Rd
uaaaaugaacaaaaaa

SEQ ID NO: 2691191 - RNA, 24 nt, Haemophilus influenzae Rd
uaaaaugcaaacaagaugucaaau

SEQ ID NO: 2691192 - RNA, 19 nt, Haemophilus influenzae Rd
uaaaaugccguuuaccaua

SEQ ID NO: 2691193 - RNA, 19 nt, Haemophilus influenzae Rd
uaaaauggaaauuugagau

SEQ ID NO: 2691194 - RNA, 12 nt, Haemophilus influenzae Rd
uaaaauggcuuu

SEQ ID NO: 2691195 - RNA, 23 nt, Haemophilus influenzae Rd
uaaaaugggucaagauuaaucuu

SEQ ID NO: 2691196 - RNA, 24 nt, Haemophilus influenzae Rd
uaaaauggugcuuuuuacaacauu

SEQ ID NO: 2691197 - RNA, 12 nt, Haemophilus influenzae Rd
uaaaauguaaaa

SEQ ID NO: 2691198 - RNA, 15 nt, Haemophilus influenzae Rd
uaaaauguaaaaaau

SEQ ID NO: 2691199 - RNA, 18 nt, Haemophilus influenzae Rd
uaaaauguaaaaaauccu

SEQ ID NO: 2691200 - RNA, 18 nt, Haemophilus influenzae Rd
uaaaauguaaaaauugga

SEQ ID NO: 2691201 - RNA, 14 nt, Haemophilus influenzae Rd
uaaaauuaagcaau

SEQ ID NO: 2691202 - RNA, 15 nt, Haemophilus influenzae Rd
uaaaauuaauaaaua

SEQ ID NO: 2691203 - RNA, 14 nt, Haemophilus influenzae Rd
uaaaauuaaucaua

SEQ ID NO: 2691204 - RNA, 19 nt, Haemophilus influenzae Rd
uaaaauuacaaaaccaauc

SEQ ID NO: 2691205 - RNA, 20 nt, Haemophilus influenzae Rd
uaaaauuacaaaaccaauca

SEQ ID NO: 2691206 - RNA, 23 nt, Haemophilus influenzae Rd
uaaaauuaccgcacuuuuuauuu

SEQ ID NO: 2691207 - RNA, 12 nt, Haemophilus influenzae Rd
uaaaauuauaau

SEQ ID NO: 2691208 - RNA, 22 nt, Haemophilus influenzae Rd
uaaaauucgacgauaaccaucu

SEQ ID NO: 2691209 - RNA, 23 nt, Haemophilus influenzae Rd
uaaaauucgacgauaaccaucug

SEQ ID NO: 2691210 - RNA, 23 nt, Haemophilus influenzae Rd
uaaaauucgcacacuuucacuaa

SEQ ID NO: 2691211 - RNA, 17 nt, Haemophilus influenzae Rd
uaaaauucuauuaaaau

SEQ ID NO: 2691212 - RNA, 18 nt, Haemophilus influenzae Rd
uaaaauucuauuaaaaua

SEQ ID NO: 2691213 - RNA, 19 nt, Haemophilus influenzae Rd
uaaaauugauuucauauau

SEQ ID NO: 2691214 - RNA, 20 nt, Haemophilus influenzae Rd
uaaacuugaauaauaacguu

SEQ ID NO: 2691215 - RNA, 21 nt, Haemophilus influenzae Rd
uaaacuuguuaaauaaacaca

SEQ ID NO: 2691216 - RNA, 23 nt, Haemophilus influenzae Rd
uaaacuuuacggauaauuucccu

SEQ ID NO: 2691217 - RNA, 22 nt, Haemophilus influenzae Rd
uaaacuuuauccccuacaguga

SEQ ID NO: 2691218 - RNA, 14 nt, Haemophilus influenzae Rd
uaaacuuucaauuu

SEQ ID NO: 2691219 - RNA, 14 nt, Haemophilus influenzae Rd
uaaacuuuuaaagu

SEQ ID NO: 2691220 - RNA, 18 nt, Haemophilus influenzae Rd
uaaagaaacguaaacaaa

SEQ ID NO: 2691221 - RNA, 19 nt, Haemophilus influenzae Rd
uaaagaaacguaaacaaaa

SEQ ID NO: 2691222 - RNA, 15 nt, Haemophilus influenzae Rd
uaaagaaauaaauuu

SEQ ID NO: 2691223 - RNA, 17 nt, Haemophilus influenzae Rd
uaaagaaauaaauuuau

SEQ ID NO: 2691224 - RNA, 14 nt, Haemophilus influenzae Rd
uaaagaaauaagca

SEQ ID NO: 2691225 - RNA, 17 nt, Haemophilus influenzae Rd
uaaagaaauaagcaauu

SEQ ID NO: 2691226 - RNA, 19 nt, Haemophilus influenzae Rd
uaaagaaaucauugcugca

SEQ ID NO: 2691227 - RNA, 20 nt, Haemophilus influenzae Rd
uaaagaaauuucauauuucu

SEQ ID NO: 2691228 - RNA, 17 nt, Haemophilus influenzae Rd
uaaagaacuauuauucc

SEQ ID NO: 2691229 - RNA, 22 nt, Haemophilus influenzae Rd
uaaagaagugagaaauaucuac

SEQ ID NO: 2691230 - RNA, 17 nt, Haemophilus influenzae Rd
uaaagaauaauuuucaa

SEQ ID NO: 2691231 - RNA, 16 nt, Haemophilus influenzae Rd
uaaagaauacuuaaua

SEQ ID NO: 2691232 - RNA, 18 nt, Haemophilus influenzae Rd
uaaagaauuucuuucgcu

SEQ ID NO: 2691233 - RNA, 19 nt, Haemophilus influenzae Rd
uaaagacguuugauuguaa

SEQ ID NO: 2691234 - RNA, 19 nt, Haemophilus influenzae Rd
uaaagagaucacuguaaau

SEQ ID NO: 2691235 - RNA, 16 nt, Haemophilus influenzae Rd
uaaagagcaaauuuaa

SEQ ID NO: 2691236 - RNA, 22 nt, Haemophilus influenzae Rd
uaaagagcaaauuuaaauaaua

SEQ ID NO: 2691237 - RNA, 18 nt, Haemophilus influenzae Rd
uaaagagugaccagucau

SEQ ID NO: 2691238 - RNA, 17 nt, Haemophilus influenzae Rd
uaaagaguguuauaaag

SEQ ID NO: 2691239 - RNA, 14 nt, Haemophilus influenzae Rd
uaaagauaaauuau

SEQ ID NO: 2691240 - RNA, 23 nt, Haemophilus influenzae Rd
uaaagauggacguguuguggcau

SEQ ID NO: 2691241 - RNA, 21 nt, Haemophilus influenzae Rd
uaaagaugguugucgaaaaaa

SEQ ID NO: 2691242 - RNA, 22 nt, Haemophilus influenzae Rd
uaaagauuaaaaucgcacggau

SEQ ID NO: 2691243 - RNA, 15 nt, Haemophilus influenzae Rd
uaaagauuauuuaua

SEQ ID NO: 2691244 - RNA, 14 nt, Haemophilus influenzae Rd
uaaagauuguccuu

SEQ ID NO: 2691245 - RNA, 9 nt, Haemophilus influenzae Rd
uaaagauuu

SEQ ID NO: 2691246 - RNA, 23 nt, Haemophilus influenzae Rd
uaaagccuguugauguuuuaaca

SEQ ID NO: 2691247 - RNA, 16 nt, Haemophilus influenzae Rd
uaaagccuugauuauc

SEQ ID NO: 2691248 - RNA, 12 nt, Haemophilus influenzae Rd
uaaagcuacuaa

SEQ ID NO: 2691249 - RNA, 17 nt, Haemophilus influenzae Rd
uaaagcuacuaaaaauu

SEQ ID NO: 2691250 - RNA, 15 nt, Haemophilus influenzae Rd
uaaagcucuaauuga

SEQ ID NO: 2691251 - RNA, 21 nt, Haemophilus influenzae Rd
uaaagcuucauuugcuuuaac

SEQ ID NO: 2691252 - RNA, 22 nt, Haemophilus influenzae Rd
uaaaggaaucccauauuuaaaa

SEQ ID NO: 2691253 - RNA, 17 nt, Haemophilus influenzae Rd
uaaaggcacaaaaaauu

SEQ ID NO: 2691254 - RNA, 19 nt, Haemophilus influenzae Rd
uaaaggcacaaaaaauucu

SEQ ID NO: 2691255 - RNA, 15 nt, Haemophilus influenzae Rd
uaaaggcauagcuau

SEQ ID NO: 2691256 - RNA, 18 nt, Haemophilus influenzae Rd
uaaagggcgguuaaaaau

SEQ ID NO: 2691257 - RNA, 21 nt, Haemophilus influenzae Rd
uaaaggugcaacgugugccag

SEQ ID NO: 2691258 - RNA, 24 nt, Haemophilus influenzae Rd
uaaagguuuaaaccuuauugcaua

SEQ ID NO: 2691259 - RNA, 15 nt, Haemophilus influenzae Rd
uaaaguaaaauauug

SEQ ID NO: 2691260 - RNA, 16 nt, Haemophilus influenzae Rd
uaaaguaaauuuuaaa

SEQ ID NO: 2691261 - RNA, 18 nt, Haemophilus influenzae Rd
uaaaguaaauuuuaaaau

SEQ ID NO: 2691262 - RNA, 20 nt, Haemophilus influenzae Rd
uaaaguaaauuuuaaaaucu

SEQ ID NO: 2691263 - RNA, 13 nt, Haemophilus influenzae Rd
uaaaguauucaua

SEQ ID NO: 2691264 - RNA, 18 nt, Haemophilus influenzae Rd
uaaaguauucauauaauu

SEQ ID NO: 2691265 - RNA, 14 nt, Haemophilus influenzae Rd
uaaaguccauaaua

SEQ ID NO: 2691266 - RNA, 19 nt, Haemophilus influenzae Rd
uaaagucuaauaugauuaa

SEQ ID NO: 2691267 - RNA, 15 nt, Haemophilus influenzae Rd
uaaagugcagauuuu

SEQ ID NO: 2691268 - RNA, 20 nt, Haemophilus influenzae Rd
uaaagugcgguuauuuuauu

SEQ ID NO: 2691269 - RNA, 22 nt, Haemophilus influenzae Rd
uaaagugguuuuagccauuugu

SEQ ID NO: 2691270 - RNA, 18 nt, Haemophilus influenzae Rd
uaaaguguggauuuugua

SEQ ID NO: 2691271 - RNA, 20 nt, Haemophilus influenzae Rd
uaaaguguggauuuuguaau

SEQ ID NO: 2691272 - RNA, 13 nt, Haemophilus influenzae Rd
uaaaguuacacaa

SEQ ID NO: 2691273 - RNA, 18 nt, Haemophilus influenzae Rd
uaaaguuacacaaugcca

SEQ ID NO: 2691274 - RNA, 17 nt, Haemophilus influenzae Rd
uaaaguuacuuugcauu

SEQ ID NO: 2691275 - RNA, 13 nt, Haemophilus influenzae Rd
uaaaguuaucaaa

SEQ ID NO: 2691276 - RNA, 21 nt, Haemophilus influenzae Rd
uaaaguugagaauuuuuucuu

SEQ ID NO: 2691277 - RNA, 17 nt, Haemophilus influenzae Rd
uaaaguuucuguugauu

SEQ ID NO: 2691278 - RNA, 12 nt, Haemophilus influenzae Rd
uaaaguuucuuu

SEQ ID NO: 2691279 - RNA, 18 nt, Haemophilus influenzae Rd
uaaaguuugcaauucgcc

SEQ ID NO: 2691280 - RNA, 17 nt, Haemophilus influenzae Rd
uaaaguuuuugcaucca

SEQ ID NO: 2691281 - RNA, 13 nt, Haemophilus influenzae Rd
uaaauaaaaaaua

SEQ ID NO: 2691282 - RNA, 13 nt, Haemophilus influenzae Rd
uaaauaaaaauga

SEQ ID NO: 2691283 - RNA, 15 nt, Haemophilus influenzae Rd
uaaauaaaacaagga

SEQ ID NO: 2691284 - RNA, 20 nt, Haemophilus influenzae Rd
uaaauaaaacgggaucuauu

SEQ ID NO: 2691285 - RNA, 21 nt, Haemophilus influenzae Rd
uaaauaaaacgggaucuauuu

SEQ ID NO: 2691286 - RNA, 13 nt, Haemophilus influenzae Rd
uaaauaaaauauu

SEQ ID NO: 2691287 - RNA, 17 nt, Haemophilus influenzae Rd
uaaauaaaauauuuaau

SEQ ID NO: 2691288 - RNA, 16 nt, Haemophilus influenzae Rd
uaaauaaaauauuugg

SEQ ID NO: 2691289 - RNA, 19 nt, Haemophilus influenzae Rd
uaaauaaacauuaugaaaa

SEQ ID NO: 2691290 - RNA, 21 nt, Haemophilus influenzae Rd
uaaauaaaccgcaucaaaauu

SEQ ID NO: 2691291 - RNA, 13 nt, Haemophilus influenzae Rd
uaaauaaaucaau

SEQ ID NO: 2691292 - RNA, 14 nt, Haemophilus influenzae Rd
uaaauaaauucauu

SEQ ID NO: 2691293 - RNA, 22 nt, Haemophilus influenzae Rd
uaaauaacacaucagaaaauca

SEQ ID NO: 2691294 - RNA, 14 nt, Haemophilus influenzae Rd
uaaauaacaucgcu

SEQ ID NO: 2691295 - RNA, 21 nt, Haemophilus influenzae Rd
uaaauaacaucgcuaaaucuu

SEQ ID NO: 2691296 - RNA, 20 nt, Haemophilus influenzae Rd
uaaauaaccauaucugaaaa

SEQ ID NO: 2691297 - RNA, 16 nt, Haemophilus influenzae Rd
uaaauaaccuaaaaua

SEQ ID NO: 2691298 - RNA, 21 nt, Haemophilus influenzae Rd
uaaauaacgcucauaagcauu

SEQ ID NO: 2691299 - RNA, 15 nt, Haemophilus influenzae Rd
uaaauaacucaagca

SEQ ID NO: 2691300 - RNA, 23 nt, Haemophilus influenzae Rd
uaaauaaggaucuuguaaagauu

SEQ ID NO: 2691301 - RNA, 20 nt, Haemophilus influenzae Rd
uaaauaaggcguaaaacuau

SEQ ID NO: 2691302 - RNA, 20 nt, Haemophilus influenzae Rd
uaaauaauccagauaacaaa

SEQ ID NO: 2691303 - RNA, 21 nt, Haemophilus influenzae Rd
uaaauaaucuucuuuguuucc

SEQ ID NO: 2691304 - RNA, 23 nt, Haemophilus influenzae Rd
uaaauaauggcgauaauuauuga

SEQ ID NO: 2691305 - RNA, 13 nt, Haemophilus influenzae Rd
uaaauaauuaaaa

SEQ ID NO: 2691306 - RNA, 14 nt, Haemophilus influenzae Rd
uaaauaauuuccuu

SEQ ID NO: 2691307 - RNA, 15 nt, Haemophilus influenzae Rd
uaaauaauuuccuuu

SEQ ID NO: 2691308 - RNA, 15 nt, Haemophilus influenzae Rd
uaaauacaaaacagg

SEQ ID NO: 2691309 - RNA, 17 nt, Haemophilus influenzae Rd
uaaauacacuucuaaaa

SEQ ID NO: 2691310 - RNA, 13 nt, Haemophilus influenzae Rd
uaaauacagcuca

SEQ ID NO: 2691311 - RNA, 20 nt, Haemophilus influenzae Rd
uaaauacagcucaaaaugcu

SEQ ID NO: 2691312 - RNA, 20 nt, Haemophilus influenzae Rd
uaaauacauuggguuacggc

SEQ ID NO: 2691313 - RNA, 15 nt, Haemophilus influenzae Rd
uaaauagaaauuacu

SEQ ID NO: 2691314 - RNA, 15 nt, Haemophilus influenzae Rd
uaaauagagaaaucc

SEQ ID NO: 2691315 - RNA, 17 nt, Haemophilus influenzae Rd
uaaauagagcuugccuu

SEQ ID NO: 2691316 - RNA, 20 nt, Haemophilus influenzae Rd
uaaauagauacaagaaagaa

SEQ ID NO: 2691317 - RNA, 20 nt, Haemophilus influenzae Rd
uaaauagccgacaucuauuu

SEQ ID NO: 2691318 - RNA, 12 nt, Haemophilus influenzae Rd
uaaauagcgauc

SEQ ID NO: 2691319 - RNA, 22 nt, Haemophilus influenzae Rd
uaaauuaucguuuacuuaaaau

SEQ ID NO: 2691320 - RNA, 19 nt, Haemophilus influenzae Rd
uaaauuaugcccaauuacc

SEQ ID NO: 2691321 - RNA, 20 nt, Haemophilus influenzae Rd
uaaauuauguuuacggaugc

SEQ ID NO: 2691322 - RNA, 15 nt, Haemophilus influenzae Rd
uaaauuauucugcaa

SEQ ID NO: 2691323 - RNA, 20 nt, Haemophilus influenzae Rd
uaaauuauuugauuuuuaua

SEQ ID NO: 2691324 - RNA, 15 nt, Haemophilus influenzae Rd
uaaauucaaucgcuu

SEQ ID NO: 2691325 - RNA, 15 nt, Haemophilus influenzae Rd
uaaauucaccaauuc

SEQ ID NO: 2691326 - RNA, 13 nt, Haemophilus influenzae Rd
uaaauucacugug

SEQ ID NO: 2691327 - RNA, 20 nt, Haemophilus influenzae Rd
uaaauucaguaagaaaccaa

SEQ ID NO: 2691328 - RNA, 17 nt, Haemophilus influenzae Rd
uaaauucaguuaagaaa

SEQ ID NO: 2691329 - RNA, 21 nt, Haemophilus influenzae Rd
uaaauucaguuaagaaaauaa

SEQ ID NO: 2691330 - RNA, 16 nt, Haemophilus influenzae Rd
uaaauuccuuuuuaau

SEQ ID NO: 2691331 - RNA, 19 nt, Haemophilus influenzae Rd
uaaauucuacgucaaagcc

SEQ ID NO: 2691332 - RNA, 17 nt, Haemophilus influenzae Rd
uaaauucuauaucugua

SEQ ID NO: 2691333 - RNA, 19 nt, Haemophilus influenzae Rd
uaaauucuauaucuguaau

SEQ ID NO: 2691334 - RNA, 20 nt, Haemophilus influenzae Rd
uaaauucucaagaauauauu

SEQ ID NO: 2691335 - RNA, 16 nt, Haemophilus influenzae Rd
uaaauucuguuuaguc

SEQ ID NO: 2691336 - RNA, 19 nt, Haemophilus influenzae Rd
uaaauucuguuuagucuuc

SEQ ID NO: 2691337 - RNA, 15 nt, Haemophilus influenzae Rd
uaaauucuuuugcca

SEQ ID NO: 2691338 - RNA, 13 nt, Haemophilus influenzae Rd
uaaauugaaaaaa

SEQ ID NO: 2691339 - RNA, 16 nt, Haemophilus influenzae Rd
uaaauugaaaaaaucu

SEQ ID NO: 2691340 - RNA, 18 nt, Haemophilus influenzae Rd
uaaauugaaaaaaucuuc

SEQ ID NO: 2691341 - RNA, 18 nt, Haemophilus influenzae Rd
uaaauugaacugaauuaa

SEQ ID NO: 2691342 - RNA, 19 nt, Haemophilus influenzae Rd
uaaauugaacugaauuaaa

SEQ ID NO: 2691343 - RNA, 21 nt, Haemophilus influenzae Rd
uaaauugaccgcacuuguaau

SEQ ID NO: 2691344 - RNA, 16 nt, Haemophilus influenzae Rd
uaaauugacggcuuca

SEQ ID NO: 2691345 - RNA, 17 nt, Haemophilus influenzae Rd
uaaauugacuugcacaa

SEQ ID NO: 2691346 - RNA, 17 nt, Haemophilus influenzae Rd
uaaauugagaucaaaaa

SEQ ID NO: 2691347 - RNA, 14 nt, Haemophilus influenzae Rd
uaaauugaucuguu

SEQ ID NO: 2691348 - RNA, 21 nt, Haemophilus influenzae Rd
uaaauuggcauuuucaagccc

SEQ ID NO: 2691349 - RNA, 21 nt, Haemophilus influenzae Rd
uaaauuggggaaguaauauuu

SEQ ID NO: 2691350 - RNA, 14 nt, Haemophilus influenzae Rd
uaaauugguuuuau

SEQ ID NO: 2691351 - RNA, 14 nt, Haemophilus influenzae Rd
uaaauuguaacuau

SEQ ID NO: 2691352 - RNA, 18 nt, Haemophilus influenzae Rd
uaaauuguugcucugaau

SEQ ID NO: 2691353 - RNA, 14 nt, Haemophilus influenzae Rd
uaaauuuaaauuau

SEQ ID NO: 2691354 - RNA, 15 nt, Haemophilus influenzae Rd
uaaauuuaaauuauu

SEQ ID NO: 2691355 - RNA, 21 nt, Haemophilus influenzae Rd
uaaauuuaaccacuaaaaaag

SEQ ID NO: 2691356 - RNA, 21 nt, Haemophilus influenzae Rd
uaaauuuaccgcacuuuucuu

SEQ ID NO: 2691357 - RNA, 20 nt, Haemophilus influenzae Rd
uaaauuuagcguauuuuguu

SEQ ID NO: 2691358 - RNA, 20 nt, Haemophilus influenzae Rd
uaaauuuagggcuuguggga

SEQ ID NO: 2691359 - RNA, 23 nt, Haemophilus influenzae Rd
uaaauuuauauaugauaaaaaua

SEQ ID NO: 2691360 - RNA, 22 nt, Haemophilus influenzae Rd
uaaauuuaugaucuucaaucau

SEQ ID NO: 2691361 - RNA, 22 nt, Haemophilus influenzae Rd
uaaauuuauuuuuuaaaacuua

SEQ ID NO: 2691362 - RNA, 13 nt, Haemophilus influenzae Rd
uaaauuucaauua

SEQ ID NO: 2691363 - RNA, 18 nt, Haemophilus influenzae Rd
uaaauuucaauuaaauca

SEQ ID NO: 2691364 - RNA, 20 nt, Haemophilus influenzae Rd
uaaauuucagcuuaaauacu

SEQ ID NO: 2691365 - RNA, 24 nt, Haemophilus influenzae Rd
uaaauuucccauuugucucaaaau

SEQ ID NO: 2691366 - RNA, 11 nt, Haemophilus influenzae Rd
uaaauuucuaa

SEQ ID NO: 2691367 - RNA, 18 nt, Haemophilus influenzae Rd
uaaauuucuaaccgcacu

SEQ ID NO: 2691368 - RNA, 13 nt, Haemophilus influenzae Rd
uaaauuucuacua

SEQ ID NO: 2691369 - RNA, 21 nt, Haemophilus influenzae Rd
uaaauuugguucaauuuuaau

SEQ ID NO: 2691370 - RNA, 15 nt, Haemophilus influenzae Rd
uaaauuuuaaaaaau

SEQ ID NO: 2691371 - RNA, 15 nt, Haemophilus influenzae Rd
uaaauuuuaaaauag

SEQ ID NO: 2691372 - RNA, 23 nt, Haemophilus influenzae Rd
uaaauuuuaaccgcacuuuaucu

SEQ ID NO: 2691373 - RNA, 19 nt, Haemophilus influenzae Rd
uaaauuuuauuauguuuug

SEQ ID NO: 2691374 - RNA, 19 nt, Haemophilus influenzae Rd
uaaauuuuauuccaccaca

SEQ ID NO: 2691375 - RNA, 20 nt, Haemophilus influenzae Rd
uaaauuuuauuccaccacag

SEQ ID NO: 2691376 - RNA, 22 nt, Haemophilus influenzae Rd
uaaauuuuauuccaccacagcc

SEQ ID NO: 2691377 - RNA, 18 nt, Haemophilus influenzae Rd
uaaauuuucaaauugaaa

SEQ ID NO: 2691378 - RNA, 20 nt, Haemophilus influenzae Rd
uaaauuuucggcaagaaauu

SEQ ID NO: 2691379 - RNA, 15 nt, Haemophilus influenzae Rd
uaaauuuugcuuuaa

SEQ ID NO: 2691380 - RNA, 13 nt, Haemophilus influenzae Rd
uaaauuuuuaaug

SEQ ID NO: 2691381 - RNA, 12 nt, Haemophilus influenzae Rd
uaaauuuuuagu

SEQ ID NO: 2691382 - RNA, 13 nt, Haemophilus influenzae Rd
uaaauuuuuccac

SEQ ID NO: 2691383 - RNA, 16 nt, Haemophilus influenzae Rd
uaaauuuuuccacauu

SEQ ID NO: 2691384 - RNA, 21 nt, Haemophilus influenzae Rd
uaaauuuuucgccuaauucaa

SEQ ID NO: 2691385 - RNA, 19 nt, Haemophilus influenzae Rd
uaaauuuuuggcugcugca

SEQ ID NO: 2691386 - RNA, 17 nt, Haemophilus influenzae Rd
uaaauuuuuuaauucag

SEQ ID NO: 2691387 - RNA, 17 nt, Haemophilus influenzae Rd
uaaauuuuuuugcauuu

SEQ ID NO: 2691388 - RNA, 12 nt, Haemophilus influenzae Rd
uaacaaaaacaa

SEQ ID NO: 2691389 - RNA, 17 nt, Haemophilus influenzae Rd
uaacaaaaacaaucacu

SEQ ID NO: 2691390 - RNA, 20 nt, Haemophilus influenzae Rd
uaacaaaagugcgguaaaaa

SEQ ID NO: 2691391 - RNA, 21 nt, Haemophilus influenzae Rd
uaacaaaagugcgguaaaaau

SEQ ID NO: 2691392 - RNA, 23 nt, Haemophilus influenzae Rd
uaacaaaagugcgguaaaaauua

SEQ ID NO: 2691393 - RNA, 13 nt, Haemophilus influenzae Rd
uaacaaaaucaau

SEQ ID NO: 2691394 - RNA, 17 nt, Haemophilus influenzae Rd
uaacaaaauggcuuuuu

SEQ ID NO: 2691395 - RNA, 21 nt, Haemophilus influenzae Rd
uaacaaaauggcuuuuuugcc

SEQ ID NO: 2691396 - RNA, 23 nt, Haemophilus influenzae Rd
uaacaaaauggcuuuuuugccuu

SEQ ID NO: 2691397 - RNA, 18 nt, Haemophilus influenzae Rd
uaacaaauacaucuucac

SEQ ID NO: 2691398 - RNA, 20 nt, Haemophilus influenzae Rd
uaacaaauaggauaaaaaug

SEQ ID NO: 2691399 - RNA, 12 nt, Haemophilus influenzae Rd
uaacaacaaaag

SEQ ID NO: 2691400 - RNA, 23 nt, Haemophilus influenzae Rd
uaacaacaaagucaauacacauu

SEQ ID NO: 2691401 - RNA, 15 nt, Haemophilus influenzae Rd
uaacaacuaaaaauc

SEQ ID NO: 2691402 - RNA, 17 nt, Haemophilus influenzae Rd
uaacaacucacaauaau

SEQ ID NO: 2691403 - RNA, 21 nt, Haemophilus influenzae Rd
uaacaagcucagguucaaaac

SEQ ID NO: 2691404 - RNA, 15 nt, Haemophilus influenzae Rd
uaacaaguaauuuau

SEQ ID NO: 2691405 - RNA, 16 nt, Haemophilus influenzae Rd
uaacaaguaauuuauc

SEQ ID NO: 2691406 - RNA, 21 nt, Haemophilus influenzae Rd
uaacaaguaauuuaucgccau

SEQ ID NO: 2691407 - RNA, 23 nt, Haemophilus influenzae Rd
uaacaaucccaggcuuaauugcu

SEQ ID NO: 2691408 - RNA, 22 nt, Haemophilus influenzae Rd
uaacaaucgacuuuguccaaaa

SEQ ID NO: 2691409 - RNA, 14 nt, Haemophilus influenzae Rd
uaacaaugaaaucg

SEQ ID NO: 2691410 - RNA, 15 nt, Haemophilus influenzae Rd
uaacaaugaaaucgc

SEQ ID NO: 2691411 - RNA, 13 nt, Haemophilus influenzae Rd
uaacaaugaaauu

SEQ ID NO: 2691412 - RNA, 16 nt, Haemophilus influenzae Rd
uaacaaugaaauuauu

SEQ ID NO: 2691413 - RNA, 15 nt, Haemophilus influenzae Rd
uaacaaugauuaaac

SEQ ID NO: 2691414 - RNA, 20 nt, Haemophilus influenzae Rd
uaacaaugcggagaaaagca

SEQ ID NO: 2691415 - RNA, 13 nt, Haemophilus influenzae Rd
uaacaauguagaa

SEQ ID NO: 2691416 - RNA, 14 nt, Haemophilus influenzae Rd
uaacacaaaaucuu

SEQ ID NO: 2691417 - RNA, 12 nt, Haemophilus influenzae Rd
uaacacagaaac

SEQ ID NO: 2691418 - RNA, 15 nt, Haemophilus influenzae Rd
uaacacagaaaccaa

SEQ ID NO: 2691419 - RNA, 16 nt, Haemophilus influenzae Rd
uaacacagaugaaaau

SEQ ID NO: 2691420 - RNA, 13 nt, Haemophilus influenzae Rd
uaacacauaagca

SEQ ID NO: 2691421 - RNA, 20 nt, Haemophilus influenzae Rd
uaacacaucagaaaaucaaa

SEQ ID NO: 2691422 - RNA, 22 nt, Haemophilus influenzae Rd
uaacacaucagaaaaucaaaaa

SEQ ID NO: 2691423 - RNA, 20 nt, Haemophilus influenzae Rd
uaacacauccguuaagaaac

SEQ ID NO: 2691424 - RNA, 13 nt, Haemophilus influenzae Rd
uaacuaagaugau

SEQ ID NO: 2691425 - RNA, 13 nt, Haemophilus influenzae Rd
uaacuaaggugca

SEQ ID NO: 2691426 - RNA, 17 nt, Haemophilus influenzae Rd
uaacuaaggugcagauu

SEQ ID NO: 2691427 - RNA, 15 nt, Haemophilus influenzae Rd
uaacuaccuaauaaa

SEQ ID NO: 2691428 - RNA, 15 nt, Haemophilus influenzae Rd
uaacuagcaaucuuu

SEQ ID NO: 2691429 - RNA, 15 nt, Haemophilus influenzae Rd
uaacuagcuggcuua

SEQ ID NO: 2691430 - RNA, 23 nt, Haemophilus influenzae Rd
uaacuaggcaucaaaauucaaaa

SEQ ID NO: 2691431 - RNA, 22 nt, Haemophilus influenzae Rd
uaacuauuggcaucaaaacguu

SEQ ID NO: 2691432 - RNA, 14 nt, Haemophilus influenzae Rd
uaacucaaaauacu

SEQ ID NO: 2691433 - RNA, 23 nt, Haemophilus influenzae Rd
uaacucaacaccgcaaaaauacu

SEQ ID NO: 2691434 - RNA, 22 nt, Haemophilus influenzae Rd
uaacucgcgcaccgucauuuuc

SEQ ID NO: 2691435 - RNA, 18 nt, Haemophilus influenzae Rd
uaacucugguucaaaaug

SEQ ID NO: 2691436 - RNA, 20 nt, Haemophilus influenzae Rd
uaacucuuuagaaaguuuug

SEQ ID NO: 2691437 - RNA, 14 nt, Haemophilus influenzae Rd
uaacugaaaauuca

SEQ ID NO: 2691438 - RNA, 14 nt, Haemophilus influenzae Rd
uaacugaauuaaau

SEQ ID NO: 2691439 - RNA, 15 nt, Haemophilus influenzae Rd
uaacugauaugccaa

SEQ ID NO: 2691440 - RNA, 14 nt, Haemophilus influenzae Rd
uaacugaucgccau

SEQ ID NO: 2691441 - RNA, 18 nt, Haemophilus influenzae Rd
uaacugauuguccaaaga

SEQ ID NO: 2691442 - RNA, 20 nt, Haemophilus influenzae Rd
uaacugcaaguccgccuuga

SEQ ID NO: 2691443 - RNA, 16 nt, Haemophilus influenzae Rd
uaacugcuuuaauaaa

SEQ ID NO: 2691444 - RNA, 14 nt, Haemophilus influenzae Rd
uaacugcuuuuuuc

SEQ ID NO: 2691445 - RNA, 16 nt, Haemophilus influenzae Rd
uaacuggcaauacuac

SEQ ID NO: 2691446 - RNA, 19 nt, Haemophilus influenzae Rd
uaacuggcuguguaaaaca

SEQ ID NO: 2691447 - RNA, 19 nt, Haemophilus influenzae Rd
uaacuguaucuacuuuauu

SEQ ID NO: 2691448 - RNA, 14 nt, Haemophilus influenzae Rd
uaacuuagaaaaua

SEQ ID NO: 2691449 - RNA, 17 nt, Haemophilus influenzae Rd
uaacuuaugaauaauaa

SEQ ID NO: 2691450 - RNA, 19 nt, Haemophilus influenzae Rd
uaacuuaugaauaauaaug

SEQ ID NO: 2691451 - RNA, 19 nt, Haemophilus influenzae Rd
uaacuucauccauuuucga

SEQ ID NO: 2691452 - RNA, 11 nt, Haemophilus influenzae Rd
uaacuucuaaa

SEQ ID NO: 2691453 - RNA, 15 nt, Haemophilus influenzae Rd
uaacuucuuccacuu

SEQ ID NO: 2691454 - RNA, 13 nt, Haemophilus influenzae Rd
uaacuugauuuug

SEQ ID NO: 2691455 - RNA, 18 nt, Haemophilus influenzae Rd
uaacuugcgauaauauca

SEQ ID NO: 2691456 - RNA, 12 nt, Haemophilus influenzae Rd
uaacuugcuauu

SEQ ID NO: 2691457 - RNA, 18 nt, Haemophilus influenzae Rd
uaacuuuccauauaacaa

SEQ ID NO: 2691458 - RNA, 19 nt, Haemophilus influenzae Rd
uaacuuuucuucaauuacc

SEQ ID NO: 2691459 - RNA, 13 nt, Haemophilus influenzae Rd
uaacuuuuuuauu

SEQ ID NO: 2691460 - RNA, 14 nt, Haemophilus influenzae Rd
uaagaaaaacauua

SEQ ID NO: 2691461 - RNA, 14 nt, Haemophilus influenzae Rd
uaagaaaagugcau

SEQ ID NO: 2691462 - RNA, 12 nt, Haemophilus influenzae Rd
uaagaaaauaau

SEQ ID NO: 2691463 - RNA, 19 nt, Haemophilus influenzae Rd
uaagaaaauaauauaagug

SEQ ID NO: 2691464 - RNA, 13 nt, Haemophilus influenzae Rd
uaagaaaauagaa

SEQ ID NO: 2691465 - RNA, 14 nt, Haemophilus influenzae Rd
uaagaaaaucaaag

SEQ ID NO: 2691466 - RNA, 16 nt, Haemophilus influenzae Rd
uaagaaaauccaagag

SEQ ID NO: 2691467 - RNA, 13 nt, Haemophilus influenzae Rd
uaagaaagaaacu

SEQ ID NO: 2691468 - RNA, 19 nt, Haemophilus influenzae Rd
uaagaaagcgacauuuugu

SEQ ID NO: 2691469 - RNA, 12 nt, Haemophilus influenzae Rd
uaagaaauaauc

SEQ ID NO: 2691470 - RNA, 19 nt, Haemophilus influenzae Rd
uaagaaauccacaaucaau

SEQ ID NO: 2691471 - RNA, 23 nt, Haemophilus influenzae Rd
uaagaaaucucuuucaauuucaa

SEQ ID NO: 2691472 - RNA, 19 nt, Haemophilus influenzae Rd
uaagaaauuuucuuuucua

SEQ ID NO: 2691473 - RNA, 21 nt, Haemophilus influenzae Rd
uaagaaguuaucauuugaauu

SEQ ID NO: 2691474 - RNA, 21 nt, Haemophilus influenzae Rd
uaagaauaacccuuguaacgu

SEQ ID NO: 2691475 - RNA, 19 nt, Haemophilus influenzae Rd
uaagaaugaaguagaaauu

SEQ ID NO: 2691476 - RNA, 14 nt, Haemophilus influenzae Rd
uaagaauguuuauc

SEQ ID NO: 2691477 - RNA, 21 nt, Haemophilus influenzae Rd
uaagaauuaccgcacuuuaaa

SEQ ID NO: 2691478 - RNA, 23 nt, Haemophilus influenzae Rd
uaagaauuaccgcacuuuaaacu

SEQ ID NO: 2691479 - RNA, 13 nt, Haemophilus influenzae Rd
uaagaauuuuaau

SEQ ID NO: 2691480 - RNA, 23 nt, Haemophilus influenzae Rd
uaagaauuuuaaucgcacuuaaa

SEQ ID NO: 2691481 - RNA, 21 nt, Haemophilus influenzae Rd
uaagacaccugcaagugcggu

SEQ ID NO: 2691482 - RNA, 15 nt, Haemophilus influenzae Rd
uaagacuuucaagca

SEQ ID NO: 2691483 - RNA, 16 nt, Haemophilus influenzae Rd
uaagagaggagaaaua

SEQ ID NO: 2691484 - RNA, 21 nt, Haemophilus influenzae Rd
uaagagcauauucguagaugu

SEQ ID NO: 2691485 - RNA, 21 nt, Haemophilus influenzae Rd
uaagaggcauaacccaccaaa

SEQ ID NO: 2691486 - RNA, 16 nt, Haemophilus influenzae Rd
uaagaguaaauuuaac

SEQ ID NO: 2691487 - RNA, 15 nt, Haemophilus influenzae Rd
uaagauaaauuuaaa

SEQ ID NO: 2691488 - RNA, 16 nt, Haemophilus influenzae Rd
uaagauaaauuuaaag

SEQ ID NO: 2691489 - RNA, 20 nt, Haemophilus influenzae Rd
uaagauaaauuuaaaggacu

SEQ ID NO: 2691490 - RNA, 21 nt, Haemophilus influenzae Rd
uaagauaaguggggaaaaaua

SEQ ID NO: 2691491 - RNA, 17 nt, Haemophilus influenzae Rd
uaagauaauaaaugcua

SEQ ID NO: 2691492 - RNA, 15 nt, Haemophilus influenzae Rd
uaagauaauuuuucu

SEQ ID NO: 2691493 - RNA, 16 nt, Haemophilus influenzae Rd
uaagauccaaaccguc

SEQ ID NO: 2691494 - RNA, 22 nt, Haemophilus influenzae Rd
uaagaucuucuacuguuaauuu

SEQ ID NO: 2691495 - RNA, 16 nt, Haemophilus influenzae Rd
uaagauggcuauuuaa

SEQ ID NO: 2691496 - RNA, 20 nt, Haemophilus influenzae Rd
uaagauggcuauuuaagccu

SEQ ID NO: 2691497 - RNA, 15 nt, Haemophilus influenzae Rd
uaagauguuguaaaa

SEQ ID NO: 2691498 - RNA, 16 nt, Haemophilus influenzae Rd
uaagauguuucacuaa

SEQ ID NO: 2691499 - RNA, 16 nt, Haemophilus influenzae Rd
uaagauuuuaucuaac

SEQ ID NO: 2691500 - RNA, 19 nt, Haemophilus influenzae Rd
uaagauuuuaugaaaucuu

SEQ ID NO: 2691501 - RNA, 14 nt, Haemophilus influenzae Rd
uaagauuuugccua

SEQ ID NO: 2691502 - RNA, 20 nt, Haemophilus influenzae Rd
uaagauuuuuaaccgcacuu

SEQ ID NO: 2691503 - RNA, 12 nt, Haemophilus influenzae Rd
uaagauuuuugg

SEQ ID NO: 2691504 - RNA, 17 nt, Haemophilus influenzae Rd
uaagauuuuuggcugca

SEQ ID NO: 2691505 - RNA, 13 nt, Haemophilus influenzae Rd
uaagcaaguaauu

SEQ ID NO: 2691506 - RNA, 18 nt, Haemophilus influenzae Rd
uaagcaauagauucuaag

SEQ ID NO: 2691507 - RNA, 17 nt, Haemophilus influenzae Rd
uaagcaauccuaagaau

SEQ ID NO: 2691508 - RNA, 13 nt, Haemophilus influenzae Rd
uaagcaauuuauu

SEQ ID NO: 2691509 - RNA, 13 nt, Haemophilus influenzae Rd
uaagcaauuucac

SEQ ID NO: 2691510 - RNA, 16 nt, Haemophilus influenzae Rd
uaagcaauuucacgau

SEQ ID NO: 2691511 - RNA, 17 nt, Haemophilus influenzae Rd
uaagcaauuucacgauu

SEQ ID NO: 2691512 - RNA, 18 nt, Haemophilus influenzae Rd
uaagcaccgaaagguguu

SEQ ID NO: 2691513 - RNA, 19 nt, Haemophilus influenzae Rd
uaagcaccuucaauauagg

SEQ ID NO: 2691514 - RNA, 15 nt, Haemophilus influenzae Rd
uaagcagcuaacaaa

SEQ ID NO: 2691515 - RNA, 17 nt, Haemophilus influenzae Rd
uaagcauuuuaucacaa

SEQ ID NO: 2691516 - RNA, 18 nt, Haemophilus influenzae Rd
uaagcauuuuaucacaag

SEQ ID NO: 2691517 - RNA, 22 nt, Haemophilus influenzae Rd
uaagcauuuuaucacaaguuaa

SEQ ID NO: 2691518 - RNA, 13 nt, Haemophilus influenzae Rd
uaagcauuuugau

SEQ ID NO: 2691519 - RNA, 13 nt, Haemophilus influenzae Rd
uaagccaaauaau

SEQ ID NO: 2691520 - RNA, 13 nt, Haemophilus influenzae Rd
uaagccaauaauu

SEQ ID NO: 2691521 - RNA, 13 nt, Haemophilus influenzae Rd
uaagccacugugc

SEQ ID NO: 2691522 - RNA, 19 nt, Haemophilus influenzae Rd
uaagccacugugcauuaaa

SEQ ID NO: 2691523 - RNA, 14 nt, Haemophilus influenzae Rd
uaagccauugugau

SEQ ID NO: 2691524 - RNA, 18 nt, Haemophilus influenzae Rd
uaagcccugcguuauauu

SEQ ID NO: 2691525 - RNA, 20 nt, Haemophilus influenzae Rd
uaagcccuguagauuacaga

SEQ ID NO: 2691526 - RNA, 16 nt, Haemophilus influenzae Rd
uaagccgcaccaauaa

SEQ ID NO: 2691527 - RNA, 19 nt, Haemophilus influenzae Rd
uaagccgcaccaauaacag

SEQ ID NO: 2691528 - RNA, 18 nt, Haemophilus influenzae Rd
uaagccuaaaccaaauau

SEQ ID NO: 2691529 - RNA, 16 nt, Haemophilus influenzae Rd
uaagccuacgcuaccu

SEQ ID NO: 2691530 - RNA, 14 nt, Haemophilus influenzae Rd
uaauaagaaaauca

SEQ ID NO: 2691531 - RNA, 20 nt, Haemophilus influenzae Rd
uaauaagaaaguaauugcau

SEQ ID NO: 2691532 - RNA, 19 nt, Haemophilus influenzae Rd
uaauaagccauuuucugca

SEQ ID NO: 2691533 - RNA, 18 nt, Haemophilus influenzae Rd
uaauaagccuugcauaau

SEQ ID NO: 2691534 - RNA, 23 nt, Haemophilus influenzae Rd
uaauaagcuaucgucaaauuuaa

SEQ ID NO: 2691535 - RNA, 20 nt, Haemophilus influenzae Rd
uaauaaggcuugcacaauaa

SEQ ID NO: 2691536 - RNA, 22 nt, Haemophilus influenzae Rd
uaauaaggcuugcacaauaauc

SEQ ID NO: 2691537 - RNA, 16 nt, Haemophilus influenzae Rd
uaauaagugagaaagu

SEQ ID NO: 2691538 - RNA, 13 nt, Haemophilus influenzae Rd
uaauaaucacaac

SEQ ID NO: 2691539 - RNA, 17 nt, Haemophilus influenzae Rd
uaauaaucacaacaaac

SEQ ID NO: 2691540 - RNA, 18 nt, Haemophilus influenzae Rd
uaauaaucacaacaaacc

SEQ ID NO: 2691541 - RNA, 16 nt, Haemophilus influenzae Rd
uaauaaucgcaaugcc

SEQ ID NO: 2691542 - RNA, 23 nt, Haemophilus influenzae Rd
uaauaaucgcaaugccagcgcuu

SEQ ID NO: 2691543 - RNA, 13 nt, Haemophilus influenzae Rd
uaauaauguauuu

SEQ ID NO: 2691544 - RNA, 20 nt, Haemophilus influenzae Rd
uaauaauuagcuaaauacuu

SEQ ID NO: 2691545 - RNA, 15 nt, Haemophilus influenzae Rd
uaauaauucauuauu

SEQ ID NO: 2691546 - RNA, 23 nt, Haemophilus influenzae Rd
uaauaauuguaguuagaccaucu

SEQ ID NO: 2691547 - RNA, 12 nt, Haemophilus influenzae Rd
uaauaauuuaaa

SEQ ID NO: 2691548 - RNA, 13 nt, Haemophilus influenzae Rd
uaauaauuuuucc

SEQ ID NO: 2691549 - RNA, 14 nt, Haemophilus influenzae Rd
uaauaauuuuuccg

SEQ ID NO: 2691550 - RNA, 13 nt, Haemophilus influenzae Rd
uaauacaaucugu

SEQ ID NO: 2691551 - RNA, 16 nt, Haemophilus influenzae Rd
uaauacacuuuuacuu

SEQ ID NO: 2691552 - RNA, 17 nt, Haemophilus influenzae Rd
uaauacagaaauaugaa

SEQ ID NO: 2691553 - RNA, 21 nt, Haemophilus influenzae Rd
uaauacagugcagaaaauugc

SEQ ID NO: 2691554 - RNA, 19 nt, Haemophilus influenzae Rd
uaauaccaauaauaauauc

SEQ ID NO: 2691555 - RNA, 12 nt, Haemophilus influenzae Rd
uaauaccaauac

SEQ ID NO: 2691556 - RNA, 22 nt, Haemophilus influenzae Rd
uaauacgucaauugcuaaaccu

SEQ ID NO: 2691557 - RNA, 13 nt, Haemophilus influenzae Rd
uaauacugauacc

SEQ ID NO: 2691558 - RNA, 14 nt, Haemophilus influenzae Rd
uaauacuugcgaua

SEQ ID NO: 2691559 - RNA, 12 nt, Haemophilus influenzae Rd
uaauacuuggug

SEQ ID NO: 2691560 - RNA, 15 nt, Haemophilus influenzae Rd
uaauacuuuuguaug

SEQ ID NO: 2691561 - RNA, 12 nt, Haemophilus influenzae Rd
uaauagaaaaau

SEQ ID NO: 2691562 - RNA, 15 nt, Haemophilus influenzae Rd
uaauagaaaaaugcc

SEQ ID NO: 2691563 - RNA, 16 nt, Haemophilus influenzae Rd
uaauagaaaaaugcca

SEQ ID NO: 2691564 - RNA, 14 nt, Haemophilus influenzae Rd
uaauagaaaacauu

SEQ ID NO: 2691565 - RNA, 15 nt, Haemophilus influenzae Rd
uaauagacauagaaa

SEQ ID NO: 2691566 - RNA, 17 nt, Haemophilus influenzae Rd
uaauagacugaaaaaag

SEQ ID NO: 2691567 - RNA, 20 nt, Haemophilus influenzae Rd
uaauagacuuaauaauauau

SEQ ID NO: 2691568 - RNA, 16 nt, Haemophilus influenzae Rd
uaauagaguaccaaaa

SEQ ID NO: 2691569 - RNA, 19 nt, Haemophilus influenzae Rd
uaauagcgugcauuccuaa

SEQ ID NO: 2691570 - RNA, 21 nt, Haemophilus influenzae Rd
uaauaggaauaacacaccaac

SEQ ID NO: 2691571 - RNA, 16 nt, Haemophilus influenzae Rd
uaauaggaguaaaaau

SEQ ID NO: 2691572 - RNA, 17 nt, Haemophilus influenzae Rd
uaauaggaguaaaaaua

SEQ ID NO: 2691573 - RNA, 14 nt, Haemophilus influenzae Rd
uaauaggauaaaua

SEQ ID NO: 2691574 - RNA, 15 nt, Haemophilus influenzae Rd
uaauaggauaaauaa

SEQ ID NO: 2691575 - RNA, 17 nt, Haemophilus influenzae Rd
uaauaggauaaauaaac

SEQ ID NO: 2691576 - RNA, 18 nt, Haemophilus influenzae Rd
uaauaggcgaaucaaaau

SEQ ID NO: 2691577 - RNA, 23 nt, Haemophilus influenzae Rd
uaauaggcgaaucaaaaucugcu

SEQ ID NO: 2691578 - RNA, 21 nt, Haemophilus influenzae Rd
uaauaggcgcguaauaaauaa

SEQ ID NO: 2691579 - RNA, 20 nt, Haemophilus influenzae Rd
uaauagguuguccacaauac

SEQ ID NO: 2691580 - RNA, 13 nt, Haemophilus influenzae Rd
uaauaguaaaauu

SEQ ID NO: 2691581 - RNA, 16 nt, Haemophilus influenzae Rd
uaauaguaaaauugcc

SEQ ID NO: 2691582 - RNA, 18 nt, Haemophilus influenzae Rd
uaauaguaaacuuuuaaa

SEQ ID NO: 2691583 - RNA, 19 nt, Haemophilus influenzae Rd
uaauaguaaacuuuuaaag

SEQ ID NO: 2691584 - RNA, 20 nt, Haemophilus influenzae Rd
uaauaguaaacuuuuaaagu

SEQ ID NO: 2691585 - RNA, 20 nt, Haemophilus influenzae Rd
uaauaguuguuugugaaguu

SEQ ID NO: 2691586 - RNA, 15 nt, Haemophilus influenzae Rd
uaauauaaaggauuu

SEQ ID NO: 2691587 - RNA, 21 nt, Haemophilus influenzae Rd
uaauauaagugauuaaaguga

SEQ ID NO: 2691588 - RNA, 21 nt, Haemophilus influenzae Rd
uaauauaaguuauuuauauaa

SEQ ID NO: 2691589 - RNA, 15 nt, Haemophilus influenzae Rd
uaauauaauugugau

SEQ ID NO: 2691590 - RNA, 20 nt, Haemophilus influenzae Rd
uaauauaccccaaacuauau

SEQ ID NO: 2691591 - RNA, 17 nt, Haemophilus influenzae Rd
uaauauaggauuuuaau

SEQ ID NO: 2691592 - RNA, 15 nt, Haemophilus influenzae Rd
uaauauaugaaaaau

SEQ ID NO: 2691593 - RNA, 18 nt, Haemophilus influenzae Rd
uaauauaugaaaaauaau

SEQ ID NO: 2691594 - RNA, 13 nt, Haemophilus influenzae Rd
uaauauauuaugu

SEQ ID NO: 2691595 - RNA, 21 nt, Haemophilus influenzae Rd
uaauauauucuacguauugaa

SEQ ID NO: 2691596 - RNA, 20 nt, Haemophilus influenzae Rd
uaauaucaaucacuucucug

SEQ ID NO: 2691597 - RNA, 12 nt, Haemophilus influenzae Rd
uaauaucacaac

SEQ ID NO: 2691598 - RNA, 21 nt, Haemophilus influenzae Rd
uaauaucacuuuguacaccaa

SEQ ID NO: 2691599 - RNA, 15 nt, Haemophilus influenzae Rd
uaauaucagagaaaa

SEQ ID NO: 2691600 - RNA, 23 nt, Haemophilus influenzae Rd
uaauaucauggcgaccauucucu

SEQ ID NO: 2691601 - RNA, 17 nt, Haemophilus influenzae Rd
uaauaucauuuuuagaa

SEQ ID NO: 2691602 - RNA, 19 nt, Haemophilus influenzae Rd
uaauaucgcccgauuuuaa

SEQ ID NO: 2691603 - RNA, 19 nt, Haemophilus influenzae Rd
uaauaucgugagcuuguug

SEQ ID NO: 2691604 - RNA, 13 nt, Haemophilus influenzae Rd
uaauaucugcuuu

SEQ ID NO: 2691605 - RNA, 21 nt, Haemophilus influenzae Rd
uaauaucuuuaacaaaaucaa

SEQ ID NO: 2691606 - RNA, 17 nt, Haemophilus influenzae Rd
uaauaugauuucuucaa

SEQ ID NO: 2691607 - RNA, 19 nt, Haemophilus influenzae Rd
uaauaugccaaauaaaauu

SEQ ID NO: 2691608 - RNA, 14 nt, Haemophilus influenzae Rd
uaauauguuuugcc

SEQ ID NO: 2691609 - RNA, 16 nt, Haemophilus influenzae Rd
uaauauuaaagaaaau

SEQ ID NO: 2691610 - RNA, 19 nt, Haemophilus influenzae Rd
uaauauucaaaacauuaau

SEQ ID NO: 2691611 - RNA, 20 nt, Haemophilus influenzae Rd
uaauauucaaaacauuaauu

SEQ ID NO: 2691612 - RNA, 17 nt, Haemophilus influenzae Rd
uaauauuccaaaaaaua

SEQ ID NO: 2691613 - RNA, 21 nt, Haemophilus influenzae Rd
uaauauuccuuagaaaguaaa

SEQ ID NO: 2691614 - RNA, 15 nt, Haemophilus influenzae Rd
uaauauugcaccaua

SEQ ID NO: 2691615 - RNA, 16 nt, Haemophilus influenzae Rd
uaauauuucuucauuu

SEQ ID NO: 2691616 - RNA, 13 nt, Haemophilus influenzae Rd
uaauauuucuugu

SEQ ID NO: 2691617 - RNA, 17 nt, Haemophilus influenzae Rd
uaauauuucuuuuugau

SEQ ID NO: 2691618 - RNA, 23 nt, Haemophilus influenzae Rd
uaauauuuuuacuccuauuagua

SEQ ID NO: 2691619 - RNA, 13 nt, Haemophilus influenzae Rd
uaauauuuuugcc

SEQ ID NO: 2691620 - RNA, 15 nt, Haemophilus influenzae Rd
uaauauuuuugccaa

SEQ ID NO: 2691621 - RNA, 19 nt, Haemophilus influenzae Rd
uaauauuuuugccaauuuu

SEQ ID NO: 2691622 - RNA, 13 nt, Haemophilus influenzae Rd
uaaucaaacuuuu

SEQ ID NO: 2691623 - RNA, 17 nt, Haemophilus influenzae Rd
uaaucaaacuuuuagaa

SEQ ID NO: 2691624 - RNA, 20 nt, Haemophilus influenzae Rd
uaaucaaaguagucuauuua

SEQ ID NO: 2691625 - RNA, 15 nt, Haemophilus influenzae Rd
uaaucaaauaaaaua

SEQ ID NO: 2691626 - RNA, 17 nt, Haemophilus influenzae Rd
uaaucaaauaaaauauu

SEQ ID NO: 2691627 - RNA, 22 nt, Haemophilus influenzae Rd
uaaucaaauaaaauauuuuuua

SEQ ID NO: 2691628 - RNA, 16 nt, Haemophilus influenzae Rd
uaaucaaaucuuugau

SEQ ID NO: 2691629 - RNA, 12 nt, Haemophilus influenzae Rd
uaaucaauaaga

SEQ ID NO: 2691630 - RNA, 14 nt, Haemophilus influenzae Rd
uaaucaauaagaaa

SEQ ID NO: 2691631 - RNA, 15 nt, Haemophilus influenzae Rd
uaaucaauaagaaau

SEQ ID NO: 2691632 - RNA, 13 nt, Haemophilus influenzae Rd
uaaucaauauuua

SEQ ID NO: 2691633 - RNA, 13 nt, Haemophilus influenzae Rd
uaaucaauuugau

SEQ ID NO: 2691634 - RNA, 19 nt, Haemophilus influenzae Rd
uaaucacaaagcuuagucc

SEQ ID NO: 2691635 - RNA, 21 nt, Haemophilus influenzae Rd
uaaucacacuugcaccaccaa

SEQ ID NO: 2691636 - RNA, 15 nt, Haemophilus influenzae Rd
uaauguaaacaaaaa

SEQ ID NO: 2691637 - RNA, 16 nt, Haemophilus influenzae Rd
uaauguaaacaaaaau

SEQ ID NO: 2691638 - RNA, 17 nt, Haemophilus influenzae Rd
uaauguaauaaaaaaua

SEQ ID NO: 2691639 - RNA, 13 nt, Haemophilus influenzae Rd
uaauguaauaacg

SEQ ID NO: 2691640 - RNA, 16 nt, Haemophilus influenzae Rd
uaaugucaucuaguac

SEQ ID NO: 2691641 - RNA, 18 nt, Haemophilus influenzae Rd
uaaugugagaauaaccac

SEQ ID NO: 2691642 - RNA, 16 nt, Haemophilus influenzae Rd
uaaugugcaaucagca

SEQ ID NO: 2691643 - RNA, 17 nt, Haemophilus influenzae Rd
uaaugugcaaucagcaa

SEQ ID NO: 2691644 - RNA, 21 nt, Haemophilus influenzae Rd
uaauguggugcuguuuggcaa

SEQ ID NO: 2691645 - RNA, 23 nt, Haemophilus influenzae Rd
uaauguggugcuguuuggcaaug

SEQ ID NO: 2691646 - RNA, 14 nt, Haemophilus influenzae Rd
uaauguuaaaucua

SEQ ID NO: 2691647 - RNA, 17 nt, Haemophilus influenzae Rd
uaauguuaaaucuaagc

SEQ ID NO: 2691648 - RNA, 15 nt, Haemophilus influenzae Rd
uaauguuauuaaaua

SEQ ID NO: 2691649 - RNA, 18 nt, Haemophilus influenzae Rd
uaauguuauuaaauauag

SEQ ID NO: 2691650 - RNA, 21 nt, Haemophilus influenzae Rd
uaauguucccacaaagacuaa

SEQ ID NO: 2691651 - RNA, 16 nt, Haemophilus influenzae Rd
uaauguucccuauaaa

SEQ ID NO: 2691652 - RNA, 20 nt, Haemophilus influenzae Rd
uaauguucccuauaaauaaa

SEQ ID NO: 2691653 - RNA, 21 nt, Haemophilus influenzae Rd
uaauguuuucuugaccuucaa

SEQ ID NO: 2691654 - RNA, 18 nt, Haemophilus influenzae Rd
uaauguuuuuaugaccgc

SEQ ID NO: 2691655 - RNA, 15 nt, Haemophilus influenzae Rd
uaauuaaaaauaaau

SEQ ID NO: 2691656 - RNA, 14 nt, Haemophilus influenzae Rd
uaauuaaaaauaac

SEQ ID NO: 2691657 - RNA, 13 nt, Haemophilus influenzae Rd
uaauuaaaaggac

SEQ ID NO: 2691658 - RNA, 20 nt, Haemophilus influenzae Rd
uaauuaaaaggacuaaaccu

SEQ ID NO: 2691659 - RNA, 17 nt, Haemophilus influenzae Rd
uaauuaaaagugcgguu

SEQ ID NO: 2691660 - RNA, 12 nt, Haemophilus influenzae Rd
uaauuaaaauau

SEQ ID NO: 2691661 - RNA, 22 nt, Haemophilus influenzae Rd
uaauuaaacagcacacuaauaa

SEQ ID NO: 2691662 - RNA, 23 nt, Haemophilus influenzae Rd
uaauuaaagauaguaauguucua

SEQ ID NO: 2691663 - RNA, 23 nt, Haemophilus influenzae Rd
uaauuaaauaaacauuaugaaaa

SEQ ID NO: 2691664 - RNA, 12 nt, Haemophilus influenzae Rd
uaauuaaauuaa

SEQ ID NO: 2691665 - RNA, 19 nt, Haemophilus influenzae Rd
uaauuaacaaauaauuauu

SEQ ID NO: 2691666 - RNA, 20 nt, Haemophilus influenzae Rd
uaauuaacgggcuuaaacuu

SEQ ID NO: 2691667 - RNA, 22 nt, Haemophilus influenzae Rd
uaauuaacgugcauuuuuauga

SEQ ID NO: 2691668 - RNA, 14 nt, Haemophilus influenzae Rd
uaauuaacugaaaa

SEQ ID NO: 2691669 - RNA, 18 nt, Haemophilus influenzae Rd
uaauuaacugaaaauuag

SEQ ID NO: 2691670 - RNA, 21 nt, Haemophilus influenzae Rd
uaauuaagagaggagaaauaa

SEQ ID NO: 2691671 - RNA, 15 nt, Haemophilus influenzae Rd
uaauuaagauaauuu

SEQ ID NO: 2691672 - RNA, 12 nt, Haemophilus influenzae Rd
uaauuaauauua

SEQ ID NO: 2691673 - RNA, 13 nt, Haemophilus influenzae Rd
uaauuaauauuag

SEQ ID NO: 2691674 - RNA, 15 nt, Haemophilus influenzae Rd
uaauuaaucuuuuuu

SEQ ID NO: 2691675 - RNA, 16 nt, Haemophilus influenzae Rd
uaauuaauuuagauaa

SEQ ID NO: 2691676 - RNA, 21 nt, Haemophilus influenzae Rd
uaauuaauuuagauaaaaauu

SEQ ID NO: 2691677 - RNA, 13 nt, Haemophilus influenzae Rd
uaauuaccgcacu

SEQ ID NO: 2691678 - RNA, 20 nt, Haemophilus influenzae Rd
uaauuaccugccaaaccauc

SEQ ID NO: 2691679 - RNA, 15 nt, Haemophilus influenzae Rd
uaauuacgcaacgcu

SEQ ID NO: 2691680 - RNA, 18 nt, Haemophilus influenzae Rd
uaauuacgccuaaccaag

SEQ ID NO: 2691681 - RNA, 22 nt, Haemophilus influenzae Rd
uaauuacgccugcccaaguugu

SEQ ID NO: 2691682 - RNA, 13 nt, Haemophilus influenzae Rd
uaauuacuuuuau

SEQ ID NO: 2691683 - RNA, 17 nt, Haemophilus influenzae Rd
uaauuacuuuuauaucu

SEQ ID NO: 2691684 - RNA, 18 nt, Haemophilus influenzae Rd
uaauuacuuuuauaucua

SEQ ID NO: 2691685 - RNA, 20 nt, Haemophilus influenzae Rd
uaauuagaauaacaacaaaa

SEQ ID NO: 2691686 - RNA, 15 nt, Haemophilus influenzae Rd
uaauuagauaauaca

SEQ ID NO: 2691687 - RNA, 19 nt, Haemophilus influenzae Rd
uaauuagccgugauaacgc

SEQ ID NO: 2691688 - RNA, 15 nt, Haemophilus influenzae Rd
uaauuagcuaaauac

SEQ ID NO: 2691689 - RNA, 14 nt, Haemophilus influenzae Rd
uaauuaggacaaua

SEQ ID NO: 2691690 - RNA, 20 nt, Haemophilus influenzae Rd
uaauuaggacaauauuuacu

SEQ ID NO: 2691691 - RNA, 23 nt, Haemophilus influenzae Rd
uaauuaggcgacgcugcaaaaug

SEQ ID NO: 2691692 - RNA, 15 nt, Haemophilus influenzae Rd
uaauuaguggaugua

SEQ ID NO: 2691693 - RNA, 14 nt, Haemophilus influenzae Rd
uaauuaguuugauu

SEQ ID NO: 2691694 - RNA, 15 nt, Haemophilus influenzae Rd
uaauuauaaaauagc

SEQ ID NO: 2691695 - RNA, 17 nt, Haemophilus influenzae Rd
uaauuauaaaauagccu

SEQ ID NO: 2691696 - RNA, 17 nt, Haemophilus influenzae Rd
uaauuauagaaaagaca

SEQ ID NO: 2691697 - RNA, 21 nt, Haemophilus influenzae Rd
uaauuauagaaaagacaauaa

SEQ ID NO: 2691698 - RNA, 14 nt, Haemophilus influenzae Rd
uaauuauagagaaa

SEQ ID NO: 2691699 - RNA, 17 nt, Haemophilus influenzae Rd
uaauuauagagaaauaa

SEQ ID NO: 2691700 - RNA, 21 nt, Haemophilus influenzae Rd
uaauuauagagaaauaaucac

SEQ ID NO: 2691701 - RNA, 12 nt, Haemophilus influenzae Rd
uaauuauauuuu

SEQ ID NO: 2691702 - RNA, 17 nt, Haemophilus influenzae Rd
uaauuaucaaaaagaaa

SEQ ID NO: 2691703 - RNA, 12 nt, Haemophilus influenzae Rd
uaauuaugguga

SEQ ID NO: 2691704 - RNA, 19 nt, Haemophilus influenzae Rd
uaauuauguauuuucuuua

SEQ ID NO: 2691705 - RNA, 15 nt, Haemophilus influenzae Rd
uaauuauuuuaaaua

SEQ ID NO: 2691706 - RNA, 23 nt, Haemophilus influenzae Rd
uaauucaagaugauauuuaauaa

SEQ ID NO: 2691707 - RNA, 20 nt, Haemophilus influenzae Rd
uaauucaagcaaauauuuag

SEQ ID NO: 2691708 - RNA, 18 nt, Haemophilus influenzae Rd
uaauucaccgccuacaug

SEQ ID NO: 2691709 - RNA, 17 nt, Haemophilus influenzae Rd
uaauucagcaaaaagug

SEQ ID NO: 2691710 - RNA, 23 nt, Haemophilus influenzae Rd
uaauucagcgagagaauauuuag

SEQ ID NO: 2691711 - RNA, 17 nt, Haemophilus influenzae Rd
uaauucagcuaaacauu

SEQ ID NO: 2691712 - RNA, 19 nt, Haemophilus influenzae Rd
uaauucagggauuaagaaa

SEQ ID NO: 2691713 - RNA, 22 nt, Haemophilus influenzae Rd
uaauucaggugggaaauaauuu

SEQ ID NO: 2691714 - RNA, 20 nt, Haemophilus influenzae Rd
uaauucaguguaauguuuua

SEQ ID NO: 2691715 - RNA, 16 nt, Haemophilus influenzae Rd
uaauucauauuggaaa

SEQ ID NO: 2691716 - RNA, 14 nt, Haemophilus influenzae Rd
uaauucaucaaaau

SEQ ID NO: 2691717 - RNA, 17 nt, Haemophilus influenzae Rd
uaauucauuagaaaguu

SEQ ID NO: 2691718 - RNA, 17 nt, Haemophilus influenzae Rd
uaauucauugaguuuag

SEQ ID NO: 2691719 - RNA, 20 nt, Haemophilus influenzae Rd
uaauuccccuucaaauauaa

SEQ ID NO: 2691720 - RNA, 21 nt, Haemophilus influenzae Rd
uaauuccgacuaaaaccaaga

SEQ ID NO: 2691721 - RNA, 20 nt, Haemophilus influenzae Rd
uaauucgaucagcacgauaa

SEQ ID NO: 2691722 - RNA, 23 nt, Haemophilus influenzae Rd
uaauucgcguuuauuuaacaaua

SEQ ID NO: 2691723 - RNA, 22 nt, Haemophilus influenzae Rd
uaauucgggauaaggcagaaau

SEQ ID NO: 2691724 - RNA, 20 nt, Haemophilus influenzae Rd
uaauucgugccacaugauaa

SEQ ID NO: 2691725 - RNA, 15 nt, Haemophilus influenzae Rd
uaauucguuucuugg

SEQ ID NO: 2691726 - RNA, 19 nt, Haemophilus influenzae Rd
uaauucuaaauucucaaga

SEQ ID NO: 2691727 - RNA, 20 nt, Haemophilus influenzae Rd
uaauucuaaauucucaagaa

SEQ ID NO: 2691728 - RNA, 21 nt, Haemophilus influenzae Rd
uaauucuacaccagcuuuaac

SEQ ID NO: 2691729 - RNA, 16 nt, Haemophilus influenzae Rd
uaauucuccaccuuga

SEQ ID NO: 2691730 - RNA, 18 nt, Haemophilus influenzae Rd
uaauucuccaccuugauu

SEQ ID NO: 2691731 - RNA, 22 nt, Haemophilus influenzae Rd
uaauucugcccuuuuucaauua

SEQ ID NO: 2691732 - RNA, 18 nt, Haemophilus influenzae Rd
uaauucugcuaaaucugu

SEQ ID NO: 2691733 - RNA, 22 nt, Haemophilus influenzae Rd
uaauucuugaccgauuaauuca

SEQ ID NO: 2691734 - RNA, 23 nt, Haemophilus influenzae Rd
uaauucuugaccgauuaauucaa

SEQ ID NO: 2691735 - RNA, 12 nt, Haemophilus influenzae Rd
uaauucuugcca

SEQ ID NO: 2691736 - RNA, 14 nt, Haemophilus influenzae Rd
uaauucuugucuuu

SEQ ID NO: 2691737 - RNA, 20 nt, Haemophilus influenzae Rd
uaauucuugucuuuuaaguu

SEQ ID NO: 2691738 - RNA, 17 nt, Haemophilus influenzae Rd
uaauucuuuugcuagua

SEQ ID NO: 2691739 - RNA, 23 nt, Haemophilus influenzae Rd
uaauucuuuuucacuauuaccgc

SEQ ID NO: 2691740 - RNA, 18 nt, Haemophilus influenzae Rd
uaauugaaauuuaucuaa

SEQ ID NO: 2691741 - RNA, 22 nt, Haemophilus influenzae Rd
uacaaauagcuguaagauaaac

SEQ ID NO: 2691742 - RNA, 17 nt, Haemophilus influenzae Rd
uacaaaucguaauuaaa

SEQ ID NO: 2691743 - RNA, 18 nt, Haemophilus influenzae Rd
uacaaaucguaauuaaaa

SEQ ID NO: 2691744 - RNA, 19 nt, Haemophilus influenzae Rd
uacaaaucguaauuaaaau

SEQ ID NO: 2691745 - RNA, 16 nt, Haemophilus influenzae Rd
uacaaauugcuggauu

SEQ ID NO: 2691746 - RNA, 19 nt, Haemophilus influenzae Rd
uacaaauuuagauaacaau

SEQ ID NO: 2691747 - RNA, 15 nt, Haemophilus influenzae Rd
uacaacaaaggguaa

SEQ ID NO: 2691748 - RNA, 18 nt, Haemophilus influenzae Rd
uacaacaaaggguaaaua

SEQ ID NO: 2691749 - RNA, 21 nt, Haemophilus influenzae Rd
uacaacaaauugugucacaua

SEQ ID NO: 2691750 - RNA, 20 nt, Haemophilus influenzae Rd
uacaacagacgaaguguuaa

SEQ ID NO: 2691751 - RNA, 22 nt, Haemophilus influenzae Rd
uacaacauuaccuucuguuuuc

SEQ ID NO: 2691752 - RNA, 18 nt, Haemophilus influenzae Rd
uacaacauuuugacuuuc

SEQ ID NO: 2691753 - RNA, 19 nt, Haemophilus influenzae Rd
uacaacgaguuaaguaagu

SEQ ID NO: 2691754 - RNA, 14 nt, Haemophilus influenzae Rd
uacaacgugaagua

SEQ ID NO: 2691755 - RNA, 18 nt, Haemophilus influenzae Rd
uacaacgugaaguaaaua

SEQ ID NO: 2691756 - RNA, 13 nt, Haemophilus influenzae Rd
uacaacuaauccc

SEQ ID NO: 2691757 - RNA, 17 nt, Haemophilus influenzae Rd
uacaacuaaucccacuu

SEQ ID NO: 2691758 - RNA, 23 nt, Haemophilus influenzae Rd
uacaacuaaucccacuuguugga

SEQ ID NO: 2691759 - RNA, 15 nt, Haemophilus influenzae Rd
uacaacucuaaauug

SEQ ID NO: 2691760 - RNA, 14 nt, Haemophilus influenzae Rd
uacaacuucaucaa

SEQ ID NO: 2691761 - RNA, 14 nt, Haemophilus influenzae Rd
uacaagaaaccaaa

SEQ ID NO: 2691762 - RNA, 14 nt, Haemophilus influenzae Rd
uacaagaaagaaau

SEQ ID NO: 2691763 - RNA, 15 nt, Haemophilus influenzae Rd
uacaagaaagaaaua

SEQ ID NO: 2691764 - RNA, 20 nt, Haemophilus influenzae Rd
uacaagaaagaaauauaaua

SEQ ID NO: 2691765 - RNA, 23 nt, Haemophilus influenzae Rd
uacaagaaagaaauauaauaaau

SEQ ID NO: 2691766 - RNA, 11 nt, Haemophilus influenzae Rd
uacaagcggcu

SEQ ID NO: 2691767 - RNA, 18 nt, Haemophilus influenzae Rd
uacaaguggcgguaaaaa

SEQ ID NO: 2691768 - RNA, 16 nt, Haemophilus influenzae Rd
uacaauaccaauuucc

SEQ ID NO: 2691769 - RNA, 20 nt, Haemophilus influenzae Rd
uacaauaucuagcacagcaa

SEQ ID NO: 2691770 - RNA, 18 nt, Haemophilus influenzae Rd
uacaauccuaacuuuucu

SEQ ID NO: 2691771 - RNA, 19 nt, Haemophilus influenzae Rd
uacaaugcucacuucgcuu

SEQ ID NO: 2691772 - RNA, 17 nt, Haemophilus influenzae Rd
uacaauuaauuaaauau

SEQ ID NO: 2691773 - RNA, 20 nt, Haemophilus influenzae Rd
uacaauucuuguuuaauauu

SEQ ID NO: 2691774 - RNA, 21 nt, Haemophilus influenzae Rd
uacaauucuuguuuaauauuu

SEQ ID NO: 2691775 - RNA, 20 nt, Haemophilus influenzae Rd
uacaauuucaaauaaacaua

SEQ ID NO: 2691776 - RNA, 22 nt, Haemophilus influenzae Rd
uacaauuugaccgcggaaaaua

SEQ ID NO: 2691777 - RNA, 17 nt, Haemophilus influenzae Rd
uacaauuuucuuuucaa

SEQ ID NO: 2691778 - RNA, 18 nt, Haemophilus influenzae Rd
uacaauuuucuuuucaaa

SEQ ID NO: 2691779 - RNA, 21 nt, Haemophilus influenzae Rd
uacaauuuuuuucaagcaaca

SEQ ID NO: 2691780 - RNA, 21 nt, Haemophilus influenzae Rd
uacacaucagagcgaauacug

SEQ ID NO: 2691781 - RNA, 20 nt, Haemophilus influenzae Rd
uacacauugccauauucgcu

SEQ ID NO: 2691782 - RNA, 15 nt, Haemophilus influenzae Rd
uacaccaaaaccaau

SEQ ID NO: 2691783 - RNA, 13 nt, Haemophilus influenzae Rd
uacaccaagcauu

SEQ ID NO: 2691784 - RNA, 16 nt, Haemophilus influenzae Rd
uacaccaauaauuaaa

SEQ ID NO: 2691785 - RNA, 14 nt, Haemophilus influenzae Rd
uacaccccaaaauc

SEQ ID NO: 2691786 - RNA, 16 nt, Haemophilus influenzae Rd
uacaccccaaaauccc

SEQ ID NO: 2691787 - RNA, 20 nt, Haemophilus influenzae Rd
uacaccgauuucuuuacaaa

SEQ ID NO: 2691788 - RNA, 18 nt, Haemophilus influenzae Rd
uacaccucgauaaagaau

SEQ ID NO: 2691789 - RNA, 15 nt, Haemophilus influenzae Rd
uacacggagauauug

SEQ ID NO: 2691790 - RNA, 14 nt, Haemophilus influenzae Rd
uacacggccguaau

SEQ ID NO: 2691791 - RNA, 17 nt, Haemophilus influenzae Rd
uacacucacuuuuccuu

SEQ ID NO: 2691792 - RNA, 17 nt, Haemophilus influenzae Rd
uacacuuaaauuauauu

SEQ ID NO: 2691793 - RNA, 20 nt, Haemophilus influenzae Rd
uacacuuaaauuauauuuuc

SEQ ID NO: 2691794 - RNA, 11 nt, Haemophilus influenzae Rd
uacacuucuaa

SEQ ID NO: 2691795 - RNA, 18 nt, Haemophilus influenzae Rd
uacacuuuaaauuuuccu

SEQ ID NO: 2691796 - RNA, 12 nt, Haemophilus influenzae Rd
uacacuuucacg

SEQ ID NO: 2691797 - RNA, 17 nt, Haemophilus influenzae Rd
uacagaaucauuuucac

SEQ ID NO: 2691798 - RNA, 19 nt, Haemophilus influenzae Rd
uacagaaucauuuucacca

SEQ ID NO: 2691799 - RNA, 20 nt, Haemophilus influenzae Rd
uacagaaucauuuucaccaa

SEQ ID NO: 2691800 - RNA, 16 nt, Haemophilus influenzae Rd
uacagaccauugagcu

SEQ ID NO: 2691801 - RNA, 15 nt, Haemophilus influenzae Rd
uacagauacagaagg

SEQ ID NO: 2691802 - RNA, 13 nt, Haemophilus influenzae Rd
uacagcaaauccu

SEQ ID NO: 2691803 - RNA, 20 nt, Haemophilus influenzae Rd
uacagccugcgauugcacca

SEQ ID NO: 2691804 - RNA, 16 nt, Haemophilus influenzae Rd
uacagcgaacauuuuu

SEQ ID NO: 2691805 - RNA, 17 nt, Haemophilus influenzae Rd
uacagcucaaaaugcuc

SEQ ID NO: 2691806 - RNA, 19 nt, Haemophilus influenzae Rd
uacagcuuguuucaucauu

SEQ ID NO: 2691807 - RNA, 23 nt, Haemophilus influenzae Rd
uacagcuuguuucaucauucugg

SEQ ID NO: 2691808 - RNA, 18 nt, Haemophilus influenzae Rd
uacagggcuuuauuuuug

SEQ ID NO: 2691809 - RNA, 14 nt, Haemophilus influenzae Rd
uacagguucuacgu

SEQ ID NO: 2691810 - RNA, 18 nt, Haemophilus influenzae Rd
uacagugacuaaaacaac

SEQ ID NO: 2691811 - RNA, 15 nt, Haemophilus influenzae Rd
uacauaaaaaacaca

SEQ ID NO: 2691812 - RNA, 22 nt, Haemophilus influenzae Rd
uacauaaaaucucgcauugauu

SEQ ID NO: 2691813 - RNA, 21 nt, Haemophilus influenzae Rd
uacauaaagaauaauuuucaa

SEQ ID NO: 2691814 - RNA, 16 nt, Haemophilus influenzae Rd
uacauaauauugaaaa

SEQ ID NO: 2691815 - RNA, 12 nt, Haemophilus influenzae Rd
uacauaauuaaa

SEQ ID NO: 2691816 - RNA, 16 nt, Haemophilus influenzae Rd
uacauagaacguuuuu

SEQ ID NO: 2691817 - RNA, 21 nt, Haemophilus influenzae Rd
uacauagauugaaaaguaaau

SEQ ID NO: 2691818 - RNA, 18 nt, Haemophilus influenzae Rd
uacauauuucaccgcaga

SEQ ID NO: 2691819 - RNA, 22 nt, Haemophilus influenzae Rd
uacauauuucaccgcagaagua

SEQ ID NO: 2691820 - RNA, 21 nt, Haemophilus influenzae Rd
uacaucaggaggaauaaugaa

SEQ ID NO: 2691821 - RNA, 19 nt, Haemophilus influenzae Rd
uacaucaguaccuuuaauu

SEQ ID NO: 2691822 - RNA, 14 nt, Haemophilus influenzae Rd
uacaucauuccgcc

SEQ ID NO: 2691823 - RNA, 19 nt, Haemophilus influenzae Rd
uacauccacuuuuucugcc

SEQ ID NO: 2691824 - RNA, 23 nt, Haemophilus influenzae Rd
uacaucccauauacuugccaaaa

SEQ ID NO: 2691825 - RNA, 16 nt, Haemophilus influenzae Rd
uacaucuaaaauguca

SEQ ID NO: 2691826 - RNA, 13 nt, Haemophilus influenzae Rd
uacaucuaauuuu

SEQ ID NO: 2691827 - RNA, 17 nt, Haemophilus influenzae Rd
uacaucuucaaaaacau

SEQ ID NO: 2691828 - RNA, 13 nt, Haemophilus influenzae Rd
uacaucuucacaa

SEQ ID NO: 2691829 - RNA, 21 nt, Haemophilus influenzae Rd
uacauggaacguuuuuuacuu

SEQ ID NO: 2691830 - RNA, 14 nt, Haemophilus influenzae Rd
uacauuaaaaucaa

SEQ ID NO: 2691831 - RNA, 17 nt, Haemophilus influenzae Rd
uacauuaagugcgugua

SEQ ID NO: 2691832 - RNA, 21 nt, Haemophilus influenzae Rd
uacauuaagugcguguauaua

SEQ ID NO: 2691833 - RNA, 24 nt, Haemophilus influenzae Rd
uacauuaagugcguguauauauuu

SEQ ID NO: 2691834 - RNA, 16 nt, Haemophilus influenzae Rd
uacauuaauuuuuccg

SEQ ID NO: 2691835 - RNA, 14 nt, Haemophilus influenzae Rd
uacauuauuaaaag

SEQ ID NO: 2691836 - RNA, 16 nt, Haemophilus influenzae Rd
uacauuauuaaaagca

SEQ ID NO: 2691837 - RNA, 22 nt, Haemophilus influenzae Rd
uacauuauugaauuugguaaua

SEQ ID NO: 2691838 - RNA, 23 nt, Haemophilus influenzae Rd
uacauucaagccuucuaaaauaa

SEQ ID NO: 2691839 - RNA, 17 nt, Haemophilus influenzae Rd
uacauucuuccgcaauu

SEQ ID NO: 2691840 - RNA, 23 nt, Haemophilus influenzae Rd
uacauugaagcgggcgaugaaag

SEQ ID NO: 2691841 - RNA, 17 nt, Haemophilus influenzae Rd
uacauugcuauggcaau

SEQ ID NO: 2691842 - RNA, 12 nt, Haemophilus influenzae Rd
uacauugcuuaa

SEQ ID NO: 2691843 - RNA, 18 nt, Haemophilus influenzae Rd
uacauuguuucaaucacu

SEQ ID NO: 2691844 - RNA, 13 nt, Haemophilus influenzae Rd
uacauuuaaccaa

SEQ ID NO: 2691845 - RNA, 20 nt, Haemophilus influenzae Rd
uacauuuaaccaaaacguca

SEQ ID NO: 2691846 - RNA, 19 nt, Haemophilus influenzae Rd
uacgauaguaaaaaaucaa

SEQ ID NO: 2691847 - RNA, 19 nt, Haemophilus influenzae Rd
uacgaucacgauuuuucuc

SEQ ID NO: 2691848 - RNA, 14 nt, Haemophilus influenzae Rd
uacgaucugcaucu

SEQ ID NO: 2691849 - RNA, 21 nt, Haemophilus influenzae Rd
uacgaucugcaucuaauucac

SEQ ID NO: 2691850 - RNA, 17 nt, Haemophilus influenzae Rd
uacgauuuaauguauaa

SEQ ID NO: 2691851 - RNA, 21 nt, Haemophilus influenzae Rd
uacgauuuuccgaaaaaacaa

SEQ ID NO: 2691852 - RNA, 14 nt, Haemophilus influenzae Rd
uacgcaauuuagau

SEQ ID NO: 2691853 - RNA, 15 nt, Haemophilus influenzae Rd
uacgcauaucacgau

SEQ ID NO: 2691854 - RNA, 22 nt, Haemophilus influenzae Rd
uacgccaagacaguauuuagcg

SEQ ID NO: 2691855 - RNA, 14 nt, Haemophilus influenzae Rd
uacgccuaaugcau

SEQ ID NO: 2691856 - RNA, 23 nt, Haemophilus influenzae Rd
uacgcgcaauuucagcacccaca

SEQ ID NO: 2691857 - RNA, 17 nt, Haemophilus influenzae Rd
uacgcugaauagcaaau

SEQ ID NO: 2691858 - RNA, 17 nt, Haemophilus influenzae Rd
uacgcugcaucuuguuu

SEQ ID NO: 2691859 - RNA, 17 nt, Haemophilus influenzae Rd
uacgcuuacucauuuau

SEQ ID NO: 2691860 - RNA, 23 nt, Haemophilus influenzae Rd
uacgcuuggaaauguuuaauuau

SEQ ID NO: 2691861 - RNA, 18 nt, Haemophilus influenzae Rd
uacgcuuuacuacaucag

SEQ ID NO: 2691862 - RNA, 18 nt, Haemophilus influenzae Rd
uacggauacgaaucgacu

SEQ ID NO: 2691863 - RNA, 17 nt, Haemophilus influenzae Rd
uacggaugcaauccacu

SEQ ID NO: 2691864 - RNA, 22 nt, Haemophilus influenzae Rd
uacggauuuuugaacguuuuug

SEQ ID NO: 2691865 - RNA, 15 nt, Haemophilus influenzae Rd
uacggcaaacuaaag

SEQ ID NO: 2691866 - RNA, 22 nt, Haemophilus influenzae Rd
uacggcauaauccgcugcagcu

SEQ ID NO: 2691867 - RNA, 18 nt, Haemophilus influenzae Rd
uacggcuaaacgaucuaa

SEQ ID NO: 2691868 - RNA, 16 nt, Haemophilus influenzae Rd
uacgggauuuuuucgc

SEQ ID NO: 2691869 - RNA, 13 nt, Haemophilus influenzae Rd
uacgguuuuaaua

SEQ ID NO: 2691870 - RNA, 22 nt, Haemophilus influenzae Rd
uacguaauaaguuuucaucaau

SEQ ID NO: 2691871 - RNA, 22 nt, Haemophilus influenzae Rd
uacguaaucccauuucaucuuc

SEQ ID NO: 2691872 - RNA, 13 nt, Haemophilus influenzae Rd
uacguaauuuaau

SEQ ID NO: 2691873 - RNA, 17 nt, Haemophilus influenzae Rd
uacguagaaaacaauaa

SEQ ID NO: 2691874 - RNA, 21 nt, Haemophilus influenzae Rd
uacguagaaaacaauaaaaaa

SEQ ID NO: 2691875 - RNA, 19 nt, Haemophilus influenzae Rd
uacgucaauugcuaaaccu

SEQ ID NO: 2691876 - RNA, 15 nt, Haemophilus influenzae Rd
uacgugcaaauaaau

SEQ ID NO: 2691877 - RNA, 20 nt, Haemophilus influenzae Rd
uacgugcaaauaaauuuggu

SEQ ID NO: 2691878 - RNA, 16 nt, Haemophilus influenzae Rd
uacguguuaauaacca

SEQ ID NO: 2691879 - RNA, 15 nt, Haemophilus influenzae Rd
uacguguucaucauc

SEQ ID NO: 2691880 - RNA, 16 nt, Haemophilus influenzae Rd
uacguguuugguuuug

SEQ ID NO: 2691881 - RNA, 19 nt, Haemophilus influenzae Rd
uacguguuugguuuuggug

SEQ ID NO: 2691882 - RNA, 15 nt, Haemophilus influenzae Rd
uacguucaacaauca

SEQ ID NO: 2691883 - RNA, 16 nt, Haemophilus influenzae Rd
uacguucauauaaauu

SEQ ID NO: 2691884 - RNA, 17 nt, Haemophilus influenzae Rd
uacguucauauaaauuu

SEQ ID NO: 2691885 - RNA, 19 nt, Haemophilus influenzae Rd
uacguuguuguucuaacau

SEQ ID NO: 2691886 - RNA, 19 nt, Haemophilus influenzae Rd
uacguuguuguucuuucca

SEQ ID NO: 2691887 - RNA, 15 nt, Haemophilus influenzae Rd
uacguuuaguaaaau

SEQ ID NO: 2691888 - RNA, 23 nt, Haemophilus influenzae Rd
uacguuuaguaaaauaaaaaauc

SEQ ID NO: 2691889 - RNA, 16 nt, Haemophilus influenzae Rd
uacguuuuguuuuaau

SEQ ID NO: 2691890 - RNA, 14 nt, Haemophilus influenzae Rd
uacguuuuuccaua

SEQ ID NO: 2691891 - RNA, 14 nt, Haemophilus influenzae Rd
uacuaaaaaauuaa

SEQ ID NO: 2691892 - RNA, 17 nt, Haemophilus influenzae Rd
uacuaaaaaauuaaauu

SEQ ID NO: 2691893 - RNA, 21 nt, Haemophilus influenzae Rd
uacuaaaugugacauuguaaa

SEQ ID NO: 2691894 - RNA, 17 nt, Haemophilus influenzae Rd
uacuaacguuucuaaua

SEQ ID NO: 2691895 - RNA, 16 nt, Haemophilus influenzae Rd
uacuaacucaaaauac

SEQ ID NO: 2691896 - RNA, 14 nt, Haemophilus influenzae Rd
uacuaauuuuagua

SEQ ID NO: 2691897 - RNA, 17 nt, Haemophilus influenzae Rd
uacuacguguucaucau

SEQ ID NO: 2691898 - RNA, 18 nt, Haemophilus influenzae Rd
uacuagcaaaacaagaca

SEQ ID NO: 2691899 - RNA, 17 nt, Haemophilus influenzae Rd
uacuagcucguaaagau

SEQ ID NO: 2691900 - RNA, 19 nt, Haemophilus influenzae Rd
uacuagcucguaaagauca

SEQ ID NO: 2691901 - RNA, 13 nt, Haemophilus influenzae Rd
uacuauacacauc

SEQ ID NO: 2691902 - RNA, 16 nt, Haemophilus influenzae Rd
uacuauacacaucaga

SEQ ID NO: 2691903 - RNA, 15 nt, Haemophilus influenzae Rd
uacucacagagccuu

SEQ ID NO: 2691904 - RNA, 21 nt, Haemophilus influenzae Rd
uacucacagagccuuuuucua

SEQ ID NO: 2691905 - RNA, 17 nt, Haemophilus influenzae Rd
uacucauaucuaaagca

SEQ ID NO: 2691906 - RNA, 20 nt, Haemophilus influenzae Rd
uacucauaucuaaagcauua

SEQ ID NO: 2691907 - RNA, 14 nt, Haemophilus influenzae Rd
uacucaucugaauu

SEQ ID NO: 2691908 - RNA, 20 nt, Haemophilus influenzae Rd
uacucauuuaucaaacaagc

SEQ ID NO: 2691909 - RNA, 13 nt, Haemophilus influenzae Rd
uacucgaauuauu

SEQ ID NO: 2691910 - RNA, 22 nt, Haemophilus influenzae Rd
uacucgagcauaaacuaaaaua

SEQ ID NO: 2691911 - RNA, 20 nt, Haemophilus influenzae Rd
uacucguagaguuuuuucac

SEQ ID NO: 2691912 - RNA, 19 nt, Haemophilus influenzae Rd
uacucucccgaaaauuguu

SEQ ID NO: 2691913 - RNA, 14 nt, Haemophilus influenzae Rd
uacucuuaacaaaa

SEQ ID NO: 2691914 - RNA, 17 nt, Haemophilus influenzae Rd
uacucuuaauuuuugau

SEQ ID NO: 2691915 - RNA, 18 nt, Haemophilus influenzae Rd
uacucuugucaauaaauc

SEQ ID NO: 2691916 - RNA, 15 nt, Haemophilus influenzae Rd
uacucuuuuuuagau

SEQ ID NO: 2691917 - RNA, 13 nt, Haemophilus influenzae Rd
uacugaaccauag

SEQ ID NO: 2691918 - RNA, 12 nt, Haemophilus influenzae Rd
uacugaccuuua

SEQ ID NO: 2691919 - RNA, 15 nt, Haemophilus influenzae Rd
uacugagaucucuau

SEQ ID NO: 2691920 - RNA, 17 nt, Haemophilus influenzae Rd
uacugcagcauuuaaag

SEQ ID NO: 2691921 - RNA, 18 nt, Haemophilus influenzae Rd
uacugccuuuuucuucuu

SEQ ID NO: 2691922 - RNA, 17 nt, Haemophilus influenzae Rd
uacugcuuuauuuucuu

SEQ ID NO: 2691923 - RNA, 22 nt, Haemophilus influenzae Rd
uacuggaaauucuucaauaaca

SEQ ID NO: 2691924 - RNA, 14 nt, Haemophilus influenzae Rd
uacuggcucuucuu

SEQ ID NO: 2691925 - RNA, 15 nt, Haemophilus influenzae Rd
uacuggcucuucuuu

SEQ ID NO: 2691926 - RNA, 13 nt, Haemophilus influenzae Rd
uacugucaaucca

SEQ ID NO: 2691927 - RNA, 18 nt, Haemophilus influenzae Rd
uacugucaauccaugcca

SEQ ID NO: 2691928 - RNA, 16 nt, Haemophilus influenzae Rd
uacugucacaauauuu

SEQ ID NO: 2691929 - RNA, 19 nt, Haemophilus influenzae Rd
uacugucaccucguaaaau

SEQ ID NO: 2691930 - RNA, 20 nt, Haemophilus influenzae Rd
uacugucguguaaucgccuu

SEQ ID NO: 2691931 - RNA, 17 nt, Haemophilus influenzae Rd
uacugugccgauuacuu

SEQ ID NO: 2691932 - RNA, 17 nt, Haemophilus influenzae Rd
uacuguggauaauucau

SEQ ID NO: 2691933 - RNA, 20 nt, Haemophilus influenzae Rd
uacuguggauaauucaucaa

SEQ ID NO: 2691934 - RNA, 21 nt, Haemophilus influenzae Rd
uacuguuaccaauaacuaaaa

SEQ ID NO: 2691935 - RNA, 17 nt, Haemophilus influenzae Rd
uacuuaaaguuaucaaa

SEQ ID NO: 2691936 - RNA, 12 nt, Haemophilus influenzae Rd
uacuuaaaucuu

SEQ ID NO: 2691937 - RNA, 17 nt, Haemophilus influenzae Rd
uacuuaaaucuuuaccu

SEQ ID NO: 2691938 - RNA, 15 nt, Haemophilus influenzae Rd
uacuuaaucaaauaa

SEQ ID NO: 2691939 - RNA, 18 nt, Haemophilus influenzae Rd
uacuuaguaauauagcaa

SEQ ID NO: 2691940 - RNA, 20 nt, Haemophilus influenzae Rd
uacuucaccgugaaguugga

SEQ ID NO: 2691941 - RNA, 17 nt, Haemophilus influenzae Rd
uacuuccacuaguucau

SEQ ID NO: 2691942 - RNA, 14 nt, Haemophilus influenzae Rd
uacuucccaaauuu

SEQ ID NO: 2691943 - RNA, 16 nt, Haemophilus influenzae Rd
uacuuccgauuuuaau

SEQ ID NO: 2691944 - RNA, 17 nt, Haemophilus influenzae Rd
uacuuccgauuuuaauu

SEQ ID NO: 2691945 - RNA, 22 nt, Haemophilus influenzae Rd
uacuuccgauuuuaauugugca

SEQ ID NO: 2691946 - RNA, 14 nt, Haemophilus influenzae Rd
uacuucgcaggaau

SEQ ID NO: 2691947 - RNA, 14 nt, Haemophilus influenzae Rd
uacuucuaaacuua

SEQ ID NO: 2691948 - RNA, 16 nt, Haemophilus influenzae Rd
uacuucuaaaggcuaa

SEQ ID NO: 2691949 - RNA, 20 nt, Haemophilus influenzae Rd
uacuucuagaaaauaaccaa

SEQ ID NO: 2691950 - RNA, 17 nt, Haemophilus influenzae Rd
uacuucuuacaacaaau

SEQ ID NO: 2691951 - RNA, 23 nt, Haemophilus influenzae Rd
uagauaaacgcuguuuugcuucc

SEQ ID NO: 2691952 - RNA, 14 nt, Haemophilus influenzae Rd
uagauaaaguauaa

SEQ ID NO: 2691953 - RNA, 13 nt, Haemophilus influenzae Rd
uagauaaauauau

SEQ ID NO: 2691954 - RNA, 14 nt, Haemophilus influenzae Rd
uagauaaauuucaa

SEQ ID NO: 2691955 - RNA, 13 nt, Haemophilus influenzae Rd
uagauaacaaaag

SEQ ID NO: 2691956 - RNA, 14 nt, Haemophilus influenzae Rd
uagauaacaacuaa

SEQ ID NO: 2691957 - RNA, 18 nt, Haemophilus influenzae Rd
uagauaacaacuaaaaau

SEQ ID NO: 2691958 - RNA, 15 nt, Haemophilus influenzae Rd
uagauaacaaugaaa

SEQ ID NO: 2691959 - RNA, 17 nt, Haemophilus influenzae Rd
uagauaacguucauauu

SEQ ID NO: 2691960 - RNA, 13 nt, Haemophilus influenzae Rd
uagauaagaaaau

SEQ ID NO: 2691961 - RNA, 19 nt, Haemophilus influenzae Rd
uagauaagccauuaacauu

SEQ ID NO: 2691962 - RNA, 14 nt, Haemophilus influenzae Rd
uagauaauaaaaaa

SEQ ID NO: 2691963 - RNA, 15 nt, Haemophilus influenzae Rd
uagauaauacagaaa

SEQ ID NO: 2691964 - RNA, 21 nt, Haemophilus influenzae Rd
uagauaaucagcccaagcuuu

SEQ ID NO: 2691965 - RNA, 19 nt, Haemophilus influenzae Rd
uagauaaugguuacagaaa

SEQ ID NO: 2691966 - RNA, 16 nt, Haemophilus influenzae Rd
uagauacaagaaagaa

SEQ ID NO: 2691967 - RNA, 15 nt, Haemophilus influenzae Rd
uagauacauaaaaaa

SEQ ID NO: 2691968 - RNA, 13 nt, Haemophilus influenzae Rd
uagauagagccaa

SEQ ID NO: 2691969 - RNA, 12 nt, Haemophilus influenzae Rd
uagauaguuuuc

SEQ ID NO: 2691970 - RNA, 21 nt, Haemophilus influenzae Rd
uagauauuguucuacugguuu

SEQ ID NO: 2691971 - RNA, 13 nt, Haemophilus influenzae Rd
uagauauuucuca

SEQ ID NO: 2691972 - RNA, 20 nt, Haemophilus influenzae Rd
uagaucauaaaaaaauguag

SEQ ID NO: 2691973 - RNA, 15 nt, Haemophilus influenzae Rd
uagauccgcaauaua

SEQ ID NO: 2691974 - RNA, 14 nt, Haemophilus influenzae Rd
uagaugaaaugccg

SEQ ID NO: 2691975 - RNA, 17 nt, Haemophilus influenzae Rd
uagaugaauuagaaaaa

SEQ ID NO: 2691976 - RNA, 18 nt, Haemophilus influenzae Rd
uagaugacuggcaaaaau

SEQ ID NO: 2691977 - RNA, 22 nt, Haemophilus influenzae Rd
uagaugauuuuaaaauaaauuu

SEQ ID NO: 2691978 - RNA, 18 nt, Haemophilus influenzae Rd
uagaugauuuuaaaguaa

SEQ ID NO: 2691979 - RNA, 19 nt, Haemophilus influenzae Rd
uagaugauuuuaaaguaaa

SEQ ID NO: 2691980 - RNA, 20 nt, Haemophilus influenzae Rd
uagaugauuuuaaaguaaau

SEQ ID NO: 2691981 - RNA, 23 nt, Haemophilus influenzae Rd
uagauguaaccuuucgggaugug

SEQ ID NO: 2691982 - RNA, 15 nt, Haemophilus influenzae Rd
uagauguauguggcg

SEQ ID NO: 2691983 - RNA, 21 nt, Haemophilus influenzae Rd
uagaugucggcuauuuaagau

SEQ ID NO: 2691984 - RNA, 18 nt, Haemophilus influenzae Rd
uagaugugccauguacau

SEQ ID NO: 2691985 - RNA, 22 nt, Haemophilus influenzae Rd
uagaugugccauguacauuaau

SEQ ID NO: 2691986 - RNA, 22 nt, Haemophilus influenzae Rd
uagauuacacauuaacagaauu

SEQ ID NO: 2691987 - RNA, 16 nt, Haemophilus influenzae Rd
uagauuacagagccua

SEQ ID NO: 2691988 - RNA, 16 nt, Haemophilus influenzae Rd
uagauuacguagaaaa

SEQ ID NO: 2691989 - RNA, 24 nt, Haemophilus influenzae Rd
uagauuacguagaaaacaauaaaa

SEQ ID NO: 2691990 - RNA, 16 nt, Haemophilus influenzae Rd
uagauuacuuuuagau

SEQ ID NO: 2691991 - RNA, 18 nt, Haemophilus influenzae Rd
uagauuacuuuuagauaa

SEQ ID NO: 2691992 - RNA, 21 nt, Haemophilus influenzae Rd
uagauuagugugauuuuagaa

SEQ ID NO: 2691993 - RNA, 17 nt, Haemophilus influenzae Rd
uagauuaucauuaaaua

SEQ ID NO: 2691994 - RNA, 19 nt, Haemophilus influenzae Rd
uagauuaucgccuaaaauu

SEQ ID NO: 2691995 - RNA, 16 nt, Haemophilus influenzae Rd
uagauucggcuaaaac

SEQ ID NO: 2691996 - RNA, 19 nt, Haemophilus influenzae Rd
uagauugugaaauuucaua

SEQ ID NO: 2691997 - RNA, 21 nt, Haemophilus influenzae Rd
uagauuuaagcaauaaacaaa

SEQ ID NO: 2691998 - RNA, 14 nt, Haemophilus influenzae Rd
uagauuuauuucug

SEQ ID NO: 2691999 - RNA, 15 nt, Haemophilus influenzae Rd
uagauuugaaccuuc

SEQ ID NO: 2692000 - RNA, 16 nt, Haemophilus influenzae Rd
uagauuugaaucaauu

SEQ ID NO: 2692001 - RNA, 17 nt, Haemophilus influenzae Rd
uagauuuucuuauuaua

SEQ ID NO: 2692002 - RNA, 16 nt, Haemophilus influenzae Rd
uagauuuuuuacucaa

SEQ ID NO: 2692003 - RNA, 17 nt, Haemophilus influenzae Rd
uagauuuuuuacucaaa

SEQ ID NO: 2692004 - RNA, 20 nt, Haemophilus influenzae Rd
uagcaaaaaaccuuggaaua

SEQ ID NO: 2692005 - RNA, 19 nt, Haemophilus influenzae Rd
uagcaaaacaagacaaaau

SEQ ID NO: 2692006 - RNA, 20 nt, Haemophilus influenzae Rd
uagcaaacuagguaauaauc

SEQ ID NO: 2692007 - RNA, 21 nt, Haemophilus influenzae Rd
uagcaacgacacacuauuaau

SEQ ID NO: 2692008 - RNA, 16 nt, Haemophilus influenzae Rd
uagcaaggcguucaau

SEQ ID NO: 2692009 - RNA, 16 nt, Haemophilus influenzae Rd
uagcaaucaauuccuu

SEQ ID NO: 2692010 - RNA, 21 nt, Haemophilus influenzae Rd
uagcaaucuuuggcaaaaaau

SEQ ID NO: 2692011 - RNA, 18 nt, Haemophilus influenzae Rd
uagcaaugccaaucuaaa

SEQ ID NO: 2692012 - RNA, 13 nt, Haemophilus influenzae Rd
uagcaauguuuuc

SEQ ID NO: 2692013 - RNA, 13 nt, Haemophilus influenzae Rd
uagcacaaucgca

SEQ ID NO: 2692014 - RNA, 20 nt, Haemophilus influenzae Rd
uagcacaaucgcaucgucuu

SEQ ID NO: 2692015 - RNA, 15 nt, Haemophilus influenzae Rd
uagcacagaaaagau

SEQ ID NO: 2692016 - RNA, 22 nt, Haemophilus influenzae Rd
uagcacagaaaagauugcggca

SEQ ID NO: 2692017 - RNA, 17 nt, Haemophilus influenzae Rd
uagcacuuguuuuuagu

SEQ ID NO: 2692018 - RNA, 15 nt, Haemophilus influenzae Rd
uagcaggagaaagcu

SEQ ID NO: 2692019 - RNA, 22 nt, Haemophilus influenzae Rd
uagcagguuguuuuuguaaaau

SEQ ID NO: 2692020 - RNA, 13 nt, Haemophilus influenzae Rd
uagcauaaaacag

SEQ ID NO: 2692021 - RNA, 17 nt, Haemophilus influenzae Rd
uagcauaauaaaaaaac

SEQ ID NO: 2692022 - RNA, 15 nt, Haemophilus influenzae Rd
uagcauagauauauu

SEQ ID NO: 2692023 - RNA, 22 nt, Haemophilus influenzae Rd
uagcaucaaaauaaauaaaaua

SEQ ID NO: 2692024 - RNA, 18 nt, Haemophilus influenzae Rd
uagcaucugauuuucagg

SEQ ID NO: 2692025 - RNA, 21 nt, Haemophilus influenzae Rd
uagcauuaaagucuaauauga

SEQ ID NO: 2692026 - RNA, 20 nt, Haemophilus influenzae Rd
uagccauauccguaucauuu

SEQ ID NO: 2692027 - RNA, 21 nt, Haemophilus influenzae Rd
uagccauauuaucugcuggau

SEQ ID NO: 2692028 - RNA, 17 nt, Haemophilus influenzae Rd
uagccauuuuggaaugg

SEQ ID NO: 2692029 - RNA, 22 nt, Haemophilus influenzae Rd
uagcccaccaauuaaccauaaa

SEQ ID NO: 2692030 - RNA, 15 nt, Haemophilus influenzae Rd
uagccccaaauuacu

SEQ ID NO: 2692031 - RNA, 23 nt, Haemophilus influenzae Rd
uagcccgaaaauuaagaaaauaa

SEQ ID NO: 2692032 - RNA, 22 nt, Haemophilus influenzae Rd
uagcccuuacaccuauuauucc

SEQ ID NO: 2692033 - RNA, 18 nt, Haemophilus influenzae Rd
uagccguaaguuaaacca

SEQ ID NO: 2692034 - RNA, 20 nt, Haemophilus influenzae Rd
uagccguaaguuaaaccaac

SEQ ID NO: 2692035 - RNA, 21 nt, Haemophilus influenzae Rd
uagccguccauuucaaucacu

SEQ ID NO: 2692036 - RNA, 20 nt, Haemophilus influenzae Rd
uagccuaagauuuuaucuaa

SEQ ID NO: 2692037 - RNA, 19 nt, Haemophilus influenzae Rd
uagccucagguauuucuuc

SEQ ID NO: 2692038 - RNA, 17 nt, Haemophilus influenzae Rd
uagccuggcacuaagaa

SEQ ID NO: 2692039 - RNA, 15 nt, Haemophilus influenzae Rd
uagccuguucuucca

SEQ ID NO: 2692040 - RNA, 16 nt, Haemophilus influenzae Rd
uagccuguucuuccac

SEQ ID NO: 2692041 - RNA, 14 nt, Haemophilus influenzae Rd
uagccuuauuuugu

SEQ ID NO: 2692042 - RNA, 17 nt, Haemophilus influenzae Rd
uagccuuauuuugucuu

SEQ ID NO: 2692043 - RNA, 12 nt, Haemophilus influenzae Rd
uagccuucugcc

SEQ ID NO: 2692044 - RNA, 13 nt, Haemophilus influenzae Rd
uagcgaacaugcg

SEQ ID NO: 2692045 - RNA, 17 nt, Haemophilus influenzae Rd
uagcgaccaacaguuaa

SEQ ID NO: 2692046 - RNA, 19 nt, Haemophilus influenzae Rd
uagcgcagcguugauuaag

SEQ ID NO: 2692047 - RNA, 18 nt, Haemophilus influenzae Rd
uagcgcuguuacuucuuu

SEQ ID NO: 2692048 - RNA, 14 nt, Haemophilus influenzae Rd
uagcggauaaaaua

SEQ ID NO: 2692049 - RNA, 15 nt, Haemophilus influenzae Rd
uagcggauaaccaaa

SEQ ID NO: 2692050 - RNA, 18 nt, Haemophilus influenzae Rd
uagcggauucugcuacuu

SEQ ID NO: 2692051 - RNA, 12 nt, Haemophilus influenzae Rd
uagcguaaacau

SEQ ID NO: 2692052 - RNA, 23 nt, Haemophilus influenzae Rd
uagcguaaacauuuuguaucuaa

SEQ ID NO: 2692053 - RNA, 17 nt, Haemophilus influenzae Rd
uagcguaguauggcaag

SEQ ID NO: 2692054 - RNA, 16 nt, Haemophilus influenzae Rd
uagcuaacaaauuuaa

SEQ ID NO: 2692055 - RNA, 17 nt, Haemophilus influenzae Rd
uagcuaacaaauuuaau

SEQ ID NO: 2692056 - RNA, 16 nt, Haemophilus influenzae Rd
uaguugcgguggugaa

SEQ ID NO: 2692057 - RNA, 17 nt, Haemophilus influenzae Rd
uaguuggguaaucaaau

SEQ ID NO: 2692058 - RNA, 22 nt, Haemophilus influenzae Rd
uaguugguaaagauuguuuuuu

SEQ ID NO: 2692059 - RNA, 17 nt, Haemophilus influenzae Rd
uaguuguuuuaguucua

SEQ ID NO: 2692060 - RNA, 15 nt, Haemophilus influenzae Rd
uaguuuacuuuugau

SEQ ID NO: 2692061 - RNA, 13 nt, Haemophilus influenzae Rd
uaguuuagguuua

SEQ ID NO: 2692062 - RNA, 12 nt, Haemophilus influenzae Rd
uaguuuccccug

SEQ ID NO: 2692063 - RNA, 13 nt, Haemophilus influenzae Rd
uaguuucuucuuu

SEQ ID NO: 2692064 - RNA, 21 nt, Haemophilus influenzae Rd
uaguuuggcugaaauucuaaa

SEQ ID NO: 2692065 - RNA, 23 nt, Haemophilus influenzae Rd
uaguuuggcugaaauucuaaaaa

SEQ ID NO: 2692066 - RNA, 22 nt, Haemophilus influenzae Rd
uaguuuguauuugagcauuuaa

SEQ ID NO: 2692067 - RNA, 17 nt, Haemophilus influenzae Rd
uaguuuuaagguuguug

SEQ ID NO: 2692068 - RNA, 15 nt, Haemophilus influenzae Rd
uaguuuuauuuuaau

SEQ ID NO: 2692069 - RNA, 17 nt, Haemophilus influenzae Rd
uaguuuucaauaucaaa

SEQ ID NO: 2692070 - RNA, 16 nt, Haemophilus influenzae Rd
uaguuuuucacccauc

SEQ ID NO: 2692071 - RNA, 22 nt, Haemophilus influenzae Rd
uaguuuuucgcugcagcugcug

SEQ ID NO: 2692072 - RNA, 16 nt, Haemophilus influenzae Rd
uaguuuuugcauagcc

SEQ ID NO: 2692073 - RNA, 19 nt, Haemophilus influenzae Rd
uaguuuuuuuauaaaaaaa

SEQ ID NO: 2692074 - RNA, 23 nt, Haemophilus influenzae Rd
uauaaaaaaacuaaaaacaaaua

SEQ ID NO: 2692075 - RNA, 18 nt, Haemophilus influenzae Rd
uauaaaaaaaucugcacu

SEQ ID NO: 2692076 - RNA, 12 nt, Haemophilus influenzae Rd
uauaaaaaaucc

SEQ ID NO: 2692077 - RNA, 12 nt, Haemophilus influenzae Rd
uauaaaaaaucg

SEQ ID NO: 2692078 - RNA, 16 nt, Haemophilus influenzae Rd
uauaaaacuuuucuua

SEQ ID NO: 2692079 - RNA, 18 nt, Haemophilus influenzae Rd
uauaaaacuuuucuuaua

SEQ ID NO: 2692080 - RNA, 21 nt, Haemophilus influenzae Rd
uauaaaagugcgguaaaaauu

SEQ ID NO: 2692081 - RNA, 21 nt, Haemophilus influenzae Rd
uauaaaaguggaagucauuca

SEQ ID NO: 2692082 - RNA, 16 nt, Haemophilus influenzae Rd
uauaaaauaaagaaac

SEQ ID NO: 2692083 - RNA, 24 nt, Haemophilus influenzae Rd
uauaaaauauauaaucuucucuag

SEQ ID NO: 2692084 - RNA, 19 nt, Haemophilus influenzae Rd
uauaaaccaguuaaauccu

SEQ ID NO: 2692085 - RNA, 20 nt, Haemophilus influenzae Rd
uauaaacccaucauaaauau

SEQ ID NO: 2692086 - RNA, 22 nt, Haemophilus influenzae Rd
uauaaacggagcgauguuuucc

SEQ ID NO: 2692087 - RNA, 18 nt, Haemophilus influenzae Rd
uauaaacguugugaacuu

SEQ ID NO: 2692088 - RNA, 21 nt, Haemophilus influenzae Rd
uauaaagcucuaauugaaaua

SEQ ID NO: 2692089 - RNA, 22 nt, Haemophilus influenzae Rd
uauaaaggauuuuaucauugcu

SEQ ID NO: 2692090 - RNA, 15 nt, Haemophilus influenzae Rd
uauaaauaauuuucu

SEQ ID NO: 2692091 - RNA, 21 nt, Haemophilus influenzae Rd
uauaaauauuuaggcuauuuu

SEQ ID NO: 2692092 - RNA, 15 nt, Haemophilus influenzae Rd
uauaaauauuuccaa

SEQ ID NO: 2692093 - RNA, 23 nt, Haemophilus influenzae Rd
uauaaaugacauauaauauuaau

SEQ ID NO: 2692094 - RNA, 22 nt, Haemophilus influenzae Rd
uauaaauuaccuuguuuugcaa

SEQ ID NO: 2692095 - RNA, 18 nt, Haemophilus influenzae Rd
uauaaauuguuuuuccca

SEQ ID NO: 2692096 - RNA, 13 nt, Haemophilus influenzae Rd
uauaaauuuaaag

SEQ ID NO: 2692097 - RNA, 12 nt, Haemophilus influenzae Rd
uauaacaaauag

SEQ ID NO: 2692098 - RNA, 17 nt, Haemophilus influenzae Rd
uauaacacagaugaaaa

SEQ ID NO: 2692099 - RNA, 22 nt, Haemophilus influenzae Rd
uauaacauuuauuuuucuuaug

SEQ ID NO: 2692100 - RNA, 21 nt, Haemophilus influenzae Rd
uauaaccagauucaucaaagu

SEQ ID NO: 2692101 - RNA, 21 nt, Haemophilus influenzae Rd
uauaaccaguuauucuucaga

SEQ ID NO: 2692102 - RNA, 23 nt, Haemophilus influenzae Rd
uauaacguagcgauaaaauauau

SEQ ID NO: 2692103 - RNA, 15 nt, Haemophilus influenzae Rd
uauaacguuuaaaaa

SEQ ID NO: 2692104 - RNA, 16 nt, Haemophilus influenzae Rd
uauaacguuuaaaaau

SEQ ID NO: 2692105 - RNA, 20 nt, Haemophilus influenzae Rd
uauaacuaggcaucaaaauu

SEQ ID NO: 2692106 - RNA, 15 nt, Haemophilus influenzae Rd
uauaagaaaaacauu

SEQ ID NO: 2692107 - RNA, 17 nt, Haemophilus influenzae Rd
uauaagaaaauuaucug

SEQ ID NO: 2692108 - RNA, 15 nt, Haemophilus influenzae Rd
uauaagaaauaaucg

SEQ ID NO: 2692109 - RNA, 16 nt, Haemophilus influenzae Rd
uauaagccccuuguuu

SEQ ID NO: 2692110 - RNA, 18 nt, Haemophilus influenzae Rd
uauaagccgcaccaauaa

SEQ ID NO: 2692111 - RNA, 12 nt, Haemophilus influenzae Rd
uauaagcgaauu

SEQ ID NO: 2692112 - RNA, 19 nt, Haemophilus influenzae Rd
uauaagcgaauuacaucau

SEQ ID NO: 2692113 - RNA, 15 nt, Haemophilus influenzae Rd
uauaaggauguuugg

SEQ ID NO: 2692114 - RNA, 20 nt, Haemophilus influenzae Rd
uauaagggacgagaacugaa

SEQ ID NO: 2692115 - RNA, 13 nt, Haemophilus influenzae Rd
uauaagugauuaa

SEQ ID NO: 2692116 - RNA, 15 nt, Haemophilus influenzae Rd
uauaagugauuaaag

SEQ ID NO: 2692117 - RNA, 18 nt, Haemophilus influenzae Rd
uauaagugauuaaaguga

SEQ ID NO: 2692118 - RNA, 17 nt, Haemophilus influenzae Rd
uauaagugccaacaaua

SEQ ID NO: 2692119 - RNA, 18 nt, Haemophilus influenzae Rd
uauaagugccaacaauau

SEQ ID NO: 2692120 - RNA, 19 nt, Haemophilus influenzae Rd
uauaaguuauuuauauaau

SEQ ID NO: 2692121 - RNA, 18 nt, Haemophilus influenzae Rd
uauaaguuauuuuuacaa

SEQ ID NO: 2692122 - RNA, 15 nt, Haemophilus influenzae Rd
uauaaguuuuuugcc

SEQ ID NO: 2692123 - RNA, 13 nt, Haemophilus influenzae Rd
uauaauaaauaug

SEQ ID NO: 2692124 - RNA, 14 nt, Haemophilus influenzae Rd
uauaauacguaaau

SEQ ID NO: 2692125 - RNA, 15 nt, Haemophilus influenzae Rd
uauaauauuuaaauu

SEQ ID NO: 2692126 - RNA, 14 nt, Haemophilus influenzae Rd
uauaauauuuuggc

SEQ ID NO: 2692127 - RNA, 19 nt, Haemophilus influenzae Rd
uauaaucaauuauuucagc

SEQ ID NO: 2692128 - RNA, 15 nt, Haemophilus influenzae Rd
uauaaucaauuucua

SEQ ID NO: 2692129 - RNA, 13 nt, Haemophilus influenzae Rd
uauaaucauugcu

SEQ ID NO: 2692130 - RNA, 18 nt, Haemophilus influenzae Rd
uauaaucuccauaauauu

SEQ ID NO: 2692131 - RNA, 20 nt, Haemophilus influenzae Rd
uauaaucuucucuagucuug

SEQ ID NO: 2692132 - RNA, 13 nt, Haemophilus influenzae Rd
uauaaucuuuaaa

SEQ ID NO: 2692133 - RNA, 15 nt, Haemophilus influenzae Rd
uauaaucuuuaaauu

SEQ ID NO: 2692134 - RNA, 16 nt, Haemophilus influenzae Rd
uauaaucuuuaaauuu

SEQ ID NO: 2692135 - RNA, 20 nt, Haemophilus influenzae Rd
uauaaucuuuaaauuuugcu

SEQ ID NO: 2692136 - RNA, 23 nt, Haemophilus influenzae Rd
uauaaugcaccgcacacaacgac

SEQ ID NO: 2692137 - RNA, 17 nt, Haemophilus influenzae Rd
uauaaugucaucuagua

SEQ ID NO: 2692138 - RNA, 13 nt, Haemophilus influenzae Rd
uauaauuaaacau

SEQ ID NO: 2692139 - RNA, 17 nt, Haemophilus influenzae Rd
uauaauuaauaaaaaau

SEQ ID NO: 2692140 - RNA, 21 nt, Haemophilus influenzae Rd
uauaauuaauaaaaaaucugu

SEQ ID NO: 2692141 - RNA, 19 nt, Haemophilus influenzae Rd
uauaauuccuaaaauacaa

SEQ ID NO: 2692142 - RNA, 15 nt, Haemophilus influenzae Rd
uauaauuuaacauaa

SEQ ID NO: 2692143 - RNA, 13 nt, Haemophilus influenzae Rd
uauaauuuacugu

SEQ ID NO: 2692144 - RNA, 18 nt, Haemophilus influenzae Rd
uauaauuuccuauacuaa

SEQ ID NO: 2692145 - RNA, 19 nt, Haemophilus influenzae Rd
uauaauuuccuauacuaau

SEQ ID NO: 2692146 - RNA, 23 nt, Haemophilus influenzae Rd
uauaauuucgccauuuuuuccua

SEQ ID NO: 2692147 - RNA, 13 nt, Haemophilus influenzae Rd
uauaauuuuagaa

SEQ ID NO: 2692148 - RNA, 21 nt, Haemophilus influenzae Rd
uauaauuuuagaacuuagccu

SEQ ID NO: 2692149 - RNA, 13 nt, Haemophilus influenzae Rd
uauacaacaaaaa

SEQ ID NO: 2692150 - RNA, 13 nt, Haemophilus influenzae Rd
uauacaauucuug

SEQ ID NO: 2692151 - RNA, 21 nt, Haemophilus influenzae Rd
uauacaauucuuguuuaauau

SEQ ID NO: 2692152 - RNA, 22 nt, Haemophilus influenzae Rd
uauacaucaggaggaauaauga

SEQ ID NO: 2692153 - RNA, 17 nt, Haemophilus influenzae Rd
uauacaucucauaaagu

SEQ ID NO: 2692154 - RNA, 14 nt, Haemophilus influenzae Rd
uauacauuaacaau

SEQ ID NO: 2692155 - RNA, 19 nt, Haemophilus influenzae Rd
uauaccauucuuucaauaa

SEQ ID NO: 2692156 - RNA, 20 nt, Haemophilus influenzae Rd
uauaccauucuuucaauaau

SEQ ID NO: 2692157 - RNA, 21 nt, Haemophilus influenzae Rd
uauacgaucacgauuuuucuc

SEQ ID NO: 2692158 - RNA, 21 nt, Haemophilus influenzae Rd
uauacuaauuuuaguauucuu

SEQ ID NO: 2692159 - RNA, 22 nt, Haemophilus influenzae Rd
uauacucguucguuauuuugau

SEQ ID NO: 2692160 - RNA, 18 nt, Haemophilus influenzae Rd
uauacugccuuuaaagaa

SEQ ID NO: 2692161 - RNA, 15 nt, Haemophilus influenzae Rd
uaucaggcuuaacuu

SEQ ID NO: 2692162 - RNA, 18 nt, Haemophilus influenzae Rd
uaucauaaacaauuucau

SEQ ID NO: 2692163 - RNA, 16 nt, Haemophilus influenzae Rd
uaucauacuaaaaaau

SEQ ID NO: 2692164 - RNA, 23 nt, Haemophilus influenzae Rd
uaucauaucgagcagacaaaauu

SEQ ID NO: 2692165 - RNA, 14 nt, Haemophilus influenzae Rd
uaucaucaagauuu

SEQ ID NO: 2692166 - RNA, 17 nt, Haemophilus influenzae Rd
uaucaucaauaucugca

SEQ ID NO: 2692167 - RNA, 20 nt, Haemophilus influenzae Rd
uaucaucauuuuuauuuaau

SEQ ID NO: 2692168 - RNA, 14 nt, Haemophilus influenzae Rd
uaucauccgcuugu

SEQ ID NO: 2692169 - RNA, 18 nt, Haemophilus influenzae Rd
uaucaucuagauuucuau

SEQ ID NO: 2692170 - RNA, 13 nt, Haemophilus influenzae Rd
uaucauuaaucuu

SEQ ID NO: 2692171 - RNA, 21 nt, Haemophilus influenzae Rd
uaucauugcuccacuucuuau

SEQ ID NO: 2692172 - RNA, 13 nt, Haemophilus influenzae Rd
uaucauuuaacuu

SEQ ID NO: 2692173 - RNA, 17 nt, Haemophilus influenzae Rd
uaucauuuaauaauuua

SEQ ID NO: 2692174 - RNA, 18 nt, Haemophilus influenzae Rd
uaucauuuaauaauuuag

SEQ ID NO: 2692175 - RNA, 19 nt, Haemophilus influenzae Rd
uaucauuugaauuaauaac

SEQ ID NO: 2692176 - RNA, 22 nt, Haemophilus influenzae Rd
uauccaaaucaaaaagcuacug

SEQ ID NO: 2692177 - RNA, 16 nt, Haemophilus influenzae Rd
uauccaaauugagauc

SEQ ID NO: 2692178 - RNA, 18 nt, Haemophilus influenzae Rd
uauccaagaaguuuucca

SEQ ID NO: 2692179 - RNA, 11 nt, Haemophilus influenzae Rd
uauccacaaaa

SEQ ID NO: 2692180 - RNA, 21 nt, Haemophilus influenzae Rd
uauccacauaaccaaagggca

SEQ ID NO: 2692181 - RNA, 13 nt, Haemophilus influenzae Rd
uauccaccacaau

SEQ ID NO: 2692182 - RNA, 17 nt, Haemophilus influenzae Rd
uaucccaacagaaaauu

SEQ ID NO: 2692183 - RNA, 19 nt, Haemophilus influenzae Rd
uaucccaacagaaaauuug

SEQ ID NO: 2692184 - RNA, 14 nt, Haemophilus influenzae Rd
uaucccaacuuuau

SEQ ID NO: 2692185 - RNA, 14 nt, Haemophilus influenzae Rd
uaucccauugugca

SEQ ID NO: 2692186 - RNA, 23 nt, Haemophilus influenzae Rd
uauccgagcucuuucauuaaauu

SEQ ID NO: 2692187 - RNA, 13 nt, Haemophilus influenzae Rd
uauccgcauugcc

SEQ ID NO: 2692188 - RNA, 18 nt, Haemophilus influenzae Rd
uauccguuacauuauuua

SEQ ID NO: 2692189 - RNA, 16 nt, Haemophilus influenzae Rd
uauccuguuguuuuuu

SEQ ID NO: 2692190 - RNA, 21 nt, Haemophilus influenzae Rd
uaucgaauagauuuuuaccaa

SEQ ID NO: 2692191 - RNA, 21 nt, Haemophilus influenzae Rd
uaucgacaaauuaauaagaaa

SEQ ID NO: 2692192 - RNA, 18 nt, Haemophilus influenzae Rd
uaucgagaaaauuaaaaa

SEQ ID NO: 2692193 - RNA, 14 nt, Haemophilus influenzae Rd
uaucgaggacaauc

SEQ ID NO: 2692194 - RNA, 14 nt, Haemophilus influenzae Rd
uaucgcacuuuuuu

SEQ ID NO: 2692195 - RNA, 19 nt, Haemophilus influenzae Rd
uaucggagggggauuuucu

SEQ ID NO: 2692196 - RNA, 21 nt, Haemophilus influenzae Rd
uaucggagggggauuuucucg

SEQ ID NO: 2692197 - RNA, 15 nt, Haemophilus influenzae Rd
uaucgggaauaauau

SEQ ID NO: 2692198 - RNA, 18 nt, Haemophilus influenzae Rd
uaucguauucccaaauuu

SEQ ID NO: 2692199 - RNA, 14 nt, Haemophilus influenzae Rd
uaucgucaaauuua

SEQ ID NO: 2692200 - RNA, 15 nt, Haemophilus influenzae Rd
uaucgucaaauuuaa

SEQ ID NO: 2692201 - RNA, 19 nt, Haemophilus influenzae Rd
uaucgucaaauuuaaauag

SEQ ID NO: 2692202 - RNA, 17 nt, Haemophilus influenzae Rd
uaucgucuuguuuucaa

SEQ ID NO: 2692203 - RNA, 18 nt, Haemophilus influenzae Rd
uaucguguaaaaguuguu

SEQ ID NO: 2692204 - RNA, 14 nt, Haemophilus influenzae Rd
uaucuaaaaagauu

SEQ ID NO: 2692205 - RNA, 12 nt, Haemophilus influenzae Rd
uaucuaaaagua

SEQ ID NO: 2692206 - RNA, 13 nt, Haemophilus influenzae Rd
uaucuaaaauaua

SEQ ID NO: 2692207 - RNA, 13 nt, Haemophilus influenzae Rd
uaucuaaacuuca

SEQ ID NO: 2692208 - RNA, 13 nt, Haemophilus influenzae Rd
uaucuaaaucucu

SEQ ID NO: 2692209 - RNA, 21 nt, Haemophilus influenzae Rd
uaucuaaaugacgugcuaauu

SEQ ID NO: 2692210 - RNA, 20 nt, Haemophilus influenzae Rd
uaucuaagaaaauagaagcc

SEQ ID NO: 2692211 - RNA, 17 nt, Haemophilus influenzae Rd
uaucuaagauaaauuua

SEQ ID NO: 2692212 - RNA, 19 nt, Haemophilus influenzae Rd
uaucuacaaucaaaaaauc

SEQ ID NO: 2692213 - RNA, 18 nt, Haemophilus influenzae Rd
uaucuacuagccaaucau

SEQ ID NO: 2692214 - RNA, 19 nt, Haemophilus influenzae Rd
uaucuacuagccaaucaua

SEQ ID NO: 2692215 - RNA, 19 nt, Haemophilus influenzae Rd
uaucuacugcuucauaaaa

SEQ ID NO: 2692216 - RNA, 14 nt, Haemophilus influenzae Rd
uaucuacuuucagg

SEQ ID NO: 2692217 - RNA, 15 nt, Haemophilus influenzae Rd
uaucuagaaaacuca

SEQ ID NO: 2692218 - RNA, 14 nt, Haemophilus influenzae Rd
uaucuagcacaaag

SEQ ID NO: 2692219 - RNA, 16 nt, Haemophilus influenzae Rd
uaucuagcacaaagac

SEQ ID NO: 2692220 - RNA, 14 nt, Haemophilus influenzae Rd
uaucuauaaaaaga

SEQ ID NO: 2692221 - RNA, 16 nt, Haemophilus influenzae Rd
uaucuaucuuguaauu

SEQ ID NO: 2692222 - RNA, 18 nt, Haemophilus influenzae Rd
uaucuauugagauuuaau

SEQ ID NO: 2692223 - RNA, 20 nt, Haemophilus influenzae Rd
uaucucauccacuaaaccau

SEQ ID NO: 2692224 - RNA, 18 nt, Haemophilus influenzae Rd
uaucucggcuaaaaucug

SEQ ID NO: 2692225 - RNA, 20 nt, Haemophilus influenzae Rd
uaucucuaaaaaauaaccgc

SEQ ID NO: 2692226 - RNA, 14 nt, Haemophilus influenzae Rd
uaucugcucucauu

SEQ ID NO: 2692227 - RNA, 12 nt, Haemophilus influenzae Rd
uaucugcuuuuu

SEQ ID NO: 2692228 - RNA, 21 nt, Haemophilus influenzae Rd
uaucuggauguuguaaaauau

SEQ ID NO: 2692229 - RNA, 18 nt, Haemophilus influenzae Rd
uaucugucauauaaccac

SEQ ID NO: 2692230 - RNA, 17 nt, Haemophilus influenzae Rd
uaucugucauuguaauu

SEQ ID NO: 2692231 - RNA, 14 nt, Haemophilus influenzae Rd
uaucuuauauuuuu

SEQ ID NO: 2692232 - RNA, 17 nt, Haemophilus influenzae Rd
uaucuucaauuucuacc

SEQ ID NO: 2692233 - RNA, 15 nt, Haemophilus influenzae Rd
uaucuucauaucuuu

SEQ ID NO: 2692234 - RNA, 15 nt, Haemophilus influenzae Rd
uaucuuccguuguuu

SEQ ID NO: 2692235 - RNA, 22 nt, Haemophilus influenzae Rd
uaucuucuucuuggcaauauuu

SEQ ID NO: 2692236 - RNA, 17 nt, Haemophilus influenzae Rd
uaucuugcuuuuuuaau

SEQ ID NO: 2692237 - RNA, 19 nt, Haemophilus influenzae Rd
uaucuuuacccuauuacuu

SEQ ID NO: 2692238 - RNA, 17 nt, Haemophilus influenzae Rd
uaucuuuauuauuucug

SEQ ID NO: 2692239 - RNA, 21 nt, Haemophilus influenzae Rd
uaucuuuugguaaauacuguu

SEQ ID NO: 2692240 - RNA, 15 nt, Haemophilus influenzae Rd
uaucuuuuuguaauu

SEQ ID NO: 2692241 - RNA, 22 nt, Haemophilus influenzae Rd
uaugaaaaaaccgacuuuauau

SEQ ID NO: 2692242 - RNA, 13 nt, Haemophilus influenzae Rd
uaugaaaaauaau

SEQ ID NO: 2692243 - RNA, 16 nt, Haemophilus influenzae Rd
uaugaaaaauaaucau

SEQ ID NO: 2692244 - RNA, 20 nt, Haemophilus influenzae Rd
uaugaaaaaugcuuguucug

SEQ ID NO: 2692245 - RNA, 23 nt, Haemophilus influenzae Rd
uaugaaaacgcgagguugaagua

SEQ ID NO: 2692246 - RNA, 15 nt, Haemophilus influenzae Rd
uaugaaacagcuaaa

SEQ ID NO: 2692247 - RNA, 21 nt, Haemophilus influenzae Rd
uaugaaacgcgaguaaaauaa

SEQ ID NO: 2692248 - RNA, 23 nt, Haemophilus influenzae Rd
uaugaaacgcgaguaaaauaaaa

SEQ ID NO: 2692249 - RNA, 19 nt, Haemophilus influenzae Rd
uaugaaagccaaugcggcu

SEQ ID NO: 2692250 - RNA, 18 nt, Haemophilus influenzae Rd
uaugaaauugcuguaaug

SEQ ID NO: 2692251 - RNA, 14 nt, Haemophilus influenzae Rd
uaugaaauuucuuu

SEQ ID NO: 2692252 - RNA, 20 nt, Haemophilus influenzae Rd
uaugaagaacaaggggaaaa

SEQ ID NO: 2692253 - RNA, 15 nt, Haemophilus influenzae Rd
uaugaagacuaaaca

SEQ ID NO: 2692254 - RNA, 18 nt, Haemophilus influenzae Rd
uaugaagacuaaacagaa

SEQ ID NO: 2692255 - RNA, 20 nt, Haemophilus influenzae Rd
uaugaagacuaaacagaauu

SEQ ID NO: 2692256 - RNA, 18 nt, Haemophilus influenzae Rd
uaugaauaacuuuaauuu

SEQ ID NO: 2692257 - RNA, 18 nt, Haemophilus influenzae Rd
uaugaauaagcgaaaaac

SEQ ID NO: 2692258 - RNA, 21 nt, Haemophilus influenzae Rd
uaugaauaagcgaaaaacaua

SEQ ID NO: 2692259 - RNA, 21 nt, Haemophilus influenzae Rd
uaugaauggcgucugcaauua

SEQ ID NO: 2692260 - RNA, 14 nt, Haemophilus influenzae Rd
uaugaauguuucaa

SEQ ID NO: 2692261 - RNA, 13 nt, Haemophilus influenzae Rd
uaugaccaaauac

SEQ ID NO: 2692262 - RNA, 14 nt, Haemophilus influenzae Rd
uaugaccauuaauc

SEQ ID NO: 2692263 - RNA, 19 nt, Haemophilus influenzae Rd
uaugaccauuaaucacacu

SEQ ID NO: 2692264 - RNA, 23 nt, Haemophilus influenzae Rd
uaugacgaacgugggaauuuucc

SEQ ID NO: 2692265 - RNA, 14 nt, Haemophilus influenzae Rd
uaugacuaauuaau

SEQ ID NO: 2692266 - RNA, 23 nt, Haemophilus influenzae Rd
uaugacuuagggcucaaaucuac

SEQ ID NO: 2692267 - RNA, 22 nt, Haemophilus influenzae Rd
uauuaugugcuugggcaauuaa

SEQ ID NO: 2692268 - RNA, 15 nt, Haemophilus influenzae Rd
uauuauguucucuca

SEQ ID NO: 2692269 - RNA, 13 nt, Haemophilus influenzae Rd
uauuauguuuugu

SEQ ID NO: 2692270 - RNA, 16 nt, Haemophilus influenzae Rd
uauuauguuuuguaga

SEQ ID NO: 2692271 - RNA, 13 nt, Haemophilus influenzae Rd
uauuauuccuuuc

SEQ ID NO: 2692272 - RNA, 13 nt, Haemophilus influenzae Rd
uauuauugugaua

SEQ ID NO: 2692273 - RNA, 23 nt, Haemophilus influenzae Rd
uauuauuuaaauggaacuuguuu

SEQ ID NO: 2692274 - RNA, 16 nt, Haemophilus influenzae Rd
uauuauuuauuuugaa

SEQ ID NO: 2692275 - RNA, 23 nt, Haemophilus influenzae Rd
uauucaaacgcccuucaccuucg

SEQ ID NO: 2692276 - RNA, 21 nt, Haemophilus influenzae Rd
uauucaaacucuaauuccacc

SEQ ID NO: 2692277 - RNA, 13 nt, Haemophilus influenzae Rd
uauucaaauuuca

SEQ ID NO: 2692278 - RNA, 23 nt, Haemophilus influenzae Rd
uauucaaggagcuuuauuauugg

SEQ ID NO: 2692279 - RNA, 13 nt, Haemophilus influenzae Rd
uauucaauaauau

SEQ ID NO: 2692280 - RNA, 14 nt, Haemophilus influenzae Rd
uauucaauaauaua

SEQ ID NO: 2692281 - RNA, 18 nt, Haemophilus influenzae Rd
uauucaauaauauauuua

SEQ ID NO: 2692282 - RNA, 17 nt, Haemophilus influenzae Rd
uauucagcaaaaucacu

SEQ ID NO: 2692283 - RNA, 19 nt, Haemophilus influenzae Rd
uauucagcaaaaucacucg

SEQ ID NO: 2692284 - RNA, 20 nt, Haemophilus influenzae Rd
uauucagcaaccuaaauugu

SEQ ID NO: 2692285 - RNA, 18 nt, Haemophilus influenzae Rd
uauucagcacuuucgcuu

SEQ ID NO: 2692286 - RNA, 22 nt, Haemophilus influenzae Rd
uauucaguaaacaaguauaaaa

SEQ ID NO: 2692287 - RNA, 13 nt, Haemophilus influenzae Rd
uauucauaaauuc

SEQ ID NO: 2692288 - RNA, 15 nt, Haemophilus influenzae Rd
uauucauaccgauaa

SEQ ID NO: 2692289 - RNA, 13 nt, Haemophilus influenzae Rd
uauucaucgccaa

SEQ ID NO: 2692290 - RNA, 21 nt, Haemophilus influenzae Rd
uauucaucgccaaauuuacuu

SEQ ID NO: 2692291 - RNA, 22 nt, Haemophilus influenzae Rd
uauucaugagcugggcaaacaa

SEQ ID NO: 2692292 - RNA, 21 nt, Haemophilus influenzae Rd
uauucaugauguaauucugcu

SEQ ID NO: 2692293 - RNA, 17 nt, Haemophilus influenzae Rd
uauucauuuaaaacaaa

SEQ ID NO: 2692294 - RNA, 12 nt, Haemophilus influenzae Rd
uauuccaccaca

SEQ ID NO: 2692295 - RNA, 19 nt, Haemophilus influenzae Rd
uauucccaaauuuuuuguu

SEQ ID NO: 2692296 - RNA, 13 nt, Haemophilus influenzae Rd
uauucccaaggcu

SEQ ID NO: 2692297 - RNA, 16 nt, Haemophilus influenzae Rd
uauucccaaggcucca

SEQ ID NO: 2692298 - RNA, 22 nt, Haemophilus influenzae Rd
uauucccuauacuccacuauaa

SEQ ID NO: 2692299 - RNA, 16 nt, Haemophilus influenzae Rd
uauuccuuacaacaaa

SEQ ID NO: 2692300 - RNA, 20 nt, Haemophilus influenzae Rd
uauuccuuucuuuauuucau

SEQ ID NO: 2692301 - RNA, 21 nt, Haemophilus influenzae Rd
uauucgacaggaacauucaca

SEQ ID NO: 2692302 - RNA, 16 nt, Haemophilus influenzae Rd
uauucgccuucacaaa

SEQ ID NO: 2692303 - RNA, 17 nt, Haemophilus influenzae Rd
uauucgcugcaaaauca

SEQ ID NO: 2692304 - RNA, 17 nt, Haemophilus influenzae Rd
uauucgggcuucucaaa

SEQ ID NO: 2692305 - RNA, 22 nt, Haemophilus influenzae Rd
uauucuaaccgcacuuuuuaau

SEQ ID NO: 2692306 - RNA, 19 nt, Haemophilus influenzae Rd
uauucuaccgcauuuuuaa

SEQ ID NO: 2692307 - RNA, 16 nt, Haemophilus influenzae Rd
uauucuauaucugaua

SEQ ID NO: 2692308 - RNA, 20 nt, Haemophilus influenzae Rd
uauucuccaaauauaaaaua

SEQ ID NO: 2692309 - RNA, 21 nt, Haemophilus influenzae Rd
uauucuccaaauauaaaauaa

SEQ ID NO: 2692310 - RNA, 21 nt, Haemophilus influenzae Rd
uauucuccuugguuuucuugc

SEQ ID NO: 2692311 - RNA, 24 nt, Haemophilus influenzae Rd
uauucuccuugguuuucuugccaa

SEQ ID NO: 2692312 - RNA, 22 nt, Haemophilus influenzae Rd
uauucugaaaccacuaaaaaca

SEQ ID NO: 2692313 - RNA, 19 nt, Haemophilus influenzae Rd
uauucuggcaauauuucaa

SEQ ID NO: 2692314 - RNA, 20 nt, Haemophilus influenzae Rd
uauucuggcaauauuucaau

SEQ ID NO: 2692315 - RNA, 21 nt, Haemophilus influenzae Rd
uauucuguaucaauuccuuca

SEQ ID NO: 2692316 - RNA, 14 nt, Haemophilus influenzae Rd
uauucuguugaaug

SEQ ID NO: 2692317 - RNA, 14 nt, Haemophilus influenzae Rd
uauucuucaauaga

SEQ ID NO: 2692318 - RNA, 22 nt, Haemophilus influenzae Rd
uauucuucagaacugcuuucuu

SEQ ID NO: 2692319 - RNA, 16 nt, Haemophilus influenzae Rd
uauucuucaucuucuu

SEQ ID NO: 2692320 - RNA, 17 nt, Haemophilus influenzae Rd
uauucuucgcuuaaugg

SEQ ID NO: 2692321 - RNA, 17 nt, Haemophilus influenzae Rd
uauucuucuaaaagauc

SEQ ID NO: 2692322 - RNA, 19 nt, Haemophilus influenzae Rd
uauucuuggagauaauauu

SEQ ID NO: 2692323 - RNA, 20 nt, Haemophilus influenzae Rd
uauucuuuccucuccaucau

SEQ ID NO: 2692324 - RNA, 19 nt, Haemophilus influenzae Rd
uauucuuuuuaaauauuua

SEQ ID NO: 2692325 - RNA, 15 nt, Haemophilus influenzae Rd
uauugaaauuuuaau

SEQ ID NO: 2692326 - RNA, 19 nt, Haemophilus influenzae Rd
uauugaaauuuuaauuuag

SEQ ID NO: 2692327 - RNA, 19 nt, Haemophilus influenzae Rd
uauugaaccauuuuacaau

SEQ ID NO: 2692328 - RNA, 21 nt, Haemophilus influenzae Rd
uauugaagaguaaaacuaauu

SEQ ID NO: 2692329 - RNA, 16 nt, Haemophilus influenzae Rd
uauugacaaagucggu

SEQ ID NO: 2692330 - RNA, 16 nt, Haemophilus influenzae Rd
uauugagauuuaauuu

SEQ ID NO: 2692331 - RNA, 15 nt, Haemophilus influenzae Rd
uauugagcaauaaau

SEQ ID NO: 2692332 - RNA, 17 nt, Haemophilus influenzae Rd
uauugagcgauugaacu

SEQ ID NO: 2692333 - RNA, 18 nt, Haemophilus influenzae Rd
uauugaguagcugaauau

SEQ ID NO: 2692334 - RNA, 15 nt, Haemophilus influenzae Rd
uauugauauuaauuu

SEQ ID NO: 2692335 - RNA, 22 nt, Haemophilus influenzae Rd
uauugaucgccuaaauacauuu

SEQ ID NO: 2692336 - RNA, 21 nt, Haemophilus influenzae Rd
uauugauguuuguaggaaaua

SEQ ID NO: 2692337 - RNA, 14 nt, Haemophilus influenzae Rd
uauugauucaauuc

SEQ ID NO: 2692338 - RNA, 13 nt, Haemophilus influenzae Rd
uauugauucuaaa

SEQ ID NO: 2692339 - RNA, 20 nt, Haemophilus influenzae Rd
uauugcauaaucauaucuaa

SEQ ID NO: 2692340 - RNA, 15 nt, Haemophilus influenzae Rd
uauugcgccuuguug

SEQ ID NO: 2692341 - RNA, 15 nt, Haemophilus influenzae Rd
uauugcggguuuuau

SEQ ID NO: 2692342 - RNA, 17 nt, Haemophilus influenzae Rd
uauugcucaauuaagcu

SEQ ID NO: 2692343 - RNA, 12 nt, Haemophilus influenzae Rd
uauugcucuccc

SEQ ID NO: 2692344 - RNA, 14 nt, Haemophilus influenzae Rd
uauugcuuaugauu

SEQ ID NO: 2692345 - RNA, 18 nt, Haemophilus influenzae Rd
uauugcuugcauucacaa

SEQ ID NO: 2692346 - RNA, 15 nt, Haemophilus influenzae Rd
uauuggaaaauucaa

SEQ ID NO: 2692347 - RNA, 13 nt, Haemophilus influenzae Rd
uauuggaauggca

SEQ ID NO: 2692348 - RNA, 19 nt, Haemophilus influenzae Rd
uauuggauuuacuuuaaug

SEQ ID NO: 2692349 - RNA, 14 nt, Haemophilus influenzae Rd
uauuggcaauuucc

SEQ ID NO: 2692350 - RNA, 13 nt, Haemophilus influenzae Rd
uauuguacucaau

SEQ ID NO: 2692351 - RNA, 19 nt, Haemophilus influenzae Rd
uauuguaguaauaaaaagc

SEQ ID NO: 2692352 - RNA, 15 nt, Haemophilus influenzae Rd
uauugucuauuuuau

SEQ ID NO: 2692353 - RNA, 13 nt, Haemophilus influenzae Rd
uauugucugcaac

SEQ ID NO: 2692354 - RNA, 22 nt, Haemophilus influenzae Rd
uauugugucacuagauuuucuu

SEQ ID NO: 2692355 - RNA, 20 nt, Haemophilus influenzae Rd
uauuguucuaaaucauauuu

SEQ ID NO: 2692356 - RNA, 15 nt, Haemophilus influenzae Rd
uauuguuugcuuugg

SEQ ID NO: 2692357 - RNA, 19 nt, Haemophilus influenzae Rd
uauuguuuuuuucuaaaua

SEQ ID NO: 2692358 - RNA, 21 nt, Haemophilus influenzae Rd
uauuuaaaaucagcccuuauu

SEQ ID NO: 2692359 - RNA, 17 nt, Haemophilus influenzae Rd
uauuuaaaccauuuuaa

SEQ ID NO: 2692360 - RNA, 21 nt, Haemophilus influenzae Rd
uauuuaaauacacuucuaaaa

SEQ ID NO: 2692361 - RNA, 22 nt, Haemophilus influenzae Rd
uauuuaaauacacuucuaaaau

SEQ ID NO: 2692362 - RNA, 14 nt, Haemophilus influenzae Rd
uauuuaaauuaaaa

SEQ ID NO: 2692363 - RNA, 15 nt, Haemophilus influenzae Rd
uauuuaaauuaaaaa

SEQ ID NO: 2692364 - RNA, 22 nt, Haemophilus influenzae Rd
uauuuaagcuauuguuauagaa

SEQ ID NO: 2692365 - RNA, 19 nt, Haemophilus influenzae Rd
uauuuaagcugaaauuuag

SEQ ID NO: 2692366 - RNA, 22 nt, Haemophilus influenzae Rd
uauuuaagcuuuccuauucuaa

SEQ ID NO: 2692367 - RNA, 18 nt, Haemophilus influenzae Rd
uauuuaaguaaugcuaaa

SEQ ID NO: 2692368 - RNA, 14 nt, Haemophilus influenzae Rd
uauuuaauaaaaug

SEQ ID NO: 2692369 - RNA, 15 nt, Haemophilus influenzae Rd
uauuuaauaaaaugu

SEQ ID NO: 2692370 - RNA, 13 nt, Haemophilus influenzae Rd
uauuuaauaauau

SEQ ID NO: 2692371 - RNA, 13 nt, Haemophilus influenzae Rd
uauuuaauaauuu

SEQ ID NO: 2692372 - RNA, 13 nt, Haemophilus influenzae Rd
uauuuuuaaacaa

SEQ ID NO: 2692373 - RNA, 19 nt, Haemophilus influenzae Rd
uauuuuuaaucaaauaaaa

SEQ ID NO: 2692374 - RNA, 13 nt, Haemophilus influenzae Rd
uauuuuuauaaau

SEQ ID NO: 2692375 - RNA, 15 nt, Haemophilus influenzae Rd
uauuuuuaucauaua

SEQ ID NO: 2692376 - RNA, 18 nt, Haemophilus influenzae Rd
uauuuuuaucuaaauucc

SEQ ID NO: 2692377 - RNA, 20 nt, Haemophilus influenzae Rd
uauuuuucaaggccauauuu

SEQ ID NO: 2692378 - RNA, 13 nt, Haemophilus influenzae Rd
uauuuuucacuga

SEQ ID NO: 2692379 - RNA, 11 nt, Haemophilus influenzae Rd
uauuuuucaua

SEQ ID NO: 2692380 - RNA, 15 nt, Haemophilus influenzae Rd
uauuuuucuaaaucg

SEQ ID NO: 2692381 - RNA, 21 nt, Haemophilus influenzae Rd
uauuuuucuaaaucgucgcua

SEQ ID NO: 2692382 - RNA, 19 nt, Haemophilus influenzae Rd
uauuuuuguggaaugccca

SEQ ID NO: 2692383 - RNA, 21 nt, Haemophilus influenzae Rd
uauuuuuguggcgugagaucc

SEQ ID NO: 2692384 - RNA, 18 nt, Haemophilus influenzae Rd
uauuuuuuaauacgaaaa

SEQ ID NO: 2692385 - RNA, 17 nt, Haemophilus influenzae Rd
uauuuuuuauaugccaa

SEQ ID NO: 2692386 - RNA, 14 nt, Haemophilus influenzae Rd
uauuuuuuauuuuu

SEQ ID NO: 2692387 - RNA, 20 nt, Haemophilus influenzae Rd
uauuuuuucaucauuucuua

SEQ ID NO: 2692388 - RNA, 19 nt, Haemophilus influenzae Rd
uauuuuuucugcaaagucu

SEQ ID NO: 2692389 - RNA, 15 nt, Haemophilus influenzae Rd
uauuuuuucuuaaau

SEQ ID NO: 2692390 - RNA, 23 nt, Haemophilus influenzae Rd
uauuuuuuucuaacaucggcaac

SEQ ID NO: 2692391 - RNA, 21 nt, Haemophilus influenzae Rd
ucaaaaaacgaaauuuuucac

SEQ ID NO: 2692392 - RNA, 13 nt, Haemophilus influenzae Rd
ucaaaaagaaaua

SEQ ID NO: 2692393 - RNA, 21 nt, Haemophilus influenzae Rd
ucaaaaagcacguuuuaauaa

SEQ ID NO: 2692394 - RNA, 16 nt, Haemophilus influenzae Rd
ucaaaaaguugaauuu

SEQ ID NO: 2692395 - RNA, 20 nt, Haemophilus influenzae Rd
ucaaaaaguugaauuuucaa

SEQ ID NO: 2692396 - RNA, 11 nt, Haemophilus influenzae Rd
ucaaaaauauc

SEQ ID NO: 2692397 - RNA, 23 nt, Haemophilus influenzae Rd
ucaaaaauugauaccaagauaau

SEQ ID NO: 2692398 - RNA, 16 nt, Haemophilus influenzae Rd
ucaaaaauuucagaau

SEQ ID NO: 2692399 - RNA, 16 nt, Haemophilus influenzae Rd
ucaaaacaguuuucaa

SEQ ID NO: 2692400 - RNA, 19 nt, Haemophilus influenzae Rd
ucaaaacauuaauugacaa

SEQ ID NO: 2692401 - RNA, 23 nt, Haemophilus influenzae Rd
ucaaaacauuaauugacaauuaa

SEQ ID NO: 2692402 - RNA, 19 nt, Haemophilus influenzae Rd
ucaaaaccuuucuguaaau

SEQ ID NO: 2692403 - RNA, 16 nt, Haemophilus influenzae Rd
ucaaaacgaguuaaga

SEQ ID NO: 2692404 - RNA, 18 nt, Haemophilus influenzae Rd
ucaaaacgaucuaaaaau

SEQ ID NO: 2692405 - RNA, 19 nt, Haemophilus influenzae Rd
ucaaaacgaucuaaaaaug

SEQ ID NO: 2692406 - RNA, 21 nt, Haemophilus influenzae Rd
ucaaaacguucuacuuguuca

SEQ ID NO: 2692407 - RNA, 16 nt, Haemophilus influenzae Rd
ucaaaagaauuaaaaa

SEQ ID NO: 2692408 - RNA, 18 nt, Haemophilus influenzae Rd
ucaaaagaauuaaaaaug

SEQ ID NO: 2692409 - RNA, 16 nt, Haemophilus influenzae Rd
ucaaaaguauaaacuu

SEQ ID NO: 2692410 - RNA, 14 nt, Haemophilus influenzae Rd
ucaaaauaaaacca

SEQ ID NO: 2692411 - RNA, 15 nt, Haemophilus influenzae Rd
ucaaaauaaaaccau

SEQ ID NO: 2692412 - RNA, 16 nt, Haemophilus influenzae Rd
ucaaaauaaauaaaau

SEQ ID NO: 2692413 - RNA, 17 nt, Haemophilus influenzae Rd
ucaaaauaaauaaaaua

SEQ ID NO: 2692414 - RNA, 15 nt, Haemophilus influenzae Rd
ucaaaauacucacaa

SEQ ID NO: 2692415 - RNA, 18 nt, Haemophilus influenzae Rd
ucaaaauagcuuuuuaau

SEQ ID NO: 2692416 - RNA, 19 nt, Haemophilus influenzae Rd
ucaaaauagcuuuuuaauu

SEQ ID NO: 2692417 - RNA, 17 nt, Haemophilus influenzae Rd
ucaaaauaguaaaaauu

SEQ ID NO: 2692418 - RNA, 19 nt, Haemophilus influenzae Rd
ucaaaaucaaguuaaaaaa

SEQ ID NO: 2692419 - RNA, 20 nt, Haemophilus influenzae Rd
ucaaaaucagcaaauuguuu

SEQ ID NO: 2692420 - RNA, 18 nt, Haemophilus influenzae Rd
ucaaaauccgccgcacuu

SEQ ID NO: 2692421 - RNA, 15 nt, Haemophilus influenzae Rd
ucaaaaugaaaacua

SEQ ID NO: 2692422 - RNA, 23 nt, Haemophilus influenzae Rd
ucaaaaugaaaacuaugcucuac

SEQ ID NO: 2692423 - RNA, 12 nt, Haemophilus influenzae Rd
ucaaaaugcagu

SEQ ID NO: 2692424 - RNA, 22 nt, Haemophilus influenzae Rd
ucaaaaugcaguagguauguuu

SEQ ID NO: 2692425 - RNA, 22 nt, Haemophilus influenzae Rd
ucaaaauugaucgaaaaaucuu

SEQ ID NO: 2692426 - RNA, 16 nt, Haemophilus influenzae Rd
ucaaaauugaugaaaa

SEQ ID NO: 2692427 - RNA, 17 nt, Haemophilus influenzae Rd
ucaaaauugaugaaaau

SEQ ID NO: 2692428 - RNA, 22 nt, Haemophilus influenzae Rd
ucaaaauugaugaaaauucucu

SEQ ID NO: 2692429 - RNA, 20 nt, Haemophilus influenzae Rd
ucaaacaaacccucccauua

SEQ ID NO: 2692430 - RNA, 11 nt, Haemophilus influenzae Rd
ucaaacaacaa

SEQ ID NO: 2692431 - RNA, 21 nt, Haemophilus influenzae Rd
ucaaacaauaugugcuuggca

SEQ ID NO: 2692432 - RNA, 21 nt, Haemophilus influenzae Rd
ucaaacaggcuuauuaaaaac

SEQ ID NO: 2692433 - RNA, 23 nt, Haemophilus influenzae Rd
ucaaacaggcuuauuaaaaacua

SEQ ID NO: 2692434 - RNA, 16 nt, Haemophilus influenzae Rd
ucaaacagguguguuu

SEQ ID NO: 2692435 - RNA, 20 nt, Haemophilus influenzae Rd
ucaaacaguucaauaaaaau

SEQ ID NO: 2692436 - RNA, 14 nt, Haemophilus influenzae Rd
ucaaaccaaccaca

SEQ ID NO: 2692437 - RNA, 14 nt, Haemophilus influenzae Rd
ucaaaccaauaaac

SEQ ID NO: 2692438 - RNA, 19 nt, Haemophilus influenzae Rd
ucaaacgccguucaaaauc

SEQ ID NO: 2692439 - RNA, 15 nt, Haemophilus influenzae Rd
ucaaacgcuguaaac

SEQ ID NO: 2692440 - RNA, 23 nt, Haemophilus influenzae Rd
ucaaacguuaaaucacuuucauu

SEQ ID NO: 2692441 - RNA, 23 nt, Haemophilus influenzae Rd
ucaaagaaguagccgccuuuuuc

SEQ ID NO: 2692442 - RNA, 21 nt, Haemophilus influenzae Rd
ucaaagaauucuggugcauuu

SEQ ID NO: 2692443 - RNA, 22 nt, Haemophilus influenzae Rd
ucaaagaauugaucaaaauuau

SEQ ID NO: 2692444 - RNA, 17 nt, Haemophilus influenzae Rd
ucaaagaauuuuuucac

SEQ ID NO: 2692445 - RNA, 21 nt, Haemophilus influenzae Rd
ucaaagagaagcugaauaaaa

SEQ ID NO: 2692446 - RNA, 18 nt, Haemophilus influenzae Rd
ucaaagaggagguagaaa

SEQ ID NO: 2692447 - RNA, 20 nt, Haemophilus influenzae Rd
ucaaagaggagguagaaaau

SEQ ID NO: 2692448 - RNA, 22 nt, Haemophilus influenzae Rd
ucaaagaggagguagaaaaucg

SEQ ID NO: 2692449 - RNA, 18 nt, Haemophilus influenzae Rd
ucaaagauuauuuaaucu

SEQ ID NO: 2692450 - RNA, 16 nt, Haemophilus influenzae Rd
ucaaagcgagaaaaac

SEQ ID NO: 2692451 - RNA, 19 nt, Haemophilus influenzae Rd
ucaaagcgagaaaaacgaa

SEQ ID NO: 2692452 - RNA, 20 nt, Haemophilus influenzae Rd
ucaaagcguuuuaaaaucuc

SEQ ID NO: 2692453 - RNA, 13 nt, Haemophilus influenzae Rd
ucaaagcucaccu

SEQ ID NO: 2692454 - RNA, 19 nt, Haemophilus influenzae Rd
ucaaaguagucuauuuacu

SEQ ID NO: 2692455 - RNA, 12 nt, Haemophilus influenzae Rd
ucaaauaaauug

SEQ ID NO: 2692456 - RNA, 15 nt, Haemophilus influenzae Rd
ucaaauaacgcauaa

SEQ ID NO: 2692457 - RNA, 15 nt, Haemophilus influenzae Rd
ucaaauaaguuugau

SEQ ID NO: 2692458 - RNA, 20 nt, Haemophilus influenzae Rd
ucaaauaauguguugauuuc

SEQ ID NO: 2692459 - RNA, 14 nt, Haemophilus influenzae Rd
ucaaauaccucaau

SEQ ID NO: 2692460 - RNA, 17 nt, Haemophilus influenzae Rd
ucaaaucaaauuuuccu

SEQ ID NO: 2692461 - RNA, 17 nt, Haemophilus influenzae Rd
ucaaaucauuuuuugca

SEQ ID NO: 2692462 - RNA, 12 nt, Haemophilus influenzae Rd
ucaaaucgauca

SEQ ID NO: 2692463 - RNA, 16 nt, Haemophilus influenzae Rd
ucaaaucgaucacuua

SEQ ID NO: 2692464 - RNA, 19 nt, Haemophilus influenzae Rd
ucaaaucuaacguauuuaa

SEQ ID NO: 2692465 - RNA, 20 nt, Haemophilus influenzae Rd
ucaaaucuaacguauuuaaa

SEQ ID NO: 2692466 - RNA, 15 nt, Haemophilus influenzae Rd
ucaaaucuacuaaaa

SEQ ID NO: 2692467 - RNA, 20 nt, Haemophilus influenzae Rd
ucaaaucuucagcaguuugg

SEQ ID NO: 2692468 - RNA, 20 nt, Haemophilus influenzae Rd
ucaaaugaaagaagaaaaag

SEQ ID NO: 2692469 - RNA, 14 nt, Haemophilus influenzae Rd
ucaaauuaaccgca

SEQ ID NO: 2692470 - RNA, 17 nt, Haemophilus influenzae Rd
ucaaauuaaccgcacuu

SEQ ID NO: 2692471 - RNA, 22 nt, Haemophilus influenzae Rd
ucaaauuaaccgcacuuucauu

SEQ ID NO: 2692472 - RNA, 14 nt, Haemophilus influenzae Rd
ucaaauuaauuuaa

SEQ ID NO: 2692473 - RNA, 21 nt, Haemophilus influenzae Rd
ucaaauucacgucgaaucuga

SEQ ID NO: 2692474 - RNA, 17 nt, Haemophilus influenzae Rd
ucaaauucagucuuaau

SEQ ID NO: 2692475 - RNA, 19 nt, Haemophilus influenzae Rd
ucaaauucagucuuaauuu

SEQ ID NO: 2692476 - RNA, 21 nt, Haemophilus influenzae Rd
ucaaauucucuguuucuuuaa

SEQ ID NO: 2692477 - RNA, 16 nt, Haemophilus influenzae Rd
ucaauaacugauuuug

SEQ ID NO: 2692478 - RNA, 16 nt, Haemophilus influenzae Rd
ucaauaagcaaguaau

SEQ ID NO: 2692479 - RNA, 21 nt, Haemophilus influenzae Rd
ucaauaagcaaguaauuuaaa

SEQ ID NO: 2692480 - RNA, 19 nt, Haemophilus influenzae Rd
ucaauaaggcuuuuuuaau

SEQ ID NO: 2692481 - RNA, 22 nt, Haemophilus influenzae Rd
ucaauaauauauuuaaugugua

SEQ ID NO: 2692482 - RNA, 22 nt, Haemophilus influenzae Rd
ucaauaauguuaccgacaacca

SEQ ID NO: 2692483 - RNA, 20 nt, Haemophilus influenzae Rd
ucaauaauucauuagaaagu

SEQ ID NO: 2692484 - RNA, 13 nt, Haemophilus influenzae Rd
ucaauaauuucaa

SEQ ID NO: 2692485 - RNA, 14 nt, Haemophilus influenzae Rd
ucaauaauuuucac

SEQ ID NO: 2692486 - RNA, 14 nt, Haemophilus influenzae Rd
ucaauaauuuuucu

SEQ ID NO: 2692487 - RNA, 18 nt, Haemophilus influenzae Rd
ucaauacaacaagaaauu

SEQ ID NO: 2692488 - RNA, 18 nt, Haemophilus influenzae Rd
ucaauacguuuaauauag

SEQ ID NO: 2692489 - RNA, 18 nt, Haemophilus influenzae Rd
ucaauagaacguaauaau

SEQ ID NO: 2692490 - RNA, 19 nt, Haemophilus influenzae Rd
ucaauagauaaaucaaaac

SEQ ID NO: 2692491 - RNA, 22 nt, Haemophilus influenzae Rd
ucaauagauaaaucaaaacgau

SEQ ID NO: 2692492 - RNA, 17 nt, Haemophilus influenzae Rd
ucaauagccaauaauaa

SEQ ID NO: 2692493 - RNA, 19 nt, Haemophilus influenzae Rd
ucaauagccuguaaauuua

SEQ ID NO: 2692494 - RNA, 14 nt, Haemophilus influenzae Rd
ucaauauaaguugu

SEQ ID NO: 2692495 - RNA, 21 nt, Haemophilus influenzae Rd
ucaauauaaguuguaggaugu

SEQ ID NO: 2692496 - RNA, 15 nt, Haemophilus influenzae Rd
ucaauauaaucaauu

SEQ ID NO: 2692497 - RNA, 15 nt, Haemophilus influenzae Rd
ucaauaucaaagaaa

SEQ ID NO: 2692498 - RNA, 16 nt, Haemophilus influenzae Rd
ucaauaucaaagaaaa

SEQ ID NO: 2692499 - RNA, 19 nt, Haemophilus influenzae Rd
ucaauaucaaagaaaaauu

SEQ ID NO: 2692500 - RNA, 23 nt, Haemophilus influenzae Rd
ucaauaucccaacuuuaugucca

SEQ ID NO: 2692501 - RNA, 18 nt, Haemophilus influenzae Rd
ucaauaucuaagaaaaua

SEQ ID NO: 2692502 - RNA, 19 nt, Haemophilus influenzae Rd
ucaauauugucuauuuuau

SEQ ID NO: 2692503 - RNA, 21 nt, Haemophilus influenzae Rd
ucaauauugucuauuuuauuu

SEQ ID NO: 2692504 - RNA, 13 nt, Haemophilus influenzae Rd
ucaaucaaauuca

SEQ ID NO: 2692505 - RNA, 16 nt, Haemophilus influenzae Rd
ucaaucaaauucaaca

SEQ ID NO: 2692506 - RNA, 19 nt, Haemophilus influenzae Rd
ucaaucaagcauaaaucuu

SEQ ID NO: 2692507 - RNA, 18 nt, Haemophilus influenzae Rd
ucaaucaggcuuucauuu

SEQ ID NO: 2692508 - RNA, 22 nt, Haemophilus influenzae Rd
ucaaucaggcuuucauuuucca

SEQ ID NO: 2692509 - RNA, 15 nt, Haemophilus influenzae Rd
ucaaucauaucauca

SEQ ID NO: 2692510 - RNA, 16 nt, Haemophilus influenzae Rd
ucaaucauaucaucaa

SEQ ID NO: 2692511 - RNA, 17 nt, Haemophilus influenzae Rd
ucaaucauaucaucaac

SEQ ID NO: 2692512 - RNA, 13 nt, Haemophilus influenzae Rd
ucaaucaucccuu

SEQ ID NO: 2692513 - RNA, 14 nt, Haemophilus influenzae Rd
ucaaucauuucuaa

SEQ ID NO: 2692514 - RNA, 19 nt, Haemophilus influenzae Rd
ucaauccccgcaucuuugg

SEQ ID NO: 2692515 - RNA, 15 nt, Haemophilus influenzae Rd
ucaaucgguuucaca

SEQ ID NO: 2692516 - RNA, 12 nt, Haemophilus influenzae Rd
ucaaucucuuua

SEQ ID NO: 2692517 - RNA, 20 nt, Haemophilus influenzae Rd
ucaaucucuuuacuguucaa

SEQ ID NO: 2692518 - RNA, 17 nt, Haemophilus influenzae Rd
ucaaucuuuuuguuaau

SEQ ID NO: 2692519 - RNA, 18 nt, Haemophilus influenzae Rd
ucaaugaaauauuacuaa

SEQ ID NO: 2692520 - RNA, 22 nt, Haemophilus influenzae Rd
ucaaugaacuuaugugcaccuu

SEQ ID NO: 2692521 - RNA, 14 nt, Haemophilus influenzae Rd
ucaaugcaaauuaa

SEQ ID NO: 2692522 - RNA, 16 nt, Haemophilus influenzae Rd
ucaaugcagaaauacu

SEQ ID NO: 2692523 - RNA, 18 nt, Haemophilus influenzae Rd
ucaaugcagaaauacuuu

SEQ ID NO: 2692524 - RNA, 15 nt, Haemophilus influenzae Rd
ucaaugccaaaugcg

SEQ ID NO: 2692525 - RNA, 18 nt, Haemophilus influenzae Rd
ucaaugccaaaugcggcc

SEQ ID NO: 2692526 - RNA, 20 nt, Haemophilus influenzae Rd
ucaaugccuuuuguauccaa

SEQ ID NO: 2692527 - RNA, 13 nt, Haemophilus influenzae Rd
ucaaugcuuccuu

SEQ ID NO: 2692528 - RNA, 12 nt, Haemophilus influenzae Rd
ucaaugcuuuuu

SEQ ID NO: 2692529 - RNA, 21 nt, Haemophilus influenzae Rd
ucaaugggcauccaaaguaca

SEQ ID NO: 2692530 - RNA, 16 nt, Haemophilus influenzae Rd
ucaauguuaagugaau

SEQ ID NO: 2692531 - RNA, 20 nt, Haemophilus influenzae Rd
ucaauguuaaguucaucaua

SEQ ID NO: 2692532 - RNA, 19 nt, Haemophilus influenzae Rd
ucaauguugcgccaucuaa

SEQ ID NO: 2692533 - RNA, 14 nt, Haemophilus influenzae Rd
ucaauuaaaugacc

SEQ ID NO: 2692534 - RNA, 15 nt, Haemophilus influenzae Rd
ucaauuaauggaaug

SEQ ID NO: 2692535 - RNA, 15 nt, Haemophilus influenzae Rd
ucaauuacauauuua

SEQ ID NO: 2692536 - RNA, 17 nt, Haemophilus influenzae Rd
ucaauuaccuuagccaa

SEQ ID NO: 2692537 - RNA, 20 nt, Haemophilus influenzae Rd
ucaauuagaugacuggcaaa

SEQ ID NO: 2692538 - RNA, 23 nt, Haemophilus influenzae Rd
ucaauuagcaaagaauuaaaaua

SEQ ID NO: 2692539 - RNA, 13 nt, Haemophilus influenzae Rd
ucaauucaucuug

SEQ ID NO: 2692540 - RNA, 17 nt, Haemophilus influenzae Rd
ucaauuccauaauaucu

SEQ ID NO: 2692541 - RNA, 16 nt, Haemophilus influenzae Rd
ucaauuccuucaucgu

SEQ ID NO: 2692542 - RNA, 12 nt, Haemophilus influenzae Rd
ucaauuccuuua

SEQ ID NO: 2692543 - RNA, 17 nt, Haemophilus influenzae Rd
ucaauucuuuuuguaau

SEQ ID NO: 2692544 - RNA, 22 nt, Haemophilus influenzae Rd
ucaauugccauaggauuauuca

SEQ ID NO: 2692545 - RNA, 14 nt, Haemophilus influenzae Rd
ucaauuuaauaauc

SEQ ID NO: 2692546 - RNA, 15 nt, Haemophilus influenzae Rd
ucaauuuaauaaucu

SEQ ID NO: 2692547 - RNA, 15 nt, Haemophilus influenzae Rd
ucaauuuacccacuu

SEQ ID NO: 2692548 - RNA, 21 nt, Haemophilus influenzae Rd
ucaauuuacccacuucauaua

SEQ ID NO: 2692549 - RNA, 18 nt, Haemophilus influenzae Rd
ucaauuucuaccgcacuu

SEQ ID NO: 2692550 - RNA, 13 nt, Haemophilus influenzae Rd
ucaauuugaaaau

SEQ ID NO: 2692551 - RNA, 18 nt, Haemophilus influenzae Rd
ucaauuugcggagaaaac

SEQ ID NO: 2692552 - RNA, 19 nt, Haemophilus influenzae Rd
ucaauuuggucgccgacuu

SEQ ID NO: 2692553 - RNA, 11 nt, Haemophilus influenzae Rd
ucaauuuuaaa

SEQ ID NO: 2692554 - RNA, 17 nt, Haemophilus influenzae Rd
ucaauuuuacguuuuaa

SEQ ID NO: 2692555 - RNA, 20 nt, Haemophilus influenzae Rd
ucaauuuuacguuuuaaauu

SEQ ID NO: 2692556 - RNA, 21 nt, Haemophilus influenzae Rd
ucaauuuuacguuuuaaauua

SEQ ID NO: 2692557 - RNA, 16 nt, Haemophilus influenzae Rd
ucaauuuucugugagu

SEQ ID NO: 2692558 - RNA, 19 nt, Haemophilus influenzae Rd
ucaauuuugacaauuugau

SEQ ID NO: 2692559 - RNA, 11 nt, Haemophilus influenzae Rd
ucaauuuuuca

SEQ ID NO: 2692560 - RNA, 20 nt, Haemophilus influenzae Rd
ucaauuuuuuaucaaauaac

SEQ ID NO: 2692561 - RNA, 20 nt, Haemophilus influenzae Rd
ucaauuuuuucuccacaaac

SEQ ID NO: 2692562 - RNA, 14 nt, Haemophilus influenzae Rd
ucacaaaacaacca

SEQ ID NO: 2692563 - RNA, 20 nt, Haemophilus influenzae Rd
ucacaaaauggcaaacaaaa

SEQ ID NO: 2692564 - RNA, 23 nt, Haemophilus influenzae Rd
ucacaaaauggcaaacaaaauaa

SEQ ID NO: 2692565 - RNA, 21 nt, Haemophilus influenzae Rd
ucacaaacauaccuaaaaaug

SEQ ID NO: 2692566 - RNA, 11 nt, Haemophilus influenzae Rd
ucacaaagcac

SEQ ID NO: 2692567 - RNA, 21 nt, Haemophilus influenzae Rd
ucacaaaguguuuuauuuauc

SEQ ID NO: 2692568 - RNA, 14 nt, Haemophilus influenzae Rd
ucacaaaucuaaaa

SEQ ID NO: 2692569 - RNA, 15 nt, Haemophilus influenzae Rd
ucacaaaucuaaaaa

SEQ ID NO: 2692570 - RNA, 17 nt, Haemophilus influenzae Rd
ucacaaaucuaaaaaua

SEQ ID NO: 2692571 - RNA, 21 nt, Haemophilus influenzae Rd
ucacaaaucuucuugaaaccu

SEQ ID NO: 2692572 - RNA, 20 nt, Haemophilus influenzae Rd
ucacaaaugaucauuuuggg

SEQ ID NO: 2692573 - RNA, 23 nt, Haemophilus influenzae Rd
ucacaaauugaccuuuuaaugcu

SEQ ID NO: 2692574 - RNA, 15 nt, Haemophilus influenzae Rd
ucacaaauuuccaua

SEQ ID NO: 2692575 - RNA, 15 nt, Haemophilus influenzae Rd
ucacaacuaccacag

SEQ ID NO: 2692576 - RNA, 15 nt, Haemophilus influenzae Rd
ucacaacuuuuuaac

SEQ ID NO: 2692577 - RNA, 14 nt, Haemophilus influenzae Rd
ucacaauaagcaau

SEQ ID NO: 2692578 - RNA, 20 nt, Haemophilus influenzae Rd
ucacaauaauuuucaauagc

SEQ ID NO: 2692579 - RNA, 21 nt, Haemophilus influenzae Rd
ucacaauauuugguugaacuu

SEQ ID NO: 2692580 - RNA, 22 nt, Haemophilus influenzae Rd
ucacaaucauacacaccaucaa

SEQ ID NO: 2692581 - RNA, 20 nt, Haemophilus influenzae Rd
ucacaaugagacuuaaccaa

SEQ ID NO: 2692582 - RNA, 15 nt, Haemophilus influenzae Rd
ucacugugccaacuu

SEQ ID NO: 2692583 - RNA, 17 nt, Haemophilus influenzae Rd
ucacuuaaaccaaauug

SEQ ID NO: 2692584 - RNA, 13 nt, Haemophilus influenzae Rd
ucacuuaaauuca

SEQ ID NO: 2692585 - RNA, 21 nt, Haemophilus influenzae Rd
ucacuuaauaaaaauuguaaa

SEQ ID NO: 2692586 - RNA, 20 nt, Haemophilus influenzae Rd
ucacuucaggguuuucauca

SEQ ID NO: 2692587 - RNA, 21 nt, Haemophilus influenzae Rd
ucacuucaggguuuucaucau

SEQ ID NO: 2692588 - RNA, 21 nt, Haemophilus influenzae Rd
ucacuugaagucuauaaaaga

SEQ ID NO: 2692589 - RNA, 16 nt, Haemophilus influenzae Rd
ucacuugauaaaaaug

SEQ ID NO: 2692590 - RNA, 21 nt, Haemophilus influenzae Rd
ucacuugauaaaaaugagauu

SEQ ID NO: 2692591 - RNA, 23 nt, Haemophilus influenzae Rd
ucacuuggcgaaaaucaucauau

SEQ ID NO: 2692592 - RNA, 19 nt, Haemophilus influenzae Rd
ucacuugugcgauuaacaa

SEQ ID NO: 2692593 - RNA, 19 nt, Haemophilus influenzae Rd
ucacuuuacucggcccauu

SEQ ID NO: 2692594 - RNA, 13 nt, Haemophilus influenzae Rd
ucacuuuuaauuc

SEQ ID NO: 2692595 - RNA, 18 nt, Haemophilus influenzae Rd
ucagaaaaagcuuccuuu

SEQ ID NO: 2692596 - RNA, 11 nt, Haemophilus influenzae Rd
ucagaaaauaa

SEQ ID NO: 2692597 - RNA, 14 nt, Haemophilus influenzae Rd
ucagaaaauaaaua

SEQ ID NO: 2692598 - RNA, 15 nt, Haemophilus influenzae Rd
ucagaacaagcauuu

SEQ ID NO: 2692599 - RNA, 18 nt, Haemophilus influenzae Rd
ucagaacaagcauuuuuc

SEQ ID NO: 2692600 - RNA, 19 nt, Haemophilus influenzae Rd
ucagaacaagcauuuuuca

SEQ ID NO: 2692601 - RNA, 20 nt, Haemophilus influenzae Rd
ucagaacaagcauuuuucau

SEQ ID NO: 2692602 - RNA, 20 nt, Haemophilus influenzae Rd
ucagaacugcuuucuuccaa

SEQ ID NO: 2692603 - RNA, 21 nt, Haemophilus influenzae Rd
ucagaaguuaaaacuugaaug

SEQ ID NO: 2692604 - RNA, 19 nt, Haemophilus influenzae Rd
ucagaauaauuaacaaaua

SEQ ID NO: 2692605 - RNA, 20 nt, Haemophilus influenzae Rd
ucagaauaauuaacaaauaa

SEQ ID NO: 2692606 - RNA, 13 nt, Haemophilus influenzae Rd
ucagaauauaagu

SEQ ID NO: 2692607 - RNA, 17 nt, Haemophilus influenzae Rd
ucagaauauaaguucuu

SEQ ID NO: 2692608 - RNA, 19 nt, Haemophilus influenzae Rd
ucagaauauaaguucuucc

SEQ ID NO: 2692609 - RNA, 21 nt, Haemophilus influenzae Rd
ucagacauauccucaacauca

SEQ ID NO: 2692610 - RNA, 18 nt, Haemophilus influenzae Rd
ucagauaacguaaguaau

SEQ ID NO: 2692611 - RNA, 15 nt, Haemophilus influenzae Rd
ucagauaaucaaaaa

SEQ ID NO: 2692612 - RNA, 19 nt, Haemophilus influenzae Rd
ucagauaaucuacaaaaca

SEQ ID NO: 2692613 - RNA, 20 nt, Haemophilus influenzae Rd
ucagauaaucuacaaaacau

SEQ ID NO: 2692614 - RNA, 14 nt, Haemophilus influenzae Rd
ucagauacuuucua

SEQ ID NO: 2692615 - RNA, 21 nt, Haemophilus influenzae Rd
ucagauacuuucuaauuauuu

SEQ ID NO: 2692616 - RNA, 15 nt, Haemophilus influenzae Rd
ucagauggaauauuu

SEQ ID NO: 2692617 - RNA, 14 nt, Haemophilus influenzae Rd
ucagauucaauaau

SEQ ID NO: 2692618 - RNA, 14 nt, Haemophilus influenzae Rd
ucagauugaacgcu

SEQ ID NO: 2692619 - RNA, 14 nt, Haemophilus influenzae Rd
ucagauuuuucgca

SEQ ID NO: 2692620 - RNA, 21 nt, Haemophilus influenzae Rd
ucagauuuuucgcauuuuaac

SEQ ID NO: 2692621 - RNA, 22 nt, Haemophilus influenzae Rd
ucagauuuuucgcauuuuaacu

SEQ ID NO: 2692622 - RNA, 15 nt, Haemophilus influenzae Rd
ucagauuuuuuucag

SEQ ID NO: 2692623 - RNA, 17 nt, Haemophilus influenzae Rd
ucagauuuuuuucagaa

SEQ ID NO: 2692624 - RNA, 23 nt, Haemophilus influenzae Rd
ucagcaacauuauugccaauuau

SEQ ID NO: 2692625 - RNA, 18 nt, Haemophilus influenzae Rd
ucagcaacgguguggaaa

SEQ ID NO: 2692626 - RNA, 16 nt, Haemophilus influenzae Rd
ucagcaaguucugcac

SEQ ID NO: 2692627 - RNA, 22 nt, Haemophilus influenzae Rd
ucagcacuuucgcuuaaaaauc

SEQ ID NO: 2692628 - RNA, 16 nt, Haemophilus influenzae Rd
ucagcauaaacaaaau

SEQ ID NO: 2692629 - RNA, 16 nt, Haemophilus influenzae Rd
ucagcauaaagagaau

SEQ ID NO: 2692630 - RNA, 20 nt, Haemophilus influenzae Rd
ucagcauaaagagaauauuu

SEQ ID NO: 2692631 - RNA, 19 nt, Haemophilus influenzae Rd
ucagccaauuuuucaaaac

SEQ ID NO: 2692632 - RNA, 17 nt, Haemophilus influenzae Rd
ucagccacuaauuucac

SEQ ID NO: 2692633 - RNA, 17 nt, Haemophilus influenzae Rd
ucagccacuucuucaaa

SEQ ID NO: 2692634 - RNA, 23 nt, Haemophilus influenzae Rd
ucagcccuuauuuuuuggaauau

SEQ ID NO: 2692635 - RNA, 22 nt, Haemophilus influenzae Rd
ucagcccuuuuaguuuccccug

SEQ ID NO: 2692636 - RNA, 16 nt, Haemophilus influenzae Rd
ucagccgcuuuuugau

SEQ ID NO: 2692637 - RNA, 12 nt, Haemophilus influenzae Rd
ucagccugcuca

SEQ ID NO: 2692638 - RNA, 16 nt, Haemophilus influenzae Rd
ucagcgauuuuaacug

SEQ ID NO: 2692639 - RNA, 17 nt, Haemophilus influenzae Rd
ucagcgcauaauuaccu

SEQ ID NO: 2692640 - RNA, 14 nt, Haemophilus influenzae Rd
ucagcggcuuucuu

SEQ ID NO: 2692641 - RNA, 22 nt, Haemophilus influenzae Rd
ucagcggcuuucuucagccauu

SEQ ID NO: 2692642 - RNA, 19 nt, Haemophilus influenzae Rd
ucagcgugaauauaagaaa

SEQ ID NO: 2692643 - RNA, 16 nt, Haemophilus influenzae Rd
ucagcguuuucaacuu

SEQ ID NO: 2692644 - RNA, 21 nt, Haemophilus influenzae Rd
ucagcuaagccaauaauuucu

SEQ ID NO: 2692645 - RNA, 22 nt, Haemophilus influenzae Rd
ucagcuaauaaaguuugcaauu

SEQ ID NO: 2692646 - RNA, 14 nt, Haemophilus influenzae Rd
ucagcuaaugcuuu

SEQ ID NO: 2692647 - RNA, 18 nt, Haemophilus influenzae Rd
ucagcuaaugcuuuaauu

SEQ ID NO: 2692648 - RNA, 17 nt, Haemophilus influenzae Rd
ucagcuccuacauuaaa

SEQ ID NO: 2692649 - RNA, 16 nt, Haemophilus influenzae Rd
ucagcugcgaugcaua

SEQ ID NO: 2692650 - RNA, 18 nt, Haemophilus influenzae Rd
ucagcugcgaugcauacu

SEQ ID NO: 2692651 - RNA, 15 nt, Haemophilus influenzae Rd
ucagcuuaaauacua

SEQ ID NO: 2692652 - RNA, 12 nt, Haemophilus influenzae Rd
ucagcuucaauu

SEQ ID NO: 2692653 - RNA, 18 nt, Haemophilus influenzae Rd
ucaggaggaauaaugaau

SEQ ID NO: 2692654 - RNA, 15 nt, Haemophilus influenzae Rd
ucaggaucaaaaaua

SEQ ID NO: 2692655 - RNA, 21 nt, Haemophilus influenzae Rd
ucaggcaguagccuauaacga

SEQ ID NO: 2692656 - RNA, 16 nt, Haemophilus influenzae Rd
ucaggcugugcauaau

SEQ ID NO: 2692657 - RNA, 14 nt, Haemophilus influenzae Rd
ucaggcuuaacuuu

SEQ ID NO: 2692658 - RNA, 18 nt, Haemophilus influenzae Rd
ucaggcuuaacuuucucu

SEQ ID NO: 2692659 - RNA, 15 nt, Haemophilus influenzae Rd
ucaggcuuucauuuu

SEQ ID NO: 2692660 - RNA, 17 nt, Haemophilus influenzae Rd
ucaggguuuucaucauu

SEQ ID NO: 2692661 - RNA, 17 nt, Haemophilus influenzae Rd
ucagguauuucuucaau

SEQ ID NO: 2692662 - RNA, 19 nt, Haemophilus influenzae Rd
ucagguauuucuucaauau

SEQ ID NO: 2692663 - RNA, 12 nt, Haemophilus influenzae Rd
ucaggugcuuua

SEQ ID NO: 2692664 - RNA, 19 nt, Haemophilus influenzae Rd
ucaggugcuuuagccacga

SEQ ID NO: 2692665 - RNA, 11 nt, Haemophilus influenzae Rd
ucagguugaau

SEQ ID NO: 2692666 - RNA, 20 nt, Haemophilus influenzae Rd
ucagguugcgguaaaucuac

SEQ ID NO: 2692667 - RNA, 15 nt, Haemophilus influenzae Rd
ucagguugguuuugu

SEQ ID NO: 2692668 - RNA, 18 nt, Haemophilus influenzae Rd
ucagguuuaauaaucgaa

SEQ ID NO: 2692669 - RNA, 20 nt, Haemophilus influenzae Rd
ucaguaaacaaguauaaaaa

SEQ ID NO: 2692670 - RNA, 20 nt, Haemophilus influenzae Rd
ucaguaaaccaagugaaauu

SEQ ID NO: 2692671 - RNA, 15 nt, Haemophilus influenzae Rd
ucaguaacuacaacu

SEQ ID NO: 2692672 - RNA, 23 nt, Haemophilus influenzae Rd
ucaguaacuacaacuucaucaau

SEQ ID NO: 2692673 - RNA, 15 nt, Haemophilus influenzae Rd
ucaguaacuuuaaua

SEQ ID NO: 2692674 - RNA, 16 nt, Haemophilus influenzae Rd
ucaguaagaaaccaac

SEQ ID NO: 2692675 - RNA, 18 nt, Haemophilus influenzae Rd
ucaguaccuuuaauuaaa

SEQ ID NO: 2692676 - RNA, 15 nt, Haemophilus influenzae Rd
ucagucuauuauaaa

SEQ ID NO: 2692677 - RNA, 19 nt, Haemophilus influenzae Rd
ucaguggggaauaaaauaa

SEQ ID NO: 2692678 - RNA, 19 nt, Haemophilus influenzae Rd
ucaguguaguuuucuguau

SEQ ID NO: 2692679 - RNA, 13 nt, Haemophilus influenzae Rd
ucaguuaaaccua

SEQ ID NO: 2692680 - RNA, 17 nt, Haemophilus influenzae Rd
ucaguuacguaauauuu

SEQ ID NO: 2692681 - RNA, 13 nt, Haemophilus influenzae Rd
ucaguuaugcaaa

SEQ ID NO: 2692682 - RNA, 23 nt, Haemophilus influenzae Rd
ucaguuaugcaaauacauauuuu

SEQ ID NO: 2692683 - RNA, 15 nt, Haemophilus influenzae Rd
ucaguucaauuuaac

SEQ ID NO: 2692684 - RNA, 12 nt, Haemophilus influenzae Rd
ucaguugcuucg

SEQ ID NO: 2692685 - RNA, 21 nt, Haemophilus influenzae Rd
ucaguuuaagcuacagugagu

SEQ ID NO: 2692686 - RNA, 14 nt, Haemophilus influenzae Rd
ucaguuucaagcac

SEQ ID NO: 2692687 - RNA, 16 nt, Haemophilus influenzae Rd
ucaucuaauaauaaga

SEQ ID NO: 2692688 - RNA, 19 nt, Haemophilus influenzae Rd
ucaucuaauugauucaaau

SEQ ID NO: 2692689 - RNA, 14 nt, Haemophilus influenzae Rd
ucaucuacccacac

SEQ ID NO: 2692690 - RNA, 20 nt, Haemophilus influenzae Rd
ucaucuacccacacaccuuu

SEQ ID NO: 2692691 - RNA, 15 nt, Haemophilus influenzae Rd
ucaucuaguuuuaau

SEQ ID NO: 2692692 - RNA, 21 nt, Haemophilus influenzae Rd
ucaucuaguuuuaauacuaaa

SEQ ID NO: 2692693 - RNA, 19 nt, Haemophilus influenzae Rd
ucaucucuaaccuaaaaua

SEQ ID NO: 2692694 - RNA, 21 nt, Haemophilus influenzae Rd
ucaucugaacguaagaucaga

SEQ ID NO: 2692695 - RNA, 22 nt, Haemophilus influenzae Rd
ucaucugauacugccaaccuug

SEQ ID NO: 2692696 - RNA, 12 nt, Haemophilus influenzae Rd
ucaucugcauca

SEQ ID NO: 2692697 - RNA, 16 nt, Haemophilus influenzae Rd
ucaucugcaucacaaa

SEQ ID NO: 2692698 - RNA, 15 nt, Haemophilus influenzae Rd
ucaucuguuggaaug

SEQ ID NO: 2692699 - RNA, 20 nt, Haemophilus influenzae Rd
ucaucuguuggaaugaucga

SEQ ID NO: 2692700 - RNA, 15 nt, Haemophilus influenzae Rd
ucaucuuauuugauu

SEQ ID NO: 2692701 - RNA, 21 nt, Haemophilus influenzae Rd
ucaucuuccgugacaucaucu

SEQ ID NO: 2692702 - RNA, 13 nt, Haemophilus influenzae Rd
ucaucuucugcug

SEQ ID NO: 2692703 - RNA, 18 nt, Haemophilus influenzae Rd
ucaucuucugcugauaau

SEQ ID NO: 2692704 - RNA, 19 nt, Haemophilus influenzae Rd
ucaucuugauccauauauu

SEQ ID NO: 2692705 - RNA, 15 nt, Haemophilus influenzae Rd
ucaucuuuuaaauaa

SEQ ID NO: 2692706 - RNA, 16 nt, Haemophilus influenzae Rd
ucaucuuuuuauaaaa

SEQ ID NO: 2692707 - RNA, 20 nt, Haemophilus influenzae Rd
ucaugaauaauuuuguuacu

SEQ ID NO: 2692708 - RNA, 18 nt, Haemophilus influenzae Rd
ucaugauguaauucugcu

SEQ ID NO: 2692709 - RNA, 18 nt, Haemophilus influenzae Rd
ucauggcacaaaauaaug

SEQ ID NO: 2692710 - RNA, 14 nt, Haemophilus influenzae Rd
ucaugguuguaaua

SEQ ID NO: 2692711 - RNA, 16 nt, Haemophilus influenzae Rd
ucauuaaaaaauaauu

SEQ ID NO: 2692712 - RNA, 19 nt, Haemophilus influenzae Rd
ucauuaaaacaaagggcug

SEQ ID NO: 2692713 - RNA, 20 nt, Haemophilus influenzae Rd
ucauuaaaaccaauuuuuuc

SEQ ID NO: 2692714 - RNA, 21 nt, Haemophilus influenzae Rd
ucauuaaaaccaauuuuuuca

SEQ ID NO: 2692715 - RNA, 13 nt, Haemophilus influenzae Rd
ucauuaaacugaa

SEQ ID NO: 2692716 - RNA, 13 nt, Haemophilus influenzae Rd
ucauuaaauaacu

SEQ ID NO: 2692717 - RNA, 13 nt, Haemophilus influenzae Rd
ucauuaaauauaa

SEQ ID NO: 2692718 - RNA, 23 nt, Haemophilus influenzae Rd
ucauuaaauuuaguuaauauauu

SEQ ID NO: 2692719 - RNA, 13 nt, Haemophilus influenzae Rd
ucauuaaggugca

SEQ ID NO: 2692720 - RNA, 23 nt, Haemophilus influenzae Rd
ucauuaaggugcagauuaaauau

SEQ ID NO: 2692721 - RNA, 21 nt, Haemophilus influenzae Rd
ucauuaauuuuauuuuuugcg

SEQ ID NO: 2692722 - RNA, 14 nt, Haemophilus influenzae Rd
ucauuaauuuuuuc

SEQ ID NO: 2692723 - RNA, 15 nt, Haemophilus influenzae Rd
ucauuaauuuuuuca

SEQ ID NO: 2692724 - RNA, 16 nt, Haemophilus influenzae Rd
ucauuaauuuuuucac

SEQ ID NO: 2692725 - RNA, 12 nt, Haemophilus influenzae Rd
ucauuacauaau

SEQ ID NO: 2692726 - RNA, 18 nt, Haemophilus influenzae Rd
ucauuacgugcaaauaaa

SEQ ID NO: 2692727 - RNA, 21 nt, Haemophilus influenzae Rd
ucauuacgugcaaauaaauuu

SEQ ID NO: 2692728 - RNA, 22 nt, Haemophilus influenzae Rd
ucauuacgugcaaauaaauuug

SEQ ID NO: 2692729 - RNA, 16 nt, Haemophilus influenzae Rd
ucauuacuugaaauug

SEQ ID NO: 2692730 - RNA, 16 nt, Haemophilus influenzae Rd
ucauuacuuuuuuaag

SEQ ID NO: 2692731 - RNA, 20 nt, Haemophilus influenzae Rd
ucauuauauuccuuauucaa

SEQ ID NO: 2692732 - RNA, 17 nt, Haemophilus influenzae Rd
ucauuauccaacauuaa

SEQ ID NO: 2692733 - RNA, 19 nt, Haemophilus influenzae Rd
ucauuauccaacauuaaua

SEQ ID NO: 2692734 - RNA, 23 nt, Haemophilus influenzae Rd
ucauuauccaacauuaauaacgu

SEQ ID NO: 2692735 - RNA, 12 nt, Haemophilus influenzae Rd
ucauuaugaaaa

SEQ ID NO: 2692736 - RNA, 21 nt, Haemophilus influenzae Rd
ucauuauugccuuucaucauu

SEQ ID NO: 2692737 - RNA, 14 nt, Haemophilus influenzae Rd
ucauucaaaaauaa

SEQ ID NO: 2692738 - RNA, 15 nt, Haemophilus influenzae Rd
ucauucaaauaauuu

SEQ ID NO: 2692739 - RNA, 22 nt, Haemophilus influenzae Rd
ucauucaacaauucauaaauaa

SEQ ID NO: 2692740 - RNA, 20 nt, Haemophilus influenzae Rd
ucauucaaugcaacaauacg

SEQ ID NO: 2692741 - RNA, 16 nt, Haemophilus influenzae Rd
ucauucacucggaaug

SEQ ID NO: 2692742 - RNA, 13 nt, Haemophilus influenzae Rd
ucauucauuuugu

SEQ ID NO: 2692743 - RNA, 15 nt, Haemophilus influenzae Rd
ucauuccauuuugca

SEQ ID NO: 2692744 - RNA, 20 nt, Haemophilus influenzae Rd
ucauucuaauggcuuccgca

SEQ ID NO: 2692745 - RNA, 12 nt, Haemophilus influenzae Rd
ucauucuauuuu

SEQ ID NO: 2692746 - RNA, 20 nt, Haemophilus influenzae Rd
ucauugauggaauaaauuuu

SEQ ID NO: 2692747 - RNA, 21 nt, Haemophilus influenzae Rd
ucauugcaagugcaguuucag

SEQ ID NO: 2692748 - RNA, 13 nt, Haemophilus influenzae Rd
ucauugcauuuuu

SEQ ID NO: 2692749 - RNA, 14 nt, Haemophilus influenzae Rd
ucauugccauuucu

SEQ ID NO: 2692750 - RNA, 18 nt, Haemophilus influenzae Rd
ucauugcugcuuuaauuu

SEQ ID NO: 2692751 - RNA, 21 nt, Haemophilus influenzae Rd
ucauugcugcuuuaauuucau

SEQ ID NO: 2692752 - RNA, 20 nt, Haemophilus influenzae Rd
ucauuguaaagcccacauga

SEQ ID NO: 2692753 - RNA, 19 nt, Haemophilus influenzae Rd
ucauuguaguuuuucacgc

SEQ ID NO: 2692754 - RNA, 23 nt, Haemophilus influenzae Rd
ucauugugacggugaauuuauca

SEQ ID NO: 2692755 - RNA, 16 nt, Haemophilus influenzae Rd
ucauugugugcagaau

SEQ ID NO: 2692756 - RNA, 13 nt, Haemophilus influenzae Rd
ucauuuaaaacaa

SEQ ID NO: 2692757 - RNA, 20 nt, Haemophilus influenzae Rd
ucauuuaaccguaauuucaa

SEQ ID NO: 2692758 - RNA, 22 nt, Haemophilus influenzae Rd
ucauuuaaccguaauuucaaau

SEQ ID NO: 2692759 - RNA, 16 nt, Haemophilus influenzae Rd
ucauuuaauaauuuag

SEQ ID NO: 2692760 - RNA, 15 nt, Haemophilus influenzae Rd
ucauuuacaaacaua

SEQ ID NO: 2692761 - RNA, 13 nt, Haemophilus influenzae Rd
ucauuuacagguu

SEQ ID NO: 2692762 - RNA, 14 nt, Haemophilus influenzae Rd
ucauuuaguuuaag

SEQ ID NO: 2692763 - RNA, 13 nt, Haemophilus influenzae Rd
ucauuuauaaaau

SEQ ID NO: 2692764 - RNA, 17 nt, Haemophilus influenzae Rd
ucauuuauggaaauaaa

SEQ ID NO: 2692765 - RNA, 18 nt, Haemophilus influenzae Rd
ucauuuauggaaauaaau

SEQ ID NO: 2692766 - RNA, 16 nt, Haemophilus influenzae Rd
ucauuucaauguuugg

SEQ ID NO: 2692767 - RNA, 18 nt, Haemophilus influenzae Rd
ucauuucaucuacaccaa

SEQ ID NO: 2692768 - RNA, 19 nt, Haemophilus influenzae Rd
ucauuuccagcaucuaacg

SEQ ID NO: 2692769 - RNA, 23 nt, Haemophilus influenzae Rd
ucauuucucgggcugaaauaccu

SEQ ID NO: 2692770 - RNA, 15 nt, Haemophilus influenzae Rd
ucauuugaauuaaua

SEQ ID NO: 2692771 - RNA, 23 nt, Haemophilus influenzae Rd
ucauuugagaagcccgaauacug

SEQ ID NO: 2692772 - RNA, 22 nt, Haemophilus influenzae Rd
ucauuugagcggcuaugaauac

SEQ ID NO: 2692773 - RNA, 23 nt, Haemophilus influenzae Rd
ucauuugcaaaucaagaugacga

SEQ ID NO: 2692774 - RNA, 12 nt, Haemophilus influenzae Rd
ucauuugcucua

SEQ ID NO: 2692775 - RNA, 20 nt, Haemophilus influenzae Rd
ucauuugcuuuaacccauuu

SEQ ID NO: 2692776 - RNA, 17 nt, Haemophilus influenzae Rd
ucauuuggaucuaaaaa

SEQ ID NO: 2692777 - RNA, 19 nt, Haemophilus influenzae Rd
ucauuuguuaagcucacuu

SEQ ID NO: 2692778 - RNA, 22 nt, Haemophilus influenzae Rd
ucauuuguuagaaauacauuau

SEQ ID NO: 2692779 - RNA, 16 nt, Haemophilus influenzae Rd
ucauuuguuagaucag

SEQ ID NO: 2692780 - RNA, 22 nt, Haemophilus influenzae Rd
ucauuuguugguaaaucuaaca

SEQ ID NO: 2692781 - RNA, 20 nt, Haemophilus influenzae Rd
ucauuuguuuuccguauuuu

SEQ ID NO: 2692782 - RNA, 22 nt, Haemophilus influenzae Rd
ucauuuguuuuccguauuuuca

SEQ ID NO: 2692783 - RNA, 15 nt, Haemophilus influenzae Rd
ucauuuuaaagaguu

SEQ ID NO: 2692784 - RNA, 17 nt, Haemophilus influenzae Rd
ucauuuucaagccacca

SEQ ID NO: 2692785 - RNA, 11 nt, Haemophilus influenzae Rd
ucauuuucgca

SEQ ID NO: 2692786 - RNA, 18 nt, Haemophilus influenzae Rd
ucauuuugagauaaauuu

SEQ ID NO: 2692787 - RNA, 21 nt, Haemophilus influenzae Rd
ucauuuugagauaaauuuuua

SEQ ID NO: 2692788 - RNA, 20 nt, Haemophilus influenzae Rd
ucauuuugucagauuuauaa

SEQ ID NO: 2692789 - RNA, 19 nt, Haemophilus influenzae Rd
ucauuuuuauuuaaugggu

SEQ ID NO: 2692790 - RNA, 18 nt, Haemophilus influenzae Rd
ucauuuuuuggugcauac

SEQ ID NO: 2692791 - RNA, 13 nt, Haemophilus influenzae Rd
ucauuuuuuuaaa

SEQ ID NO: 2692792 - RNA, 16 nt, Haemophilus influenzae Rd
uccauaugaccauuaa

SEQ ID NO: 2692793 - RNA, 20 nt, Haemophilus influenzae Rd
uccauaugaccauuaaucac

SEQ ID NO: 2692794 - RNA, 18 nt, Haemophilus influenzae Rd
uccauauuguuucaauuu

SEQ ID NO: 2692795 - RNA, 12 nt, Haemophilus influenzae Rd
uccaucaaucau

SEQ ID NO: 2692796 - RNA, 18 nt, Haemophilus influenzae Rd
uccaucaauucuucccaa

SEQ ID NO: 2692797 - RNA, 17 nt, Haemophilus influenzae Rd
uccaucaccuucaacau

SEQ ID NO: 2692798 - RNA, 18 nt, Haemophilus influenzae Rd
uccaucaccuucaacaua

SEQ ID NO: 2692799 - RNA, 23 nt, Haemophilus influenzae Rd
uccaucauugcucgacaaagauu

SEQ ID NO: 2692800 - RNA, 14 nt, Haemophilus influenzae Rd
uccaucauuuuucg

SEQ ID NO: 2692801 - RNA, 17 nt, Haemophilus influenzae Rd
uccaucauuuuucgcaa

SEQ ID NO: 2692802 - RNA, 21 nt, Haemophilus influenzae Rd
uccaucauuuuucgcaaaauc

SEQ ID NO: 2692803 - RNA, 23 nt, Haemophilus influenzae Rd
uccaucauuuuucgcaaaaucuu

SEQ ID NO: 2692804 - RNA, 18 nt, Haemophilus influenzae Rd
uccaucgcacuguuauau

SEQ ID NO: 2692805 - RNA, 14 nt, Haemophilus influenzae Rd
uccaucuaaaaguu

SEQ ID NO: 2692806 - RNA, 15 nt, Haemophilus influenzae Rd
uccaucuuuuacaua

SEQ ID NO: 2692807 - RNA, 20 nt, Haemophilus influenzae Rd
uccaugaugaaauaauucau

SEQ ID NO: 2692808 - RNA, 17 nt, Haemophilus influenzae Rd
uccaugaugaugggaug

SEQ ID NO: 2692809 - RNA, 20 nt, Haemophilus influenzae Rd
uccauggacgguuacagcuu

SEQ ID NO: 2692810 - RNA, 13 nt, Haemophilus influenzae Rd
uccauuaauucau

SEQ ID NO: 2692811 - RNA, 21 nt, Haemophilus influenzae Rd
uccauuacguucauauaaauu

SEQ ID NO: 2692812 - RNA, 13 nt, Haemophilus influenzae Rd
uccauuccugcaa

SEQ ID NO: 2692813 - RNA, 12 nt, Haemophilus influenzae Rd
uccauucucaaa

SEQ ID NO: 2692814 - RNA, 15 nt, Haemophilus influenzae Rd
uccauugauauauuc

SEQ ID NO: 2692815 - RNA, 23 nt, Haemophilus influenzae Rd
uccauugcauugccuaaauacau

SEQ ID NO: 2692816 - RNA, 17 nt, Haemophilus influenzae Rd
uccauuggugaaaucaa

SEQ ID NO: 2692817 - RNA, 22 nt, Haemophilus influenzae Rd
uccauuggugaaaucaacaauc

SEQ ID NO: 2692818 - RNA, 16 nt, Haemophilus influenzae Rd
uccauuguuguuuauu

SEQ ID NO: 2692819 - RNA, 21 nt, Haemophilus influenzae Rd
uccauuucgucgcuuuucccu

SEQ ID NO: 2692820 - RNA, 19 nt, Haemophilus influenzae Rd
uccauuugaagaauuuguu

SEQ ID NO: 2692821 - RNA, 20 nt, Haemophilus influenzae Rd
uccauuugcccacauagcuu

SEQ ID NO: 2692822 - RNA, 15 nt, Haemophilus influenzae Rd
uccauuuugaacaag

SEQ ID NO: 2692823 - RNA, 13 nt, Haemophilus influenzae Rd
uccauuuuuuucu

SEQ ID NO: 2692824 - RNA, 19 nt, Haemophilus influenzae Rd
uccauuuuuuuugcauuua

SEQ ID NO: 2692825 - RNA, 13 nt, Haemophilus influenzae Rd
ucccaaaaacuaa

SEQ ID NO: 2692826 - RNA, 20 nt, Haemophilus influenzae Rd
ucccaaaagcaaaugaggaa

SEQ ID NO: 2692827 - RNA, 13 nt, Haemophilus influenzae Rd
ucccaaaauauuu

SEQ ID NO: 2692828 - RNA, 21 nt, Haemophilus influenzae Rd
ucccaaaauauuuucaaauaa

SEQ ID NO: 2692829 - RNA, 18 nt, Haemophilus influenzae Rd
ucccaaagucuuaaugac

SEQ ID NO: 2692830 - RNA, 21 nt, Haemophilus influenzae Rd
ucccaaccgauauacucuccc

SEQ ID NO: 2692831 - RNA, 16 nt, Haemophilus influenzae Rd
ucccaacuuuaugucc

SEQ ID NO: 2692832 - RNA, 20 nt, Haemophilus influenzae Rd
ucccaagauuuuauacauuc

SEQ ID NO: 2692833 - RNA, 23 nt, Haemophilus influenzae Rd
ucccaauggggguuagguaaaaa

SEQ ID NO: 2692834 - RNA, 13 nt, Haemophilus influenzae Rd
ucccaauuauugg

SEQ ID NO: 2692835 - RNA, 15 nt, Haemophilus influenzae Rd
ucccagauuuuacuu

SEQ ID NO: 2692836 - RNA, 20 nt, Haemophilus influenzae Rd
ucccagcauaaauaaauagc

SEQ ID NO: 2692837 - RNA, 12 nt, Haemophilus influenzae Rd
ucccaguaaaua

SEQ ID NO: 2692838 - RNA, 14 nt, Haemophilus influenzae Rd
ucccaguaaauauc

SEQ ID NO: 2692839 - RNA, 17 nt, Haemophilus influenzae Rd
ucccaguaaucuuuuaa

SEQ ID NO: 2692840 - RNA, 14 nt, Haemophilus influenzae Rd
ucccagucaaaaau

SEQ ID NO: 2692841 - RNA, 19 nt, Haemophilus influenzae Rd
ucccagugcugaaauauag

SEQ ID NO: 2692842 - RNA, 21 nt, Haemophilus influenzae Rd
ucccauaaaucggcguauuuu

SEQ ID NO: 2692843 - RNA, 18 nt, Haemophilus influenzae Rd
ucccauaacaagugcuag

SEQ ID NO: 2692844 - RNA, 14 nt, Haemophilus influenzae Rd
ucccauaauccagc

SEQ ID NO: 2692845 - RNA, 15 nt, Haemophilus influenzae Rd
ucccauaauccagca

SEQ ID NO: 2692846 - RNA, 16 nt, Haemophilus influenzae Rd
ucccauaccguauuuu

SEQ ID NO: 2692847 - RNA, 22 nt, Haemophilus influenzae Rd
ucccauauacuugccaaaacga

SEQ ID NO: 2692848 - RNA, 19 nt, Haemophilus influenzae Rd
ucccauauuuaaaaccaaa

SEQ ID NO: 2692849 - RNA, 21 nt, Haemophilus influenzae Rd
ucccaucuuuaagaguaaauu

SEQ ID NO: 2692850 - RNA, 17 nt, Haemophilus influenzae Rd
ucccauucuuaaaucau

SEQ ID NO: 2692851 - RNA, 21 nt, Haemophilus influenzae Rd
ucccauuuagguuagaauaaa

SEQ ID NO: 2692852 - RNA, 22 nt, Haemophilus influenzae Rd
ucccauuuagguuagaauaaac

SEQ ID NO: 2692853 - RNA, 23 nt, Haemophilus influenzae Rd
ucccauuuagguuagaauaaacc

SEQ ID NO: 2692854 - RNA, 15 nt, Haemophilus influenzae Rd
ucccauuucaucuuc

SEQ ID NO: 2692855 - RNA, 17 nt, Haemophilus influenzae Rd
ucccauuucaucuucag

SEQ ID NO: 2692856 - RNA, 22 nt, Haemophilus influenzae Rd
ucccauuucuaaugcaauuuca

SEQ ID NO: 2692857 - RNA, 23 nt, Haemophilus influenzae Rd
ucccauuucuaaugcaauuucaa

SEQ ID NO: 2692858 - RNA, 13 nt, Haemophilus influenzae Rd
uccccaagguaua

SEQ ID NO: 2692859 - RNA, 17 nt, Haemophilus influenzae Rd
uccccacuuaucuuaaa

SEQ ID NO: 2692860 - RNA, 21 nt, Haemophilus influenzae Rd
uccccauacaaguauuuuccu

SEQ ID NO: 2692861 - RNA, 19 nt, Haemophilus influenzae Rd
uccccauaucucugccauc

SEQ ID NO: 2692862 - RNA, 14 nt, Haemophilus influenzae Rd
uccccauuuguaga

SEQ ID NO: 2692863 - RNA, 14 nt, Haemophilus influenzae Rd
ucccccaguacauc

SEQ ID NO: 2692864 - RNA, 15 nt, Haemophilus influenzae Rd
uccccgaugauuuuu

SEQ ID NO: 2692865 - RNA, 21 nt, Haemophilus influenzae Rd
uccccgcuuucgcuucugcuu

SEQ ID NO: 2692866 - RNA, 19 nt, Haemophilus influenzae Rd
uccccugucaauuuuucua

SEQ ID NO: 2692867 - RNA, 21 nt, Haemophilus influenzae Rd
uccccugucaauuuuucuacu

SEQ ID NO: 2692868 - RNA, 18 nt, Haemophilus influenzae Rd
uccccuuaacuaauuguu

SEQ ID NO: 2692869 - RNA, 15 nt, Haemophilus influenzae Rd
uccccuuccuugaca

SEQ ID NO: 2692870 - RNA, 14 nt, Haemophilus influenzae Rd
uccccuuguucuuc

SEQ ID NO: 2692871 - RNA, 18 nt, Haemophilus influenzae Rd
ucccgaaaauuguucagc

SEQ ID NO: 2692872 - RNA, 14 nt, Haemophilus influenzae Rd
ucccgcaggaggag

SEQ ID NO: 2692873 - RNA, 15 nt, Haemophilus influenzae Rd
ucccgcauauaaaau

SEQ ID NO: 2692874 - RNA, 16 nt, Haemophilus influenzae Rd
ucccgcuuuugccaua

SEQ ID NO: 2692875 - RNA, 19 nt, Haemophilus influenzae Rd
ucccgcuuuugccauauuu

SEQ ID NO: 2692876 - RNA, 22 nt, Haemophilus influenzae Rd
ucccgucaauuccauaauaucu

SEQ ID NO: 2692877 - RNA, 14 nt, Haemophilus influenzae Rd
ucccuaaaaucuuc

SEQ ID NO: 2692878 - RNA, 20 nt, Haemophilus influenzae Rd
ucccuauaaugcaccgcaca

SEQ ID NO: 2692879 - RNA, 12 nt, Haemophilus influenzae Rd
ucccucaaaauu

SEQ ID NO: 2692880 - RNA, 17 nt, Haemophilus influenzae Rd
ucccucuuuaucuuuuu

SEQ ID NO: 2692881 - RNA, 14 nt, Haemophilus influenzae Rd
ucccucuuuuucag

SEQ ID NO: 2692882 - RNA, 20 nt, Haemophilus influenzae Rd
ucccugauagguaauaauag

SEQ ID NO: 2692883 - RNA, 15 nt, Haemophilus influenzae Rd
ucccuguauaaagau

SEQ ID NO: 2692884 - RNA, 14 nt, Haemophilus influenzae Rd
ucccugucuggcaa

SEQ ID NO: 2692885 - RNA, 12 nt, Haemophilus influenzae Rd
ucccuguucaaa

SEQ ID NO: 2692886 - RNA, 11 nt, Haemophilus influenzae Rd
ucccuuuucuu

SEQ ID NO: 2692887 - RNA, 17 nt, Haemophilus influenzae Rd
uccgaaauuaauuuggg

SEQ ID NO: 2692888 - RNA, 14 nt, Haemophilus influenzae Rd
uccgagcucuuuca

SEQ ID NO: 2692889 - RNA, 16 nt, Haemophilus influenzae Rd
uccgauacauaauacu

SEQ ID NO: 2692890 - RNA, 18 nt, Haemophilus influenzae Rd
uccgaucaaauugucaaa

SEQ ID NO: 2692891 - RNA, 21 nt, Haemophilus influenzae Rd
uccgaucaaauugucaaaauu

SEQ ID NO: 2692892 - RNA, 21 nt, Haemophilus influenzae Rd
uccgauuuuaauugugcaauu

SEQ ID NO: 2692893 - RNA, 22 nt, Haemophilus influenzae Rd
uccgcaaccagcagaaaauaac

SEQ ID NO: 2692894 - RNA, 15 nt, Haemophilus influenzae Rd
uccgcaauauaguca

SEQ ID NO: 2692895 - RNA, 16 nt, Haemophilus influenzae Rd
uccgcaauauagucaa

SEQ ID NO: 2692896 - RNA, 23 nt, Haemophilus influenzae Rd
uccgcauuaaucggcaauguuuu

SEQ ID NO: 2692897 - RNA, 15 nt, Haemophilus influenzae Rd
uccgcauuugguggg

SEQ ID NO: 2692898 - RNA, 17 nt, Haemophilus influenzae Rd
uccgcauuuuuuuauuc

SEQ ID NO: 2692899 - RNA, 13 nt, Haemophilus influenzae Rd
uccgccacuuuga

SEQ ID NO: 2692900 - RNA, 14 nt, Haemophilus influenzae Rd
uccgccugaagccu

SEQ ID NO: 2692901 - RNA, 23 nt, Haemophilus influenzae Rd
uccgcguaaaguuuuaaaccaag

SEQ ID NO: 2692902 - RNA, 11 nt, Haemophilus influenzae Rd
uccgcuaaugc

SEQ ID NO: 2692903 - RNA, 17 nt, Haemophilus influenzae Rd
uccgcuuguaauuucau

SEQ ID NO: 2692904 - RNA, 21 nt, Haemophilus influenzae Rd
uccgcuuguaauuucauuuua

SEQ ID NO: 2692905 - RNA, 14 nt, Haemophilus influenzae Rd
uccgcuuuuuucgc

SEQ ID NO: 2692906 - RNA, 15 nt, Haemophilus influenzae Rd
uccgcuuuuuucgca

SEQ ID NO: 2692907 - RNA, 21 nt, Haemophilus influenzae Rd
uccgcuuuuuucgcaccaaug

SEQ ID NO: 2692908 - RNA, 12 nt, Haemophilus influenzae Rd
uccguaaaauac

SEQ ID NO: 2692909 - RNA, 22 nt, Haemophilus influenzae Rd
uccguaaucgugccugccacca

SEQ ID NO: 2692910 - RNA, 20 nt, Haemophilus influenzae Rd
uccguaguuauuuauuuaag

SEQ ID NO: 2692911 - RNA, 20 nt, Haemophilus influenzae Rd
uccgugaacugaguuuucac

SEQ ID NO: 2692912 - RNA, 21 nt, Haemophilus influenzae Rd
uccguguacacaaugcuauca

SEQ ID NO: 2692913 - RNA, 14 nt, Haemophilus influenzae Rd
uccguguuuacgau

SEQ ID NO: 2692914 - RNA, 21 nt, Haemophilus influenzae Rd
uccguguuuacgauaaugcca

SEQ ID NO: 2692915 - RNA, 16 nt, Haemophilus influenzae Rd
uccguuaagaaacgau

SEQ ID NO: 2692916 - RNA, 13 nt, Haemophilus influenzae Rd
uccguuaauaaug

SEQ ID NO: 2692917 - RNA, 17 nt, Haemophilus influenzae Rd
uccguuggcucaagccu

SEQ ID NO: 2692918 - RNA, 19 nt, Haemophilus influenzae Rd
uccguuuuuaaucucccaa

SEQ ID NO: 2692919 - RNA, 15 nt, Haemophilus influenzae Rd
uccuaaauaaagauu

SEQ ID NO: 2692920 - RNA, 14 nt, Haemophilus influenzae Rd
uccuaacuuuucuu

SEQ ID NO: 2692921 - RNA, 18 nt, Haemophilus influenzae Rd
uccuaacuuuucuucaau

SEQ ID NO: 2692922 - RNA, 20 nt, Haemophilus influenzae Rd
uccuaauagacaggcauauu

SEQ ID NO: 2692923 - RNA, 18 nt, Haemophilus influenzae Rd
uccuaaugugcaaucagc

SEQ ID NO: 2692924 - RNA, 17 nt, Haemophilus influenzae Rd
uccuacauuaaaagaua

SEQ ID NO: 2692925 - RNA, 18 nt, Haemophilus influenzae Rd
uccuacuacagcccaauu

SEQ ID NO: 2692926 - RNA, 16 nt, Haemophilus influenzae Rd
uccuagaguaaguaac

SEQ ID NO: 2692927 - RNA, 16 nt, Haemophilus influenzae Rd
uccuaguuuuuucccu

SEQ ID NO: 2692928 - RNA, 14 nt, Haemophilus influenzae Rd
uccuauuaauuuaa

SEQ ID NO: 2692929 - RNA, 15 nt, Haemophilus influenzae Rd
uccuauuaauuuaau

SEQ ID NO: 2692930 - RNA, 20 nt, Haemophilus influenzae Rd
uccuauuaauuuaauucuaa

SEQ ID NO: 2692931 - RNA, 23 nt, Haemophilus influenzae Rd
uccuauuuacguaaaaaaguuug

SEQ ID NO: 2692932 - RNA, 14 nt, Haemophilus influenzae Rd
uccuauuuuuaaug

SEQ ID NO: 2692933 - RNA, 12 nt, Haemophilus influenzae Rd
uccucagguuca

SEQ ID NO: 2692934 - RNA, 18 nt, Haemophilus influenzae Rd
uccucagguucaaacauc

SEQ ID NO: 2692935 - RNA, 16 nt, Haemophilus influenzae Rd
uccucccauucuuaaa

SEQ ID NO: 2692936 - RNA, 13 nt, Haemophilus influenzae Rd
uccucuccaucau

SEQ ID NO: 2692937 - RNA, 15 nt, Haemophilus influenzae Rd
uccucucgccaaauc

SEQ ID NO: 2692938 - RNA, 16 nt, Haemophilus influenzae Rd
uccucugcauucugaa

SEQ ID NO: 2692939 - RNA, 21 nt, Haemophilus influenzae Rd
uccugauaaugucccugcccu

SEQ ID NO: 2692940 - RNA, 15 nt, Haemophilus influenzae Rd
uccugcaucagugau

SEQ ID NO: 2692941 - RNA, 15 nt, Haemophilus influenzae Rd
uccugcuuuuuucaa

SEQ ID NO: 2692942 - RNA, 15 nt, Haemophilus influenzae Rd
uccugucaguuugcu

SEQ ID NO: 2692943 - RNA, 15 nt, Haemophilus influenzae Rd
uccuguuugagcaag

SEQ ID NO: 2692944 - RNA, 13 nt, Haemophilus influenzae Rd
uccuuaauuucau

SEQ ID NO: 2692945 - RNA, 14 nt, Haemophilus influenzae Rd
uccuuaauuucauu

SEQ ID NO: 2692946 - RNA, 17 nt, Haemophilus influenzae Rd
uccuuaauuucauuaau

SEQ ID NO: 2692947 - RNA, 16 nt, Haemophilus influenzae Rd
uccuuaccuuccacuu

SEQ ID NO: 2692948 - RNA, 14 nt, Haemophilus influenzae Rd
uccuuacgcugaau

SEQ ID NO: 2692949 - RNA, 20 nt, Haemophilus influenzae Rd
uccuuagaaaguaaacaauu

SEQ ID NO: 2692950 - RNA, 21 nt, Haemophilus influenzae Rd
uccuuauccugccuugcauuc

SEQ ID NO: 2692951 - RNA, 20 nt, Haemophilus influenzae Rd
uccuuauucgcugcaaaauc

SEQ ID NO: 2692952 - RNA, 13 nt, Haemophilus influenzae Rd
uccuucaaucgca

SEQ ID NO: 2692953 - RNA, 22 nt, Haemophilus influenzae Rd
uccuucagggcggagauauaag

SEQ ID NO: 2692954 - RNA, 18 nt, Haemophilus influenzae Rd
uccuucaucgucuucuuc

SEQ ID NO: 2692955 - RNA, 18 nt, Haemophilus influenzae Rd
uccuucgccauuuuuaac

SEQ ID NO: 2692956 - RNA, 19 nt, Haemophilus influenzae Rd
uccuucgccuucggcuccc

SEQ ID NO: 2692957 - RNA, 18 nt, Haemophilus influenzae Rd
uccuucggcauauaagau

SEQ ID NO: 2692958 - RNA, 20 nt, Haemophilus influenzae Rd
uccuucggcauauaagauuu

SEQ ID NO: 2692959 - RNA, 15 nt, Haemophilus influenzae Rd
uccuugauauucaag

SEQ ID NO: 2692960 - RNA, 15 nt, Haemophilus influenzae Rd
uccuugguuaauccu

SEQ ID NO: 2692961 - RNA, 16 nt, Haemophilus influenzae Rd
uccuugguuaauccua

SEQ ID NO: 2692962 - RNA, 14 nt, Haemophilus influenzae Rd
uccuugguuuucuu

SEQ ID NO: 2692963 - RNA, 14 nt, Haemophilus influenzae Rd
uccuuguuuuucaa

SEQ ID NO: 2692964 - RNA, 19 nt, Haemophilus influenzae Rd
uccuuuacugacuuucuaa

SEQ ID NO: 2692965 - RNA, 15 nt, Haemophilus influenzae Rd
uccuuuauagcaauu

SEQ ID NO: 2692966 - RNA, 16 nt, Haemophilus influenzae Rd
uccuuucuuuccgauu

SEQ ID NO: 2692967 - RNA, 17 nt, Haemophilus influenzae Rd
uccuuuucauaaaaauu

SEQ ID NO: 2692968 - RNA, 17 nt, Haemophilus influenzae Rd
uccuuuugcauuauuga

SEQ ID NO: 2692969 - RNA, 18 nt, Haemophilus influenzae Rd
uccuuuugccauuuugcu

SEQ ID NO: 2692970 - RNA, 16 nt, Haemophilus influenzae Rd
uccuuuuucuacuucu

SEQ ID NO: 2692971 - RNA, 16 nt, Haemophilus influenzae Rd
uccuuuuuuauuuauu

SEQ ID NO: 2692972 - RNA, 21 nt, Haemophilus influenzae Rd
uccuuuuuuauuuauuugcua

SEQ ID NO: 2692973 - RNA, 13 nt, Haemophilus influenzae Rd
uccuuuuuuugaa

SEQ ID NO: 2692974 - RNA, 21 nt, Haemophilus influenzae Rd
ucgaaaaaacgcggucuaaau

SEQ ID NO: 2692975 - RNA, 19 nt, Haemophilus influenzae Rd
ucgaaaacauaauccgcau

SEQ ID NO: 2692976 - RNA, 20 nt, Haemophilus influenzae Rd
ucgaaaauaacuucauccau

SEQ ID NO: 2692977 - RNA, 13 nt, Haemophilus influenzae Rd
ucgaaacauaaaa

SEQ ID NO: 2692978 - RNA, 20 nt, Haemophilus influenzae Rd
ucgaaaguggcuuuuuucau

SEQ ID NO: 2692979 - RNA, 18 nt, Haemophilus influenzae Rd
ucgaaaguugguuuugca

SEQ ID NO: 2692980 - RNA, 13 nt, Haemophilus influenzae Rd
ucgaaaucauaau

SEQ ID NO: 2692981 - RNA, 19 nt, Haemophilus influenzae Rd
ucgaaaucauaaucugaaa

SEQ ID NO: 2692982 - RNA, 14 nt, Haemophilus influenzae Rd
ucgaaaucuaauuu

SEQ ID NO: 2692983 - RNA, 14 nt, Haemophilus influenzae Rd
ucgaaauuaaaaua

SEQ ID NO: 2692984 - RNA, 16 nt, Haemophilus influenzae Rd
ucgaaauuaaaauaau

SEQ ID NO: 2692985 - RNA, 21 nt, Haemophilus influenzae Rd
ucgaacgaguaaucuaauucu

SEQ ID NO: 2692986 - RNA, 20 nt, Haemophilus influenzae Rd
ucgaacuuagucucuuuauu

SEQ ID NO: 2692987 - RNA, 21 nt, Haemophilus influenzae Rd
ucgaacuuagucucuuuauuu

SEQ ID NO: 2692988 - RNA, 16 nt, Haemophilus influenzae Rd
ucgaagguucgaaucc

SEQ ID NO: 2692989 - RNA, 19 nt, Haemophilus influenzae Rd
ucgaauagauuuuuaccaa

SEQ ID NO: 2692990 - RNA, 22 nt, Haemophilus influenzae Rd
ucgaauauugagggcuuuuuua

SEQ ID NO: 2692991 - RNA, 17 nt, Haemophilus influenzae Rd
ucgaauauugaucaucu

SEQ ID NO: 2692992 - RNA, 15 nt, Haemophilus influenzae Rd
ucgaauuauuuuacg

SEQ ID NO: 2692993 - RNA, 14 nt, Haemophilus influenzae Rd
ucgacaaauuaaua

SEQ ID NO: 2692994 - RNA, 16 nt, Haemophilus influenzae Rd
ucgacaggaacauuca

SEQ ID NO: 2692995 - RNA, 23 nt, Haemophilus influenzae Rd
ucgacauaacauuguuuuaaugu

SEQ ID NO: 2692996 - RNA, 14 nt, Haemophilus influenzae Rd
ucgaccauugcacg

SEQ ID NO: 2692997 - RNA, 16 nt, Haemophilus influenzae Rd
ucgaccguuuuuucuu

SEQ ID NO: 2692998 - RNA, 23 nt, Haemophilus influenzae Rd
ucgaccguuuuuucuuuuuccug

SEQ ID NO: 2692999 - RNA, 14 nt, Haemophilus influenzae Rd
ucgacuuuguccaa

SEQ ID NO: 2693000 - RNA, 13 nt, Haemophilus influenzae Rd
ucgacuuuuucac

SEQ ID NO: 2693001 - RNA, 13 nt, Haemophilus influenzae Rd
ucgaggcaccauu

SEQ ID NO: 2693002 - RNA, 14 nt, Haemophilus influenzae Rd
ucgaggcaccauuu

SEQ ID NO: 2693003 - RNA, 16 nt, Haemophilus influenzae Rd
ucggaauuuuuuucaa

SEQ ID NO: 2693004 - RNA, 17 nt, Haemophilus influenzae Rd
ucggauaauaauuuuuc

SEQ ID NO: 2693005 - RNA, 18 nt, Haemophilus influenzae Rd
ucggauaauaauuuuucc

SEQ ID NO: 2693006 - RNA, 16 nt, Haemophilus influenzae Rd
ucggauuaagugcggu

SEQ ID NO: 2693007 - RNA, 21 nt, Haemophilus influenzae Rd
ucggauuucuuuauucugaaa

SEQ ID NO: 2693008 - RNA, 13 nt, Haemophilus influenzae Rd
ucggauuuuucaa

SEQ ID NO: 2693009 - RNA, 21 nt, Haemophilus influenzae Rd
ucggcaagccacauacgcaaa

SEQ ID NO: 2693010 - RNA, 14 nt, Haemophilus influenzae Rd
ucggcaauguuuua

SEQ ID NO: 2693011 - RNA, 21 nt, Haemophilus influenzae Rd
ucggcauauaagauuuuugcc

SEQ ID NO: 2693012 - RNA, 20 nt, Haemophilus influenzae Rd
ucggcuacuauacacaucag

SEQ ID NO: 2693013 - RNA, 15 nt, Haemophilus influenzae Rd
ucggcuauuucagcu

SEQ ID NO: 2693014 - RNA, 13 nt, Haemophilus influenzae Rd
ucggcuuuuucaa

SEQ ID NO: 2693015 - RNA, 15 nt, Haemophilus influenzae Rd
ucgggcgaaaccuuu

SEQ ID NO: 2693016 - RNA, 19 nt, Haemophilus influenzae Rd
ucggggcauuggcaagcau

SEQ ID NO: 2693017 - RNA, 14 nt, Haemophilus influenzae Rd
ucgguaaaaaucau

SEQ ID NO: 2693018 - RNA, 20 nt, Haemophilus influenzae Rd
ucggugaaugcauuggcuga

SEQ ID NO: 2693019 - RNA, 22 nt, Haemophilus influenzae Rd
ucgguguucugcaucaauaauu

SEQ ID NO: 2693020 - RNA, 16 nt, Haemophilus influenzae Rd
ucgguuguuuuuuaau

SEQ ID NO: 2693021 - RNA, 16 nt, Haemophilus influenzae Rd
ucgguuucaugauugg

SEQ ID NO: 2693022 - RNA, 13 nt, Haemophilus influenzae Rd
ucgguuuuuucau

SEQ ID NO: 2693023 - RNA, 21 nt, Haemophilus influenzae Rd
ucguaaauucuguuuagucuu

SEQ ID NO: 2693024 - RNA, 22 nt, Haemophilus influenzae Rd
ucguaaccgacucguccaucaa

SEQ ID NO: 2693025 - RNA, 20 nt, Haemophilus influenzae Rd
ucguacaaaugaaaagggcg

SEQ ID NO: 2693026 - RNA, 17 nt, Haemophilus influenzae Rd
ucguacaucgaaaacau

SEQ ID NO: 2693027 - RNA, 18 nt, Haemophilus influenzae Rd
ucguacaucgaaaacaua

SEQ ID NO: 2693028 - RNA, 17 nt, Haemophilus influenzae Rd
ucguagaguuuuuucac

SEQ ID NO: 2693029 - RNA, 14 nt, Haemophilus influenzae Rd
ucguagccaauuuu

SEQ ID NO: 2693030 - RNA, 16 nt, Haemophilus influenzae Rd
ucguagccaauuuugu

SEQ ID NO: 2693031 - RNA, 12 nt, Haemophilus influenzae Rd
ucguagccugau

SEQ ID NO: 2693032 - RNA, 13 nt, Haemophilus influenzae Rd
ucguauaagcccc

SEQ ID NO: 2693033 - RNA, 11 nt, Haemophilus influenzae Rd
ucguauaagcg

SEQ ID NO: 2693034 - RNA, 13 nt, Haemophilus influenzae Rd
ucguauaagcguu

SEQ ID NO: 2693035 - RNA, 16 nt, Haemophilus influenzae Rd
ucguauaagcguuuac

SEQ ID NO: 2693036 - RNA, 14 nt, Haemophilus influenzae Rd
ucguauaauauuuu

SEQ ID NO: 2693037 - RNA, 17 nt, Haemophilus influenzae Rd
ucguauucccaaauuuu

SEQ ID NO: 2693038 - RNA, 15 nt, Haemophilus influenzae Rd
ucgucaaaaaugucg

SEQ ID NO: 2693039 - RNA, 11 nt, Haemophilus influenzae Rd
ucgucaaaauc

SEQ ID NO: 2693040 - RNA, 20 nt, Haemophilus influenzae Rd
ucgucaaaggaacagacagu

SEQ ID NO: 2693041 - RNA, 16 nt, Haemophilus influenzae Rd
ucgucaaauuuaaaua

SEQ ID NO: 2693042 - RNA, 22 nt, Haemophilus influenzae Rd
ucgucaaucaucccuucuuuua

SEQ ID NO: 2693043 - RNA, 18 nt, Haemophilus influenzae Rd
ucguccaaagaaguuuuc

SEQ ID NO: 2693044 - RNA, 15 nt, Haemophilus influenzae Rd
ucgucgcuuuucccu

SEQ ID NO: 2693045 - RNA, 15 nt, Haemophilus influenzae Rd
ucgucuaucuaagau

SEQ ID NO: 2693046 - RNA, 22 nt, Haemophilus influenzae Rd
ucgucucaguaacgauguugca

SEQ ID NO: 2693047 - RNA, 20 nt, Haemophilus influenzae Rd
ucgucuuaauuuuuuaaccg

SEQ ID NO: 2693048 - RNA, 14 nt, Haemophilus influenzae Rd
ucgucuuugaagcc

SEQ ID NO: 2693049 - RNA, 15 nt, Haemophilus influenzae Rd
ucgugaaagaauaau

SEQ ID NO: 2693050 - RNA, 19 nt, Haemophilus influenzae Rd
ucgugaaucguuuguaaaa

SEQ ID NO: 2693051 - RNA, 19 nt, Haemophilus influenzae Rd
ucgugaccaaguucacaaa

SEQ ID NO: 2693052 - RNA, 18 nt, Haemophilus influenzae Rd
ucgugauauuucacuaaa

SEQ ID NO: 2693053 - RNA, 18 nt, Haemophilus influenzae Rd
ucgugauccgcaauaauu

SEQ ID NO: 2693054 - RNA, 13 nt, Haemophilus influenzae Rd
ucgugaucugcau

SEQ ID NO: 2693055 - RNA, 18 nt, Haemophilus influenzae Rd
ucgugcaaauuuuuucaa

SEQ ID NO: 2693056 - RNA, 14 nt, Haemophilus influenzae Rd
ucgugccuauuuau

SEQ ID NO: 2693057 - RNA, 14 nt, Haemophilus influenzae Rd
ucgugccugccacc

SEQ ID NO: 2693058 - RNA, 15 nt, Haemophilus influenzae Rd
ucgugcuguuuucaa

SEQ ID NO: 2693059 - RNA, 20 nt, Haemophilus influenzae Rd
ucgugcuuggauauucugca

SEQ ID NO: 2693060 - RNA, 15 nt, Haemophilus influenzae Rd
ucguguaaaaguugu

SEQ ID NO: 2693061 - RNA, 21 nt, Haemophilus influenzae Rd
ucguguaaaaguuguuuugcu

SEQ ID NO: 2693062 - RNA, 19 nt, Haemophilus influenzae Rd
ucgugugccaucaguuccu

SEQ ID NO: 2693063 - RNA, 15 nt, Haemophilus influenzae Rd
ucguguuuaguuuua

SEQ ID NO: 2693064 - RNA, 19 nt, Haemophilus influenzae Rd
ucguguuuaguuuuauagu

SEQ ID NO: 2693065 - RNA, 23 nt, Haemophilus influenzae Rd
ucguuaaacugccgccuucuucc

SEQ ID NO: 2693066 - RNA, 15 nt, Haemophilus influenzae Rd
ucguuaaaguugcug

SEQ ID NO: 2693067 - RNA, 20 nt, Haemophilus influenzae Rd
ucguuaauuaauugcucuga

SEQ ID NO: 2693068 - RNA, 12 nt, Haemophilus influenzae Rd
ucguuaccuuua

SEQ ID NO: 2693069 - RNA, 14 nt, Haemophilus influenzae Rd
ucguuauuauuaag

SEQ ID NO: 2693070 - RNA, 20 nt, Haemophilus influenzae Rd
ucguucaacccauuuuccau

SEQ ID NO: 2693071 - RNA, 15 nt, Haemophilus influenzae Rd
ucguucccaaauauc

SEQ ID NO: 2693072 - RNA, 13 nt, Haemophilus influenzae Rd
ucguucuaaaaug

SEQ ID NO: 2693073 - RNA, 21 nt, Haemophilus influenzae Rd
ucguucuuaccccaacaaaca

SEQ ID NO: 2693074 - RNA, 15 nt, Haemophilus influenzae Rd
ucguugcaucuucua

SEQ ID NO: 2693075 - RNA, 16 nt, Haemophilus influenzae Rd
ucguugcaucuucuau

SEQ ID NO: 2693076 - RNA, 16 nt, Haemophilus influenzae Rd
ucguuguaaucuucau

SEQ ID NO: 2693077 - RNA, 13 nt, Haemophilus influenzae Rd
ucguuguucuuua

SEQ ID NO: 2693078 - RNA, 20 nt, Haemophilus influenzae Rd
ucguuguuuuaauaaacaua

SEQ ID NO: 2693079 - RNA, 15 nt, Haemophilus influenzae Rd
ucguuuaaauuaaaa

SEQ ID NO: 2693080 - RNA, 15 nt, Haemophilus influenzae Rd
ucguuuacuuaaaau

SEQ ID NO: 2693081 - RNA, 18 nt, Haemophilus influenzae Rd
ucguuucauaugccauug

SEQ ID NO: 2693082 - RNA, 16 nt, Haemophilus influenzae Rd
ucguuucaucgagaaa

SEQ ID NO: 2693083 - RNA, 19 nt, Haemophilus influenzae Rd
ucguuugauauaccauucu

SEQ ID NO: 2693084 - RNA, 13 nt, Haemophilus influenzae Rd
ucguuuguucuga

SEQ ID NO: 2693085 - RNA, 14 nt, Haemophilus influenzae Rd
ucguuuguuugaaa

SEQ ID NO: 2693086 - RNA, 13 nt, Haemophilus influenzae Rd
ucguuuucugcuu

SEQ ID NO: 2693087 - RNA, 15 nt, Haemophilus influenzae Rd
ucuaaaaaaaucacc

SEQ ID NO: 2693088 - RNA, 20 nt, Haemophilus influenzae Rd
ucuaaaaaaauccuaaauaa

SEQ ID NO: 2693089 - RNA, 19 nt, Haemophilus influenzae Rd
ucuaaaaaaccaccagaaa

SEQ ID NO: 2693090 - RNA, 23 nt, Haemophilus influenzae Rd
ucuaaaaaagaguaaauauuguc

SEQ ID NO: 2693091 - RNA, 20 nt, Haemophilus influenzae Rd
ucuaaaaaaucaaucaggcu

SEQ ID NO: 2693092 - RNA, 12 nt, Haemophilus influenzae Rd
ucuaaaaacuuu

SEQ ID NO: 2693093 - RNA, 22 nt, Haemophilus influenzae Rd
ucuaaaaagaagcucacuuuau

SEQ ID NO: 2693094 - RNA, 22 nt, Haemophilus influenzae Rd
ucuaaaaauaauuuuacuugug

SEQ ID NO: 2693095 - RNA, 21 nt, Haemophilus influenzae Rd
ucuaaaagcuguucugcauua

SEQ ID NO: 2693096 - RNA, 11 nt, Haemophilus influenzae Rd
ucuaaaaguaa

SEQ ID NO: 2693097 - RNA, 22 nt, Haemophilus influenzae Rd
ucuaaaaguuugauuaacuuuc

SEQ ID NO: 2693098 - RNA, 21 nt, Haemophilus influenzae Rd
ucuaaaauauaacauuuauuu

SEQ ID NO: 2693099 - RNA, 13 nt, Haemophilus influenzae Rd
ucuaaaauuauag

SEQ ID NO: 2693100 - RNA, 16 nt, Haemophilus influenzae Rd
ucuaaacgaugugcau

SEQ ID NO: 2693101 - RNA, 15 nt, Haemophilus influenzae Rd
ucuaaacuuaauucu

SEQ ID NO: 2693102 - RNA, 16 nt, Haemophilus influenzae Rd
ucuaaacuuauauuau

SEQ ID NO: 2693103 - RNA, 18 nt, Haemophilus influenzae Rd
ucuaaacuuguuaaauaa

SEQ ID NO: 2693104 - RNA, 21 nt, Haemophilus influenzae Rd
ucuaaagcacguuucaucagc

SEQ ID NO: 2693105 - RNA, 12 nt, Haemophilus influenzae Rd
ucuaaagcgauc

SEQ ID NO: 2693106 - RNA, 15 nt, Haemophilus influenzae Rd
ucuaaaggcuaaaua

SEQ ID NO: 2693107 - RNA, 16 nt, Haemophilus influenzae Rd
ucuaaaggcuaaauaa

SEQ ID NO: 2693108 - RNA, 22 nt, Haemophilus influenzae Rd
ucuaaaggcuaaauaaccuaaa

SEQ ID NO: 2693109 - RNA, 15 nt, Haemophilus influenzae Rd
ucuaucuuauuaaag

SEQ ID NO: 2693110 - RNA, 14 nt, Haemophilus influenzae Rd
ucuaugaaaaaacc

SEQ ID NO: 2693111 - RNA, 17 nt, Haemophilus influenzae Rd
ucuauuaaaaaaucauc

SEQ ID NO: 2693112 - RNA, 21 nt, Haemophilus influenzae Rd
ucuauuaaaaaaucaucaauu

SEQ ID NO: 2693113 - RNA, 15 nt, Haemophilus influenzae Rd
ucuauuaaaauauuu

SEQ ID NO: 2693114 - RNA, 16 nt, Haemophilus influenzae Rd
ucuauucucuguugcu

SEQ ID NO: 2693115 - RNA, 17 nt, Haemophilus influenzae Rd
ucuauugauauuaauuu

SEQ ID NO: 2693116 - RNA, 16 nt, Haemophilus influenzae Rd
ucuauugauucuaaaa

SEQ ID NO: 2693117 - RNA, 17 nt, Haemophilus influenzae Rd
ucuauugauucuaaaaa

SEQ ID NO: 2693118 - RNA, 18 nt, Haemophilus influenzae Rd
ucuauuggauaaauuauu

SEQ ID NO: 2693119 - RNA, 23 nt, Haemophilus influenzae Rd
ucuauuggauaaauuauucugca

SEQ ID NO: 2693120 - RNA, 19 nt, Haemophilus influenzae Rd
ucuauuguuuuuuucuaaa

SEQ ID NO: 2693121 - RNA, 14 nt, Haemophilus influenzae Rd
ucuauuugauuuaa

SEQ ID NO: 2693122 - RNA, 18 nt, Haemophilus influenzae Rd
ucuauuugucggaaaaua

SEQ ID NO: 2693123 - RNA, 16 nt, Haemophilus influenzae Rd
ucuauuuuuucugcaa

SEQ ID NO: 2693124 - RNA, 17 nt, Haemophilus influenzae Rd
ucuauuuuuucugcaaa

SEQ ID NO: 2693125 - RNA, 14 nt, Haemophilus influenzae Rd
ucucaaaaaguuaa

SEQ ID NO: 2693126 - RNA, 16 nt, Haemophilus influenzae Rd
ucucaaaaaguuaaau

SEQ ID NO: 2693127 - RNA, 13 nt, Haemophilus influenzae Rd
ucucaaaaucagc

SEQ ID NO: 2693128 - RNA, 21 nt, Haemophilus influenzae Rd
ucucaaaaucagcaaauuguu

SEQ ID NO: 2693129 - RNA, 21 nt, Haemophilus influenzae Rd
ucucaaagaggagguagaaaa

SEQ ID NO: 2693130 - RNA, 13 nt, Haemophilus influenzae Rd
ucucaaauauuuu

SEQ ID NO: 2693131 - RNA, 15 nt, Haemophilus influenzae Rd
ucucaauugcaaaau

SEQ ID NO: 2693132 - RNA, 16 nt, Haemophilus influenzae Rd
ucucaauugcaaaauc

SEQ ID NO: 2693133 - RNA, 19 nt, Haemophilus influenzae Rd
ucucaauuuuuucaaauaa

SEQ ID NO: 2693134 - RNA, 14 nt, Haemophilus influenzae Rd
ucucacaucaucaa

SEQ ID NO: 2693135 - RNA, 20 nt, Haemophilus influenzae Rd
ucucaccaccagauaaggua

SEQ ID NO: 2693136 - RNA, 18 nt, Haemophilus influenzae Rd
ucucaccgugccacgccc

SEQ ID NO: 2693137 - RNA, 14 nt, Haemophilus influenzae Rd
ucucacuaacuuuc

SEQ ID NO: 2693138 - RNA, 23 nt, Haemophilus influenzae Rd
ucucagcuuucuaacgcaaacua

SEQ ID NO: 2693139 - RNA, 18 nt, Haemophilus influenzae Rd
ucucauaaaguauacuuu

SEQ ID NO: 2693140 - RNA, 16 nt, Haemophilus influenzae Rd
ucucauaauagaaaac

SEQ ID NO: 2693141 - RNA, 19 nt, Haemophilus influenzae Rd
ucucauaauagaaaacauu

SEQ ID NO: 2693142 - RNA, 18 nt, Haemophilus influenzae Rd
ucuccaaauauaaaauaa

SEQ ID NO: 2693143 - RNA, 20 nt, Haemophilus influenzae Rd
ucuccaagaauauuucacac

SEQ ID NO: 2693144 - RNA, 16 nt, Haemophilus influenzae Rd
ucuccccguccaaagg

SEQ ID NO: 2693145 - RNA, 17 nt, Haemophilus influenzae Rd
ucuccccuuguucuaaa

SEQ ID NO: 2693146 - RNA, 18 nt, Haemophilus influenzae Rd
ucucccgaaaauuguuca

SEQ ID NO: 2693147 - RNA, 19 nt, Haemophilus influenzae Rd
ucucccgaaaauuguucag

SEQ ID NO: 2693148 - RNA, 14 nt, Haemophilus influenzae Rd
ucucccgccgcaua

SEQ ID NO: 2693149 - RNA, 18 nt, Haemophilus influenzae Rd
ucucccuugcccaguuua

SEQ ID NO: 2693150 - RNA, 22 nt, Haemophilus influenzae Rd
ucuccgcauuuuuuuauucuau

SEQ ID NO: 2693151 - RNA, 15 nt, Haemophilus influenzae Rd
ucuccgcgacauuaa

SEQ ID NO: 2693152 - RNA, 13 nt, Haemophilus influenzae Rd
ucuccugauauag

SEQ ID NO: 2693153 - RNA, 18 nt, Haemophilus influenzae Rd
ucuccuugguuuucuugc

SEQ ID NO: 2693154 - RNA, 18 nt, Haemophilus influenzae Rd
ucucgaguaucaaaacuu

SEQ ID NO: 2693155 - RNA, 13 nt, Haemophilus influenzae Rd
ucucgauaaaaga

SEQ ID NO: 2693156 - RNA, 21 nt, Haemophilus influenzae Rd
ucucggacuucgcuaauuuuu

SEQ ID NO: 2693157 - RNA, 19 nt, Haemophilus influenzae Rd
ucucuaaaacauugucaau

SEQ ID NO: 2693158 - RNA, 11 nt, Haemophilus influenzae Rd
ucucuaaaauc

SEQ ID NO: 2693159 - RNA, 18 nt, Haemophilus influenzae Rd
ucucuauuaauuuuaaau

SEQ ID NO: 2693160 - RNA, 14 nt, Haemophilus influenzae Rd
ucucucaaaaauca

SEQ ID NO: 2693161 - RNA, 14 nt, Haemophilus influenzae Rd
ucucucacgugaau

SEQ ID NO: 2693162 - RNA, 16 nt, Haemophilus influenzae Rd
ucucucauuuuuuacc

SEQ ID NO: 2693163 - RNA, 14 nt, Haemophilus influenzae Rd
ucucucuuuuuuau

SEQ ID NO: 2693164 - RNA, 21 nt, Haemophilus influenzae Rd
ucucugacuaaucguccaauu

SEQ ID NO: 2693165 - RNA, 17 nt, Haemophilus influenzae Rd
ucucugcccauaagaaa

SEQ ID NO: 2693166 - RNA, 14 nt, Haemophilus influenzae Rd
ucucugugagugga

SEQ ID NO: 2693167 - RNA, 15 nt, Haemophilus influenzae Rd
ucucuuauuugugug

SEQ ID NO: 2693168 - RNA, 20 nt, Haemophilus influenzae Rd
ucucuuuacgacuaaaacga

SEQ ID NO: 2693169 - RNA, 13 nt, Haemophilus influenzae Rd
ucucuuucuauuu

SEQ ID NO: 2693170 - RNA, 13 nt, Haemophilus influenzae Rd
ucucuuucuuaaa

SEQ ID NO: 2693171 - RNA, 13 nt, Haemophilus influenzae Rd
ucucuuuucucaa

SEQ ID NO: 2693172 - RNA, 23 nt, Haemophilus influenzae Rd
ucucuuuugaggcuaauaaugcc

SEQ ID NO: 2693173 - RNA, 18 nt, Haemophilus influenzae Rd
ucucuuuuuauuuuacua

SEQ ID NO: 2693174 - RNA, 14 nt, Haemophilus influenzae Rd
ucugaaauuuugau

SEQ ID NO: 2693175 - RNA, 22 nt, Haemophilus influenzae Rd
ucugaaauuuuuaucuaaauua

SEQ ID NO: 2693176 - RNA, 20 nt, Haemophilus influenzae Rd
ucugaacacucuaucuaaaa

SEQ ID NO: 2693177 - RNA, 14 nt, Haemophilus influenzae Rd
ucugaacuaaaaua

SEQ ID NO: 2693178 - RNA, 24 nt, Haemophilus influenzae Rd
ucugaagggcgagcaacuuggaau

SEQ ID NO: 2693179 - RNA, 14 nt, Haemophilus influenzae Rd
ucugaauaaauuuu

SEQ ID NO: 2693180 - RNA, 22 nt, Haemophilus influenzae Rd
ucugaaugaucgaguaaaaaua

SEQ ID NO: 2693181 - RNA, 20 nt, Haemophilus influenzae Rd
ucugacacccaaauuaaaaa

SEQ ID NO: 2693182 - RNA, 13 nt, Haemophilus influenzae Rd
ucugacacuucuc

SEQ ID NO: 2693183 - RNA, 18 nt, Haemophilus influenzae Rd
ucugacaguuuaucucuu

SEQ ID NO: 2693184 - RNA, 14 nt, Haemophilus influenzae Rd
ucugacgcauugca

SEQ ID NO: 2693185 - RNA, 23 nt, Haemophilus influenzae Rd
ucugacuaaucguccaauuucau

SEQ ID NO: 2693186 - RNA, 20 nt, Haemophilus influenzae Rd
ucugagcuuuucuuguaaug

SEQ ID NO: 2693187 - RNA, 14 nt, Haemophilus influenzae Rd
ucugaucacaauga

SEQ ID NO: 2693188 - RNA, 19 nt, Haemophilus influenzae Rd
ucugauguagcuugaauau

SEQ ID NO: 2693189 - RNA, 14 nt, Haemophilus influenzae Rd
ucugauugagaaaa

SEQ ID NO: 2693190 - RNA, 12 nt, Haemophilus influenzae Rd
ucugauuuaaaa

SEQ ID NO: 2693191 - RNA, 16 nt, Haemophilus influenzae Rd
ucugauuuagguuuca

SEQ ID NO: 2693192 - RNA, 20 nt, Haemophilus influenzae Rd
ucugauuuagguuucaauuu

SEQ ID NO: 2693193 - RNA, 21 nt, Haemophilus influenzae Rd
ucugcaaauaaagaagaaaau

SEQ ID NO: 2693194 - RNA, 14 nt, Haemophilus influenzae Rd
ucugcaaauggugu

SEQ ID NO: 2693195 - RNA, 15 nt, Haemophilus influenzae Rd
ucugcaaaugguguu

SEQ ID NO: 2693196 - RNA, 13 nt, Haemophilus influenzae Rd
ucugcaacaacga

SEQ ID NO: 2693197 - RNA, 19 nt, Haemophilus influenzae Rd
ucugcaauaauaucugcuu

SEQ ID NO: 2693198 - RNA, 14 nt, Haemophilus influenzae Rd
ucugcaauuuuacg

SEQ ID NO: 2693199 - RNA, 14 nt, Haemophilus influenzae Rd
ucugcaccauccau

SEQ ID NO: 2693200 - RNA, 17 nt, Haemophilus influenzae Rd
ucugcaccccaaaaguu

SEQ ID NO: 2693201 - RNA, 22 nt, Haemophilus influenzae Rd
ucugcacgauagcaaugccaau

SEQ ID NO: 2693202 - RNA, 17 nt, Haemophilus influenzae Rd
ucugcacgggaaaucca

SEQ ID NO: 2693203 - RNA, 14 nt, Haemophilus influenzae Rd
ucugcacuccaaaa

SEQ ID NO: 2693204 - RNA, 17 nt, Haemophilus influenzae Rd
ucugcacuccaaaaguu

SEQ ID NO: 2693205 - RNA, 15 nt, Haemophilus influenzae Rd
ucugcacuuuaauuc

SEQ ID NO: 2693206 - RNA, 19 nt, Haemophilus influenzae Rd
ucugcacuuuaauucgcug

SEQ ID NO: 2693207 - RNA, 12 nt, Haemophilus influenzae Rd
ucugcagaaaaa

SEQ ID NO: 2693208 - RNA, 19 nt, Haemophilus influenzae Rd
ucugcagaaaaauguucau

SEQ ID NO: 2693209 - RNA, 15 nt, Haemophilus influenzae Rd
ucugcaggcauuuuc

SEQ ID NO: 2693210 - RNA, 17 nt, Haemophilus influenzae Rd
ucugcaggcauuuucaa

SEQ ID NO: 2693211 - RNA, 20 nt, Haemophilus influenzae Rd
ucugcagggaaaaauuuuac

SEQ ID NO: 2693212 - RNA, 20 nt, Haemophilus influenzae Rd
ucugcaguuucugguuccau

SEQ ID NO: 2693213 - RNA, 22 nt, Haemophilus influenzae Rd
ucugcaguuuuuuguuuuuccg

SEQ ID NO: 2693214 - RNA, 13 nt, Haemophilus influenzae Rd
ucugcauaacgau

SEQ ID NO: 2693215 - RNA, 20 nt, Haemophilus influenzae Rd
ucuucaucauacaauccacc

SEQ ID NO: 2693216 - RNA, 17 nt, Haemophilus influenzae Rd
ucuucaugauuuuccaa

SEQ ID NO: 2693217 - RNA, 19 nt, Haemophilus influenzae Rd
ucuucaugauuuuccaaaa

SEQ ID NO: 2693218 - RNA, 15 nt, Haemophilus influenzae Rd
ucuucauuuuaaauu

SEQ ID NO: 2693219 - RNA, 13 nt, Haemophilus influenzae Rd
ucuuccaaaaguu

SEQ ID NO: 2693220 - RNA, 20 nt, Haemophilus influenzae Rd
ucuuccaauaauucuuuaau

SEQ ID NO: 2693221 - RNA, 17 nt, Haemophilus influenzae Rd
ucuuccaaugugaccaa

SEQ ID NO: 2693222 - RNA, 16 nt, Haemophilus influenzae Rd
ucuuccacaacaacca

SEQ ID NO: 2693223 - RNA, 22 nt, Haemophilus influenzae Rd
ucuuccaccgcuuugcuugccc

SEQ ID NO: 2693224 - RNA, 19 nt, Haemophilus influenzae Rd
ucuucccaaccuaauuguu

SEQ ID NO: 2693225 - RNA, 17 nt, Haemophilus influenzae Rd
ucuuccgcaucggcuaa

SEQ ID NO: 2693226 - RNA, 20 nt, Haemophilus influenzae Rd
ucuuccgcaucggcuaacgg

SEQ ID NO: 2693227 - RNA, 16 nt, Haemophilus influenzae Rd
ucuuccgcuguccaau

SEQ ID NO: 2693228 - RNA, 18 nt, Haemophilus influenzae Rd
ucuuccgugacaucaucu

SEQ ID NO: 2693229 - RNA, 20 nt, Haemophilus influenzae Rd
ucuucgaaaauaacuucauc

SEQ ID NO: 2693230 - RNA, 17 nt, Haemophilus influenzae Rd
ucuucgacaucuccuaa

SEQ ID NO: 2693231 - RNA, 17 nt, Haemophilus influenzae Rd
ucuucgauuuuucuaaa

SEQ ID NO: 2693232 - RNA, 16 nt, Haemophilus influenzae Rd
ucuucggauuuuucaa

SEQ ID NO: 2693233 - RNA, 14 nt, Haemophilus influenzae Rd
ucuucgucaucauc

SEQ ID NO: 2693234 - RNA, 15 nt, Haemophilus influenzae Rd
ucuucgucaucauca

SEQ ID NO: 2693235 - RNA, 20 nt, Haemophilus influenzae Rd
ucuucuaagguaacagguga

SEQ ID NO: 2693236 - RNA, 15 nt, Haemophilus influenzae Rd
ucuucuaauaaaaua

SEQ ID NO: 2693237 - RNA, 16 nt, Haemophilus influenzae Rd
ucuucuaauucuuccc

SEQ ID NO: 2693238 - RNA, 18 nt, Haemophilus influenzae Rd
ucuucuaauucuucccag

SEQ ID NO: 2693239 - RNA, 15 nt, Haemophilus influenzae Rd
ucuucuaauuguuug

SEQ ID NO: 2693240 - RNA, 16 nt, Haemophilus influenzae Rd
ucuucuaguuuuccuu

SEQ ID NO: 2693241 - RNA, 18 nt, Haemophilus influenzae Rd
ucuucuaguuuuccuuuc

SEQ ID NO: 2693242 - RNA, 19 nt, Haemophilus influenzae Rd
ucuucuaguuuuccuuucu

SEQ ID NO: 2693243 - RNA, 18 nt, Haemophilus influenzae Rd
ucuucuauugauauuaau

SEQ ID NO: 2693244 - RNA, 16 nt, Haemophilus influenzae Rd
ucuucuauuuuaucaa

SEQ ID NO: 2693245 - RNA, 19 nt, Haemophilus influenzae Rd
ucuucucauucgaauauug

SEQ ID NO: 2693246 - RNA, 19 nt, Haemophilus influenzae Rd
ucuucuggauuaucuguaa

SEQ ID NO: 2693247 - RNA, 23 nt, Haemophilus influenzae Rd
ucuucuguuaaacgcauauuuug

SEQ ID NO: 2693248 - RNA, 20 nt, Haemophilus influenzae Rd
ucuucuguuugguaagauuu

SEQ ID NO: 2693249 - RNA, 17 nt, Haemophilus influenzae Rd
ucuucuguuuugccugc

SEQ ID NO: 2693250 - RNA, 10 nt, Haemophilus influenzae Rd
ucuucuuccc

SEQ ID NO: 2693251 - RNA, 12 nt, Haemophilus influenzae Rd
ucuucuucccaa

SEQ ID NO: 2693252 - RNA, 15 nt, Haemophilus influenzae Rd
ucuucuuggcaauau

SEQ ID NO: 2693253 - RNA, 16 nt, Haemophilus influenzae Rd
ucuucuuguucaaaua

SEQ ID NO: 2693254 - RNA, 20 nt, Haemophilus influenzae Rd
ucuucuuguucaaauaaugu

SEQ ID NO: 2693255 - RNA, 13 nt, Haemophilus influenzae Rd
ucuucuuuaccaa

SEQ ID NO: 2693256 - RNA, 14 nt, Haemophilus influenzae Rd
ucuucuuuaccaac

SEQ ID NO: 2693257 - RNA, 18 nt, Haemophilus influenzae Rd
ucuucuuugacuaaagua

SEQ ID NO: 2693258 - RNA, 14 nt, Haemophilus influenzae Rd
ucuucuuugcgauu

SEQ ID NO: 2693259 - RNA, 12 nt, Haemophilus influenzae Rd
ucuucuuuuaau

SEQ ID NO: 2693260 - RNA, 17 nt, Haemophilus influenzae Rd
ucuucuuuuaauaauag

SEQ ID NO: 2693261 - RNA, 22 nt, Haemophilus influenzae Rd
ucuucuuuuauaaccaguuauu

SEQ ID NO: 2693262 - RNA, 14 nt, Haemophilus influenzae Rd
ucuucuuuuuucuc

SEQ ID NO: 2693263 - RNA, 23 nt, Haemophilus influenzae Rd
ucuugaaaccucccaaaaacuaa

SEQ ID NO: 2693264 - RNA, 16 nt, Haemophilus influenzae Rd
ucuugaacgcaaauac

SEQ ID NO: 2693265 - RNA, 12 nt, Haemophilus influenzae Rd
ucuugaauacaa

SEQ ID NO: 2693266 - RNA, 17 nt, Haemophilus influenzae Rd
ucuugacauaauuucac

SEQ ID NO: 2693267 - RNA, 16 nt, Haemophilus influenzae Rd
ucuugacguaauucuc

SEQ ID NO: 2693268 - RNA, 22 nt, Haemophilus influenzae Rd
ucuugaguaccgcuaauaaucg

SEQ ID NO: 2693269 - RNA, 15 nt, Haemophilus influenzae Rd
ucuugaugauaaucu

SEQ ID NO: 2693270 - RNA, 22 nt, Haemophilus influenzae Rd
ucuugaugauaaucuucccauu

SEQ ID NO: 2693271 - RNA, 17 nt, Haemophilus influenzae Rd
ucuugauuauuuaauuu

SEQ ID NO: 2693272 - RNA, 20 nt, Haemophilus influenzae Rd
ucuugauuauuuaauuucaa

SEQ ID NO: 2693273 - RNA, 13 nt, Haemophilus influenzae Rd
ucuugccaaaauu

SEQ ID NO: 2693274 - RNA, 23 nt, Haemophilus influenzae Rd
ucuugccaaugccaaauuucucc

SEQ ID NO: 2693275 - RNA, 23 nt, Haemophilus influenzae Rd
ucuugcccgcaccgcuucuuugu

SEQ ID NO: 2693276 - RNA, 19 nt, Haemophilus influenzae Rd
ucuugccgaaaauuuaccg

SEQ ID NO: 2693277 - RNA, 17 nt, Haemophilus influenzae Rd
ucuugcguaaccaaaga

SEQ ID NO: 2693278 - RNA, 17 nt, Haemophilus influenzae Rd
ucuugcuaaaauaucuu

SEQ ID NO: 2693279 - RNA, 20 nt, Haemophilus influenzae Rd
ucuugcugcuuugagguaaa

SEQ ID NO: 2693280 - RNA, 19 nt, Haemophilus influenzae Rd
ucuugcuugaucauccauu

SEQ ID NO: 2693281 - RNA, 15 nt, Haemophilus influenzae Rd
ucuugcuuuuuuaau

SEQ ID NO: 2693282 - RNA, 14 nt, Haemophilus influenzae Rd
ucuuggaaaucuug

SEQ ID NO: 2693283 - RNA, 15 nt, Haemophilus influenzae Rd
ucuuggauaauuucg

SEQ ID NO: 2693284 - RNA, 21 nt, Haemophilus influenzae Rd
ucuuggauuuucuuagcuuca

SEQ ID NO: 2693285 - RNA, 20 nt, Haemophilus influenzae Rd
ucuuggcucauuuuaaagag

SEQ ID NO: 2693286 - RNA, 19 nt, Haemophilus influenzae Rd
ucuugggcggcuuguugaa

SEQ ID NO: 2693287 - RNA, 23 nt, Haemophilus influenzae Rd
ucuuggugccaauccauuuuuaa

SEQ ID NO: 2693288 - RNA, 16 nt, Haemophilus influenzae Rd
ucuugguuuaaauuuu

SEQ ID NO: 2693289 - RNA, 15 nt, Haemophilus influenzae Rd
ucuuguggaucuaaa

SEQ ID NO: 2693290 - RNA, 15 nt, Haemophilus influenzae Rd
ucuuguucaaauaau

SEQ ID NO: 2693291 - RNA, 18 nt, Haemophilus influenzae Rd
ucuuguucaaauaaugug

SEQ ID NO: 2693292 - RNA, 22 nt, Haemophilus influenzae Rd
ucuuguucuaagaaaguuuuau

SEQ ID NO: 2693293 - RNA, 14 nt, Haemophilus influenzae Rd
ucuuguucuccauu

SEQ ID NO: 2693294 - RNA, 18 nt, Haemophilus influenzae Rd
ucuuguuuaaauucaggc

SEQ ID NO: 2693295 - RNA, 13 nt, Haemophilus influenzae Rd
ucuuguuuuaaau

SEQ ID NO: 2693296 - RNA, 16 nt, Haemophilus influenzae Rd
ucuuguuuuaauauca

SEQ ID NO: 2693297 - RNA, 13 nt, Haemophilus influenzae Rd
ucuuguuuuaauu

SEQ ID NO: 2693298 - RNA, 14 nt, Haemophilus influenzae Rd
ucuuguuuuaauug

SEQ ID NO: 2693299 - RNA, 15 nt, Haemophilus influenzae Rd
ucuuguuuuuccaau

SEQ ID NO: 2693300 - RNA, 17 nt, Haemophilus influenzae Rd
ucuuuaaaauuauaaua

SEQ ID NO: 2693301 - RNA, 20 nt, Haemophilus influenzae Rd
ucuuuaaaauuauaauauuu

SEQ ID NO: 2693302 - RNA, 22 nt, Haemophilus influenzae Rd
ucuuuaaacaccaaauauucuu

SEQ ID NO: 2693303 - RNA, 20 nt, Haemophilus influenzae Rd
ucuuuaaagagcaaauuuaa

SEQ ID NO: 2693304 - RNA, 22 nt, Haemophilus influenzae Rd
ucuuuaaagagcaaauuuaaau

SEQ ID NO: 2693305 - RNA, 13 nt, Haemophilus influenzae Rd
ucuuuaaauauuc

SEQ ID NO: 2693306 - RNA, 14 nt, Haemophilus influenzae Rd
ucuuuaaauauuca

SEQ ID NO: 2693307 - RNA, 16 nt, Haemophilus influenzae Rd
ucuuuaaauucaauaa

SEQ ID NO: 2693308 - RNA, 13 nt, Haemophilus influenzae Rd
ucuuuaacaaauu

SEQ ID NO: 2693309 - RNA, 21 nt, Haemophilus influenzae Rd
ucuuuaacaauauaucagaca

SEQ ID NO: 2693310 - RNA, 24 nt, Haemophilus influenzae Rd
ucuuuaauagcgugcauuccuaaa

SEQ ID NO: 2693311 - RNA, 19 nt, Haemophilus influenzae Rd
ucuuuaaucguuaccaaga

SEQ ID NO: 2693312 - RNA, 19 nt, Haemophilus influenzae Rd
ucuuuaauuaaaauauuuu

SEQ ID NO: 2693313 - RNA, 13 nt, Haemophilus influenzae Rd
ucuuuaauuccaa

SEQ ID NO: 2693314 - RNA, 19 nt, Haemophilus influenzae Rd
ucuuuaauugauuaaaaaa

SEQ ID NO: 2693315 - RNA, 22 nt, Haemophilus influenzae Rd
ucuuuaauugauuaaaaaagca

SEQ ID NO: 2693316 - RNA, 15 nt, Haemophilus influenzae Rd
ucuuuacaaauuucg

SEQ ID NO: 2693317 - RNA, 13 nt, Haemophilus influenzae Rd
ucuuuacaacugg

SEQ ID NO: 2693318 - RNA, 16 nt, Haemophilus influenzae Rd
ucuuuacaacuggagc

SEQ ID NO: 2693319 - RNA, 15 nt, Haemophilus influenzae Rd
ucuuuaccaaaaaau

SEQ ID NO: 2693320 - RNA, 21 nt, Haemophilus influenzae Rd
ugaaacuugguguaauuugau

SEQ ID NO: 2693321 - RNA, 15 nt, Haemophilus influenzae Rd
ugaaagaauaucaau

SEQ ID NO: 2693322 - RNA, 14 nt, Haemophilus influenzae Rd
ugaaagacgaauca

SEQ ID NO: 2693323 - RNA, 17 nt, Haemophilus influenzae Rd
ugaaagauaaauuacau

SEQ ID NO: 2693324 - RNA, 16 nt, Haemophilus influenzae Rd
ugaaagggaaauuuau

SEQ ID NO: 2693325 - RNA, 21 nt, Haemophilus influenzae Rd
ugaaaggugguuuuuguuucg

SEQ ID NO: 2693326 - RNA, 20 nt, Haemophilus influenzae Rd
ugaaaguaacaauguagaaa

SEQ ID NO: 2693327 - RNA, 21 nt, Haemophilus influenzae Rd
ugaaaguaacaauguagaaau

SEQ ID NO: 2693328 - RNA, 20 nt, Haemophilus influenzae Rd
ugaaaguauaauauagauga

SEQ ID NO: 2693329 - RNA, 22 nt, Haemophilus influenzae Rd
ugaaagucgauucaaauaacgc

SEQ ID NO: 2693330 - RNA, 20 nt, Haemophilus influenzae Rd
ugaaaguuugcuuagugaaa

SEQ ID NO: 2693331 - RNA, 12 nt, Haemophilus influenzae Rd
ugaaauaaaaua

SEQ ID NO: 2693332 - RNA, 13 nt, Haemophilus influenzae Rd
ugaaauaaaauau

SEQ ID NO: 2693333 - RNA, 23 nt, Haemophilus influenzae Rd
ugaaauaagauuuuugauaaaaa

SEQ ID NO: 2693334 - RNA, 13 nt, Haemophilus influenzae Rd
ugaaauaauucau

SEQ ID NO: 2693335 - RNA, 16 nt, Haemophilus influenzae Rd
ugaaauaguuaaagaa

SEQ ID NO: 2693336 - RNA, 20 nt, Haemophilus influenzae Rd
ugaaauaguuaaagaaaaua

SEQ ID NO: 2693337 - RNA, 13 nt, Haemophilus influenzae Rd
ugaaauauagcuu

SEQ ID NO: 2693338 - RNA, 20 nt, Haemophilus influenzae Rd
ugaaauaugacuuauuaucu

SEQ ID NO: 2693339 - RNA, 16 nt, Haemophilus influenzae Rd
ugaaauauugaucucc

SEQ ID NO: 2693340 - RNA, 16 nt, Haemophilus influenzae Rd
ugaaaucgcaguuucu

SEQ ID NO: 2693341 - RNA, 20 nt, Haemophilus influenzae Rd
ugaaaugcaagguuuauacc

SEQ ID NO: 2693342 - RNA, 22 nt, Haemophilus influenzae Rd
ugaaaugcccguuacuuuuauu

SEQ ID NO: 2693343 - RNA, 19 nt, Haemophilus influenzae Rd
ugaaaugcuugguuuuaua

SEQ ID NO: 2693344 - RNA, 15 nt, Haemophilus influenzae Rd
ugaaauguagcacga

SEQ ID NO: 2693345 - RNA, 22 nt, Haemophilus influenzae Rd
ugaaauguuuuuuccauuuuuu

SEQ ID NO: 2693346 - RNA, 13 nt, Haemophilus influenzae Rd
ugaaauuaauaag

SEQ ID NO: 2693347 - RNA, 17 nt, Haemophilus influenzae Rd
ugaaauuaauaagcccu

SEQ ID NO: 2693348 - RNA, 16 nt, Haemophilus influenzae Rd
ugaaauuacucaucug

SEQ ID NO: 2693349 - RNA, 19 nt, Haemophilus influenzae Rd
ugaaauuacuugaaucuaa

SEQ ID NO: 2693350 - RNA, 22 nt, Haemophilus influenzae Rd
ugaaauuauugcuuaugauuua

SEQ ID NO: 2693351 - RNA, 14 nt, Haemophilus influenzae Rd
ugaaauucauucaa

SEQ ID NO: 2693352 - RNA, 20 nt, Haemophilus influenzae Rd
ugaaauuccuugccaaagug

SEQ ID NO: 2693353 - RNA, 19 nt, Haemophilus influenzae Rd
ugaaauucuaccugcugua

SEQ ID NO: 2693354 - RNA, 19 nt, Haemophilus influenzae Rd
ugaaauugaggauuugccu

SEQ ID NO: 2693355 - RNA, 21 nt, Haemophilus influenzae Rd
ugaaauugaggauuugccucu

SEQ ID NO: 2693356 - RNA, 13 nt, Haemophilus influenzae Rd
ugaaauuuauuau

SEQ ID NO: 2693357 - RNA, 23 nt, Haemophilus influenzae Rd
ugaaauuuauuauaaaaauauuu

SEQ ID NO: 2693358 - RNA, 18 nt, Haemophilus influenzae Rd
ugaaauuucaccgcacuu

SEQ ID NO: 2693359 - RNA, 21 nt, Haemophilus influenzae Rd
ugaaauuuccugagaauuuuc

SEQ ID NO: 2693360 - RNA, 13 nt, Haemophilus influenzae Rd
ugaaauuucuuua

SEQ ID NO: 2693361 - RNA, 18 nt, Haemophilus influenzae Rd
ugaaauuuuaccgcacuu

SEQ ID NO: 2693362 - RNA, 22 nt, Haemophilus influenzae Rd
ugaaauuuuauaaaaaauuaau

SEQ ID NO: 2693363 - RNA, 13 nt, Haemophilus influenzae Rd
ugaacaagcaccc

SEQ ID NO: 2693364 - RNA, 19 nt, Haemophilus influenzae Rd
ugaacaaugucagaaaaga

SEQ ID NO: 2693365 - RNA, 23 nt, Haemophilus influenzae Rd
ugaacauuaugugcaauuugaca

SEQ ID NO: 2693366 - RNA, 23 nt, Haemophilus influenzae Rd
ugaaccaccgcaagcagaagaau

SEQ ID NO: 2693367 - RNA, 19 nt, Haemophilus influenzae Rd
ugaacccuacaggcuucca

SEQ ID NO: 2693368 - RNA, 23 nt, Haemophilus influenzae Rd
ugaacccuacaggcuuccaacaa

SEQ ID NO: 2693369 - RNA, 15 nt, Haemophilus influenzae Rd
ugaaccuauuagaau

SEQ ID NO: 2693370 - RNA, 22 nt, Haemophilus influenzae Rd
ugaaccuucacagauuucaauu

SEQ ID NO: 2693371 - RNA, 21 nt, Haemophilus influenzae Rd
ugaacgaguaaauuaauuuag

SEQ ID NO: 2693372 - RNA, 17 nt, Haemophilus influenzae Rd
ugaacgccaacaacuua

SEQ ID NO: 2693373 - RNA, 15 nt, Haemophilus influenzae Rd
ugaacggaucgccug

SEQ ID NO: 2693374 - RNA, 18 nt, Haemophilus influenzae Rd
ugaacgggguuaaaagug

SEQ ID NO: 2693375 - RNA, 15 nt, Haemophilus influenzae Rd
ugaacguuuaacuuc

SEQ ID NO: 2693376 - RNA, 14 nt, Haemophilus influenzae Rd
ugaacuaaaauauc

SEQ ID NO: 2693377 - RNA, 19 nt, Haemophilus influenzae Rd
ugaacuuaugugcaccuuc

SEQ ID NO: 2693378 - RNA, 20 nt, Haemophilus influenzae Rd
ugaacuuaugugcaccuuca

SEQ ID NO: 2693379 - RNA, 15 nt, Haemophilus influenzae Rd
ugaacuucauuuagu

SEQ ID NO: 2693380 - RNA, 14 nt, Haemophilus influenzae Rd
ugaacuucuaaaaa

SEQ ID NO: 2693381 - RNA, 12 nt, Haemophilus influenzae Rd
ugaacuuucaau

SEQ ID NO: 2693382 - RNA, 15 nt, Haemophilus influenzae Rd
ugaacuuucaauaau

SEQ ID NO: 2693383 - RNA, 19 nt, Haemophilus influenzae Rd
ugaacuuucgcguaauaac

SEQ ID NO: 2693384 - RNA, 15 nt, Haemophilus influenzae Rd
ugaacuuuguucauu

SEQ ID NO: 2693385 - RNA, 14 nt, Haemophilus influenzae Rd
ugaacuuuuuuaua

SEQ ID NO: 2693386 - RNA, 13 nt, Haemophilus influenzae Rd
ugaagaaaauuuc

SEQ ID NO: 2693387 - RNA, 16 nt, Haemophilus influenzae Rd
ugaagaauacaagcga

SEQ ID NO: 2693388 - RNA, 20 nt, Haemophilus influenzae Rd
ugaagaauuuguuguuugcu

SEQ ID NO: 2693389 - RNA, 16 nt, Haemophilus influenzae Rd
ugaagagaauuuucau

SEQ ID NO: 2693390 - RNA, 20 nt, Haemophilus influenzae Rd
ugaagagaauuuucaucaau

SEQ ID NO: 2693391 - RNA, 19 nt, Haemophilus influenzae Rd
ugaagagauugauuuucuu

SEQ ID NO: 2693392 - RNA, 16 nt, Haemophilus influenzae Rd
ugaagaguaaaacuaa

SEQ ID NO: 2693393 - RNA, 22 nt, Haemophilus influenzae Rd
ugaagaguaaaacuaauuugca

SEQ ID NO: 2693394 - RNA, 21 nt, Haemophilus influenzae Rd
ugaagaugaagcuaagaaaau

SEQ ID NO: 2693395 - RNA, 13 nt, Haemophilus influenzae Rd
ugaagaugauaua

SEQ ID NO: 2693396 - RNA, 15 nt, Haemophilus influenzae Rd
ugaagauuaaaugua

SEQ ID NO: 2693397 - RNA, 13 nt, Haemophilus influenzae Rd
ugaagauugaaau

SEQ ID NO: 2693398 - RNA, 20 nt, Haemophilus influenzae Rd
ugaagauuuuggugcauguu

SEQ ID NO: 2693399 - RNA, 19 nt, Haemophilus influenzae Rd
ugaagcaacaaucacugua

SEQ ID NO: 2693400 - RNA, 19 nt, Haemophilus influenzae Rd
ugaagcacugaaauaucag

SEQ ID NO: 2693401 - RNA, 18 nt, Haemophilus influenzae Rd
ugaagccgaugaaagcua

SEQ ID NO: 2693402 - RNA, 17 nt, Haemophilus influenzae Rd
ugaagcuaaacuuuaga

SEQ ID NO: 2693403 - RNA, 14 nt, Haemophilus influenzae Rd
ugaagcuaagaaaa

SEQ ID NO: 2693404 - RNA, 20 nt, Haemophilus influenzae Rd
ugaagcuccaguaagcauau

SEQ ID NO: 2693405 - RNA, 15 nt, Haemophilus influenzae Rd
ugaaggcaaaauuga

SEQ ID NO: 2693406 - RNA, 12 nt, Haemophilus influenzae Rd
ugaaguaaauau

SEQ ID NO: 2693407 - RNA, 13 nt, Haemophilus influenzae Rd
ugaaguaaauauu

SEQ ID NO: 2693408 - RNA, 15 nt, Haemophilus influenzae Rd
ugaagucuauaaaag

SEQ ID NO: 2693409 - RNA, 19 nt, Haemophilus influenzae Rd
ugaagucuauaaaagaagg

SEQ ID NO: 2693410 - RNA, 13 nt, Haemophilus influenzae Rd
ugaagucuuaaua

SEQ ID NO: 2693411 - RNA, 15 nt, Haemophilus influenzae Rd
ugaaguuagaaacag

SEQ ID NO: 2693412 - RNA, 19 nt, Haemophilus influenzae Rd
ugaaguuagaaacagaagu

SEQ ID NO: 2693413 - RNA, 16 nt, Haemophilus influenzae Rd
ugaaguucacuucauc

SEQ ID NO: 2693414 - RNA, 16 nt, Haemophilus influenzae Rd
ugaaguugccauagac

SEQ ID NO: 2693415 - RNA, 16 nt, Haemophilus influenzae Rd
ugaaguuggagauuuu

SEQ ID NO: 2693416 - RNA, 19 nt, Haemophilus influenzae Rd
ugaaguuguaauaaagcug

SEQ ID NO: 2693417 - RNA, 12 nt, Haemophilus influenzae Rd
ugaaguuuuuua

SEQ ID NO: 2693418 - RNA, 16 nt, Haemophilus influenzae Rd
ugaaguuuuuuaaguu

SEQ ID NO: 2693419 - RNA, 13 nt, Haemophilus influenzae Rd
ugaauaaaagaga

SEQ ID NO: 2693420 - RNA, 20 nt, Haemophilus influenzae Rd
ugaauaaaaucaauaauauu

SEQ ID NO: 2693421 - RNA, 18 nt, Haemophilus influenzae Rd
ugaauaaaauuuuuaaag

SEQ ID NO: 2693422 - RNA, 18 nt, Haemophilus influenzae Rd
ugaauaauguuuucauua

SEQ ID NO: 2693423 - RNA, 19 nt, Haemophilus influenzae Rd
ugaauaauguuuucauuaa

SEQ ID NO: 2693424 - RNA, 14 nt, Haemophilus influenzae Rd
ugaauaauuacuug

SEQ ID NO: 2693425 - RNA, 16 nt, Haemophilus influenzae Rd
ugacgccauccaaaac

SEQ ID NO: 2693426 - RNA, 13 nt, Haemophilus influenzae Rd
ugacguaaaaguu

SEQ ID NO: 2693427 - RNA, 14 nt, Haemophilus influenzae Rd
ugacguaauuugug

SEQ ID NO: 2693428 - RNA, 21 nt, Haemophilus influenzae Rd
ugacguacaauuucaaauaaa

SEQ ID NO: 2693429 - RNA, 12 nt, Haemophilus influenzae Rd
ugacgugcuaau

SEQ ID NO: 2693430 - RNA, 18 nt, Haemophilus influenzae Rd
ugacgugcuaauucugcu

SEQ ID NO: 2693431 - RNA, 19 nt, Haemophilus influenzae Rd
ugacguuguucaauaauau

SEQ ID NO: 2693432 - RNA, 15 nt, Haemophilus influenzae Rd
ugacuaaaguaaauu

SEQ ID NO: 2693433 - RNA, 12 nt, Haemophilus influenzae Rd
ugacuaaaucau

SEQ ID NO: 2693434 - RNA, 15 nt, Haemophilus influenzae Rd
ugacuaaaucaugaa

SEQ ID NO: 2693435 - RNA, 15 nt, Haemophilus influenzae Rd
ugacuaccaauauua

SEQ ID NO: 2693436 - RNA, 17 nt, Haemophilus influenzae Rd
ugacuaccaauauuauc

SEQ ID NO: 2693437 - RNA, 15 nt, Haemophilus influenzae Rd
ugacuggcaaaaaug

SEQ ID NO: 2693438 - RNA, 12 nt, Haemophilus influenzae Rd
ugacuuauucca

SEQ ID NO: 2693439 - RNA, 20 nt, Haemophilus influenzae Rd
ugacuugcgcauccguacuu

SEQ ID NO: 2693440 - RNA, 20 nt, Haemophilus influenzae Rd
ugacuuggauugauauuugg

SEQ ID NO: 2693441 - RNA, 16 nt, Haemophilus influenzae Rd
ugacuuguuuuaaaac

SEQ ID NO: 2693442 - RNA, 14 nt, Haemophilus influenzae Rd
ugagaaaaauguua

SEQ ID NO: 2693443 - RNA, 16 nt, Haemophilus influenzae Rd
ugagaaagaauauaaa

SEQ ID NO: 2693444 - RNA, 18 nt, Haemophilus influenzae Rd
ugagaaagaauauaaaua

SEQ ID NO: 2693445 - RNA, 18 nt, Haemophilus influenzae Rd
ugagaaagggauuuuaau

SEQ ID NO: 2693446 - RNA, 20 nt, Haemophilus influenzae Rd
ugagaaagggauuuuaauua

SEQ ID NO: 2693447 - RNA, 15 nt, Haemophilus influenzae Rd
ugagaaaguaaugga

SEQ ID NO: 2693448 - RNA, 18 nt, Haemophilus influenzae Rd
ugagaaaguuaaucaaac

SEQ ID NO: 2693449 - RNA, 23 nt, Haemophilus influenzae Rd
ugagaaaguuaaucaaacuuuua

SEQ ID NO: 2693450 - RNA, 19 nt, Haemophilus influenzae Rd
ugagaaauaauauaaccug

SEQ ID NO: 2693451 - RNA, 23 nt, Haemophilus influenzae Rd
ugagaaugaaaauaaccgcacuu

SEQ ID NO: 2693452 - RNA, 21 nt, Haemophilus influenzae Rd
ugagaauuuucaaccgcacuu

SEQ ID NO: 2693453 - RNA, 19 nt, Haemophilus influenzae Rd
ugagaauuuuuucuucaau

SEQ ID NO: 2693454 - RNA, 20 nt, Haemophilus influenzae Rd
ugagauaaaugggcaaacau

SEQ ID NO: 2693455 - RNA, 17 nt, Haemophilus influenzae Rd
ugagauaugaaauaaag

SEQ ID NO: 2693456 - RNA, 18 nt, Haemophilus influenzae Rd
ugagauggccgagcaggc

SEQ ID NO: 2693457 - RNA, 19 nt, Haemophilus influenzae Rd
ugagauguuucgcgauacu

SEQ ID NO: 2693458 - RNA, 15 nt, Haemophilus influenzae Rd
ugagauuauuucuac

SEQ ID NO: 2693459 - RNA, 15 nt, Haemophilus influenzae Rd
ugagauuuaauuuau

SEQ ID NO: 2693460 - RNA, 17 nt, Haemophilus influenzae Rd
ugagauuuuauuucgcu

SEQ ID NO: 2693461 - RNA, 22 nt, Haemophilus influenzae Rd
ugagauuuuauuucgcuauugu

SEQ ID NO: 2693462 - RNA, 15 nt, Haemophilus influenzae Rd
ugagcaaaucaaaac

SEQ ID NO: 2693463 - RNA, 20 nt, Haemophilus influenzae Rd
ugagcaaaucaaaaccuuuc

SEQ ID NO: 2693464 - RNA, 17 nt, Haemophilus influenzae Rd
ugagcaaccacuaaaac

SEQ ID NO: 2693465 - RNA, 16 nt, Haemophilus influenzae Rd
ugagcaauccaaucag

SEQ ID NO: 2693466 - RNA, 14 nt, Haemophilus influenzae Rd
ugagcacuucugua

SEQ ID NO: 2693467 - RNA, 18 nt, Haemophilus influenzae Rd
ugagcauuuagucaauuu

SEQ ID NO: 2693468 - RNA, 23 nt, Haemophilus influenzae Rd
ugagcauuuuuuauuaaaaaagu

SEQ ID NO: 2693469 - RNA, 15 nt, Haemophilus influenzae Rd
ugagccaauaacuuc

SEQ ID NO: 2693470 - RNA, 13 nt, Haemophilus influenzae Rd
ugagccaauggaa

SEQ ID NO: 2693471 - RNA, 16 nt, Haemophilus influenzae Rd
ugagcgcauuauggaa

SEQ ID NO: 2693472 - RNA, 17 nt, Haemophilus influenzae Rd
ugagcuaagcauuucag

SEQ ID NO: 2693473 - RNA, 17 nt, Haemophilus influenzae Rd
ugagcugcuuguaacca

SEQ ID NO: 2693474 - RNA, 15 nt, Haemophilus influenzae Rd
ugagcuugauuuuca

SEQ ID NO: 2693475 - RNA, 14 nt, Haemophilus influenzae Rd
ugagcuuuucgcgc

SEQ ID NO: 2693476 - RNA, 13 nt, Haemophilus influenzae Rd
ugaggaaaauaaa

SEQ ID NO: 2693477 - RNA, 20 nt, Haemophilus influenzae Rd
ugaggaaguuaaaauacuuu

SEQ ID NO: 2693478 - RNA, 15 nt, Haemophilus influenzae Rd
ugaggcuaauaauaa

SEQ ID NO: 2693479 - RNA, 17 nt, Haemophilus influenzae Rd
ugaggcuaauaaugcca

SEQ ID NO: 2693480 - RNA, 13 nt, Haemophilus influenzae Rd
ugagggagcaaug

SEQ ID NO: 2693481 - RNA, 18 nt, Haemophilus influenzae Rd
ugagguauuguccuucau

SEQ ID NO: 2693482 - RNA, 19 nt, Haemophilus influenzae Rd
ugaguacccgugccuaauu

SEQ ID NO: 2693483 - RNA, 16 nt, Haemophilus influenzae Rd
ugaguauaaauuugug

SEQ ID NO: 2693484 - RNA, 14 nt, Haemophilus influenzae Rd
ugaguauagucauu

SEQ ID NO: 2693485 - RNA, 13 nt, Haemophilus influenzae Rd
ugaguaucuuuua

SEQ ID NO: 2693486 - RNA, 14 nt, Haemophilus influenzae Rd
ugaguauguugcuu

SEQ ID NO: 2693487 - RNA, 15 nt, Haemophilus influenzae Rd
ugaguauguugcuuu

SEQ ID NO: 2693488 - RNA, 20 nt, Haemophilus influenzae Rd
ugaguauguugcuuuuauca

SEQ ID NO: 2693489 - RNA, 21 nt, Haemophilus influenzae Rd
ugaguccgauccauacaguaa

SEQ ID NO: 2693490 - RNA, 22 nt, Haemophilus influenzae Rd
ugaguccuuuuaguuuccccug

SEQ ID NO: 2693491 - RNA, 12 nt, Haemophilus influenzae Rd
ugagugauuuca

SEQ ID NO: 2693492 - RNA, 13 nt, Haemophilus influenzae Rd
ugagugucuugag

SEQ ID NO: 2693493 - RNA, 13 nt, Haemophilus influenzae Rd
ugaguucuguaau

SEQ ID NO: 2693494 - RNA, 17 nt, Haemophilus influenzae Rd
ugaguucuguaauucac

SEQ ID NO: 2693495 - RNA, 20 nt, Haemophilus influenzae Rd
ugaguugauuuuaaaauauc

SEQ ID NO: 2693496 - RNA, 23 nt, Haemophilus influenzae Rd
ugaguugauuuuaaaauaucaaa

SEQ ID NO: 2693497 - RNA, 21 nt, Haemophilus influenzae Rd
ugaguugucccgcauauaaaa

SEQ ID NO: 2693498 - RNA, 23 nt, Haemophilus influenzae Rd
ugaguugucccgcauauaaaaua

SEQ ID NO: 2693499 - RNA, 19 nt, Haemophilus influenzae Rd
ugaguuuccacguuuucaa

SEQ ID NO: 2693500 - RNA, 21 nt, Haemophilus influenzae Rd
ugaguuuccacguuuucaacu

SEQ ID NO: 2693501 - RNA, 17 nt, Haemophilus influenzae Rd
ugaguuuucaucuaagu

SEQ ID NO: 2693502 - RNA, 20 nt, Haemophilus influenzae Rd
ugauaaaaaccgcugucaua

SEQ ID NO: 2693503 - RNA, 13 nt, Haemophilus influenzae Rd
ugauaaaaauaaa

SEQ ID NO: 2693504 - RNA, 20 nt, Haemophilus influenzae Rd
ugauaaaaauaucguaaaaa

SEQ ID NO: 2693505 - RNA, 19 nt, Haemophilus influenzae Rd
ugauaaaaaucaaagagaa

SEQ ID NO: 2693506 - RNA, 19 nt, Haemophilus influenzae Rd
ugauaaacgccuuuuaaac

SEQ ID NO: 2693507 - RNA, 21 nt, Haemophilus influenzae Rd
ugauaaaggcauuuauuucaa

SEQ ID NO: 2693508 - RNA, 20 nt, Haemophilus influenzae Rd
ugauaaaugcgggaauagcu

SEQ ID NO: 2693509 - RNA, 23 nt, Haemophilus influenzae Rd
ugauaaaugcgggaauagcucag

SEQ ID NO: 2693510 - RNA, 21 nt, Haemophilus influenzae Rd
ugauaaaugguuucaguugcu

SEQ ID NO: 2693511 - RNA, 20 nt, Haemophilus influenzae Rd
ugauaaauguguuaaauaac

SEQ ID NO: 2693512 - RNA, 15 nt, Haemophilus influenzae Rd
ugauaaauuccuucc

SEQ ID NO: 2693513 - RNA, 16 nt, Haemophilus influenzae Rd
ugauaaauuccuucca

SEQ ID NO: 2693514 - RNA, 12 nt, Haemophilus influenzae Rd
ugauaaauuucu

SEQ ID NO: 2693515 - RNA, 14 nt, Haemophilus influenzae Rd
ugauaaauuucuaa

SEQ ID NO: 2693516 - RNA, 20 nt, Haemophilus influenzae Rd
ugauaacaacucacaauaau

SEQ ID NO: 2693517 - RNA, 17 nt, Haemophilus influenzae Rd
ugauaaccaucuauauu

SEQ ID NO: 2693518 - RNA, 18 nt, Haemophilus influenzae Rd
ugauaaccuaucaucuga

SEQ ID NO: 2693519 - RNA, 21 nt, Haemophilus influenzae Rd
ugauaacgcuugaauaaaucc

SEQ ID NO: 2693520 - RNA, 19 nt, Haemophilus influenzae Rd
ugauaagccacucuaaguu

SEQ ID NO: 2693521 - RNA, 19 nt, Haemophilus influenzae Rd
ugauaagcccgaacagaaa

SEQ ID NO: 2693522 - RNA, 12 nt, Haemophilus influenzae Rd
ugauaaguagaa

SEQ ID NO: 2693523 - RNA, 13 nt, Haemophilus influenzae Rd
ugauaaguagaaa

SEQ ID NO: 2693524 - RNA, 17 nt, Haemophilus influenzae Rd
ugauaaguucauaaaag

SEQ ID NO: 2693525 - RNA, 22 nt, Haemophilus influenzae Rd
ugauaaguucauaaaaggggca

SEQ ID NO: 2693526 - RNA, 18 nt, Haemophilus influenzae Rd
ugauaauccagcuacauu

SEQ ID NO: 2693527 - RNA, 20 nt, Haemophilus influenzae Rd
ugauaauccagcuacauuca

SEQ ID NO: 2693528 - RNA, 15 nt, Haemophilus influenzae Rd
ugauaaugccucuuu

SEQ ID NO: 2693529 - RNA, 21 nt, Haemophilus influenzae Rd
ugauaaugccucuuuaacauu

SEQ ID NO: 2693530 - RNA, 17 nt, Haemophilus influenzae Rd
ugauucgccuuauaucc

SEQ ID NO: 2693531 - RNA, 17 nt, Haemophilus influenzae Rd
ugauucuucauaaauac

SEQ ID NO: 2693532 - RNA, 19 nt, Haemophilus influenzae Rd
ugauucuucgccauuuucu

SEQ ID NO: 2693533 - RNA, 16 nt, Haemophilus influenzae Rd
ugauugacauuuuacu

SEQ ID NO: 2693534 - RNA, 20 nt, Haemophilus influenzae Rd
ugauugacauuuuacuuuag

SEQ ID NO: 2693535 - RNA, 15 nt, Haemophilus influenzae Rd
ugauugacgaaaaau

SEQ ID NO: 2693536 - RNA, 16 nt, Haemophilus influenzae Rd
ugauugagaugccauu

SEQ ID NO: 2693537 - RNA, 21 nt, Haemophilus influenzae Rd
ugauugagaugccauuucgcu

SEQ ID NO: 2693538 - RNA, 13 nt, Haemophilus influenzae Rd
ugauugcaccuaa

SEQ ID NO: 2693539 - RNA, 16 nt, Haemophilus influenzae Rd
ugauugcgaauauuaa

SEQ ID NO: 2693540 - RNA, 20 nt, Haemophilus influenzae Rd
ugauugcgcauuuaauacug

SEQ ID NO: 2693541 - RNA, 16 nt, Haemophilus influenzae Rd
ugauugcuacagcaaa

SEQ ID NO: 2693542 - RNA, 17 nt, Haemophilus influenzae Rd
ugauuguaaaagucccu

SEQ ID NO: 2693543 - RNA, 19 nt, Haemophilus influenzae Rd
ugauuguaaaagucccuga

SEQ ID NO: 2693544 - RNA, 14 nt, Haemophilus influenzae Rd
ugauuguggugaga

SEQ ID NO: 2693545 - RNA, 16 nt, Haemophilus influenzae Rd
ugauuuaaauugaaaa

SEQ ID NO: 2693546 - RNA, 18 nt, Haemophilus influenzae Rd
ugauuuagggaaguuaug

SEQ ID NO: 2693547 - RNA, 13 nt, Haemophilus influenzae Rd
ugauuuaucauuc

SEQ ID NO: 2693548 - RNA, 14 nt, Haemophilus influenzae Rd
ugauuuauuaauag

SEQ ID NO: 2693549 - RNA, 23 nt, Haemophilus influenzae Rd
ugauuucaauuccuuuaacgccu

SEQ ID NO: 2693550 - RNA, 17 nt, Haemophilus influenzae Rd
ugauuuccuguaaaaaa

SEQ ID NO: 2693551 - RNA, 16 nt, Haemophilus influenzae Rd
ugauuuguaucauauc

SEQ ID NO: 2693552 - RNA, 17 nt, Haemophilus influenzae Rd
ugauuuguuacuaaaau

SEQ ID NO: 2693553 - RNA, 18 nt, Haemophilus influenzae Rd
ugauuuguuacuaaaaua

SEQ ID NO: 2693554 - RNA, 17 nt, Haemophilus influenzae Rd
ugauuuuaaaauaucaa

SEQ ID NO: 2693555 - RNA, 12 nt, Haemophilus influenzae Rd
ugauuuuaaaga

SEQ ID NO: 2693556 - RNA, 15 nt, Haemophilus influenzae Rd
ugauuuuaaagccau

SEQ ID NO: 2693557 - RNA, 22 nt, Haemophilus influenzae Rd
ugauuuuaaaguaaauuuuaaa

SEQ ID NO: 2693558 - RNA, 12 nt, Haemophilus influenzae Rd
ugauuuuaaauc

SEQ ID NO: 2693559 - RNA, 18 nt, Haemophilus influenzae Rd
ugauuuucagaccgcacu

SEQ ID NO: 2693560 - RNA, 19 nt, Haemophilus influenzae Rd
ugauuuucagcaaaaugcg

SEQ ID NO: 2693561 - RNA, 12 nt, Haemophilus influenzae Rd
ugauuuucauuc

SEQ ID NO: 2693562 - RNA, 13 nt, Haemophilus influenzae Rd
ugauuuucauucc

SEQ ID NO: 2693563 - RNA, 16 nt, Haemophilus influenzae Rd
ugauuuuccaaaauuu

SEQ ID NO: 2693564 - RNA, 21 nt, Haemophilus influenzae Rd
ugauuuuccccgcucuuucca

SEQ ID NO: 2693565 - RNA, 23 nt, Haemophilus influenzae Rd
ugauuuugagcaaaaaaaaaagc

SEQ ID NO: 2693566 - RNA, 14 nt, Haemophilus influenzae Rd
ugauuuugcauuaa

SEQ ID NO: 2693567 - RNA, 16 nt, Haemophilus influenzae Rd
ugauuuugucuaaggu

SEQ ID NO: 2693568 - RNA, 18 nt, Haemophilus influenzae Rd
ugauuuuuaaccgcccuu

SEQ ID NO: 2693569 - RNA, 15 nt, Haemophilus influenzae Rd
ugauuuuuuaaagua

SEQ ID NO: 2693570 - RNA, 14 nt, Haemophilus influenzae Rd
ugauuuuuuucauu

SEQ ID NO: 2693571 - RNA, 20 nt, Haemophilus influenzae Rd
ugauuuuuuucauuuuagaa

SEQ ID NO: 2693572 - RNA, 14 nt, Haemophilus influenzae Rd
ugauuuuuuugccu

SEQ ID NO: 2693573 - RNA, 16 nt, Haemophilus influenzae Rd
ugauuuuuuugccuua

SEQ ID NO: 2693574 - RNA, 20 nt, Haemophilus influenzae Rd
ugcaaaaacccucaagaaac

SEQ ID NO: 2693575 - RNA, 17 nt, Haemophilus influenzae Rd
ugcaaaaguaaauaauc

SEQ ID NO: 2693576 - RNA, 13 nt, Haemophilus influenzae Rd
ugcaaacauacca

SEQ ID NO: 2693577 - RNA, 11 nt, Haemophilus influenzae Rd
ugcaaaccaaa

SEQ ID NO: 2693578 - RNA, 23 nt, Haemophilus influenzae Rd
ugcaaaccaaaucacaauaagca

SEQ ID NO: 2693579 - RNA, 11 nt, Haemophilus influenzae Rd
ugcaaaccaac

SEQ ID NO: 2693580 - RNA, 18 nt, Haemophilus influenzae Rd
ugcaaacgcaagcugugc

SEQ ID NO: 2693581 - RNA, 15 nt, Haemophilus influenzae Rd
ugcaaagccuucacc

SEQ ID NO: 2693582 - RNA, 23 nt, Haemophilus influenzae Rd
ugcaaaggcagccauaaaugcua

SEQ ID NO: 2693583 - RNA, 21 nt, Haemophilus influenzae Rd
ugcaaaguaacuuuaauuaua

SEQ ID NO: 2693584 - RNA, 23 nt, Haemophilus influenzae Rd
ugcaaaguauuuuucuaaaucgu

SEQ ID NO: 2693585 - RNA, 19 nt, Haemophilus influenzae Rd
ugcaaagugcgguaagaaa

SEQ ID NO: 2693586 - RNA, 20 nt, Haemophilus influenzae Rd
ugcaaagugcgguaagaaaa

SEQ ID NO: 2693587 - RNA, 13 nt, Haemophilus influenzae Rd
ugcaaaguuauaa

SEQ ID NO: 2693588 - RNA, 13 nt, Haemophilus influenzae Rd
ugcaaauaacuau

SEQ ID NO: 2693589 - RNA, 18 nt, Haemophilus influenzae Rd
ugcaaaucgagguuuucc

SEQ ID NO: 2693590 - RNA, 14 nt, Haemophilus influenzae Rd
ugcaaaugguguuu

SEQ ID NO: 2693591 - RNA, 12 nt, Haemophilus influenzae Rd
ugcaaauuuuuc

SEQ ID NO: 2693592 - RNA, 15 nt, Haemophilus influenzae Rd
ugcaaauuuuuucaa

SEQ ID NO: 2693593 - RNA, 16 nt, Haemophilus influenzae Rd
ugcaaauuuuuucaaa

SEQ ID NO: 2693594 - RNA, 21 nt, Haemophilus influenzae Rd
ugcaacaaagugcggcaaaaa

SEQ ID NO: 2693595 - RNA, 14 nt, Haemophilus influenzae Rd
ugcaacaauaucau

SEQ ID NO: 2693596 - RNA, 16 nt, Haemophilus influenzae Rd
ugcaacaauaucauug

SEQ ID NO: 2693597 - RNA, 14 nt, Haemophilus influenzae Rd
ugcaacaauuucau

SEQ ID NO: 2693598 - RNA, 17 nt, Haemophilus influenzae Rd
ugcaacaauuucaucag

SEQ ID NO: 2693599 - RNA, 19 nt, Haemophilus influenzae Rd
ugcaacagcugcacaagca

SEQ ID NO: 2693600 - RNA, 19 nt, Haemophilus influenzae Rd
ugcaaccacacaagcacca

SEQ ID NO: 2693601 - RNA, 18 nt, Haemophilus influenzae Rd
ugcaacgagcaauauuca

SEQ ID NO: 2693602 - RNA, 19 nt, Haemophilus influenzae Rd
ugcaacgagcaauauucaa

SEQ ID NO: 2693603 - RNA, 18 nt, Haemophilus influenzae Rd
ugcaacguuacucaucau

SEQ ID NO: 2693604 - RNA, 15 nt, Haemophilus influenzae Rd
ugcaacuucagcagc

SEQ ID NO: 2693605 - RNA, 11 nt, Haemophilus influenzae Rd
ugcaacuuuuu

SEQ ID NO: 2693606 - RNA, 13 nt, Haemophilus influenzae Rd
ugcaacuuuuuua

SEQ ID NO: 2693607 - RNA, 17 nt, Haemophilus influenzae Rd
ugcaagaaauugauaua

SEQ ID NO: 2693608 - RNA, 14 nt, Haemophilus influenzae Rd
ugcaagcacauuaa

SEQ ID NO: 2693609 - RNA, 18 nt, Haemophilus influenzae Rd
ugcaagcaguuuacgguu

SEQ ID NO: 2693610 - RNA, 21 nt, Haemophilus influenzae Rd
ugcaagcauucucaauugcaa

SEQ ID NO: 2693611 - RNA, 13 nt, Haemophilus influenzae Rd
ugcaagccccuga

SEQ ID NO: 2693612 - RNA, 16 nt, Haemophilus influenzae Rd
ugcaagccccugaagc

SEQ ID NO: 2693613 - RNA, 19 nt, Haemophilus influenzae Rd
ugcaauaaagcuugaaaaa

SEQ ID NO: 2693614 - RNA, 20 nt, Haemophilus influenzae Rd
ugcaauaaaguugagaauuu

SEQ ID NO: 2693615 - RNA, 12 nt, Haemophilus influenzae Rd
ugcaauaaccac

SEQ ID NO: 2693616 - RNA, 18 nt, Haemophilus influenzae Rd
ugcaauaauaucugcuuu

SEQ ID NO: 2693617 - RNA, 20 nt, Haemophilus influenzae Rd
ugcaauaggauugccuucau

SEQ ID NO: 2693618 - RNA, 23 nt, Haemophilus influenzae Rd
ugcaauaggauugccuucauaua

SEQ ID NO: 2693619 - RNA, 15 nt, Haemophilus influenzae Rd
ugcaaucacgcucaa

SEQ ID NO: 2693620 - RNA, 17 nt, Haemophilus influenzae Rd
ugcaauuaauucuuuug

SEQ ID NO: 2693621 - RNA, 12 nt, Haemophilus influenzae Rd
ugcaauuaucaa

SEQ ID NO: 2693622 - RNA, 21 nt, Haemophilus influenzae Rd
ugcaauuuaacauaauuuaua

SEQ ID NO: 2693623 - RNA, 12 nt, Haemophilus influenzae Rd
ugcaauuucagc

SEQ ID NO: 2693624 - RNA, 21 nt, Haemophilus influenzae Rd
ugcaauuuuacgagaaaggug

SEQ ID NO: 2693625 - RNA, 13 nt, Haemophilus influenzae Rd
ugcacaacaugcc

SEQ ID NO: 2693626 - RNA, 14 nt, Haemophilus influenzae Rd
ugcacaagcaccac

SEQ ID NO: 2693627 - RNA, 13 nt, Haemophilus influenzae Rd
ugcacaaucaaac

SEQ ID NO: 2693628 - RNA, 15 nt, Haemophilus influenzae Rd
ugcacauaacaaaau

SEQ ID NO: 2693629 - RNA, 17 nt, Haemophilus influenzae Rd
ugcaccaaaaauccuca

SEQ ID NO: 2693630 - RNA, 18 nt, Haemophilus influenzae Rd
ugcaccaaaaauccucau

SEQ ID NO: 2693631 - RNA, 20 nt, Haemophilus influenzae Rd
ugcaccaauaauugaugcua

SEQ ID NO: 2693632 - RNA, 17 nt, Haemophilus influenzae Rd
ugcaccaaucaaauaaa

SEQ ID NO: 2693633 - RNA, 15 nt, Haemophilus influenzae Rd
ugcaccaccaauuaa

SEQ ID NO: 2693634 - RNA, 20 nt, Haemophilus influenzae Rd
ugcaccacguucuuuuaaug

SEQ ID NO: 2693635 - RNA, 17 nt, Haemophilus influenzae Rd
ugcacccauuuugauug

SEQ ID NO: 2693636 - RNA, 15 nt, Haemophilus influenzae Rd
ugccaacaauaucac

SEQ ID NO: 2693637 - RNA, 14 nt, Haemophilus influenzae Rd
ugccaacgcaggua

SEQ ID NO: 2693638 - RNA, 21 nt, Haemophilus influenzae Rd
ugccaagcuaauugguaaaau

SEQ ID NO: 2693639 - RNA, 19 nt, Haemophilus influenzae Rd
ugccaauccauuuuuaaau

SEQ ID NO: 2693640 - RNA, 14 nt, Haemophilus influenzae Rd
ugccaaugcaguaa

SEQ ID NO: 2693641 - RNA, 19 nt, Haemophilus influenzae Rd
ugccacaaagcaaauggca

SEQ ID NO: 2693642 - RNA, 18 nt, Haemophilus influenzae Rd
ugccacagguaaagaacc

SEQ ID NO: 2693643 - RNA, 16 nt, Haemophilus influenzae Rd
ugccaccgcgaucugu

SEQ ID NO: 2693644 - RNA, 13 nt, Haemophilus influenzae Rd
ugccacuaauaag

SEQ ID NO: 2693645 - RNA, 19 nt, Haemophilus influenzae Rd
ugccacuuggugaucaccg

SEQ ID NO: 2693646 - RNA, 23 nt, Haemophilus influenzae Rd
ugccagaccuaagguuaauuuuu

SEQ ID NO: 2693647 - RNA, 22 nt, Haemophilus influenzae Rd
ugccagcagaacauugugacau

SEQ ID NO: 2693648 - RNA, 23 nt, Haemophilus influenzae Rd
ugccaguaacuuucuucaauaau

SEQ ID NO: 2693649 - RNA, 17 nt, Haemophilus influenzae Rd
ugccagucuuacgccaa

SEQ ID NO: 2693650 - RNA, 18 nt, Haemophilus influenzae Rd
ugccaguggcucaauauc

SEQ ID NO: 2693651 - RNA, 22 nt, Haemophilus influenzae Rd
ugccaguuaaggauuuuugaau

SEQ ID NO: 2693652 - RNA, 15 nt, Haemophilus influenzae Rd
ugccauaaauuugga

SEQ ID NO: 2693653 - RNA, 17 nt, Haemophilus influenzae Rd
ugccauaauaacgccac

SEQ ID NO: 2693654 - RNA, 21 nt, Haemophilus influenzae Rd
ugccauaauaaucacaacaaa

SEQ ID NO: 2693655 - RNA, 18 nt, Haemophilus influenzae Rd
ugccauauaccaauaauu

SEQ ID NO: 2693656 - RNA, 15 nt, Haemophilus influenzae Rd
ugccauauuuaauaa

SEQ ID NO: 2693657 - RNA, 16 nt, Haemophilus influenzae Rd
ugccauauuuaauaag

SEQ ID NO: 2693658 - RNA, 21 nt, Haemophilus influenzae Rd
ugccaucacagucuuuuaaca

SEQ ID NO: 2693659 - RNA, 18 nt, Haemophilus influenzae Rd
ugccaucacauccacaaa

SEQ ID NO: 2693660 - RNA, 14 nt, Haemophilus influenzae Rd
ugccaucaccaaga

SEQ ID NO: 2693661 - RNA, 19 nt, Haemophilus influenzae Rd
ugccauuaaacuucuguaa

SEQ ID NO: 2693662 - RNA, 18 nt, Haemophilus influenzae Rd
ugccauuacaagcauuaa

SEQ ID NO: 2693663 - RNA, 17 nt, Haemophilus influenzae Rd
ugccauugcgugaauau

SEQ ID NO: 2693664 - RNA, 19 nt, Haemophilus influenzae Rd
ugccauugcgugaauaucu

SEQ ID NO: 2693665 - RNA, 21 nt, Haemophilus influenzae Rd
ugccauugcuuguuucauaca

SEQ ID NO: 2693666 - RNA, 13 nt, Haemophilus influenzae Rd
ugccauuucuaaa

SEQ ID NO: 2693667 - RNA, 14 nt, Haemophilus influenzae Rd
ugccauuugcuucu

SEQ ID NO: 2693668 - RNA, 22 nt, Haemophilus influenzae Rd
ugccauuuuucagcaagcauuu

SEQ ID NO: 2693669 - RNA, 15 nt, Haemophilus influenzae Rd
ugccauuuuuuauaa

SEQ ID NO: 2693670 - RNA, 12 nt, Haemophilus influenzae Rd
ugcccaagugcg

SEQ ID NO: 2693671 - RNA, 17 nt, Haemophilus influenzae Rd
ugcccauaagugagaaa

SEQ ID NO: 2693672 - RNA, 15 nt, Haemophilus influenzae Rd
ugcccauauuauucc

SEQ ID NO: 2693673 - RNA, 13 nt, Haemophilus influenzae Rd
ugcccaugcuuug

SEQ ID NO: 2693674 - RNA, 15 nt, Haemophilus influenzae Rd
ugccccugcaauugu

SEQ ID NO: 2693675 - RNA, 21 nt, Haemophilus influenzae Rd
ugcccgcuacaaauaagccaa

SEQ ID NO: 2693676 - RNA, 23 nt, Haemophilus influenzae Rd
ugcccgcuucuucgauaaaaucu

SEQ ID NO: 2693677 - RNA, 16 nt, Haemophilus influenzae Rd
ugcccgugaguaaaau

SEQ ID NO: 2693678 - RNA, 14 nt, Haemophilus influenzae Rd
ugccgaaaauuuac

SEQ ID NO: 2693679 - RNA, 13 nt, Haemophilus influenzae Rd
ugccgaagccuaa

SEQ ID NO: 2693680 - RNA, 21 nt, Haemophilus influenzae Rd
ugccgaauagauuuaaacaau

SEQ ID NO: 2693681 - RNA, 22 nt, Haemophilus influenzae Rd
ugccgaauagauuuaaacaauu

SEQ ID NO: 2693682 - RNA, 20 nt, Haemophilus influenzae Rd
ugccgacacuaaaaagccca

SEQ ID NO: 2693683 - RNA, 14 nt, Haemophilus influenzae Rd
ugccgcaaacauca

SEQ ID NO: 2693684 - RNA, 18 nt, Haemophilus influenzae Rd
ugccgcaaacaucaucac

SEQ ID NO: 2693685 - RNA, 18 nt, Haemophilus influenzae Rd
ugccgcaagugguaaaau

SEQ ID NO: 2693686 - RNA, 16 nt, Haemophilus influenzae Rd
ugccgcugcagcagga

SEQ ID NO: 2693687 - RNA, 14 nt, Haemophilus influenzae Rd
ugccgcuuuacaaa

SEQ ID NO: 2693688 - RNA, 12 nt, Haemophilus influenzae Rd
ugccguucaaaa

SEQ ID NO: 2693689 - RNA, 18 nt, Haemophilus influenzae Rd
ugccuaacccccuuaauu

SEQ ID NO: 2693690 - RNA, 14 nt, Haemophilus influenzae Rd
ugccuaauaaaaaa

SEQ ID NO: 2693691 - RNA, 15 nt, Haemophilus influenzae Rd
ugccuaauaaaaaau

SEQ ID NO: 2693692 - RNA, 19 nt, Haemophilus influenzae Rd
ugccuaauagaaaaaugcc

SEQ ID NO: 2693693 - RNA, 22 nt, Haemophilus influenzae Rd
ugccuaauucagcggcuuucuu

SEQ ID NO: 2693694 - RNA, 18 nt, Haemophilus influenzae Rd
ugccuacuuuuuauuuuu

SEQ ID NO: 2693695 - RNA, 20 nt, Haemophilus influenzae Rd
ugccuacuuuuuauuuuuga

SEQ ID NO: 2693696 - RNA, 17 nt, Haemophilus influenzae Rd
ugccucuguauuuuuca

SEQ ID NO: 2693697 - RNA, 19 nt, Haemophilus influenzae Rd
ugccucuguauuuuucaua

SEQ ID NO: 2693698 - RNA, 15 nt, Haemophilus influenzae Rd
ugccugcauuaauaa

SEQ ID NO: 2693699 - RNA, 17 nt, Haemophilus influenzae Rd
ugccugcauuaauaauc

SEQ ID NO: 2693700 - RNA, 19 nt, Haemophilus influenzae Rd
ugccugccaccauggcacc

SEQ ID NO: 2693701 - RNA, 20 nt, Haemophilus influenzae Rd
ugccuucauuugcccauacc

SEQ ID NO: 2693702 - RNA, 18 nt, Haemophilus influenzae Rd
ugccuucgccaacguaag

SEQ ID NO: 2693703 - RNA, 12 nt, Haemophilus influenzae Rd
ugccuucuucac

SEQ ID NO: 2693704 - RNA, 13 nt, Haemophilus influenzae Rd
ugccuugaugcuc

SEQ ID NO: 2693705 - RNA, 17 nt, Haemophilus influenzae Rd
ugccuuuccugcaucau

SEQ ID NO: 2693706 - RNA, 12 nt, Haemophilus influenzae Rd
ugccuuuuaaua

SEQ ID NO: 2693707 - RNA, 16 nt, Haemophilus influenzae Rd
ugccuuuuaauaaacc

SEQ ID NO: 2693708 - RNA, 12 nt, Haemophilus influenzae Rd
ugccuuuuauga

SEQ ID NO: 2693709 - RNA, 15 nt, Haemophilus influenzae Rd
ugcgaagcccgaauu

SEQ ID NO: 2693710 - RNA, 22 nt, Haemophilus influenzae Rd
ugcgaagcccgaauucugagca

SEQ ID NO: 2693711 - RNA, 22 nt, Haemophilus influenzae Rd
ugcgaauugcaucguuuacauc

SEQ ID NO: 2693712 - RNA, 16 nt, Haemophilus influenzae Rd
ugcgaccugaagauga

SEQ ID NO: 2693713 - RNA, 20 nt, Haemophilus influenzae Rd
ugcgacuugguggauugugc

SEQ ID NO: 2693714 - RNA, 23 nt, Haemophilus influenzae Rd
ugcgaggcucggucgauggcugg

SEQ ID NO: 2693715 - RNA, 13 nt, Haemophilus influenzae Rd
ugcgauaauauca

SEQ ID NO: 2693716 - RNA, 18 nt, Haemophilus influenzae Rd
ugcgauaauuugcaucau

SEQ ID NO: 2693717 - RNA, 16 nt, Haemophilus influenzae Rd
ugcgauacguuucaua

SEQ ID NO: 2693718 - RNA, 22 nt, Haemophilus influenzae Rd
ugcgauauugaccauuucaucu

SEQ ID NO: 2693719 - RNA, 14 nt, Haemophilus influenzae Rd
ugcgaucacugcac

SEQ ID NO: 2693720 - RNA, 15 nt, Haemophilus influenzae Rd
ugcgauccaaaauuc

SEQ ID NO: 2693721 - RNA, 15 nt, Haemophilus influenzae Rd
ugcgaucuuuuguua

SEQ ID NO: 2693722 - RNA, 12 nt, Haemophilus influenzae Rd
ugcgaugauaaa

SEQ ID NO: 2693723 - RNA, 18 nt, Haemophilus influenzae Rd
ugcgaugccgaaugaaga

SEQ ID NO: 2693724 - RNA, 13 nt, Haemophilus influenzae Rd
ugcgauucaucac

SEQ ID NO: 2693725 - RNA, 15 nt, Haemophilus influenzae Rd
ugcgauuuccaagcu

SEQ ID NO: 2693726 - RNA, 14 nt, Haemophilus influenzae Rd
ugcgauuucuuuug

SEQ ID NO: 2693727 - RNA, 23 nt, Haemophilus influenzae Rd
ugcgauuuuugcacgaauuucag

SEQ ID NO: 2693728 - RNA, 13 nt, Haemophilus influenzae Rd
ugcgcaauggcuu

SEQ ID NO: 2693729 - RNA, 17 nt, Haemophilus influenzae Rd
ugcgcauauacuucuuu

SEQ ID NO: 2693730 - RNA, 15 nt, Haemophilus influenzae Rd
ugcgcauuuaauacu

SEQ ID NO: 2693731 - RNA, 13 nt, Haemophilus influenzae Rd
ugcgccaauaaua

SEQ ID NO: 2693732 - RNA, 17 nt, Haemophilus influenzae Rd
ugcgccacccacuaaug

SEQ ID NO: 2693733 - RNA, 20 nt, Haemophilus influenzae Rd
ugcgccaccuuuuguagaaa

SEQ ID NO: 2693734 - RNA, 16 nt, Haemophilus influenzae Rd
ugcgccaguuucuugg

SEQ ID NO: 2693735 - RNA, 23 nt, Haemophilus influenzae Rd
ugcgcccauuggaauauacaguu

SEQ ID NO: 2693736 - RNA, 18 nt, Haemophilus influenzae Rd
ugcgccuaauuggaaaag

SEQ ID NO: 2693737 - RNA, 12 nt, Haemophilus influenzae Rd
ugcgccugaucg

SEQ ID NO: 2693738 - RNA, 14 nt, Haemophilus influenzae Rd
ugcgcgcaauccaa

SEQ ID NO: 2693739 - RNA, 16 nt, Haemophilus influenzae Rd
ugcgcgcagaaagacg

SEQ ID NO: 2693740 - RNA, 13 nt, Haemophilus influenzae Rd
ugcgcugauuuuu

SEQ ID NO: 2693741 - RNA, 22 nt, Haemophilus influenzae Rd
ugcgcuuucaauuuucugugag

SEQ ID NO: 2693742 - RNA, 12 nt, Haemophilus influenzae Rd
ugcucuuucaaa

SEQ ID NO: 2693743 - RNA, 13 nt, Haemophilus influenzae Rd
ugcucuuuuucca

SEQ ID NO: 2693744 - RNA, 17 nt, Haemophilus influenzae Rd
ugcugaaauauugggcu

SEQ ID NO: 2693745 - RNA, 16 nt, Haemophilus influenzae Rd
ugcugaacgcauucuc

SEQ ID NO: 2693746 - RNA, 21 nt, Haemophilus influenzae Rd
ugcugaagaguuaagccgaua

SEQ ID NO: 2693747 - RNA, 21 nt, Haemophilus influenzae Rd
ugcugaauaaaccuaaagcca

SEQ ID NO: 2693748 - RNA, 23 nt, Haemophilus influenzae Rd
ugcugacgguucaguuucaagca

SEQ ID NO: 2693749 - RNA, 14 nt, Haemophilus influenzae Rd
ugcugaguaccaaa

SEQ ID NO: 2693750 - RNA, 19 nt, Haemophilus influenzae Rd
ugcugauaaauuccuucca

SEQ ID NO: 2693751 - RNA, 14 nt, Haemophilus influenzae Rd
ugcugauuagcagg

SEQ ID NO: 2693752 - RNA, 20 nt, Haemophilus influenzae Rd
ugcugcaaaagcuagaacac

SEQ ID NO: 2693753 - RNA, 16 nt, Haemophilus influenzae Rd
ugcugcaauucaacaa

SEQ ID NO: 2693754 - RNA, 20 nt, Haemophilus influenzae Rd
ugcugcaauucaacaacgug

SEQ ID NO: 2693755 - RNA, 18 nt, Haemophilus influenzae Rd
ugcugcaauuguugcacc

SEQ ID NO: 2693756 - RNA, 16 nt, Haemophilus influenzae Rd
ugcugcaccaaucaaa

SEQ ID NO: 2693757 - RNA, 23 nt, Haemophilus influenzae Rd
ugcugcacgagcuugagcugcug

SEQ ID NO: 2693758 - RNA, 14 nt, Haemophilus influenzae Rd
ugcugcaguuacug

SEQ ID NO: 2693759 - RNA, 18 nt, Haemophilus influenzae Rd
ugcugcugucgcuucuaa

SEQ ID NO: 2693760 - RNA, 13 nt, Haemophilus influenzae Rd
ugcuggaaaaaug

SEQ ID NO: 2693761 - RNA, 16 nt, Haemophilus influenzae Rd
ugcuguaacguuaaau

SEQ ID NO: 2693762 - RNA, 23 nt, Haemophilus influenzae Rd
ugcuguaacguuaaaugaacguu

SEQ ID NO: 2693763 - RNA, 13 nt, Haemophilus influenzae Rd
ugcuguacacaca

SEQ ID NO: 2693764 - RNA, 13 nt, Haemophilus influenzae Rd
ugcuguagaaauu

SEQ ID NO: 2693765 - RNA, 21 nt, Haemophilus influenzae Rd
ugcuguagaaauuaauaaugc

SEQ ID NO: 2693766 - RNA, 18 nt, Haemophilus influenzae Rd
ugcuguauauuuuuaauu

SEQ ID NO: 2693767 - RNA, 22 nt, Haemophilus influenzae Rd
ugcuguauauuuuuaauuuggu

SEQ ID NO: 2693768 - RNA, 17 nt, Haemophilus influenzae Rd
ugcugucgcuucuaauu

SEQ ID NO: 2693769 - RNA, 15 nt, Haemophilus influenzae Rd
ugcuguuuggcaaug

SEQ ID NO: 2693770 - RNA, 12 nt, Haemophilus influenzae Rd
ugcuguuuucaa

SEQ ID NO: 2693771 - RNA, 13 nt, Haemophilus influenzae Rd
ugcuguuuucaau

SEQ ID NO: 2693772 - RNA, 13 nt, Haemophilus influenzae Rd
ugcuguuuuuccg

SEQ ID NO: 2693773 - RNA, 12 nt, Haemophilus influenzae Rd
ugcuuaaaagcu

SEQ ID NO: 2693774 - RNA, 13 nt, Haemophilus influenzae Rd
ugcuuaaaagcuu

SEQ ID NO: 2693775 - RNA, 17 nt, Haemophilus influenzae Rd
ugcuuacuuuauuuuua

SEQ ID NO: 2693776 - RNA, 18 nt, Haemophilus influenzae Rd
ugcuuacuuuauuuuuaa

SEQ ID NO: 2693777 - RNA, 20 nt, Haemophilus influenzae Rd
ugcuuacuuuauuuuuaagu

SEQ ID NO: 2693778 - RNA, 23 nt, Haemophilus influenzae Rd
ugcuuacuuuauuuuuaaguggu

SEQ ID NO: 2693779 - RNA, 15 nt, Haemophilus influenzae Rd
ugcuuauaaaacaga

SEQ ID NO: 2693780 - RNA, 12 nt, Haemophilus influenzae Rd
ugcuuauuuugu

SEQ ID NO: 2693781 - RNA, 19 nt, Haemophilus influenzae Rd
ugcuucaacgacuaaaauu

SEQ ID NO: 2693782 - RNA, 17 nt, Haemophilus influenzae Rd
ugcuucaagaucuuuca

SEQ ID NO: 2693783 - RNA, 21 nt, Haemophilus influenzae Rd
ugcuucauaaaaaccuguugg

SEQ ID NO: 2693784 - RNA, 17 nt, Haemophilus influenzae Rd
ugcuucauagaaaccaa

SEQ ID NO: 2693785 - RNA, 15 nt, Haemophilus influenzae Rd
ugcuucgugaauacg

SEQ ID NO: 2693786 - RNA, 16 nt, Haemophilus influenzae Rd
ugcuucuguugcuuca

SEQ ID NO: 2693787 - RNA, 18 nt, Haemophilus influenzae Rd
ugcuucuguugcuucaau

SEQ ID NO: 2693788 - RNA, 21 nt, Haemophilus influenzae Rd
ugcuucuguugcuucaauugu

SEQ ID NO: 2693789 - RNA, 11 nt, Haemophilus influenzae Rd
ugcuucuuuua

SEQ ID NO: 2693790 - RNA, 14 nt, Haemophilus influenzae Rd
ugcuucuuuuaaua

SEQ ID NO: 2693791 - RNA, 23 nt, Haemophilus influenzae Rd
ugcuugaguuugaucguauugca

SEQ ID NO: 2693792 - RNA, 17 nt, Haemophilus influenzae Rd
ugcuugaugucagugaa

SEQ ID NO: 2693793 - RNA, 15 nt, Haemophilus influenzae Rd
ugcuugguaauaauc

SEQ ID NO: 2693794 - RNA, 16 nt, Haemophilus influenzae Rd
ugcuugguaauaauca

SEQ ID NO: 2693795 - RNA, 13 nt, Haemophilus influenzae Rd
ugcuugguuuuau

SEQ ID NO: 2693796 - RNA, 22 nt, Haemophilus influenzae Rd
ugcuuguucacguguuuuuuca

SEQ ID NO: 2693797 - RNA, 14 nt, Haemophilus influenzae Rd
ugcuuguuuuaaaa

SEQ ID NO: 2693798 - RNA, 15 nt, Haemophilus influenzae Rd
ugcuuguuuuaaaau

SEQ ID NO: 2693799 - RNA, 17 nt, Haemophilus influenzae Rd
ugcuuuaacaauuacug

SEQ ID NO: 2693800 - RNA, 21 nt, Haemophilus influenzae Rd
ugcuuuaacccauuuauuuaa

SEQ ID NO: 2693801 - RNA, 23 nt, Haemophilus influenzae Rd
ugcuuuaacccauuuauuuaaau

SEQ ID NO: 2693802 - RNA, 20 nt, Haemophilus influenzae Rd
ugcuuuaauacgugauaaug

SEQ ID NO: 2693803 - RNA, 22 nt, Haemophilus influenzae Rd
ugcuuuaauucgugcaaauuuu

SEQ ID NO: 2693804 - RNA, 18 nt, Haemophilus influenzae Rd
ugcuuuauuuaaauuaaa

SEQ ID NO: 2693805 - RNA, 14 nt, Haemophilus influenzae Rd
ugcuuuauuuagaa

SEQ ID NO: 2693806 - RNA, 17 nt, Haemophilus influenzae Rd
ugcuuuauuuagaauuu

SEQ ID NO: 2693807 - RNA, 22 nt, Haemophilus influenzae Rd
ugcuuucuagaugaugaaauuu

SEQ ID NO: 2693808 - RNA, 17 nt, Haemophilus influenzae Rd
ugcuuucuuauauauaa

SEQ ID NO: 2693809 - RNA, 23 nt, Haemophilus influenzae Rd
ugcuuuuaaguugugauuugcaa

SEQ ID NO: 2693810 - RNA, 18 nt, Haemophilus influenzae Rd
ugcuuuugccgaaaaugg

SEQ ID NO: 2693811 - RNA, 19 nt, Haemophilus influenzae Rd
ugcuuuugccgaaaauggu

SEQ ID NO: 2693812 - RNA, 13 nt, Haemophilus influenzae Rd
ugcuuuugcuuca

SEQ ID NO: 2693813 - RNA, 12 nt, Haemophilus influenzae Rd
ugcuuuuguagc

SEQ ID NO: 2693814 - RNA, 12 nt, Haemophilus influenzae Rd
ugcuuuuuaauu

SEQ ID NO: 2693815 - RNA, 13 nt, Haemophilus influenzae Rd
ugcuuuuugcuau

SEQ ID NO: 2693816 - RNA, 18 nt, Haemophilus influenzae Rd
ugcuuuuugcuauuaauu

SEQ ID NO: 2693817 - RNA, 13 nt, Haemophilus influenzae Rd
ugcuuuuuuaauu

SEQ ID NO: 2693818 - RNA, 21 nt, Haemophilus influenzae Rd
uggaaaagccuuaaccugcaa

SEQ ID NO: 2693819 - RNA, 13 nt, Haemophilus influenzae Rd
uggaaaaguaaga

SEQ ID NO: 2693820 - RNA, 14 nt, Haemophilus influenzae Rd
uggaaaaguaagaa

SEQ ID NO: 2693821 - RNA, 16 nt, Haemophilus influenzae Rd
uggaaaaguaagaaac

SEQ ID NO: 2693822 - RNA, 22 nt, Haemophilus influenzae Rd
uggaaacgguuaauaaauucuu

SEQ ID NO: 2693823 - RNA, 22 nt, Haemophilus influenzae Rd
uggaaacgugcaauuaauucuu

SEQ ID NO: 2693824 - RNA, 19 nt, Haemophilus influenzae Rd
uggaaagaguaagcaagua

SEQ ID NO: 2693825 - RNA, 21 nt, Haemophilus influenzae Rd
uggaaaguaacgcgcggacgu

SEQ ID NO: 2693826 - RNA, 14 nt, Haemophilus influenzae Rd
uggaaauaauauuc

SEQ ID NO: 2693827 - RNA, 21 nt, Haemophilus influenzae Rd
uggaaauguuuaauuauagaa

SEQ ID NO: 2693828 - RNA, 18 nt, Haemophilus influenzae Rd
uggaaauugccaaaaaag

SEQ ID NO: 2693829 - RNA, 21 nt, Haemophilus influenzae Rd
uggaaauuugagauuuuauuu

SEQ ID NO: 2693830 - RNA, 14 nt, Haemophilus influenzae Rd
uggaacaguugaaa

SEQ ID NO: 2693831 - RNA, 13 nt, Haemophilus influenzae Rd
uggaagaaaagca

SEQ ID NO: 2693832 - RNA, 15 nt, Haemophilus influenzae Rd
uggaagguaauuuaa

SEQ ID NO: 2693833 - RNA, 14 nt, Haemophilus influenzae Rd
uggaaguuuuuccg

SEQ ID NO: 2693834 - RNA, 17 nt, Haemophilus influenzae Rd
uggaauaaauuaauuac

SEQ ID NO: 2693835 - RNA, 15 nt, Haemophilus influenzae Rd
uggaauaccagagga

SEQ ID NO: 2693836 - RNA, 16 nt, Haemophilus influenzae Rd
uggaauauacaguuca

SEQ ID NO: 2693837 - RNA, 13 nt, Haemophilus influenzae Rd
uggaauauucuuu

SEQ ID NO: 2693838 - RNA, 22 nt, Haemophilus influenzae Rd
uggaauauucuuuuuaaauauu

SEQ ID NO: 2693839 - RNA, 17 nt, Haemophilus influenzae Rd
uggaaucaaugaguggu

SEQ ID NO: 2693840 - RNA, 16 nt, Haemophilus influenzae Rd
uggaaugcaucacugc

SEQ ID NO: 2693841 - RNA, 22 nt, Haemophilus influenzae Rd
uggaauggaggauuagaaauga

SEQ ID NO: 2693842 - RNA, 15 nt, Haemophilus influenzae Rd
uggaauggauaaacg

SEQ ID NO: 2693843 - RNA, 22 nt, Haemophilus influenzae Rd
uggaaugguugcaaaggcagga

SEQ ID NO: 2693844 - RNA, 18 nt, Haemophilus influenzae Rd
uggaauugugcuaaauuu

SEQ ID NO: 2693845 - RNA, 20 nt, Haemophilus influenzae Rd
uggaauugugcuaaauuuuu

SEQ ID NO: 2693846 - RNA, 21 nt, Haemophilus influenzae Rd
uggaauuuguaagauuuugcc

SEQ ID NO: 2693847 - RNA, 20 nt, Haemophilus influenzae Rd
uggaauuuucacauuaguga

SEQ ID NO: 2693848 - RNA, 17 nt, Haemophilus influenzae Rd
ugggauuaaccgcacuu

SEQ ID NO: 2693849 - RNA, 22 nt, Haemophilus influenzae Rd
ugggauuucaaacaauaugugc

SEQ ID NO: 2693850 - RNA, 15 nt, Haemophilus influenzae Rd
ugggauuugccauca

SEQ ID NO: 2693851 - RNA, 17 nt, Haemophilus influenzae Rd
ugggauuuucacuaauu

SEQ ID NO: 2693852 - RNA, 15 nt, Haemophilus influenzae Rd
ugggcaaucaaauuc

SEQ ID NO: 2693853 - RNA, 21 nt, Haemophilus influenzae Rd
ugggcacgauaguggaauaau

SEQ ID NO: 2693854 - RNA, 17 nt, Haemophilus influenzae Rd
ugggccucuuuaucuau

SEQ ID NO: 2693855 - RNA, 23 nt, Haemophilus influenzae Rd
ugggcgaguggcuuguaaugcaa

SEQ ID NO: 2693856 - RNA, 17 nt, Haemophilus influenzae Rd
ugggcgauaaaaauuaa

SEQ ID NO: 2693857 - RNA, 23 nt, Haemophilus influenzae Rd
ugggcgauaaaaauuaaggaaag

SEQ ID NO: 2693858 - RNA, 22 nt, Haemophilus influenzae Rd
ugggcguaauguuggaucccaa

SEQ ID NO: 2693859 - RNA, 23 nt, Haemophilus influenzae Rd
ugggcuguucggacuuacaucug

SEQ ID NO: 2693860 - RNA, 15 nt, Haemophilus influenzae Rd
uggggaaguaauauu

SEQ ID NO: 2693861 - RNA, 17 nt, Haemophilus influenzae Rd
uggggaauaaaauaaga

SEQ ID NO: 2693862 - RNA, 22 nt, Haemophilus influenzae Rd
uggggacgcaccuuuugaaaaa

SEQ ID NO: 2693863 - RNA, 19 nt, Haemophilus influenzae Rd
uggggcuaauuuuuaaaau

SEQ ID NO: 2693864 - RNA, 18 nt, Haemophilus influenzae Rd
uggggcuuuuuuuuauuc

SEQ ID NO: 2693865 - RNA, 14 nt, Haemophilus influenzae Rd
ugggguuaaaaagc

SEQ ID NO: 2693866 - RNA, 13 nt, Haemophilus influenzae Rd
uggguaaaauaau

SEQ ID NO: 2693867 - RNA, 18 nt, Haemophilus influenzae Rd
uggguaaaccaaacgaga

SEQ ID NO: 2693868 - RNA, 18 nt, Haemophilus influenzae Rd
uggguaaucaaauucaau

SEQ ID NO: 2693869 - RNA, 20 nt, Haemophilus influenzae Rd
uggguauugauucaauucuu

SEQ ID NO: 2693870 - RNA, 14 nt, Haemophilus influenzae Rd
ugggugugaaauau

SEQ ID NO: 2693871 - RNA, 23 nt, Haemophilus influenzae Rd
uggguucacagagaauaaaucac

SEQ ID NO: 2693872 - RNA, 18 nt, Haemophilus influenzae Rd
uggguucaucuaauaaua

SEQ ID NO: 2693873 - RNA, 23 nt, Haemophilus influenzae Rd
uggguucaucuaauaauaagauu

SEQ ID NO: 2693874 - RNA, 14 nt, Haemophilus influenzae Rd
uggguuuaaaaagu

SEQ ID NO: 2693875 - RNA, 21 nt, Haemophilus influenzae Rd
uggguuuauugguaacaacug

SEQ ID NO: 2693876 - RNA, 15 nt, Haemophilus influenzae Rd
uggguuuuuuuauuu

SEQ ID NO: 2693877 - RNA, 17 nt, Haemophilus influenzae Rd
ugguaaaauuucuucua

SEQ ID NO: 2693878 - RNA, 20 nt, Haemophilus influenzae Rd
ugguaaacgaacuucacuuu

SEQ ID NO: 2693879 - RNA, 22 nt, Haemophilus influenzae Rd
ugguaaauauuguauuuaagua

SEQ ID NO: 2693880 - RNA, 20 nt, Haemophilus influenzae Rd
ugguaaaucuaacaaucgac

SEQ ID NO: 2693881 - RNA, 13 nt, Haemophilus influenzae Rd
ugguaacaacugc

SEQ ID NO: 2693882 - RNA, 14 nt, Haemophilus influenzae Rd
ugguaacaacugcu

SEQ ID NO: 2693883 - RNA, 23 nt, Haemophilus influenzae Rd
ugguaauaaaccguuagguuuaa

SEQ ID NO: 2693884 - RNA, 15 nt, Haemophilus influenzae Rd
ugguaauaaaucaaa

SEQ ID NO: 2693885 - RNA, 19 nt, Haemophilus influenzae Rd
ugguaaugcacguucuaau

SEQ ID NO: 2693886 - RNA, 17 nt, Haemophilus influenzae Rd
ugguaauuaacgugcau

SEQ ID NO: 2693887 - RNA, 16 nt, Haemophilus influenzae Rd
ugguaauuugcucaaa

SEQ ID NO: 2693888 - RNA, 14 nt, Haemophilus influenzae Rd
ugguacaaauuuag

SEQ ID NO: 2693889 - RNA, 17 nt, Haemophilus influenzae Rd
ugguaccgguugugcag

SEQ ID NO: 2693890 - RNA, 14 nt, Haemophilus influenzae Rd
ugguacgagaaaaa

SEQ ID NO: 2693891 - RNA, 23 nt, Haemophilus influenzae Rd
ugguacgccagucacuucuucaa

SEQ ID NO: 2693892 - RNA, 14 nt, Haemophilus influenzae Rd
ugguagaaaauuug

SEQ ID NO: 2693893 - RNA, 15 nt, Haemophilus influenzae Rd
ugguagcuaaaaaua

SEQ ID NO: 2693894 - RNA, 14 nt, Haemophilus influenzae Rd
ugguagguauuauc

SEQ ID NO: 2693895 - RNA, 14 nt, Haemophilus influenzae Rd
ugguauucuuucca

SEQ ID NO: 2693896 - RNA, 19 nt, Haemophilus influenzae Rd
uggucauugcugccuaacc

SEQ ID NO: 2693897 - RNA, 22 nt, Haemophilus influenzae Rd
uggucgcaguguugcagggaaa

SEQ ID NO: 2693898 - RNA, 18 nt, Haemophilus influenzae Rd
uggucuaacauuucauaa

SEQ ID NO: 2693899 - RNA, 16 nt, Haemophilus influenzae Rd
uggucugcauuacugc

SEQ ID NO: 2693900 - RNA, 18 nt, Haemophilus influenzae Rd
uggugaaaggugguuuuu

SEQ ID NO: 2693901 - RNA, 18 nt, Haemophilus influenzae Rd
uggugaaaucaacaaucc

SEQ ID NO: 2693902 - RNA, 13 nt, Haemophilus influenzae Rd
uggugcaauuuga

SEQ ID NO: 2693903 - RNA, 22 nt, Haemophilus influenzae Rd
uggugccaauccauuuuuaaau

SEQ ID NO: 2693904 - RNA, 22 nt, Haemophilus influenzae Rd
uggugccguuugugcuaaauua

SEQ ID NO: 2693905 - RNA, 14 nt, Haemophilus influenzae Rd
ugguggauuauaaa

SEQ ID NO: 2693906 - RNA, 14 nt, Haemophilus influenzae Rd
ugguguauuuauaa

SEQ ID NO: 2693907 - RNA, 13 nt, Haemophilus influenzae Rd
ugguguuauugga

SEQ ID NO: 2693908 - RNA, 17 nt, Haemophilus influenzae Rd
ugguguuauuggaaaau

SEQ ID NO: 2693909 - RNA, 16 nt, Haemophilus influenzae Rd
ugguuaaaaauagccu

SEQ ID NO: 2693910 - RNA, 22 nt, Haemophilus influenzae Rd
ugguuaauccuaguuuuuuccc

SEQ ID NO: 2693911 - RNA, 21 nt, Haemophilus influenzae Rd
ugguuacagaaauauuauuaa

SEQ ID NO: 2693912 - RNA, 16 nt, Haemophilus influenzae Rd
ugguuauuugauuauc

SEQ ID NO: 2693913 - RNA, 15 nt, Haemophilus influenzae Rd
ugguucaaaaccaaa

SEQ ID NO: 2693914 - RNA, 13 nt, Haemophilus influenzae Rd
ugguucaaaaugg

SEQ ID NO: 2693915 - RNA, 18 nt, Haemophilus influenzae Rd
ugguucauuauuaauuga

SEQ ID NO: 2693916 - RNA, 21 nt, Haemophilus influenzae Rd
ugguucgagaaacuuucaaaa

SEQ ID NO: 2693917 - RNA, 19 nt, Haemophilus influenzae Rd
ugguucuaaauauuuuuca

SEQ ID NO: 2693918 - RNA, 16 nt, Haemophilus influenzae Rd
ugguugcgaauugcau

SEQ ID NO: 2693919 - RNA, 13 nt, Haemophilus influenzae Rd
ugguuguaauaau

SEQ ID NO: 2693920 - RNA, 14 nt, Haemophilus influenzae Rd
ugguuguaauaaug

SEQ ID NO: 2693921 - RNA, 17 nt, Haemophilus influenzae Rd
ugguuugcuuaaaagcu

SEQ ID NO: 2693922 - RNA, 15 nt, Haemophilus influenzae Rd
ugguuuguuaaauga

SEQ ID NO: 2693923 - RNA, 20 nt, Haemophilus influenzae Rd
ugguuuugugaguaaaauac

SEQ ID NO: 2693924 - RNA, 21 nt, Haemophilus influenzae Rd
ugguuuugugaguucaagcaa

SEQ ID NO: 2693925 - RNA, 16 nt, Haemophilus influenzae Rd
uguaaaaaaccuugug

SEQ ID NO: 2693926 - RNA, 13 nt, Haemophilus influenzae Rd
uguaaaaaauaau

SEQ ID NO: 2693927 - RNA, 22 nt, Haemophilus influenzae Rd
uguaaaaagggaugguuaauuu

SEQ ID NO: 2693928 - RNA, 15 nt, Haemophilus influenzae Rd
uguaaaaauuggaaa

SEQ ID NO: 2693929 - RNA, 16 nt, Haemophilus influenzae Rd
uguaaaaauuggaaaa

SEQ ID NO: 2693930 - RNA, 19 nt, Haemophilus influenzae Rd
uguaaaaauuggaaaauaa

SEQ ID NO: 2693931 - RNA, 21 nt, Haemophilus influenzae Rd
uguaaaaauuggaaaauaaaa

SEQ ID NO: 2693932 - RNA, 12 nt, Haemophilus influenzae Rd
uguaaaacauug

SEQ ID NO: 2693933 - RNA, 12 nt, Haemophilus influenzae Rd
uguaaaauagug

SEQ ID NO: 2693934 - RNA, 13 nt, Haemophilus influenzae Rd
uguaaaauaguga

SEQ ID NO: 2693935 - RNA, 22 nt, Haemophilus influenzae Rd
uguaaaauucguacuuuugauu

SEQ ID NO: 2693936 - RNA, 13 nt, Haemophilus influenzae Rd
uguaaacaaaaau

SEQ ID NO: 2693937 - RNA, 21 nt, Haemophilus influenzae Rd
uguaaacaaaaauacagccac

SEQ ID NO: 2693938 - RNA, 18 nt, Haemophilus influenzae Rd
uguaaacgaccuugcaaa

SEQ ID NO: 2693939 - RNA, 22 nt, Haemophilus influenzae Rd
uguaaacgauuucgugcaauaa

SEQ ID NO: 2693940 - RNA, 15 nt, Haemophilus influenzae Rd
uguaaacgccaucaa

SEQ ID NO: 2693941 - RNA, 14 nt, Haemophilus influenzae Rd
uguaaacuaaaucu

SEQ ID NO: 2693942 - RNA, 17 nt, Haemophilus influenzae Rd
uguaaacugcuuucaaa

SEQ ID NO: 2693943 - RNA, 16 nt, Haemophilus influenzae Rd
uguaaacuuuccucaa

SEQ ID NO: 2693944 - RNA, 17 nt, Haemophilus influenzae Rd
uguaaagauuguccuuu

SEQ ID NO: 2693945 - RNA, 15 nt, Haemophilus influenzae Rd
uguaaaucuaaaaua

SEQ ID NO: 2693946 - RNA, 23 nt, Haemophilus influenzae Rd
uguaaaucuuuacccauugucau

SEQ ID NO: 2693947 - RNA, 17 nt, Haemophilus influenzae Rd
uguaaauuauuuuaaua

SEQ ID NO: 2693948 - RNA, 15 nt, Haemophilus influenzae Rd
uguaaauugguuuua

SEQ ID NO: 2693949 - RNA, 17 nt, Haemophilus influenzae Rd
uguaacacaaaaucuug

SEQ ID NO: 2693950 - RNA, 15 nt, Haemophilus influenzae Rd
uguaacgagcaacuu

SEQ ID NO: 2693951 - RNA, 16 nt, Haemophilus influenzae Rd
uguaacgcuuaaccau

SEQ ID NO: 2693952 - RNA, 17 nt, Haemophilus influenzae Rd
uguaacgcuuaaccauc

SEQ ID NO: 2693953 - RNA, 14 nt, Haemophilus influenzae Rd
ugucgcuuuuuccu

SEQ ID NO: 2693954 - RNA, 23 nt, Haemophilus influenzae Rd
ugucgcuuuuuccucagcaaaag

SEQ ID NO: 2693955 - RNA, 12 nt, Haemophilus influenzae Rd
ugucguucuuuu

SEQ ID NO: 2693956 - RNA, 13 nt, Haemophilus influenzae Rd
ugucguucuuuuu

SEQ ID NO: 2693957 - RNA, 14 nt, Haemophilus influenzae Rd
ugucguucuuuuuc

SEQ ID NO: 2693958 - RNA, 15 nt, Haemophilus influenzae Rd
ugucguucuuuuucc

SEQ ID NO: 2693959 - RNA, 16 nt, Haemophilus influenzae Rd
ugucuaagguuuccau

SEQ ID NO: 2693960 - RNA, 14 nt, Haemophilus influenzae Rd
ugucuaauuuuuua

SEQ ID NO: 2693961 - RNA, 16 nt, Haemophilus influenzae Rd
ugucuauuuauuuuca

SEQ ID NO: 2693962 - RNA, 17 nt, Haemophilus influenzae Rd
ugucuauuuuauuugcc

SEQ ID NO: 2693963 - RNA, 11 nt, Haemophilus influenzae Rd
ugucugaaauu

SEQ ID NO: 2693964 - RNA, 16 nt, Haemophilus influenzae Rd
ugucugaaauuuugau

SEQ ID NO: 2693965 - RNA, 21 nt, Haemophilus influenzae Rd
ugucugaaauuuuuaucuaaa

SEQ ID NO: 2693966 - RNA, 21 nt, Haemophilus influenzae Rd
ugucuggcugaguaaauaauu

SEQ ID NO: 2693967 - RNA, 17 nt, Haemophilus influenzae Rd
ugucuucuguuuggaua

SEQ ID NO: 2693968 - RNA, 16 nt, Haemophilus influenzae Rd
ugucuuuucuauaauu

SEQ ID NO: 2693969 - RNA, 18 nt, Haemophilus influenzae Rd
ugugaaaacgaugaaguu

SEQ ID NO: 2693970 - RNA, 22 nt, Haemophilus influenzae Rd
ugugaaguuuaugaucuacacc

SEQ ID NO: 2693971 - RNA, 19 nt, Haemophilus influenzae Rd
ugugaauauccaaacuuuc

SEQ ID NO: 2693972 - RNA, 17 nt, Haemophilus influenzae Rd
ugugacauuggauuaau

SEQ ID NO: 2693973 - RNA, 21 nt, Haemophilus influenzae Rd
ugugacuacaaacaaauuuuu

SEQ ID NO: 2693974 - RNA, 16 nt, Haemophilus influenzae Rd
ugugaguguaaugcgu

SEQ ID NO: 2693975 - RNA, 22 nt, Haemophilus influenzae Rd
ugugaucaugguuguaauaaug

SEQ ID NO: 2693976 - RNA, 16 nt, Haemophilus influenzae Rd
ugugaugggaaacuga

SEQ ID NO: 2693977 - RNA, 16 nt, Haemophilus influenzae Rd
ugugauuuuagaaaaa

SEQ ID NO: 2693978 - RNA, 23 nt, Haemophilus influenzae Rd
ugugcaaaguuaccauuuauucc

SEQ ID NO: 2693979 - RNA, 20 nt, Haemophilus influenzae Rd
ugugcaagaaauugauauaa

SEQ ID NO: 2693980 - RNA, 20 nt, Haemophilus influenzae Rd
ugugcaauaacguuacuaaa

SEQ ID NO: 2693981 - RNA, 18 nt, Haemophilus influenzae Rd
ugugcaccuucaacauuu

SEQ ID NO: 2693982 - RNA, 22 nt, Haemophilus influenzae Rd
ugugcaccuucaacauuuuuug

SEQ ID NO: 2693983 - RNA, 21 nt, Haemophilus influenzae Rd
ugugcaucagaaaguucuaau

SEQ ID NO: 2693984 - RNA, 16 nt, Haemophilus influenzae Rd
ugugcauugaauuuuu

SEQ ID NO: 2693985 - RNA, 17 nt, Haemophilus influenzae Rd
ugugccaacuucuacac

SEQ ID NO: 2693986 - RNA, 19 nt, Haemophilus influenzae Rd
ugugccaauccauaaaaua

SEQ ID NO: 2693987 - RNA, 16 nt, Haemophilus influenzae Rd
ugugccauguacauua

SEQ ID NO: 2693988 - RNA, 18 nt, Haemophilus influenzae Rd
ugugccauguacauuaau

SEQ ID NO: 2693989 - RNA, 16 nt, Haemophilus influenzae Rd
ugugccauuucuaaac

SEQ ID NO: 2693990 - RNA, 14 nt, Haemophilus influenzae Rd
ugugcgaccugaag

SEQ ID NO: 2693991 - RNA, 18 nt, Haemophilus influenzae Rd
ugugcgauggcccaaaac

SEQ ID NO: 2693992 - RNA, 18 nt, Haemophilus influenzae Rd
ugugcgauuaacaauaau

SEQ ID NO: 2693993 - RNA, 20 nt, Haemophilus influenzae Rd
ugugcgauucaucacuucuu

SEQ ID NO: 2693994 - RNA, 16 nt, Haemophilus influenzae Rd
ugugcuaaauuuuuuu

SEQ ID NO: 2693995 - RNA, 21 nt, Haemophilus influenzae Rd
ugugcucccccccaauaaaaa

SEQ ID NO: 2693996 - RNA, 21 nt, Haemophilus influenzae Rd
uguggaaaaauguaauucugg

SEQ ID NO: 2693997 - RNA, 21 nt, Haemophilus influenzae Rd
uguggaguuauuucuuuaaau

SEQ ID NO: 2693998 - RNA, 16 nt, Haemophilus influenzae Rd
uguggcggguuucuuu

SEQ ID NO: 2693999 - RNA, 21 nt, Haemophilus influenzae Rd
uguggcuuuugucgcuaacug

SEQ ID NO: 2694000 - RNA, 19 nt, Haemophilus influenzae Rd
ugugggauaaauucauuuu

SEQ ID NO: 2694001 - RNA, 17 nt, Haemophilus influenzae Rd
uguggguuuauugguaa

SEQ ID NO: 2694002 - RNA, 23 nt, Haemophilus influenzae Rd
uguguaaguguagcaauaaacag

SEQ ID NO: 2694003 - RNA, 16 nt, Haemophilus influenzae Rd
uguguaccgucuaaac

SEQ ID NO: 2694004 - RNA, 13 nt, Haemophilus influenzae Rd
ugugugcguuuuc

SEQ ID NO: 2694005 - RNA, 13 nt, Haemophilus influenzae Rd
uguguggaaaaau

SEQ ID NO: 2694006 - RNA, 22 nt, Haemophilus influenzae Rd
uguguuagaaagccuuuuaaaa

SEQ ID NO: 2694007 - RNA, 15 nt, Haemophilus influenzae Rd
uguguugauuucuac

SEQ ID NO: 2694008 - RNA, 21 nt, Haemophilus influenzae Rd
uguguugauuucuacacuuaa

SEQ ID NO: 2694009 - RNA, 18 nt, Haemophilus influenzae Rd
uguguuggaacguuuaaa

SEQ ID NO: 2694010 - RNA, 14 nt, Haemophilus influenzae Rd
uguguuuauuuaac

SEQ ID NO: 2694011 - RNA, 15 nt, Haemophilus influenzae Rd
uguguuuauuuaaca

SEQ ID NO: 2694012 - RNA, 13 nt, Haemophilus influenzae Rd
uguguuuuggaua

SEQ ID NO: 2694013 - RNA, 14 nt, Haemophilus influenzae Rd
uguuaaauaaaucc

SEQ ID NO: 2694014 - RNA, 15 nt, Haemophilus influenzae Rd
uguuaaaucuacauu

SEQ ID NO: 2694015 - RNA, 16 nt, Haemophilus influenzae Rd
uguuaaauugcaaaaa

SEQ ID NO: 2694016 - RNA, 12 nt, Haemophilus influenzae Rd
uguuaagcacca

SEQ ID NO: 2694017 - RNA, 14 nt, Haemophilus influenzae Rd
uguuaagcaccauc

SEQ ID NO: 2694018 - RNA, 15 nt, Haemophilus influenzae Rd
uguuaagcaccauca

SEQ ID NO: 2694019 - RNA, 21 nt, Haemophilus influenzae Rd
uguuaaguaugccauaaaaua

SEQ ID NO: 2694020 - RNA, 15 nt, Haemophilus influenzae Rd
uguuaaguucaucau

SEQ ID NO: 2694021 - RNA, 21 nt, Haemophilus influenzae Rd
uguuaauaaaccuuuuucuaa

SEQ ID NO: 2694022 - RNA, 14 nt, Haemophilus influenzae Rd
uguuaauaaacgcc

SEQ ID NO: 2694023 - RNA, 14 nt, Haemophilus influenzae Rd
uguuacaaauuccu

SEQ ID NO: 2694024 - RNA, 21 nt, Haemophilus influenzae Rd
uguuacaacgccucaaucgcu

SEQ ID NO: 2694025 - RNA, 15 nt, Haemophilus influenzae Rd
uguuacaucgaauug

SEQ ID NO: 2694026 - RNA, 14 nt, Haemophilus influenzae Rd
uguuacuuuccauu

SEQ ID NO: 2694027 - RNA, 21 nt, Haemophilus influenzae Rd
uguuagaaagccuuuuaaaau

SEQ ID NO: 2694028 - RNA, 20 nt, Haemophilus influenzae Rd
uguuagaucaaauuugaucu

SEQ ID NO: 2694029 - RNA, 18 nt, Haemophilus influenzae Rd
uguuauauaaacaauucc

SEQ ID NO: 2694030 - RNA, 13 nt, Haemophilus influenzae Rd
uguuaugcuuauc

SEQ ID NO: 2694031 - RNA, 17 nt, Haemophilus influenzae Rd
uguuauuaaauaaaccg

SEQ ID NO: 2694032 - RNA, 13 nt, Haemophilus influenzae Rd
uguuauugaugaa

SEQ ID NO: 2694033 - RNA, 17 nt, Haemophilus influenzae Rd
uguuauugaugaagaug

SEQ ID NO: 2694034 - RNA, 20 nt, Haemophilus influenzae Rd
uguuauugaugaagaugaag

SEQ ID NO: 2694035 - RNA, 22 nt, Haemophilus influenzae Rd
uguuauugugaugggaaacuga

SEQ ID NO: 2694036 - RNA, 19 nt, Haemophilus influenzae Rd
uguucaacaaguaaaucaa

SEQ ID NO: 2694037 - RNA, 21 nt, Haemophilus influenzae Rd
uguucaacuuccgcuaauacu

SEQ ID NO: 2694038 - RNA, 14 nt, Haemophilus influenzae Rd
uguucaagauguga

SEQ ID NO: 2694039 - RNA, 13 nt, Haemophilus influenzae Rd
uguucaauaauau

SEQ ID NO: 2694040 - RNA, 15 nt, Haemophilus influenzae Rd
uguucacaucaaaau

SEQ ID NO: 2694041 - RNA, 17 nt, Haemophilus influenzae Rd
uguucacuaaagagaaa

SEQ ID NO: 2694042 - RNA, 20 nt, Haemophilus influenzae Rd
uguucacuaaagagaaacau

SEQ ID NO: 2694043 - RNA, 18 nt, Haemophilus influenzae Rd
uguucagccaauuuuuca

SEQ ID NO: 2694044 - RNA, 21 nt, Haemophilus influenzae Rd
uguucauccuuauccugccuu

SEQ ID NO: 2694045 - RNA, 19 nt, Haemophilus influenzae Rd
uguuccaggaaaauuuuau

SEQ ID NO: 2694046 - RNA, 17 nt, Haemophilus influenzae Rd
uguucccacaaagacua

SEQ ID NO: 2694047 - RNA, 15 nt, Haemophilus influenzae Rd
uguuccgcaguuaaa

SEQ ID NO: 2694048 - RNA, 20 nt, Haemophilus influenzae Rd
uguucgaguuggcucauugu

SEQ ID NO: 2694049 - RNA, 23 nt, Haemophilus influenzae Rd
uguucgaguuggcucauugugau

SEQ ID NO: 2694050 - RNA, 20 nt, Haemophilus influenzae Rd
uguucgcugguuaaauuaac

SEQ ID NO: 2694051 - RNA, 22 nt, Haemophilus influenzae Rd
uguucgguaagcgaggauaaug

SEQ ID NO: 2694052 - RNA, 13 nt, Haemophilus influenzae Rd
uguucgguuuuuu

SEQ ID NO: 2694053 - RNA, 18 nt, Haemophilus influenzae Rd
uguucuacguaauuuaau

SEQ ID NO: 2694054 - RNA, 22 nt, Haemophilus influenzae Rd
uguucuacugguuuuuguaagg

SEQ ID NO: 2694055 - RNA, 14 nt, Haemophilus influenzae Rd
uguucuacuuuuuu

SEQ ID NO: 2694056 - RNA, 13 nt, Haemophilus influenzae Rd
uguucuagugcaa

SEQ ID NO: 2694057 - RNA, 20 nt, Haemophilus influenzae Rd
uguucuagugcaacaacaaa

SEQ ID NO: 2694058 - RNA, 22 nt, Haemophilus influenzae Rd
uuaaaaaaucaccgcacuuugu

SEQ ID NO: 2694059 - RNA, 22 nt, Haemophilus influenzae Rd
uuaaaaacacuaugauuuuuaa

SEQ ID NO: 2694060 - RNA, 15 nt, Haemophilus influenzae Rd
uuaaaaacggaauca

SEQ ID NO: 2694061 - RNA, 19 nt, Haemophilus influenzae Rd
uuaaaaauauacagcacua

SEQ ID NO: 2694062 - RNA, 16 nt, Haemophilus influenzae Rd
uuaaaaauuuaaaagc

SEQ ID NO: 2694063 - RNA, 14 nt, Haemophilus influenzae Rd
uuaaaacaaaagaa

SEQ ID NO: 2694064 - RNA, 18 nt, Haemophilus influenzae Rd
uuaaaacaaaagaaauuu

SEQ ID NO: 2694065 - RNA, 16 nt, Haemophilus influenzae Rd
uuaaaacacgaaaaaa

SEQ ID NO: 2694066 - RNA, 18 nt, Haemophilus influenzae Rd
uuaaaacaugaauaucau

SEQ ID NO: 2694067 - RNA, 22 nt, Haemophilus influenzae Rd
uuaaaacaugaauaucaucaga

SEQ ID NO: 2694068 - RNA, 15 nt, Haemophilus influenzae Rd
uuaaaaccaaaagau

SEQ ID NO: 2694069 - RNA, 19 nt, Haemophilus influenzae Rd
uuaaaacgccauucacauu

SEQ ID NO: 2694070 - RNA, 16 nt, Haemophilus influenzae Rd
uuaaaacuauuuuuaa

SEQ ID NO: 2694071 - RNA, 18 nt, Haemophilus influenzae Rd
uuaaaacuauuuuuaauu

SEQ ID NO: 2694072 - RNA, 21 nt, Haemophilus influenzae Rd
uuaaaacuauuuuuaauuuug

SEQ ID NO: 2694073 - RNA, 20 nt, Haemophilus influenzae Rd
uuaaaacuugacguuguucu

SEQ ID NO: 2694074 - RNA, 13 nt, Haemophilus influenzae Rd
uuaaaagaaauuc

SEQ ID NO: 2694075 - RNA, 16 nt, Haemophilus influenzae Rd
uuaaaagaaccuaucu

SEQ ID NO: 2694076 - RNA, 14 nt, Haemophilus influenzae Rd
uuaaaagccaauau

SEQ ID NO: 2694077 - RNA, 18 nt, Haemophilus influenzae Rd
uuaaaagccaauauggaa

SEQ ID NO: 2694078 - RNA, 23 nt, Haemophilus influenzae Rd
uuaaaaggcuuucuaacacagaa

SEQ ID NO: 2694079 - RNA, 16 nt, Haemophilus influenzae Rd
uuaaaaguaaaaauaa

SEQ ID NO: 2694080 - RNA, 12 nt, Haemophilus influenzae Rd
uuaaaaguaaac

SEQ ID NO: 2694081 - RNA, 18 nt, Haemophilus influenzae Rd
uuaaaaguccgcugcucu

SEQ ID NO: 2694082 - RNA, 12 nt, Haemophilus influenzae Rd
uuaaaagugcgg

SEQ ID NO: 2694083 - RNA, 19 nt, Haemophilus influenzae Rd
uuaaaagugcggugcaauu

SEQ ID NO: 2694084 - RNA, 18 nt, Haemophilus influenzae Rd
uuaaaaguguauaaauau

SEQ ID NO: 2694085 - RNA, 22 nt, Haemophilus influenzae Rd
uuaaaaguuuaguccuuaauuu

SEQ ID NO: 2694086 - RNA, 21 nt, Haemophilus influenzae Rd
uuaaaauaaaagaauuuuuaa

SEQ ID NO: 2694087 - RNA, 12 nt, Haemophilus influenzae Rd
uuaaaauaccca

SEQ ID NO: 2694088 - RNA, 15 nt, Haemophilus influenzae Rd
uuaaaauacccauaa

SEQ ID NO: 2694089 - RNA, 13 nt, Haemophilus influenzae Rd
uuaaaauaguuuu

SEQ ID NO: 2694090 - RNA, 15 nt, Haemophilus influenzae Rd
uuaaaaucucucaaa

SEQ ID NO: 2694091 - RNA, 18 nt, Haemophilus influenzae Rd
uuaaaaugaacaaaaaau

SEQ ID NO: 2694092 - RNA, 23 nt, Haemophilus influenzae Rd
uuaaaauuaguaacagguaaaau

SEQ ID NO: 2694093 - RNA, 13 nt, Haemophilus influenzae Rd
uuaaaauucaaag

SEQ ID NO: 2694094 - RNA, 11 nt, Haemophilus influenzae Rd
uuaaaauuuaa

SEQ ID NO: 2694095 - RNA, 14 nt, Haemophilus influenzae Rd
uuaaacaauucacu

SEQ ID NO: 2694096 - RNA, 18 nt, Haemophilus influenzae Rd
uuaaacaauucacugcaa

SEQ ID NO: 2694097 - RNA, 23 nt, Haemophilus influenzae Rd
uuaaacaccaaauauucuucuaa

SEQ ID NO: 2694098 - RNA, 18 nt, Haemophilus influenzae Rd
uuaaacagcaaaagugcu

SEQ ID NO: 2694099 - RNA, 15 nt, Haemophilus influenzae Rd
uuaaaccaaauaaug

SEQ ID NO: 2694100 - RNA, 14 nt, Haemophilus influenzae Rd
uuaaaccaaauuga

SEQ ID NO: 2694101 - RNA, 18 nt, Haemophilus influenzae Rd
uuaaaccgucauuuauaa

SEQ ID NO: 2694102 - RNA, 20 nt, Haemophilus influenzae Rd
uuaaacgcauauuuuguucu

SEQ ID NO: 2694103 - RNA, 17 nt, Haemophilus influenzae Rd
uuaaacggucauuuaca

SEQ ID NO: 2694104 - RNA, 19 nt, Haemophilus influenzae Rd
uuaaacggucauuuacaaa

SEQ ID NO: 2694105 - RNA, 21 nt, Haemophilus influenzae Rd
uuaaacggucauuuacaaaca

SEQ ID NO: 2694106 - RNA, 14 nt, Haemophilus influenzae Rd
uuaaacguugaauc

SEQ ID NO: 2694107 - RNA, 17 nt, Haemophilus influenzae Rd
uuaaacguuuauuuauu

SEQ ID NO: 2694108 - RNA, 19 nt, Haemophilus influenzae Rd
uuaaacuauugaaaauuaa

SEQ ID NO: 2694109 - RNA, 20 nt, Haemophilus influenzae Rd
uuaaacugccgccuucuucc

SEQ ID NO: 2694110 - RNA, 18 nt, Haemophilus influenzae Rd
uuaaacuggguuuuauuu

SEQ ID NO: 2694111 - RNA, 23 nt, Haemophilus influenzae Rd
uuaaagaaaauacauaauuaaau

SEQ ID NO: 2694112 - RNA, 15 nt, Haemophilus influenzae Rd
uuaaagaaaauauuu

SEQ ID NO: 2694113 - RNA, 16 nt, Haemophilus influenzae Rd
uuaaagaaaauauuua

SEQ ID NO: 2694114 - RNA, 13 nt, Haemophilus influenzae Rd
uuaaagaaauuuc

SEQ ID NO: 2694115 - RNA, 20 nt, Haemophilus influenzae Rd
uuaaagagcaaauuuaaaua

SEQ ID NO: 2694116 - RNA, 23 nt, Haemophilus influenzae Rd
uuaaagagcaaauuuaaauaaua

SEQ ID NO: 2694117 - RNA, 18 nt, Haemophilus influenzae Rd
uuaaagaguucguccaaa

SEQ ID NO: 2694118 - RNA, 19 nt, Haemophilus influenzae Rd
uuaaagauaguaauguucu

SEQ ID NO: 2694119 - RNA, 21 nt, Haemophilus influenzae Rd
uuaaagcaaucaaaaaugaaa

SEQ ID NO: 2694120 - RNA, 20 nt, Haemophilus influenzae Rd
uuaaagcacccaucacauuu

SEQ ID NO: 2694121 - RNA, 21 nt, Haemophilus influenzae Rd
uuaaagcacccaucacauuuu

SEQ ID NO: 2694122 - RNA, 23 nt, Haemophilus influenzae Rd
uuaaagcucguauaauauuuucu

SEQ ID NO: 2694123 - RNA, 17 nt, Haemophilus influenzae Rd
uuaaaggcggauuuauu

SEQ ID NO: 2694124 - RNA, 22 nt, Haemophilus influenzae Rd
uuaaaggcggauuuauuauuua

SEQ ID NO: 2694125 - RNA, 14 nt, Haemophilus influenzae Rd
uuaaaggcugaaua

SEQ ID NO: 2694126 - RNA, 15 nt, Haemophilus influenzae Rd
uuaaaggcugaauaa

SEQ ID NO: 2694127 - RNA, 22 nt, Haemophilus influenzae Rd
uuaaaggcugaauaaaucagcg

SEQ ID NO: 2694128 - RNA, 15 nt, Haemophilus influenzae Rd
uuaaagguuauuucu

SEQ ID NO: 2694129 - RNA, 13 nt, Haemophilus influenzae Rd
uuaaaguaagaau

SEQ ID NO: 2694130 - RNA, 13 nt, Haemophilus influenzae Rd
uuaaaguaauagc

SEQ ID NO: 2694131 - RNA, 23 nt, Haemophilus influenzae Rd
uuaaagugcgguagaaauuacca

SEQ ID NO: 2694132 - RNA, 18 nt, Haemophilus influenzae Rd
uuaaagugcgguuaauuu

SEQ ID NO: 2694133 - RNA, 12 nt, Haemophilus influenzae Rd
uuaaauaaaaaa

SEQ ID NO: 2694134 - RNA, 12 nt, Haemophilus influenzae Rd
uuaaauaaaaau

SEQ ID NO: 2694135 - RNA, 22 nt, Haemophilus influenzae Rd
uuaaauaaaaaugaugauaauu

SEQ ID NO: 2694136 - RNA, 20 nt, Haemophilus influenzae Rd
uuaaauaaaauauuuaauuu

SEQ ID NO: 2694137 - RNA, 13 nt, Haemophilus influenzae Rd
uuaaauaaacaca

SEQ ID NO: 2694138 - RNA, 15 nt, Haemophilus influenzae Rd
uuaaauaaacauuau

SEQ ID NO: 2694139 - RNA, 21 nt, Haemophilus influenzae Rd
uuaaauaaacauuaugaaaaa

SEQ ID NO: 2694140 - RNA, 18 nt, Haemophilus influenzae Rd
uuaaauaaauccuuaauu

SEQ ID NO: 2694141 - RNA, 23 nt, Haemophilus influenzae Rd
uuaaauaaccauaucugaaaaua

SEQ ID NO: 2694142 - RNA, 14 nt, Haemophilus influenzae Rd
uuaaauaauuaaaa

SEQ ID NO: 2694143 - RNA, 19 nt, Haemophilus influenzae Rd
uuaaauacagcucaaaaug

SEQ ID NO: 2694144 - RNA, 22 nt, Haemophilus influenzae Rd
uuaaauacuaauaggaguaaaa

SEQ ID NO: 2694145 - RNA, 16 nt, Haemophilus influenzae Rd
uuaaauagauaaucag

SEQ ID NO: 2694146 - RNA, 18 nt, Haemophilus influenzae Rd
uuaaauagcgaacaugcg

SEQ ID NO: 2694147 - RNA, 19 nt, Haemophilus influenzae Rd
uuaaauauaaugaaaacag

SEQ ID NO: 2694148 - RNA, 19 nt, Haemophilus influenzae Rd
uuaaauauaggguaaauaa

SEQ ID NO: 2694149 - RNA, 17 nt, Haemophilus influenzae Rd
uuaaauauucaauuaca

SEQ ID NO: 2694150 - RNA, 15 nt, Haemophilus influenzae Rd
uuaaauauuuaaaaa

SEQ ID NO: 2694151 - RNA, 17 nt, Haemophilus influenzae Rd
uuaaauauuuaaaaaga

SEQ ID NO: 2694152 - RNA, 17 nt, Haemophilus influenzae Rd
uuaaauauuuucauuua

SEQ ID NO: 2694153 - RNA, 20 nt, Haemophilus influenzae Rd
uuaaauauuuuuacaaaaaa

SEQ ID NO: 2694154 - RNA, 11 nt, Haemophilus influenzae Rd
uuaaaucaaaa

SEQ ID NO: 2694155 - RNA, 14 nt, Haemophilus influenzae Rd
uuaaaucaaaaauu

SEQ ID NO: 2694156 - RNA, 15 nt, Haemophilus influenzae Rd
uuaaaucaaaaccaa

SEQ ID NO: 2694157 - RNA, 20 nt, Haemophilus influenzae Rd
uuaaaucaaaaccaaucauu

SEQ ID NO: 2694158 - RNA, 23 nt, Haemophilus influenzae Rd
uuaaaucaaacaaaauuuuaaau

SEQ ID NO: 2694159 - RNA, 15 nt, Haemophilus influenzae Rd
uuaaaucaaauuuag

SEQ ID NO: 2694160 - RNA, 18 nt, Haemophilus influenzae Rd
uuaaaucaauuaacuauu

SEQ ID NO: 2694161 - RNA, 23 nt, Haemophilus influenzae Rd
uuaaauccacgccagcuacaucu

SEQ ID NO: 2694162 - RNA, 23 nt, Haemophilus influenzae Rd
uuaaauccugacaaccuguuugg

SEQ ID NO: 2694163 - RNA, 21 nt, Haemophilus influenzae Rd
uuaaguugggcuuauuuguuu

SEQ ID NO: 2694164 - RNA, 18 nt, Haemophilus influenzae Rd
uuaaguuuccaagugcgu

SEQ ID NO: 2694165 - RNA, 22 nt, Haemophilus influenzae Rd
uuaauaaaaaaucugugauaua

SEQ ID NO: 2694166 - RNA, 18 nt, Haemophilus influenzae Rd
uuaauaaaaauuguaaaa

SEQ ID NO: 2694167 - RNA, 23 nt, Haemophilus influenzae Rd
uuaauaaaccaacauacauuaau

SEQ ID NO: 2694168 - RNA, 22 nt, Haemophilus influenzae Rd
uuaauaaagauaaauuauauuu

SEQ ID NO: 2694169 - RNA, 16 nt, Haemophilus influenzae Rd
uuaauaaauauuauua

SEQ ID NO: 2694170 - RNA, 22 nt, Haemophilus influenzae Rd
uuaauaaauauugauuacccau

SEQ ID NO: 2694171 - RNA, 22 nt, Haemophilus influenzae Rd
uuaauaacauagaaaucacuaa

SEQ ID NO: 2694172 - RNA, 21 nt, Haemophilus influenzae Rd
uuaauaagaaaaucaaagaua

SEQ ID NO: 2694173 - RNA, 14 nt, Haemophilus influenzae Rd
uuaauaagaaagaa

SEQ ID NO: 2694174 - RNA, 21 nt, Haemophilus influenzae Rd
uuaauaagccauuuucugcau

SEQ ID NO: 2694175 - RNA, 15 nt, Haemophilus influenzae Rd
uuaauaaggcaaaac

SEQ ID NO: 2694176 - RNA, 21 nt, Haemophilus influenzae Rd
uuaauaaggcaccuuuuugcu

SEQ ID NO: 2694177 - RNA, 15 nt, Haemophilus influenzae Rd
uuaauaauauauuca

SEQ ID NO: 2694178 - RNA, 18 nt, Haemophilus influenzae Rd
uuaauaaucuuaaauaau

SEQ ID NO: 2694179 - RNA, 19 nt, Haemophilus influenzae Rd
uuaauaaugcuaauuucaa

SEQ ID NO: 2694180 - RNA, 17 nt, Haemophilus influenzae Rd
uuaauaccaauaauaau

SEQ ID NO: 2694181 - RNA, 22 nt, Haemophilus influenzae Rd
uuaauacgaaaaauuacuuaau

SEQ ID NO: 2694182 - RNA, 22 nt, Haemophilus influenzae Rd
uuaauacgacggcaucguaauc

SEQ ID NO: 2694183 - RNA, 22 nt, Haemophilus influenzae Rd
uuaauacgccaagauaacucac

SEQ ID NO: 2694184 - RNA, 19 nt, Haemophilus influenzae Rd
uuaauacuuggugcaauaa

SEQ ID NO: 2694185 - RNA, 21 nt, Haemophilus influenzae Rd
uuaauacuuucuuuucaauuu

SEQ ID NO: 2694186 - RNA, 17 nt, Haemophilus influenzae Rd
uuaauacuuuuguaugu

SEQ ID NO: 2694187 - RNA, 17 nt, Haemophilus influenzae Rd
uuaauagagaauaauua

SEQ ID NO: 2694188 - RNA, 16 nt, Haemophilus influenzae Rd
uuaauagauucuugcg

SEQ ID NO: 2694189 - RNA, 15 nt, Haemophilus influenzae Rd
uuaauagcugggcaa

SEQ ID NO: 2694190 - RNA, 15 nt, Haemophilus influenzae Rd
uuaauaggaauaaca

SEQ ID NO: 2694191 - RNA, 13 nt, Haemophilus influenzae Rd
uuaauauauuuuu

SEQ ID NO: 2694192 - RNA, 16 nt, Haemophilus influenzae Rd
uuaauauauuuuuuua

SEQ ID NO: 2694193 - RNA, 23 nt, Haemophilus influenzae Rd
uuaauaucuuccguuuuuuucac

SEQ ID NO: 2694194 - RNA, 14 nt, Haemophilus influenzae Rd
uuaauaucuucuaa

SEQ ID NO: 2694195 - RNA, 18 nt, Haemophilus influenzae Rd
uuaauaucuuuaacaaaa

SEQ ID NO: 2694196 - RNA, 23 nt, Haemophilus influenzae Rd
uuaauaugccaaauaaaauuaca

SEQ ID NO: 2694197 - RNA, 12 nt, Haemophilus influenzae Rd
uuaauauguucu

SEQ ID NO: 2694198 - RNA, 20 nt, Haemophilus influenzae Rd
uuaauauguucuuuguugau

SEQ ID NO: 2694199 - RNA, 18 nt, Haemophilus influenzae Rd
uuaauauuauucuuuuca

SEQ ID NO: 2694200 - RNA, 19 nt, Haemophilus influenzae Rd
uuaauauugccauaauaau

SEQ ID NO: 2694201 - RNA, 15 nt, Haemophilus influenzae Rd
uuaaucaaacuuuua

SEQ ID NO: 2694202 - RNA, 13 nt, Haemophilus influenzae Rd
uuaaucaauuaaa

SEQ ID NO: 2694203 - RNA, 14 nt, Haemophilus influenzae Rd
uuaaucaccauauc

SEQ ID NO: 2694204 - RNA, 12 nt, Haemophilus influenzae Rd
uuaaucauugca

SEQ ID NO: 2694205 - RNA, 14 nt, Haemophilus influenzae Rd
uuaaucauuuucac

SEQ ID NO: 2694206 - RNA, 14 nt, Haemophilus influenzae Rd
uuaaucauuuuuua

SEQ ID NO: 2694207 - RNA, 22 nt, Haemophilus influenzae Rd
uuaauccaauccauaacaacca

SEQ ID NO: 2694208 - RNA, 17 nt, Haemophilus influenzae Rd
uuaauccaucauuuuuc

SEQ ID NO: 2694209 - RNA, 20 nt, Haemophilus influenzae Rd
uuaauccguuaauuucaucc

SEQ ID NO: 2694210 - RNA, 17 nt, Haemophilus influenzae Rd
uuaauccuaguuuuuuc

SEQ ID NO: 2694211 - RNA, 17 nt, Haemophilus influenzae Rd
uuaaucgaucuauauuc

SEQ ID NO: 2694212 - RNA, 15 nt, Haemophilus influenzae Rd
uuaaucgcacuuaaa

SEQ ID NO: 2694213 - RNA, 23 nt, Haemophilus influenzae Rd
uuaaucggauguuugaacuauau

SEQ ID NO: 2694214 - RNA, 22 nt, Haemophilus influenzae Rd
uuaaucggcaauguuuuaaguu

SEQ ID NO: 2694215 - RNA, 14 nt, Haemophilus influenzae Rd
uuaaucguuaccaa

SEQ ID NO: 2694216 - RNA, 17 nt, Haemophilus influenzae Rd
uuaaucguuaccaagaa

SEQ ID NO: 2694217 - RNA, 18 nt, Haemophilus influenzae Rd
uuaaucguuaccaagaaa

SEQ ID NO: 2694218 - RNA, 16 nt, Haemophilus influenzae Rd
uuaaucugaauuucca

SEQ ID NO: 2694219 - RNA, 13 nt, Haemophilus influenzae Rd
uuaaucugcaccu

SEQ ID NO: 2694220 - RNA, 14 nt, Haemophilus influenzae Rd
uuaaucuuauacaa

SEQ ID NO: 2694221 - RNA, 13 nt, Haemophilus influenzae Rd
uuaaucuuaucaa

SEQ ID NO: 2694222 - RNA, 16 nt, Haemophilus influenzae Rd
uuaaucuuaucaaaca

SEQ ID NO: 2694223 - RNA, 22 nt, Haemophilus influenzae Rd
uuaaugaaacuugguguaauuu

SEQ ID NO: 2694224 - RNA, 16 nt, Haemophilus influenzae Rd
uuaaugaaccaaaucu

SEQ ID NO: 2694225 - RNA, 21 nt, Haemophilus influenzae Rd
uuaaugaacgaacuaaaaugg

SEQ ID NO: 2694226 - RNA, 14 nt, Haemophilus influenzae Rd
uuaaugauaaauuu

SEQ ID NO: 2694227 - RNA, 20 nt, Haemophilus influenzae Rd
uuaaugaugaaacugaacca

SEQ ID NO: 2694228 - RNA, 22 nt, Haemophilus influenzae Rd
uuaaugcaaaaucuuuacgaau

SEQ ID NO: 2694229 - RNA, 23 nt, Haemophilus influenzae Rd
uuaaugcaguaauaaauccuuca

SEQ ID NO: 2694230 - RNA, 23 nt, Haemophilus influenzae Rd
uuaaugcauugauugcuaaauaa

SEQ ID NO: 2694231 - RNA, 21 nt, Haemophilus influenzae Rd
uuaaugcgcccuuuaaauuac

SEQ ID NO: 2694232 - RNA, 20 nt, Haemophilus influenzae Rd
uuaaugcggugcuuuaagua

SEQ ID NO: 2694233 - RNA, 15 nt, Haemophilus influenzae Rd
uuaaugcuaaaccaa

SEQ ID NO: 2694234 - RNA, 17 nt, Haemophilus influenzae Rd
uuaaugcuaaaccaauu

SEQ ID NO: 2694235 - RNA, 17 nt, Haemophilus influenzae Rd
uuaauggaaugauauuc

SEQ ID NO: 2694236 - RNA, 22 nt, Haemophilus influenzae Rd
uuaauggagguuuuacauauaa

SEQ ID NO: 2694237 - RNA, 17 nt, Haemophilus influenzae Rd
uuaauggaugaauacaa

SEQ ID NO: 2694238 - RNA, 18 nt, Haemophilus influenzae Rd
uuaauggcgugccauuac

SEQ ID NO: 2694239 - RNA, 20 nt, Haemophilus influenzae Rd
uuaaugggugauccauaaug

SEQ ID NO: 2694240 - RNA, 13 nt, Haemophilus influenzae Rd
uuaauguaaacaa

SEQ ID NO: 2694241 - RNA, 14 nt, Haemophilus influenzae Rd
uuaauguaggcucu

SEQ ID NO: 2694242 - RNA, 16 nt, Haemophilus influenzae Rd
uuaauguuauuaaaua

SEQ ID NO: 2694243 - RNA, 18 nt, Haemophilus influenzae Rd
uuaauguucccacaaaga

SEQ ID NO: 2694244 - RNA, 21 nt, Haemophilus influenzae Rd
uuaauuaaacguugugcauca

SEQ ID NO: 2694245 - RNA, 12 nt, Haemophilus influenzae Rd
uuaauuaaauac

SEQ ID NO: 2694246 - RNA, 15 nt, Haemophilus influenzae Rd
uuaauuaaauacaaa

SEQ ID NO: 2694247 - RNA, 17 nt, Haemophilus influenzae Rd
uuaauuaaauacaaaac

SEQ ID NO: 2694248 - RNA, 22 nt, Haemophilus influenzae Rd
uuaauuaacgcucaaaaauuuc

SEQ ID NO: 2694249 - RNA, 18 nt, Haemophilus influenzae Rd
uuaauuaaucaauaagaa

SEQ ID NO: 2694250 - RNA, 17 nt, Haemophilus influenzae Rd
uuaauuaccacaugcau

SEQ ID NO: 2694251 - RNA, 16 nt, Haemophilus influenzae Rd
uuaauuaccugccaaa

SEQ ID NO: 2694252 - RNA, 13 nt, Haemophilus influenzae Rd
uuaauuacuuuua

SEQ ID NO: 2694253 - RNA, 15 nt, Haemophilus influenzae Rd
uuaauuacuuuuaua

SEQ ID NO: 2694254 - RNA, 17 nt, Haemophilus influenzae Rd
uuaauuaguuauacuua

SEQ ID NO: 2694255 - RNA, 20 nt, Haemophilus influenzae Rd
uuaauuaguuauacuuaauc

SEQ ID NO: 2694256 - RNA, 12 nt, Haemophilus influenzae Rd
uuaauuauauuu

SEQ ID NO: 2694257 - RNA, 22 nt, Haemophilus influenzae Rd
uuaauuaucaaaaagaaauauu

SEQ ID NO: 2694258 - RNA, 18 nt, Haemophilus influenzae Rd
uuaauuaucuaaauuaca

SEQ ID NO: 2694259 - RNA, 16 nt, Haemophilus influenzae Rd
uuaauuauuuuaaaua

SEQ ID NO: 2694260 - RNA, 18 nt, Haemophilus influenzae Rd
uuaauuauuuuaaauaaa

SEQ ID NO: 2694261 - RNA, 23 nt, Haemophilus influenzae Rd
uuaauucacuacgauuuaaugua

SEQ ID NO: 2694262 - RNA, 22 nt, Haemophilus influenzae Rd
uuaauucauugaguuuagucuu

SEQ ID NO: 2694263 - RNA, 19 nt, Haemophilus influenzae Rd
uuaauucuucgauuaguuu

SEQ ID NO: 2694264 - RNA, 13 nt, Haemophilus influenzae Rd
uuaauucuuuauc

SEQ ID NO: 2694265 - RNA, 19 nt, Haemophilus influenzae Rd
uuaauugauggaauuuaua

SEQ ID NO: 2694266 - RNA, 22 nt, Haemophilus influenzae Rd
uuaauuggaaauaauauucaaa

SEQ ID NO: 2694267 - RNA, 22 nt, Haemophilus influenzae Rd
uuaauuggcgaaggcaaaucac

SEQ ID NO: 2694268 - RNA, 19 nt, Haemophilus influenzae Rd
uuacucacuauaacuuuuc

SEQ ID NO: 2694269 - RNA, 12 nt, Haemophilus influenzae Rd
uuacucauucua

SEQ ID NO: 2694270 - RNA, 15 nt, Haemophilus influenzae Rd
uuacucauucuaaug

SEQ ID NO: 2694271 - RNA, 19 nt, Haemophilus influenzae Rd
uuacucauuuaucaaacaa

SEQ ID NO: 2694272 - RNA, 20 nt, Haemophilus influenzae Rd
uuacucguccaaauucauuu

SEQ ID NO: 2694273 - RNA, 21 nt, Haemophilus influenzae Rd
uuacucuuuuuuagauaaaaa

SEQ ID NO: 2694274 - RNA, 21 nt, Haemophilus influenzae Rd
uuacugacuuucuaacuuuua

SEQ ID NO: 2694275 - RNA, 15 nt, Haemophilus influenzae Rd
uuacugcuugguucu

SEQ ID NO: 2694276 - RNA, 19 nt, Haemophilus influenzae Rd
uuacuggaaauucuucaau

SEQ ID NO: 2694277 - RNA, 16 nt, Haemophilus influenzae Rd
uuacuguucaaauaag

SEQ ID NO: 2694278 - RNA, 16 nt, Haemophilus influenzae Rd
uuacuguuugaacgcu

SEQ ID NO: 2694279 - RNA, 18 nt, Haemophilus influenzae Rd
uuacuguuuuuauauuua

SEQ ID NO: 2694280 - RNA, 13 nt, Haemophilus influenzae Rd
uuacuuaaaucuu

SEQ ID NO: 2694281 - RNA, 13 nt, Haemophilus influenzae Rd
uuacuuaacauca

SEQ ID NO: 2694282 - RNA, 21 nt, Haemophilus influenzae Rd
uuacuuaacaucaucaucgca

SEQ ID NO: 2694283 - RNA, 15 nt, Haemophilus influenzae Rd
uuacuuauaagauga

SEQ ID NO: 2694284 - RNA, 15 nt, Haemophilus influenzae Rd
uuacuucaucaaaac

SEQ ID NO: 2694285 - RNA, 16 nt, Haemophilus influenzae Rd
uuacuucaucccauuu

SEQ ID NO: 2694286 - RNA, 14 nt, Haemophilus influenzae Rd
uuacuugaaauugu

SEQ ID NO: 2694287 - RNA, 16 nt, Haemophilus influenzae Rd
uuacuuggcauuucaa

SEQ ID NO: 2694288 - RNA, 22 nt, Haemophilus influenzae Rd
uuacuuggggcuaauuuuuaaa

SEQ ID NO: 2694289 - RNA, 22 nt, Haemophilus influenzae Rd
uuacuugguaauuuggcguaaa

SEQ ID NO: 2694290 - RNA, 16 nt, Haemophilus influenzae Rd
uuacuuuauuuaacug

SEQ ID NO: 2694291 - RNA, 16 nt, Haemophilus influenzae Rd
uuacuuuuacaauccu

SEQ ID NO: 2694292 - RNA, 18 nt, Haemophilus influenzae Rd
uuacuuuuacuuaaagca

SEQ ID NO: 2694293 - RNA, 17 nt, Haemophilus influenzae Rd
uuacuuuucgauagaac

SEQ ID NO: 2694294 - RNA, 12 nt, Haemophilus influenzae Rd
uuacuuuuuaau

SEQ ID NO: 2694295 - RNA, 22 nt, Haemophilus influenzae Rd
uuagaaagccuuuuaaaaugaa

SEQ ID NO: 2694296 - RNA, 19 nt, Haemophilus influenzae Rd
uuagaaagcuggcgaccuu

SEQ ID NO: 2694297 - RNA, 13 nt, Haemophilus influenzae Rd
uuagaaaguaaac

SEQ ID NO: 2694298 - RNA, 22 nt, Haemophilus influenzae Rd
uuagaaauacauuauuaaaagc

SEQ ID NO: 2694299 - RNA, 16 nt, Haemophilus influenzae Rd
uuagaaaucaacacac

SEQ ID NO: 2694300 - RNA, 19 nt, Haemophilus influenzae Rd
uuagaacaauacucuuaac

SEQ ID NO: 2694301 - RNA, 18 nt, Haemophilus influenzae Rd
uuagaaguaaauucaguu

SEQ ID NO: 2694302 - RNA, 14 nt, Haemophilus influenzae Rd
uuagaagugaaaua

SEQ ID NO: 2694303 - RNA, 22 nt, Haemophilus influenzae Rd
uuagaauaaaccaaugagaaaa

SEQ ID NO: 2694304 - RNA, 14 nt, Haemophilus influenzae Rd
uuagaauccaaaau

SEQ ID NO: 2694305 - RNA, 22 nt, Haemophilus influenzae Rd
uuagaauccaaaauuacuuuuc

SEQ ID NO: 2694306 - RNA, 19 nt, Haemophilus influenzae Rd
uuagaaugcagauuaauuu

SEQ ID NO: 2694307 - RNA, 13 nt, Haemophilus influenzae Rd
uuagaauuuauag

SEQ ID NO: 2694308 - RNA, 15 nt, Haemophilus influenzae Rd
uuagaauuuuaacuu

SEQ ID NO: 2694309 - RNA, 15 nt, Haemophilus influenzae Rd
uuagaauuuuuauuu

SEQ ID NO: 2694310 - RNA, 12 nt, Haemophilus influenzae Rd
uuagacaaaaau

SEQ ID NO: 2694311 - RNA, 22 nt, Haemophilus influenzae Rd
uuagacaauaaaacacaacaua

SEQ ID NO: 2694312 - RNA, 23 nt, Haemophilus influenzae Rd
uuagacagacuauuucuguauuu

SEQ ID NO: 2694313 - RNA, 18 nt, Haemophilus influenzae Rd
uuagacggucaaauucag

SEQ ID NO: 2694314 - RNA, 14 nt, Haemophilus influenzae Rd
uuagagagaaaaau

SEQ ID NO: 2694315 - RNA, 21 nt, Haemophilus influenzae Rd
uuagagauuuuauucauaaau

SEQ ID NO: 2694316 - RNA, 22 nt, Haemophilus influenzae Rd
uuagagcaggcgacucauaauc

SEQ ID NO: 2694317 - RNA, 16 nt, Haemophilus influenzae Rd
uuagagggauaaaaau

SEQ ID NO: 2694318 - RNA, 17 nt, Haemophilus influenzae Rd
uuagauaaaaaccuaaa

SEQ ID NO: 2694319 - RNA, 13 nt, Haemophilus influenzae Rd
uuagauaagccau

SEQ ID NO: 2694320 - RNA, 21 nt, Haemophilus influenzae Rd
uuagauaagccauuaacauuu

SEQ ID NO: 2694321 - RNA, 13 nt, Haemophilus influenzae Rd
uuagauaauaaaa

SEQ ID NO: 2694322 - RNA, 13 nt, Haemophilus influenzae Rd
uuagauacaaaga

SEQ ID NO: 2694323 - RNA, 14 nt, Haemophilus influenzae Rd
uuagauacaaagau

SEQ ID NO: 2694324 - RNA, 19 nt, Haemophilus influenzae Rd
uuagauacaaagauuucau

SEQ ID NO: 2694325 - RNA, 15 nt, Haemophilus influenzae Rd
uuagauacauaaaaa

SEQ ID NO: 2694326 - RNA, 16 nt, Haemophilus influenzae Rd
uuagauacauaaaaaa

SEQ ID NO: 2694327 - RNA, 12 nt, Haemophilus influenzae Rd
uuagauauaaaa

SEQ ID NO: 2694328 - RNA, 16 nt, Haemophilus influenzae Rd
uuagauauuauuuauu

SEQ ID NO: 2694329 - RNA, 17 nt, Haemophilus influenzae Rd
uuagauauuauuuauuu

SEQ ID NO: 2694330 - RNA, 14 nt, Haemophilus influenzae Rd
uuagaucagaaaac

SEQ ID NO: 2694331 - RNA, 16 nt, Haemophilus influenzae Rd
uuagaugauuuuaaaa

SEQ ID NO: 2694332 - RNA, 18 nt, Haemophilus influenzae Rd
uuagaugauuuuaaaaua

SEQ ID NO: 2694333 - RNA, 19 nt, Haemophilus influenzae Rd
uuagaugauuuuaaaguaa

SEQ ID NO: 2694334 - RNA, 14 nt, Haemophilus influenzae Rd
uuagauuacuuuua

SEQ ID NO: 2694335 - RNA, 21 nt, Haemophilus influenzae Rd
uuagauuugaaccuucacaga

SEQ ID NO: 2694336 - RNA, 14 nt, Haemophilus influenzae Rd
uuagcaacugcuga

SEQ ID NO: 2694337 - RNA, 16 nt, Haemophilus influenzae Rd
uuagccaaaucaucua

SEQ ID NO: 2694338 - RNA, 18 nt, Haemophilus influenzae Rd
uuagcccaccaauuaacc

SEQ ID NO: 2694339 - RNA, 14 nt, Haemophilus influenzae Rd
uuagccuagauauu

SEQ ID NO: 2694340 - RNA, 13 nt, Haemophilus influenzae Rd
uuagccuguucuu

SEQ ID NO: 2694341 - RNA, 23 nt, Haemophilus influenzae Rd
uuagcgaaaauuuugccaauuac

SEQ ID NO: 2694342 - RNA, 20 nt, Haemophilus influenzae Rd
uuagcgcauuuuucuuuaaa

SEQ ID NO: 2694343 - RNA, 16 nt, Haemophilus influenzae Rd
uuagcggcuuuuugcu

SEQ ID NO: 2694344 - RNA, 15 nt, Haemophilus influenzae Rd
uuagcguuuagcuuu

SEQ ID NO: 2694345 - RNA, 17 nt, Haemophilus influenzae Rd
uuagcuaaacgcucaaa

SEQ ID NO: 2694346 - RNA, 22 nt, Haemophilus influenzae Rd
uuagcuaaauacuugcuuaugc

SEQ ID NO: 2694347 - RNA, 13 nt, Haemophilus influenzae Rd
uuagcuccuaaau

SEQ ID NO: 2694348 - RNA, 14 nt, Haemophilus influenzae Rd
uuagcuccuaaauu

SEQ ID NO: 2694349 - RNA, 19 nt, Haemophilus influenzae Rd
uuagcuccuaaauuaggca

SEQ ID NO: 2694350 - RNA, 18 nt, Haemophilus influenzae Rd
uuagcugguuuauuuauu

SEQ ID NO: 2694351 - RNA, 15 nt, Haemophilus influenzae Rd
uuaggacaauauuua

SEQ ID NO: 2694352 - RNA, 20 nt, Haemophilus influenzae Rd
uuaggaucguugaaugcacu

SEQ ID NO: 2694353 - RNA, 13 nt, Haemophilus influenzae Rd
uuaggguauuuau

SEQ ID NO: 2694354 - RNA, 15 nt, Haemophilus influenzae Rd
uuaggguauuucggu

SEQ ID NO: 2694355 - RNA, 21 nt, Haemophilus influenzae Rd
uuagggugcauuugguuagau

SEQ ID NO: 2694356 - RNA, 21 nt, Haemophilus influenzae Rd
uuagguaaauuugguucaauu

SEQ ID NO: 2694357 - RNA, 17 nt, Haemophilus influenzae Rd
uuagguuuaaaagauac

SEQ ID NO: 2694358 - RNA, 14 nt, Haemophilus influenzae Rd
uuaguaacagguaa

SEQ ID NO: 2694359 - RNA, 16 nt, Haemophilus influenzae Rd
uuaguaauaaauucaa

SEQ ID NO: 2694360 - RNA, 19 nt, Haemophilus influenzae Rd
uuaguaauggguuaaagug

SEQ ID NO: 2694361 - RNA, 14 nt, Haemophilus influenzae Rd
uuaguaauuuuaau

SEQ ID NO: 2694362 - RNA, 18 nt, Haemophilus influenzae Rd
uuaguaguuagaauuuua

SEQ ID NO: 2694363 - RNA, 15 nt, Haemophilus influenzae Rd
uuaguauuuuugaau

SEQ ID NO: 2694364 - RNA, 14 nt, Haemophilus influenzae Rd
uuagucaauuuacc

SEQ ID NO: 2694365 - RNA, 16 nt, Haemophilus influenzae Rd
uuaguccuuaauuuaa

SEQ ID NO: 2694366 - RNA, 15 nt, Haemophilus influenzae Rd
uuagugaaaagaaaa

SEQ ID NO: 2694367 - RNA, 20 nt, Haemophilus influenzae Rd
uuagugauuucuauguuauu

SEQ ID NO: 2694368 - RNA, 17 nt, Haemophilus influenzae Rd
uuagugguuucagaaua

SEQ ID NO: 2694369 - RNA, 21 nt, Haemophilus influenzae Rd
uuagugguuucagaauaaaga

SEQ ID NO: 2694370 - RNA, 14 nt, Haemophilus influenzae Rd
uuaguuaaauaauc

SEQ ID NO: 2694371 - RNA, 16 nt, Haemophilus influenzae Rd
uuaguuagaagugaaa

SEQ ID NO: 2694372 - RNA, 20 nt, Haemophilus influenzae Rd
uuaguuagaagugaaauauu

SEQ ID NO: 2694373 - RNA, 23 nt, Haemophilus influenzae Rd
uuaguucaaggacugaguucugu

SEQ ID NO: 2694374 - RNA, 15 nt, Haemophilus influenzae Rd
uuaucuaccacauca

SEQ ID NO: 2694375 - RNA, 19 nt, Haemophilus influenzae Rd
uuaucuacugcuucauaaa

SEQ ID NO: 2694376 - RNA, 20 nt, Haemophilus influenzae Rd
uuaucuagacaaaaccugca

SEQ ID NO: 2694377 - RNA, 14 nt, Haemophilus influenzae Rd
uuaucuagcacaaa

SEQ ID NO: 2694378 - RNA, 15 nt, Haemophilus influenzae Rd
uuaucuauaaaaaga

SEQ ID NO: 2694379 - RNA, 16 nt, Haemophilus influenzae Rd
uuaucuauaaaaagaa

SEQ ID NO: 2694380 - RNA, 18 nt, Haemophilus influenzae Rd
uuaucuauugauucuaaa

SEQ ID NO: 2694381 - RNA, 23 nt, Haemophilus influenzae Rd
uuaucucggcuaaaaucugugca

SEQ ID NO: 2694382 - RNA, 15 nt, Haemophilus influenzae Rd
uuaucucuuacagua

SEQ ID NO: 2694383 - RNA, 13 nt, Haemophilus influenzae Rd
uuaucucuuucuu

SEQ ID NO: 2694384 - RNA, 19 nt, Haemophilus influenzae Rd
uuaucucuuucuuaaaaua

SEQ ID NO: 2694385 - RNA, 23 nt, Haemophilus influenzae Rd
uuaucugauccacgguauuuucu

SEQ ID NO: 2694386 - RNA, 19 nt, Haemophilus influenzae Rd
uuaucuggauguaacacaa

SEQ ID NO: 2694387 - RNA, 21 nt, Haemophilus influenzae Rd
uuaucuggcaaucgccaaugu

SEQ ID NO: 2694388 - RNA, 13 nt, Haemophilus influenzae Rd
uuaucuuccccca

SEQ ID NO: 2694389 - RNA, 15 nt, Haemophilus influenzae Rd
uuaucuucuaaaaga

SEQ ID NO: 2694390 - RNA, 18 nt, Haemophilus influenzae Rd
uuaucuuguugccaguaa

SEQ ID NO: 2694391 - RNA, 15 nt, Haemophilus influenzae Rd
uuaugaaaaaaagaa

SEQ ID NO: 2694392 - RNA, 23 nt, Haemophilus influenzae Rd
uuaugaaacagcuaaaaaugaau

SEQ ID NO: 2694393 - RNA, 20 nt, Haemophilus influenzae Rd
uuaugaaagccaaugcggcu

SEQ ID NO: 2694394 - RNA, 14 nt, Haemophilus influenzae Rd
uuaugaaauugcug

SEQ ID NO: 2694395 - RNA, 23 nt, Haemophilus influenzae Rd
uuaugaaauugcuguaaugugcu

SEQ ID NO: 2694396 - RNA, 16 nt, Haemophilus influenzae Rd
uuaugaauguuucaaa

SEQ ID NO: 2694397 - RNA, 13 nt, Haemophilus influenzae Rd
uuaugaccaaaua

SEQ ID NO: 2694398 - RNA, 14 nt, Haemophilus influenzae Rd
uuaugacuauuuuu

SEQ ID NO: 2694399 - RNA, 14 nt, Haemophilus influenzae Rd
uuaugauauuucaa

SEQ ID NO: 2694400 - RNA, 13 nt, Haemophilus influenzae Rd
uuaugaucuacac

SEQ ID NO: 2694401 - RNA, 21 nt, Haemophilus influenzae Rd
uuaugcaacgagcaauauuca

SEQ ID NO: 2694402 - RNA, 19 nt, Haemophilus influenzae Rd
uuaugccguguaauacuga

SEQ ID NO: 2694403 - RNA, 22 nt, Haemophilus influenzae Rd
uuaugccguguaauacugauaa

SEQ ID NO: 2694404 - RNA, 16 nt, Haemophilus influenzae Rd
uuaugcuaaaggguuu

SEQ ID NO: 2694405 - RNA, 23 nt, Haemophilus influenzae Rd
uuaugcuccauugcaauuucagc

SEQ ID NO: 2694406 - RNA, 23 nt, Haemophilus influenzae Rd
uuaugcuucuucugcaggaaaaa

SEQ ID NO: 2694407 - RNA, 21 nt, Haemophilus influenzae Rd
uuauggauauuguaggaagac

SEQ ID NO: 2694408 - RNA, 22 nt, Haemophilus influenzae Rd
uuauggaucacccauuaaauaa

SEQ ID NO: 2694409 - RNA, 21 nt, Haemophilus influenzae Rd
uuauggcugacuagauaaacg

SEQ ID NO: 2694410 - RNA, 14 nt, Haemophilus influenzae Rd
uuaugguaaauauu

SEQ ID NO: 2694411 - RNA, 15 nt, Haemophilus influenzae Rd
uuaugguaaauauug

SEQ ID NO: 2694412 - RNA, 17 nt, Haemophilus influenzae Rd
uuauguaaacuuccaaa

SEQ ID NO: 2694413 - RNA, 13 nt, Haemophilus influenzae Rd
uuauguaaauuua

SEQ ID NO: 2694414 - RNA, 20 nt, Haemophilus influenzae Rd
uuauguaaauuuaucugauc

SEQ ID NO: 2694415 - RNA, 13 nt, Haemophilus influenzae Rd
uuauguaauauaa

SEQ ID NO: 2694416 - RNA, 20 nt, Haemophilus influenzae Rd
uuauguauuaccauuuaucu

SEQ ID NO: 2694417 - RNA, 18 nt, Haemophilus influenzae Rd
uuaugugcaauuugacaa

SEQ ID NO: 2694418 - RNA, 21 nt, Haemophilus influenzae Rd
uuaugugcuugggcaauuaau

SEQ ID NO: 2694419 - RNA, 20 nt, Haemophilus influenzae Rd
uuauguuauuuugauaacgc

SEQ ID NO: 2694420 - RNA, 15 nt, Haemophilus influenzae Rd
uuauguugcccauau

SEQ ID NO: 2694421 - RNA, 18 nt, Haemophilus influenzae Rd
uuauuaaaaaagugcggu

SEQ ID NO: 2694422 - RNA, 12 nt, Haemophilus influenzae Rd
uuauuaaauaua

SEQ ID NO: 2694423 - RNA, 22 nt, Haemophilus influenzae Rd
uuauuaacaaaaagauugaaug

SEQ ID NO: 2694424 - RNA, 14 nt, Haemophilus influenzae Rd
uuauuaauagauaa

SEQ ID NO: 2694425 - RNA, 12 nt, Haemophilus influenzae Rd
uuauuaaugcgu

SEQ ID NO: 2694426 - RNA, 15 nt, Haemophilus influenzae Rd
uuauuacccuauucu

SEQ ID NO: 2694427 - RNA, 14 nt, Haemophilus influenzae Rd
uuauuaccuacuaa

SEQ ID NO: 2694428 - RNA, 13 nt, Haemophilus influenzae Rd
uuauuaccuaguu

SEQ ID NO: 2694429 - RNA, 18 nt, Haemophilus influenzae Rd
uuauuacuucaccaauca

SEQ ID NO: 2694430 - RNA, 20 nt, Haemophilus influenzae Rd
uuauuagaaauauauuuguu

SEQ ID NO: 2694431 - RNA, 12 nt, Haemophilus influenzae Rd
uuauuauauaaa

SEQ ID NO: 2694432 - RNA, 14 nt, Haemophilus influenzae Rd
uuauuauauaaaaa

SEQ ID NO: 2694433 - RNA, 15 nt, Haemophilus influenzae Rd
uuauuaucuucuaaa

SEQ ID NO: 2694434 - RNA, 19 nt, Haemophilus influenzae Rd
uuauuaucuucuaaaagag

SEQ ID NO: 2694435 - RNA, 14 nt, Haemophilus influenzae Rd
uuauuauuaaauaa

SEQ ID NO: 2694436 - RNA, 23 nt, Haemophilus influenzae Rd
uuauuauuucguuguuuuaauaa

SEQ ID NO: 2694437 - RNA, 16 nt, Haemophilus influenzae Rd
uuauucaaaauuugug

SEQ ID NO: 2694438 - RNA, 22 nt, Haemophilus influenzae Rd
uuauucaauaauauauuuaaug

SEQ ID NO: 2694439 - RNA, 23 nt, Haemophilus influenzae Rd
uuauucagcuuuaaggcacagau

SEQ ID NO: 2694440 - RNA, 19 nt, Haemophilus influenzae Rd
uuauucccccauuaaaaga

SEQ ID NO: 2694441 - RNA, 15 nt, Haemophilus influenzae Rd
uuauuccuucaaucg

SEQ ID NO: 2694442 - RNA, 17 nt, Haemophilus influenzae Rd
uuauucgcugcaaaauc

SEQ ID NO: 2694443 - RNA, 21 nt, Haemophilus influenzae Rd
uuauucgguguucugcaucaa

SEQ ID NO: 2694444 - RNA, 14 nt, Haemophilus influenzae Rd
uuauucguuugcaa

SEQ ID NO: 2694445 - RNA, 16 nt, Haemophilus influenzae Rd
uuauucguuugcaaug

SEQ ID NO: 2694446 - RNA, 17 nt, Haemophilus influenzae Rd
uuauucuccaaauauaa

SEQ ID NO: 2694447 - RNA, 22 nt, Haemophilus influenzae Rd
uuauugaagcacugaaauauca

SEQ ID NO: 2694448 - RNA, 21 nt, Haemophilus influenzae Rd
uuauugaguagcugaauauca

SEQ ID NO: 2694449 - RNA, 21 nt, Haemophilus influenzae Rd
uuauugcacuaauaaauagaa

SEQ ID NO: 2694450 - RNA, 17 nt, Haemophilus influenzae Rd
uuauugcauaguuuuau

SEQ ID NO: 2694451 - RNA, 22 nt, Haemophilus influenzae Rd
uuauugccaacuuagauuuucu

SEQ ID NO: 2694452 - RNA, 15 nt, Haemophilus influenzae Rd
uuauugccaauuauc

SEQ ID NO: 2694453 - RNA, 23 nt, Haemophilus influenzae Rd
uuauugcccgugaguaaaauaua

SEQ ID NO: 2694454 - RNA, 20 nt, Haemophilus influenzae Rd
uuauugccuaauaaaaaaua

SEQ ID NO: 2694455 - RNA, 18 nt, Haemophilus influenzae Rd
uuauugccuuucaucauu

SEQ ID NO: 2694456 - RNA, 19 nt, Haemophilus influenzae Rd
uuauugccuuucaucauug

SEQ ID NO: 2694457 - RNA, 17 nt, Haemophilus influenzae Rd
uuauugcguuccaauuu

SEQ ID NO: 2694458 - RNA, 15 nt, Haemophilus influenzae Rd
uuauuggaaaauuca

SEQ ID NO: 2694459 - RNA, 16 nt, Haemophilus influenzae Rd
uuauuggaaaauucaa

SEQ ID NO: 2694460 - RNA, 14 nt, Haemophilus influenzae Rd
uuauuguacucaau

SEQ ID NO: 2694461 - RNA, 23 nt, Haemophilus influenzae Rd
uuauugucugcuccaaauaaucc

SEQ ID NO: 2694462 - RNA, 20 nt, Haemophilus influenzae Rd
uuauugucuuuucuauaauu

SEQ ID NO: 2694463 - RNA, 21 nt, Haemophilus influenzae Rd
uuauugugaugggaaacugaa

SEQ ID NO: 2694464 - RNA, 17 nt, Haemophilus influenzae Rd
uuauuuaagccagaaca

SEQ ID NO: 2694465 - RNA, 14 nt, Haemophilus influenzae Rd
uuauuuaauuucaa

SEQ ID NO: 2694466 - RNA, 19 nt, Haemophilus influenzae Rd
uuauuuaauuucaaaauca

SEQ ID NO: 2694467 - RNA, 15 nt, Haemophilus influenzae Rd
uuauuuauuaagaua

SEQ ID NO: 2694468 - RNA, 15 nt, Haemophilus influenzae Rd
uuauuuauucagcuu

SEQ ID NO: 2694469 - RNA, 21 nt, Haemophilus influenzae Rd
uuauuuauuccaucaauaccu

SEQ ID NO: 2694470 - RNA, 13 nt, Haemophilus influenzae Rd
uuauuuauuuaau

SEQ ID NO: 2694471 - RNA, 17 nt, Haemophilus influenzae Rd
uuauuucaauauaauca

SEQ ID NO: 2694472 - RNA, 13 nt, Haemophilus influenzae Rd
uuauuucaauauu

SEQ ID NO: 2694473 - RNA, 21 nt, Haemophilus influenzae Rd
uuauuucaauauugucuauuu

SEQ ID NO: 2694474 - RNA, 21 nt, Haemophilus influenzae Rd
uuauuucauaucucacaauaa

SEQ ID NO: 2694475 - RNA, 18 nt, Haemophilus influenzae Rd
uuauuuccauaaaugaca

SEQ ID NO: 2694476 - RNA, 16 nt, Haemophilus influenzae Rd
uuauuucucuauaauu

SEQ ID NO: 2694477 - RNA, 14 nt, Haemophilus influenzae Rd
uuauuucugaaggu

SEQ ID NO: 2694478 - RNA, 21 nt, Haemophilus influenzae Rd
uuauuucuguuacuaaaucgc

SEQ ID NO: 2694479 - RNA, 14 nt, Haemophilus influenzae Rd
uucaauuacauauu

SEQ ID NO: 2694480 - RNA, 18 nt, Haemophilus influenzae Rd
uucaauuaccuuagccaa

SEQ ID NO: 2694481 - RNA, 14 nt, Haemophilus influenzae Rd
uucaauucuucuaa

SEQ ID NO: 2694482 - RNA, 15 nt, Haemophilus influenzae Rd
uucaauucuucuaau

SEQ ID NO: 2694483 - RNA, 21 nt, Haemophilus influenzae Rd
uucaauugugccguauuuuuu

SEQ ID NO: 2694484 - RNA, 22 nt, Haemophilus influenzae Rd
uucaauugugccguauuuuuua

SEQ ID NO: 2694485 - RNA, 14 nt, Haemophilus influenzae Rd
uucaauuuaaauca

SEQ ID NO: 2694486 - RNA, 14 nt, Haemophilus influenzae Rd
uucaauuuaacauu

SEQ ID NO: 2694487 - RNA, 16 nt, Haemophilus influenzae Rd
uucaauuuaagcccug

SEQ ID NO: 2694488 - RNA, 15 nt, Haemophilus influenzae Rd
uucaauuugagaaau

SEQ ID NO: 2694489 - RNA, 19 nt, Haemophilus influenzae Rd
uucaauuuggaaaccugca

SEQ ID NO: 2694490 - RNA, 16 nt, Haemophilus influenzae Rd
uucaauuuuaauuggu

SEQ ID NO: 2694491 - RNA, 18 nt, Haemophilus influenzae Rd
uucaauuuucugugaguc

SEQ ID NO: 2694492 - RNA, 14 nt, Haemophilus influenzae Rd
uucaauuuuuccac

SEQ ID NO: 2694493 - RNA, 16 nt, Haemophilus influenzae Rd
uucaauuuuuuaucaa

SEQ ID NO: 2694494 - RNA, 20 nt, Haemophilus influenzae Rd
uucaauuuuuuaucaaauaa

SEQ ID NO: 2694495 - RNA, 21 nt, Haemophilus influenzae Rd
uucaauuuuuuaucaaauaac

SEQ ID NO: 2694496 - RNA, 15 nt, Haemophilus influenzae Rd
uucacaaaacaacca

SEQ ID NO: 2694497 - RNA, 19 nt, Haemophilus influenzae Rd
uucacaaaaguuugcaaca

SEQ ID NO: 2694498 - RNA, 20 nt, Haemophilus influenzae Rd
uucacaaaaguuugcaacau

SEQ ID NO: 2694499 - RNA, 22 nt, Haemophilus influenzae Rd
uucacaaaaguuugcaacauau

SEQ ID NO: 2694500 - RNA, 15 nt, Haemophilus influenzae Rd
uucacaaaauauuag

SEQ ID NO: 2694501 - RNA, 12 nt, Haemophilus influenzae Rd
uucacaaaccca

SEQ ID NO: 2694502 - RNA, 13 nt, Haemophilus influenzae Rd
uucacaacuuuuu

SEQ ID NO: 2694503 - RNA, 18 nt, Haemophilus influenzae Rd
uucacaacuuuuuaacug

SEQ ID NO: 2694504 - RNA, 21 nt, Haemophilus influenzae Rd
uucacagaaacggcgaagauu

SEQ ID NO: 2694505 - RNA, 19 nt, Haemophilus influenzae Rd
uucacagauuucaauuaaa

SEQ ID NO: 2694506 - RNA, 14 nt, Haemophilus influenzae Rd
uucaccaaauaaug

SEQ ID NO: 2694507 - RNA, 18 nt, Haemophilus influenzae Rd
uucaccaauuuaucugcu

SEQ ID NO: 2694508 - RNA, 20 nt, Haemophilus influenzae Rd
uucaccacuuggugcaacca

SEQ ID NO: 2694509 - RNA, 18 nt, Haemophilus influenzae Rd
uucaccauugauuuuuac

SEQ ID NO: 2694510 - RNA, 22 nt, Haemophilus influenzae Rd
uucacccaagauucuaaauauu

SEQ ID NO: 2694511 - RNA, 15 nt, Haemophilus influenzae Rd
uucacccaucuaaac

SEQ ID NO: 2694512 - RNA, 17 nt, Haemophilus influenzae Rd
uucaccgcacuuuuauc

SEQ ID NO: 2694513 - RNA, 23 nt, Haemophilus influenzae Rd
uucaccguuaagcaaauuucugu

SEQ ID NO: 2694514 - RNA, 13 nt, Haemophilus influenzae Rd
uucaccuaauccu

SEQ ID NO: 2694515 - RNA, 16 nt, Haemophilus influenzae Rd
uucaccuucgaauaaa

SEQ ID NO: 2694516 - RNA, 19 nt, Haemophilus influenzae Rd
uucacgacccaccacuuaa

SEQ ID NO: 2694517 - RNA, 23 nt, Haemophilus influenzae Rd
uucacgagagacgccuuuaaaac

SEQ ID NO: 2694518 - RNA, 15 nt, Haemophilus influenzae Rd
uucacgauauugcac

SEQ ID NO: 2694519 - RNA, 15 nt, Haemophilus influenzae Rd
uucacgaucauaaau

SEQ ID NO: 2694520 - RNA, 19 nt, Haemophilus influenzae Rd
uucacgcccaaauacuuca

SEQ ID NO: 2694521 - RNA, 23 nt, Haemophilus influenzae Rd
uucacgccuucgcgagauaaaau

SEQ ID NO: 2694522 - RNA, 19 nt, Haemophilus influenzae Rd
uucacgcucguuaaaucac

SEQ ID NO: 2694523 - RNA, 15 nt, Haemophilus influenzae Rd
uucacgguuauacca

SEQ ID NO: 2694524 - RNA, 21 nt, Haemophilus influenzae Rd
uucacgguuauaccacauaaa

SEQ ID NO: 2694525 - RNA, 23 nt, Haemophilus influenzae Rd
uucacguccgccgaugaauaauu

SEQ ID NO: 2694526 - RNA, 20 nt, Haemophilus influenzae Rd
uucacguucuuuaauaucau

SEQ ID NO: 2694527 - RNA, 18 nt, Haemophilus influenzae Rd
uucacuaaauaaaugguc

SEQ ID NO: 2694528 - RNA, 20 nt, Haemophilus influenzae Rd
uucacuacagguugcucgcc

SEQ ID NO: 2694529 - RNA, 22 nt, Haemophilus influenzae Rd
uucacuacuugaacuaauauca

SEQ ID NO: 2694530 - RNA, 14 nt, Haemophilus influenzae Rd
uucacucggaaugc

SEQ ID NO: 2694531 - RNA, 12 nt, Haemophilus influenzae Rd
uucacugaaagu

SEQ ID NO: 2694532 - RNA, 19 nt, Haemophilus influenzae Rd
uucacugauuuccuguaaa

SEQ ID NO: 2694533 - RNA, 23 nt, Haemophilus influenzae Rd
uucacugcaucuguugugaaugc

SEQ ID NO: 2694534 - RNA, 17 nt, Haemophilus influenzae Rd
uucacugcggcaaaauc

SEQ ID NO: 2694535 - RNA, 15 nt, Haemophilus influenzae Rd
uucacuuaaauucau

SEQ ID NO: 2694536 - RNA, 19 nt, Haemophilus influenzae Rd
uucacuuuuccacaauuca

SEQ ID NO: 2694537 - RNA, 11 nt, Haemophilus influenzae Rd
uucagaaaaag

SEQ ID NO: 2694538 - RNA, 16 nt, Haemophilus influenzae Rd
uucagaaaauaaauaa

SEQ ID NO: 2694539 - RNA, 15 nt, Haemophilus influenzae Rd
uucagaaagagacuc

SEQ ID NO: 2694540 - RNA, 20 nt, Haemophilus influenzae Rd
uucagaaaugaccuucacuu

SEQ ID NO: 2694541 - RNA, 20 nt, Haemophilus influenzae Rd
uucagaacugcuuucuucca

SEQ ID NO: 2694542 - RNA, 17 nt, Haemophilus influenzae Rd
uucagaagucacauauu

SEQ ID NO: 2694543 - RNA, 16 nt, Haemophilus influenzae Rd
uucagaauaaagaaau

SEQ ID NO: 2694544 - RNA, 20 nt, Haemophilus influenzae Rd
uucagaauuaguaaagaaau

SEQ ID NO: 2694545 - RNA, 18 nt, Haemophilus influenzae Rd
uucagacaaaacuuauca

SEQ ID NO: 2694546 - RNA, 19 nt, Haemophilus influenzae Rd
uucagacuagcaucaaaau

SEQ ID NO: 2694547 - RNA, 16 nt, Haemophilus influenzae Rd
uucagacugaauuuga

SEQ ID NO: 2694548 - RNA, 16 nt, Haemophilus influenzae Rd
uucagauaaucaaaaa

SEQ ID NO: 2694549 - RNA, 16 nt, Haemophilus influenzae Rd
uucagauucaauaaua

SEQ ID NO: 2694550 - RNA, 15 nt, Haemophilus influenzae Rd
uucagauuucuucgc

SEQ ID NO: 2694551 - RNA, 15 nt, Haemophilus influenzae Rd
uucagauuuuauauc

SEQ ID NO: 2694552 - RNA, 17 nt, Haemophilus influenzae Rd
uucagcaagaaacucaa

SEQ ID NO: 2694553 - RNA, 20 nt, Haemophilus influenzae Rd
uucagcaagaaacucaaggu

SEQ ID NO: 2694554 - RNA, 16 nt, Haemophilus influenzae Rd
uucagcaaguucugca

SEQ ID NO: 2694555 - RNA, 13 nt, Haemophilus influenzae Rd
uucagcaauuaau

SEQ ID NO: 2694556 - RNA, 21 nt, Haemophilus influenzae Rd
uucagcacuuucgcuuaaaaa

SEQ ID NO: 2694557 - RNA, 20 nt, Haemophilus influenzae Rd
uucagcagggauuuuaaguu

SEQ ID NO: 2694558 - RNA, 17 nt, Haemophilus influenzae Rd
uucagcaucaacauaaa

SEQ ID NO: 2694559 - RNA, 18 nt, Haemophilus influenzae Rd
uucagccacuaauuucac

SEQ ID NO: 2694560 - RNA, 18 nt, Haemophilus influenzae Rd
uucagcguugucaucaga

SEQ ID NO: 2694561 - RNA, 22 nt, Haemophilus influenzae Rd
uucagcguugucaucagaaaua

SEQ ID NO: 2694562 - RNA, 19 nt, Haemophilus influenzae Rd
uucagcuaagccaauaauu

SEQ ID NO: 2694563 - RNA, 14 nt, Haemophilus influenzae Rd
uucagcuugugaaa

SEQ ID NO: 2694564 - RNA, 22 nt, Haemophilus influenzae Rd
uucagcuuuaaggcacagauua

SEQ ID NO: 2694565 - RNA, 19 nt, Haemophilus influenzae Rd
uucaggauagagaaacuaa

SEQ ID NO: 2694566 - RNA, 20 nt, Haemophilus influenzae Rd
uucaggcucuaacauaccgc

SEQ ID NO: 2694567 - RNA, 18 nt, Haemophilus influenzae Rd
uucaggugggaaauaauu

SEQ ID NO: 2694568 - RNA, 22 nt, Haemophilus influenzae Rd
uucaguaaacaaguauaaaaaa

SEQ ID NO: 2694569 - RNA, 23 nt, Haemophilus influenzae Rd
uucaguaaacaaguauaaaaaau

SEQ ID NO: 2694570 - RNA, 16 nt, Haemophilus influenzae Rd
uucaguaagaaaccaa

SEQ ID NO: 2694571 - RNA, 18 nt, Haemophilus influenzae Rd
uucaguaucaaauacaca

SEQ ID NO: 2694572 - RNA, 18 nt, Haemophilus influenzae Rd
uucaguccgcauugaaac

SEQ ID NO: 2694573 - RNA, 17 nt, Haemophilus influenzae Rd
uucagucuuaauuuguu

SEQ ID NO: 2694574 - RNA, 21 nt, Haemophilus influenzae Rd
uucagucuuaauuuguugaau

SEQ ID NO: 2694575 - RNA, 17 nt, Haemophilus influenzae Rd
uucaguguaguuuucug

SEQ ID NO: 2694576 - RNA, 19 nt, Haemophilus influenzae Rd
uucaguuaaauuuucaaug

SEQ ID NO: 2694577 - RNA, 13 nt, Haemophilus influenzae Rd
uucaguuaagaaa

SEQ ID NO: 2694578 - RNA, 21 nt, Haemophilus influenzae Rd
uucaguuaauuagaauaacaa

SEQ ID NO: 2694579 - RNA, 18 nt, Haemophilus influenzae Rd
uucaguuacguaauauuu

SEQ ID NO: 2694580 - RNA, 11 nt, Haemophilus influenzae Rd
uucauaaaaaa

SEQ ID NO: 2694581 - RNA, 13 nt, Haemophilus influenzae Rd
uucauaaaaaaag

SEQ ID NO: 2694582 - RNA, 15 nt, Haemophilus influenzae Rd
uucauaaauucaucu

SEQ ID NO: 2694583 - RNA, 19 nt, Haemophilus influenzae Rd
uucauaagauaacaagaaa

SEQ ID NO: 2694584 - RNA, 16 nt, Haemophilus influenzae Rd
uuccauaaaagaccuc

SEQ ID NO: 2694585 - RNA, 23 nt, Haemophilus influenzae Rd
uuccauaaaugacagaaacaaau

SEQ ID NO: 2694586 - RNA, 13 nt, Haemophilus influenzae Rd
uuccauaauaacg

SEQ ID NO: 2694587 - RNA, 20 nt, Haemophilus influenzae Rd
uuccauaauguucccuauaa

SEQ ID NO: 2694588 - RNA, 23 nt, Haemophilus influenzae Rd
uuccauaauguucccuauaaaua

SEQ ID NO: 2694589 - RNA, 17 nt, Haemophilus influenzae Rd
uuccauaccaaaauguc

SEQ ID NO: 2694590 - RNA, 19 nt, Haemophilus influenzae Rd
uuccauaguucacuaaaaa

SEQ ID NO: 2694591 - RNA, 20 nt, Haemophilus influenzae Rd
uuccauauuguuucaauuua

SEQ ID NO: 2694592 - RNA, 12 nt, Haemophilus influenzae Rd
uuccaucaaaac

SEQ ID NO: 2694593 - RNA, 16 nt, Haemophilus influenzae Rd
uuccaucaauaccuaa

SEQ ID NO: 2694594 - RNA, 15 nt, Haemophilus influenzae Rd
uuccaucauugcucg

SEQ ID NO: 2694595 - RNA, 21 nt, Haemophilus influenzae Rd
uuccaucgcacuguuauauaa

SEQ ID NO: 2694596 - RNA, 13 nt, Haemophilus influenzae Rd
uuccaugccuaau

SEQ ID NO: 2694597 - RNA, 20 nt, Haemophilus influenzae Rd
uuccauuaauucauauugga

SEQ ID NO: 2694598 - RNA, 18 nt, Haemophilus influenzae Rd
uuccauucacuuucacau

SEQ ID NO: 2694599 - RNA, 15 nt, Haemophilus influenzae Rd
uuccauuuugcauau

SEQ ID NO: 2694600 - RNA, 11 nt, Haemophilus influenzae Rd
uuccauuuuuu

SEQ ID NO: 2694601 - RNA, 23 nt, Haemophilus influenzae Rd
uuccauuuuuuaugguaaauauu

SEQ ID NO: 2694602 - RNA, 13 nt, Haemophilus influenzae Rd
uucccaaauuuuu

SEQ ID NO: 2694603 - RNA, 19 nt, Haemophilus influenzae Rd
uucccaaccgauauacucu

SEQ ID NO: 2694604 - RNA, 14 nt, Haemophilus influenzae Rd
uucccaagauuuua

SEQ ID NO: 2694605 - RNA, 15 nt, Haemophilus influenzae Rd
uucccaguaaauauc

SEQ ID NO: 2694606 - RNA, 18 nt, Haemophilus influenzae Rd
uucccccauuaaaagaag

SEQ ID NO: 2694607 - RNA, 15 nt, Haemophilus influenzae Rd
uucccgcaacuuuug

SEQ ID NO: 2694608 - RNA, 16 nt, Haemophilus influenzae Rd
uucccuagccuuuucu

SEQ ID NO: 2694609 - RNA, 17 nt, Haemophilus influenzae Rd
uucccuauaaauaaacg

SEQ ID NO: 2694610 - RNA, 17 nt, Haemophilus influenzae Rd
uuccgaaaaaacaagag

SEQ ID NO: 2694611 - RNA, 22 nt, Haemophilus influenzae Rd
uuccgacaacacuugcuguuuu

SEQ ID NO: 2694612 - RNA, 20 nt, Haemophilus influenzae Rd
uuccgcaagaggaauuucga

SEQ ID NO: 2694613 - RNA, 14 nt, Haemophilus influenzae Rd
uuccgcaauauuua

SEQ ID NO: 2694614 - RNA, 15 nt, Haemophilus influenzae Rd
uuccgcuaauacuag

SEQ ID NO: 2694615 - RNA, 20 nt, Haemophilus influenzae Rd
uuccgcuggugggaauaauu

SEQ ID NO: 2694616 - RNA, 15 nt, Haemophilus influenzae Rd
uuccgcuuccugcug

SEQ ID NO: 2694617 - RNA, 15 nt, Haemophilus influenzae Rd
uuccgcuuuaauaau

SEQ ID NO: 2694618 - RNA, 17 nt, Haemophilus influenzae Rd
uuccgcuuuaauaauca

SEQ ID NO: 2694619 - RNA, 18 nt, Haemophilus influenzae Rd
uuccgcuuuaauaaucaa

SEQ ID NO: 2694620 - RNA, 14 nt, Haemophilus influenzae Rd
uuccguagccguuu

SEQ ID NO: 2694621 - RNA, 20 nt, Haemophilus influenzae Rd
uuccgugccacgaauaagca

SEQ ID NO: 2694622 - RNA, 12 nt, Haemophilus influenzae Rd
uuccguuuucua

SEQ ID NO: 2694623 - RNA, 17 nt, Haemophilus influenzae Rd
uuccuaaaguuuuugca

SEQ ID NO: 2694624 - RNA, 16 nt, Haemophilus influenzae Rd
uuccucagcaaaagac

SEQ ID NO: 2694625 - RNA, 23 nt, Haemophilus influenzae Rd
uuccuccgccaucaauuuuuacg

SEQ ID NO: 2694626 - RNA, 17 nt, Haemophilus influenzae Rd
uuccucgacauaaaaac

SEQ ID NO: 2694627 - RNA, 12 nt, Haemophilus influenzae Rd
uuccucugcagg

SEQ ID NO: 2694628 - RNA, 23 nt, Haemophilus influenzae Rd
uuccugcaaacauaccacuucag

SEQ ID NO: 2694629 - RNA, 14 nt, Haemophilus influenzae Rd
uuccugcuuuuuuc

SEQ ID NO: 2694630 - RNA, 19 nt, Haemophilus influenzae Rd
uuccuguacucgaauuauu

SEQ ID NO: 2694631 - RNA, 13 nt, Haemophilus influenzae Rd
uuccuuacaacaa

SEQ ID NO: 2694632 - RNA, 12 nt, Haemophilus influenzae Rd
uuccuuauauuc

SEQ ID NO: 2694633 - RNA, 22 nt, Haemophilus influenzae Rd
uuccuuauucaaauaacguaac

SEQ ID NO: 2694634 - RNA, 15 nt, Haemophilus influenzae Rd
uuccuugccaaagug

SEQ ID NO: 2694635 - RNA, 14 nt, Haemophilus influenzae Rd
uuccuuuucauaaa

SEQ ID NO: 2694636 - RNA, 15 nt, Haemophilus influenzae Rd
uucgaccaacggauu

SEQ ID NO: 2694637 - RNA, 23 nt, Haemophilus influenzae Rd
uucgaccguuuuuucuuuuuccu

SEQ ID NO: 2694638 - RNA, 22 nt, Haemophilus influenzae Rd
uucgagcgugaagauaugcucg

SEQ ID NO: 2694639 - RNA, 17 nt, Haemophilus influenzae Rd
uucgauacuuucuugcu

SEQ ID NO: 2694640 - RNA, 13 nt, Haemophilus influenzae Rd
uucgaucuaaucc

SEQ ID NO: 2694641 - RNA, 18 nt, Haemophilus influenzae Rd
uucgaucucugccauacu

SEQ ID NO: 2694642 - RNA, 22 nt, Haemophilus influenzae Rd
uucgauuuaacacuuuuucuau

SEQ ID NO: 2694643 - RNA, 17 nt, Haemophilus influenzae Rd
uucgauuucaucuucau

SEQ ID NO: 2694644 - RNA, 14 nt, Haemophilus influenzae Rd
uucgcaaucagcau

SEQ ID NO: 2694645 - RNA, 12 nt, Haemophilus influenzae Rd
uucgcacaaacu

SEQ ID NO: 2694646 - RNA, 13 nt, Haemophilus influenzae Rd
uucgcacaaacuc

SEQ ID NO: 2694647 - RNA, 20 nt, Haemophilus influenzae Rd
uucgcaccacgauauuucgc

SEQ ID NO: 2694648 - RNA, 22 nt, Haemophilus influenzae Rd
uucgcaggaauaucggcaagua

SEQ ID NO: 2694649 - RNA, 19 nt, Haemophilus influenzae Rd
uucgcauaaaaauuccagu

SEQ ID NO: 2694650 - RNA, 20 nt, Haemophilus influenzae Rd
uucgcauauuuuugcaagau

SEQ ID NO: 2694651 - RNA, 15 nt, Haemophilus influenzae Rd
uucgcauuuuaacuc

SEQ ID NO: 2694652 - RNA, 21 nt, Haemophilus influenzae Rd
uucgccacuggugcugaaaau

SEQ ID NO: 2694653 - RNA, 23 nt, Haemophilus influenzae Rd
uucgccagcaccacguucauaaa

SEQ ID NO: 2694654 - RNA, 16 nt, Haemophilus influenzae Rd
uucgccauuuuuaaaa

SEQ ID NO: 2694655 - RNA, 14 nt, Haemophilus influenzae Rd
uucgccgaguaaau

SEQ ID NO: 2694656 - RNA, 21 nt, Haemophilus influenzae Rd
uucgccgaguaaauucaccaa

SEQ ID NO: 2694657 - RNA, 14 nt, Haemophilus influenzae Rd
uucgccguuaguuu

SEQ ID NO: 2694658 - RNA, 22 nt, Haemophilus influenzae Rd
uucgccuaauucaauaucugca

SEQ ID NO: 2694659 - RNA, 14 nt, Haemophilus influenzae Rd
uucgccuucauaag

SEQ ID NO: 2694660 - RNA, 15 nt, Haemophilus influenzae Rd
uucgcguaauaacaa

SEQ ID NO: 2694661 - RNA, 21 nt, Haemophilus influenzae Rd
uucgcuaauuuuuuuccaauu

SEQ ID NO: 2694662 - RNA, 19 nt, Haemophilus influenzae Rd
uucgcuauguuuaaauauu

SEQ ID NO: 2694663 - RNA, 14 nt, Haemophilus influenzae Rd
uucgcuauuuucua

SEQ ID NO: 2694664 - RNA, 17 nt, Haemophilus influenzae Rd
uucgcuauuuucuaaug

SEQ ID NO: 2694665 - RNA, 14 nt, Haemophilus influenzae Rd
uucgcucaauaauu

SEQ ID NO: 2694666 - RNA, 13 nt, Haemophilus influenzae Rd
uucgcugcaaaau

SEQ ID NO: 2694667 - RNA, 15 nt, Haemophilus influenzae Rd
uucgcuuaaacgaau

SEQ ID NO: 2694668 - RNA, 19 nt, Haemophilus influenzae Rd
uucgcuucauuauauuccu

SEQ ID NO: 2694669 - RNA, 16 nt, Haemophilus influenzae Rd
uucgcuucuuuuaaug

SEQ ID NO: 2694670 - RNA, 21 nt, Haemophilus influenzae Rd
uucggacucgcuguaacauca

SEQ ID NO: 2694671 - RNA, 19 nt, Haemophilus influenzae Rd
uucggacuuugauaauaca

SEQ ID NO: 2694672 - RNA, 17 nt, Haemophilus influenzae Rd
uucggcgaugguaaaau

SEQ ID NO: 2694673 - RNA, 14 nt, Haemophilus influenzae Rd
uucgggcaccauuu

SEQ ID NO: 2694674 - RNA, 14 nt, Haemophilus influenzae Rd
uucgguuaaagaag

SEQ ID NO: 2694675 - RNA, 12 nt, Haemophilus influenzae Rd
uucguauuguug

SEQ ID NO: 2694676 - RNA, 14 nt, Haemophilus influenzae Rd
uucgucaauguuau

SEQ ID NO: 2694677 - RNA, 18 nt, Haemophilus influenzae Rd
uucgucaucuucauuaaa

SEQ ID NO: 2694678 - RNA, 16 nt, Haemophilus influenzae Rd
uucguccaaaaucucu

SEQ ID NO: 2694679 - RNA, 18 nt, Haemophilus influenzae Rd
uucguccaguuauaauaa

SEQ ID NO: 2694680 - RNA, 12 nt, Haemophilus influenzae Rd
uucgugauuuug

SEQ ID NO: 2694681 - RNA, 13 nt, Haemophilus influenzae Rd
uucgugcaauaac

SEQ ID NO: 2694682 - RNA, 15 nt, Haemophilus influenzae Rd
uucguuauaagccua

SEQ ID NO: 2694683 - RNA, 22 nt, Haemophilus influenzae Rd
uucguucaacccauuuuccauu

SEQ ID NO: 2694684 - RNA, 19 nt, Haemophilus influenzae Rd
uucguuguuuuaauaaaca

SEQ ID NO: 2694685 - RNA, 15 nt, Haemophilus influenzae Rd
uucguuuaaauuaaa

SEQ ID NO: 2694686 - RNA, 12 nt, Haemophilus influenzae Rd
uucguuucuugg

SEQ ID NO: 2694687 - RNA, 20 nt, Haemophilus influenzae Rd
uucguuugacagcaauauau

SEQ ID NO: 2694688 - RNA, 24 nt, Haemophilus influenzae Rd
uucguuuguuugaaaaauuaucaa

SEQ ID NO: 2694689 - RNA, 23 nt, Haemophilus influenzae Rd
uucuaaaaaaauccuaaauaaag

SEQ ID NO: 2694690 - RNA, 13 nt, Haemophilus influenzae Rd
uucuuuauucguu

SEQ ID NO: 2694691 - RNA, 14 nt, Haemophilus influenzae Rd
uucuuuauucguuu

SEQ ID NO: 2694692 - RNA, 18 nt, Haemophilus influenzae Rd
uucuuuccauuuuuuucu

SEQ ID NO: 2694693 - RNA, 17 nt, Haemophilus influenzae Rd
uucuuucguucaaccca

SEQ ID NO: 2694694 - RNA, 17 nt, Haemophilus influenzae Rd
uucuuuguuaccuuuuc

SEQ ID NO: 2694695 - RNA, 15 nt, Haemophilus influenzae Rd
uucuuuuaaaagacc

SEQ ID NO: 2694696 - RNA, 16 nt, Haemophilus influenzae Rd
uucuuuuaaauacagc

SEQ ID NO: 2694697 - RNA, 19 nt, Haemophilus influenzae Rd
uucuuuuauacuuacucaa

SEQ ID NO: 2694698 - RNA, 12 nt, Haemophilus influenzae Rd
uucuuuucuucu

SEQ ID NO: 2694699 - RNA, 14 nt, Haemophilus influenzae Rd
uucuuuugccauau

SEQ ID NO: 2694700 - RNA, 12 nt, Haemophilus influenzae Rd
uucuuuuggaua

SEQ ID NO: 2694701 - RNA, 19 nt, Haemophilus influenzae Rd
uucuuuugguaauaaauca

SEQ ID NO: 2694702 - RNA, 16 nt, Haemophilus influenzae Rd
uucuuuuuaaauauuu

SEQ ID NO: 2694703 - RNA, 14 nt, Haemophilus influenzae Rd
uucuuuuucaguuu

SEQ ID NO: 2694704 - RNA, 12 nt, Haemophilus influenzae Rd
uucuuuuuccug

SEQ ID NO: 2694705 - RNA, 14 nt, Haemophilus influenzae Rd
uucuuuuuccugaa

SEQ ID NO: 2694706 - RNA, 21 nt, Haemophilus influenzae Rd
uucuuuuuugcuuauuuuguu

SEQ ID NO: 2694707 - RNA, 10 nt, Haemophilus influenzae Rd
uugaaaaacu

SEQ ID NO: 2694708 - RNA, 22 nt, Haemophilus influenzae Rd
uugaaaaaguuagacuaugaaa

SEQ ID NO: 2694709 - RNA, 18 nt, Haemophilus influenzae Rd
uugaaaaauuauugcauu

SEQ ID NO: 2694710 - RNA, 22 nt, Haemophilus influenzae Rd
uugaaaagaaaguauuaaauau

SEQ ID NO: 2694711 - RNA, 16 nt, Haemophilus influenzae Rd
uugaaaagaaauauau

SEQ ID NO: 2694712 - RNA, 13 nt, Haemophilus influenzae Rd
uugaaaagaauuu

SEQ ID NO: 2694713 - RNA, 21 nt, Haemophilus influenzae Rd
uugaaaagcugauauaaaaau

SEQ ID NO: 2694714 - RNA, 21 nt, Haemophilus influenzae Rd
uugaaaauacagugucaaaug

SEQ ID NO: 2694715 - RNA, 17 nt, Haemophilus influenzae Rd
uugaaaaucucuauaau

SEQ ID NO: 2694716 - RNA, 14 nt, Haemophilus influenzae Rd
uugaaaauuauugu

SEQ ID NO: 2694717 - RNA, 19 nt, Haemophilus influenzae Rd
uugaaaauucuucuaacau

SEQ ID NO: 2694718 - RNA, 20 nt, Haemophilus influenzae Rd
uugaaaauucuucuaacauu

SEQ ID NO: 2694719 - RNA, 13 nt, Haemophilus influenzae Rd
uugaaacagguaa

SEQ ID NO: 2694720 - RNA, 20 nt, Haemophilus influenzae Rd
uugaaaccucccaaaaacua

SEQ ID NO: 2694721 - RNA, 22 nt, Haemophilus influenzae Rd
uugaaaccugaguaaauaaacg

SEQ ID NO: 2694722 - RNA, 15 nt, Haemophilus influenzae Rd
uugaaaccuuguaaa

SEQ ID NO: 2694723 - RNA, 13 nt, Haemophilus influenzae Rd
uugaaauugcgug

SEQ ID NO: 2694724 - RNA, 22 nt, Haemophilus influenzae Rd
uugaaauugucguccuucaaau

SEQ ID NO: 2694725 - RNA, 12 nt, Haemophilus influenzae Rd
uugaaauuuaug

SEQ ID NO: 2694726 - RNA, 17 nt, Haemophilus influenzae Rd
uugaacccauuaaccaa

SEQ ID NO: 2694727 - RNA, 16 nt, Haemophilus influenzae Rd
uugaacgcuauuaagc

SEQ ID NO: 2694728 - RNA, 14 nt, Haemophilus influenzae Rd
uugaacgucucaaa

SEQ ID NO: 2694729 - RNA, 15 nt, Haemophilus influenzae Rd
uugaacuaaaauauc

SEQ ID NO: 2694730 - RNA, 19 nt, Haemophilus influenzae Rd
uugaacuaauaucacuuug

SEQ ID NO: 2694731 - RNA, 12 nt, Haemophilus influenzae Rd
uugaagaaaguu

SEQ ID NO: 2694732 - RNA, 15 nt, Haemophilus influenzae Rd
uugaagccugacuca

SEQ ID NO: 2694733 - RNA, 22 nt, Haemophilus influenzae Rd
uugaaggucauacgaucuacau

SEQ ID NO: 2694734 - RNA, 15 nt, Haemophilus influenzae Rd
uugaaguacauucaa

SEQ ID NO: 2694735 - RNA, 18 nt, Haemophilus influenzae Rd
uugaaguacauucaagcc

SEQ ID NO: 2694736 - RNA, 15 nt, Haemophilus influenzae Rd
uugaagucuauaaaa

SEQ ID NO: 2694737 - RNA, 17 nt, Haemophilus influenzae Rd
uugaagucuauaaaaga

SEQ ID NO: 2694738 - RNA, 14 nt, Haemophilus influenzae Rd
uugaauaauaacgu

SEQ ID NO: 2694739 - RNA, 21 nt, Haemophilus influenzae Rd
uugaauaauggcuuuucucaa

SEQ ID NO: 2694740 - RNA, 19 nt, Haemophilus influenzae Rd
uugaauaauuacuugcucu

SEQ ID NO: 2694741 - RNA, 22 nt, Haemophilus influenzae Rd
uugaauagcaagaacaauuaau

SEQ ID NO: 2694742 - RNA, 16 nt, Haemophilus influenzae Rd
uugaauaguaaagaau

SEQ ID NO: 2694743 - RNA, 22 nt, Haemophilus influenzae Rd
uugaauaucaaggagcuaguuu

SEQ ID NO: 2694744 - RNA, 21 nt, Haemophilus influenzae Rd
uugaauaugauguggcuuuug

SEQ ID NO: 2694745 - RNA, 15 nt, Haemophilus influenzae Rd
uugaaucauuucauc

SEQ ID NO: 2694746 - RNA, 16 nt, Haemophilus influenzae Rd
uugaaucauuucaucu

SEQ ID NO: 2694747 - RNA, 23 nt, Haemophilus influenzae Rd
uugaaugcacuuucgcggaauuu

SEQ ID NO: 2694748 - RNA, 16 nt, Haemophilus influenzae Rd
uugaaugcuauucucu

SEQ ID NO: 2694749 - RNA, 21 nt, Haemophilus influenzae Rd
uugaauggcuaaagaaauacg

SEQ ID NO: 2694750 - RNA, 11 nt, Haemophilus influenzae Rd
uugaaugguug

SEQ ID NO: 2694751 - RNA, 16 nt, Haemophilus influenzae Rd
uugaauguaaaaauaa

SEQ ID NO: 2694752 - RNA, 19 nt, Haemophilus influenzae Rd
uugaaugucuuaaagauaa

SEQ ID NO: 2694753 - RNA, 15 nt, Haemophilus influenzae Rd
uugaauguuuuucau

SEQ ID NO: 2694754 - RNA, 14 nt, Haemophilus influenzae Rd
uugaauuaaaaaug

SEQ ID NO: 2694755 - RNA, 22 nt, Haemophilus influenzae Rd
uugaauugcauuuucuuccaau

SEQ ID NO: 2694756 - RNA, 19 nt, Haemophilus influenzae Rd
uugaauugcuuuaauuucu

SEQ ID NO: 2694757 - RNA, 23 nt, Haemophilus influenzae Rd
uugaauuggaaguuuuuccguug

SEQ ID NO: 2694758 - RNA, 19 nt, Haemophilus influenzae Rd
uugaauuuuacuucuucag

SEQ ID NO: 2694759 - RNA, 15 nt, Haemophilus influenzae Rd
uugacauaauuucac

SEQ ID NO: 2694760 - RNA, 13 nt, Haemophilus influenzae Rd
uugacauacuuug

SEQ ID NO: 2694761 - RNA, 14 nt, Haemophilus influenzae Rd
uugacauacuuugu

SEQ ID NO: 2694762 - RNA, 18 nt, Haemophilus influenzae Rd
uugacauacuuuguugaa

SEQ ID NO: 2694763 - RNA, 15 nt, Haemophilus influenzae Rd
uugacauauucuguu

SEQ ID NO: 2694764 - RNA, 15 nt, Haemophilus influenzae Rd
uugacauauuuucua

SEQ ID NO: 2694765 - RNA, 20 nt, Haemophilus influenzae Rd
uugaccaccgccaauacaaa

SEQ ID NO: 2694766 - RNA, 22 nt, Haemophilus influenzae Rd
uugaccgaaaaccgaaaaaaua

SEQ ID NO: 2694767 - RNA, 20 nt, Haemophilus influenzae Rd
uugaccgcuucauuaaaaga

SEQ ID NO: 2694768 - RNA, 19 nt, Haemophilus influenzae Rd
uugaccucguggcaaaaga

SEQ ID NO: 2694769 - RNA, 18 nt, Haemophilus influenzae Rd
uugacggcuucagaaaau

SEQ ID NO: 2694770 - RNA, 16 nt, Haemophilus influenzae Rd
uugacgguuuuuauua

SEQ ID NO: 2694771 - RNA, 12 nt, Haemophilus influenzae Rd
uugacugaaucg

SEQ ID NO: 2694772 - RNA, 15 nt, Haemophilus influenzae Rd
uugacuuaaaugaag

SEQ ID NO: 2694773 - RNA, 23 nt, Haemophilus influenzae Rd
uugacuuauuccagucuacacuu

SEQ ID NO: 2694774 - RNA, 21 nt, Haemophilus influenzae Rd
uugagaaaauguauaaagcau

SEQ ID NO: 2694775 - RNA, 14 nt, Haemophilus influenzae Rd
uugagaauuuuuuc

SEQ ID NO: 2694776 - RNA, 19 nt, Haemophilus influenzae Rd
uugagaauuuuuucuucaa

SEQ ID NO: 2694777 - RNA, 15 nt, Haemophilus influenzae Rd
uugagaucuuugcca

SEQ ID NO: 2694778 - RNA, 16 nt, Haemophilus influenzae Rd
uugagaucuuugccaa

SEQ ID NO: 2694779 - RNA, 22 nt, Haemophilus influenzae Rd
uugagauuuaauccguuaauuu

SEQ ID NO: 2694780 - RNA, 18 nt, Haemophilus influenzae Rd
uugagcaaaggcuguuuu

SEQ ID NO: 2694781 - RNA, 15 nt, Haemophilus influenzae Rd
uugagcaaaucaaaa

SEQ ID NO: 2694782 - RNA, 23 nt, Haemophilus influenzae Rd
uugagcaaaucaaaaccuuucug

SEQ ID NO: 2694783 - RNA, 20 nt, Haemophilus influenzae Rd
uugagcaagaacuugauaau

SEQ ID NO: 2694784 - RNA, 21 nt, Haemophilus influenzae Rd
uugagcauaaggaccaagcaa

SEQ ID NO: 2694785 - RNA, 21 nt, Haemophilus influenzae Rd
uugagcauuuuuuauuaaaaa

SEQ ID NO: 2694786 - RNA, 15 nt, Haemophilus influenzae Rd
uugagccaauaacuu

SEQ ID NO: 2694787 - RNA, 13 nt, Haemophilus influenzae Rd
uugagccugaauc

SEQ ID NO: 2694788 - RNA, 15 nt, Haemophilus influenzae Rd
uugagcucuaguaau

SEQ ID NO: 2694789 - RNA, 13 nt, Haemophilus influenzae Rd
uugaggacuuaaa

SEQ ID NO: 2694790 - RNA, 20 nt, Haemophilus influenzae Rd
uugaggggaauuuuuuacug

SEQ ID NO: 2694791 - RNA, 17 nt, Haemophilus influenzae Rd
uugagguaaaagugcgg

SEQ ID NO: 2694792 - RNA, 19 nt, Haemophilus influenzae Rd
uugaguaaaaaaucuagag

SEQ ID NO: 2694793 - RNA, 20 nt, Haemophilus influenzae Rd
uugaguagcugaauaucaga

SEQ ID NO: 2694794 - RNA, 19 nt, Haemophilus influenzae Rd
uugaguauaucgaauuaaa

SEQ ID NO: 2694795 - RNA, 19 nt, Haemophilus influenzae Rd
uugagugaauuucuugccg

SEQ ID NO: 2694796 - RNA, 22 nt, Haemophilus influenzae Rd
uugcaugauauuuuacguuuuu

SEQ ID NO: 2694797 - RNA, 24 nt, Haemophilus influenzae Rd
uugcauuaaagcgagaauaguuaa

SEQ ID NO: 2694798 - RNA, 18 nt, Haemophilus influenzae Rd
uugcauucacaaaaguuu

SEQ ID NO: 2694799 - RNA, 19 nt, Haemophilus influenzae Rd
uugcauucacaaaaguuug

SEQ ID NO: 2694800 - RNA, 15 nt, Haemophilus influenzae Rd
uugcauugaguuuuu

SEQ ID NO: 2694801 - RNA, 13 nt, Haemophilus influenzae Rd
uugcauuuaacuu

SEQ ID NO: 2694802 - RNA, 15 nt, Haemophilus influenzae Rd
uugcauuuacauaaa

SEQ ID NO: 2694803 - RNA, 13 nt, Haemophilus influenzae Rd
uugcauuucuaaa

SEQ ID NO: 2694804 - RNA, 16 nt, Haemophilus influenzae Rd
uugccaaaauucuguu

SEQ ID NO: 2694805 - RNA, 21 nt, Haemophilus influenzae Rd
uugccaacgcagguacacguu

SEQ ID NO: 2694806 - RNA, 15 nt, Haemophilus influenzae Rd
uugccaaugccaaau

SEQ ID NO: 2694807 - RNA, 22 nt, Haemophilus influenzae Rd
uugccaauuauccgagagaaag

SEQ ID NO: 2694808 - RNA, 14 nt, Haemophilus influenzae Rd
uugccaauuccuug

SEQ ID NO: 2694809 - RNA, 18 nt, Haemophilus influenzae Rd
uugccaauugaauuaaaa

SEQ ID NO: 2694810 - RNA, 22 nt, Haemophilus influenzae Rd
uugccaauuuuuucugaauaaa

SEQ ID NO: 2694811 - RNA, 17 nt, Haemophilus influenzae Rd
uugccacgccaaagcca

SEQ ID NO: 2694812 - RNA, 13 nt, Haemophilus influenzae Rd
uugccagauuuuu

SEQ ID NO: 2694813 - RNA, 14 nt, Haemophilus influenzae Rd
uugccaguaacuuu

SEQ ID NO: 2694814 - RNA, 15 nt, Haemophilus influenzae Rd
uugccaguaacuuuc

SEQ ID NO: 2694815 - RNA, 18 nt, Haemophilus influenzae Rd
uugccauauuuaauaagg

SEQ ID NO: 2694816 - RNA, 22 nt, Haemophilus influenzae Rd
uugccaucacucaauuuacaca

SEQ ID NO: 2694817 - RNA, 14 nt, Haemophilus influenzae Rd
uugccauuugcuuc

SEQ ID NO: 2694818 - RNA, 15 nt, Haemophilus influenzae Rd
uugccauuugcuucu

SEQ ID NO: 2694819 - RNA, 15 nt, Haemophilus influenzae Rd
uugccauuuugcuau

SEQ ID NO: 2694820 - RNA, 20 nt, Haemophilus influenzae Rd
uugcccacgcacuuuuccaa

SEQ ID NO: 2694821 - RNA, 22 nt, Haemophilus influenzae Rd
uugcccgcuucuucgauaaaau

SEQ ID NO: 2694822 - RNA, 21 nt, Haemophilus influenzae Rd
uugccgcagguucgccacugg

SEQ ID NO: 2694823 - RNA, 16 nt, Haemophilus influenzae Rd
uugccgccaaaaugag

SEQ ID NO: 2694824 - RNA, 22 nt, Haemophilus influenzae Rd
uugccgcuuccacaccaaaaau

SEQ ID NO: 2694825 - RNA, 20 nt, Haemophilus influenzae Rd
uugccuaauagaaaaaugcc

SEQ ID NO: 2694826 - RNA, 23 nt, Haemophilus influenzae Rd
uugccucgcaugcggaauaauuu

SEQ ID NO: 2694827 - RNA, 13 nt, Haemophilus influenzae Rd
uugccucuucuuu

SEQ ID NO: 2694828 - RNA, 13 nt, Haemophilus influenzae Rd
uugccuugugacu

SEQ ID NO: 2694829 - RNA, 18 nt, Haemophilus influenzae Rd
uugccuuucaucauugcu

SEQ ID NO: 2694830 - RNA, 18 nt, Haemophilus influenzae Rd
uugcgagucaaauuuuua

SEQ ID NO: 2694831 - RNA, 17 nt, Haemophilus influenzae Rd
uugcgauauugaccauu

SEQ ID NO: 2694832 - RNA, 17 nt, Haemophilus influenzae Rd
uugcgcauuuaauacug

SEQ ID NO: 2694833 - RNA, 18 nt, Haemophilus influenzae Rd
uugcgccuaaaccaaaac

SEQ ID NO: 2694834 - RNA, 22 nt, Haemophilus influenzae Rd
uugcggaaacauaucaaaaagu

SEQ ID NO: 2694835 - RNA, 14 nt, Haemophilus influenzae Rd
uugcguaauguuua

SEQ ID NO: 2694836 - RNA, 16 nt, Haemophilus influenzae Rd
uugcguaucacuuaaa

SEQ ID NO: 2694837 - RNA, 17 nt, Haemophilus influenzae Rd
uugcguaucacuuaaac

SEQ ID NO: 2694838 - RNA, 13 nt, Haemophilus influenzae Rd
uugcgucuucaag

SEQ ID NO: 2694839 - RNA, 21 nt, Haemophilus influenzae Rd
uugcuaaaucaccuaaaucuu

SEQ ID NO: 2694840 - RNA, 14 nt, Haemophilus influenzae Rd
uugcuaaauuuauu

SEQ ID NO: 2694841 - RNA, 20 nt, Haemophilus influenzae Rd
uugcuaauuuauccaauacu

SEQ ID NO: 2694842 - RNA, 17 nt, Haemophilus influenzae Rd
uugcuacagcaaauccu

SEQ ID NO: 2694843 - RNA, 19 nt, Haemophilus influenzae Rd
uugcuaguaagauuuugac

SEQ ID NO: 2694844 - RNA, 21 nt, Haemophilus influenzae Rd
uugcuauccaaccuaauaacg

SEQ ID NO: 2694845 - RNA, 13 nt, Haemophilus influenzae Rd
uugcuauuuucua

SEQ ID NO: 2694846 - RNA, 23 nt, Haemophilus influenzae Rd
uugcucaaaaucaaguuaaaaaa

SEQ ID NO: 2694847 - RNA, 17 nt, Haemophilus influenzae Rd
uugcucaauaauuucaa

SEQ ID NO: 2694848 - RNA, 23 nt, Haemophilus influenzae Rd
uugcucacguaaccguucuaguu

SEQ ID NO: 2694849 - RNA, 17 nt, Haemophilus influenzae Rd
uugcucacuaauucccc

SEQ ID NO: 2694850 - RNA, 19 nt, Haemophilus influenzae Rd
uugcucagccaguuuucua

SEQ ID NO: 2694851 - RNA, 14 nt, Haemophilus influenzae Rd
uugcuccuccuaau

SEQ ID NO: 2694852 - RNA, 22 nt, Haemophilus influenzae Rd
uugcucgugcaggauaaagguu

SEQ ID NO: 2694853 - RNA, 20 nt, Haemophilus influenzae Rd
uugcucguuauuauuaagug

SEQ ID NO: 2694854 - RNA, 21 nt, Haemophilus influenzae Rd
uugcucuaaaugugauuucca

SEQ ID NO: 2694855 - RNA, 17 nt, Haemophilus influenzae Rd
uugcucuaauuuuacca

SEQ ID NO: 2694856 - RNA, 13 nt, Haemophilus influenzae Rd
uugcucugacacu

SEQ ID NO: 2694857 - RNA, 16 nt, Haemophilus influenzae Rd
uugcucugccacggcu

SEQ ID NO: 2694858 - RNA, 16 nt, Haemophilus influenzae Rd
uugcucuuuaacaaua

SEQ ID NO: 2694859 - RNA, 14 nt, Haemophilus influenzae Rd
uugcucuuuuucca

SEQ ID NO: 2694860 - RNA, 16 nt, Haemophilus influenzae Rd
uugcugacaauuucua

SEQ ID NO: 2694861 - RNA, 22 nt, Haemophilus influenzae Rd
uugcugacaauuucuaaaaauc

SEQ ID NO: 2694862 - RNA, 23 nt, Haemophilus influenzae Rd
uugcugacaauuucuaaaaaucu

SEQ ID NO: 2694863 - RNA, 13 nt, Haemophilus influenzae Rd
uugcugauaaauu

SEQ ID NO: 2694864 - RNA, 15 nt, Haemophilus influenzae Rd
uugcugccacaagau

SEQ ID NO: 2694865 - RNA, 19 nt, Haemophilus influenzae Rd
uugcugccacuucagcuaa

SEQ ID NO: 2694866 - RNA, 14 nt, Haemophilus influenzae Rd
uugcugcuuuaauu

SEQ ID NO: 2694867 - RNA, 20 nt, Haemophilus influenzae Rd
uugcugugcgaccugaagau

SEQ ID NO: 2694868 - RNA, 20 nt, Haemophilus influenzae Rd
uugcuguggaguuauuucuu

SEQ ID NO: 2694869 - RNA, 17 nt, Haemophilus influenzae Rd
uugcuguugguuaaaaa

SEQ ID NO: 2694870 - RNA, 14 nt, Haemophilus influenzae Rd
uugcuuaacauuaa

SEQ ID NO: 2694871 - RNA, 15 nt, Haemophilus influenzae Rd
uugcuuagugaaaag

SEQ ID NO: 2694872 - RNA, 17 nt, Haemophilus influenzae Rd
uugcuuagugaaaagaa

SEQ ID NO: 2694873 - RNA, 14 nt, Haemophilus influenzae Rd
uugcuucaauuuga

SEQ ID NO: 2694874 - RNA, 15 nt, Haemophilus influenzae Rd
uugcuugaucaucca

SEQ ID NO: 2694875 - RNA, 13 nt, Haemophilus influenzae Rd
uugcuuguaaaaa

SEQ ID NO: 2694876 - RNA, 13 nt, Haemophilus influenzae Rd
uugcuuuuuaauu

SEQ ID NO: 2694877 - RNA, 21 nt, Haemophilus influenzae Rd
uuggaaaagccuuaaccugca

SEQ ID NO: 2694878 - RNA, 19 nt, Haemophilus influenzae Rd
uuggaaaggcacugcgggu

SEQ ID NO: 2694879 - RNA, 18 nt, Haemophilus influenzae Rd
uuggaaauuaacaauacg

SEQ ID NO: 2694880 - RNA, 14 nt, Haemophilus influenzae Rd
uuggaagaauguuu

SEQ ID NO: 2694881 - RNA, 16 nt, Haemophilus influenzae Rd
uuggaaugguauaaaa

SEQ ID NO: 2694882 - RNA, 17 nt, Haemophilus influenzae Rd
uuggaauugugcuaaau

SEQ ID NO: 2694883 - RNA, 16 nt, Haemophilus influenzae Rd
uuggacaagaaauaau

SEQ ID NO: 2694884 - RNA, 17 nt, Haemophilus influenzae Rd
uuggacaagaaauaaua

SEQ ID NO: 2694885 - RNA, 15 nt, Haemophilus influenzae Rd
uuggacacaauaaua

SEQ ID NO: 2694886 - RNA, 14 nt, Haemophilus influenzae Rd
uuggagauuuuuua

SEQ ID NO: 2694887 - RNA, 13 nt, Haemophilus influenzae Rd
uuggaguuagaau

SEQ ID NO: 2694888 - RNA, 19 nt, Haemophilus influenzae Rd
uuggaguucuugaauacaa

SEQ ID NO: 2694889 - RNA, 20 nt, Haemophilus influenzae Rd
uuggaguucuugaauacaaa

SEQ ID NO: 2694890 - RNA, 16 nt, Haemophilus influenzae Rd
uuggauaacaaauugc

SEQ ID NO: 2694891 - RNA, 20 nt, Haemophilus influenzae Rd
uuggauaacaaauugcuucu

SEQ ID NO: 2694892 - RNA, 16 nt, Haemophilus influenzae Rd
uuggauaauugccacu

SEQ ID NO: 2694893 - RNA, 19 nt, Haemophilus influenzae Rd
uuggauacguuuuguuaau

SEQ ID NO: 2694894 - RNA, 14 nt, Haemophilus influenzae Rd
uuggauaucuuguu

SEQ ID NO: 2694895 - RNA, 17 nt, Haemophilus influenzae Rd
uuggauaucuuguugau

SEQ ID NO: 2694896 - RNA, 16 nt, Haemophilus influenzae Rd
uuggaucuaagauacc

SEQ ID NO: 2694897 - RNA, 23 nt, Haemophilus influenzae Rd
uuggauuaagaaucuuacgaaga

SEQ ID NO: 2694898 - RNA, 22 nt, Haemophilus influenzae Rd
uuggcaaacucuugugccaaau

SEQ ID NO: 2694899 - RNA, 22 nt, Haemophilus influenzae Rd
uuggcauaaaauuauaagauaa

SEQ ID NO: 2694900 - RNA, 11 nt, Haemophilus influenzae Rd
uuggcauuuug

SEQ ID NO: 2694901 - RNA, 19 nt, Haemophilus influenzae Rd
uugugcuguguuuuguaau

SEQ ID NO: 2694902 - RNA, 19 nt, Haemophilus influenzae Rd
uuguggaaacgugcaauua

SEQ ID NO: 2694903 - RNA, 15 nt, Haemophilus influenzae Rd
uuguggaauaaaaua

SEQ ID NO: 2694904 - RNA, 17 nt, Haemophilus influenzae Rd
uuguggaauaaaauaau

SEQ ID NO: 2694905 - RNA, 11 nt, Haemophilus influenzae Rd
uugugggaauu

SEQ ID NO: 2694906 - RNA, 19 nt, Haemophilus influenzae Rd
uugugguaauuuauuuaca

SEQ ID NO: 2694907 - RNA, 14 nt, Haemophilus influenzae Rd
uugugguauugauu

SEQ ID NO: 2694908 - RNA, 20 nt, Haemophilus influenzae Rd
uuguguaacagcucuguaaa

SEQ ID NO: 2694909 - RNA, 14 nt, Haemophilus influenzae Rd
uuguguauuaagua

SEQ ID NO: 2694910 - RNA, 19 nt, Haemophilus influenzae Rd
uugugucacuagauuuucu

SEQ ID NO: 2694911 - RNA, 22 nt, Haemophilus influenzae Rd
uugugucuaccgauuccaccac

SEQ ID NO: 2694912 - RNA, 18 nt, Haemophilus influenzae Rd
uugugugcagaauuugga

SEQ ID NO: 2694913 - RNA, 19 nt, Haemophilus influenzae Rd
uuguguuucaacaaaaaua

SEQ ID NO: 2694914 - RNA, 12 nt, Haemophilus influenzae Rd
uuguuaaaacgc

SEQ ID NO: 2694915 - RNA, 14 nt, Haemophilus influenzae Rd
uuguuacuaaaaua

SEQ ID NO: 2694916 - RNA, 15 nt, Haemophilus influenzae Rd
uuguuacuaaaauaa

SEQ ID NO: 2694917 - RNA, 19 nt, Haemophilus influenzae Rd
uuguuacucgcaucaauau

SEQ ID NO: 2694918 - RNA, 17 nt, Haemophilus influenzae Rd
uuguuauagaaaauauc

SEQ ID NO: 2694919 - RNA, 16 nt, Haemophilus influenzae Rd
uuguuaucuaaauaau

SEQ ID NO: 2694920 - RNA, 15 nt, Haemophilus influenzae Rd
uuguuaugaaauugc

SEQ ID NO: 2694921 - RNA, 18 nt, Haemophilus influenzae Rd
uuguucaaguuguuugau

SEQ ID NO: 2694922 - RNA, 15 nt, Haemophilus influenzae Rd
uuguucaauaauauu

SEQ ID NO: 2694923 - RNA, 21 nt, Haemophilus influenzae Rd
uuguucaauaucucgugaugc

SEQ ID NO: 2694924 - RNA, 18 nt, Haemophilus influenzae Rd
uuguucaggugucaucac

SEQ ID NO: 2694925 - RNA, 13 nt, Haemophilus influenzae Rd
uuguuccacauua

SEQ ID NO: 2694926 - RNA, 17 nt, Haemophilus influenzae Rd
uuguuccacgagaaaag

SEQ ID NO: 2694927 - RNA, 23 nt, Haemophilus influenzae Rd
uuguuccacuucauaaauccaau

SEQ ID NO: 2694928 - RNA, 18 nt, Haemophilus influenzae Rd
uuguucgaacguuucaaa

SEQ ID NO: 2694929 - RNA, 18 nt, Haemophilus influenzae Rd
uuguucuaagaaaguuuu

SEQ ID NO: 2694930 - RNA, 15 nt, Haemophilus influenzae Rd
uuguucuacugguuu

SEQ ID NO: 2694931 - RNA, 17 nt, Haemophilus influenzae Rd
uuguucugacacuuccc

SEQ ID NO: 2694932 - RNA, 23 nt, Haemophilus influenzae Rd
uuguucuucggguuuauguaaau

SEQ ID NO: 2694933 - RNA, 16 nt, Haemophilus influenzae Rd
uuguugagcaauccaa

SEQ ID NO: 2694934 - RNA, 13 nt, Haemophilus influenzae Rd
uuguugaucugca

SEQ ID NO: 2694935 - RNA, 17 nt, Haemophilus influenzae Rd
uuguugauuuugguucg

SEQ ID NO: 2694936 - RNA, 14 nt, Haemophilus influenzae Rd
uuguugcacauuaa

SEQ ID NO: 2694937 - RNA, 20 nt, Haemophilus influenzae Rd
uuguugcacauuaauuugug

SEQ ID NO: 2694938 - RNA, 15 nt, Haemophilus influenzae Rd
uuguugcacccauuu

SEQ ID NO: 2694939 - RNA, 15 nt, Haemophilus influenzae Rd
uuguugcuuggucaa

SEQ ID NO: 2694940 - RNA, 16 nt, Haemophilus influenzae Rd
uuguuggaaaaaugcu

SEQ ID NO: 2694941 - RNA, 21 nt, Haemophilus influenzae Rd
uuguuggcggaauuauguauu

SEQ ID NO: 2694942 - RNA, 12 nt, Haemophilus influenzae Rd
uuguuguuugcu

SEQ ID NO: 2694943 - RNA, 12 nt, Haemophilus influenzae Rd
uuguuuaaagaa

SEQ ID NO: 2694944 - RNA, 22 nt, Haemophilus influenzae Rd
uuguuuacccacuucuucaagu

SEQ ID NO: 2694945 - RNA, 13 nt, Haemophilus influenzae Rd
uuguuuauaacgu

SEQ ID NO: 2694946 - RNA, 19 nt, Haemophilus influenzae Rd
uuguuucauaaaaaaugcu

SEQ ID NO: 2694947 - RNA, 19 nt, Haemophilus influenzae Rd
uuguuuccaaguauuuucu

SEQ ID NO: 2694948 - RNA, 20 nt, Haemophilus influenzae Rd
uuguuucgcacaauucucau

SEQ ID NO: 2694949 - RNA, 12 nt, Haemophilus influenzae Rd
uuguuucuaaau

SEQ ID NO: 2694950 - RNA, 13 nt, Haemophilus influenzae Rd
uuguuucuaaauu

SEQ ID NO: 2694951 - RNA, 17 nt, Haemophilus influenzae Rd
uuguuucuaauuuuuca

SEQ ID NO: 2694952 - RNA, 19 nt, Haemophilus influenzae Rd
uuguuucuaauuuuucacu

SEQ ID NO: 2694953 - RNA, 12 nt, Haemophilus influenzae Rd
uuguuucucaau

SEQ ID NO: 2694954 - RNA, 20 nt, Haemophilus influenzae Rd
uuguuugcguucaauaugca

SEQ ID NO: 2694955 - RNA, 22 nt, Haemophilus influenzae Rd
uuguuugcguucaauaugcaaa

SEQ ID NO: 2694956 - RNA, 11 nt, Haemophilus influenzae Rd
uuguuuuaaaa

SEQ ID NO: 2694957 - RNA, 14 nt, Haemophilus influenzae Rd
uuguuuuaaaacua

SEQ ID NO: 2694958 - RNA, 13 nt, Haemophilus influenzae Rd
uuguuuuaaaauu

SEQ ID NO: 2694959 - RNA, 17 nt, Haemophilus influenzae Rd
uuguuuuaauaaacaua

SEQ ID NO: 2694960 - RNA, 15 nt, Haemophilus influenzae Rd
uuguuuuaauaucau

SEQ ID NO: 2694961 - RNA, 15 nt, Haemophilus influenzae Rd
uuguuuuacuucauc

SEQ ID NO: 2694962 - RNA, 21 nt, Haemophilus influenzae Rd
uuguuuuacuugaccagagcc

SEQ ID NO: 2694963 - RNA, 17 nt, Haemophilus influenzae Rd
uuguuuucaauaguuuu

SEQ ID NO: 2694964 - RNA, 14 nt, Haemophilus influenzae Rd
uuguuuuucugcuu

SEQ ID NO: 2694965 - RNA, 18 nt, Haemophilus influenzae Rd
uuguuuuugccaaaauuc

SEQ ID NO: 2694966 - RNA, 21 nt, Haemophilus influenzae Rd
uuguuuuugcuuucagauuca

SEQ ID NO: 2694967 - RNA, 14 nt, Haemophilus influenzae Rd
uuguuuuuucuauu

SEQ ID NO: 2694968 - RNA, 15 nt, Haemophilus influenzae Rd
uuguuuuuuucuaaa

SEQ ID NO: 2694969 - RNA, 15 nt, Haemophilus influenzae Rd
uuuaaaaaaacguua

SEQ ID NO: 2694970 - RNA, 19 nt, Haemophilus influenzae Rd
uuuaaaaaaacguuaaauu

SEQ ID NO: 2694971 - RNA, 17 nt, Haemophilus influenzae Rd
uuuaaaaaguaguauca

SEQ ID NO: 2694972 - RNA, 18 nt, Haemophilus influenzae Rd
uuuaaaaaguaguaucag

SEQ ID NO: 2694973 - RNA, 12 nt, Haemophilus influenzae Rd
uuuaaaaauaaa

SEQ ID NO: 2694974 - RNA, 18 nt, Haemophilus influenzae Rd
uuuaaaaauauuaagcaa

SEQ ID NO: 2694975 - RNA, 17 nt, Haemophilus influenzae Rd
uuuaaaacaaaaggccu

SEQ ID NO: 2694976 - RNA, 22 nt, Haemophilus influenzae Rd
uuuaaaacaugaauaucaucag

SEQ ID NO: 2694977 - RNA, 23 nt, Haemophilus influenzae Rd
uuuaaaacgcgcauuaaacugga

SEQ ID NO: 2694978 - RNA, 20 nt, Haemophilus influenzae Rd
uuuaaaacuauuuuuaauuu

SEQ ID NO: 2694979 - RNA, 14 nt, Haemophilus influenzae Rd
uuuaaaagauacua

SEQ ID NO: 2694980 - RNA, 23 nt, Haemophilus influenzae Rd
uuuaaaaguaaaaauaaaaacau

SEQ ID NO: 2694981 - RNA, 11 nt, Haemophilus influenzae Rd
uuuaaaaguuu

SEQ ID NO: 2694982 - RNA, 19 nt, Haemophilus influenzae Rd
uuuaaaauagaaugaaaaa

SEQ ID NO: 2694983 - RNA, 17 nt, Haemophilus influenzae Rd
uuuaaaaucaucuaauu

SEQ ID NO: 2694984 - RNA, 18 nt, Haemophilus influenzae Rd
uuuaaaaucaucuaauug

SEQ ID NO: 2694985 - RNA, 13 nt, Haemophilus influenzae Rd
uuuaaaaucccuc

SEQ ID NO: 2694986 - RNA, 12 nt, Haemophilus influenzae Rd
uuuaaaaucgcu

SEQ ID NO: 2694987 - RNA, 13 nt, Haemophilus influenzae Rd
uuuaaaauuauaa

SEQ ID NO: 2694988 - RNA, 16 nt, Haemophilus influenzae Rd
uuuaaacaccaauuca

SEQ ID NO: 2694989 - RNA, 21 nt, Haemophilus influenzae Rd
uuuaaacaucgcuucaucauc

SEQ ID NO: 2694990 - RNA, 19 nt, Haemophilus influenzae Rd
uuuaaaccauuuuaaucau

SEQ ID NO: 2694991 - RNA, 15 nt, Haemophilus influenzae Rd
uuuaaacguuuauuu

SEQ ID NO: 2694992 - RNA, 13 nt, Haemophilus influenzae Rd
uuuaaagaaauaa

SEQ ID NO: 2694993 - RNA, 21 nt, Haemophilus influenzae Rd
uuuaaagcaacugaaauauga

SEQ ID NO: 2694994 - RNA, 15 nt, Haemophilus influenzae Rd
uuuaaaggacuaaau

SEQ ID NO: 2694995 - RNA, 16 nt, Haemophilus influenzae Rd
uuuaaaggacuaaauu

SEQ ID NO: 2694996 - RNA, 15 nt, Haemophilus influenzae Rd
uuuaaaguaauagcg

SEQ ID NO: 2694997 - RNA, 13 nt, Haemophilus influenzae Rd
uuuaaauaaaaaa

SEQ ID NO: 2694998 - RNA, 15 nt, Haemophilus influenzae Rd
uuuaaauaaaaaaua

SEQ ID NO: 2694999 - RNA, 22 nt, Haemophilus influenzae Rd
uuuaaauaaaacacaguuauuu

SEQ ID NO: 2695000 - RNA, 23 nt, Haemophilus influenzae Rd
uuuaaauaaaacacaguuauuuu

SEQ ID NO: 2695001 - RNA, 19 nt, Haemophilus influenzae Rd
uuuaaauaaaauaacaaaa

SEQ ID NO: 2695002 - RNA, 15 nt, Haemophilus influenzae Rd
uuuaaauaaaauauu

SEQ ID NO: 2695003 - RNA, 14 nt, Haemophilus influenzae Rd
uuuaaauaaagcau

SEQ ID NO: 2695004 - RNA, 13 nt, Haemophilus influenzae Rd
uuuaaauaaauaa

SEQ ID NO: 2695005 - RNA, 15 nt, Haemophilus influenzae Rd
uuuaaauaaauaaua

SEQ ID NO: 2695006 - RNA, 22 nt, Haemophilus influenzae Rd
uuuaaauaauuagccuagauau

SEQ ID NO: 2695007 - RNA, 18 nt, Haemophilus influenzae Rd
uuuacaccaacggcauuu

SEQ ID NO: 2695008 - RNA, 13 nt, Haemophilus influenzae Rd
uuuacagauaaau

SEQ ID NO: 2695009 - RNA, 17 nt, Haemophilus influenzae Rd
uuuacagguugccagcc

SEQ ID NO: 2695010 - RNA, 19 nt, Haemophilus influenzae Rd
uuuacagguuugacauuca

SEQ ID NO: 2695011 - RNA, 16 nt, Haemophilus influenzae Rd
uuuacaucaauuguga

SEQ ID NO: 2695012 - RNA, 17 nt, Haemophilus influenzae Rd
uuuacaucuugcguuaa

SEQ ID NO: 2695013 - RNA, 19 nt, Haemophilus influenzae Rd
uuuacauuuggcaaaauaa

SEQ ID NO: 2695014 - RNA, 13 nt, Haemophilus influenzae Rd
uuuaccaaaaaau

SEQ ID NO: 2695015 - RNA, 23 nt, Haemophilus influenzae Rd
uuuaccaaauagggaugcuaauu

SEQ ID NO: 2695016 - RNA, 17 nt, Haemophilus influenzae Rd
uuuacccaagccaauua

SEQ ID NO: 2695017 - RNA, 15 nt, Haemophilus influenzae Rd
uuuacccacuucaua

SEQ ID NO: 2695018 - RNA, 17 nt, Haemophilus influenzae Rd
uuuacccacuucauaua

SEQ ID NO: 2695019 - RNA, 20 nt, Haemophilus influenzae Rd
uuuacccgugccaauugccc

SEQ ID NO: 2695020 - RNA, 20 nt, Haemophilus influenzae Rd
uuuacccuauuacuuuccau

SEQ ID NO: 2695021 - RNA, 16 nt, Haemophilus influenzae Rd
uuuaccgaaagaggca

SEQ ID NO: 2695022 - RNA, 16 nt, Haemophilus influenzae Rd
uuuaccgaaguaagau

SEQ ID NO: 2695023 - RNA, 19 nt, Haemophilus influenzae Rd
uuuaccucgccauuuugag

SEQ ID NO: 2695024 - RNA, 23 nt, Haemophilus influenzae Rd
uuuaccugaacguucacguaagu

SEQ ID NO: 2695025 - RNA, 19 nt, Haemophilus influenzae Rd
uuuaccuucagcacuuaau

SEQ ID NO: 2695026 - RNA, 17 nt, Haemophilus influenzae Rd
uuuaccuugcauuucuu

SEQ ID NO: 2695027 - RNA, 14 nt, Haemophilus influenzae Rd
uuuaccuuuuaauu

SEQ ID NO: 2695028 - RNA, 16 nt, Haemophilus influenzae Rd
uuuacgaacuaauaag

SEQ ID NO: 2695029 - RNA, 23 nt, Haemophilus influenzae Rd
uuuacgacuaaaacgaacaaucg

SEQ ID NO: 2695030 - RNA, 13 nt, Haemophilus influenzae Rd
uuuacgauuaacu

SEQ ID NO: 2695031 - RNA, 20 nt, Haemophilus influenzae Rd
uuuacgccccuacuuuaaag

SEQ ID NO: 2695032 - RNA, 16 nt, Haemophilus influenzae Rd
uuuacgguuaagucau

SEQ ID NO: 2695033 - RNA, 13 nt, Haemophilus influenzae Rd
uuuacguaauaag

SEQ ID NO: 2695034 - RNA, 19 nt, Haemophilus influenzae Rd
uuuacguaauguaccacgg

SEQ ID NO: 2695035 - RNA, 17 nt, Haemophilus influenzae Rd
uuuacguaguacaucau

SEQ ID NO: 2695036 - RNA, 19 nt, Haemophilus influenzae Rd
uuuacgugcgaauuuuuau

SEQ ID NO: 2695037 - RNA, 15 nt, Haemophilus influenzae Rd
uuuacguuucauuuu

SEQ ID NO: 2695038 - RNA, 18 nt, Haemophilus influenzae Rd
uuuacguuuuaaauuaau

SEQ ID NO: 2695039 - RNA, 22 nt, Haemophilus influenzae Rd
uuuacuaaacguaacuaaaaaa

SEQ ID NO: 2695040 - RNA, 20 nt, Haemophilus influenzae Rd
uuuacuaaaugcuguagaaa

SEQ ID NO: 2695041 - RNA, 14 nt, Haemophilus influenzae Rd
uuuacuacguaaag

SEQ ID NO: 2695042 - RNA, 22 nt, Haemophilus influenzae Rd
uuuacuauuaaaguguggauuu

SEQ ID NO: 2695043 - RNA, 17 nt, Haemophilus influenzae Rd
uuuacuauuaauucucu

SEQ ID NO: 2695044 - RNA, 16 nt, Haemophilus influenzae Rd
uuuacuauucuucaau

SEQ ID NO: 2695045 - RNA, 15 nt, Haemophilus influenzae Rd
uuuacucguauaagc

SEQ ID NO: 2695046 - RNA, 22 nt, Haemophilus influenzae Rd
uuuacucguccaaauucauuuu

SEQ ID NO: 2695047 - RNA, 15 nt, Haemophilus influenzae Rd
uuuacugauucuucg

SEQ ID NO: 2695048 - RNA, 12 nt, Haemophilus influenzae Rd
uuuacugauuua

SEQ ID NO: 2695049 - RNA, 18 nt, Haemophilus influenzae Rd
uuuacuggaaauucuuca

SEQ ID NO: 2695050 - RNA, 22 nt, Haemophilus influenzae Rd
uuuacuuaaagcaccgcauuaa

SEQ ID NO: 2695051 - RNA, 12 nt, Haemophilus influenzae Rd
uuuacuuaaauc

SEQ ID NO: 2695052 - RNA, 11 nt, Haemophilus influenzae Rd
uuuacuucauc

SEQ ID NO: 2695053 - RNA, 13 nt, Haemophilus influenzae Rd
uuuacuucuucag

SEQ ID NO: 2695054 - RNA, 13 nt, Haemophilus influenzae Rd
uuuacuugaccag

SEQ ID NO: 2695055 - RNA, 21 nt, Haemophilus influenzae Rd
uuuacuuggaauaucaucuag

SEQ ID NO: 2695056 - RNA, 21 nt, Haemophilus influenzae Rd
uuuacuuggcaaaugggugcu

SEQ ID NO: 2695057 - RNA, 14 nt, Haemophilus influenzae Rd
uuuacuuggcauuu

SEQ ID NO: 2695058 - RNA, 22 nt, Haemophilus influenzae Rd
uuuacuuggcauuucaagcugg

SEQ ID NO: 2695059 - RNA, 15 nt, Haemophilus influenzae Rd
uuuacuuuauuuaac

SEQ ID NO: 2695060 - RNA, 15 nt, Haemophilus influenzae Rd
uuuacuuuuacaauc

SEQ ID NO: 2695061 - RNA, 23 nt, Haemophilus influenzae Rd
uuuacuuuugauuuuauuuacuu

SEQ ID NO: 2695062 - RNA, 13 nt, Haemophilus influenzae Rd
uuuacuuuuucca

SEQ ID NO: 2695063 - RNA, 21 nt, Haemophilus influenzae Rd
uuuacuuuuuccauaauaacg

SEQ ID NO: 2695064 - RNA, 19 nt, Haemophilus influenzae Rd
uuuagaaaaagaaaaccug

SEQ ID NO: 2695065 - RNA, 15 nt, Haemophilus influenzae Rd
uuuagaacaauauuu

SEQ ID NO: 2695066 - RNA, 16 nt, Haemophilus influenzae Rd
uuuagaacaauauuua

SEQ ID NO: 2695067 - RNA, 19 nt, Haemophilus influenzae Rd
uuuagaacaauauuuauaa

SEQ ID NO: 2695068 - RNA, 13 nt, Haemophilus influenzae Rd
uuuagaauuuuua

SEQ ID NO: 2695069 - RNA, 21 nt, Haemophilus influenzae Rd
uuuagacaacaacuuuucuaa

SEQ ID NO: 2695070 - RNA, 23 nt, Haemophilus influenzae Rd
uuuagaggcuaugauuuuaaagc

SEQ ID NO: 2695071 - RNA, 19 nt, Haemophilus influenzae Rd
uuuagauaauaaaaaaaca

SEQ ID NO: 2695072 - RNA, 13 nt, Haemophilus influenzae Rd
uuuagauacaaaa

SEQ ID NO: 2695073 - RNA, 15 nt, Haemophilus influenzae Rd
uuuagauauaaaaau

SEQ ID NO: 2695074 - RNA, 22 nt, Haemophilus influenzae Rd
uuuagauuacuuuuagauaaau

SEQ ID NO: 2695075 - RNA, 18 nt, Haemophilus influenzae Rd
uuuagauuugugaacuug

SEQ ID NO: 2695076 - RNA, 21 nt, Haemophilus influenzae Rd
uuuagcauaaaacaguauuuu

SEQ ID NO: 2695077 - RNA, 17 nt, Haemophilus influenzae Rd
uuuagccaguaauuuua

SEQ ID NO: 2695078 - RNA, 13 nt, Haemophilus influenzae Rd
uuuagccauuuuc

SEQ ID NO: 2695079 - RNA, 12 nt, Haemophilus influenzae Rd
uuuagcccacca

SEQ ID NO: 2695080 - RNA, 17 nt, Haemophilus influenzae Rd
uuuagcggcgcaacuuc

SEQ ID NO: 2695081 - RNA, 21 nt, Haemophilus influenzae Rd
uuuagcuaaacgcucaaauaa

SEQ ID NO: 2695082 - RNA, 22 nt, Haemophilus influenzae Rd
uuuagcuaaacgcucaaauaaa

SEQ ID NO: 2695083 - RNA, 19 nt, Haemophilus influenzae Rd
uuuagcugcaauaauuuua

SEQ ID NO: 2695084 - RNA, 19 nt, Haemophilus influenzae Rd
uuuaggaaguaaauaguua

SEQ ID NO: 2695085 - RNA, 22 nt, Haemophilus influenzae Rd
uuuaguaaaauaaaaaauccac

SEQ ID NO: 2695086 - RNA, 14 nt, Haemophilus influenzae Rd
uuuagucauacaga

SEQ ID NO: 2695087 - RNA, 21 nt, Haemophilus influenzae Rd
uuuagucauacagaaaccaga

SEQ ID NO: 2695088 - RNA, 12 nt, Haemophilus influenzae Rd
uuuaguccuuaa

SEQ ID NO: 2695089 - RNA, 21 nt, Haemophilus influenzae Rd
uuuagugcuguauauuuuuaa

SEQ ID NO: 2695090 - RNA, 20 nt, Haemophilus influenzae Rd
uuuaguggcuaaauuaguuu

SEQ ID NO: 2695091 - RNA, 17 nt, Haemophilus influenzae Rd
uuuagugguuugcaaag

SEQ ID NO: 2695092 - RNA, 17 nt, Haemophilus influenzae Rd
uuuaguguauaacaaau

SEQ ID NO: 2695093 - RNA, 13 nt, Haemophilus influenzae Rd
uuuaguuaaauaa

SEQ ID NO: 2695094 - RNA, 23 nt, Haemophilus influenzae Rd
uuuaguuagaagugaaauauuuc

SEQ ID NO: 2695095 - RNA, 13 nt, Haemophilus influenzae Rd
uuuaguucaagga

SEQ ID NO: 2695096 - RNA, 16 nt, Haemophilus influenzae Rd
uuuaguugguaaagau

SEQ ID NO: 2695097 - RNA, 16 nt, Haemophilus influenzae Rd
uuuaguuucuaauucu

SEQ ID NO: 2695098 - RNA, 17 nt, Haemophilus influenzae Rd
uuuaguuucuaauucuu

SEQ ID NO: 2695099 - RNA, 20 nt, Haemophilus influenzae Rd
uuuaguuuguuguacuuuag

SEQ ID NO: 2695100 - RNA, 11 nt, Haemophilus influenzae Rd
uuuauaaaaaa

SEQ ID NO: 2695101 - RNA, 21 nt, Haemophilus influenzae Rd
uuuauaaacuacccaaauuua

SEQ ID NO: 2695102 - RNA, 23 nt, Haemophilus influenzae Rd
uuuauaaaguaagccauugugau

SEQ ID NO: 2695103 - RNA, 22 nt, Haemophilus influenzae Rd
uuuauaaauuaauucucauaca

SEQ ID NO: 2695104 - RNA, 14 nt, Haemophilus influenzae Rd
uuuauaacaaguua

SEQ ID NO: 2695105 - RNA, 13 nt, Haemophilus influenzae Rd
uuuauaagcuauu

SEQ ID NO: 2695106 - RNA, 12 nt, Haemophilus influenzae Rd
uuuauaaguaau

SEQ ID NO: 2695107 - RNA, 17 nt, Haemophilus influenzae Rd
uuuauaagugaaaugcu

SEQ ID NO: 2695108 - RNA, 13 nt, Haemophilus influenzae Rd
uuuauaauagacu

SEQ ID NO: 2695109 - RNA, 19 nt, Haemophilus influenzae Rd
uuuauaauagacugaaaaa

SEQ ID NO: 2695110 - RNA, 13 nt, Haemophilus influenzae Rd
uuuauaaucuuua

SEQ ID NO: 2695111 - RNA, 16 nt, Haemophilus influenzae Rd
uuuauacuaaaaguac

SEQ ID NO: 2695112 - RNA, 20 nt, Haemophilus influenzae Rd
uuucaaaggcucuaccuaaa

SEQ ID NO: 2695113 - RNA, 13 nt, Haemophilus influenzae Rd
uuucaaauaaaca

SEQ ID NO: 2695114 - RNA, 13 nt, Haemophilus influenzae Rd
uuucaacaaaaaa

SEQ ID NO: 2695115 - RNA, 15 nt, Haemophilus influenzae Rd
uuucaacaaaaauac

SEQ ID NO: 2695116 - RNA, 12 nt, Haemophilus influenzae Rd
uuucaacacaac

SEQ ID NO: 2695117 - RNA, 14 nt, Haemophilus influenzae Rd
uuucaacacaacau

SEQ ID NO: 2695118 - RNA, 17 nt, Haemophilus influenzae Rd
uuucaacacaacaucag

SEQ ID NO: 2695119 - RNA, 19 nt, Haemophilus influenzae Rd
uuucaacacuuccaaagua

SEQ ID NO: 2695120 - RNA, 16 nt, Haemophilus influenzae Rd
uuucaaccauuaaaua

SEQ ID NO: 2695121 - RNA, 21 nt, Haemophilus influenzae Rd
uuucaaccgcacuuuuuuuca

SEQ ID NO: 2695122 - RNA, 21 nt, Haemophilus influenzae Rd
uuucaaccgcucuuuuuauuu

SEQ ID NO: 2695123 - RNA, 21 nt, Haemophilus influenzae Rd
uuucaacuacgccguuuuuca

SEQ ID NO: 2695124 - RNA, 15 nt, Haemophilus influenzae Rd
uuucaacuuggaaag

SEQ ID NO: 2695125 - RNA, 14 nt, Haemophilus influenzae Rd
uuucaacuuggcua

SEQ ID NO: 2695126 - RNA, 18 nt, Haemophilus influenzae Rd
uuucaagaacagaaacca

SEQ ID NO: 2695127 - RNA, 23 nt, Haemophilus influenzae Rd
uuucaagcacuuuauuuaauuca

SEQ ID NO: 2695128 - RNA, 18 nt, Haemophilus influenzae Rd
uuucaagcccuuccaucu

SEQ ID NO: 2695129 - RNA, 14 nt, Haemophilus influenzae Rd
uuucaagcuuugca

SEQ ID NO: 2695130 - RNA, 17 nt, Haemophilus influenzae Rd
uuucaaguaacuuucac

SEQ ID NO: 2695131 - RNA, 19 nt, Haemophilus influenzae Rd
uuucaaguaacuuucacaa

SEQ ID NO: 2695132 - RNA, 11 nt, Haemophilus influenzae Rd
uuucaauaauc

SEQ ID NO: 2695133 - RNA, 18 nt, Haemophilus influenzae Rd
uuucaauagccaauaaua

SEQ ID NO: 2695134 - RNA, 15 nt, Haemophilus influenzae Rd
uuucaaugaaauauu

SEQ ID NO: 2695135 - RNA, 16 nt, Haemophilus influenzae Rd
uuucaaugaaauauua

SEQ ID NO: 2695136 - RNA, 19 nt, Haemophilus influenzae Rd
uuucaaugacugauauuua

SEQ ID NO: 2695137 - RNA, 20 nt, Haemophilus influenzae Rd
uuucaaugcagaaauaaacg

SEQ ID NO: 2695138 - RNA, 18 nt, Haemophilus influenzae Rd
uuucaauggcaucaauaa

SEQ ID NO: 2695139 - RNA, 16 nt, Haemophilus influenzae Rd
uuucaauuaaaugacc

SEQ ID NO: 2695140 - RNA, 14 nt, Haemophilus influenzae Rd
uuucaauuccuuua

SEQ ID NO: 2695141 - RNA, 22 nt, Haemophilus influenzae Rd
uuucaauuucucuacuaauuca

SEQ ID NO: 2695142 - RNA, 19 nt, Haemophilus influenzae Rd
uuucacaaccuuguuccag

SEQ ID NO: 2695143 - RNA, 21 nt, Haemophilus influenzae Rd
uuucacaacuaccacagguuu

SEQ ID NO: 2695144 - RNA, 19 nt, Haemophilus influenzae Rd
uuucacaccauuuuuaauu

SEQ ID NO: 2695145 - RNA, 13 nt, Haemophilus influenzae Rd
uuucacacugccc

SEQ ID NO: 2695146 - RNA, 14 nt, Haemophilus influenzae Rd
uuucacacugcccu

SEQ ID NO: 2695147 - RNA, 16 nt, Haemophilus influenzae Rd
uuucacauaauaaaca

SEQ ID NO: 2695148 - RNA, 20 nt, Haemophilus influenzae Rd
uuucaccaacaaauucuaau

SEQ ID NO: 2695149 - RNA, 15 nt, Haemophilus influenzae Rd
uuucaccacuucauc

SEQ ID NO: 2695150 - RNA, 21 nt, Haemophilus influenzae Rd
uuucacccaagauucuaaaua

SEQ ID NO: 2695151 - RNA, 17 nt, Haemophilus influenzae Rd
uuucaccgcacuuaauc

SEQ ID NO: 2695152 - RNA, 16 nt, Haemophilus influenzae Rd
uuucaccgcacuuucu

SEQ ID NO: 2695153 - RNA, 18 nt, Haemophilus influenzae Rd
uuucaccgcacuuuugug

SEQ ID NO: 2695154 - RNA, 14 nt, Haemophilus influenzae Rd
uuucaccguauuuu

SEQ ID NO: 2695155 - RNA, 17 nt, Haemophilus influenzae Rd
uuucaccguauuuuuua

SEQ ID NO: 2695156 - RNA, 21 nt, Haemophilus influenzae Rd
uuucaccuugaucuacagaag

SEQ ID NO: 2695157 - RNA, 22 nt, Haemophilus influenzae Rd
uuucacgcgugguauucuuucc

SEQ ID NO: 2695158 - RNA, 22 nt, Haemophilus influenzae Rd
uuucacgcugacguuguucaau

SEQ ID NO: 2695159 - RNA, 17 nt, Haemophilus influenzae Rd
uuucacggcggauugca

SEQ ID NO: 2695160 - RNA, 20 nt, Haemophilus influenzae Rd
uuucacgguacgcugcaucu

SEQ ID NO: 2695161 - RNA, 15 nt, Haemophilus influenzae Rd
uuucacgguuuucca

SEQ ID NO: 2695162 - RNA, 22 nt, Haemophilus influenzae Rd
uuucacguccgccgaugaauaa

SEQ ID NO: 2695163 - RNA, 16 nt, Haemophilus influenzae Rd
uuucacuaaauaaaug

SEQ ID NO: 2695164 - RNA, 18 nt, Haemophilus influenzae Rd
uuucacuaaauaaauggu

SEQ ID NO: 2695165 - RNA, 14 nt, Haemophilus influenzae Rd
uuucacuauuucau

SEQ ID NO: 2695166 - RNA, 19 nt, Haemophilus influenzae Rd
uuucacuauuucaucuuua

SEQ ID NO: 2695167 - RNA, 13 nt, Haemophilus influenzae Rd
uuucacucuacca

SEQ ID NO: 2695168 - RNA, 22 nt, Haemophilus influenzae Rd
uuucacucuaccaucuaaaguu

SEQ ID NO: 2695169 - RNA, 16 nt, Haemophilus influenzae Rd
uuucacuuuacauuuc

SEQ ID NO: 2695170 - RNA, 12 nt, Haemophilus influenzae Rd
uuucagaauaaa

SEQ ID NO: 2695171 - RNA, 13 nt, Haemophilus influenzae Rd
uuucagaauaaag

SEQ ID NO: 2695172 - RNA, 14 nt, Haemophilus influenzae Rd
uuucagacaaaacu

SEQ ID NO: 2695173 - RNA, 16 nt, Haemophilus influenzae Rd
uuucagauaaucaaaa

SEQ ID NO: 2695174 - RNA, 15 nt, Haemophilus influenzae Rd
uuucagauacuuucu

SEQ ID NO: 2695175 - RNA, 20 nt, Haemophilus influenzae Rd
uuucagauacuuucuaauua

SEQ ID NO: 2695176 - RNA, 21 nt, Haemophilus influenzae Rd
uuucagccuauuuuuagaaaa

SEQ ID NO: 2695177 - RNA, 15 nt, Haemophilus influenzae Rd
uuucagcgaaacuug

SEQ ID NO: 2695178 - RNA, 17 nt, Haemophilus influenzae Rd
uuucagcguuuucaacu

SEQ ID NO: 2695179 - RNA, 22 nt, Haemophilus influenzae Rd
uuucagcugcgaugcauacuug

SEQ ID NO: 2695180 - RNA, 17 nt, Haemophilus influenzae Rd
uuucagcuuaaauacua

SEQ ID NO: 2695181 - RNA, 14 nt, Haemophilus influenzae Rd
uuucaguaucaaua

SEQ ID NO: 2695182 - RNA, 14 nt, Haemophilus influenzae Rd
uuucaguauuuuuu

SEQ ID NO: 2695183 - RNA, 20 nt, Haemophilus influenzae Rd
uuucaguuacguaauauuua

SEQ ID NO: 2695184 - RNA, 14 nt, Haemophilus influenzae Rd
uuucaguuaucucc

SEQ ID NO: 2695185 - RNA, 18 nt, Haemophilus influenzae Rd
  misc_feature (6)..(6): n is a, c, g or u
uuucanagagguuuccuu

SEQ ID NO: 2695186 - RNA, 19 nt, Haemophilus influenzae Rd
  misc_feature (6)..(6): n is a, c, g or u
uuucanagagguuuccuua

SEQ ID NO: 2695187 - RNA, 18 nt, Haemophilus influenzae Rd
uuucauaaaaauugaucu

SEQ ID NO: 2695188 - RNA, 22 nt, Haemophilus influenzae Rd
uuucauaaacgguauuuucucg

SEQ ID NO: 2695189 - RNA, 15 nt, Haemophilus influenzae Rd
uuucauacaaucucu

SEQ ID NO: 2695190 - RNA, 16 nt, Haemophilus influenzae Rd
uuucauaguuuucuga

SEQ ID NO: 2695191 - RNA, 13 nt, Haemophilus influenzae Rd
uuucauauuucug

SEQ ID NO: 2695192 - RNA, 19 nt, Haemophilus influenzae Rd
uuucauauuucuguauuau

SEQ ID NO: 2695193 - RNA, 17 nt, Haemophilus influenzae Rd
uuucauauuuuaaauaa

SEQ ID NO: 2695194 - RNA, 19 nt, Haemophilus influenzae Rd
uuucauauuuuaaauaauu

SEQ ID NO: 2695195 - RNA, 19 nt, Haemophilus influenzae Rd
uuucaucaaucuucucauu

SEQ ID NO: 2695196 - RNA, 16 nt, Haemophilus influenzae Rd
uuucaucaaugccauu

SEQ ID NO: 2695197 - RNA, 14 nt, Haemophilus influenzae Rd
uuucauccaaugcu

SEQ ID NO: 2695198 - RNA, 22 nt, Haemophilus influenzae Rd
uuucauccuaaaaaaauaaccg

SEQ ID NO: 2695199 - RNA, 16 nt, Haemophilus influenzae Rd
uuucaucgcauuuuua

SEQ ID NO: 2695200 - RNA, 17 nt, Haemophilus influenzae Rd
uuucaucgcgcaaaaua

SEQ ID NO: 2695201 - RNA, 16 nt, Haemophilus influenzae Rd
uuucaucgcguuuuuu

SEQ ID NO: 2695202 - RNA, 19 nt, Haemophilus influenzae Rd
uuucaucgcguuuuuucuu

SEQ ID NO: 2695203 - RNA, 18 nt, Haemophilus influenzae Rd
uuucaucguauuuccuau

SEQ ID NO: 2695204 - RNA, 18 nt, Haemophilus influenzae Rd
uuucaucuacaccaaaac

SEQ ID NO: 2695205 - RNA, 17 nt, Haemophilus influenzae Rd
uuucaucuggugaguga

SEQ ID NO: 2695206 - RNA, 21 nt, Haemophilus influenzae Rd
uuucaucuuccgugacaucau

SEQ ID NO: 2695207 - RNA, 15 nt, Haemophilus influenzae Rd
uuucauuaaagaaga

SEQ ID NO: 2695208 - RNA, 14 nt, Haemophilus influenzae Rd
uuucauuaauuuua

SEQ ID NO: 2695209 - RNA, 14 nt, Haemophilus influenzae Rd
uuucauuauauuua

SEQ ID NO: 2695210 - RNA, 12 nt, Haemophilus influenzae Rd
uuucauucaaaa

SEQ ID NO: 2695211 - RNA, 13 nt, Haemophilus influenzae Rd
uuucauucaaaaa

SEQ ID NO: 2695212 - RNA, 17 nt, Haemophilus influenzae Rd
uuucauucaacaauuca

SEQ ID NO: 2695213 - RNA, 21 nt, Haemophilus influenzae Rd
uuucauucaacaauucauaaa

SEQ ID NO: 2695214 - RNA, 20 nt, Haemophilus influenzae Rd
uuucauuccuucacuuggcg

SEQ ID NO: 2695215 - RNA, 20 nt, Haemophilus influenzae Rd
uuucauuugcgccaauaaua

SEQ ID NO: 2695216 - RNA, 12 nt, Haemophilus influenzae Rd
uuucauuuucca

SEQ ID NO: 2695217 - RNA, 22 nt, Haemophilus influenzae Rd
uuucauuuuuuggugcauacgu

SEQ ID NO: 2695218 - RNA, 20 nt, Haemophilus influenzae Rd
uuucuuccuaugaauaagcg

SEQ ID NO: 2695219 - RNA, 21 nt, Haemophilus influenzae Rd
uuucuucgcgagaauuaccac

SEQ ID NO: 2695220 - RNA, 15 nt, Haemophilus influenzae Rd
uuucuucuaauucuu

SEQ ID NO: 2695221 - RNA, 17 nt, Haemophilus influenzae Rd
uuucuucuacuucuucu

SEQ ID NO: 2695222 - RNA, 22 nt, Haemophilus influenzae Rd
uuucuucuuucauuugaacaau

SEQ ID NO: 2695223 - RNA, 12 nt, Haemophilus influenzae Rd
uuucuugcuaaa

SEQ ID NO: 2695224 - RNA, 14 nt, Haemophilus influenzae Rd
uuucuugcuaaaaa

SEQ ID NO: 2695225 - RNA, 15 nt, Haemophilus influenzae Rd
uuucuugcuaaaaua

SEQ ID NO: 2695226 - RNA, 18 nt, Haemophilus influenzae Rd
uuucuugcuauucuuuag

SEQ ID NO: 2695227 - RNA, 15 nt, Haemophilus influenzae Rd
uuucuugcucuaauu

SEQ ID NO: 2695228 - RNA, 19 nt, Haemophilus influenzae Rd
uuucuugcuguugguuaaa

SEQ ID NO: 2695229 - RNA, 22 nt, Haemophilus influenzae Rd
uuucuugcuguugguuaaaaau

SEQ ID NO: 2695230 - RNA, 23 nt, Haemophilus influenzae Rd
uuucuugcuguugguuaaaaaua

SEQ ID NO: 2695231 - RNA, 16 nt, Haemophilus influenzae Rd
uuucuuguucuccauu

SEQ ID NO: 2695232 - RNA, 18 nt, Haemophilus influenzae Rd
uuucuuguucuccauuaa

SEQ ID NO: 2695233 - RNA, 13 nt, Haemophilus influenzae Rd
uuucuuuaaaauu

SEQ ID NO: 2695234 - RNA, 14 nt, Haemophilus influenzae Rd
uuucuuuaaaauua

SEQ ID NO: 2695235 - RNA, 14 nt, Haemophilus influenzae Rd
uuucuuuaauugau

SEQ ID NO: 2695236 - RNA, 22 nt, Haemophilus influenzae Rd
uuucuuucguucaacccauuuu

SEQ ID NO: 2695237 - RNA, 12 nt, Haemophilus influenzae Rd
uuucuuuuucaa

SEQ ID NO: 2695238 - RNA, 17 nt, Haemophilus influenzae Rd
uuugaaagauuuucuac

SEQ ID NO: 2695239 - RNA, 12 nt, Haemophilus influenzae Rd
uuugaaaucaaa

SEQ ID NO: 2695240 - RNA, 12 nt, Haemophilus influenzae Rd
uuugaaauuuau

SEQ ID NO: 2695241 - RNA, 14 nt, Haemophilus influenzae Rd
uuugaacgaauuaa

SEQ ID NO: 2695242 - RNA, 22 nt, Haemophilus influenzae Rd
uuugaacguuuuugucguucuu

SEQ ID NO: 2695243 - RNA, 15 nt, Haemophilus influenzae Rd
uuugaaguacauuca

SEQ ID NO: 2695244 - RNA, 13 nt, Haemophilus influenzae Rd
uuugaauaaauau

SEQ ID NO: 2695245 - RNA, 16 nt, Haemophilus influenzae Rd
uuugaauguaaaaaua

SEQ ID NO: 2695246 - RNA, 15 nt, Haemophilus influenzae Rd
uuugaauuaauaacg

SEQ ID NO: 2695247 - RNA, 19 nt, Haemophilus influenzae Rd
uuugaauugguguuuaaau

SEQ ID NO: 2695248 - RNA, 13 nt, Haemophilus influenzae Rd
uuugacauauuuu

SEQ ID NO: 2695249 - RNA, 14 nt, Haemophilus influenzae Rd
uuugacauuccuau

SEQ ID NO: 2695250 - RNA, 13 nt, Haemophilus influenzae Rd
uuugaccauuuca

SEQ ID NO: 2695251 - RNA, 23 nt, Haemophilus influenzae Rd
uuugaccgacaagauaagagcuu

SEQ ID NO: 2695252 - RNA, 21 nt, Haemophilus influenzae Rd
uuugaccuucauaaacuucua

SEQ ID NO: 2695253 - RNA, 16 nt, Haemophilus influenzae Rd
uuugacgaaauaaaug

SEQ ID NO: 2695254 - RNA, 23 nt, Haemophilus influenzae Rd
uuugacgagauuuuuugaauaaa

SEQ ID NO: 2695255 - RNA, 16 nt, Haemophilus influenzae Rd
uuugacgauaauauuu

SEQ ID NO: 2695256 - RNA, 16 nt, Haemophilus influenzae Rd
uuugacgcagcaucug

SEQ ID NO: 2695257 - RNA, 17 nt, Haemophilus influenzae Rd
uuugacgcgcacauacu

SEQ ID NO: 2695258 - RNA, 17 nt, Haemophilus influenzae Rd
uuugagauaaauuuuua

SEQ ID NO: 2695259 - RNA, 17 nt, Haemophilus influenzae Rd
uuugagaugaaaaaaag

SEQ ID NO: 2695260 - RNA, 15 nt, Haemophilus influenzae Rd
uuugagcaaaucaaa

SEQ ID NO: 2695261 - RNA, 16 nt, Haemophilus influenzae Rd
uuugagcaaaucaaaa

SEQ ID NO: 2695262 - RNA, 15 nt, Haemophilus influenzae Rd
uuugagccaauaacu

SEQ ID NO: 2695263 - RNA, 20 nt, Haemophilus influenzae Rd
uuugagcggugaauucuuuu

SEQ ID NO: 2695264 - RNA, 23 nt, Haemophilus influenzae Rd
uuugagucggggauuuuuuauau

SEQ ID NO: 2695265 - RNA, 17 nt, Haemophilus influenzae Rd
uuugagucucaaauuuu

SEQ ID NO: 2695266 - RNA, 21 nt, Haemophilus influenzae Rd
uuugagugcuguacacacacc

SEQ ID NO: 2695267 - RNA, 12 nt, Haemophilus influenzae Rd
uuugaguuauuu

SEQ ID NO: 2695268 - RNA, 19 nt, Haemophilus influenzae Rd
uuugauaauacacguuaau

SEQ ID NO: 2695269 - RNA, 14 nt, Haemophilus influenzae Rd
uuugauaauuucuu

SEQ ID NO: 2695270 - RNA, 23 nt, Haemophilus influenzae Rd
uuugauauuaagccauuggaaaa

SEQ ID NO: 2695271 - RNA, 19 nt, Haemophilus influenzae Rd
uuugaucauggcucagauu

SEQ ID NO: 2695272 - RNA, 22 nt, Haemophilus influenzae Rd
uuugauccacaaauaauaaucu

SEQ ID NO: 2695273 - RNA, 16 nt, Haemophilus influenzae Rd
uuugaucguauugcau

SEQ ID NO: 2695274 - RNA, 19 nt, Haemophilus influenzae Rd
uuugaucguauugcauaaa

SEQ ID NO: 2695275 - RNA, 13 nt, Haemophilus influenzae Rd
uuugaucuaauuu

SEQ ID NO: 2695276 - RNA, 17 nt, Haemophilus influenzae Rd
uuugaucucuuucuauu

SEQ ID NO: 2695277 - RNA, 20 nt, Haemophilus influenzae Rd
uuugaucuuagacaaauuaa

SEQ ID NO: 2695278 - RNA, 18 nt, Haemophilus influenzae Rd
uuugaucuuccgcgucau

SEQ ID NO: 2695279 - RNA, 22 nt, Haemophilus influenzae Rd
uuugaugaaaguugaauauuuu

SEQ ID NO: 2695280 - RNA, 12 nt, Haemophilus influenzae Rd
uuugauuuauac

SEQ ID NO: 2695281 - RNA, 18 nt, Haemophilus influenzae Rd
uuugauuuugcuuugccu

SEQ ID NO: 2695282 - RNA, 22 nt, Haemophilus influenzae Rd
uuugcaaagugcgguaagaaaa

SEQ ID NO: 2695283 - RNA, 21 nt, Haemophilus influenzae Rd
uuugcaaauacagugacaaau

SEQ ID NO: 2695284 - RNA, 22 nt, Haemophilus influenzae Rd
uuugcaaauacagugacaaauu

SEQ ID NO: 2695285 - RNA, 21 nt, Haemophilus influenzae Rd
uuugcaagguuuccaagaauu

SEQ ID NO: 2695286 - RNA, 22 nt, Haemophilus influenzae Rd
uuugcaauaaauucguacaaau

SEQ ID NO: 2695287 - RNA, 18 nt, Haemophilus influenzae Rd
uuugcaauuuaacauaau

SEQ ID NO: 2695288 - RNA, 19 nt, Haemophilus influenzae Rd
uuugcaccacguucuuuua

SEQ ID NO: 2695289 - RNA, 14 nt, Haemophilus influenzae Rd
uuugcacccgccau

SEQ ID NO: 2695290 - RNA, 16 nt, Haemophilus influenzae Rd
uuugcaccugcaucaa

SEQ ID NO: 2695291 - RNA, 21 nt, Haemophilus influenzae Rd
uuugcaccugcaucaauuuua

SEQ ID NO: 2695292 - RNA, 22 nt, Haemophilus influenzae Rd
uuugcacguuugcgaucguuuu

SEQ ID NO: 2695293 - RNA, 16 nt, Haemophilus influenzae Rd
uuugcacuuuaaagaa

SEQ ID NO: 2695294 - RNA, 12 nt, Haemophilus influenzae Rd
uuugcacuuucu

SEQ ID NO: 2695295 - RNA, 20 nt, Haemophilus influenzae Rd
uuugcagugcauuaaugccu

SEQ ID NO: 2695296 - RNA, 21 nt, Haemophilus influenzae Rd
uuugcauaaaaccagcauuga

SEQ ID NO: 2695297 - RNA, 13 nt, Haemophilus influenzae Rd
uuugcauauaaaa

SEQ ID NO: 2695298 - RNA, 21 nt, Haemophilus influenzae Rd
uuugcauuauugaaccauuuu

SEQ ID NO: 2695299 - RNA, 15 nt, Haemophilus influenzae Rd
uuugcauuuucaggg

SEQ ID NO: 2695300 - RNA, 13 nt, Haemophilus influenzae Rd
uuugcauuuugga

SEQ ID NO: 2695301 - RNA, 20 nt, Haemophilus influenzae Rd
uuugcauuuuggaaaauaga

SEQ ID NO: 2695302 - RNA, 13 nt, Haemophilus influenzae Rd
uuugccaaaauca

SEQ ID NO: 2695303 - RNA, 13 nt, Haemophilus influenzae Rd
uuugccaauacuu

SEQ ID NO: 2695304 - RNA, 19 nt, Haemophilus influenzae Rd
uuugccaucacgaccuuuu

SEQ ID NO: 2695305 - RNA, 16 nt, Haemophilus influenzae Rd
uuugcccauucuaaug

SEQ ID NO: 2695306 - RNA, 12 nt, Haemophilus influenzae Rd
uuugccuaaaac

SEQ ID NO: 2695307 - RNA, 12 nt, Haemophilus influenzae Rd
uuugcgccuuca

SEQ ID NO: 2695308 - RNA, 21 nt, Haemophilus influenzae Rd
uuugcggacgcuugggcuuuu

SEQ ID NO: 2695309 - RNA, 16 nt, Haemophilus influenzae Rd
uuugcgucuucaaguc

SEQ ID NO: 2695310 - RNA, 17 nt, Haemophilus influenzae Rd
uuugcguugcuggaacu

SEQ ID NO: 2695311 - RNA, 19 nt, Haemophilus influenzae Rd
uuugcuaccuucaaccacc

SEQ ID NO: 2695312 - RNA, 23 nt, Haemophilus influenzae Rd
uuugcucuaaaugugauuuccau

SEQ ID NO: 2695313 - RNA, 18 nt, Haemophilus influenzae Rd
uuugcugcaccaaucaaa

SEQ ID NO: 2695314 - RNA, 20 nt, Haemophilus influenzae Rd
uuugcugcacgaguuugauu

SEQ ID NO: 2695315 - RNA, 21 nt, Haemophilus influenzae Rd
uuugcuuauuuuguugcagcu

SEQ ID NO: 2695316 - RNA, 18 nt, Haemophilus influenzae Rd
uuugcuuccuuauugccu

SEQ ID NO: 2695317 - RNA, 18 nt, Haemophilus influenzae Rd
uuugcuugaguauuuacu

SEQ ID NO: 2695318 - RNA, 15 nt, Haemophilus influenzae Rd
uuugcuuugauaaau

SEQ ID NO: 2695319 - RNA, 21 nt, Haemophilus influenzae Rd
uuugcuuuucccuuuacacga

SEQ ID NO: 2695320 - RNA, 18 nt, Haemophilus influenzae Rd
uuuggaaagaguaagcaa

SEQ ID NO: 2695321 - RNA, 19 nt, Haemophilus influenzae Rd
uuuggacaccuuuuuccuu

SEQ ID NO: 2695322 - RNA, 22 nt, Haemophilus influenzae Rd
uuuggacuuuauuugauuguug

SEQ ID NO: 2695323 - RNA, 12 nt, Haemophilus influenzae Rd
uuuuaauuuagc

SEQ ID NO: 2695324 - RNA, 14 nt, Haemophilus influenzae Rd
uuuuaauuuauacu

SEQ ID NO: 2695325 - RNA, 18 nt, Haemophilus influenzae Rd
uuuuaauuuuaguuaucu

SEQ ID NO: 2695326 - RNA, 14 nt, Haemophilus influenzae Rd
uuuuacaauaccaa

SEQ ID NO: 2695327 - RNA, 15 nt, Haemophilus influenzae Rd
uuuuacaauaccaau

SEQ ID NO: 2695328 - RNA, 21 nt, Haemophilus influenzae Rd
uuuuacaccguccaagguuuu

SEQ ID NO: 2695329 - RNA, 19 nt, Haemophilus influenzae Rd
uuuuacagguguaguuagc

SEQ ID NO: 2695330 - RNA, 14 nt, Haemophilus influenzae Rd
uuuuacaucaauug

SEQ ID NO: 2695331 - RNA, 20 nt, Haemophilus influenzae Rd
uuuuaccaauugauuuuuca

SEQ ID NO: 2695332 - RNA, 18 nt, Haemophilus influenzae Rd
uuuuaccgcacuuuuguu

SEQ ID NO: 2695333 - RNA, 18 nt, Haemophilus influenzae Rd
uuuuaccuucaguuuuca

SEQ ID NO: 2695334 - RNA, 14 nt, Haemophilus influenzae Rd
uuuuaccuuuggcu

SEQ ID NO: 2695335 - RNA, 19 nt, Haemophilus influenzae Rd
uuuuacgaacuaauaagcu

SEQ ID NO: 2695336 - RNA, 14 nt, Haemophilus influenzae Rd
uuuuacgauauuuu

SEQ ID NO: 2695337 - RNA, 15 nt, Haemophilus influenzae Rd
uuuuacgauuucugc

SEQ ID NO: 2695338 - RNA, 18 nt, Haemophilus influenzae Rd
uuuuacgugcgaauuuuu

SEQ ID NO: 2695339 - RNA, 19 nt, Haemophilus influenzae Rd
uuuuacgugcgaauuuuua

SEQ ID NO: 2695340 - RNA, 15 nt, Haemophilus influenzae Rd
uuuuacguuuuaaau

SEQ ID NO: 2695341 - RNA, 19 nt, Haemophilus influenzae Rd
uuuuacuacguaaagagag

SEQ ID NO: 2695342 - RNA, 19 nt, Haemophilus influenzae Rd
uuuuacugcuuuauuuucu

SEQ ID NO: 2695343 - RNA, 13 nt, Haemophilus influenzae Rd
uuuuacuucuuca

SEQ ID NO: 2695344 - RNA, 19 nt, Haemophilus influenzae Rd
uuuuacuuucuuucaauaa

SEQ ID NO: 2695345 - RNA, 15 nt, Haemophilus influenzae Rd
uuuuagaaaaucacu

SEQ ID NO: 2695346 - RNA, 17 nt, Haemophilus influenzae Rd
uuuuagaauuaaauuug

SEQ ID NO: 2695347 - RNA, 21 nt, Haemophilus influenzae Rd
uuuuagccuaagauuuuaucu

SEQ ID NO: 2695348 - RNA, 22 nt, Haemophilus influenzae Rd
uuuuagcugaaaucccuuagaa

SEQ ID NO: 2695349 - RNA, 16 nt, Haemophilus influenzae Rd
uuuuagcugauuuuuu

SEQ ID NO: 2695350 - RNA, 17 nt, Haemophilus influenzae Rd
uuuuaggacuaaaucaa

SEQ ID NO: 2695351 - RNA, 14 nt, Haemophilus influenzae Rd
uuuuaggacuugug

SEQ ID NO: 2695352 - RNA, 22 nt, Haemophilus influenzae Rd
uuuuaggauugcguucuccgca

SEQ ID NO: 2695353 - RNA, 17 nt, Haemophilus influenzae Rd
uuuuaguaauuuuaauu

SEQ ID NO: 2695354 - RNA, 19 nt, Haemophilus influenzae Rd
uuuuagugcuguauauuuu

SEQ ID NO: 2695355 - RNA, 14 nt, Haemophilus influenzae Rd
uuuuaguuaaauaa

SEQ ID NO: 2695356 - RNA, 20 nt, Haemophilus influenzae Rd
uuuuaguuagaagugaaaua

SEQ ID NO: 2695357 - RNA, 20 nt, Haemophilus influenzae Rd
uuuuaguuucuaauucuucc

SEQ ID NO: 2695358 - RNA, 20 nt, Haemophilus influenzae Rd
uuuuaguuuuuuuauaaaaa

SEQ ID NO: 2695359 - RNA, 11 nt, Haemophilus influenzae Rd
uuuuauaaaau

SEQ ID NO: 2695360 - RNA, 13 nt, Haemophilus influenzae Rd
uuuuauaagugaa

SEQ ID NO: 2695361 - RNA, 13 nt, Haemophilus influenzae Rd
uuuuauaauuaau

SEQ ID NO: 2695362 - RNA, 14 nt, Haemophilus influenzae Rd
uuuuauaguuuuau

SEQ ID NO: 2695363 - RNA, 13 nt, Haemophilus influenzae Rd
uuuuauauguucc

SEQ ID NO: 2695364 - RNA, 17 nt, Haemophilus influenzae Rd
uuuuauauuuaguuagu

SEQ ID NO: 2695365 - RNA, 16 nt, Haemophilus influenzae Rd
uuuuauauuuuuuacu

SEQ ID NO: 2695366 - RNA, 14 nt, Haemophilus influenzae Rd
uuuuauauuuuuuc

SEQ ID NO: 2695367 - RNA, 15 nt, Haemophilus influenzae Rd
uuuuaucaaaaaucu

SEQ ID NO: 2695368 - RNA, 19 nt, Haemophilus influenzae Rd
uuuuaucaaaaaucuuauu

SEQ ID NO: 2695369 - RNA, 17 nt, Haemophilus influenzae Rd
uuuuaucaacuaaaaaa

SEQ ID NO: 2695370 - RNA, 18 nt, Haemophilus influenzae Rd
uuuuaucaacuaaaaaau

SEQ ID NO: 2695371 - RNA, 20 nt, Haemophilus influenzae Rd
uuuuaucagaaugauuaucu

SEQ ID NO: 2695372 - RNA, 21 nt, Haemophilus influenzae Rd
uuuuauccaaccuacauuaau

SEQ ID NO: 2695373 - RNA, 23 nt, Haemophilus influenzae Rd
uuuuauccaaccuacauuaauca

SEQ ID NO: 2695374 - RNA, 13 nt, Haemophilus influenzae Rd
uuuuauccgaguu

SEQ ID NO: 2695375 - RNA, 21 nt, Haemophilus influenzae Rd
uuuuauccuauuaauuuaauu

SEQ ID NO: 2695376 - RNA, 18 nt, Haemophilus influenzae Rd
uuuuaucgacaaauuaau

SEQ ID NO: 2695377 - RNA, 22 nt, Haemophilus influenzae Rd
uuuuaucgaccgcacuucuaau

SEQ ID NO: 2695378 - RNA, 18 nt, Haemophilus influenzae Rd
uuuuaucgagauuucuuu

SEQ ID NO: 2695379 - RNA, 14 nt, Haemophilus influenzae Rd
uuuuaucgguuauu

SEQ ID NO: 2695380 - RNA, 15 nt, Haemophilus influenzae Rd
uuuuaucuaaaaaag

SEQ ID NO: 2695381 - RNA, 14 nt, Haemophilus influenzae Rd
uuuuaucuauaaaa

SEQ ID NO: 2695382 - RNA, 16 nt, Haemophilus influenzae Rd
uuuuaucuuuuauauu

SEQ ID NO: 2695383 - RNA, 12 nt, Haemophilus influenzae Rd
uuuuaugaagaa

SEQ ID NO: 2695384 - RNA, 20 nt, Haemophilus influenzae Rd
uuuuaugaauaacuuuaauu

SEQ ID NO: 2695385 - RNA, 18 nt, Haemophilus influenzae Rd
uuuuaugauaaccaucua

SEQ ID NO: 2695386 - RNA, 21 nt, Haemophilus influenzae Rd
uuuuauggcauacuuaacaaa

SEQ ID NO: 2695387 - RNA, 16 nt, Haemophilus influenzae Rd
uuuuauggcuugugcu

SEQ ID NO: 2695388 - RNA, 23 nt, Haemophilus influenzae Rd
uuuuauggcuugugcuauacaaa

SEQ ID NO: 2695389 - RNA, 18 nt, Haemophilus influenzae Rd
uuuuauguguuuuuaauu

SEQ ID NO: 2695390 - RNA, 12 nt, Haemophilus influenzae Rd
uuuuauuaaaaa

SEQ ID NO: 2695391 - RNA, 12 nt, Haemophilus influenzae Rd
uuuuauuaauaa

SEQ ID NO: 2695392 - RNA, 13 nt, Haemophilus influenzae Rd
uuuuauuacaaaa

SEQ ID NO: 2695393 - RNA, 19 nt, Haemophilus influenzae Rd
uuuuauuacauuaaaauca

SEQ ID NO: 2695394 - RNA, 15 nt, Haemophilus influenzae Rd
uuuuauuacccuauu

SEQ ID NO: 2695395 - RNA, 21 nt, Haemophilus influenzae Rd
uuuuauuacccuauucuaaau

SEQ ID NO: 2695396 - RNA, 22 nt, Haemophilus influenzae Rd
uuuuauuagagaacguauuauu

SEQ ID NO: 2695397 - RNA, 19 nt, Haemophilus influenzae Rd
uuuuauuagcgaaaauuuu

SEQ ID NO: 2695398 - RNA, 20 nt, Haemophilus influenzae Rd
uuuuauuagugauauuguuu

SEQ ID NO: 2695399 - RNA, 13 nt, Haemophilus influenzae Rd
uuuuauuaucaaa

SEQ ID NO: 2695400 - RNA, 14 nt, Haemophilus influenzae Rd
uuuuauucaaaauu

SEQ ID NO: 2695401 - RNA, 15 nt, Haemophilus influenzae Rd
uuuuauucaauaaua

SEQ ID NO: 2695402 - RNA, 19 nt, Haemophilus influenzae Rd
uuuuauucaauaauauauu

SEQ ID NO: 2695403 - RNA, 23 nt, Haemophilus influenzae Rd
uuuuauucaauaauauauuuaau

SEQ ID NO: 2695404 - RNA, 22 nt, Haemophilus influenzae Rd
uuuuauucuccaaauauaaaau

SEQ ID NO: 2695405 - RNA, 19 nt, Haemophilus influenzae Rd
uuuuauugaaauuuuaauu

SEQ ID NO: 2695406 - RNA, 16 nt, Haemophilus influenzae Rd
uuuuauugaacuguuu

SEQ ID NO: 2695407 - RNA, 12 nt, Haemophilus influenzae Rd
uuuuauuuacuu

SEQ ID NO: 2695408 - RNA, 14 nt, Haemophilus influenzae Rd
uuuuauuuauauaa

SEQ ID NO: 2695409 - RNA, 15 nt, Haemophilus influenzae Rd
uuuuauuuauauaaa

SEQ ID NO: 2695410 - RNA, 12 nt, Haemophilus influenzae Rd
uuuuauuuauca

SEQ ID NO: 2695411 - RNA, 17 nt, Haemophilus influenzae Rd
uuuuauuucuaaucauu

SEQ ID NO: 2695412 - RNA, 21 nt, Haemophilus influenzae Rd
uuuuauuugcggacaguauau

SEQ ID NO: 2695413 - RNA, 17 nt, Haemophilus influenzae Rd
uuuuauuuguuaauaaa

SEQ ID NO: 2695414 - RNA, 17 nt, Haemophilus influenzae Rd
uuuuauuuguucuacuu

SEQ ID NO: 2695415 - RNA, 13 nt, Haemophilus influenzae Rd
uuuuauuuuaauu

SEQ ID NO: 2695416 - RNA, 13 nt, Haemophilus influenzae Rd
uuuuauuuuacua

SEQ ID NO: 2695417 - RNA, 16 nt, Haemophilus influenzae Rd
uuuuauuuuaucuauu

SEQ ID NO: 2695418 - RNA, 18 nt, Haemophilus influenzae Rd
uuuuauuuuauuaucaau

SEQ ID NO: 2695419 - RNA, 12 nt, Haemophilus influenzae Rd
uuuuauuuugaa

SEQ ID NO: 2695420 - RNA, 12 nt, Haemophilus influenzae Rd
uuuuauuuuucc

SEQ ID NO: 2695421 - RNA, 14 nt, Haemophilus influenzae Rd
uuuucaaaaauuuu

SEQ ID NO: 2695422 - RNA, 16 nt, Haemophilus influenzae Rd
uuuucaaaaauuuuug

SEQ ID NO: 2695423 - RNA, 14 nt, Haemophilus influenzae Rd
uuuucaaaaguuuu

SEQ ID NO: 2695424 - RNA, 11 nt, Haemophilus influenzae Rd
uuuucaaacac

SEQ ID NO: 2695425 - RNA, 21 nt, Haemophilus influenzae Rd
uuuucaaaggcucuaccuaaa

SEQ ID NO: 2695426 - RNA, 22 nt, Haemophilus influenzae Rd
uuuucaaauaaguuugauugaa

SEQ ID NO: 2695427 - RNA, 15 nt, Haemophilus influenzae Rd
uuuucaaauugaaaa

SEQ ID NO: 2695428 - RNA, 16 nt, Haemophilus influenzae Rd
uuuucaacaaaaaaca

SEQ ID NO: 2695429 - RNA, 11 nt, Haemophilus influenzae Rd
uuuugaauaaa

SEQ ID NO: 2695430 - RNA, 17 nt, Haemophilus influenzae Rd
uuuugaauaaauauucu

SEQ ID NO: 2695431 - RNA, 12 nt, Haemophilus influenzae Rd
uuuugaauaaua

SEQ ID NO: 2695432 - RNA, 22 nt, Haemophilus influenzae Rd
uuuugacaucacgaggauuuuu

SEQ ID NO: 2695433 - RNA, 14 nt, Haemophilus influenzae Rd
uuuugagauaaauu

SEQ ID NO: 2695434 - RNA, 17 nt, Haemophilus influenzae Rd
uuuugaggccagcuuga

SEQ ID NO: 2695435 - RNA, 22 nt, Haemophilus influenzae Rd
uuuugaggggaauuuuuuacug

SEQ ID NO: 2695436 - RNA, 17 nt, Haemophilus influenzae Rd
uuuugaguuuucaucua

SEQ ID NO: 2695437 - RNA, 14 nt, Haemophilus influenzae Rd
uuuugauaauuuuu

SEQ ID NO: 2695438 - RNA, 22 nt, Haemophilus influenzae Rd
uuuugauacuaacucaaaauac

SEQ ID NO: 2695439 - RNA, 23 nt, Haemophilus influenzae Rd
uuuugauacuaacucaaaauacu

SEQ ID NO: 2695440 - RNA, 13 nt, Haemophilus influenzae Rd
uuuugaugugauu

SEQ ID NO: 2695441 - RNA, 18 nt, Haemophilus influenzae Rd
uuuugauugagauuuaau

SEQ ID NO: 2695442 - RNA, 16 nt, Haemophilus influenzae Rd
uuuugauugcuacagc

SEQ ID NO: 2695443 - RNA, 22 nt, Haemophilus influenzae Rd
uuuugcaaaaaguacuugcaag

SEQ ID NO: 2695444 - RNA, 17 nt, Haemophilus influenzae Rd
uuuugcaauaaaguuga

SEQ ID NO: 2695445 - RNA, 13 nt, Haemophilus influenzae Rd
uuuugcaauuuuu

SEQ ID NO: 2695446 - RNA, 20 nt, Haemophilus influenzae Rd
uuuugcaccacguucuuuua

SEQ ID NO: 2695447 - RNA, 23 nt, Haemophilus influenzae Rd
uuuugcaccacguucuuuuaaug

SEQ ID NO: 2695448 - RNA, 15 nt, Haemophilus influenzae Rd
uuuugcacugguucu

SEQ ID NO: 2695449 - RNA, 16 nt, Haemophilus influenzae Rd
uuuugcaugauauuuu

SEQ ID NO: 2695450 - RNA, 18 nt, Haemophilus influenzae Rd
uuuugcauugagcacuuc

SEQ ID NO: 2695451 - RNA, 15 nt, Haemophilus influenzae Rd
uuuugccaaaaaacu

SEQ ID NO: 2695452 - RNA, 15 nt, Haemophilus influenzae Rd
uuuugccaaaauucu

SEQ ID NO: 2695453 - RNA, 20 nt, Haemophilus influenzae Rd
uuuugccgagaauaaaggga

SEQ ID NO: 2695454 - RNA, 14 nt, Haemophilus influenzae Rd
uuuuggaauauuau

SEQ ID NO: 2695455 - RNA, 16 nt, Haemophilus influenzae Rd
uuuuggaauauuaucu

SEQ ID NO: 2695456 - RNA, 13 nt, Haemophilus influenzae Rd
uuuuggacuuuau

SEQ ID NO: 2695457 - RNA, 22 nt, Haemophilus influenzae Rd
uuuuguaaucguucaaaaauuu

SEQ ID NO: 2695458 - RNA, 13 nt, Haemophilus influenzae Rd
uuuuguaauuucu

SEQ ID NO: 2695459 - RNA, 13 nt, Haemophilus influenzae Rd
uuuuguaauuuuu

SEQ ID NO: 2695460 - RNA, 23 nt, Haemophilus influenzae Rd
uuuuguacguccaugaacuguaa

SEQ ID NO: 2695461 - RNA, 12 nt, Haemophilus influenzae Rd
uuuuguacuucc

SEQ ID NO: 2695462 - RNA, 15 nt, Haemophilus influenzae Rd
uuuuguagauuaucu

SEQ ID NO: 2695463 - RNA, 19 nt, Haemophilus influenzae Rd
uuuuguauccaauccuaaa

SEQ ID NO: 2695464 - RNA, 20 nt, Haemophilus influenzae Rd
uuuugucaccaaauacauuu

SEQ ID NO: 2695465 - RNA, 23 nt, Haemophilus influenzae Rd
uuuugugaagauugaaauagacu

SEQ ID NO: 2695466 - RNA, 23 nt, Haemophilus influenzae Rd
uuuuguggcacgcccaaaggcuu

SEQ ID NO: 2695467 - RNA, 23 nt, Haemophilus influenzae Rd
uuuuguuacaucuucaaaaacau

SEQ ID NO: 2695468 - RNA, 17 nt, Haemophilus influenzae Rd
uuuuguucauuuuaaaa

SEQ ID NO: 2695469 - RNA, 14 nt, Haemophilus influenzae Rd
uuuuguucuaauuu

SEQ ID NO: 2695470 - RNA, 16 nt, Haemophilus influenzae Rd
uuuuguugauaaacau

SEQ ID NO: 2695471 - RNA, 22 nt, Haemophilus influenzae Rd
uuuuguugauuagcuaauauaa

SEQ ID NO: 2695472 - RNA, 16 nt, Haemophilus influenzae Rd
uuuuguugguugaguu

SEQ ID NO: 2695473 - RNA, 15 nt, Haemophilus influenzae Rd
uuuuguuuauuuacu

SEQ ID NO: 2695474 - RNA, 13 nt, Haemophilus influenzae Rd
uuuuguuucuaaa

SEQ ID NO: 2695475 - RNA, 22 nt, Haemophilus influenzae Rd
uuuuguuuguaauaaauuuuau

SEQ ID NO: 2695476 - RNA, 23 nt, Haemophilus influenzae Rd
uuuuguuuucaggauagagaaac

SEQ ID NO: 2695477 - RNA, 12 nt, Haemophilus influenzae Rd
uuuuguuuuguu

SEQ ID NO: 2695478 - RNA, 10 nt, Haemophilus influenzae Rd
uuuuuaaaac

SEQ ID NO: 2695479 - RNA, 14 nt, Haemophilus influenzae Rd
uuuuuaaaauagaa

SEQ ID NO: 2695480 - RNA, 17 nt, Haemophilus influenzae Rd
uuuuuaaacgaauauca

SEQ ID NO: 2695481 - RNA, 21 nt, Haemophilus influenzae Rd
uuuuuaaccgcacuuuuuaau

SEQ ID NO: 2695482 - RNA, 16 nt, Haemophilus influenzae Rd
uuuuuaaguaguauuu

SEQ ID NO: 2695483 - RNA, 14 nt, Haemophilus influenzae Rd
uuuuuaauaaagua

SEQ ID NO: 2695484 - RNA, 14 nt, Haemophilus influenzae Rd
uuuuuaauaaauca

SEQ ID NO: 2695485 - RNA, 14 nt, Haemophilus influenzae Rd
uuuuuaaucuccca

SEQ ID NO: 2695486 - RNA, 13 nt, Haemophilus influenzae Rd
uuuuuaauuacuc

SEQ ID NO: 2695487 - RNA, 20 nt, Haemophilus influenzae Rd
uuuuuaauuagagagaaaaa

SEQ ID NO: 2695488 - RNA, 16 nt, Haemophilus influenzae Rd
uuuuuacaaaaaguac

SEQ ID NO: 2695489 - RNA, 16 nt, Haemophilus influenzae Rd
uuuuuacauuauugaa

SEQ ID NO: 2695490 - RNA, 15 nt, Haemophilus influenzae Rd
uuuuuacguaauaag

SEQ ID NO: 2695491 - RNA, 19 nt, Haemophilus influenzae Rd
uuuuuacguucauguaaau

SEQ ID NO: 2695492 - RNA, 18 nt, Haemophilus influenzae Rd
uuuuuacuuuuacaaucc

SEQ ID NO: 2695493 - RNA, 16 nt, Haemophilus influenzae Rd
uuuuuagaaaaucacu

SEQ ID NO: 2695494 - RNA, 17 nt, Haemophilus influenzae Rd
uuuuuagauuuauuucu

SEQ ID NO: 2695495 - RNA, 23 nt, Haemophilus influenzae Rd
uuuuuagcucguugccauaaaaa

SEQ ID NO: 2695496 - RNA, 12 nt, Haemophilus influenzae Rd
uuuuuaguaucg

SEQ ID NO: 2695497 - RNA, 20 nt, Haemophilus influenzae Rd
uuuuuauaaaguaagccauu

SEQ ID NO: 2695498 - RNA, 15 nt, Haemophilus influenzae Rd
uuuuuauauguuccu

SEQ ID NO: 2695499 - RNA, 13 nt, Haemophilus influenzae Rd
uuuuuaucuaauu

SEQ ID NO: 2695500 - RNA, 20 nt, Haemophilus influenzae Rd
uuuuuaugagcaaauacaau

SEQ ID NO: 2695501 - RNA, 15 nt, Haemophilus influenzae Rd
uuuuuauuaauaaac

SEQ ID NO: 2695502 - RNA, 16 nt, Haemophilus influenzae Rd
uuuuuauuaauaaacu

SEQ ID NO: 2695503 - RNA, 23 nt, Haemophilus influenzae Rd
uuuuuauuaauuauaaaauagcc

SEQ ID NO: 2695504 - RNA, 12 nt, Haemophilus influenzae Rd
uuuuuauuaucu

SEQ ID NO: 2695505 - RNA, 19 nt, Haemophilus influenzae Rd
uuuuuauuaugcuaauaau

SEQ ID NO: 2695506 - RNA, 12 nt, Haemophilus influenzae Rd
uuuuuauucaau

SEQ ID NO: 2695507 - RNA, 18 nt, Haemophilus influenzae Rd
uuuuuauuuagaacaaua

SEQ ID NO: 2695508 - RNA, 19 nt, Haemophilus influenzae Rd
uuuuuauuuagaacaauac

SEQ ID NO: 2695509 - RNA, 12 nt, Haemophilus influenzae Rd
uuuuuauuuauu

SEQ ID NO: 2695510 - RNA, 13 nt, Haemophilus influenzae Rd
uuuuuauuugguu

SEQ ID NO: 2695511 - RNA, 12 nt, Haemophilus influenzae Rd
uuuuuauuuucu

SEQ ID NO: 2695512 - RNA, 15 nt, Haemophilus influenzae Rd
uuuuucaaaaagaua

SEQ ID NO: 2695513 - RNA, 12 nt, Haemophilus influenzae Rd
uuuuucaaugcu

SEQ ID NO: 2695514 - RNA, 22 nt, Haemophilus influenzae Rd
uuuuucacaccgucuaaaaauc

SEQ ID NO: 2695515 - RNA, 19 nt, Haemophilus influenzae Rd
uuuuucaccgcacuuucuu

SEQ ID NO: 2695516 - RNA, 21 nt, Haemophilus influenzae Rd
uuuuucaccgcacuuucuucu

SEQ ID NO: 2695517 - RNA, 24 nt, Haemophilus influenzae Rd
uuuuucagaagucacauauuguuu

SEQ ID NO: 2695518 - RNA, 18 nt, Haemophilus influenzae Rd
uuuuucagugaguucaua

SEQ ID NO: 2695519 - RNA, 23 nt, Haemophilus influenzae Rd
uuuuucaucauaauuuauucaaa

SEQ ID NO: 2695520 - RNA, 17 nt, Haemophilus influenzae Rd
uuuuucauugcaucagg

SEQ ID NO: 2695521 - RNA, 12 nt, Haemophilus influenzae Rd
uuuuuccagcaa

SEQ ID NO: 2695522 - RNA, 14 nt, Haemophilus influenzae Rd
uuuuuccagcaaaa

SEQ ID NO: 2695523 - RNA, 18 nt, Haemophilus influenzae Rd
uuuuucccacaaagguaa

SEQ ID NO: 2695524 - RNA, 11 nt, Haemophilus influenzae Rd
uuuuuccucag

SEQ ID NO: 2695525 - RNA, 11 nt, Haemophilus influenzae Rd
uuuuuccugau

SEQ ID NO: 2695526 - RNA, 20 nt, Haemophilus influenzae Rd
uuuuucgugaggucugcaau

SEQ ID NO: 2695527 - RNA, 22 nt, Haemophilus influenzae Rd
uuuuucuaaauagcuaacaaua

SEQ ID NO: 2695528 - RNA, 12 nt, Haemophilus influenzae Rd
uuuuucugcauu

SEQ ID NO: 2695529 - RNA, 13 nt, Haemophilus influenzae Rd
uuuuucuuguucu

SEQ ID NO: 2695530 - RNA, 13 nt, Haemophilus influenzae Rd
uuuuucuuuucuu

SEQ ID NO: 2695531 - RNA, 12 nt, Haemophilus influenzae Rd
uuuuugaccuuu

SEQ ID NO: 2695532 - RNA, 18 nt, Haemophilus influenzae Rd
uuuuugaggcuaaacuuu

SEQ ID NO: 2695533 - RNA, 19 nt, Haemophilus influenzae Rd
uuuuugaggggaauuuuuu

SEQ ID NO: 2695534 - RNA, 20 nt, Haemophilus influenzae Rd
uuuuugauaugccaccguca

SEQ ID NO: 2695535 - RNA, 16 nt, Haemophilus influenzae Rd
aacuagaccaaacucc

SEQ ID NO: 2695536 - RNA, 12 nt, Haemophilus influenzae Rd
aacuagcaaucu

SEQ ID NO: 2695537 - RNA, 22 nt, Haemophilus influenzae Rd
aacuauaauuagaucauaaaaa

SEQ ID NO: 2695538 - RNA, 22 nt, Haemophilus influenzae Rd
aacuauauccaaaucaaaaagc

SEQ ID NO: 2695539 - RNA, 14 nt, Haemophilus influenzae Rd
aacuaugaagacua

SEQ ID NO: 2695540 - RNA, 15 nt, Haemophilus influenzae Rd
aacuauuaucuacua

SEQ ID NO: 2695541 - RNA, 16 nt, Haemophilus influenzae Rd
aacuauucaaaugaaa

SEQ ID NO: 2695542 - RNA, 15 nt, Haemophilus influenzae Rd
aacuauugaaaauua

SEQ ID NO: 2695543 - RNA, 11 nt, Haemophilus influenzae Rd
aacuauuuuua

SEQ ID NO: 2695544 - RNA, 11 nt, Haemophilus influenzae Rd
aacucaaaaua

SEQ ID NO: 2695545 - RNA, 13 nt, Haemophilus influenzae Rd
aacucacuuuguu

SEQ ID NO: 2695546 - RNA, 16 nt, Haemophilus influenzae Rd
aacucagaauauaagu

SEQ ID NO: 2695547 - RNA, 17 nt, Haemophilus influenzae Rd
aacucaugcugagugaa

SEQ ID NO: 2695548 - RNA, 19 nt, Haemophilus influenzae Rd
aacucaugcugagugaaac

SEQ ID NO: 2695549 - RNA, 12 nt, Haemophilus influenzae Rd
aacucauucauc

SEQ ID NO: 2695550 - RNA, 21 nt, Haemophilus influenzae Rd
aacucauucaucaaaucauuu

SEQ ID NO: 2695551 - RNA, 20 nt, Haemophilus influenzae Rd
aacucuaauuccaccgcacu

SEQ ID NO: 2695552 - RNA, 13 nt, Haemophilus influenzae Rd
aacucuauaaaau

SEQ ID NO: 2695553 - RNA, 16 nt, Haemophilus influenzae Rd
aacucuggacaagcca

SEQ ID NO: 2695554 - RNA, 19 nt, Haemophilus influenzae Rd
aacucuguuugcauauaca

SEQ ID NO: 2695555 - RNA, 16 nt, Haemophilus influenzae Rd
aacucuuggcuaacuu

SEQ ID NO: 2695556 - RNA, 19 nt, Haemophilus influenzae Rd
aacucuugucauugccauu

SEQ ID NO: 2695557 - RNA, 12 nt, Haemophilus influenzae Rd
aacugaagcuuc

SEQ ID NO: 2695558 - RNA, 21 nt, Haemophilus influenzae Rd
aacugauuguccaaagaauaa

SEQ ID NO: 2695559 - RNA, 15 nt, Haemophilus influenzae Rd
aacugauuuugaguu

SEQ ID NO: 2695560 - RNA, 13 nt, Haemophilus influenzae Rd
aacugauuuugau

SEQ ID NO: 2695561 - RNA, 23 nt, Haemophilus influenzae Rd
aacugauuuugauuuagccagua

SEQ ID NO: 2695562 - RNA, 14 nt, Haemophilus influenzae Rd
aacugcaacaauuu

SEQ ID NO: 2695563 - RNA, 22 nt, Haemophilus influenzae Rd
aacugcacucgcucuaacaaua

SEQ ID NO: 2695564 - RNA, 19 nt, Haemophilus influenzae Rd
aacugccacaucaucguuu

SEQ ID NO: 2695565 - RNA, 23 nt, Haemophilus influenzae Rd
aacugcgauagaaucuacagcug

SEQ ID NO: 2695566 - RNA, 19 nt, Haemophilus influenzae Rd
aacugcgccaauauaaggg

SEQ ID NO: 2695567 - RNA, 15 nt, Haemophilus influenzae Rd
aacuggaauaaagca

SEQ ID NO: 2695568 - RNA, 16 nt, Haemophilus influenzae Rd
aacuggaugaaaucau

SEQ ID NO: 2695569 - RNA, 21 nt, Haemophilus influenzae Rd
aacuggcuguguaaaacauug

SEQ ID NO: 2695570 - RNA, 23 nt, Haemophilus influenzae Rd
aacuggcuuaaaugaucuaaugg

SEQ ID NO: 2695571 - RNA, 18 nt, Haemophilus influenzae Rd
aacugguuuaucacuaau

SEQ ID NO: 2695572 - RNA, 15 nt, Haemophilus influenzae Rd
aacuguaauuucggu

SEQ ID NO: 2695573 - RNA, 20 nt, Haemophilus influenzae Rd
aacugugaggcaaaggcuuc

SEQ ID NO: 2695574 - RNA, 20 nt, Haemophilus influenzae Rd
aacugugcggucuguugcaa

SEQ ID NO: 2695575 - RNA, 23 nt, Haemophilus influenzae Rd
aacugugcggucuguugcaaauu

SEQ ID NO: 2695576 - RNA, 21 nt, Haemophilus influenzae Rd
aacuguuauuugcaaagauau

SEQ ID NO: 2695577 - RNA, 13 nt, Haemophilus influenzae Rd
aacuguugccaua

SEQ ID NO: 2695578 - RNA, 15 nt, Haemophilus influenzae Rd
aacuuaaagaauacu

SEQ ID NO: 2695579 - RNA, 14 nt, Haemophilus influenzae Rd
aacuuaaauuuuua

SEQ ID NO: 2695580 - RNA, 20 nt, Haemophilus influenzae Rd
aacuuaaauuuuuauaaagu

SEQ ID NO: 2695581 - RNA, 17 nt, Haemophilus influenzae Rd
aacuuaccgaucauuuc

SEQ ID NO: 2695582 - RNA, 14 nt, Haemophilus influenzae Rd
aacuuagaaaauau

SEQ ID NO: 2695583 - RNA, 15 nt, Haemophilus influenzae Rd
aacuuagauuuucuu

SEQ ID NO: 2695584 - RNA, 22 nt, Haemophilus influenzae Rd
aacuuagauuuucuuauuauac

SEQ ID NO: 2695585 - RNA, 16 nt, Haemophilus influenzae Rd
aacuuaggaugauaca

SEQ ID NO: 2695586 - RNA, 15 nt, Haemophilus influenzae Rd
aacuuauaaagauau

SEQ ID NO: 2695587 - RNA, 17 nt, Haemophilus influenzae Rd
aacuuaucauuaaucuu

SEQ ID NO: 2695588 - RNA, 22 nt, Haemophilus influenzae Rd
aacuuaucauuaaucuuauaca

SEQ ID NO: 2695589 - RNA, 15 nt, Haemophilus influenzae Rd
aacuuaucuaaaaag

SEQ ID NO: 2695590 - RNA, 13 nt, Haemophilus influenzae Rd
aacuuauuuggaa

SEQ ID NO: 2695591 - RNA, 15 nt, Haemophilus influenzae Rd
aacuuauuuggaaca

SEQ ID NO: 2695592 - RNA, 17 nt, Haemophilus influenzae Rd
aacuucaaccacuucaa

SEQ ID NO: 2695593 - RNA, 22 nt, Haemophilus influenzae Rd
aacuucaauuuuuuaucaaaua

SEQ ID NO: 2695594 - RNA, 12 nt, Haemophilus influenzae Rd
aacuucaccaau

SEQ ID NO: 2695595 - RNA, 19 nt, Haemophilus influenzae Rd
aacuucaccagugaauuuc

SEQ ID NO: 2695596 - RNA, 23 nt, Haemophilus influenzae Rd
aacuucagcagcaaaaucuucuu

SEQ ID NO: 2695597 - RNA, 19 nt, Haemophilus influenzae Rd
aacuucagcuaagccaaua

SEQ ID NO: 2695598 - RNA, 13 nt, Haemophilus influenzae Rd
aacuucauccauu

SEQ ID NO: 2695599 - RNA, 14 nt, Haemophilus influenzae Rd
aacuucauccauuu

SEQ ID NO: 2695600 - RNA, 23 nt, Haemophilus influenzae Rd
aacuucauuuaguuuaagggcua

SEQ ID NO: 2695601 - RNA, 17 nt, Haemophilus influenzae Rd
aacuuccgcuaauacua

SEQ ID NO: 2695602 - RNA, 15 nt, Haemophilus influenzae Rd
aacuuccuaaugcca

SEQ ID NO: 2695603 - RNA, 14 nt, Haemophilus influenzae Rd
aacuucuaaaaaac

SEQ ID NO: 2695604 - RNA, 13 nt, Haemophilus influenzae Rd
aacuucuauguuu

SEQ ID NO: 2695605 - RNA, 16 nt, Haemophilus influenzae Rd
aacuucucaguguuuc

SEQ ID NO: 2695606 - RNA, 12 nt, Haemophilus influenzae Rd
aacuucucuuau

SEQ ID NO: 2695607 - RNA, 22 nt, Haemophilus influenzae Rd
aacuucuucauucccaucuuua

SEQ ID NO: 2695608 - RNA, 14 nt, Haemophilus influenzae Rd
aacuugaauggcua

SEQ ID NO: 2695609 - RNA, 22 nt, Haemophilus influenzae Rd
aacuugaauggcuaaagaaaua

SEQ ID NO: 2695610 - RNA, 16 nt, Haemophilus influenzae Rd
aacuugaauugaagag

SEQ ID NO: 2695611 - RNA, 15 nt, Haemophilus influenzae Rd
aacuugcuauuuucu

SEQ ID NO: 2695612 - RNA, 16 nt, Haemophilus influenzae Rd
aacuugcuauuuucua

SEQ ID NO: 2695613 - RNA, 17 nt, Haemophilus influenzae Rd
aacuugcuauuuucuaa

SEQ ID NO: 2695614 - RNA, 20 nt, Haemophilus influenzae Rd
aacuuguuuuccaaacauuu

SEQ ID NO: 2695615 - RNA, 21 nt, Haemophilus influenzae Rd
aacuuguuuuccaaacauuuu

SEQ ID NO: 2695616 - RNA, 21 nt, Haemophilus influenzae Rd
aacuuuacggauaauuucccu

SEQ ID NO: 2695617 - RNA, 16 nt, Haemophilus influenzae Rd
aacuuuagagauuuua

SEQ ID NO: 2695618 - RNA, 16 nt, Haemophilus influenzae Rd
aacuuuagucgcuuuc

SEQ ID NO: 2695619 - RNA, 15 nt, Haemophilus influenzae Rd
aacuuuauccccuac

SEQ ID NO: 2695620 - RNA, 12 nt, Haemophilus influenzae Rd
aacuuucaguua

SEQ ID NO: 2695621 - RNA, 19 nt, Haemophilus influenzae Rd
aacuuuccaccccagaauu

SEQ ID NO: 2695622 - RNA, 13 nt, Haemophilus influenzae Rd
aacuuuccauaua

SEQ ID NO: 2695623 - RNA, 13 nt, Haemophilus influenzae Rd
aacuuuccuacua

SEQ ID NO: 2695624 - RNA, 21 nt, Haemophilus influenzae Rd
aacuuucuacgacauuuuuaa

SEQ ID NO: 2695625 - RNA, 13 nt, Haemophilus influenzae Rd
aacuuucuaguuc

SEQ ID NO: 2695626 - RNA, 15 nt, Haemophilus influenzae Rd
aacuuuguucauuuu

SEQ ID NO: 2695627 - RNA, 11 nt, Haemophilus influenzae Rd
aacuuuuaaag

SEQ ID NO: 2695628 - RNA, 21 nt, Haemophilus influenzae Rd
aacuuuuagaaugcagauuaa

SEQ ID NO: 2695629 - RNA, 14 nt, Haemophilus influenzae Rd
aacuuuugagucaa

SEQ ID NO: 2695630 - RNA, 16 nt, Haemophilus influenzae Rd
aacuuuuguucuugcu

SEQ ID NO: 2695631 - RNA, 14 nt, Haemophilus influenzae Rd
aacuuuuuggcaua

SEQ ID NO: 2695632 - RNA, 18 nt, Haemophilus influenzae Rd
aagaaaacuuauaaagau

SEQ ID NO: 2695633 - RNA, 14 nt, Haemophilus influenzae Rd
aagaaaagcauuaa

SEQ ID NO: 2695634 - RNA, 15 nt, Haemophilus influenzae Rd
aagaaaagcauuaau

SEQ ID NO: 2695635 - RNA, 13 nt, Haemophilus influenzae Rd
aagaaaauacaau

SEQ ID NO: 2695636 - RNA, 21 nt, Haemophilus influenzae Rd
aagaaaauacauaauuaaauu

SEQ ID NO: 2695637 - RNA, 18 nt, Haemophilus influenzae Rd
aagaaaauagaaagaaua

SEQ ID NO: 2695638 - RNA, 14 nt, Haemophilus influenzae Rd
aagaaaauauuuaa

SEQ ID NO: 2695639 - RNA, 12 nt, Haemophilus influenzae Rd
aagaaaaucaaa

SEQ ID NO: 2695640 - RNA, 22 nt, Haemophilus influenzae Rd
aagaaaauugucgcuaacauau

SEQ ID NO: 2695641 - RNA, 18 nt, Haemophilus influenzae Rd
aagaaacaggacaccgcu

SEQ ID NO: 2695642 - RNA, 18 nt, Haemophilus influenzae Rd
aagaaacgccagcuuaag

SEQ ID NO: 2695643 - RNA, 14 nt, Haemophilus influenzae Rd
aagaaacguaaaca

SEQ ID NO: 2695644 - RNA, 18 nt, Haemophilus influenzae Rd
aagaaagcgacauuuugu

SEQ ID NO: 2695645 - RNA, 18 nt, Haemophilus influenzae Rd
aagaaaguuaaaacagag

SEQ ID NO: 2695646 - RNA, 15 nt, Haemophilus influenzae Rd
aagaaaguucuuuuu

SEQ ID NO: 2695647 - RNA, 20 nt, Haemophilus influenzae Rd
aagaaaguuucacggauuuc

SEQ ID NO: 2695648 - RNA, 14 nt, Haemophilus influenzae Rd
aagaaauaagcaau

SEQ ID NO: 2695649 - RNA, 14 nt, Haemophilus influenzae Rd
aagaaauaauaaaa

SEQ ID NO: 2695650 - RNA, 17 nt, Haemophilus influenzae Rd
aagaaauacaauccuug

SEQ ID NO: 2695651 - RNA, 14 nt, Haemophilus influenzae Rd
aagaaauauauuau

SEQ ID NO: 2695652 - RNA, 18 nt, Haemophilus influenzae Rd
aagaaauauuuuuaccgc

SEQ ID NO: 2695653 - RNA, 18 nt, Haemophilus influenzae Rd
aagaaauccccuacagau

SEQ ID NO: 2695654 - RNA, 21 nt, Haemophilus influenzae Rd
aagaaauccccuacagauaca

SEQ ID NO: 2695655 - RNA, 17 nt, Haemophilus influenzae Rd
aagaaauuaagaaauuu

SEQ ID NO: 2695656 - RNA, 21 nt, Haemophilus influenzae Rd
aagaaauucacucaauucaaa

SEQ ID NO: 2695657 - RNA, 22 nt, Haemophilus influenzae Rd
aagaaauuuuaaccgcacuuuu

SEQ ID NO: 2695658 - RNA, 21 nt, Haemophilus influenzae Rd
aagaaauuuuaaucacuguca

SEQ ID NO: 2695659 - RNA, 13 nt, Haemophilus influenzae Rd
aagaaauuuucuu

SEQ ID NO: 2695660 - RNA, 19 nt, Haemophilus influenzae Rd
aagaaauuuuguuuuguuc

SEQ ID NO: 2695661 - RNA, 19 nt, Haemophilus influenzae Rd
aagaacaaggggaaaauau

SEQ ID NO: 2695662 - RNA, 20 nt, Haemophilus influenzae Rd
aagaacaaggggaaaauauu

SEQ ID NO: 2695663 - RNA, 16 nt, Haemophilus influenzae Rd
aagaacguaaauuaug

SEQ ID NO: 2695664 - RNA, 20 nt, Haemophilus influenzae Rd
aagaagcuauuacucuuaau

SEQ ID NO: 2695665 - RNA, 21 nt, Haemophilus influenzae Rd
aagaagcucacuuuauauagu

SEQ ID NO: 2695666 - RNA, 23 nt, Haemophilus influenzae Rd
aagaagggaugauugacgaaaaa

SEQ ID NO: 2695667 - RNA, 22 nt, Haemophilus influenzae Rd
aagaagugcggggacaauugca

SEQ ID NO: 2695668 - RNA, 21 nt, Haemophilus influenzae Rd
aagaaguuuuccagauuuuac

SEQ ID NO: 2695669 - RNA, 12 nt, Haemophilus influenzae Rd
aagaauaaaaug

SEQ ID NO: 2695670 - RNA, 17 nt, Haemophilus influenzae Rd
aagaauacaccccaaaa

SEQ ID NO: 2695671 - RNA, 15 nt, Haemophilus influenzae Rd
aagaauaccacgcgu

SEQ ID NO: 2695672 - RNA, 18 nt, Haemophilus influenzae Rd
aagaauacuuaauagcug

SEQ ID NO: 2695673 - RNA, 16 nt, Haemophilus influenzae Rd
aagaauauaaauaaaa

SEQ ID NO: 2695674 - RNA, 15 nt, Haemophilus influenzae Rd
aagaauauuccaaag

SEQ ID NO: 2695675 - RNA, 16 nt, Haemophilus influenzae Rd
aagaauauucuuuucu

SEQ ID NO: 2695676 - RNA, 14 nt, Haemophilus influenzae Rd
aagaauauuuuaau

SEQ ID NO: 2695677 - RNA, 13 nt, Haemophilus influenzae Rd
aagaaucaucuuc

SEQ ID NO: 2695678 - RNA, 23 nt, Haemophilus influenzae Rd
aagaaucccauagcggauaacca

SEQ ID NO: 2695679 - RNA, 15 nt, Haemophilus influenzae Rd
aagaaucuuaaauuc

SEQ ID NO: 2695680 - RNA, 16 nt, Haemophilus influenzae Rd
aagaaugaaguagaaa

SEQ ID NO: 2695681 - RNA, 20 nt, Haemophilus influenzae Rd
aagaaugacguaauuugugc

SEQ ID NO: 2695682 - RNA, 21 nt, Haemophilus influenzae Rd
aagaaugacuggcuugugaaa

SEQ ID NO: 2695683 - RNA, 18 nt, Haemophilus influenzae Rd
aagaauguuugaaaauuc

SEQ ID NO: 2695684 - RNA, 22 nt, Haemophilus influenzae Rd
aagaauguuugaaaauucuucu

SEQ ID NO: 2695685 - RNA, 20 nt, Haemophilus influenzae Rd
aagaauguuuugauugagau

SEQ ID NO: 2695686 - RNA, 16 nt, Haemophilus influenzae Rd
aagaauuaaaaauggc

SEQ ID NO: 2695687 - RNA, 19 nt, Haemophilus influenzae Rd
aagaauugaucaaaauuau

SEQ ID NO: 2695688 - RNA, 23 nt, Haemophilus influenzae Rd
aagaauuggcgaaccuucacuua

SEQ ID NO: 2695689 - RNA, 17 nt, Haemophilus influenzae Rd
aagaauuucaucgcauu

SEQ ID NO: 2695690 - RNA, 21 nt, Haemophilus influenzae Rd
aagaauuucaucgcauuuuua

SEQ ID NO: 2695691 - RNA, 15 nt, Haemophilus influenzae Rd
aagaauuuuuucaca

SEQ ID NO: 2695692 - RNA, 19 nt, Haemophilus influenzae Rd
aagacaccugcaagugcgg

SEQ ID NO: 2695693 - RNA, 19 nt, Haemophilus influenzae Rd
aagacagaagaaguaaaaa

SEQ ID NO: 2695694 - RNA, 16 nt, Haemophilus influenzae Rd
aagacagcuauuaaaa

SEQ ID NO: 2695695 - RNA, 20 nt, Haemophilus influenzae Rd
aagacagcuauuaaaaaaag

SEQ ID NO: 2695696 - RNA, 23 nt, Haemophilus influenzae Rd
aagacagcuauuaaaaaaagcaa

SEQ ID NO: 2695697 - RNA, 23 nt, Haemophilus influenzae Rd
aagacaucauauauucaacuaaa

SEQ ID NO: 2695698 - RNA, 19 nt, Haemophilus influenzae Rd
aagacccaccgcaaaagcc

SEQ ID NO: 2695699 - RNA, 16 nt, Haemophilus influenzae Rd
aagaccccaagcaaau

SEQ ID NO: 2695700 - RNA, 17 nt, Haemophilus influenzae Rd
aagaccgcacuuuaaaa

SEQ ID NO: 2695701 - RNA, 22 nt, Haemophilus influenzae Rd
aagacgcuguuucuuuucaucu

SEQ ID NO: 2695702 - RNA, 18 nt, Haemophilus influenzae Rd
aagacggcgcguucuucu

SEQ ID NO: 2695703 - RNA, 16 nt, Haemophilus influenzae Rd
aagacuaaaaccacau

SEQ ID NO: 2695704 - RNA, 17 nt, Haemophilus influenzae Rd
aagacuaugcguagaaa

SEQ ID NO: 2695705 - RNA, 16 nt, Haemophilus influenzae Rd
aagacuauuaaguuca

SEQ ID NO: 2695706 - RNA, 18 nt, Haemophilus influenzae Rd
aagagaagcugaauaaaa

SEQ ID NO: 2695707 - RNA, 13 nt, Haemophilus influenzae Rd
aagagaauauuuc

SEQ ID NO: 2695708 - RNA, 21 nt, Haemophilus influenzae Rd
aagagaauuuucaucaauuuu

SEQ ID NO: 2695709 - RNA, 21 nt, Haemophilus influenzae Rd
aagagacucuguuccacaggu

SEQ ID NO: 2695710 - RNA, 18 nt, Haemophilus influenzae Rd
aagagagcuucucuuuuu

SEQ ID NO: 2695711 - RNA, 20 nt, Haemophilus influenzae Rd
aagagaucacuguaaauaau

SEQ ID NO: 2695712 - RNA, 17 nt, Haemophilus influenzae Rd
aagagauucuaauuccc

SEQ ID NO: 2695713 - RNA, 13 nt, Haemophilus influenzae Rd
aagagcaaauuua

SEQ ID NO: 2695714 - RNA, 14 nt, Haemophilus influenzae Rd
aagagcaaauuuaa

SEQ ID NO: 2695715 - RNA, 17 nt, Haemophilus influenzae Rd
aagagcaaauuuaaaua

SEQ ID NO: 2695716 - RNA, 22 nt, Haemophilus influenzae Rd
aagagcaaauuuaaauaauaaa

SEQ ID NO: 2695717 - RNA, 18 nt, Haemophilus influenzae Rd
aagagcggucgguuuuuc

SEQ ID NO: 2695718 - RNA, 23 nt, Haemophilus influenzae Rd
aagaggaaguuaauggguuaaaa

SEQ ID NO: 2695719 - RNA, 15 nt, Haemophilus influenzae Rd
aagaggagguagaaa

SEQ ID NO: 2695720 - RNA, 11 nt, Haemophilus influenzae Rd
aagaguaaaua

SEQ ID NO: 2695721 - RNA, 11 nt, Haemophilus influenzae Rd
aagaguaaauu

SEQ ID NO: 2695722 - RNA, 22 nt, Haemophilus influenzae Rd
aagaguacggauuggaccguuu

SEQ ID NO: 2695723 - RNA, 19 nt, Haemophilus influenzae Rd
aagaguucguccaaaaucu

SEQ ID NO: 2695724 - RNA, 21 nt, Haemophilus influenzae Rd
aagaguuuuaaccguuauaac

SEQ ID NO: 2695725 - RNA, 21 nt, Haemophilus influenzae Rd
aagauaaaacagagaaaaaaa

SEQ ID NO: 2695726 - RNA, 15 nt, Haemophilus influenzae Rd
aagauaaaagugcgg

SEQ ID NO: 2695727 - RNA, 20 nt, Haemophilus influenzae Rd
aagauaaauuacauaaaagc

SEQ ID NO: 2695728 - RNA, 22 nt, Haemophilus influenzae Rd
aagauaaauuacauaaaagcgg

SEQ ID NO: 2695729 - RNA, 13 nt, Haemophilus influenzae Rd
aagauaaauuuaa

SEQ ID NO: 2695730 - RNA, 14 nt, Haemophilus influenzae Rd
aagauaaauuuaaa

SEQ ID NO: 2695731 - RNA, 16 nt, Haemophilus influenzae Rd
aagauaacgauauguu

SEQ ID NO: 2695732 - RNA, 19 nt, Haemophilus influenzae Rd
aagauaacuuagaaaauau

SEQ ID NO: 2695733 - RNA, 21 nt, Haemophilus influenzae Rd
aagauaaguggggaaaaauau

SEQ ID NO: 2695734 - RNA, 13 nt, Haemophilus influenzae Rd
aagauaauaaagu

SEQ ID NO: 2695735 - RNA, 14 nt, Haemophilus influenzae Rd
aagauaauaaaguu

SEQ ID NO: 2695736 - RNA, 13 nt, Haemophilus influenzae Rd
aagauaaucccuu

SEQ ID NO: 2695737 - RNA, 12 nt, Haemophilus influenzae Rd
aagauaauuuuu

SEQ ID NO: 2695738 - RNA, 20 nt, Haemophilus influenzae Rd
aagauacacucacuuuuccu

SEQ ID NO: 2695739 - RNA, 12 nt, Haemophilus influenzae Rd
aagauaccaaua

SEQ ID NO: 2695740 - RNA, 15 nt, Haemophilus influenzae Rd
aagauaccaauaauc

SEQ ID NO: 2695741 - RNA, 17 nt, Haemophilus influenzae Rd
aagauacccauuucgau

SEQ ID NO: 2695742 - RNA, 14 nt, Haemophilus influenzae Rd
aagauagcaaaaua

SEQ ID NO: 2695743 - RNA, 21 nt, Haemophilus influenzae Rd
aagauaggauuccacuugaaa

SEQ ID NO: 2695744 - RNA, 23 nt, Haemophilus influenzae Rd
aagauaugcucgccucgcuuucc

SEQ ID NO: 2695745 - RNA, 13 nt, Haemophilus influenzae Rd
aagauauuauuau

SEQ ID NO: 2695746 - RNA, 23 nt, Haemophilus influenzae Rd
aagauauuauuauuaaauccaaa

SEQ ID NO: 2695747 - RNA, 19 nt, Haemophilus influenzae Rd
aagaucaagcacuuuuccu

SEQ ID NO: 2695748 - RNA, 21 nt, Haemophilus influenzae Rd
aagaucaagcacuuuuccuuu

SEQ ID NO: 2695749 - RNA, 22 nt, Haemophilus influenzae Rd
aagaucaagcacuuuuccuuuu

SEQ ID NO: 2695750 - RNA, 18 nt, Haemophilus influenzae Rd
aagaucaauauaaccuug

SEQ ID NO: 2695751 - RNA, 15 nt, Haemophilus influenzae Rd
aagaucaauggguuu

SEQ ID NO: 2695752 - RNA, 19 nt, Haemophilus influenzae Rd
aagaucaauggguuuaaaa

SEQ ID NO: 2695753 - RNA, 22 nt, Haemophilus influenzae Rd
aagaucagauuuuuuucagaaa

SEQ ID NO: 2695754 - RNA, 20 nt, Haemophilus influenzae Rd
aagaucaggaucaaaaauau

SEQ ID NO: 2695755 - RNA, 20 nt, Haemophilus influenzae Rd
aagaucaguuaccauacauu

SEQ ID NO: 2695756 - RNA, 16 nt, Haemophilus influenzae Rd
aagauccaaagacuaa

SEQ ID NO: 2695757 - RNA, 21 nt, Haemophilus influenzae Rd
aagauccuuccaccacaacag

SEQ ID NO: 2695758 - RNA, 23 nt, Haemophilus influenzae Rd
aagaucgauugcaucuuggcauu

SEQ ID NO: 2695759 - RNA, 22 nt, Haemophilus influenzae Rd
aagaucgccccaauuagauuac

SEQ ID NO: 2695760 - RNA, 14 nt, Haemophilus influenzae Rd
aagaucuaaaccua

SEQ ID NO: 2695761 - RNA, 22 nt, Haemophilus influenzae Rd
aagaucuucgaugugcauuuuu

SEQ ID NO: 2695762 - RNA, 18 nt, Haemophilus influenzae Rd
aagaucuucuuugcgauu

SEQ ID NO: 2695763 - RNA, 15 nt, Haemophilus influenzae Rd
aagaugaaagugcgg

SEQ ID NO: 2695764 - RNA, 14 nt, Haemophilus influenzae Rd
aagaugaagcuaag

SEQ ID NO: 2695765 - RNA, 17 nt, Haemophilus influenzae Rd
aagaugaagcuaagaaa

SEQ ID NO: 2695766 - RNA, 18 nt, Haemophilus influenzae Rd
aagaugaagcuaagaaaa

SEQ ID NO: 2695767 - RNA, 20 nt, Haemophilus influenzae Rd
aagaugacgaaaugaaauua

SEQ ID NO: 2695768 - RNA, 16 nt, Haemophilus influenzae Rd
aagaugacuuguuuca

SEQ ID NO: 2695769 - RNA, 21 nt, Haemophilus influenzae Rd
aagaugacuuguuucauaaaa

SEQ ID NO: 2695770 - RNA, 21 nt, Haemophilus influenzae Rd
aagaugaggcguuuuucuuaa

SEQ ID NO: 2695771 - RNA, 21 nt, Haemophilus influenzae Rd
aagauggcuauuuaagccuug

SEQ ID NO: 2695772 - RNA, 21 nt, Haemophilus influenzae Rd
aagauguuccuacagaacccg

SEQ ID NO: 2695773 - RNA, 23 nt, Haemophilus influenzae Rd
aagauguuguaaaaucucuauug

SEQ ID NO: 2695774 - RNA, 16 nt, Haemophilus influenzae Rd
aagauuacuuucauaa

SEQ ID NO: 2695775 - RNA, 21 nt, Haemophilus influenzae Rd
aagauuauacgaucacgauuu

SEQ ID NO: 2695776 - RNA, 18 nt, Haemophilus influenzae Rd
aagauuguccuuuugcca

SEQ ID NO: 2695777 - RNA, 14 nt, Haemophilus influenzae Rd
aagauuucuucuac

SEQ ID NO: 2695778 - RNA, 15 nt, Haemophilus influenzae Rd
aagauuugcaaggcu

SEQ ID NO: 2695779 - RNA, 12 nt, Haemophilus influenzae Rd
aagauuuuaaaa

SEQ ID NO: 2695780 - RNA, 16 nt, Haemophilus influenzae Rd
aagauuuuauacauuc

SEQ ID NO: 2695781 - RNA, 17 nt, Haemophilus influenzae Rd
aagauuuuaugaaaucu

SEQ ID NO: 2695782 - RNA, 16 nt, Haemophilus influenzae Rd
aagauuuuugauaaaa

SEQ ID NO: 2695783 - RNA, 23 nt, Haemophilus influenzae Rd
aagauuuuugauaaaaaagaaau

SEQ ID NO: 2695784 - RNA, 13 nt, Haemophilus influenzae Rd
aagcaaaaucaaa

SEQ ID NO: 2695785 - RNA, 22 nt, Haemophilus influenzae Rd
aagcaaauagacuaauucguuu

SEQ ID NO: 2695786 - RNA, 13 nt, Haemophilus influenzae Rd
aagcaaauauuua

SEQ ID NO: 2695787 - RNA, 19 nt, Haemophilus influenzae Rd
aagcaaauggcaucaauau

SEQ ID NO: 2695788 - RNA, 13 nt, Haemophilus influenzae Rd
aagcaacacagau

SEQ ID NO: 2695789 - RNA, 22 nt, Haemophilus influenzae Rd
aagcaaccgcacuucuaugaag

SEQ ID NO: 2695790 - RNA, 20 nt, Haemophilus influenzae Rd
aagcaaccuaaacccgcaau

SEQ ID NO: 2695791 - RNA, 23 nt, Haemophilus influenzae Rd
aagcaaccuaaacccgcaauuaa

SEQ ID NO: 2695792 - RNA, 23 nt, Haemophilus influenzae Rd
aagcaacgcaucgcccaauuugg

SEQ ID NO: 2695793 - RNA, 16 nt, Haemophilus influenzae Rd
aagcaagcaaaauuaa

SEQ ID NO: 2695794 - RNA, 23 nt, Haemophilus influenzae Rd
aagcaaggcgaaucgaaagauuc

SEQ ID NO: 2695795 - RNA, 17 nt, Haemophilus influenzae Rd
aagcaauaaacaaagaa

SEQ ID NO: 2695796 - RNA, 17 nt, Haemophilus influenzae Rd
aagcaauagauucuaag

SEQ ID NO: 2695797 - RNA, 13 nt, Haemophilus influenzae Rd
aagcaauauaauc

SEQ ID NO: 2695798 - RNA, 15 nt, Haemophilus influenzae Rd
aagcaauucuuccgu

SEQ ID NO: 2695799 - RNA, 21 nt, Haemophilus influenzae Rd
aagcaauucuuccguugcauu

SEQ ID NO: 2695800 - RNA, 22 nt, Haemophilus influenzae Rd
aagcaauuucaucacaucaaua

SEQ ID NO: 2695801 - RNA, 16 nt, Haemophilus influenzae Rd
aagcacaaagaaaaac

SEQ ID NO: 2695802 - RNA, 19 nt, Haemophilus influenzae Rd
aagcacaagauuugccaaa

SEQ ID NO: 2695803 - RNA, 23 nt, Haemophilus influenzae Rd
aagcacaagauuugccaaaauca

SEQ ID NO: 2695804 - RNA, 23 nt, Haemophilus influenzae Rd
aagcacaagggguuacagcugca

SEQ ID NO: 2695805 - RNA, 20 nt, Haemophilus influenzae Rd
aagcacauuaaucauuucaa

SEQ ID NO: 2695806 - RNA, 21 nt, Haemophilus influenzae Rd
aagcacauuaaucauuucaau

SEQ ID NO: 2695807 - RNA, 19 nt, Haemophilus influenzae Rd
aagcacugaaauucauuca

SEQ ID NO: 2695808 - RNA, 21 nt, Haemophilus influenzae Rd
aagcacuucaucacccaucaa

SEQ ID NO: 2695809 - RNA, 22 nt, Haemophilus influenzae Rd
aagcacuucaucacccaucaaa

SEQ ID NO: 2695810 - RNA, 23 nt, Haemophilus influenzae Rd
aagcacuucaucacccaucaaau

SEQ ID NO: 2695811 - RNA, 16 nt, Haemophilus influenzae Rd
aagcacuuuauuuaau

SEQ ID NO: 2695812 - RNA, 13 nt, Haemophilus influenzae Rd
aagcagaagaauc

SEQ ID NO: 2695813 - RNA, 20 nt, Haemophilus influenzae Rd
aagcagguuuuucuuuuaau

SEQ ID NO: 2695814 - RNA, 17 nt, Haemophilus influenzae Rd
aagcaguuuauugagcg

SEQ ID NO: 2695815 - RNA, 15 nt, Haemophilus influenzae Rd
aagcauaaaucuuua

SEQ ID NO: 2695816 - RNA, 17 nt, Haemophilus influenzae Rd
aagcauauuugcugcac

SEQ ID NO: 2695817 - RNA, 22 nt, Haemophilus influenzae Rd
aagcauauuugcugcacgaguu

SEQ ID NO: 2695818 - RNA, 20 nt, Haemophilus influenzae Rd
aagcauccaucgacauacaa

SEQ ID NO: 2695819 - RNA, 18 nt, Haemophilus influenzae Rd
aagcaucgcuggauaaau

SEQ ID NO: 2695820 - RNA, 20 nt, Haemophilus influenzae Rd
aagcaucgcuggauaaaugc

SEQ ID NO: 2695821 - RNA, 22 nt, Haemophilus influenzae Rd
aagcaucgcuggauaaaugccg

SEQ ID NO: 2695822 - RNA, 14 nt, Haemophilus influenzae Rd
aagcaugaauaaaa

SEQ ID NO: 2695823 - RNA, 12 nt, Haemophilus influenzae Rd
aagcauuaaguu

SEQ ID NO: 2695824 - RNA, 14 nt, Haemophilus influenzae Rd
aagcauuaaguuuu

SEQ ID NO: 2695825 - RNA, 13 nt, Haemophilus influenzae Rd
aagcauuacaaag

SEQ ID NO: 2695826 - RNA, 20 nt, Haemophilus influenzae Rd
aagcauuuugauaauuuuuc

SEQ ID NO: 2695827 - RNA, 23 nt, Haemophilus influenzae Rd
aagcauuuugauaauuuuucacc

SEQ ID NO: 2695828 - RNA, 12 nt, Haemophilus influenzae Rd
aagccaacuugu

SEQ ID NO: 2695829 - RNA, 14 nt, Haemophilus influenzae Rd
aagccaauaauuuc

SEQ ID NO: 2695830 - RNA, 22 nt, Haemophilus influenzae Rd
aagccaauagauuacguagaaa

SEQ ID NO: 2695831 - RNA, 14 nt, Haemophilus influenzae Rd
aagccaaugccaaa

SEQ ID NO: 2695832 - RNA, 16 nt, Haemophilus influenzae Rd
aagccaccagagaaau

SEQ ID NO: 2695833 - RNA, 21 nt, Haemophilus influenzae Rd
aagccaccagagaaaucauca

SEQ ID NO: 2695834 - RNA, 15 nt, Haemophilus influenzae Rd
aagccacugauuaua

SEQ ID NO: 2695835 - RNA, 21 nt, Haemophilus influenzae Rd
aagccacugauuauauuguug

SEQ ID NO: 2695836 - RNA, 20 nt, Haemophilus influenzae Rd
aagccacugugcauuaaauc

SEQ ID NO: 2695837 - RNA, 13 nt, Haemophilus influenzae Rd
aagccacuugcug

SEQ ID NO: 2695838 - RNA, 17 nt, Haemophilus influenzae Rd
aagccauguugauguaa

SEQ ID NO: 2695839 - RNA, 19 nt, Haemophilus influenzae Rd
aagccauguugauguaaaa

SEQ ID NO: 2695840 - RNA, 20 nt, Haemophilus influenzae Rd
aagccauuuaauguucccac

SEQ ID NO: 2695841 - RNA, 14 nt, Haemophilus influenzae Rd
aagccauuuucugc

SEQ ID NO: 2695842 - RNA, 23 nt, Haemophilus influenzae Rd
aagcccaauuacgaaguggcguu

SEQ ID NO: 2695843 - RNA, 17 nt, Haemophilus influenzae Rd
aagccccugaagccaau

SEQ ID NO: 2695844 - RNA, 20 nt, Haemophilus influenzae Rd
aagcccuaaucguugcccca

SEQ ID NO: 2695845 - RNA, 20 nt, Haemophilus influenzae Rd
aagcccuguagauuacagag

SEQ ID NO: 2695846 - RNA, 23 nt, Haemophilus influenzae Rd
aagcccuucuaugccaaucacaa

SEQ ID NO: 2695847 - RNA, 16 nt, Haemophilus influenzae Rd
aagccuaaaccaaaua

SEQ ID NO: 2695848 - RNA, 12 nt, Haemophilus influenzae Rd
aagccuaaaucu

SEQ ID NO: 2695849 - RNA, 18 nt, Haemophilus influenzae Rd
aagccuaaaucuucuuua

SEQ ID NO: 2695850 - RNA, 21 nt, Haemophilus influenzae Rd
aagccucugcagggaaaaauu

SEQ ID NO: 2695851 - RNA, 20 nt, Haemophilus influenzae Rd
aagccugcuacagaagcugc

SEQ ID NO: 2695852 - RNA, 18 nt, Haemophilus influenzae Rd
aagccuguugauguuuua

SEQ ID NO: 2695853 - RNA, 19 nt, Haemophilus influenzae Rd
aagccuguugauguuuuaa

SEQ ID NO: 2695854 - RNA, 23 nt, Haemophilus influenzae Rd
aagccuguugauguuuuaacaaa

SEQ ID NO: 2695855 - RNA, 13 nt, Haemophilus influenzae Rd
aagccuuuuaaaa

SEQ ID NO: 2695856 - RNA, 20 nt, Haemophilus influenzae Rd
aagccuuuuaaaaugaacaa

SEQ ID NO: 2695857 - RNA, 15 nt, Haemophilus influenzae Rd
aagcgaaaaacauau

SEQ ID NO: 2695858 - RNA, 14 nt, Haemophilus influenzae Rd
aagcgaacaccuug

SEQ ID NO: 2695859 - RNA, 22 nt, Haemophilus influenzae Rd
aagcgagcaaaaagucaaaaua

SEQ ID NO: 2695860 - RNA, 19 nt, Haemophilus influenzae Rd
aagcgaguuuugaaguuau

SEQ ID NO: 2695861 - RNA, 22 nt, Haemophilus influenzae Rd
aagcgcaaucgggcguucuuua

SEQ ID NO: 2695862 - RNA, 15 nt, Haemophilus influenzae Rd
aagcgcauuuaaaua

SEQ ID NO: 2695863 - RNA, 16 nt, Haemophilus influenzae Rd
aagcgcauuuaaauaa

SEQ ID NO: 2695864 - RNA, 16 nt, Haemophilus influenzae Rd
aagcgcguuuaucauc

SEQ ID NO: 2695865 - RNA, 18 nt, Haemophilus influenzae Rd
aagcggauuuguuaagua

SEQ ID NO: 2695866 - RNA, 21 nt, Haemophilus influenzae Rd
aagcgguaacgacaaaacuau

SEQ ID NO: 2695867 - RNA, 18 nt, Haemophilus influenzae Rd
aagcgguuguaauuguug

SEQ ID NO: 2695868 - RNA, 13 nt, Haemophilus influenzae Rd
aagcgugauuuuu

SEQ ID NO: 2695869 - RNA, 17 nt, Haemophilus influenzae Rd
aagcguucaaaaagaac

SEQ ID NO: 2695870 - RNA, 14 nt, Haemophilus influenzae Rd
aagcguucaucaau

SEQ ID NO: 2695871 - RNA, 19 nt, Haemophilus influenzae Rd
aagcguucaucuuauaaag

SEQ ID NO: 2695872 - RNA, 15 nt, Haemophilus influenzae Rd
aagcguugaaaauaa

SEQ ID NO: 2695873 - RNA, 17 nt, Haemophilus influenzae Rd
aagcguugaaaauaaau

SEQ ID NO: 2695874 - RNA, 18 nt, Haemophilus influenzae Rd
aagcguugaguaaauagc

SEQ ID NO: 2695875 - RNA, 13 nt, Haemophilus influenzae Rd
aagcuaagaaaau

SEQ ID NO: 2695876 - RNA, 16 nt, Haemophilus influenzae Rd
aagcuaagaaaaucca

SEQ ID NO: 2695877 - RNA, 17 nt, Haemophilus influenzae Rd
aagcuaaguacaaaaga

SEQ ID NO: 2695878 - RNA, 19 nt, Haemophilus influenzae Rd
aagcuaaguacaaaagagc

SEQ ID NO: 2695879 - RNA, 18 nt, Haemophilus influenzae Rd
aagcuaaugguuggaaga

SEQ ID NO: 2695880 - RNA, 21 nt, Haemophilus influenzae Rd
aagcuaaugguuggaagaaaa

SEQ ID NO: 2695881 - RNA, 16 nt, Haemophilus influenzae Rd
aagcuaauucuucuau

SEQ ID NO: 2695882 - RNA, 14 nt, Haemophilus influenzae Rd
aagcuacuaaaaau

SEQ ID NO: 2695883 - RNA, 22 nt, Haemophilus influenzae Rd
aagcuaucgucaaauuuaaaua

SEQ ID NO: 2695884 - RNA, 21 nt, Haemophilus influenzae Rd
aagcuauuacucuuaauuuuu

SEQ ID NO: 2695885 - RNA, 19 nt, Haemophilus influenzae Rd
aagcuauuguuauagaaaa

SEQ ID NO: 2695886 - RNA, 17 nt, Haemophilus influenzae Rd
aagcucgcuauuuugag

SEQ ID NO: 2695887 - RNA, 16 nt, Haemophilus influenzae Rd
aagcucggaauguuuu

SEQ ID NO: 2695888 - RNA, 22 nt, Haemophilus influenzae Rd
aagcucggaauguuuuaaagaa

SEQ ID NO: 2695889 - RNA, 13 nt, Haemophilus influenzae Rd
aagcugaaauuua

SEQ ID NO: 2695890 - RNA, 14 nt, Haemophilus influenzae Rd
aagcugaaauuuag

SEQ ID NO: 2695891 - RNA, 13 nt, Haemophilus influenzae Rd
aagcugaauaaaa

SEQ ID NO: 2695892 - RNA, 21 nt, Haemophilus influenzae Rd
aagcugaccacuuucaauuug

SEQ ID NO: 2695893 - RNA, 12 nt, Haemophilus influenzae Rd
aagcugauauaa

SEQ ID NO: 2695894 - RNA, 18 nt, Haemophilus influenzae Rd
aagcugauucuucauaaa

SEQ ID NO: 2695895 - RNA, 17 nt, Haemophilus influenzae Rd
aagcugcgaauugcaau

SEQ ID NO: 2695896 - RNA, 19 nt, Haemophilus influenzae Rd
aagcugcgaauugcaaugc

SEQ ID NO: 2695897 - RNA, 14 nt, Haemophilus influenzae Rd
aagcugcuuuuaau

SEQ ID NO: 2695898 - RNA, 15 nt, Haemophilus influenzae Rd
aagcugcuuuuaaua

SEQ ID NO: 2695899 - RNA, 17 nt, Haemophilus influenzae Rd
aagcugugguaaaaaua

SEQ ID NO: 2695900 - RNA, 14 nt, Haemophilus influenzae Rd
aagcuuaauauguu

SEQ ID NO: 2695901 - RNA, 16 nt, Haemophilus influenzae Rd
aagcuuauguaaauuu

SEQ ID NO: 2695902 - RNA, 19 nt, Haemophilus influenzae Rd
aagcuuauuucacuuuaca

SEQ ID NO: 2695903 - RNA, 13 nt, Haemophilus influenzae Rd
aagcuucauauaa

SEQ ID NO: 2695904 - RNA, 19 nt, Haemophilus influenzae Rd
aagcuuguccaugaaaaac

SEQ ID NO: 2695905 - RNA, 23 nt, Haemophilus influenzae Rd
aagcuuugcaacaaagugcggca

SEQ ID NO: 2695906 - RNA, 15 nt, Haemophilus influenzae Rd
aagcuuuuucuuguu

SEQ ID NO: 2695907 - RNA, 14 nt, Haemophilus influenzae Rd
aaggaaaaaggcau

SEQ ID NO: 2695908 - RNA, 16 nt, Haemophilus influenzae Rd
aaggaaacguaaaaua

SEQ ID NO: 2695909 - RNA, 13 nt, Haemophilus influenzae Rd
aaggaaagcccca

SEQ ID NO: 2695910 - RNA, 22 nt, Haemophilus influenzae Rd
aaggaaagccccauuucuuuuu

SEQ ID NO: 2695911 - RNA, 19 nt, Haemophilus influenzae Rd
aaggaaucccauauuuaaa

SEQ ID NO: 2695912 - RNA, 20 nt, Haemophilus influenzae Rd
aaggaaucccauauuuaaaa

SEQ ID NO: 2695913 - RNA, 18 nt, Haemophilus influenzae Rd
aaggaaucgaaauuaaaa

SEQ ID NO: 2695914 - RNA, 19 nt, Haemophilus influenzae Rd
aaggaauuggauuugaacg

SEQ ID NO: 2695915 - RNA, 15 nt, Haemophilus influenzae Rd
aaggacgaaggauaa

SEQ ID NO: 2695916 - RNA, 14 nt, Haemophilus influenzae Rd
aaggacuaaacuuu

SEQ ID NO: 2695917 - RNA, 15 nt, Haemophilus influenzae Rd
aaggacuaggcucug

SEQ ID NO: 2695918 - RNA, 17 nt, Haemophilus influenzae Rd
aaggagcuaguuuaguu

SEQ ID NO: 2695919 - RNA, 14 nt, Haemophilus influenzae Rd
aaggaucuuguaaa

SEQ ID NO: 2695920 - RNA, 22 nt, Haemophilus influenzae Rd
aaggauuaguaagugcuuugag

SEQ ID NO: 2695921 - RNA, 16 nt, Haemophilus influenzae Rd
aaggauuuauuuaaca

SEQ ID NO: 2695922 - RNA, 22 nt, Haemophilus influenzae Rd
aaggauuucuuaugaaaaaaaa

SEQ ID NO: 2695923 - RNA, 23 nt, Haemophilus influenzae Rd
aaggauuucuuaugaaaaaaaau

SEQ ID NO: 2695924 - RNA, 15 nt, Haemophilus influenzae Rd
aaggcaaagcaaaau

SEQ ID NO: 2695925 - RNA, 17 nt, Haemophilus influenzae Rd
aaggcaaagcaaaauca

SEQ ID NO: 2695926 - RNA, 23 nt, Haemophilus influenzae Rd
aaggcaagguaucuauaauuucg

SEQ ID NO: 2695927 - RNA, 20 nt, Haemophilus influenzae Rd
aaggcacagggcugauaaau

SEQ ID NO: 2695928 - RNA, 23 nt, Haemophilus influenzae Rd
aaggcaccgugggugugaaauau

SEQ ID NO: 2695929 - RNA, 20 nt, Haemophilus influenzae Rd
aaggcacugauuuuuuuaua

SEQ ID NO: 2695930 - RNA, 17 nt, Haemophilus influenzae Rd
aaggcaucggcagaauu

SEQ ID NO: 2695931 - RNA, 15 nt, Haemophilus influenzae Rd
aaggcauuuauuacg

SEQ ID NO: 2695932 - RNA, 16 nt, Haemophilus influenzae Rd
aaggccauauuuuccc

SEQ ID NO: 2695933 - RNA, 20 nt, Haemophilus influenzae Rd
aaggccuccgccaagugcgg

SEQ ID NO: 2695934 - RNA, 21 nt, Haemophilus influenzae Rd
aaggccuccgccaagugcggu

SEQ ID NO: 2695935 - RNA, 17 nt, Haemophilus influenzae Rd
aaggcgaacauaacuuu

SEQ ID NO: 2695936 - RNA, 18 nt, Haemophilus influenzae Rd
aaggcgaacauaacuuuu

SEQ ID NO: 2695937 - RNA, 18 nt, Haemophilus influenzae Rd
aaggcgagggauuuuaaa

SEQ ID NO: 2695938 - RNA, 19 nt, Haemophilus influenzae Rd
aaggcgagggauuuuaaau

SEQ ID NO: 2695939 - RNA, 15 nt, Haemophilus influenzae Rd
aaggcuaccugauac

SEQ ID NO: 2695940 - RNA, 16 nt, Haemophilus influenzae Rd
aaggcuaguucuuccu

SEQ ID NO: 2695941 - RNA, 13 nt, Haemophilus influenzae Rd
aaggcucaucauu

SEQ ID NO: 2695942 - RNA, 20 nt, Haemophilus influenzae Rd
aaggcuccaguuguaaagau

SEQ ID NO: 2695943 - RNA, 23 nt, Haemophilus influenzae Rd
aaggcugcuugauauaauauuuu

SEQ ID NO: 2695944 - RNA, 16 nt, Haemophilus influenzae Rd
aaggcuucauuugcuu

SEQ ID NO: 2695945 - RNA, 21 nt, Haemophilus influenzae Rd
aaggcuuuaccuuuuaauuca

SEQ ID NO: 2695946 - RNA, 20 nt, Haemophilus influenzae Rd
aaggcuuuuuuaauuacuca

SEQ ID NO: 2695947 - RNA, 20 nt, Haemophilus influenzae Rd
aagggauaaacccaaaaaag

SEQ ID NO: 2695948 - RNA, 18 nt, Haemophilus influenzae Rd
aagggaugguuaauuuuu

SEQ ID NO: 2695949 - RNA, 14 nt, Haemophilus influenzae Rd
aagggauuuaaaau

SEQ ID NO: 2695950 - RNA, 16 nt, Haemophilus influenzae Rd
aagggauuuaaaaucc

SEQ ID NO: 2695951 - RNA, 13 nt, Haemophilus influenzae Rd
aagggcaaaaaau

SEQ ID NO: 2695952 - RNA, 14 nt, Haemophilus influenzae Rd
aagggcguuuagga

SEQ ID NO: 2695953 - RNA, 16 nt, Haemophilus influenzae Rd
aaggguaucuaaauuu

SEQ ID NO: 2695954 - RNA, 20 nt, Haemophilus influenzae Rd
aaggguaucuaaauuugcug

SEQ ID NO: 2695955 - RNA, 11 nt, Haemophilus influenzae Rd
aagguaaaaau

SEQ ID NO: 2695956 - RNA, 13 nt, Haemophilus influenzae Rd
aagguaacgcccc

SEQ ID NO: 2695957 - RNA, 12 nt, Haemophilus influenzae Rd
aagguacaacag

SEQ ID NO: 2695958 - RNA, 13 nt, Haemophilus influenzae Rd
aagguauccacuu

SEQ ID NO: 2695959 - RNA, 17 nt, Haemophilus influenzae Rd
aagguaucuauaauuuc

SEQ ID NO: 2695960 - RNA, 18 nt, Haemophilus influenzae Rd
aagguauuuuuuuuaaag

SEQ ID NO: 2695961 - RNA, 14 nt, Haemophilus influenzae Rd
aaggucagcaaauu

SEQ ID NO: 2695962 - RNA, 20 nt, Haemophilus influenzae Rd
aaggucauacgaucuacauu

SEQ ID NO: 2695963 - RNA, 16 nt, Haemophilus influenzae Rd
aaggugcguucuacac

SEQ ID NO: 2695964 - RNA, 16 nt, Haemophilus influenzae Rd
aagguggauuggucac

SEQ ID NO: 2695965 - RNA, 24 nt, Haemophilus influenzae Rd
aagguggauuggucacgauaagau

SEQ ID NO: 2695966 - RNA, 15 nt, Haemophilus influenzae Rd
aaggugguuuuuguu

SEQ ID NO: 2695967 - RNA, 14 nt, Haemophilus influenzae Rd
aagguguaauucca

SEQ ID NO: 2695968 - RNA, 19 nt, Haemophilus influenzae Rd
aagguuauuucuugccaaa

SEQ ID NO: 2695969 - RNA, 20 nt, Haemophilus influenzae Rd
aagguuuaguggguaaacca

SEQ ID NO: 2695970 - RNA, 23 nt, Haemophilus influenzae Rd
aagguuuaguggguaaaccaaac

SEQ ID NO: 2695971 - RNA, 22 nt, Haemophilus influenzae Rd
aagguuuauagaugaacucaau

SEQ ID NO: 2695972 - RNA, 16 nt, Haemophilus influenzae Rd
aagguuuccaagaauu

SEQ ID NO: 2695973 - RNA, 21 nt, Haemophilus influenzae Rd
aagguuucuaaaugaauaaaa

SEQ ID NO: 2695974 - RNA, 16 nt, Haemophilus influenzae Rd
aagguuuuauuuucaa

SEQ ID NO: 2695975 - RNA, 15 nt, Haemophilus influenzae Rd
aagguuuucuuuguu

SEQ ID NO: 2695976 - RNA, 11 nt, Haemophilus influenzae Rd
aaguaaaaaaa

SEQ ID NO: 2695977 - RNA, 15 nt, Haemophilus influenzae Rd
aaguaaaaagaaaag

SEQ ID NO: 2695978 - RNA, 14 nt, Haemophilus influenzae Rd
aaguaaaaauaaaa

SEQ ID NO: 2695979 - RNA, 14 nt, Haemophilus influenzae Rd
aaguaaaaccauua

SEQ ID NO: 2695980 - RNA, 14 nt, Haemophilus influenzae Rd
aaguaaacaauuuu

SEQ ID NO: 2695981 - RNA, 17 nt, Haemophilus influenzae Rd
aaguaaacaauuuuccu

SEQ ID NO: 2695982 - RNA, 20 nt, Haemophilus influenzae Rd
aaguaaaccaaauccaguga

SEQ ID NO: 2695983 - RNA, 16 nt, Haemophilus influenzae Rd
aaguaaauauuuuuua

SEQ ID NO: 2695984 - RNA, 15 nt, Haemophilus influenzae Rd
aaguaaaucaacaau

SEQ ID NO: 2695985 - RNA, 23 nt, Haemophilus influenzae Rd
aaguaaaucggcuggauuucccg

SEQ ID NO: 2695986 - RNA, 13 nt, Haemophilus influenzae Rd
aaguaaauucagu

SEQ ID NO: 2695987 - RNA, 15 nt, Haemophilus influenzae Rd
aaguaaauucaguua

SEQ ID NO: 2695988 - RNA, 23 nt, Haemophilus influenzae Rd
aaguaaauucaguuaagaaaaua

SEQ ID NO: 2695989 - RNA, 17 nt, Haemophilus influenzae Rd
aaguaacaauguagaaa

SEQ ID NO: 2695990 - RNA, 18 nt, Haemophilus influenzae Rd
aaguaacaauguagaaau

SEQ ID NO: 2695991 - RNA, 23 nt, Haemophilus influenzae Rd
aaguaacuuuagaacauugauaa

SEQ ID NO: 2695992 - RNA, 13 nt, Haemophilus influenzae Rd
aaguaagcaaaua

SEQ ID NO: 2695993 - RNA, 15 nt, Haemophilus influenzae Rd
aaguaagucaagcua

SEQ ID NO: 2695994 - RNA, 12 nt, Haemophilus influenzae Rd
aaguaagucgca

SEQ ID NO: 2695995 - RNA, 18 nt, Haemophilus influenzae Rd
aaguaauaaucuucuucc

SEQ ID NO: 2695996 - RNA, 17 nt, Haemophilus influenzae Rd
aaguaauacaccaauaa

SEQ ID NO: 2695997 - RNA, 15 nt, Haemophilus influenzae Rd
aaguaauacuuuuua

SEQ ID NO: 2695998 - RNA, 18 nt, Haemophilus influenzae Rd
aaguaauacuuuuuauuu

SEQ ID NO: 2695999 - RNA, 12 nt, Haemophilus influenzae Rd
aaguaauauuuc

SEQ ID NO: 2696000 - RNA, 18 nt, Haemophilus influenzae Rd
aaguaaucagaacaagca

SEQ ID NO: 2696001 - RNA, 16 nt, Haemophilus influenzae Rd
aaguaaucuaaauauu

SEQ ID NO: 2696002 - RNA, 18 nt, Haemophilus influenzae Rd
aaguaaugaaaaguuauu

SEQ ID NO: 2696003 - RNA, 14 nt, Haemophilus influenzae Rd
aaguacaacugagc

SEQ ID NO: 2696004 - RNA, 21 nt, Haemophilus influenzae Rd
aaguacaauuaaauccaucaa

SEQ ID NO: 2696005 - RNA, 22 nt, Haemophilus influenzae Rd
aaguacacgaugaugcaggaaa

SEQ ID NO: 2696006 - RNA, 15 nt, Haemophilus influenzae Rd
aaguacauucaacca

SEQ ID NO: 2696007 - RNA, 17 nt, Haemophilus influenzae Rd
aaguacgacaucuuaaa

SEQ ID NO: 2696008 - RNA, 15 nt, Haemophilus influenzae Rd
aaguagaaauugcca

SEQ ID NO: 2696009 - RNA, 18 nt, Haemophilus influenzae Rd
aaguagauaacaaaagug

SEQ ID NO: 2696010 - RNA, 19 nt, Haemophilus influenzae Rd
aaguagcacuuuccaucau

SEQ ID NO: 2696011 - RNA, 21 nt, Haemophilus influenzae Rd
aaguaggcauuaugccuacuu

SEQ ID NO: 2696012 - RNA, 19 nt, Haemophilus influenzae Rd
aaguaggcugaauacauua

SEQ ID NO: 2696013 - RNA, 23 nt, Haemophilus influenzae Rd
aaguaggcugaauacauuaagua

SEQ ID NO: 2696014 - RNA, 20 nt, Haemophilus influenzae Rd
aaguaguauuuuauuuauag

SEQ ID NO: 2696015 - RNA, 18 nt, Haemophilus influenzae Rd
aaguauaacuaauuaaga

SEQ ID NO: 2696016 - RNA, 18 nt, Haemophilus influenzae Rd
aaguauaaguuauuuuua

SEQ ID NO: 2696017 - RNA, 21 nt, Haemophilus influenzae Rd
aaguauacuuuucaacacuuu

SEQ ID NO: 2696018 - RNA, 22 nt, Haemophilus influenzae Rd
aaguauacuuuucaacacuuua

SEQ ID NO: 2696019 - RNA, 14 nt, Haemophilus influenzae Rd
aaguaugugaugua

SEQ ID NO: 2696020 - RNA, 13 nt, Haemophilus influenzae Rd
aaguauuaaauau

SEQ ID NO: 2696021 - RNA, 18 nt, Haemophilus influenzae Rd
aaguauugagcgauaaaa

SEQ ID NO: 2696022 - RNA, 22 nt, Haemophilus influenzae Rd
aaguauuuuccuucugccauaa

SEQ ID NO: 2696023 - RNA, 21 nt, Haemophilus influenzae Rd
aaguauuuucuuuccaaccag

SEQ ID NO: 2696024 - RNA, 22 nt, Haemophilus influenzae Rd
aaguauuuucuuuccaaccagg

SEQ ID NO: 2696025 - RNA, 15 nt, Haemophilus influenzae Rd
aagucaaaauaagua

SEQ ID NO: 2696026 - RNA, 16 nt, Haemophilus influenzae Rd
aagucaagcuaaucuc

SEQ ID NO: 2696027 - RNA, 17 nt, Haemophilus influenzae Rd
aagucacauauuguuuc

SEQ ID NO: 2696028 - RNA, 19 nt, Haemophilus influenzae Rd
aagucacauauuguuucuu

SEQ ID NO: 2696029 - RNA, 14 nt, Haemophilus influenzae Rd
aagucaggaauaaa

SEQ ID NO: 2696030 - RNA, 16 nt, Haemophilus influenzae Rd
aagucaggaauaaaag

SEQ ID NO: 2696031 - RNA, 14 nt, Haemophilus influenzae Rd
aagucaucgaguuu

SEQ ID NO: 2696032 - RNA, 13 nt, Haemophilus influenzae Rd
aaguccaaguuuu

SEQ ID NO: 2696033 - RNA, 15 nt, Haemophilus influenzae Rd
aaguccaucacuuuu

SEQ ID NO: 2696034 - RNA, 24 nt, Haemophilus influenzae Rd
aaguccaucacuuuuaauucuuua

SEQ ID NO: 2696035 - RNA, 18 nt, Haemophilus influenzae Rd
aagucccaaaagcaaaug

SEQ ID NO: 2696036 - RNA, 18 nt, Haemophilus influenzae Rd
aagucccagcaauaccac

SEQ ID NO: 2696037 - RNA, 20 nt, Haemophilus influenzae Rd
aaguccccauuuguagaaag

SEQ ID NO: 2696038 - RNA, 17 nt, Haemophilus influenzae Rd
aagucgguucauuuggg

SEQ ID NO: 2696039 - RNA, 21 nt, Haemophilus influenzae Rd
aagucgugaucugcaucagau

SEQ ID NO: 2696040 - RNA, 13 nt, Haemophilus influenzae Rd
aagucguuucauc

SEQ ID NO: 2696041 - RNA, 15 nt, Haemophilus influenzae Rd
aagucguuucaucga

SEQ ID NO: 2696042 - RNA, 18 nt, Haemophilus influenzae Rd
aagucugcugaaauacaa

SEQ ID NO: 2696043 - RNA, 13 nt, Haemophilus influenzae Rd
aagucuuaaucuu

SEQ ID NO: 2696044 - RNA, 14 nt, Haemophilus influenzae Rd
aagucuucaucuuu

SEQ ID NO: 2696045 - RNA, 15 nt, Haemophilus influenzae Rd
aagugaaagauaaau

SEQ ID NO: 2696046 - RNA, 16 nt, Haemophilus influenzae Rd
aagugaaauuacucau

SEQ ID NO: 2696047 - RNA, 22 nt, Haemophilus influenzae Rd
aagugaaauucuaccugcugua

SEQ ID NO: 2696048 - RNA, 17 nt, Haemophilus influenzae Rd
aagugaaugaagguuuc

SEQ ID NO: 2696049 - RNA, 20 nt, Haemophilus influenzae Rd
aagugagaaaguuaaucaaa

SEQ ID NO: 2696050 - RNA, 14 nt, Haemophilus influenzae Rd
aagugauauccgcu

SEQ ID NO: 2696051 - RNA, 21 nt, Haemophilus influenzae Rd
aagugauauccgcuuuuaaaa

SEQ ID NO: 2696052 - RNA, 20 nt, Haemophilus influenzae Rd
aagugaucuugauccccaua

SEQ ID NO: 2696053 - RNA, 19 nt, Haemophilus influenzae Rd
aagugcaagccccugaagc

SEQ ID NO: 2696054 - RNA, 22 nt, Haemophilus influenzae Rd
aagugcagaucgcuauuuaaua

SEQ ID NO: 2696055 - RNA, 19 nt, Haemophilus influenzae Rd
aagugcagauuuuuuuaua

SEQ ID NO: 2696056 - RNA, 19 nt, Haemophilus influenzae Rd
aagugcaugagcuuugcuu

SEQ ID NO: 2696057 - RNA, 20 nt, Haemophilus influenzae Rd
aagugcaugagcuuugcuuu

SEQ ID NO: 2696058 - RNA, 22 nt, Haemophilus influenzae Rd
aagugcaugagcuuugcuuucg

SEQ ID NO: 2696059 - RNA, 17 nt, Haemophilus influenzae Rd
aagugcggaugaaauuu

SEQ ID NO: 2696060 - RNA, 21 nt, Haemophilus influenzae Rd
aagugcggggacaauugcagc

SEQ ID NO: 2696061 - RNA, 17 nt, Haemophilus influenzae Rd
aagugcgguaaaaaaau

SEQ ID NO: 2696062 - RNA, 24 nt, Haemophilus influenzae Rd
aagugcgguaaaauucuauuaaaa

SEQ ID NO: 2696063 - RNA, 17 nt, Haemophilus influenzae Rd
aagugcgguaaaauuuu

SEQ ID NO: 2696064 - RNA, 18 nt, Haemophilus influenzae Rd
aagugcgguaaaauuuuu

SEQ ID NO: 2696065 - RNA, 22 nt, Haemophilus influenzae Rd
aagugcgguaaauucuucaagu

SEQ ID NO: 2696066 - RNA, 16 nt, Haemophilus influenzae Rd
aagugcgguaaauuuu

SEQ ID NO: 2696067 - RNA, 23 nt, Haemophilus influenzae Rd
aagugcgguaaauuuuaaaauag

SEQ ID NO: 2696068 - RNA, 19 nt, Haemophilus influenzae Rd
aagugcgguaaauuuuuag

SEQ ID NO: 2696069 - RNA, 21 nt, Haemophilus influenzae Rd
aagugcgguaagguuucuaaa

SEQ ID NO: 2696070 - RNA, 17 nt, Haemophilus influenzae Rd
aagugcgguauuuuuau

SEQ ID NO: 2696071 - RNA, 23 nt, Haemophilus influenzae Rd
aagugcggucaacauaaagauua

SEQ ID NO: 2696072 - RNA, 20 nt, Haemophilus influenzae Rd
aagugcggucaauaaaaaua

SEQ ID NO: 2696073 - RNA, 17 nt, Haemophilus influenzae Rd
aagugcggucaauuuca

SEQ ID NO: 2696074 - RNA, 19 nt, Haemophilus influenzae Rd
aagugcggucaauuucaaa

SEQ ID NO: 2696075 - RNA, 23 nt, Haemophilus influenzae Rd
aagugcggucagcauaaagagaa

SEQ ID NO: 2696076 - RNA, 17 nt, Haemophilus influenzae Rd
aagugcggucauuuuug

SEQ ID NO: 2696077 - RNA, 18 nt, Haemophilus influenzae Rd
aagugcgguuauguguuc

SEQ ID NO: 2696078 - RNA, 17 nt, Haemophilus influenzae Rd
aagugcgguugaaauuu

SEQ ID NO: 2696079 - RNA, 19 nt, Haemophilus influenzae Rd
aagugcgguugaauuuuuu

SEQ ID NO: 2696080 - RNA, 20 nt, Haemophilus influenzae Rd
aagugcgguugauuuuccug

SEQ ID NO: 2696081 - RNA, 19 nt, Haemophilus influenzae Rd
aagugcguguauauauuuu

SEQ ID NO: 2696082 - RNA, 22 nt, Haemophilus influenzae Rd
aagugcguguauauauuuuccu

SEQ ID NO: 2696083 - RNA, 17 nt, Haemophilus influenzae Rd
aagugcuaucuuaaaua

SEQ ID NO: 2696084 - RNA, 14 nt, Haemophilus influenzae Rd
aaguggcauaaaga

SEQ ID NO: 2696085 - RNA, 15 nt, Haemophilus influenzae Rd
aaguggcauaaagaa

SEQ ID NO: 2696086 - RNA, 16 nt, Haemophilus influenzae Rd
aaguggcauaaagaaa

SEQ ID NO: 2696087 - RNA, 16 nt, Haemophilus influenzae Rd
aagugguggaauaaaa

SEQ ID NO: 2696088 - RNA, 13 nt, Haemophilus influenzae Rd
aaguguauaaaua

SEQ ID NO: 2696089 - RNA, 22 nt, Haemophilus influenzae Rd
aaguguauggucgguauucaua

SEQ ID NO: 2696090 - RNA, 23 nt, Haemophilus influenzae Rd
aaguguggauuuuguaauaaaac

SEQ ID NO: 2696091 - RNA, 20 nt, Haemophilus influenzae Rd
aaguguggcuuuuuuuccuu

SEQ ID NO: 2696092 - RNA, 22 nt, Haemophilus influenzae Rd
aaguguucgugauauccauuca

SEQ ID NO: 2696093 - RNA, 21 nt, Haemophilus influenzae Rd
aaguuaaaaaaugauuaaguu

SEQ ID NO: 2696094 - RNA, 18 nt, Haemophilus influenzae Rd
aaguuaaaacuugauuga

SEQ ID NO: 2696095 - RNA, 18 nt, Haemophilus influenzae Rd
aaguuaaaccaacaacug

SEQ ID NO: 2696096 - RNA, 14 nt, Haemophilus influenzae Rd
aaguuaaucaaacu

SEQ ID NO: 2696097 - RNA, 17 nt, Haemophilus influenzae Rd
aaguuaauggguuaaaa

SEQ ID NO: 2696098 - RNA, 15 nt, Haemophilus influenzae Rd
aaguuacaaguacua

SEQ ID NO: 2696099 - RNA, 15 nt, Haemophilus influenzae Rd
aaguuacacaaugcc

SEQ ID NO: 2696100 - RNA, 21 nt, Haemophilus influenzae Rd
aaguuacuuaauuuugcuaaa

SEQ ID NO: 2696101 - RNA, 17 nt, Haemophilus influenzae Rd
aaguuagacuaugaaau

SEQ ID NO: 2696102 - RNA, 20 nt, Haemophilus influenzae Rd
aaguuagacuaugaaaucaa

SEQ ID NO: 2696103 - RNA, 17 nt, Haemophilus influenzae Rd
aaguuauaguauauuua

SEQ ID NO: 2696104 - RNA, 19 nt, Haemophilus influenzae Rd
aaguuaucaaacaguucaa

SEQ ID NO: 2696105 - RNA, 22 nt, Haemophilus influenzae Rd
aaguuauuuauauaauuuaaca

SEQ ID NO: 2696106 - RNA, 13 nt, Haemophilus influenzae Rd
aaguuauuuuuac

SEQ ID NO: 2696107 - RNA, 19 nt, Haemophilus influenzae Rd
aaguuauuuuuacaaggac

SEQ ID NO: 2696108 - RNA, 23 nt, Haemophilus influenzae Rd
aaguucacaaaucuaaaaauaug

SEQ ID NO: 2696109 - RNA, 13 nt, Haemophilus influenzae Rd
aaguucacuucau

SEQ ID NO: 2696110 - RNA, 16 nt, Haemophilus influenzae Rd
aaguucaucauaaauu

SEQ ID NO: 2696111 - RNA, 19 nt, Haemophilus influenzae Rd
aaguucccaaagucuuaau

SEQ ID NO: 2696112 - RNA, 22 nt, Haemophilus influenzae Rd
aaguucgggcuucgcgcuaaau

SEQ ID NO: 2696113 - RNA, 16 nt, Haemophilus influenzae Rd
aaguucucaaaaaguu

SEQ ID NO: 2696114 - RNA, 23 nt, Haemophilus influenzae Rd
aaguucucaaaaaguuaaauaag

SEQ ID NO: 2696115 - RNA, 22 nt, Haemophilus influenzae Rd
aaguugaagagaauuuucauca

SEQ ID NO: 2696116 - RNA, 16 nt, Haemophilus influenzae Rd
aaguugaauuuucaau

SEQ ID NO: 2696117 - RNA, 15 nt, Haemophilus influenzae Rd
aaguugauauucacu

SEQ ID NO: 2696118 - RNA, 14 nt, Haemophilus influenzae Rd
aaguuggauucauu

SEQ ID NO: 2696119 - RNA, 16 nt, Haemophilus influenzae Rd
aaguuggauucauuaa

SEQ ID NO: 2696120 - RNA, 18 nt, Haemophilus influenzae Rd
aaguuggcacuucaauuu

SEQ ID NO: 2696121 - RNA, 18 nt, Haemophilus influenzae Rd
aaguuggccaauuugcau

SEQ ID NO: 2696122 - RNA, 14 nt, Haemophilus influenzae Rd
aaguuggcuuacag

SEQ ID NO: 2696123 - RNA, 18 nt, Haemophilus influenzae Rd
aaguugggauaagcuuuu

SEQ ID NO: 2696124 - RNA, 17 nt, Haemophilus influenzae Rd
aaguugggauuuaucuu

SEQ ID NO: 2696125 - RNA, 20 nt, Haemophilus influenzae Rd
aaguugggauuuaucuuccc

SEQ ID NO: 2696126 - RNA, 21 nt, Haemophilus influenzae Rd
aaguugggauuuaucuucccc

SEQ ID NO: 2696127 - RNA, 20 nt, Haemophilus influenzae Rd
aaguugguuuugcaauuuuu

SEQ ID NO: 2696128 - RNA, 21 nt, Haemophilus influenzae Rd
aaguugguuuugcaauuuuua

SEQ ID NO: 2696129 - RNA, 17 nt, Haemophilus influenzae Rd
aaguuuaacuuucaaca

SEQ ID NO: 2696130 - RNA, 19 nt, Haemophilus influenzae Rd
aaguuuaacuuucaacacg

SEQ ID NO: 2696131 - RNA, 13 nt, Haemophilus influenzae Rd
aaguuuaagaaaa

SEQ ID NO: 2696132 - RNA, 14 nt, Haemophilus influenzae Rd
aaguuuaugacgaa

SEQ ID NO: 2696133 - RNA, 13 nt, Haemophilus influenzae Rd
aaguuuaugaucu

SEQ ID NO: 2696134 - RNA, 22 nt, Haemophilus influenzae Rd
aaguuucuuuuacauuuggaua

SEQ ID NO: 2696135 - RNA, 18 nt, Haemophilus influenzae Rd
aaguuugagcaaaucaaa

SEQ ID NO: 2696136 - RNA, 22 nt, Haemophilus influenzae Rd
aaguuugagcaaaucaaaaccu

SEQ ID NO: 2696137 - RNA, 23 nt, Haemophilus influenzae Rd
aaguuugagcaaaucaaaaccuu

SEQ ID NO: 2696138 - RNA, 21 nt, Haemophilus influenzae Rd
aaguuugauccacaaauaaua

SEQ ID NO: 2696139 - RNA, 12 nt, Haemophilus influenzae Rd
aaguuugauucc

SEQ ID NO: 2696140 - RNA, 20 nt, Haemophilus influenzae Rd
aaguuugauuccguuuacaa

SEQ ID NO: 2696141 - RNA, 17 nt, Haemophilus influenzae Rd
aaguuugcuaucuuacc

SEQ ID NO: 2696142 - RNA, 23 nt, Haemophilus influenzae Rd
aaguuugcuaucuuaccuuuuuc

SEQ ID NO: 2696143 - RNA, 20 nt, Haemophilus influenzae Rd
aaguuugcuuagugaaaaga

SEQ ID NO: 2696144 - RNA, 22 nt, Haemophilus influenzae Rd
aaguuugcuuagugaaaagaaa

SEQ ID NO: 2696145 - RNA, 20 nt, Haemophilus influenzae Rd
aaguuuguagcgauauucuu

SEQ ID NO: 2696146 - RNA, 15 nt, Haemophilus influenzae Rd
aaguuuuaaaccaag

SEQ ID NO: 2696147 - RNA, 15 nt, Haemophilus influenzae Rd
aaguuuuccagauuu

SEQ ID NO: 2696148 - RNA, 22 nt, Haemophilus influenzae Rd
aaguuuugucugaaauuuuuau

SEQ ID NO: 2696149 - RNA, 14 nt, Haemophilus influenzae Rd
aaguuuuuuaaguu

SEQ ID NO: 2696150 - RNA, 16 nt, Haemophilus influenzae Rd
aaguuuuuuaaguuuc

SEQ ID NO: 2696151 - RNA, 18 nt, Haemophilus influenzae Rd
aaguuuuuuaaguuucca

SEQ ID NO: 2696152 - RNA, 13 nt, Haemophilus influenzae Rd
aauaaaaaaacac

SEQ ID NO: 2696153 - RNA, 22 nt, Haemophilus influenzae Rd
aauaaaaaaacccaguuuuaaa

SEQ ID NO: 2696154 - RNA, 11 nt, Haemophilus influenzae Rd
aauaaaaaaua

SEQ ID NO: 2696155 - RNA, 16 nt, Haemophilus influenzae Rd
aauaaaaaauaaauua

SEQ ID NO: 2696156 - RNA, 13 nt, Haemophilus influenzae Rd
aauaaaaaauauu

SEQ ID NO: 2696157 - RNA, 11 nt, Haemophilus influenzae Rd
aauaaaaaauc

SEQ ID NO: 2696158 - RNA, 18 nt, Haemophilus influenzae Rd
aauaaaaaauccacacuu

SEQ ID NO: 2696159 - RNA, 17 nt, Haemophilus influenzae Rd
aauaaaaacauugccaa

SEQ ID NO: 2696160 - RNA, 15 nt, Haemophilus influenzae Rd
aauaaaaacgcccuu

SEQ ID NO: 2696161 - RNA, 18 nt, Haemophilus influenzae Rd
aauaaaaaggaaauaauu

SEQ ID NO: 2696162 - RNA, 23 nt, Haemophilus influenzae Rd
aauaaaaauauauuuagauacaa

SEQ ID NO: 2696163 - RNA, 16 nt, Haemophilus influenzae Rd
aauaaaaaugaauaaa

SEQ ID NO: 2696164 - RNA, 19 nt, Haemophilus influenzae Rd
aauaaaaaugaauaaaauu

SEQ ID NO: 2696165 - RNA, 22 nt, Haemophilus influenzae Rd
aauaaaaccauauugcuauuca

SEQ ID NO: 2696166 - RNA, 18 nt, Haemophilus influenzae Rd
aauaaaacccaguuuaaa

SEQ ID NO: 2696167 - RNA, 23 nt, Haemophilus influenzae Rd
aauaaaacgggaucuauuugauu

SEQ ID NO: 2696168 - RNA, 22 nt, Haemophilus influenzae Rd
aauaaaagagagcuucucuuuu

SEQ ID NO: 2696169 - RNA, 18 nt, Haemophilus influenzae Rd
aauaaaagauaacaaaua

SEQ ID NO: 2696170 - RNA, 13 nt, Haemophilus influenzae Rd
aauaaaagcaaua

SEQ ID NO: 2696171 - RNA, 22 nt, Haemophilus influenzae Rd
aauaaaagugcgguauuuuuua

SEQ ID NO: 2696172 - RNA, 18 nt, Haemophilus influenzae Rd
aauaaaauaacaaaaaag

SEQ ID NO: 2696173 - RNA, 18 nt, Haemophilus influenzae Rd
accaacuaaggugcagau

SEQ ID NO: 2696174 - RNA, 15 nt, Haemophilus influenzae Rd
accaagaaaccaaca

SEQ ID NO: 2696175 - RNA, 12 nt, Haemophilus influenzae Rd
accaagaaucaa

SEQ ID NO: 2696176 - RNA, 20 nt, Haemophilus influenzae Rd
accaagagccuccacaagca

SEQ ID NO: 2696177 - RNA, 13 nt, Haemophilus influenzae Rd
accaagccauuua

SEQ ID NO: 2696178 - RNA, 22 nt, Haemophilus influenzae Rd
accaaggaauuguaauuuugug

SEQ ID NO: 2696179 - RNA, 20 nt, Haemophilus influenzae Rd
accaaggcauuuuuucugca

SEQ ID NO: 2696180 - RNA, 19 nt, Haemophilus influenzae Rd
accaagucagcucaagcaa

SEQ ID NO: 2696181 - RNA, 18 nt, Haemophilus influenzae Rd
accaauaagccuuuucau

SEQ ID NO: 2696182 - RNA, 23 nt, Haemophilus influenzae Rd
accaauaauccuuuuuuugaacg

SEQ ID NO: 2696183 - RNA, 23 nt, Haemophilus influenzae Rd
accaauaauuaaugcuaaaccaa

SEQ ID NO: 2696184 - RNA, 11 nt, Haemophilus influenzae Rd
accaauaccaa

SEQ ID NO: 2696185 - RNA, 13 nt, Haemophilus influenzae Rd
accaauaccaaua

SEQ ID NO: 2696186 - RNA, 16 nt, Haemophilus influenzae Rd
accaauacgauaauua

SEQ ID NO: 2696187 - RNA, 12 nt, Haemophilus influenzae Rd
accaauauaauc

SEQ ID NO: 2696188 - RNA, 16 nt, Haemophilus influenzae Rd
accaauauaauuuacu

SEQ ID NO: 2696189 - RNA, 15 nt, Haemophilus influenzae Rd
accaaucaaagugcg

SEQ ID NO: 2696190 - RNA, 17 nt, Haemophilus influenzae Rd
accaaucacaacacaau

SEQ ID NO: 2696191 - RNA, 15 nt, Haemophilus influenzae Rd
accaaucauaaaauu

SEQ ID NO: 2696192 - RNA, 21 nt, Haemophilus influenzae Rd
accaaucauaaaauuuccgcc

SEQ ID NO: 2696193 - RNA, 11 nt, Haemophilus influenzae Rd
accaaugaaua

SEQ ID NO: 2696194 - RNA, 14 nt, Haemophilus influenzae Rd
accaaugagaaaaa

SEQ ID NO: 2696195 - RNA, 14 nt, Haemophilus influenzae Rd
accaaugcaacagg

SEQ ID NO: 2696196 - RNA, 15 nt, Haemophilus influenzae Rd
accaauggcaaucac

SEQ ID NO: 2696197 - RNA, 15 nt, Haemophilus influenzae Rd
accaauuaagcaaua

SEQ ID NO: 2696198 - RNA, 16 nt, Haemophilus influenzae Rd
accaauucaaagauuu

SEQ ID NO: 2696199 - RNA, 11 nt, Haemophilus influenzae Rd
accaauuccaa

SEQ ID NO: 2696200 - RNA, 16 nt, Haemophilus influenzae Rd
accaauugaugcacaa

SEQ ID NO: 2696201 - RNA, 19 nt, Haemophilus influenzae Rd
accaauugcaacuucgccu

SEQ ID NO: 2696202 - RNA, 23 nt, Haemophilus influenzae Rd
accaauuucuggcauacccaaug

SEQ ID NO: 2696203 - RNA, 14 nt, Haemophilus influenzae Rd
accaauuuuuucau

SEQ ID NO: 2696204 - RNA, 17 nt, Haemophilus influenzae Rd
accacaagaugguaauu

SEQ ID NO: 2696205 - RNA, 18 nt, Haemophilus influenzae Rd
accacaagaugguaauuu

SEQ ID NO: 2696206 - RNA, 21 nt, Haemophilus influenzae Rd
accacacccuuuucaaacaac

SEQ ID NO: 2696207 - RNA, 16 nt, Haemophilus influenzae Rd
accacagccaagguuu

SEQ ID NO: 2696208 - RNA, 15 nt, Haemophilus influenzae Rd
accacagcccaaaau

SEQ ID NO: 2696209 - RNA, 18 nt, Haemophilus influenzae Rd
accacagcccaaaauuca

SEQ ID NO: 2696210 - RNA, 17 nt, Haemophilus influenzae Rd
accacaucaaauuuauc

SEQ ID NO: 2696211 - RNA, 14 nt, Haemophilus influenzae Rd
accacaugaauuuc

SEQ ID NO: 2696212 - RNA, 17 nt, Haemophilus influenzae Rd
accacauucaaauccaa

SEQ ID NO: 2696213 - RNA, 20 nt, Haemophilus influenzae Rd
accacauucaaauccaauga

SEQ ID NO: 2696214 - RNA, 21 nt, Haemophilus influenzae Rd
accacauuucgaguuugucau

SEQ ID NO: 2696215 - RNA, 22 nt, Haemophilus influenzae Rd
accacccuucuuucaaauuccc

SEQ ID NO: 2696216 - RNA, 14 nt, Haemophilus influenzae Rd
accaccgauuaaua

SEQ ID NO: 2696217 - RNA, 20 nt, Haemophilus influenzae Rd
accaccgauuaauaaaauca

SEQ ID NO: 2696218 - RNA, 20 nt, Haemophilus influenzae Rd
accaccugaugcuuuaacac

SEQ ID NO: 2696219 - RNA, 22 nt, Haemophilus influenzae Rd
accaccugaugcuuuaacacca

SEQ ID NO: 2696220 - RNA, 18 nt, Haemophilus influenzae Rd
accacgaccuaagaaaag

SEQ ID NO: 2696221 - RNA, 16 nt, Haemophilus influenzae Rd
accacgaguauauugc

SEQ ID NO: 2696222 - RNA, 22 nt, Haemophilus influenzae Rd
accacgauacggcaaauuaaau

SEQ ID NO: 2696223 - RNA, 13 nt, Haemophilus influenzae Rd
accacgccuucga

SEQ ID NO: 2696224 - RNA, 21 nt, Haemophilus influenzae Rd
accacguucuuguaagccaaa

SEQ ID NO: 2696225 - RNA, 14 nt, Haemophilus influenzae Rd
accacguucuuuua

SEQ ID NO: 2696226 - RNA, 20 nt, Haemophilus influenzae Rd
accacguucuuuuaaugcuu

SEQ ID NO: 2696227 - RNA, 21 nt, Haemophilus influenzae Rd
accacguuuucaacagugaaa

SEQ ID NO: 2696228 - RNA, 14 nt, Haemophilus influenzae Rd
accacuaaaaaagc

SEQ ID NO: 2696229 - RNA, 13 nt, Haemophilus influenzae Rd
accacuaaaacac

SEQ ID NO: 2696230 - RNA, 21 nt, Haemophilus influenzae Rd
accacuaaaacacguuugcca

SEQ ID NO: 2696231 - RNA, 18 nt, Haemophilus influenzae Rd
accacuucagcagauaca

SEQ ID NO: 2696232 - RNA, 18 nt, Haemophilus influenzae Rd
accacuucauauaaauua

SEQ ID NO: 2696233 - RNA, 14 nt, Haemophilus influenzae Rd
accacuucauccaa

SEQ ID NO: 2696234 - RNA, 16 nt, Haemophilus influenzae Rd
accacuugccaaacau

SEQ ID NO: 2696235 - RNA, 17 nt, Haemophilus influenzae Rd
accacuugccaaacauu

SEQ ID NO: 2696236 - RNA, 22 nt, Haemophilus influenzae Rd
accacuugucauuaaaaaauaa

SEQ ID NO: 2696237 - RNA, 19 nt, Haemophilus influenzae Rd
accagaaauagaguuaagu

SEQ ID NO: 2696238 - RNA, 17 nt, Haemophilus influenzae Rd
accagacaaaauuuuac

SEQ ID NO: 2696239 - RNA, 13 nt, Haemophilus influenzae Rd
accagaugcaaua

SEQ ID NO: 2696240 - RNA, 24 nt, Haemophilus influenzae Rd
accagccgacuauuacaagauaau

SEQ ID NO: 2696241 - RNA, 16 nt, Haemophilus influenzae Rd
accagccugaaaaagc

SEQ ID NO: 2696242 - RNA, 23 nt, Haemophilus influenzae Rd
accagccugaaaaagcuaaaaaa

SEQ ID NO: 2696243 - RNA, 13 nt, Haemophilus influenzae Rd
accaggcgaaacc

SEQ ID NO: 2696244 - RNA, 18 nt, Haemophilus influenzae Rd
accagucaagguugcaac

SEQ ID NO: 2696245 - RNA, 14 nt, Haemophilus influenzae Rd
accaguuauucuuc

SEQ ID NO: 2696246 - RNA, 20 nt, Haemophilus influenzae Rd
accauaacuuaugaauaaua

SEQ ID NO: 2696247 - RNA, 15 nt, Haemophilus influenzae Rd
accauacauaaaauc

SEQ ID NO: 2696248 - RNA, 16 nt, Haemophilus influenzae Rd
accauacauaaaaucu

SEQ ID NO: 2696249 - RNA, 22 nt, Haemophilus influenzae Rd
accauacauucagugguaauca

SEQ ID NO: 2696250 - RNA, 17 nt, Haemophilus influenzae Rd
accauacuugccacagg

SEQ ID NO: 2696251 - RNA, 13 nt, Haemophilus influenzae Rd
accauaucaauuu

SEQ ID NO: 2696252 - RNA, 19 nt, Haemophilus influenzae Rd
accauauccauugcaacac

SEQ ID NO: 2696253 - RNA, 20 nt, Haemophilus influenzae Rd
accauaucguaaccaucaga

SEQ ID NO: 2696254 - RNA, 22 nt, Haemophilus influenzae Rd
accauaucuuccaaagcaaucc

SEQ ID NO: 2696255 - RNA, 18 nt, Haemophilus influenzae Rd
accauauuaaucgcaaua

SEQ ID NO: 2696256 - RNA, 22 nt, Haemophilus influenzae Rd
accauauuaaucgcaauaacac

SEQ ID NO: 2696257 - RNA, 14 nt, Haemophilus influenzae Rd
accaucacaagcaa

SEQ ID NO: 2696258 - RNA, 20 nt, Haemophilus influenzae Rd
accaucacguaauacaaaau

SEQ ID NO: 2696259 - RNA, 13 nt, Haemophilus influenzae Rd
accauccaagcaa

SEQ ID NO: 2696260 - RNA, 15 nt, Haemophilus influenzae Rd
accauccgaaauuaa

SEQ ID NO: 2696261 - RNA, 21 nt, Haemophilus influenzae Rd
accaucguuaaaccaaauaau

SEQ ID NO: 2696262 - RNA, 19 nt, Haemophilus influenzae Rd
accaucuaauacgucuaau

SEQ ID NO: 2696263 - RNA, 12 nt, Haemophilus influenzae Rd
accaucuacacg

SEQ ID NO: 2696264 - RNA, 23 nt, Haemophilus influenzae Rd
accaucuacacggagauauugua

SEQ ID NO: 2696265 - RNA, 12 nt, Haemophilus influenzae Rd
accaucuucaac

SEQ ID NO: 2696266 - RNA, 16 nt, Haemophilus influenzae Rd
accaucuucaacgaua

SEQ ID NO: 2696267 - RNA, 19 nt, Haemophilus influenzae Rd
accaucuuuaauuccaacu

SEQ ID NO: 2696268 - RNA, 16 nt, Haemophilus influenzae Rd
accauguaaucacaaa

SEQ ID NO: 2696269 - RNA, 14 nt, Haemophilus influenzae Rd
accauucaguaaua

SEQ ID NO: 2696270 - RNA, 18 nt, Haemophilus influenzae Rd
accauucaugucgcuugc

SEQ ID NO: 2696271 - RNA, 21 nt, Haemophilus influenzae Rd
accauucucuaacgcauucaa

SEQ ID NO: 2696272 - RNA, 11 nt, Haemophilus influenzae Rd
accauucuuuc

SEQ ID NO: 2696273 - RNA, 13 nt, Haemophilus influenzae Rd
accauucuuucaa

SEQ ID NO: 2696274 - RNA, 21 nt, Haemophilus influenzae Rd
accauucuuucaauaauuuuu

SEQ ID NO: 2696275 - RNA, 23 nt, Haemophilus influenzae Rd
accauucuuucaauaauuuuucu

SEQ ID NO: 2696276 - RNA, 21 nt, Haemophilus influenzae Rd
accauugcguucacucacuuu

SEQ ID NO: 2696277 - RNA, 22 nt, Haemophilus influenzae Rd
accauugcguucacucacuuua

SEQ ID NO: 2696278 - RNA, 12 nt, Haemophilus influenzae Rd
uucaaagcgaug

SEQ ID NO: 2696279 - RNA, 17 nt, Haemophilus influenzae Rd
uucaaagcguuuuaaaa

SEQ ID NO: 2696280 - RNA, 22 nt, Haemophilus influenzae Rd
uucaaaggcucuaccuaaaaua

SEQ ID NO: 2696281 - RNA, 17 nt, Haemophilus influenzae Rd
uucaaauccaaugaucc

SEQ ID NO: 2696282 - RNA, 19 nt, Haemophilus influenzae Rd
uucaaaucgaucacuuaau

SEQ ID NO: 2696283 - RNA, 23 nt, Haemophilus influenzae Rd
uucaaaucguuugccguaauaac

SEQ ID NO: 2696284 - RNA, 14 nt, Haemophilus influenzae Rd
uucaaaucuaacgu

SEQ ID NO: 2696285 - RNA, 12 nt, Haemophilus influenzae Rd
uucaaaucuuca

SEQ ID NO: 2696286 - RNA, 17 nt, Haemophilus influenzae Rd
uucaaaucuugacauaa

SEQ ID NO: 2696287 - RNA, 16 nt, Haemophilus influenzae Rd
uucaaaugaaauguuu

SEQ ID NO: 2696288 - RNA, 15 nt, Haemophilus influenzae Rd
uucaaauucugcuug

SEQ ID NO: 2696289 - RNA, 16 nt, Haemophilus influenzae Rd
uucaaauugaaaagaa

SEQ ID NO: 2696290 - RNA, 19 nt, Haemophilus influenzae Rd
uucaaauuucauccuaaaa

SEQ ID NO: 2696291 - RNA, 23 nt, Haemophilus influenzae Rd
uucaaauuuuuguugauaaacau

SEQ ID NO: 2696292 - RNA, 13 nt, Haemophilus influenzae Rd
uucaacaaaaaua

SEQ ID NO: 2696293 - RNA, 23 nt, Haemophilus influenzae Rd
uucaacaccuaaaugagaaaaau

SEQ ID NO: 2696294 - RNA, 17 nt, Haemophilus influenzae Rd
uucaaccacuucaaaua

SEQ ID NO: 2696295 - RNA, 22 nt, Haemophilus influenzae Rd
uucaaccacuucaaauaccuca

SEQ ID NO: 2696296 - RNA, 18 nt, Haemophilus influenzae Rd
uucaaccgcacuuaauaa

SEQ ID NO: 2696297 - RNA, 19 nt, Haemophilus influenzae Rd
uucaaccgcacuuaauaaa

SEQ ID NO: 2696298 - RNA, 22 nt, Haemophilus influenzae Rd
uucaacuaaaggcacaaaaaau

SEQ ID NO: 2696299 - RNA, 18 nt, Haemophilus influenzae Rd
uucaacuugccacaguag

SEQ ID NO: 2696300 - RNA, 15 nt, Haemophilus influenzae Rd
uucaacuugccagca

SEQ ID NO: 2696301 - RNA, 14 nt, Haemophilus influenzae Rd
uucaagaacagaaa

SEQ ID NO: 2696302 - RNA, 13 nt, Haemophilus influenzae Rd
uucaagauaauua

SEQ ID NO: 2696303 - RNA, 20 nt, Haemophilus influenzae Rd
uucaagaugauauuuaauaa

SEQ ID NO: 2696304 - RNA, 23 nt, Haemophilus influenzae Rd
uucaagccaccagagaaaucauc

SEQ ID NO: 2696305 - RNA, 14 nt, Haemophilus influenzae Rd
uucaagcuuugcaa

SEQ ID NO: 2696306 - RNA, 17 nt, Haemophilus influenzae Rd
uucaaggacugaguucu

SEQ ID NO: 2696307 - RNA, 18 nt, Haemophilus influenzae Rd
uucaaggccauauuuucc

SEQ ID NO: 2696308 - RNA, 22 nt, Haemophilus influenzae Rd
uucaaggccauauuuucccagu

SEQ ID NO: 2696309 - RNA, 18 nt, Haemophilus influenzae Rd
uucaaguaaaugcgcuuu

SEQ ID NO: 2696310 - RNA, 17 nt, Haemophilus influenzae Rd
uucaaguaacuuucaca

SEQ ID NO: 2696311 - RNA, 14 nt, Haemophilus influenzae Rd
uucaaguaagucac

SEQ ID NO: 2696312 - RNA, 18 nt, Haemophilus influenzae Rd
uucaagucguuauuuucu

SEQ ID NO: 2696313 - RNA, 15 nt, Haemophilus influenzae Rd
uucaagucuuuuuuu

SEQ ID NO: 2696314 - RNA, 13 nt, Haemophilus influenzae Rd
uucaaguguuuuu

SEQ ID NO: 2696315 - RNA, 15 nt, Haemophilus influenzae Rd
uucaauaaaaauaua

SEQ ID NO: 2696316 - RNA, 22 nt, Haemophilus influenzae Rd
uucaauaaaaauauauuuagau

SEQ ID NO: 2696317 - RNA, 16 nt, Haemophilus influenzae Rd
uucaauaagcaaguaa

SEQ ID NO: 2696318 - RNA, 21 nt, Haemophilus influenzae Rd
uucaauaagcucgccuuuuuc

SEQ ID NO: 2696319 - RNA, 16 nt, Haemophilus influenzae Rd
uucaauaauagccaua

SEQ ID NO: 2696320 - RNA, 13 nt, Haemophilus influenzae Rd
uucaauaauauua

SEQ ID NO: 2696321 - RNA, 20 nt, Haemophilus influenzae Rd
uucaauaauugaagcaauug

SEQ ID NO: 2696322 - RNA, 12 nt, Haemophilus influenzae Rd
uucaauacauca

SEQ ID NO: 2696323 - RNA, 22 nt, Haemophilus influenzae Rd
uucaauacuuuucccaaugcac

SEQ ID NO: 2696324 - RNA, 22 nt, Haemophilus influenzae Rd
uucaauagaacguaauaauuca

SEQ ID NO: 2696325 - RNA, 21 nt, Haemophilus influenzae Rd
uucaauagguuauaaguuuuu

SEQ ID NO: 2696326 - RNA, 13 nt, Haemophilus influenzae Rd
uucaauagucguu

SEQ ID NO: 2696327 - RNA, 16 nt, Haemophilus influenzae Rd
uucaauaguuuuucag

SEQ ID NO: 2696328 - RNA, 17 nt, Haemophilus influenzae Rd
uucaauauaaaaaauaa

SEQ ID NO: 2696329 - RNA, 17 nt, Haemophilus influenzae Rd
uucaauaucaaagaaaa

SEQ ID NO: 2696330 - RNA, 19 nt, Haemophilus influenzae Rd
uucaauaucaaagaaaaau

SEQ ID NO: 2696331 - RNA, 22 nt, Haemophilus influenzae Rd
uucaauaucuaagaaaauagaa

SEQ ID NO: 2696332 - RNA, 23 nt, Haemophilus influenzae Rd
uucaauaucucgugaugcagaaa

SEQ ID NO: 2696333 - RNA, 14 nt, Haemophilus influenzae Rd
uucaauaucugcac

SEQ ID NO: 2696334 - RNA, 14 nt, Haemophilus influenzae Rd
uucaauauugucua

SEQ ID NO: 2696335 - RNA, 22 nt, Haemophilus influenzae Rd
uucaauauugucuauuuuauuu

SEQ ID NO: 2696336 - RNA, 20 nt, Haemophilus influenzae Rd
uucaaucaucauuuauuaaa

SEQ ID NO: 2696337 - RNA, 21 nt, Haemophilus influenzae Rd
uucaaucaucauuuauuaaaa

SEQ ID NO: 2696338 - RNA, 12 nt, Haemophilus influenzae Rd
uucaaucauuuc

SEQ ID NO: 2696339 - RNA, 23 nt, Haemophilus influenzae Rd
uucaaucgaaaguggcuuuuuuc

SEQ ID NO: 2696340 - RNA, 17 nt, Haemophilus influenzae Rd
uucaaucgcaucauuca

SEQ ID NO: 2696341 - RNA, 20 nt, Haemophilus influenzae Rd
uucaaucuuuuuguuaauaa

SEQ ID NO: 2696342 - RNA, 15 nt, Haemophilus influenzae Rd
uucaaugaaauauua

SEQ ID NO: 2696343 - RNA, 19 nt, Haemophilus influenzae Rd
uucaaugacugauauuuaa

SEQ ID NO: 2696344 - RNA, 19 nt, Haemophilus influenzae Rd
uucaaugcaacaauacguu

SEQ ID NO: 2696345 - RNA, 15 nt, Haemophilus influenzae Rd
uucaaugcagaaaua

SEQ ID NO: 2696346 - RNA, 11 nt, Haemophilus influenzae Rd
uucaauguuug

SEQ ID NO: 2696347 - RNA, 21 nt, Haemophilus influenzae Rd
uucaauuaaaucaaaaauuaa

SEQ ID NO: 2696348 - RNA, 20 nt, Haemophilus influenzae Rd
uucaauucuucuaauucagu

SEQ ID NO: 2696349 - RNA, 23 nt, Haemophilus influenzae Rd
uucaauugccauaggauuauuca

SEQ ID NO: 2696350 - RNA, 20 nt, Haemophilus influenzae Rd
uucaauuuacccacuucaua

SEQ ID NO: 2696351 - RNA, 22 nt, Haemophilus influenzae Rd
uucaauuucucuacuaauucau

SEQ ID NO: 2696352 - RNA, 17 nt, Haemophilus influenzae Rd
uucaauuugaacaaacg

SEQ ID NO: 2696353 - RNA, 17 nt, Haemophilus influenzae Rd
uucaauuugaccuugaa

SEQ ID NO: 2696354 - RNA, 18 nt, Haemophilus influenzae Rd
uucaauuugagucucaaa

SEQ ID NO: 2696355 - RNA, 21 nt, Haemophilus influenzae Rd
uucaauuugagucucaaauuu

SEQ ID NO: 2696356 - RNA, 13 nt, Haemophilus influenzae Rd
uucaauuuggaaa

SEQ ID NO: 2696357 - RNA, 13 nt, Haemophilus influenzae Rd
uucaauuuuaaaa

SEQ ID NO: 2696358 - RNA, 14 nt, Haemophilus influenzae Rd
uucaauuuuaaaau

SEQ ID NO: 2696359 - RNA, 18 nt, Haemophilus influenzae Rd
uucaauuuuaauugguuu

SEQ ID NO: 2696360 - RNA, 12 nt, Haemophilus influenzae Rd
uucaauuuuccc

SEQ ID NO: 2696361 - RNA, 19 nt, Haemophilus influenzae Rd
uucaauuuuccccucaauu

SEQ ID NO: 2696362 - RNA, 23 nt, Haemophilus influenzae Rd
uucaauuuuccccucaauuugug

SEQ ID NO: 2696363 - RNA, 12 nt, Haemophilus influenzae Rd
uucacaaacaua

SEQ ID NO: 2696364 - RNA, 16 nt, Haemophilus influenzae Rd
uucacaaacauaccua

SEQ ID NO: 2696365 - RNA, 13 nt, Haemophilus influenzae Rd
uucacaaacccau

SEQ ID NO: 2696366 - RNA, 17 nt, Haemophilus influenzae Rd
uucacaaaucuaaaaau

SEQ ID NO: 2696367 - RNA, 21 nt, Haemophilus influenzae Rd
uucacaaaucuaaaaauaugu

SEQ ID NO: 2696368 - RNA, 13 nt, Haemophilus influenzae Rd
uucacaagcauag

SEQ ID NO: 2696369 - RNA, 18 nt, Haemophilus influenzae Rd
uucacaaucgccaauucu

SEQ ID NO: 2696370 - RNA, 22 nt, Haemophilus influenzae Rd
uucacaaucgccaauucuucag

SEQ ID NO: 2696371 - RNA, 12 nt, Haemophilus influenzae Rd
uucacacccaug

SEQ ID NO: 2696372 - RNA, 18 nt, Haemophilus influenzae Rd
uucacaccgucuaaaaau

SEQ ID NO: 2696373 - RNA, 16 nt, Haemophilus influenzae Rd
uucacagagaauaaau

SEQ ID NO: 2696374 - RNA, 18 nt, Haemophilus influenzae Rd
uucacagagaauaaauca

SEQ ID NO: 2696375 - RNA, 16 nt, Haemophilus influenzae Rd
uucacagauuucaauu

SEQ ID NO: 2696376 - RNA, 18 nt, Haemophilus influenzae Rd
uucacagggcugaguccu

SEQ ID NO: 2696377 - RNA, 17 nt, Haemophilus influenzae Rd
uucacauaaauuacaau

SEQ ID NO: 2696378 - RNA, 15 nt, Haemophilus influenzae Rd
uucacauaauaaaca

SEQ ID NO: 2696379 - RNA, 14 nt, Haemophilus influenzae Rd
uucacauuagugaa

SEQ ID NO: 2696380 - RNA, 17 nt, Haemophilus influenzae Rd
uucacauucuuuuaaau

SEQ ID NO: 2696381 - RNA, 18 nt, Haemophilus influenzae Rd
uucacauucuuuuaaaua

SEQ ID NO: 2696382 - RNA, 14 nt, Haemophilus influenzae Rd
uucaccaaucacag

SEQ ID NO: 2696383 - RNA, 17 nt, Haemophilus influenzae Rd
uucaucauucugguaau

SEQ ID NO: 2696384 - RNA, 12 nt, Haemophilus influenzae Rd
uucaucauugcu

SEQ ID NO: 2696385 - RNA, 16 nt, Haemophilus influenzae Rd
uucaucauuucuuaau

SEQ ID NO: 2696386 - RNA, 14 nt, Haemophilus influenzae Rd
uucauccaauacug

SEQ ID NO: 2696387 - RNA, 17 nt, Haemophilus influenzae Rd
uucaucccagauuuuac

SEQ ID NO: 2696388 - RNA, 17 nt, Haemophilus influenzae Rd
uucaucccauuuuugcg

SEQ ID NO: 2696389 - RNA, 16 nt, Haemophilus influenzae Rd
uucaucgcgcaaaaua

SEQ ID NO: 2696390 - RNA, 19 nt, Haemophilus influenzae Rd
uucaucgcgcaaaauaaua

SEQ ID NO: 2696391 - RNA, 22 nt, Haemophilus influenzae Rd
uucaucgcgcaaaauaauaucc

SEQ ID NO: 2696392 - RNA, 17 nt, Haemophilus influenzae Rd
uucaucgucuucuucgc

SEQ ID NO: 2696393 - RNA, 21 nt, Haemophilus influenzae Rd
uucaucgugagcauaacgaua

SEQ ID NO: 2696394 - RNA, 15 nt, Haemophilus influenzae Rd
uucaucguuaauuaa

SEQ ID NO: 2696395 - RNA, 22 nt, Haemophilus influenzae Rd
uucaucuacaccaaaaccaaua

SEQ ID NO: 2696396 - RNA, 17 nt, Haemophilus influenzae Rd
uucaucugcaucacaaa

SEQ ID NO: 2696397 - RNA, 16 nt, Haemophilus influenzae Rd
uucaucuggugaguga

SEQ ID NO: 2696398 - RNA, 15 nt, Haemophilus influenzae Rd
uucaucuucaucaau

SEQ ID NO: 2696399 - RNA, 16 nt, Haemophilus influenzae Rd
uucaucuucaucaaua

SEQ ID NO: 2696400 - RNA, 22 nt, Haemophilus influenzae Rd
uucaucuucauuccauuuugca

SEQ ID NO: 2696401 - RNA, 15 nt, Haemophilus influenzae Rd
uucaucuuuuaaaua

SEQ ID NO: 2696402 - RNA, 19 nt, Haemophilus influenzae Rd
uucaucuuuuaacacgaaa

SEQ ID NO: 2696403 - RNA, 22 nt, Haemophilus influenzae Rd
uucaucuuuuaacacgaaacca

SEQ ID NO: 2696404 - RNA, 20 nt, Haemophilus influenzae Rd
uucaugagcugggcaaacaa

SEQ ID NO: 2696405 - RNA, 16 nt, Haemophilus influenzae Rd
uucaugauguaauucu

SEQ ID NO: 2696406 - RNA, 19 nt, Haemophilus influenzae Rd
uucaugauguaauucugcu

SEQ ID NO: 2696407 - RNA, 22 nt, Haemophilus influenzae Rd
uucaugauguaauucugcuuuu

SEQ ID NO: 2696408 - RNA, 21 nt, Haemophilus influenzae Rd
uucaugauuuuccaaaauuuc

SEQ ID NO: 2696409 - RNA, 21 nt, Haemophilus influenzae Rd
uucaugguuuguuccaauucu

SEQ ID NO: 2696410 - RNA, 23 nt, Haemophilus influenzae Rd
uucauuaaaaccaauuuuuucau

SEQ ID NO: 2696411 - RNA, 13 nt, Haemophilus influenzae Rd
uucauuaaacuga

SEQ ID NO: 2696412 - RNA, 14 nt, Haemophilus influenzae Rd
uucauuaaauuagu

SEQ ID NO: 2696413 - RNA, 19 nt, Haemophilus influenzae Rd
uucauuauauuccuuauuc

SEQ ID NO: 2696414 - RNA, 16 nt, Haemophilus influenzae Rd
uucauucaacaaaaau

SEQ ID NO: 2696415 - RNA, 18 nt, Haemophilus influenzae Rd
uucauuccauuuugcaua

SEQ ID NO: 2696416 - RNA, 18 nt, Haemophilus influenzae Rd
uucauucguauaaauauu

SEQ ID NO: 2696417 - RNA, 20 nt, Haemophilus influenzae Rd
uucauugauggaauaaauuu

SEQ ID NO: 2696418 - RNA, 23 nt, Haemophilus influenzae Rd
uucauugcaucagguacgucuuu

SEQ ID NO: 2696419 - RNA, 15 nt, Haemophilus influenzae Rd
uucauugcauuuuua

SEQ ID NO: 2696420 - RNA, 14 nt, Haemophilus influenzae Rd
uucauuguuaaaua

SEQ ID NO: 2696421 - RNA, 19 nt, Haemophilus influenzae Rd
uucauuguuaaauaaaucc

SEQ ID NO: 2696422 - RNA, 14 nt, Haemophilus influenzae Rd
uucauuguuucuca

SEQ ID NO: 2696423 - RNA, 21 nt, Haemophilus influenzae Rd
uucauuguuucucaauaaaua

SEQ ID NO: 2696424 - RNA, 15 nt, Haemophilus influenzae Rd
uucauuuaaaauaua

SEQ ID NO: 2696425 - RNA, 15 nt, Haemophilus influenzae Rd
uucauuuagugacca

SEQ ID NO: 2696426 - RNA, 19 nt, Haemophilus influenzae Rd
uucauuuauguuauuuuga

SEQ ID NO: 2696427 - RNA, 21 nt, Haemophilus influenzae Rd
uucauuugaacaauuaacgca

SEQ ID NO: 2696428 - RNA, 17 nt, Haemophilus influenzae Rd
uucauuugagaagcccg

SEQ ID NO: 2696429 - RNA, 22 nt, Haemophilus influenzae Rd
uucauuugcacccgcuuuaaua

SEQ ID NO: 2696430 - RNA, 20 nt, Haemophilus influenzae Rd
uucauuugcuuuaacccauu

SEQ ID NO: 2696431 - RNA, 14 nt, Haemophilus influenzae Rd
uucauuuuaaauua

SEQ ID NO: 2696432 - RNA, 13 nt, Haemophilus influenzae Rd
uucauuuugagcc

SEQ ID NO: 2696433 - RNA, 16 nt, Haemophilus influenzae Rd
uuccaaacuggaauaa

SEQ ID NO: 2696434 - RNA, 17 nt, Haemophilus influenzae Rd
uuccaaaucauaccaau

SEQ ID NO: 2696435 - RNA, 22 nt, Haemophilus influenzae Rd
uuccaaauuccaucaauuaaug

SEQ ID NO: 2696436 - RNA, 17 nt, Haemophilus influenzae Rd
uuccaacaaaauaaaca

SEQ ID NO: 2696437 - RNA, 13 nt, Haemophilus influenzae Rd
uuccaagcagcca

SEQ ID NO: 2696438 - RNA, 22 nt, Haemophilus influenzae Rd
uuccaagugcgucguuauuuuu

SEQ ID NO: 2696439 - RNA, 17 nt, Haemophilus influenzae Rd
uuccaauacaaucagcu

SEQ ID NO: 2696440 - RNA, 20 nt, Haemophilus influenzae Rd
uuccaauacaaucagcugcu

SEQ ID NO: 2696441 - RNA, 17 nt, Haemophilus influenzae Rd
uuccaauaggaaacuac

SEQ ID NO: 2696442 - RNA, 13 nt, Haemophilus influenzae Rd
uuccaauuaauuc

SEQ ID NO: 2696443 - RNA, 19 nt, Haemophilus influenzae Rd
uuccaauucuaguucuucc

SEQ ID NO: 2696444 - RNA, 22 nt, Haemophilus influenzae Rd
uuccaauucuuuuaaauguguu

SEQ ID NO: 2696445 - RNA, 14 nt, Haemophilus influenzae Rd
uuccacaacaacca

SEQ ID NO: 2696446 - RNA, 18 nt, Haemophilus influenzae Rd
uuccacaccaaaaaugcc

SEQ ID NO: 2696447 - RNA, 17 nt, Haemophilus influenzae Rd
uuccaccacaacagauu

SEQ ID NO: 2696448 - RNA, 15 nt, Haemophilus influenzae Rd
uuccaccacagccca

SEQ ID NO: 2696449 - RNA, 22 nt, Haemophilus influenzae Rd
uuccaccacagcccaaaauuca

SEQ ID NO: 2696450 - RNA, 22 nt, Haemophilus influenzae Rd
uuccacccgguacgcaaccuug

SEQ ID NO: 2696451 - RNA, 16 nt, Haemophilus influenzae Rd
uuccaccuugaauaau

SEQ ID NO: 2696452 - RNA, 21 nt, Haemophilus influenzae Rd
uuccacgccuguggcaaaauc

SEQ ID NO: 2696453 - RNA, 19 nt, Haemophilus influenzae Rd
uuccacgcguuuuuacaua

SEQ ID NO: 2696454 - RNA, 14 nt, Haemophilus influenzae Rd
uuccacuucauaaa

SEQ ID NO: 2696455 - RNA, 19 nt, Haemophilus influenzae Rd
uuccacuucugaauccaau

SEQ ID NO: 2696456 - RNA, 21 nt, Haemophilus influenzae Rd
uuccacuucuucuuuaaacac

SEQ ID NO: 2696457 - RNA, 14 nt, Haemophilus influenzae Rd
uuccagcaaaaaaa

SEQ ID NO: 2696458 - RNA, 22 nt, Haemophilus influenzae Rd
uuccagccuaagcuaaagucgu

SEQ ID NO: 2696459 - RNA, 14 nt, Haemophilus influenzae Rd
uuccaggaaaauuu

SEQ ID NO: 2696460 - RNA, 16 nt, Haemophilus influenzae Rd
uuccaggaaaauuuua

SEQ ID NO: 2696461 - RNA, 19 nt, Haemophilus influenzae Rd
uuccaguauagugcgcaua

SEQ ID NO: 2696462 - RNA, 12 nt, Haemophilus influenzae Rd
uuccauaaaaga

SEQ ID NO: 2696463 - RNA, 17 nt, Haemophilus influenzae Rd
uuccauaauagaaacua

SEQ ID NO: 2696464 - RNA, 14 nt, Haemophilus influenzae Rd
uuccauaauagaau

SEQ ID NO: 2696465 - RNA, 23 nt, Haemophilus influenzae Rd
uuccauaccaaaaugucgccauu

SEQ ID NO: 2696466 - RNA, 18 nt, Haemophilus influenzae Rd
uuccauacccuugcuucu

SEQ ID NO: 2696467 - RNA, 18 nt, Haemophilus influenzae Rd
uuccauagauuaucgccu

SEQ ID NO: 2696468 - RNA, 15 nt, Haemophilus influenzae Rd
uuccauauaacaaca

SEQ ID NO: 2696469 - RNA, 20 nt, Haemophilus influenzae Rd
uuccauaucacauuuuauug

SEQ ID NO: 2696470 - RNA, 22 nt, Haemophilus influenzae Rd
uuccauauuguuucaauuuauu

SEQ ID NO: 2696471 - RNA, 13 nt, Haemophilus influenzae Rd
uuccaucaucuua

SEQ ID NO: 2696472 - RNA, 19 nt, Haemophilus influenzae Rd
uuccaucaucuuaucuaga

SEQ ID NO: 2696473 - RNA, 22 nt, Haemophilus influenzae Rd
uuccauuaauacuuuugcacug

SEQ ID NO: 2696474 - RNA, 15 nt, Haemophilus influenzae Rd
uuccauuaauucaua

SEQ ID NO: 2696475 - RNA, 15 nt, Haemophilus influenzae Rd
uuccauucacuuuca

SEQ ID NO: 2696476 - RNA, 18 nt, Haemophilus influenzae Rd
uuccauucuaaaaaaauc

SEQ ID NO: 2696477 - RNA, 14 nt, Haemophilus influenzae Rd
uuccauugcaucca

SEQ ID NO: 2696478 - RNA, 21 nt, Haemophilus influenzae Rd
uuccauugcauccacuucauc

SEQ ID NO: 2696479 - RNA, 22 nt, Haemophilus influenzae Rd
uuccauugggaagcuggaagua

SEQ ID NO: 2696480 - RNA, 16 nt, Haemophilus influenzae Rd
uuccauuuuuuuugca

SEQ ID NO: 2696481 - RNA, 12 nt, Haemophilus influenzae Rd
uucccaaauauc

SEQ ID NO: 2696482 - RNA, 17 nt, Haemophilus influenzae Rd
uucccacaugucaaauc

SEQ ID NO: 2696483 - RNA, 19 nt, Haemophilus influenzae Rd
uucccagcguaaaaaugcu

SEQ ID NO: 2696484 - RNA, 20 nt, Haemophilus influenzae Rd
uucccaguaaucuuuuaauu

SEQ ID NO: 2696485 - RNA, 17 nt, Haemophilus influenzae Rd
uucccauuucuaaugca

SEQ ID NO: 2696486 - RNA, 18 nt, Haemophilus influenzae Rd
uucccauuugucucaaaa

SEQ ID NO: 2696487 - RNA, 12 nt, Haemophilus influenzae Rd
uuccccugaaug

SEQ ID NO: 2696488 - RNA, 19 nt, Haemophilus influenzae Rd
uucgucaauguuauugccu

SEQ ID NO: 2696489 - RNA, 13 nt, Haemophilus influenzae Rd
uucgucaucauca

SEQ ID NO: 2696490 - RNA, 15 nt, Haemophilus influenzae Rd
uucgucaucuucauu

SEQ ID NO: 2696491 - RNA, 12 nt, Haemophilus influenzae Rd
uucgucgcuuuu

SEQ ID NO: 2696492 - RNA, 19 nt, Haemophilus influenzae Rd
uucgugaaauuagacaaaa

SEQ ID NO: 2696493 - RNA, 20 nt, Haemophilus influenzae Rd
uucgugaauacgaucugcau

SEQ ID NO: 2696494 - RNA, 20 nt, Haemophilus influenzae Rd
uucguucaacccauuuucca

SEQ ID NO: 2696495 - RNA, 14 nt, Haemophilus influenzae Rd
uucguuucaagaua

SEQ ID NO: 2696496 - RNA, 19 nt, Haemophilus influenzae Rd
uucguuugguucgauaaac

SEQ ID NO: 2696497 - RNA, 20 nt, Haemophilus influenzae Rd
uucguuuugguaauuugcgu

SEQ ID NO: 2696498 - RNA, 12 nt, Haemophilus influenzae Rd
uucuaaaaacuc

SEQ ID NO: 2696499 - RNA, 22 nt, Haemophilus influenzae Rd
uucuaaaaauaggcugaaaaaa

SEQ ID NO: 2696500 - RNA, 23 nt, Haemophilus influenzae Rd
uucuaaaaaugcguucagaauuu

SEQ ID NO: 2696501 - RNA, 14 nt, Haemophilus influenzae Rd
uucuaaaaauuacc

SEQ ID NO: 2696502 - RNA, 16 nt, Haemophilus influenzae Rd
uucuaaaaccaauaau

SEQ ID NO: 2696503 - RNA, 12 nt, Haemophilus influenzae Rd
uucuaaaaguuu

SEQ ID NO: 2696504 - RNA, 21 nt, Haemophilus influenzae Rd
uucuaaacaugagguguuauu

SEQ ID NO: 2696505 - RNA, 17 nt, Haemophilus influenzae Rd
uucuaaacgaugugcau

SEQ ID NO: 2696506 - RNA, 23 nt, Haemophilus influenzae Rd
uucuaaacucggaauuuuuuuca

SEQ ID NO: 2696507 - RNA, 20 nt, Haemophilus influenzae Rd
uucuaaaggaguaaguuuua

SEQ ID NO: 2696508 - RNA, 17 nt, Haemophilus influenzae Rd
uucuaaaggcuaaauaa

SEQ ID NO: 2696509 - RNA, 18 nt, Haemophilus influenzae Rd
uucuaaauagcuaacaau

SEQ ID NO: 2696510 - RNA, 13 nt, Haemophilus influenzae Rd
uucuaaauauuuu

SEQ ID NO: 2696511 - RNA, 17 nt, Haemophilus influenzae Rd
uucuaaauauuuuucaa

SEQ ID NO: 2696512 - RNA, 22 nt, Haemophilus influenzae Rd
uucuaacaauguaguuucuucu

SEQ ID NO: 2696513 - RNA, 14 nt, Haemophilus influenzae Rd
uucuaacacagaaa

SEQ ID NO: 2696514 - RNA, 23 nt, Haemophilus influenzae Rd
uucuaacauuucuuuuggccaua

SEQ ID NO: 2696515 - RNA, 22 nt, Haemophilus influenzae Rd
uucuaaccgcacuuuuuaauaa

SEQ ID NO: 2696516 - RNA, 18 nt, Haemophilus influenzae Rd
uucuaaggcagcaagaaa

SEQ ID NO: 2696517 - RNA, 18 nt, Haemophilus influenzae Rd
uucuaagguauaaauaau

SEQ ID NO: 2696518 - RNA, 19 nt, Haemophilus influenzae Rd
uucuaagguauccacuuuu

SEQ ID NO: 2696519 - RNA, 21 nt, Haemophilus influenzae Rd
uucuaagguuaugccaaugcu

SEQ ID NO: 2696520 - RNA, 22 nt, Haemophilus influenzae Rd
uucuaagguuaugccaaugcua

SEQ ID NO: 2696521 - RNA, 14 nt, Haemophilus influenzae Rd
uucuaauaaaauau

SEQ ID NO: 2696522 - RNA, 15 nt, Haemophilus influenzae Rd
uucuaauaaaauaua

SEQ ID NO: 2696523 - RNA, 11 nt, Haemophilus influenzae Rd
uucuaauccag

SEQ ID NO: 2696524 - RNA, 15 nt, Haemophilus influenzae Rd
uucuaaugaaauuuc

SEQ ID NO: 2696525 - RNA, 22 nt, Haemophilus influenzae Rd
uucuaaugaaauuucuugcucu

SEQ ID NO: 2696526 - RNA, 12 nt, Haemophilus influenzae Rd
uucuaaugguug

SEQ ID NO: 2696527 - RNA, 19 nt, Haemophilus influenzae Rd
uucuaauguuaauuuuaaa

SEQ ID NO: 2696528 - RNA, 13 nt, Haemophilus influenzae Rd
uucuaauucagug

SEQ ID NO: 2696529 - RNA, 19 nt, Haemophilus influenzae Rd
uucuaauucaguguaaugu

SEQ ID NO: 2696530 - RNA, 21 nt, Haemophilus influenzae Rd
uucuaauucaguguaauguuu

SEQ ID NO: 2696531 - RNA, 10 nt, Haemophilus influenzae Rd
uucuaauucc

SEQ ID NO: 2696532 - RNA, 21 nt, Haemophilus influenzae Rd
uucuaauucggcuucaguauc

SEQ ID NO: 2696533 - RNA, 14 nt, Haemophilus influenzae Rd
uucuaauucugcac

SEQ ID NO: 2696534 - RNA, 13 nt, Haemophilus influenzae Rd
uucuaauugcugc

SEQ ID NO: 2696535 - RNA, 18 nt, Haemophilus influenzae Rd
uucuaauugcugcucugc

SEQ ID NO: 2696536 - RNA, 16 nt, Haemophilus influenzae Rd
uucuaauuuuaaaaca

SEQ ID NO: 2696537 - RNA, 14 nt, Haemophilus influenzae Rd
uucuaauuuuugca

SEQ ID NO: 2696538 - RNA, 17 nt, Haemophilus influenzae Rd
uucuaauuuuugcaaug

SEQ ID NO: 2696539 - RNA, 17 nt, Haemophilus influenzae Rd
uucuacaccuucccaau

SEQ ID NO: 2696540 - RNA, 12 nt, Haemophilus influenzae Rd
uucuacauaaug

SEQ ID NO: 2696541 - RNA, 21 nt, Haemophilus influenzae Rd
uucuaccccucuuuucucaaa

SEQ ID NO: 2696542 - RNA, 16 nt, Haemophilus influenzae Rd
uucuaccgcauuuuua

SEQ ID NO: 2696543 - RNA, 20 nt, Haemophilus influenzae Rd
uucuacgaauugguucuaaa

SEQ ID NO: 2696544 - RNA, 18 nt, Haemophilus influenzae Rd
uucuacgccuaaugcauu

SEQ ID NO: 2696545 - RNA, 20 nt, Haemophilus influenzae Rd
uucuacggucgcaccaccuu

SEQ ID NO: 2696546 - RNA, 15 nt, Haemophilus influenzae Rd
uucuacguaauuuaa

SEQ ID NO: 2696547 - RNA, 17 nt, Haemophilus influenzae Rd
uucuacgucaaagccau

SEQ ID NO: 2696548 - RNA, 20 nt, Haemophilus influenzae Rd
uucuacuuccgauuuuaauu

SEQ ID NO: 2696549 - RNA, 17 nt, Haemophilus influenzae Rd
uucuacuugaguugcgg

SEQ ID NO: 2696550 - RNA, 14 nt, Haemophilus influenzae Rd
uucuacuuuugugc

SEQ ID NO: 2696551 - RNA, 18 nt, Haemophilus influenzae Rd
uucuagaaaauaaccaau

SEQ ID NO: 2696552 - RNA, 20 nt, Haemophilus influenzae Rd
uucuagaaaauaaccaauau

SEQ ID NO: 2696553 - RNA, 15 nt, Haemophilus influenzae Rd
uucuagcgguaaacc

SEQ ID NO: 2696554 - RNA, 20 nt, Haemophilus influenzae Rd
uucuagcuuaccuuaauuaa

SEQ ID NO: 2696555 - RNA, 19 nt, Haemophilus influenzae Rd
uucuaguaaaacuaauacu

SEQ ID NO: 2696556 - RNA, 17 nt, Haemophilus influenzae Rd
uucuaguucuuccccuc

SEQ ID NO: 2696557 - RNA, 14 nt, Haemophilus influenzae Rd
uucuauaucagaaa

SEQ ID NO: 2696558 - RNA, 13 nt, Haemophilus influenzae Rd
uucuauccauuuc

SEQ ID NO: 2696559 - RNA, 13 nt, Haemophilus influenzae Rd
uucuauuaaaaua

SEQ ID NO: 2696560 - RNA, 15 nt, Haemophilus influenzae Rd
uucuauuaaaauauu

SEQ ID NO: 2696561 - RNA, 15 nt, Haemophilus influenzae Rd
uucuauucucuguug

SEQ ID NO: 2696562 - RNA, 21 nt, Haemophilus influenzae Rd
uucuauucucuguugcucagc

SEQ ID NO: 2696563 - RNA, 23 nt, Haemophilus influenzae Rd
uucuauugauauuaauuuuaucu

SEQ ID NO: 2696564 - RNA, 16 nt, Haemophilus influenzae Rd
uucuauuuauaaucca

SEQ ID NO: 2696565 - RNA, 20 nt, Haemophilus influenzae Rd
uucuauuugaauuaaaacuu

SEQ ID NO: 2696566 - RNA, 14 nt, Haemophilus influenzae Rd
uucuauuuuaucaa

SEQ ID NO: 2696567 - RNA, 16 nt, Haemophilus influenzae Rd
uucucaagaauauauu

SEQ ID NO: 2696568 - RNA, 15 nt, Haemophilus influenzae Rd
uucucaauaaauauc

SEQ ID NO: 2696569 - RNA, 19 nt, Haemophilus influenzae Rd
uucucaauaaauaucuaaa

SEQ ID NO: 2696570 - RNA, 15 nt, Haemophilus influenzae Rd
uucucaauugcaaaa

SEQ ID NO: 2696571 - RNA, 17 nt, Haemophilus influenzae Rd
uucucaauugcaaaauc

SEQ ID NO: 2696572 - RNA, 17 nt, Haemophilus influenzae Rd
uucucaggaaauuucaa

SEQ ID NO: 2696573 - RNA, 19 nt, Haemophilus influenzae Rd
uucucauaauagaaaacau

SEQ ID NO: 2696574 - RNA, 20 nt, Haemophilus influenzae Rd
uucucauaauagaaaacauu

SEQ ID NO: 2696575 - RNA, 12 nt, Haemophilus influenzae Rd
uucuccacaaac

SEQ ID NO: 2696576 - RNA, 15 nt, Haemophilus influenzae Rd
uucucccugauuauu

SEQ ID NO: 2696577 - RNA, 15 nt, Haemophilus influenzae Rd
uucuccguaaaaauc

SEQ ID NO: 2696578 - RNA, 15 nt, Haemophilus influenzae Rd
uucucgcucuaguuu

SEQ ID NO: 2696579 - RNA, 19 nt, Haemophilus influenzae Rd
uucucggcaaugguucauu

SEQ ID NO: 2696580 - RNA, 14 nt, Haemophilus influenzae Rd
uucucgugccuauu

SEQ ID NO: 2696581 - RNA, 18 nt, Haemophilus influenzae Rd
uucucgugccuauuuauu

SEQ ID NO: 2696582 - RNA, 19 nt, Haemophilus influenzae Rd
uucucguucguuuaaauua

SEQ ID NO: 2696583 - RNA, 16 nt, Haemophilus influenzae Rd
uucucuaaaacauugu

SEQ ID NO: 2696584 - RNA, 22 nt, Haemophilus influenzae Rd
uucucugccgcuucgcuaaacc

SEQ ID NO: 2696585 - RNA, 12 nt, Haemophilus influenzae Rd
uucucuguuuua

SEQ ID NO: 2696586 - RNA, 14 nt, Haemophilus influenzae Rd
uucucuguuuuauc

SEQ ID NO: 2696587 - RNA, 23 nt, Haemophilus influenzae Rd
uucucuugcguuugguucaucau

SEQ ID NO: 2696588 - RNA, 12 nt, Haemophilus influenzae Rd
uucucuuuuuau

SEQ ID NO: 2696589 - RNA, 23 nt, Haemophilus influenzae Rd
uucugaaagauauuauuauuaaa

SEQ ID NO: 2696590 - RNA, 16 nt, Haemophilus influenzae Rd
uucugauaacucuaaa

SEQ ID NO: 2696591 - RNA, 16 nt, Haemophilus influenzae Rd
uucugauaauuuuuca

SEQ ID NO: 2696592 - RNA, 19 nt, Haemophilus influenzae Rd
uucugauuacuuaaaguua

SEQ ID NO: 2696593 - RNA, 20 nt, Haemophilus influenzae Rd
uucugauuuagguuucaauu

SEQ ID NO: 2696594 - RNA, 14 nt, Haemophilus influenzae Rd
uugaaaauuuauuu

SEQ ID NO: 2696595 - RNA, 22 nt, Haemophilus influenzae Rd
uugaaaccuaaacuugauauaa

SEQ ID NO: 2696596 - RNA, 19 nt, Haemophilus influenzae Rd
uugaaaccugaguaaauaa

SEQ ID NO: 2696597 - RNA, 21 nt, Haemophilus influenzae Rd
uugaaacuaaagaaucaaauu

SEQ ID NO: 2696598 - RNA, 22 nt, Haemophilus influenzae Rd
uugaaacuguuuuggcauuuuc

SEQ ID NO: 2696599 - RNA, 15 nt, Haemophilus influenzae Rd
uugaaagaauaucaa

SEQ ID NO: 2696600 - RNA, 13 nt, Haemophilus influenzae Rd
uugaaagacugcu

SEQ ID NO: 2696601 - RNA, 18 nt, Haemophilus influenzae Rd
uugaaagacugcuacuuu

SEQ ID NO: 2696602 - RNA, 18 nt, Haemophilus influenzae Rd
uugaaaggguugcagaac

SEQ ID NO: 2696603 - RNA, 18 nt, Haemophilus influenzae Rd
uugaaauaguuaaagaaa

SEQ ID NO: 2696604 - RNA, 18 nt, Haemophilus influenzae Rd
uugaaauugacaauguuu

SEQ ID NO: 2696605 - RNA, 18 nt, Haemophilus influenzae Rd
uugaaauuuaucuaaaag

SEQ ID NO: 2696606 - RNA, 20 nt, Haemophilus influenzae Rd
uugaacaaauucagcuaauu

SEQ ID NO: 2696607 - RNA, 13 nt, Haemophilus influenzae Rd
uugaacaauguuu

SEQ ID NO: 2696608 - RNA, 15 nt, Haemophilus influenzae Rd
uugaacacucuaauc

SEQ ID NO: 2696609 - RNA, 23 nt, Haemophilus influenzae Rd
uugaacagggaacgguucgccug

SEQ ID NO: 2696610 - RNA, 22 nt, Haemophilus influenzae Rd
uugaacgccuagauauuguucu

SEQ ID NO: 2696611 - RNA, 18 nt, Haemophilus influenzae Rd
uugaacgggguuaaaagu

SEQ ID NO: 2696612 - RNA, 23 nt, Haemophilus influenzae Rd
uugaacuauauccaaaucaaaaa

SEQ ID NO: 2696613 - RNA, 21 nt, Haemophilus influenzae Rd
uugaacucacaauugauguaa

SEQ ID NO: 2696614 - RNA, 15 nt, Haemophilus influenzae Rd
uugaacugaauuaaa

SEQ ID NO: 2696615 - RNA, 14 nt, Haemophilus influenzae Rd
uugaacuucuaaaa

SEQ ID NO: 2696616 - RNA, 16 nt, Haemophilus influenzae Rd
uugaacuucuaaaaaa

SEQ ID NO: 2696617 - RNA, 17 nt, Haemophilus influenzae Rd
uugaacuucuaaaaaac

SEQ ID NO: 2696618 - RNA, 18 nt, Haemophilus influenzae Rd
uugaacuugaauugaaga

SEQ ID NO: 2696619 - RNA, 15 nt, Haemophilus influenzae Rd
uugaagaacguaaau

SEQ ID NO: 2696620 - RNA, 14 nt, Haemophilus influenzae Rd
uugaagaauuuguu

SEQ ID NO: 2696621 - RNA, 21 nt, Haemophilus influenzae Rd
uugaagagaauuuucaucaau

SEQ ID NO: 2696622 - RNA, 16 nt, Haemophilus influenzae Rd
uugaagaucuucauau

SEQ ID NO: 2696623 - RNA, 17 nt, Haemophilus influenzae Rd
uugaagauuaaauguau

SEQ ID NO: 2696624 - RNA, 17 nt, Haemophilus influenzae Rd
uugaagcacugaaauau

SEQ ID NO: 2696625 - RNA, 17 nt, Haemophilus influenzae Rd
uugaagccgaugaaagc

SEQ ID NO: 2696626 - RNA, 18 nt, Haemophilus influenzae Rd
uugaagccgaugaaagcu

SEQ ID NO: 2696627 - RNA, 21 nt, Haemophilus influenzae Rd
uugaaggcaccggucuugaaa

SEQ ID NO: 2696628 - RNA, 20 nt, Haemophilus influenzae Rd
uugaagguuagggauaauuu

SEQ ID NO: 2696629 - RNA, 15 nt, Haemophilus influenzae Rd
uugaaguaaaaaaau

SEQ ID NO: 2696630 - RNA, 14 nt, Haemophilus influenzae Rd
uugaaguaaugcga

SEQ ID NO: 2696631 - RNA, 13 nt, Haemophilus influenzae Rd
uugaagucuuaau

SEQ ID NO: 2696632 - RNA, 17 nt, Haemophilus influenzae Rd
uugaauaauaaauuggg

SEQ ID NO: 2696633 - RNA, 15 nt, Haemophilus influenzae Rd
uugaauaccugauuu

SEQ ID NO: 2696634 - RNA, 14 nt, Haemophilus influenzae Rd
uugaauaguaaaga

SEQ ID NO: 2696635 - RNA, 18 nt, Haemophilus influenzae Rd
uugaauaucuaaaugacg

SEQ ID NO: 2696636 - RNA, 22 nt, Haemophilus influenzae Rd
uugaauaucuaaaugacgugcu

SEQ ID NO: 2696637 - RNA, 12 nt, Haemophilus influenzae Rd
uugaauaugaug

SEQ ID NO: 2696638 - RNA, 15 nt, Haemophilus influenzae Rd
uugaauauuuaguuu

SEQ ID NO: 2696639 - RNA, 16 nt, Haemophilus influenzae Rd
uugaauauuugggaaa

SEQ ID NO: 2696640 - RNA, 18 nt, Haemophilus influenzae Rd
uugaauauuuuguugaag

SEQ ID NO: 2696641 - RNA, 21 nt, Haemophilus influenzae Rd
uugaauauuuuguugaagaaa

SEQ ID NO: 2696642 - RNA, 14 nt, Haemophilus influenzae Rd
uugaaucuaauccu

SEQ ID NO: 2696643 - RNA, 18 nt, Haemophilus influenzae Rd
uugaaugaaauucaguga

SEQ ID NO: 2696644 - RNA, 22 nt, Haemophilus influenzae Rd
uugaauggcuaaagaaauacga

SEQ ID NO: 2696645 - RNA, 17 nt, Haemophilus influenzae Rd
uugaaugucuuaaagau

SEQ ID NO: 2696646 - RNA, 22 nt, Haemophilus influenzae Rd
uugaauguggguuccagguugu

SEQ ID NO: 2696647 - RNA, 15 nt, Haemophilus influenzae Rd
uugaauugcauuuuc

SEQ ID NO: 2696648 - RNA, 19 nt, Haemophilus influenzae Rd
uugaauugcauuuucuucc

SEQ ID NO: 2696649 - RNA, 21 nt, Haemophilus influenzae Rd
uugaauugcauuuucuuccaa

SEQ ID NO: 2696650 - RNA, 12 nt, Haemophilus influenzae Rd
uugaauugcucc

SEQ ID NO: 2696651 - RNA, 22 nt, Haemophilus influenzae Rd
uugaauugcuccuccuaaugca

SEQ ID NO: 2696652 - RNA, 21 nt, Haemophilus influenzae Rd
uugaauugcuuuaauuucuuu

SEQ ID NO: 2696653 - RNA, 21 nt, Haemophilus influenzae Rd
uugaauuucuuuuucugcugg

SEQ ID NO: 2696654 - RNA, 18 nt, Haemophilus influenzae Rd
uugaauuuucaaugguuu

SEQ ID NO: 2696655 - RNA, 17 nt, Haemophilus influenzae Rd
uugaauuuuuuuaguuu

SEQ ID NO: 2696656 - RNA, 15 nt, Haemophilus influenzae Rd
uugacaauuaauaua

SEQ ID NO: 2696657 - RNA, 22 nt, Haemophilus influenzae Rd
uugacauaauuucacaauuuuu

SEQ ID NO: 2696658 - RNA, 22 nt, Haemophilus influenzae Rd
uugacauacuuuguugaaugcc

SEQ ID NO: 2696659 - RNA, 17 nt, Haemophilus influenzae Rd
uugacauauuuucuaaa

SEQ ID NO: 2696660 - RNA, 21 nt, Haemophilus influenzae Rd
uugacauuccuauucuaaaua

SEQ ID NO: 2696661 - RNA, 15 nt, Haemophilus influenzae Rd
uugacauuuuacuuu

SEQ ID NO: 2696662 - RNA, 18 nt, Haemophilus influenzae Rd
uugaccgcggaaaauauc

SEQ ID NO: 2696663 - RNA, 23 nt, Haemophilus influenzae Rd
uugaccugcagccauaauauuua

SEQ ID NO: 2696664 - RNA, 19 nt, Haemophilus influenzae Rd
uugaccuuuucgaauuaaa

SEQ ID NO: 2696665 - RNA, 19 nt, Haemophilus influenzae Rd
uugacgaaaaauuaaccau

SEQ ID NO: 2696666 - RNA, 13 nt, Haemophilus influenzae Rd
uugacgaaauaaa

SEQ ID NO: 2696667 - RNA, 19 nt, Haemophilus influenzae Rd
uugacggcuucagaaaaua

SEQ ID NO: 2696668 - RNA, 15 nt, Haemophilus influenzae Rd
uugacggcuugcuuu

SEQ ID NO: 2696669 - RNA, 20 nt, Haemophilus influenzae Rd
uugacguaaaaguuuuccga

SEQ ID NO: 2696670 - RNA, 16 nt, Haemophilus influenzae Rd
uugacguuguucuucu

SEQ ID NO: 2696671 - RNA, 16 nt, Haemophilus influenzae Rd
uugacuaucuguuuua

SEQ ID NO: 2696672 - RNA, 19 nt, Haemophilus influenzae Rd
uugacuuucgaguaauaga

SEQ ID NO: 2696673 - RNA, 22 nt, Haemophilus influenzae Rd
uugagaaaauguauaaagcaua

SEQ ID NO: 2696674 - RNA, 20 nt, Haemophilus influenzae Rd
uugagaugccauuucgcuug

SEQ ID NO: 2696675 - RNA, 14 nt, Haemophilus influenzae Rd
uugagauuuaaucc

SEQ ID NO: 2696676 - RNA, 22 nt, Haemophilus influenzae Rd
uugagauuuaauuuauuuucua

SEQ ID NO: 2696677 - RNA, 14 nt, Haemophilus influenzae Rd
uugagcaauaaauu

SEQ ID NO: 2696678 - RNA, 16 nt, Haemophilus influenzae Rd
uugagcaauccaauca

SEQ ID NO: 2696679 - RNA, 21 nt, Haemophilus influenzae Rd
uugagcaauccaaucagcaaa

SEQ ID NO: 2696680 - RNA, 22 nt, Haemophilus influenzae Rd
uugagcacuucuguaccugcau

SEQ ID NO: 2696681 - RNA, 21 nt, Haemophilus influenzae Rd
uugagccaguuuaucuacuug

SEQ ID NO: 2696682 - RNA, 17 nt, Haemophilus influenzae Rd
uugagcccuaagucaua

SEQ ID NO: 2696683 - RNA, 13 nt, Haemophilus influenzae Rd
uugagccuucaaa

SEQ ID NO: 2696684 - RNA, 22 nt, Haemophilus influenzae Rd
  misc_feature (13)..(13): n is a, c, g or u
uugagcgguuugnucugucgcu

SEQ ID NO: 2696685 - RNA, 16 nt, Haemophilus influenzae Rd
uugagcguaacccaaa

SEQ ID NO: 2696686 - RNA, 16 nt, Haemophilus influenzae Rd
uugagcuaaagugcgg

SEQ ID NO: 2696687 - RNA, 23 nt, Haemophilus influenzae Rd
uugagcuuauuuuuauuaucaaa

SEQ ID NO: 2696688 - RNA, 21 nt, Haemophilus influenzae Rd
uugaggcuaaacuuuucgcaa

SEQ ID NO: 2696689 - RNA, 12 nt, Haemophilus influenzae Rd
uugagguaaaag

SEQ ID NO: 2696690 - RNA, 21 nt, Haemophilus influenzae Rd
uugaguauagucauucaaugc

SEQ ID NO: 2696691 - RNA, 13 nt, Haemophilus influenzae Rd
uugaguauuuacu

SEQ ID NO: 2696692 - RNA, 19 nt, Haemophilus influenzae Rd
uugagucucaaauuuuuca

SEQ ID NO: 2696693 - RNA, 16 nt, Haemophilus influenzae Rd
uugagugagauaaaug

SEQ ID NO: 2696694 - RNA, 13 nt, Haemophilus influenzae Rd
uugauaaacauaa

SEQ ID NO: 2696695 - RNA, 21 nt, Haemophilus influenzae Rd
uugauaaaguuuuuucaauaa

SEQ ID NO: 2696696 - RNA, 20 nt, Haemophilus influenzae Rd
uugauaaccuucaaugguuu

SEQ ID NO: 2696697 - RNA, 22 nt, Haemophilus influenzae Rd
uugauaacuuuaaguaaucaga

SEQ ID NO: 2696698 - RNA, 22 nt, Haemophilus influenzae Rd
uugauaauacacguuaauaggc

SEQ ID NO: 2696699 - RNA, 12 nt, Haemophilus influenzae Rd
uugccaaaaauu

SEQ ID NO: 2696700 - RNA, 20 nt, Haemophilus influenzae Rd
uugccaacuuagauuuucuu

SEQ ID NO: 2696701 - RNA, 21 nt, Haemophilus influenzae Rd
uugccaaugccaaauuucucc

SEQ ID NO: 2696702 - RNA, 17 nt, Haemophilus influenzae Rd
uugccaauuacauugaa

SEQ ID NO: 2696703 - RNA, 23 nt, Haemophilus influenzae Rd
uugccaauugaauuaaaaguaga

SEQ ID NO: 2696704 - RNA, 12 nt, Haemophilus influenzae Rd
uugccaauuuuu

SEQ ID NO: 2696705 - RNA, 18 nt, Haemophilus influenzae Rd
uugccacaggauaaaaac

SEQ ID NO: 2696706 - RNA, 21 nt, Haemophilus influenzae Rd
uugccacuuccacuucugaau

SEQ ID NO: 2696707 - RNA, 12 nt, Haemophilus influenzae Rd
uugccagaaagc

SEQ ID NO: 2696708 - RNA, 14 nt, Haemophilus influenzae Rd
uugccauaaaaaau

SEQ ID NO: 2696709 - RNA, 17 nt, Haemophilus influenzae Rd
uugccauaaaaaauuaa

SEQ ID NO: 2696710 - RNA, 18 nt, Haemophilus influenzae Rd
uugccauagacauuagua

SEQ ID NO: 2696711 - RNA, 13 nt, Haemophilus influenzae Rd
uugccauauuuaa

SEQ ID NO: 2696712 - RNA, 16 nt, Haemophilus influenzae Rd
uugccauuuacagguu

SEQ ID NO: 2696713 - RNA, 15 nt, Haemophilus influenzae Rd
uugcccaauaaaagu

SEQ ID NO: 2696714 - RNA, 22 nt, Haemophilus influenzae Rd
uugcccagaaauuggcuuguug

SEQ ID NO: 2696715 - RNA, 21 nt, Haemophilus influenzae Rd
uugcccgcaccgcuucuuugu

SEQ ID NO: 2696716 - RNA, 17 nt, Haemophilus influenzae Rd
uugcccgugaguaaaau

SEQ ID NO: 2696717 - RNA, 17 nt, Haemophilus influenzae Rd
uugcccuagugcaacca

SEQ ID NO: 2696718 - RNA, 18 nt, Haemophilus influenzae Rd
uugccgacacuaaaaagc

SEQ ID NO: 2696719 - RNA, 18 nt, Haemophilus influenzae Rd
uugccgccaguaagaucu

SEQ ID NO: 2696720 - RNA, 23 nt, Haemophilus influenzae Rd
uugccgcuuccacaccaaaaaug

SEQ ID NO: 2696721 - RNA, 21 nt, Haemophilus influenzae Rd
uugccuaaauacaucacuaau

SEQ ID NO: 2696722 - RNA, 15 nt, Haemophilus influenzae Rd
uugccuaauaaaaaa

SEQ ID NO: 2696723 - RNA, 20 nt, Haemophilus influenzae Rd
uugccuaauaaaaaauaaag

SEQ ID NO: 2696724 - RNA, 15 nt, Haemophilus influenzae Rd
uugccuaauagaaaa

SEQ ID NO: 2696725 - RNA, 18 nt, Haemophilus influenzae Rd
uugccuuuauggugugca

SEQ ID NO: 2696726 - RNA, 20 nt, Haemophilus influenzae Rd
uugccuuuuaauaaacccuc

SEQ ID NO: 2696727 - RNA, 21 nt, Haemophilus influenzae Rd
uugcgauaauuugcaucauuu

SEQ ID NO: 2696728 - RNA, 12 nt, Haemophilus influenzae Rd
uugcgccaauaa

SEQ ID NO: 2696729 - RNA, 17 nt, Haemophilus influenzae Rd
uugcgccacaauauuua

SEQ ID NO: 2696730 - RNA, 14 nt, Haemophilus influenzae Rd
uugcgccuaaacca

SEQ ID NO: 2696731 - RNA, 20 nt, Haemophilus influenzae Rd
uugcgcugcuuuauuuggca

SEQ ID NO: 2696732 - RNA, 17 nt, Haemophilus influenzae Rd
uugcgcuuucaauuuuc

SEQ ID NO: 2696733 - RNA, 20 nt, Haemophilus influenzae Rd
uugcggaucaagauuugcaa

SEQ ID NO: 2696734 - RNA, 21 nt, Haemophilus influenzae Rd
uugcguaucacuuaaaccaaa

SEQ ID NO: 2696735 - RNA, 15 nt, Haemophilus influenzae Rd
uugcgucuucaaguc

SEQ ID NO: 2696736 - RNA, 18 nt, Haemophilus influenzae Rd
uugcgucuucaagucuuu

SEQ ID NO: 2696737 - RNA, 18 nt, Haemophilus influenzae Rd
uugcgugauuccaaaaau

SEQ ID NO: 2696738 - RNA, 13 nt, Haemophilus influenzae Rd
uugcgugcgaauu

SEQ ID NO: 2696739 - RNA, 14 nt, Haemophilus influenzae Rd
uugcguguuuauau

SEQ ID NO: 2696740 - RNA, 12 nt, Haemophilus influenzae Rd
uugcguucuccg

SEQ ID NO: 2696741 - RNA, 13 nt, Haemophilus influenzae Rd
uugcguucuccgc

SEQ ID NO: 2696742 - RNA, 11 nt, Haemophilus influenzae Rd
uugcuaaaaag

SEQ ID NO: 2696743 - RNA, 13 nt, Haemophilus influenzae Rd
uugcuaaaaagaa

SEQ ID NO: 2696744 - RNA, 23 nt, Haemophilus influenzae Rd
uugcuaaaaagaaauaaaagaua

SEQ ID NO: 2696745 - RNA, 15 nt, Haemophilus influenzae Rd
uugcuaaugaugugc

SEQ ID NO: 2696746 - RNA, 16 nt, Haemophilus influenzae Rd
uugcuaccuucaacca

SEQ ID NO: 2696747 - RNA, 14 nt, Haemophilus influenzae Rd
uugcuagccaauaa

SEQ ID NO: 2696748 - RNA, 17 nt, Haemophilus influenzae Rd
uugcuagccaauaaucu

SEQ ID NO: 2696749 - RNA, 16 nt, Haemophilus influenzae Rd
uugcuauccaaccuaa

SEQ ID NO: 2696750 - RNA, 19 nt, Haemophilus influenzae Rd
uugcuauccaguaaagaau

SEQ ID NO: 2696751 - RNA, 22 nt, Haemophilus influenzae Rd
uugcuaugcccaagcaauucuu

SEQ ID NO: 2696752 - RNA, 17 nt, Haemophilus influenzae Rd
uugcuauggcaaugaau

SEQ ID NO: 2696753 - RNA, 15 nt, Haemophilus influenzae Rd
uugcuauucuuuaga

SEQ ID NO: 2696754 - RNA, 16 nt, Haemophilus influenzae Rd
uugcuauuuucuaauu

SEQ ID NO: 2696755 - RNA, 18 nt, Haemophilus influenzae Rd
uugcucaauaauuucaau

SEQ ID NO: 2696756 - RNA, 23 nt, Haemophilus influenzae Rd
uugcucagccaguuuucuagcuu

SEQ ID NO: 2696757 - RNA, 13 nt, Haemophilus influenzae Rd
uugcuccacuucu

SEQ ID NO: 2696758 - RNA, 15 nt, Haemophilus influenzae Rd
uugcuccuacuuuua

SEQ ID NO: 2696759 - RNA, 18 nt, Haemophilus influenzae Rd
uugcucgugugccaucag

SEQ ID NO: 2696760 - RNA, 14 nt, Haemophilus influenzae Rd
uugcucuaaaugug

SEQ ID NO: 2696761 - RNA, 22 nt, Haemophilus influenzae Rd
uugcucugcguucaagccuuug

SEQ ID NO: 2696762 - RNA, 20 nt, Haemophilus influenzae Rd
uugcucuuuaacaauauauc

SEQ ID NO: 2696763 - RNA, 21 nt, Haemophilus influenzae Rd
uugcucuuuaacaauauauca

SEQ ID NO: 2696764 - RNA, 15 nt, Haemophilus influenzae Rd
uugcucuuucaaguu

SEQ ID NO: 2696765 - RNA, 17 nt, Haemophilus influenzae Rd
uugcugauaaauuccuu

SEQ ID NO: 2696766 - RNA, 16 nt, Haemophilus influenzae Rd
uugcugauugcacauu

SEQ ID NO: 2696767 - RNA, 18 nt, Haemophilus influenzae Rd
uugcugauugcacauuag

SEQ ID NO: 2696768 - RNA, 18 nt, Haemophilus influenzae Rd
uugcugugguuuugugag

SEQ ID NO: 2696769 - RNA, 13 nt, Haemophilus influenzae Rd
uugcuguguugau

SEQ ID NO: 2696770 - RNA, 16 nt, Haemophilus influenzae Rd
uugcuguuaagaccaa

SEQ ID NO: 2696771 - RNA, 20 nt, Haemophilus influenzae Rd
uugcuguuaagaccaauucu

SEQ ID NO: 2696772 - RNA, 17 nt, Haemophilus influenzae Rd
uugcuguucgauuucau

SEQ ID NO: 2696773 - RNA, 15 nt, Haemophilus influenzae Rd
uugcuguugguuaaa

SEQ ID NO: 2696774 - RNA, 19 nt, Haemophilus influenzae Rd
uugcuguugguuaaaaaua

SEQ ID NO: 2696775 - RNA, 22 nt, Haemophilus influenzae Rd
uugcuguuucgcaucaaagaau

SEQ ID NO: 2696776 - RNA, 23 nt, Haemophilus influenzae Rd
uugcuuaagugcgguauuuuuau

SEQ ID NO: 2696777 - RNA, 22 nt, Haemophilus influenzae Rd
uugcuuagugaaaagaaaacuu

SEQ ID NO: 2696778 - RNA, 20 nt, Haemophilus influenzae Rd
uugcuucaacgacuaaaauu

SEQ ID NO: 2696779 - RNA, 19 nt, Haemophilus influenzae Rd
uugcuucaauuugacgaau

SEQ ID NO: 2696780 - RNA, 17 nt, Haemophilus influenzae Rd
uugcuucgugaauacga

SEQ ID NO: 2696781 - RNA, 23 nt, Haemophilus influenzae Rd
uugcuucgugaauacgaucugca

SEQ ID NO: 2696782 - RNA, 13 nt, Haemophilus influenzae Rd
uugcuuuaacuga

SEQ ID NO: 2696783 - RNA, 21 nt, Haemophilus influenzae Rd
uugcuuucuuauauauaaaau

SEQ ID NO: 2696784 - RNA, 21 nt, Haemophilus influenzae Rd
uugcuuugguuuaguuuacuu

SEQ ID NO: 2696785 - RNA, 16 nt, Haemophilus influenzae Rd
uugcuuuuuuaauuug

SEQ ID NO: 2696786 - RNA, 12 nt, Haemophilus influenzae Rd
uuggaaaaguaa

SEQ ID NO: 2696787 - RNA, 20 nt, Haemophilus influenzae Rd
uuggaaaaguaagaaacuug

SEQ ID NO: 2696788 - RNA, 18 nt, Haemophilus influenzae Rd
uuggaaacuaugcagaau

SEQ ID NO: 2696789 - RNA, 22 nt, Haemophilus influenzae Rd
uuggaaauaauauucaaaacau

SEQ ID NO: 2696790 - RNA, 23 nt, Haemophilus influenzae Rd
uuggaaauaauauucaaaacauu

SEQ ID NO: 2696791 - RNA, 16 nt, Haemophilus influenzae Rd
uuggaacaguaaauuu

SEQ ID NO: 2696792 - RNA, 12 nt, Haemophilus influenzae Rd
uuggaacaucau

SEQ ID NO: 2696793 - RNA, 17 nt, Haemophilus influenzae Rd
uuggaacgauuaaaaau

SEQ ID NO: 2696794 - RNA, 18 nt, Haemophilus influenzae Rd
uuggaagaaaagcauuaa

SEQ ID NO: 2696795 - RNA, 15 nt, Haemophilus influenzae Rd
uuggaaugcuaauca

SEQ ID NO: 2696796 - RNA, 22 nt, Haemophilus influenzae Rd
uuggaaugguugcaaaggcagg

SEQ ID NO: 2696797 - RNA, 15 nt, Haemophilus influenzae Rd
uuggaauguugugac

SEQ ID NO: 2696798 - RNA, 15 nt, Haemophilus influenzae Rd
uuggaauuucaaaau

SEQ ID NO: 2696799 - RNA, 23 nt, Haemophilus influenzae Rd
uuggagguuaaaaaauuaaaaga

SEQ ID NO: 2696800 - RNA, 13 nt, Haemophilus influenzae Rd
uuggaguagugca

SEQ ID NO: 2696801 - RNA, 20 nt, Haemophilus influenzae Rd
uuggauacauuccaucaaaa

SEQ ID NO: 2696802 - RNA, 19 nt, Haemophilus influenzae Rd
uuggauagaccacaugaau

SEQ ID NO: 2696803 - RNA, 17 nt, Haemophilus influenzae Rd
uuggaucauuauccaaa

SEQ ID NO: 2696804 - RNA, 15 nt, Haemophilus influenzae Rd
uuguccuuugccuuu

SEQ ID NO: 2696805 - RNA, 15 nt, Haemophilus influenzae Rd
uuguccuuuugccau

SEQ ID NO: 2696806 - RNA, 20 nt, Haemophilus influenzae Rd
uugucgcaggugucacagca

SEQ ID NO: 2696807 - RNA, 14 nt, Haemophilus influenzae Rd
uugucguaauaaca

SEQ ID NO: 2696808 - RNA, 23 nt, Haemophilus influenzae Rd
uugucguucuuaccccaacaaac

SEQ ID NO: 2696809 - RNA, 16 nt, Haemophilus influenzae Rd
uugucguugaacucac

SEQ ID NO: 2696810 - RNA, 21 nt, Haemophilus influenzae Rd
uugucuauuuuauuugccuug

SEQ ID NO: 2696811 - RNA, 22 nt, Haemophilus influenzae Rd
uugucucaaaauccaaguuugu

SEQ ID NO: 2696812 - RNA, 13 nt, Haemophilus influenzae Rd
uugucugaaauuu

SEQ ID NO: 2696813 - RNA, 14 nt, Haemophilus influenzae Rd
uugucugaaauuuu

SEQ ID NO: 2696814 - RNA, 16 nt, Haemophilus influenzae Rd
uugucuuuuacguuau

SEQ ID NO: 2696815 - RNA, 13 nt, Haemophilus influenzae Rd
uugugaaaaaacg

SEQ ID NO: 2696816 - RNA, 19 nt, Haemophilus influenzae Rd
uugugaaguuuuuuaaguu

SEQ ID NO: 2696817 - RNA, 21 nt, Haemophilus influenzae Rd
uugugacuacaaacaaauuuu

SEQ ID NO: 2696818 - RNA, 23 nt, Haemophilus influenzae Rd
uugugacuacaaacaaauuuuua

SEQ ID NO: 2696819 - RNA, 23 nt, Haemophilus influenzae Rd
uugugaggaaguuaaaauacuuu

SEQ ID NO: 2696820 - RNA, 14 nt, Haemophilus influenzae Rd
uugugaguaaaaua

SEQ ID NO: 2696821 - RNA, 16 nt, Haemophilus influenzae Rd
uugugaguaaaauacg

SEQ ID NO: 2696822 - RNA, 17 nt, Haemophilus influenzae Rd
uugugaguaaaauacga

SEQ ID NO: 2696823 - RNA, 19 nt, Haemophilus influenzae Rd
uugugaguaaaauacgaau

SEQ ID NO: 2696824 - RNA, 15 nt, Haemophilus influenzae Rd
uugugaguucaagca

SEQ ID NO: 2696825 - RNA, 15 nt, Haemophilus influenzae Rd
uugugauguucuaaa

SEQ ID NO: 2696826 - RNA, 20 nt, Haemophilus influenzae Rd
uugugauugaugccccugca

SEQ ID NO: 2696827 - RNA, 22 nt, Haemophilus influenzae Rd
uugugcaagaaauugauauaaa

SEQ ID NO: 2696828 - RNA, 17 nt, Haemophilus influenzae Rd
uugugccaaauucagua

SEQ ID NO: 2696829 - RNA, 20 nt, Haemophilus influenzae Rd
uugugccagcuggaaauucc

SEQ ID NO: 2696830 - RNA, 21 nt, Haemophilus influenzae Rd
uugugccagcuggaaauucca

SEQ ID NO: 2696831 - RNA, 14 nt, Haemophilus influenzae Rd
uugugccauuucua

SEQ ID NO: 2696832 - RNA, 21 nt, Haemophilus influenzae Rd
uugugccuuuaaagucacgag

SEQ ID NO: 2696833 - RNA, 16 nt, Haemophilus influenzae Rd
uugugcgauuaacaau

SEQ ID NO: 2696834 - RNA, 16 nt, Haemophilus influenzae Rd
uugugcgcguaccaaa

SEQ ID NO: 2696835 - RNA, 16 nt, Haemophilus influenzae Rd
uugugcgguucauaag

SEQ ID NO: 2696836 - RNA, 14 nt, Haemophilus influenzae Rd
uugugcuaaauaau

SEQ ID NO: 2696837 - RNA, 14 nt, Haemophilus influenzae Rd
uugugcuauacaaa

SEQ ID NO: 2696838 - RNA, 22 nt, Haemophilus influenzae Rd
uugugcuggaguugcagauuua

SEQ ID NO: 2696839 - RNA, 18 nt, Haemophilus influenzae Rd
uuguggaauaaaauaauc

SEQ ID NO: 2696840 - RNA, 19 nt, Haemophilus influenzae Rd
uuguggaauaaaauaaucu

SEQ ID NO: 2696841 - RNA, 19 nt, Haemophilus influenzae Rd
uuguggaauaccauucguu

SEQ ID NO: 2696842 - RNA, 15 nt, Haemophilus influenzae Rd
uuguggaaugcccag

SEQ ID NO: 2696843 - RNA, 16 nt, Haemophilus influenzae Rd
uuguggacguuucaaa

SEQ ID NO: 2696844 - RNA, 19 nt, Haemophilus influenzae Rd
uuguggcaaucguucuaaa

SEQ ID NO: 2696845 - RNA, 20 nt, Haemophilus influenzae Rd
uuguggcaguaaaggcacuu

SEQ ID NO: 2696846 - RNA, 14 nt, Haemophilus influenzae Rd
uugugguaauuuau

SEQ ID NO: 2696847 - RNA, 20 nt, Haemophilus influenzae Rd
uugugguaauuuauuuacau

SEQ ID NO: 2696848 - RNA, 16 nt, Haemophilus influenzae Rd
uugugucacauaauca

SEQ ID NO: 2696849 - RNA, 20 nt, Haemophilus influenzae Rd
uuguguuucaacaaaaauac

SEQ ID NO: 2696850 - RNA, 16 nt, Haemophilus influenzae Rd
uuguguuuuagaaagc

SEQ ID NO: 2696851 - RNA, 14 nt, Haemophilus influenzae Rd
uuguuaaauaaaca

SEQ ID NO: 2696852 - RNA, 16 nt, Haemophilus influenzae Rd
uuguuaauaaaagaau

SEQ ID NO: 2696853 - RNA, 16 nt, Haemophilus influenzae Rd
uuguuaccuuuuccaa

SEQ ID NO: 2696854 - RNA, 18 nt, Haemophilus influenzae Rd
uuguuacguuucacuaca

SEQ ID NO: 2696855 - RNA, 13 nt, Haemophilus influenzae Rd
uuguuacuuucca

SEQ ID NO: 2696856 - RNA, 15 nt, Haemophilus influenzae Rd
uuguuagaucaaauu

SEQ ID NO: 2696857 - RNA, 19 nt, Haemophilus influenzae Rd
uuguuagcggauaaaauaa

SEQ ID NO: 2696858 - RNA, 22 nt, Haemophilus influenzae Rd
uuguucaaauaauguguugauu

SEQ ID NO: 2696859 - RNA, 20 nt, Haemophilus influenzae Rd
uuguucaagacugaauuuua

SEQ ID NO: 2696860 - RNA, 22 nt, Haemophilus influenzae Rd
uuguucaagaugugauauuaaa

SEQ ID NO: 2696861 - RNA, 15 nt, Haemophilus influenzae Rd
uuguucacaucaaaa

SEQ ID NO: 2696862 - RNA, 19 nt, Haemophilus influenzae Rd
uuguucagccaauuuuuca

SEQ ID NO: 2696863 - RNA, 21 nt, Haemophilus influenzae Rd
uuguucagccaauuuuucaaa

SEQ ID NO: 2696864 - RNA, 14 nt, Haemophilus influenzae Rd
uuguuccaggaaaa

SEQ ID NO: 2696865 - RNA, 20 nt, Haemophilus influenzae Rd
uuguuccaggaaaauuuuau

SEQ ID NO: 2696866 - RNA, 20 nt, Haemophilus influenzae Rd
uuguucgucaccguauugcu

SEQ ID NO: 2696867 - RNA, 17 nt, Haemophilus influenzae Rd
uuguugaaauuccucac

SEQ ID NO: 2696868 - RNA, 23 nt, Haemophilus influenzae Rd
uuguugaauuggaaguuuuuccg

SEQ ID NO: 2696869 - RNA, 23 nt, Haemophilus influenzae Rd
uuguuggcauauucgcaccuuca

SEQ ID NO: 2696870 - RNA, 18 nt, Haemophilus influenzae Rd
uuguuggcuugauuuuaa

SEQ ID NO: 2696871 - RNA, 13 nt, Haemophilus influenzae Rd
uuguuguaaaaua

SEQ ID NO: 2696872 - RNA, 20 nt, Haemophilus influenzae Rd
uuguuguaaauugguuuuau

SEQ ID NO: 2696873 - RNA, 18 nt, Haemophilus influenzae Rd
uuguuguucuaacauuuu

SEQ ID NO: 2696874 - RNA, 14 nt, Haemophilus influenzae Rd
uuguuuaauauuuu

SEQ ID NO: 2696875 - RNA, 17 nt, Haemophilus influenzae Rd
uuguuuauaucuuuauu

SEQ ID NO: 2696876 - RNA, 17 nt, Haemophilus influenzae Rd
uuguuuaugucuaaacu

SEQ ID NO: 2696877 - RNA, 15 nt, Haemophilus influenzae Rd
uuguuucaacauauc

SEQ ID NO: 2696878 - RNA, 13 nt, Haemophilus influenzae Rd
uuguuucaccauu

SEQ ID NO: 2696879 - RNA, 20 nt, Haemophilus influenzae Rd
uuguuugaaaaauuaucaaa

SEQ ID NO: 2696880 - RNA, 15 nt, Haemophilus influenzae Rd
uuguuugauccuuua

SEQ ID NO: 2696881 - RNA, 13 nt, Haemophilus influenzae Rd
uuguuugccaucu

SEQ ID NO: 2696882 - RNA, 20 nt, Haemophilus influenzae Rd
uuguuuguaauaaauuuuau

SEQ ID NO: 2696883 - RNA, 13 nt, Haemophilus influenzae Rd
uuguuuuaaaaug

SEQ ID NO: 2696884 - RNA, 15 nt, Haemophilus influenzae Rd
uuguuuuaaaaugga

SEQ ID NO: 2696885 - RNA, 17 nt, Haemophilus influenzae Rd
uuguuuuacuugaccag

SEQ ID NO: 2696886 - RNA, 21 nt, Haemophilus influenzae Rd
uuguuuucaggauagagaaac

SEQ ID NO: 2696887 - RNA, 12 nt, Haemophilus influenzae Rd
uuguuuuccaaa

SEQ ID NO: 2696888 - RNA, 22 nt, Haemophilus influenzae Rd
uuguuuucugaacuaaaauaac

SEQ ID NO: 2696889 - RNA, 17 nt, Haemophilus influenzae Rd
uuguuuucuuuuuuucu

SEQ ID NO: 2696890 - RNA, 13 nt, Haemophilus influenzae Rd
uuguuuugcaaua

SEQ ID NO: 2696891 - RNA, 14 nt, Haemophilus influenzae Rd
uuguuuuguucauc

SEQ ID NO: 2696892 - RNA, 12 nt, Haemophilus influenzae Rd
uuguuuuuccaa

SEQ ID NO: 2696893 - RNA, 11 nt, Haemophilus influenzae Rd
uuguuuuuccg

SEQ ID NO: 2696894 - RNA, 23 nt, Haemophilus influenzae Rd
uuguuuuucgcguucuuucgcaa

SEQ ID NO: 2696895 - RNA, 16 nt, Haemophilus influenzae Rd
uuguuuuuuucuaaau

SEQ ID NO: 2696896 - RNA, 17 nt, Haemophilus influenzae Rd
uuguuuuuuucuaaaua

SEQ ID NO: 2696897 - RNA, 18 nt, Haemophilus influenzae Rd
uuuaaaaaaacguuaaau

SEQ ID NO: 2696898 - RNA, 14 nt, Haemophilus influenzae Rd
uuuaaaaaauaauu

SEQ ID NO: 2696899 - RNA, 19 nt, Haemophilus influenzae Rd
uuuaaaaacggaaucaggu

SEQ ID NO: 2696900 - RNA, 16 nt, Haemophilus influenzae Rd
uuuaaaaauaacauaa

SEQ ID NO: 2696901 - RNA, 16 nt, Haemophilus influenzae Rd
uuuaaaaauuaauguc

SEQ ID NO: 2696902 - RNA, 15 nt, Haemophilus influenzae Rd
uuuaaaacacgaaaa

SEQ ID NO: 2696903 - RNA, 17 nt, Haemophilus influenzae Rd
uuuaaaaccaaaagauu

SEQ ID NO: 2696904 - RNA, 23 nt, Haemophilus influenzae Rd
uuuaaaaccacaauaaaauaaua

SEQ ID NO: 2696905 - RNA, 11 nt, Haemophilus influenzae Rd
uuuaaaacuau

SEQ ID NO: 2696906 - RNA, 16 nt, Haemophilus influenzae Rd
uuuaaaacuauaaaaa

SEQ ID NO: 2696907 - RNA, 12 nt, Haemophilus influenzae Rd
uuuaaaaguuua

SEQ ID NO: 2696908 - RNA, 16 nt, Haemophilus influenzae Rd
uuuaaaaguuuacuau

SEQ ID NO: 2696909 - RNA, 20 nt, Haemophilus influenzae Rd
uuuaaaauacugcacaauca

SEQ ID NO: 2696910 - RNA, 21 nt, Haemophilus influenzae Rd
uuuaauuuuguccgaaaaaac

SEQ ID NO: 2696911 - RNA, 19 nt, Haemophilus influenzae Rd
uuuacaaggacaauaauaa

SEQ ID NO: 2696912 - RNA, 21 nt, Haemophilus influenzae Rd
uuuacaauccuaacuuuucuu

SEQ ID NO: 2696913 - RNA, 16 nt, Haemophilus influenzae Rd
uuuacacauugccaua

SEQ ID NO: 2696914 - RNA, 14 nt, Haemophilus influenzae Rd
uuuacaccaacacu

SEQ ID NO: 2696915 - RNA, 17 nt, Haemophilus influenzae Rd
uuuacagaacaaaauaa

SEQ ID NO: 2696916 - RNA, 16 nt, Haemophilus influenzae Rd
uuuacauauaaaagug

SEQ ID NO: 2696917 - RNA, 19 nt, Haemophilus influenzae Rd
uuuacauauaaagauugca

SEQ ID NO: 2696918 - RNA, 11 nt, Haemophilus influenzae Rd
uuuacaucuug

SEQ ID NO: 2696919 - RNA, 20 nt, Haemophilus influenzae Rd
uuuaccaaccgguaaaauua

SEQ ID NO: 2696920 - RNA, 19 nt, Haemophilus influenzae Rd
uuuaccaauugauuuuuca

SEQ ID NO: 2696921 - RNA, 18 nt, Haemophilus influenzae Rd
uuuacccaaauuaucaaa

SEQ ID NO: 2696922 - RNA, 20 nt, Haemophilus influenzae Rd
uuuaccgcaaucuucacaaa

SEQ ID NO: 2696923 - RNA, 19 nt, Haemophilus influenzae Rd
uuuaccgcacuuucuucgu

SEQ ID NO: 2696924 - RNA, 21 nt, Haemophilus influenzae Rd
uuuaccgcacuuuuaaaauua

SEQ ID NO: 2696925 - RNA, 21 nt, Haemophilus influenzae Rd
uuuaccgcacuuuuuuucuua

SEQ ID NO: 2696926 - RNA, 23 nt, Haemophilus influenzae Rd
uuuaccgcacuuuuuuucuuauu

SEQ ID NO: 2696927 - RNA, 16 nt, Haemophilus influenzae Rd
uuuaccgucaauaaag

SEQ ID NO: 2696928 - RNA, 23 nt, Haemophilus influenzae Rd
uuuaccgucagccaaauuuuucu

SEQ ID NO: 2696929 - RNA, 22 nt, Haemophilus influenzae Rd
uuuaccuuguaaacuuuccuca

SEQ ID NO: 2696930 - RNA, 23 nt, Haemophilus influenzae Rd
uuuaccuuguaaacuuuccucaa

SEQ ID NO: 2696931 - RNA, 18 nt, Haemophilus influenzae Rd
uuuacgaagugcgguaaa

SEQ ID NO: 2696932 - RNA, 22 nt, Haemophilus influenzae Rd
uuuacgagaaagguguaauucc

SEQ ID NO: 2696933 - RNA, 16 nt, Haemophilus influenzae Rd
uuuacgauauuuuuau

SEQ ID NO: 2696934 - RNA, 18 nt, Haemophilus influenzae Rd
uuuacgauauuuuuauca

SEQ ID NO: 2696935 - RNA, 18 nt, Haemophilus influenzae Rd
uuuacgauuucugccucu

SEQ ID NO: 2696936 - RNA, 16 nt, Haemophilus influenzae Rd
uuuacgccauucuuua

SEQ ID NO: 2696937 - RNA, 23 nt, Haemophilus influenzae Rd
uuuacgccccuacuuuaaagaau

SEQ ID NO: 2696938 - RNA, 15 nt, Haemophilus influenzae Rd
uuuacggauuuauau

SEQ ID NO: 2696939 - RNA, 21 nt, Haemophilus influenzae Rd
uuuacguaucgcuaagaauaa

SEQ ID NO: 2696940 - RNA, 18 nt, Haemophilus influenzae Rd
uuuacguauguauuuuca

SEQ ID NO: 2696941 - RNA, 13 nt, Haemophilus influenzae Rd
uuuacguuucauu

SEQ ID NO: 2696942 - RNA, 17 nt, Haemophilus influenzae Rd
uuuacguuuuaaauuaa

SEQ ID NO: 2696943 - RNA, 19 nt, Haemophilus influenzae Rd
uuuacuaaacguaacuaaa

SEQ ID NO: 2696944 - RNA, 16 nt, Haemophilus influenzae Rd
uuuacuaaauucuuuu

SEQ ID NO: 2696945 - RNA, 16 nt, Haemophilus influenzae Rd
uuuacuaauuaaaagg

SEQ ID NO: 2696946 - RNA, 13 nt, Haemophilus influenzae Rd
uuuacuacaucag

SEQ ID NO: 2696947 - RNA, 17 nt, Haemophilus influenzae Rd
uuuacuauuaaugcucu

SEQ ID NO: 2696948 - RNA, 14 nt, Haemophilus influenzae Rd
uuuacucaaagaaa

SEQ ID NO: 2696949 - RNA, 22 nt, Haemophilus influenzae Rd
uuuacucggcaccguuccugga

SEQ ID NO: 2696950 - RNA, 16 nt, Haemophilus influenzae Rd
uuuacugaauaaaaaa

SEQ ID NO: 2696951 - RNA, 16 nt, Haemophilus influenzae Rd
uuuacugauuuaaaaa

SEQ ID NO: 2696952 - RNA, 17 nt, Haemophilus influenzae Rd
uuuacugauuuaaaaaa

SEQ ID NO: 2696953 - RNA, 18 nt, Haemophilus influenzae Rd
uuuacugauuuaaaaaaa

SEQ ID NO: 2696954 - RNA, 20 nt, Haemophilus influenzae Rd
uuuacugauuuaaaaaaacg

SEQ ID NO: 2696955 - RNA, 18 nt, Haemophilus influenzae Rd
uuuacugauuuuaagaaa

SEQ ID NO: 2696956 - RNA, 21 nt, Haemophilus influenzae Rd
uuuacugcuucauaaauguaa

SEQ ID NO: 2696957 - RNA, 13 nt, Haemophilus influenzae Rd
uuuacuuaaaauc

SEQ ID NO: 2696958 - RNA, 17 nt, Haemophilus influenzae Rd
uuuacuucacguuguac

SEQ ID NO: 2696959 - RNA, 14 nt, Haemophilus influenzae Rd
uuuacuucaucaaa

SEQ ID NO: 2696960 - RNA, 18 nt, Haemophilus influenzae Rd
uuuacuucaucaaaacca

SEQ ID NO: 2696961 - RNA, 21 nt, Haemophilus influenzae Rd
uuuacuugcgauaucuucuaa

SEQ ID NO: 2696962 - RNA, 12 nt, Haemophilus influenzae Rd
uuuacuugugca

SEQ ID NO: 2696963 - RNA, 15 nt, Haemophilus influenzae Rd
uuuacuugugcauuu

SEQ ID NO: 2696964 - RNA, 23 nt, Haemophilus influenzae Rd
uuuagaacaauacucuuaacaaa

SEQ ID NO: 2696965 - RNA, 14 nt, Haemophilus influenzae Rd
uuuagaacauugau

SEQ ID NO: 2696966 - RNA, 18 nt, Haemophilus influenzae Rd
uuuagaauaaauuaaaaa

SEQ ID NO: 2696967 - RNA, 21 nt, Haemophilus influenzae Rd
uuuagaauccaaaauuacuuu

SEQ ID NO: 2696968 - RNA, 16 nt, Haemophilus influenzae Rd
uuuagaauuuuuauuu

SEQ ID NO: 2696969 - RNA, 13 nt, Haemophilus influenzae Rd
uuuagacaacaac

SEQ ID NO: 2696970 - RNA, 22 nt, Haemophilus influenzae Rd
uuuagacaacaacuuuucuaaa

SEQ ID NO: 2696971 - RNA, 19 nt, Haemophilus influenzae Rd
uuuagagcuuuuugcgcca

SEQ ID NO: 2696972 - RNA, 20 nt, Haemophilus influenzae Rd
uuuagauaaauuucaauuaa

SEQ ID NO: 2696973 - RNA, 14 nt, Haemophilus influenzae Rd
uuuagauauaaaaa

SEQ ID NO: 2696974 - RNA, 22 nt, Haemophilus influenzae Rd
uuuagauuaucauuaaauauaa

SEQ ID NO: 2696975 - RNA, 19 nt, Haemophilus influenzae Rd
uuuagauugcucaauauaa

SEQ ID NO: 2696976 - RNA, 19 nt, Haemophilus influenzae Rd
uuuagcaaggcguucaaua

SEQ ID NO: 2696977 - RNA, 22 nt, Haemophilus influenzae Rd
uuuagcaucuagcuuaacaaca

SEQ ID NO: 2696978 - RNA, 16 nt, Haemophilus influenzae Rd
uuuagcccgaaaauua

SEQ ID NO: 2696979 - RNA, 17 nt, Haemophilus influenzae Rd
uuuagcguacagaccau

SEQ ID NO: 2696980 - RNA, 19 nt, Haemophilus influenzae Rd
uuuagcgucgguaauaucg

SEQ ID NO: 2696981 - RNA, 20 nt, Haemophilus influenzae Rd
uuuagcuaauccuuuaccaa

SEQ ID NO: 2696982 - RNA, 21 nt, Haemophilus influenzae Rd
uuuagcucguugccauaaaaa

SEQ ID NO: 2696983 - RNA, 15 nt, Haemophilus influenzae Rd
uuuaggaauuuaugg

SEQ ID NO: 2696984 - RNA, 23 nt, Haemophilus influenzae Rd
uuuaggaugaaauuugaauauaa

SEQ ID NO: 2696985 - RNA, 23 nt, Haemophilus influenzae Rd
uuuaggauuguugauuuugguuc

SEQ ID NO: 2696986 - RNA, 20 nt, Haemophilus influenzae Rd
uuuaggggccuuuuuuaucu

SEQ ID NO: 2696987 - RNA, 20 nt, Haemophilus influenzae Rd
uuuaggguauuuauuauucu

SEQ ID NO: 2696988 - RNA, 14 nt, Haemophilus influenzae Rd
uuuagggugcauuu

SEQ ID NO: 2696989 - RNA, 18 nt, Haemophilus influenzae Rd
uuuagguuagaauaaacc

SEQ ID NO: 2696990 - RNA, 21 nt, Haemophilus influenzae Rd
uuuaguaauggguuaaagugc

SEQ ID NO: 2696991 - RNA, 13 nt, Haemophilus influenzae Rd
uuuaguaauuuua

SEQ ID NO: 2696992 - RNA, 19 nt, Haemophilus influenzae Rd
uuuaguaauuuuaauucuu

SEQ ID NO: 2696993 - RNA, 19 nt, Haemophilus influenzae Rd
uuuagucauacagaaacca

SEQ ID NO: 2696994 - RNA, 18 nt, Haemophilus influenzae Rd
uuuagugcuguauauuuu

SEQ ID NO: 2696995 - RNA, 14 nt, Haemophilus influenzae Rd
uuuaguguauaaca

SEQ ID NO: 2696996 - RNA, 14 nt, Haemophilus influenzae Rd
uuuaguuaaauaau

SEQ ID NO: 2696997 - RNA, 14 nt, Haemophilus influenzae Rd
uuuaguuguuuguu

SEQ ID NO: 2696998 - RNA, 13 nt, Haemophilus influenzae Rd
uuuaguuuacuuu

SEQ ID NO: 2696999 - RNA, 14 nt, Haemophilus influenzae Rd
uuuaguuucuaauu

SEQ ID NO: 2697000 - RNA, 12 nt, Haemophilus influenzae Rd
uuuaguuuuagg

SEQ ID NO: 2697001 - RNA, 12 nt, Haemophilus influenzae Rd
uuuaguuuuuuu

SEQ ID NO: 2697002 - RNA, 19 nt, Haemophilus influenzae Rd
uuuaguuuuuuuauaaaaa

SEQ ID NO: 2697003 - RNA, 20 nt, Haemophilus influenzae Rd
uuuaguuuuuuuauaaaaaa

SEQ ID NO: 2697004 - RNA, 15 nt, Haemophilus influenzae Rd
uuuauaaaaaaacaa

SEQ ID NO: 2697005 - RNA, 21 nt, Haemophilus influenzae Rd
uuuauaaaaaaaucugcacuu

SEQ ID NO: 2697006 - RNA, 11 nt, Haemophilus influenzae Rd
uuuauaaaauu

SEQ ID NO: 2697007 - RNA, 17 nt, Haemophilus influenzae Rd
uuuauaaaccaauuuua

SEQ ID NO: 2697008 - RNA, 20 nt, Haemophilus influenzae Rd
uuuauaaaguuuugcaucag

SEQ ID NO: 2697009 - RNA, 13 nt, Haemophilus influenzae Rd
uuuauaaauaaca

SEQ ID NO: 2697010 - RNA, 13 nt, Haemophilus influenzae Rd
uuuauaacauaau

SEQ ID NO: 2697011 - RNA, 14 nt, Haemophilus influenzae Rd
uuuauaacauaauu

SEQ ID NO: 2697012 - RNA, 14 nt, Haemophilus influenzae Rd
uuuauaacguuaau

SEQ ID NO: 2697013 - RNA, 20 nt, Haemophilus influenzae Rd
uuuauaagugccaacaauau

SEQ ID NO: 2697014 - RNA, 20 nt, Haemophilus influenzae Rd
uuuauaauagacugaaaaaa

SEQ ID NO: 2697015 - RNA, 18 nt, Haemophilus influenzae Rd
uuuauuuguuaauaaacg

SEQ ID NO: 2697016 - RNA, 15 nt, Haemophilus influenzae Rd
uuuauuuuaauuuua

SEQ ID NO: 2697017 - RNA, 13 nt, Haemophilus influenzae Rd
uuuauuuuacuaa

SEQ ID NO: 2697018 - RNA, 22 nt, Haemophilus influenzae Rd
uuuauuuuauauauuaaaaaaa

SEQ ID NO: 2697019 - RNA, 16 nt, Haemophilus influenzae Rd
uuuauuuugguauuuu

SEQ ID NO: 2697020 - RNA, 17 nt, Haemophilus influenzae Rd
uuuauuuuuauuauuua

SEQ ID NO: 2697021 - RNA, 14 nt, Haemophilus influenzae Rd
uuuauuuuuucuaa

SEQ ID NO: 2697022 - RNA, 18 nt, Haemophilus influenzae Rd
uuuauuuuuucuaaaaua

SEQ ID NO: 2697023 - RNA, 17 nt, Haemophilus influenzae Rd
uuucaaaaauuuuugca

SEQ ID NO: 2697024 - RNA, 18 nt, Haemophilus influenzae Rd
uuucaaaacguucuacuu

SEQ ID NO: 2697025 - RNA, 18 nt, Haemophilus influenzae Rd
uuucaaacaacaagucau

SEQ ID NO: 2697026 - RNA, 13 nt, Haemophilus influenzae Rd
uuucaaacacaaa

SEQ ID NO: 2697027 - RNA, 14 nt, Haemophilus influenzae Rd
uuucaaacacaaca

SEQ ID NO: 2697028 - RNA, 18 nt, Haemophilus influenzae Rd
uuucaaagcguuuuaaaa

SEQ ID NO: 2697029 - RNA, 23 nt, Haemophilus influenzae Rd
uuucaaaggcucuaccuaaaaua

SEQ ID NO: 2697030 - RNA, 15 nt, Haemophilus influenzae Rd
uuucaaauaauugac

SEQ ID NO: 2697031 - RNA, 14 nt, Haemophilus influenzae Rd
uuucaaauuaaccg

SEQ ID NO: 2697032 - RNA, 13 nt, Haemophilus influenzae Rd
uuucaacacaaca

SEQ ID NO: 2697033 - RNA, 19 nt, Haemophilus influenzae Rd
uuucaaccgcacuuaauaa

SEQ ID NO: 2697034 - RNA, 20 nt, Haemophilus influenzae Rd
uuucaaccgcacuuaauaaa

SEQ ID NO: 2697035 - RNA, 22 nt, Haemophilus influenzae Rd
uuucaaccgcucuuuuuauuua

SEQ ID NO: 2697036 - RNA, 15 nt, Haemophilus influenzae Rd
uuucaagaacagaaa

SEQ ID NO: 2697037 - RNA, 16 nt, Haemophilus influenzae Rd
uuucaagaagauuugu

SEQ ID NO: 2697038 - RNA, 19 nt, Haemophilus influenzae Rd
uuucaagaggauaacccuc

SEQ ID NO: 2697039 - RNA, 18 nt, Haemophilus influenzae Rd
uuucaagcacuuuauuua

SEQ ID NO: 2697040 - RNA, 21 nt, Haemophilus influenzae Rd
uuucaagcacuuuauuuaauu

SEQ ID NO: 2697041 - RNA, 16 nt, Haemophilus influenzae Rd
uuucaagcuuugcaac

SEQ ID NO: 2697042 - RNA, 20 nt, Haemophilus influenzae Rd
uuucaaggccauauuuuccc

SEQ ID NO: 2697043 - RNA, 21 nt, Haemophilus influenzae Rd
uuucaaguaacuuucacaacu

SEQ ID NO: 2697044 - RNA, 11 nt, Haemophilus influenzae Rd
uuucaauaauu

SEQ ID NO: 2697045 - RNA, 16 nt, Haemophilus influenzae Rd
uuucaauaauuuuucu

SEQ ID NO: 2697046 - RNA, 17 nt, Haemophilus influenzae Rd
uuucaauaauuuuucuu

SEQ ID NO: 2697047 - RNA, 19 nt, Haemophilus influenzae Rd
uuucaauaauuuuucuuca

SEQ ID NO: 2697048 - RNA, 14 nt, Haemophilus influenzae Rd
uuucaauauaaguu

SEQ ID NO: 2697049 - RNA, 15 nt, Haemophilus influenzae Rd
uuucaauauaaucaa

SEQ ID NO: 2697050 - RNA, 20 nt, Haemophilus influenzae Rd
uuucaauauaaucaauuauu

SEQ ID NO: 2697051 - RNA, 16 nt, Haemophilus influenzae Rd
uuucaaucauuucuaa

SEQ ID NO: 2697052 - RNA, 17 nt, Haemophilus influenzae Rd
uuucaaucccuucugcu

SEQ ID NO: 2697053 - RNA, 22 nt, Haemophilus influenzae Rd
uuucaaucgaaaguggcuuuuu

SEQ ID NO: 2697054 - RNA, 13 nt, Haemophilus influenzae Rd
uuucaaugaaaua

SEQ ID NO: 2697055 - RNA, 11 nt, Haemophilus influenzae Rd
uuucaaugacu

SEQ ID NO: 2697056 - RNA, 14 nt, Haemophilus influenzae Rd
uuucaaugcuuuuu

SEQ ID NO: 2697057 - RNA, 18 nt, Haemophilus influenzae Rd
uuucaaugucuuuuucuu

SEQ ID NO: 2697058 - RNA, 19 nt, Haemophilus influenzae Rd
uuucaaugucuuuuucuua

SEQ ID NO: 2697059 - RNA, 19 nt, Haemophilus influenzae Rd
uuucaauguugcgccaucu

SEQ ID NO: 2697060 - RNA, 13 nt, Haemophilus influenzae Rd
uuucaauugccau

SEQ ID NO: 2697061 - RNA, 13 nt, Haemophilus influenzae Rd
uuucaauuucacu

SEQ ID NO: 2697062 - RNA, 13 nt, Haemophilus influenzae Rd
uuucaauuucucu

SEQ ID NO: 2697063 - RNA, 18 nt, Haemophilus influenzae Rd
uuucaauuugaaaauuua

SEQ ID NO: 2697064 - RNA, 18 nt, Haemophilus influenzae Rd
uuucaauuugaacaaacg

SEQ ID NO: 2697065 - RNA, 16 nt, Haemophilus influenzae Rd
uuucaauuuuaaaauu

SEQ ID NO: 2697066 - RNA, 13 nt, Haemophilus influenzae Rd
uuucaauuuuucc

SEQ ID NO: 2697067 - RNA, 15 nt, Haemophilus influenzae Rd
uuucacaaaauauua

SEQ ID NO: 2697068 - RNA, 15 nt, Haemophilus influenzae Rd
uuucacaacuaccac

SEQ ID NO: 2697069 - RNA, 21 nt, Haemophilus influenzae Rd
uuucacaaguucuugcgcauu

SEQ ID NO: 2697070 - RNA, 17 nt, Haemophilus influenzae Rd
uuucacacccaugaauc

SEQ ID NO: 2697071 - RNA, 16 nt, Haemophilus influenzae Rd
uuucacauaaauuaca

SEQ ID NO: 2697072 - RNA, 20 nt, Haemophilus influenzae Rd
uuucacauaauaaacauaca

SEQ ID NO: 2697073 - RNA, 22 nt, Haemophilus influenzae Rd
uuucacauuugagaugaaaaaa

SEQ ID NO: 2697074 - RNA, 17 nt, Haemophilus influenzae Rd
uuucaccaacaaauucu

SEQ ID NO: 2697075 - RNA, 12 nt, Haemophilus influenzae Rd
uuucaccauuaa

SEQ ID NO: 2697076 - RNA, 19 nt, Haemophilus influenzae Rd
uuucacccaagauucuaaa

SEQ ID NO: 2697077 - RNA, 20 nt, Haemophilus influenzae Rd
uuucacccaagauucuaaau

SEQ ID NO: 2697078 - RNA, 13 nt, Haemophilus influenzae Rd
uuucaccgcacuu

SEQ ID NO: 2697079 - RNA, 15 nt, Haemophilus influenzae Rd
uuucacgcccaaaua

SEQ ID NO: 2697080 - RNA, 17 nt, Haemophilus influenzae Rd
uuucacgcccaaauacu

SEQ ID NO: 2697081 - RNA, 18 nt, Haemophilus influenzae Rd
uuucacgcccaaauacuu

SEQ ID NO: 2697082 - RNA, 18 nt, Haemophilus influenzae Rd
uuucacggauuucggcuu

SEQ ID NO: 2697083 - RNA, 15 nt, Haemophilus influenzae Rd
uuucacuaauuugcu

SEQ ID NO: 2697084 - RNA, 22 nt, Haemophilus influenzae Rd
uuucacucguauccguuccacu

SEQ ID NO: 2697085 - RNA, 22 nt, Haemophilus influenzae Rd
uuucacugcauuuucuuuuuca

SEQ ID NO: 2697086 - RNA, 22 nt, Haemophilus influenzae Rd
uuucacuguauuggaaaaguuc

SEQ ID NO: 2697087 - RNA, 19 nt, Haemophilus influenzae Rd
uuucacuucuaacuaaaaa

SEQ ID NO: 2697088 - RNA, 14 nt, Haemophilus influenzae Rd
uuucacuuugcccg

SEQ ID NO: 2697089 - RNA, 12 nt, Haemophilus influenzae Rd
uuucagaaaucg

SEQ ID NO: 2697090 - RNA, 16 nt, Haemophilus influenzae Rd
uuucagaauaaagaaa

SEQ ID NO: 2697091 - RNA, 20 nt, Haemophilus influenzae Rd
uuucagaauuaguaaagaaa

SEQ ID NO: 2697092 - RNA, 23 nt, Haemophilus influenzae Rd
uuucagaccgcacuuuaaaagug

SEQ ID NO: 2697093 - RNA, 16 nt, Haemophilus influenzae Rd
uuucagcaaaaugcgu

SEQ ID NO: 2697094 - RNA, 19 nt, Haemophilus influenzae Rd
uuucagcaagcauuuugaa

SEQ ID NO: 2697095 - RNA, 16 nt, Haemophilus influenzae Rd
uuucagccuauuuuua

SEQ ID NO: 2697096 - RNA, 13 nt, Haemophilus influenzae Rd
uuucagcuaaaau

SEQ ID NO: 2697097 - RNA, 16 nt, Haemophilus influenzae Rd
uuucagcuaguccugc

SEQ ID NO: 2697098 - RNA, 23 nt, Haemophilus influenzae Rd
uuucagcugcaauaucaauccca

SEQ ID NO: 2697099 - RNA, 19 nt, Haemophilus influenzae Rd
uuucaggauuucuaaaguu

SEQ ID NO: 2697100 - RNA, 18 nt, Haemophilus influenzae Rd
uuucaguaacuuuaauaa

SEQ ID NO: 2697101 - RNA, 16 nt, Haemophilus influenzae Rd
uuucaguaucaauacc

SEQ ID NO: 2697102 - RNA, 21 nt, Haemophilus influenzae Rd
uuucaguggggaauaaaauaa

SEQ ID NO: 2697103 - RNA, 22 nt, Haemophilus influenzae Rd
uuucaguggggaauaaaauaag

SEQ ID NO: 2697104 - RNA, 19 nt, Haemophilus influenzae Rd
uuucaguuacguaauauuu

SEQ ID NO: 2697105 - RNA, 17 nt, Haemophilus influenzae Rd
uuucaguuuugcuuuuu

SEQ ID NO: 2697106 - RNA, 16 nt, Haemophilus influenzae Rd
uuucauaaaaaaugcu

SEQ ID NO: 2697107 - RNA, 18 nt, Haemophilus influenzae Rd
uuucauaaacgguauuuu

SEQ ID NO: 2697108 - RNA, 14 nt, Haemophilus influenzae Rd
uuucauaaagauaa

SEQ ID NO: 2697109 - RNA, 18 nt, Haemophilus influenzae Rd
uuucauaagauaacaaga

SEQ ID NO: 2697110 - RNA, 20 nt, Haemophilus influenzae Rd
uuucauaagauaacaagaaa

SEQ ID NO: 2697111 - RNA, 22 nt, Haemophilus influenzae Rd
uuucauaaugcgaucuuuuguu

SEQ ID NO: 2697112 - RNA, 20 nt, Haemophilus influenzae Rd
uuucauacaaucucuagauu

SEQ ID NO: 2697113 - RNA, 23 nt, Haemophilus influenzae Rd
uuucauacgcgcccauucauuuu

SEQ ID NO: 2697114 - RNA, 13 nt, Haemophilus influenzae Rd
uuucauauaaaua

SEQ ID NO: 2697115 - RNA, 16 nt, Haemophilus influenzae Rd
uuucauaucuucuucu

SEQ ID NO: 2697116 - RNA, 16 nt, Haemophilus influenzae Rd
uuucauauuuuaaaua

SEQ ID NO: 2697117 - RNA, 20 nt, Haemophilus influenzae Rd
uuucauauuuuaaauaauua

SEQ ID NO: 2697118 - RNA, 20 nt, Haemophilus influenzae Rd
uuucaucaaugccauuuuuu

SEQ ID NO: 2697119 - RNA, 18 nt, Haemophilus influenzae Rd
uuucaucacaucaauacu

SEQ ID NO: 2697120 - RNA, 14 nt, Haemophilus influenzae Rd
uuucaucacuucaa

SEQ ID NO: 2697121 - RNA, 20 nt, Haemophilus influenzae Rd
uuucaucaggcauugcgccu

SEQ ID NO: 2697122 - RNA, 23 nt, Haemophilus influenzae Rd
uuucaucauucugguaauuugcu

SEQ ID NO: 2697123 - RNA, 15 nt, Haemophilus influenzae Rd
uuucauccuaaaaaa

SEQ ID NO: 2697124 - RNA, 18 nt, Haemophilus influenzae Rd
uuucaucgagaaauacga

SEQ ID NO: 2697125 - RNA, 22 nt, Haemophilus influenzae Rd
uuucaucgcgcaaaauaauauc

SEQ ID NO: 2697126 - RNA, 16 nt, Haemophilus influenzae Rd
uuucaucguauuuccu

SEQ ID NO: 2697127 - RNA, 14 nt, Haemophilus influenzae Rd
uuucaucguuaauu

SEQ ID NO: 2697128 - RNA, 18 nt, Haemophilus influenzae Rd
uuucaucuuuuuauaaaa

SEQ ID NO: 2697129 - RNA, 15 nt, Haemophilus influenzae Rd
uuucauuaauuuuau

SEQ ID NO: 2697130 - RNA, 19 nt, Haemophilus influenzae Rd
uuucauuaauuuuauuuuu

SEQ ID NO: 2697131 - RNA, 20 nt, Haemophilus influenzae Rd
uuucauuaauuuuauuuuuu

SEQ ID NO: 2697132 - RNA, 19 nt, Haemophilus influenzae Rd
uuucauucaacaauucaua

SEQ ID NO: 2697133 - RNA, 21 nt, Haemophilus influenzae Rd
uuucauucguauaaauauuuc

SEQ ID NO: 2697134 - RNA, 12 nt, Haemophilus influenzae Rd
uuucauucuauu

SEQ ID NO: 2697135 - RNA, 19 nt, Haemophilus influenzae Rd
uuucauucuauuuuaaaaa

SEQ ID NO: 2697136 - RNA, 14 nt, Haemophilus influenzae Rd
uuucauuugaacaa

SEQ ID NO: 2697137 - RNA, 20 nt, Haemophilus influenzae Rd
uuucauuugaacaauuaacg

SEQ ID NO: 2697138 - RNA, 18 nt, Haemophilus influenzae Rd
uuuccaaaaaccaacgcc

SEQ ID NO: 2697139 - RNA, 21 nt, Haemophilus influenzae Rd
uuuccaaaauuucugaacaca

SEQ ID NO: 2697140 - RNA, 17 nt, Haemophilus influenzae Rd
uuuccaaacauuuuuau

SEQ ID NO: 2697141 - RNA, 22 nt, Haemophilus influenzae Rd
uuuccaaauuccgcaauauuua

SEQ ID NO: 2697142 - RNA, 16 nt, Haemophilus influenzae Rd
uuuccaaccaaucagu

SEQ ID NO: 2697143 - RNA, 13 nt, Haemophilus influenzae Rd
uuuccaaguauuu

SEQ ID NO: 2697144 - RNA, 21 nt, Haemophilus influenzae Rd
uuuccacgccuguggcaaaau

SEQ ID NO: 2697145 - RNA, 22 nt, Haemophilus influenzae Rd
uuuccacgccuguggcaaaauc

SEQ ID NO: 2697146 - RNA, 19 nt, Haemophilus influenzae Rd
uuuccacguuguaagcaaa

SEQ ID NO: 2697147 - RNA, 21 nt, Haemophilus influenzae Rd
uuuccacuauucguaaugccu

SEQ ID NO: 2697148 - RNA, 21 nt, Haemophilus influenzae Rd
uuuccagcaaaaaaauuucuu

SEQ ID NO: 2697149 - RNA, 17 nt, Haemophilus influenzae Rd
uuuccauaaaugacaga

SEQ ID NO: 2697150 - RNA, 18 nt, Haemophilus influenzae Rd
uuuccauaugaccauuaa

SEQ ID NO: 2697151 - RNA, 22 nt, Haemophilus influenzae Rd
uuuccaucaccuucaacauaag

SEQ ID NO: 2697152 - RNA, 22 nt, Haemophilus influenzae Rd
uuuccauuuuugagguguuuau

SEQ ID NO: 2697153 - RNA, 17 nt, Haemophilus influenzae Rd
uuuccauuuuuuucuau

SEQ ID NO: 2697154 - RNA, 18 nt, Haemophilus influenzae Rd
uuucccauuugucucaaa

SEQ ID NO: 2697155 - RNA, 19 nt, Haemophilus influenzae Rd
uuuccccacuuaucuuaaa

SEQ ID NO: 2697156 - RNA, 16 nt, Haemophilus influenzae Rd
uuuccccgcucuuucc

SEQ ID NO: 2697157 - RNA, 15 nt, Haemophilus influenzae Rd
uuuccccugaaugug

SEQ ID NO: 2697158 - RNA, 14 nt, Haemophilus influenzae Rd
uuuccccuuguucu

SEQ ID NO: 2697159 - RNA, 19 nt, Haemophilus influenzae Rd
uuuccccuuguucuucaua

SEQ ID NO: 2697160 - RNA, 14 nt, Haemophilus influenzae Rd
uuucccucaaaauu

SEQ ID NO: 2697161 - RNA, 16 nt, Haemophilus influenzae Rd
uuucccucuuuuucag

SEQ ID NO: 2697162 - RNA, 13 nt, Haemophilus influenzae Rd
uuucccuuuucuu

SEQ ID NO: 2697163 - RNA, 15 nt, Haemophilus influenzae Rd
uuucccuuuucuuau

SEQ ID NO: 2697164 - RNA, 18 nt, Haemophilus influenzae Rd
uuuccgacaacacuugcu

SEQ ID NO: 2697165 - RNA, 16 nt, Haemophilus influenzae Rd
uuuccguuuuuucauu

SEQ ID NO: 2697166 - RNA, 18 nt, Haemophilus influenzae Rd
uuuccuacucgagcauaa

SEQ ID NO: 2697167 - RNA, 14 nt, Haemophilus influenzae Rd
uuuccuauucuaaa

SEQ ID NO: 2697168 - RNA, 18 nt, Haemophilus influenzae Rd
uuuccuauuuacguaaaa

SEQ ID NO: 2697169 - RNA, 20 nt, Haemophilus influenzae Rd
uuuccuauuuacguaaaaaa

SEQ ID NO: 2697170 - RNA, 17 nt, Haemophilus influenzae Rd
uuuccucgacauaaaaa

SEQ ID NO: 2697171 - RNA, 19 nt, Haemophilus influenzae Rd
uuuccugccuugcaaaaac

SEQ ID NO: 2697172 - RNA, 13 nt, Haemophilus influenzae Rd
uuuccuuuaauug

SEQ ID NO: 2697173 - RNA, 14 nt, Haemophilus influenzae Rd
uuuccuuuccuuga

SEQ ID NO: 2697174 - RNA, 21 nt, Haemophilus influenzae Rd
uuuccuuuggcuugaaaauau

SEQ ID NO: 2697175 - RNA, 16 nt, Haemophilus influenzae Rd
uuuccuuuuauuuuau

SEQ ID NO: 2697176 - RNA, 14 nt, Haemophilus influenzae Rd
uuucgacuugugca

SEQ ID NO: 2697177 - RNA, 22 nt, Haemophilus influenzae Rd
uuucgauaagauugugcaauaa

SEQ ID NO: 2697178 - RNA, 16 nt, Haemophilus influenzae Rd
uuucgauagaacaaau

SEQ ID NO: 2697179 - RNA, 14 nt, Haemophilus influenzae Rd
uuucgcagccacuu

SEQ ID NO: 2697180 - RNA, 19 nt, Haemophilus influenzae Rd
uuucgcaggaucacaauca

SEQ ID NO: 2697181 - RNA, 22 nt, Haemophilus influenzae Rd
uuucgcaucaaagaauccaccc

SEQ ID NO: 2697182 - RNA, 19 nt, Haemophilus influenzae Rd
uuucgcaucaaucacagca

SEQ ID NO: 2697183 - RNA, 14 nt, Haemophilus influenzae Rd
uuucgccagcacca

SEQ ID NO: 2697184 - RNA, 16 nt, Haemophilus influenzae Rd
uuucgccccauuauuu

SEQ ID NO: 2697185 - RNA, 23 nt, Haemophilus influenzae Rd
uuucgcuuugcuuggaucacgca

SEQ ID NO: 2697186 - RNA, 13 nt, Haemophilus influenzae Rd
uuucgcuuuuguu

SEQ ID NO: 2697187 - RNA, 15 nt, Haemophilus influenzae Rd
uuucgggcaaacgcu

SEQ ID NO: 2697188 - RNA, 15 nt, Haemophilus influenzae Rd
uuucguauuucguau

SEQ ID NO: 2697189 - RNA, 18 nt, Haemophilus influenzae Rd
uuucgugaggucugcaau

SEQ ID NO: 2697190 - RNA, 14 nt, Haemophilus influenzae Rd
uuucguguuuaguu

SEQ ID NO: 2697191 - RNA, 17 nt, Haemophilus influenzae Rd
uuucguucccaaggugg

SEQ ID NO: 2697192 - RNA, 22 nt, Haemophilus influenzae Rd
uuucguuugacagcaauauaua

SEQ ID NO: 2697193 - RNA, 20 nt, Haemophilus influenzae Rd
uuucuaaaaucacuuuuaau

SEQ ID NO: 2697194 - RNA, 13 nt, Haemophilus influenzae Rd
uuucuaaauuuua

SEQ ID NO: 2697195 - RNA, 21 nt, Haemophilus influenzae Rd
uuucuaacaaaugauuagaag

SEQ ID NO: 2697196 - RNA, 13 nt, Haemophilus influenzae Rd
uuucuaacacaac

SEQ ID NO: 2697197 - RNA, 23 nt, Haemophilus influenzae Rd
uuucuaacaucggcaaccaagua

SEQ ID NO: 2697198 - RNA, 15 nt, Haemophilus influenzae Rd
uuucuaacgcaaacu

SEQ ID NO: 2697199 - RNA, 17 nt, Haemophilus influenzae Rd
uuucuaacgcaaacuac

SEQ ID NO: 2697200 - RNA, 19 nt, Haemophilus influenzae Rd
uuucuaacuuuuaauucuu

SEQ ID NO: 2697201 - RNA, 15 nt, Haemophilus influenzae Rd
uuucuaaggcuuguu

SEQ ID NO: 2697202 - RNA, 23 nt, Haemophilus influenzae Rd
uuucuaaggcuuguuguucaaaa

SEQ ID NO: 2697203 - RNA, 18 nt, Haemophilus influenzae Rd
uuucuaagguauccacuu

SEQ ID NO: 2697204 - RNA, 12 nt, Haemophilus influenzae Rd
uuucuaauaaag

SEQ ID NO: 2697205 - RNA, 17 nt, Haemophilus influenzae Rd
uuucuaauaagaagcug

SEQ ID NO: 2697206 - RNA, 14 nt, Haemophilus influenzae Rd
uuucuaauauuucu

SEQ ID NO: 2697207 - RNA, 15 nt, Haemophilus influenzae Rd
uuucuacacuuaaau

SEQ ID NO: 2697208 - RNA, 15 nt, Haemophilus influenzae Rd
uuucuacgacauuuu

SEQ ID NO: 2697209 - RNA, 17 nt, Haemophilus influenzae Rd
uuucuacgacauuuuua

SEQ ID NO: 2697210 - RNA, 20 nt, Haemophilus influenzae Rd
uuucuacgacauuuuuaacu

SEQ ID NO: 2697211 - RNA, 23 nt, Haemophilus influenzae Rd
uuucuacucguagaguuuuuuca

SEQ ID NO: 2697212 - RNA, 20 nt, Haemophilus influenzae Rd
uuucuacuuuugugccagcu

SEQ ID NO: 2697213 - RNA, 23 nt, Haemophilus influenzae Rd
uuucuagaugaugaaauuuuuca

SEQ ID NO: 2697214 - RNA, 18 nt, Haemophilus influenzae Rd
uuucuagcgguaaaccaa

SEQ ID NO: 2697215 - RNA, 18 nt, Haemophilus influenzae Rd
uuucuagcuuaccuuaau

SEQ ID NO: 2697216 - RNA, 15 nt, Haemophilus influenzae Rd
uuucuaguaaaacua

SEQ ID NO: 2697217 - RNA, 14 nt, Haemophilus influenzae Rd
uuucuauuaaaaaa

SEQ ID NO: 2697218 - RNA, 21 nt, Haemophilus influenzae Rd
uuucuauuguuuuuuucuaaa

SEQ ID NO: 2697219 - RNA, 22 nt, Haemophilus influenzae Rd
uuucuauuguuuuuuucuaaau

SEQ ID NO: 2697220 - RNA, 18 nt, Haemophilus influenzae Rd
uuucucaauaaauaucua

SEQ ID NO: 2697221 - RNA, 14 nt, Haemophilus influenzae Rd
uuucucacuucuuu

SEQ ID NO: 2697222 - RNA, 18 nt, Haemophilus influenzae Rd
uuucucaucauuauuuuu

SEQ ID NO: 2697223 - RNA, 20 nt, Haemophilus influenzae Rd
uuucuccguuagcaauaacu

SEQ ID NO: 2697224 - RNA, 17 nt, Haemophilus influenzae Rd
uuucucgaucauuuuua

SEQ ID NO: 2697225 - RNA, 13 nt, Haemophilus influenzae Rd
uuugcgauuuuau

SEQ ID NO: 2697226 - RNA, 17 nt, Haemophilus influenzae Rd
uuugcgcauuaucuucg

SEQ ID NO: 2697227 - RNA, 15 nt, Haemophilus influenzae Rd
uuugcgccaacgcau

SEQ ID NO: 2697228 - RNA, 20 nt, Haemophilus influenzae Rd
uuugcgccacaauauuuaau

SEQ ID NO: 2697229 - RNA, 21 nt, Haemophilus influenzae Rd
uuugcgccuucaagccuugcu

SEQ ID NO: 2697230 - RNA, 20 nt, Haemophilus influenzae Rd
uuugcggaaacauaucaaaa

SEQ ID NO: 2697231 - RNA, 21 nt, Haemophilus influenzae Rd
uuugcggagaaaacaaacgau

SEQ ID NO: 2697232 - RNA, 24 nt, Haemophilus influenzae Rd
uuugcuaaacccacuucacaacuu

SEQ ID NO: 2697233 - RNA, 23 nt, Haemophilus influenzae Rd
uuugcuaacucuuuagaaaguuu

SEQ ID NO: 2697234 - RNA, 17 nt, Haemophilus influenzae Rd
uuugcuaauuuauccaa

SEQ ID NO: 2697235 - RNA, 13 nt, Haemophilus influenzae Rd
uuugcuaccacgu

SEQ ID NO: 2697236 - RNA, 15 nt, Haemophilus influenzae Rd
uuugcucgcucgcca

SEQ ID NO: 2697237 - RNA, 18 nt, Haemophilus influenzae Rd
uuugcucuuuaacaauau

SEQ ID NO: 2697238 - RNA, 20 nt, Haemophilus influenzae Rd
uuugcuggucacuugugauu

SEQ ID NO: 2697239 - RNA, 22 nt, Haemophilus influenzae Rd
uuugcuuaaaagcuuccauaau

SEQ ID NO: 2697240 - RNA, 17 nt, Haemophilus influenzae Rd
uuugcuuggaauaaauu

SEQ ID NO: 2697241 - RNA, 19 nt, Haemophilus influenzae Rd
uuugcuuggaauaaauuaa

SEQ ID NO: 2697242 - RNA, 13 nt, Haemophilus influenzae Rd
uuugcuuuaccaa

SEQ ID NO: 2697243 - RNA, 20 nt, Haemophilus influenzae Rd
uuugcuuuuuguuacaucuu

SEQ ID NO: 2697244 - RNA, 19 nt, Haemophilus influenzae Rd
uuugcuuuuuuaauuuggg

SEQ ID NO: 2697245 - RNA, 18 nt, Haemophilus influenzae Rd
uuuggaaacuaugcagaa

SEQ ID NO: 2697246 - RNA, 13 nt, Haemophilus influenzae Rd
uuuggaauaaacu

SEQ ID NO: 2697247 - RNA, 16 nt, Haemophilus influenzae Rd
uuuggaauauucuuuu

SEQ ID NO: 2697248 - RNA, 21 nt, Haemophilus influenzae Rd
uuuggaauauucuuuuuaaau

SEQ ID NO: 2697249 - RNA, 23 nt, Haemophilus influenzae Rd
uuuggaaugaagugaaagauaaa

SEQ ID NO: 2697250 - RNA, 18 nt, Haemophilus influenzae Rd
uuuggacuuuauuugauu

SEQ ID NO: 2697251 - RNA, 21 nt, Haemophilus influenzae Rd
uuuggacuuuauuugauuguu

SEQ ID NO: 2697252 - RNA, 18 nt, Haemophilus influenzae Rd
uuuggaguuguuuaaaau

SEQ ID NO: 2697253 - RNA, 15 nt, Haemophilus influenzae Rd
uuuggauaguuuauu

SEQ ID NO: 2697254 - RNA, 20 nt, Haemophilus influenzae Rd
uuuggaucauuagcaacuuc

SEQ ID NO: 2697255 - RNA, 22 nt, Haemophilus influenzae Rd
uuuggaugaaacgagauuuauu

SEQ ID NO: 2697256 - RNA, 19 nt, Haemophilus influenzae Rd
uuuggauugguguuuaaau

SEQ ID NO: 2697257 - RNA, 24 nt, Haemophilus influenzae Rd
uuuggcucuucuuuaauuucuuca

SEQ ID NO: 2697258 - RNA, 15 nt, Haemophilus influenzae Rd
uuugggaaugccauu

SEQ ID NO: 2697259 - RNA, 12 nt, Haemophilus influenzae Rd
uuuggguuaaau

SEQ ID NO: 2697260 - RNA, 16 nt, Haemophilus influenzae Rd
uuuggguuaaauaaug

SEQ ID NO: 2697261 - RNA, 23 nt, Haemophilus influenzae Rd
uuugguaagcaauagauucuaag

SEQ ID NO: 2697262 - RNA, 22 nt, Haemophilus influenzae Rd
uuugguauaucuguaauuggua

SEQ ID NO: 2697263 - RNA, 12 nt, Haemophilus influenzae Rd
uuugguauuuuu

SEQ ID NO: 2697264 - RNA, 13 nt, Haemophilus influenzae Rd
uuuggucuaacau

SEQ ID NO: 2697265 - RNA, 20 nt, Haemophilus influenzae Rd
uuuggucuaacauuucauaa

SEQ ID NO: 2697266 - RNA, 22 nt, Haemophilus influenzae Rd
uuuggugcauguuuacuuaaau

SEQ ID NO: 2697267 - RNA, 16 nt, Haemophilus influenzae Rd
uuugguucgauaaaca

SEQ ID NO: 2697268 - RNA, 22 nt, Haemophilus influenzae Rd
uuugguucgauaaacauuuuuu

SEQ ID NO: 2697269 - RNA, 16 nt, Haemophilus influenzae Rd
uuuguaaacgccauca

SEQ ID NO: 2697270 - RNA, 21 nt, Haemophilus influenzae Rd
uuuguaaacgccaucaaccau

SEQ ID NO: 2697271 - RNA, 18 nt, Haemophilus influenzae Rd
uuuguaagcauuaaaaau

SEQ ID NO: 2697272 - RNA, 16 nt, Haemophilus influenzae Rd
uuuguaauaaauuuua

SEQ ID NO: 2697273 - RNA, 18 nt, Haemophilus influenzae Rd
uuuguaauugcucuaauu

SEQ ID NO: 2697274 - RNA, 19 nt, Haemophilus influenzae Rd
uuuguaccauugugccaaa

SEQ ID NO: 2697275 - RNA, 14 nt, Haemophilus influenzae Rd
uuuguagccauuuu

SEQ ID NO: 2697276 - RNA, 15 nt, Haemophilus influenzae Rd
uuuguaucuaaauau

SEQ ID NO: 2697277 - RNA, 23 nt, Haemophilus influenzae Rd
uuuguaucuaaauauauuuuuau

SEQ ID NO: 2697278 - RNA, 18 nt, Haemophilus influenzae Rd
uuugucagauuuauaaau

SEQ ID NO: 2697279 - RNA, 19 nt, Haemophilus influenzae Rd
uuugucagugguuucuguu

SEQ ID NO: 2697280 - RNA, 13 nt, Haemophilus influenzae Rd
uuuguccaaaaau

SEQ ID NO: 2697281 - RNA, 17 nt, Haemophilus influenzae Rd
uuuguccgaaaaaacua

SEQ ID NO: 2697282 - RNA, 13 nt, Haemophilus influenzae Rd
uuuguccuuuauc

SEQ ID NO: 2697283 - RNA, 21 nt, Haemophilus influenzae Rd
uuugucgcaggugucacagca

SEQ ID NO: 2697284 - RNA, 15 nt, Haemophilus influenzae Rd
uuugucggaaaauaa

SEQ ID NO: 2697285 - RNA, 15 nt, Haemophilus influenzae Rd
uuugucguaaugaaa

SEQ ID NO: 2697286 - RNA, 14 nt, Haemophilus influenzae Rd
uuugucugaaauuu

SEQ ID NO: 2697287 - RNA, 14 nt, Haemophilus influenzae Rd
uuugugacuucgcu

SEQ ID NO: 2697288 - RNA, 17 nt, Haemophilus influenzae Rd
uuugugagugauuucau

SEQ ID NO: 2697289 - RNA, 17 nt, Haemophilus influenzae Rd
uuugugauugacauuuu

SEQ ID NO: 2697290 - RNA, 13 nt, Haemophilus influenzae Rd
uuugugauuucaa

SEQ ID NO: 2697291 - RNA, 14 nt, Haemophilus influenzae Rd
uuugugauuucaau

SEQ ID NO: 2697292 - RNA, 15 nt, Haemophilus influenzae Rd
uuugugauuucaauu

SEQ ID NO: 2697293 - RNA, 19 nt, Haemophilus influenzae Rd
uuugugcaagcacauuaau

SEQ ID NO: 2697294 - RNA, 21 nt, Haemophilus influenzae Rd
uuugugcaagcacauuaauca

SEQ ID NO: 2697295 - RNA, 15 nt, Haemophilus influenzae Rd
uuugugccauuucua

SEQ ID NO: 2697296 - RNA, 14 nt, Haemophilus influenzae Rd
uuugugcguuuuuu

SEQ ID NO: 2697297 - RNA, 13 nt, Haemophilus influenzae Rd
uuuguggaauacc

SEQ ID NO: 2697298 - RNA, 20 nt, Haemophilus influenzae Rd
uuuguggcaaucguucuaaa

SEQ ID NO: 2697299 - RNA, 21 nt, Haemophilus influenzae Rd
uuuguggcacgcccaaaggcu

SEQ ID NO: 2697300 - RNA, 20 nt, Haemophilus influenzae Rd
uuuguggcuuuucagcuaaa

SEQ ID NO: 2697301 - RNA, 23 nt, Haemophilus influenzae Rd
uuuguguaacagcucuguaaaac

SEQ ID NO: 2697302 - RNA, 23 nt, Haemophilus influenzae Rd
uuuguuaaaugaaaagcaccuuu

SEQ ID NO: 2697303 - RNA, 20 nt, Haemophilus influenzae Rd
uuuguuaagcucacuugcau

SEQ ID NO: 2697304 - RNA, 15 nt, Haemophilus influenzae Rd
uuuguuacuaaaaua

SEQ ID NO: 2697305 - RNA, 16 nt, Haemophilus influenzae Rd
uuuguuagaucaaauu

SEQ ID NO: 2697306 - RNA, 15 nt, Haemophilus influenzae Rd
uuuguuauuaaauaa

SEQ ID NO: 2697307 - RNA, 18 nt, Haemophilus influenzae Rd
uuuguucacaucaaaauu

SEQ ID NO: 2697308 - RNA, 12 nt, Haemophilus influenzae Rd
uuuguucauuuu

SEQ ID NO: 2697309 - RNA, 15 nt, Haemophilus influenzae Rd
uuuguuccaauucug

SEQ ID NO: 2697310 - RNA, 22 nt, Haemophilus influenzae Rd
uuuguugagcugcuuguaacca

SEQ ID NO: 2697311 - RNA, 16 nt, Haemophilus influenzae Rd
uuuguugauaaacaua

SEQ ID NO: 2697312 - RNA, 20 nt, Haemophilus influenzae Rd
uuuguugauaaacauaaccu

SEQ ID NO: 2697313 - RNA, 17 nt, Haemophilus influenzae Rd
uuuguugguaaaucuaa

SEQ ID NO: 2697314 - RNA, 18 nt, Haemophilus influenzae Rd
uuuguugguugaguucuu

SEQ ID NO: 2697315 - RNA, 12 nt, Haemophilus influenzae Rd
uuuguuuaaaag

SEQ ID NO: 2697316 - RNA, 21 nt, Haemophilus influenzae Rd
uuuguuuaauuggaaauaaua

SEQ ID NO: 2697317 - RNA, 12 nt, Haemophilus influenzae Rd
uuuguuucuaaa

SEQ ID NO: 2697318 - RNA, 13 nt, Haemophilus influenzae Rd
uuuguuucuaauu

SEQ ID NO: 2697319 - RNA, 19 nt, Haemophilus influenzae Rd
uuuguuuuauagccuucug

SEQ ID NO: 2697320 - RNA, 13 nt, Haemophilus influenzae Rd
uuuguuuucagga

SEQ ID NO: 2697321 - RNA, 21 nt, Haemophilus influenzae Rd
uuuuaaaaaauaaauuuaaau

SEQ ID NO: 2697322 - RNA, 21 nt, Haemophilus influenzae Rd
uuuuaaaacacgaaaaaaacc

SEQ ID NO: 2697323 - RNA, 14 nt, Haemophilus influenzae Rd
uuuuaaaacuauuu

SEQ ID NO: 2697324 - RNA, 17 nt, Haemophilus influenzae Rd
uuuuaaaacuauuuuua

SEQ ID NO: 2697325 - RNA, 20 nt, Haemophilus influenzae Rd
uuuuaaaacuauuuuuaauu

SEQ ID NO: 2697326 - RNA, 20 nt, Haemophilus influenzae Rd
uuuuaaaagaccacauucua

SEQ ID NO: 2697327 - RNA, 19 nt, Haemophilus influenzae Rd
uuuuaaaauaaauuuuaaa

SEQ ID NO: 2697328 - RNA, 21 nt, Haemophilus influenzae Rd
uuuuaaaauacugcacaauca

SEQ ID NO: 2697329 - RNA, 13 nt, Haemophilus influenzae Rd
uuuuaaaauauca

SEQ ID NO: 2697330 - RNA, 15 nt, Haemophilus influenzae Rd
uuuuauccaucaaac

SEQ ID NO: 2697331 - RNA, 20 nt, Haemophilus influenzae Rd
uuuuauccaugaugaaauaa

SEQ ID NO: 2697332 - RNA, 24 nt, Haemophilus influenzae Rd
uuuuauccaugaugaaauaauuca

SEQ ID NO: 2697333 - RNA, 23 nt, Haemophilus influenzae Rd
uuuuauccgaguuaaacgcuguu

SEQ ID NO: 2697334 - RNA, 15 nt, Haemophilus influenzae Rd
uuuuauccuauuaau

SEQ ID NO: 2697335 - RNA, 20 nt, Haemophilus influenzae Rd
uuuuaucgacaaauuaauaa

SEQ ID NO: 2697336 - RNA, 21 nt, Haemophilus influenzae Rd
uuuuaucgagaaaauuaaaaa

SEQ ID NO: 2697337 - RNA, 18 nt, Haemophilus influenzae Rd
uuuuaucuauaaaaagaa

SEQ ID NO: 2697338 - RNA, 19 nt, Haemophilus influenzae Rd
uuuuaucuauaaaaagaac

SEQ ID NO: 2697339 - RNA, 20 nt, Haemophilus influenzae Rd
uuuuaucuauaaaaagaacu

SEQ ID NO: 2697340 - RNA, 16 nt, Haemophilus influenzae Rd
uuuuaucuuuuacauc

SEQ ID NO: 2697341 - RNA, 20 nt, Haemophilus influenzae Rd
uuuuaugaccaaauaccaca

SEQ ID NO: 2697342 - RNA, 17 nt, Haemophilus influenzae Rd
uuuuauguguuuuuaau

SEQ ID NO: 2697343 - RNA, 23 nt, Haemophilus influenzae Rd
uuuuauguuucucucuauucauc

SEQ ID NO: 2697344 - RNA, 13 nt, Haemophilus influenzae Rd
uuuuauuaacaaa

SEQ ID NO: 2697345 - RNA, 14 nt, Haemophilus influenzae Rd
uuuuauuaucaaaa

SEQ ID NO: 2697346 - RNA, 15 nt, Haemophilus influenzae Rd
uuuuauuccaccaca

SEQ ID NO: 2697347 - RNA, 22 nt, Haemophilus influenzae Rd
uuuuauugaaauuuuaauuuag

SEQ ID NO: 2697348 - RNA, 15 nt, Haemophilus influenzae Rd
uuuuauuuaauauaa

SEQ ID NO: 2697349 - RNA, 12 nt, Haemophilus influenzae Rd
uuuuauuuaauu

SEQ ID NO: 2697350 - RNA, 15 nt, Haemophilus influenzae Rd
uuuuauuuaucagcc

SEQ ID NO: 2697351 - RNA, 11 nt, Haemophilus influenzae Rd
uuuuauuuauu

SEQ ID NO: 2697352 - RNA, 12 nt, Haemophilus influenzae Rd
uuuuauuucuaa

SEQ ID NO: 2697353 - RNA, 21 nt, Haemophilus influenzae Rd
uuuuauuucuaaucauuuguu

SEQ ID NO: 2697354 - RNA, 14 nt, Haemophilus influenzae Rd
uuuuauuucucauu

SEQ ID NO: 2697355 - RNA, 13 nt, Haemophilus influenzae Rd
uuuuauuuguucu

SEQ ID NO: 2697356 - RNA, 15 nt, Haemophilus influenzae Rd
uuuuauuuuacuaau

SEQ ID NO: 2697357 - RNA, 16 nt, Haemophilus influenzae Rd
uuuuauuuuccaucau

SEQ ID NO: 2697358 - RNA, 12 nt, Haemophilus influenzae Rd
uuuuauuuucuu

SEQ ID NO: 2697359 - RNA, 16 nt, Haemophilus influenzae Rd
uuuuauuuuuacuauu

SEQ ID NO: 2697360 - RNA, 13 nt, Haemophilus influenzae Rd
uuuuauuuuugau

SEQ ID NO: 2697361 - RNA, 12 nt, Haemophilus influenzae Rd
uuuucaaaaaau

SEQ ID NO: 2697362 - RNA, 15 nt, Haemophilus influenzae Rd
uuuucaaaacguucu

SEQ ID NO: 2697363 - RNA, 13 nt, Haemophilus influenzae Rd
uuuucaaaauuuu

SEQ ID NO: 2697364 - RNA, 14 nt, Haemophilus influenzae Rd
uuuucaaaauuuug

SEQ ID NO: 2697365 - RNA, 18 nt, Haemophilus influenzae Rd
uuuucaaacacaaaauaa

SEQ ID NO: 2697366 - RNA, 15 nt, Haemophilus influenzae Rd
uuuucaaauaaguuu

SEQ ID NO: 2697367 - RNA, 19 nt, Haemophilus influenzae Rd
uuuucaaauuaaccgcacu

SEQ ID NO: 2697368 - RNA, 18 nt, Haemophilus influenzae Rd
uuuucaaauugaaaagaa

SEQ ID NO: 2697369 - RNA, 22 nt, Haemophilus influenzae Rd
uuuucaaguaacuuucacaacu

SEQ ID NO: 2697370 - RNA, 17 nt, Haemophilus influenzae Rd
uuuucaaguuacuuaau

SEQ ID NO: 2697371 - RNA, 11 nt, Haemophilus influenzae Rd
uuuucaauauc

SEQ ID NO: 2697372 - RNA, 12 nt, Haemophilus influenzae Rd
uuuucaauauca

SEQ ID NO: 2697373 - RNA, 14 nt, Haemophilus influenzae Rd
uuuucaaugaaaua

SEQ ID NO: 2697374 - RNA, 23 nt, Haemophilus influenzae Rd
uuuucaaugcuuuuugcguugcu

SEQ ID NO: 2697375 - RNA, 12 nt, Haemophilus influenzae Rd
uuuucaauuuga

SEQ ID NO: 2697376 - RNA, 15 nt, Haemophilus influenzae Rd
uuuucacaccgucua

SEQ ID NO: 2697377 - RNA, 21 nt, Haemophilus influenzae Rd
uuuucacauaauaaacauaca

SEQ ID NO: 2697378 - RNA, 19 nt, Haemophilus influenzae Rd
uuuucaccaacaaauucua

SEQ ID NO: 2697379 - RNA, 21 nt, Haemophilus influenzae Rd
uuuucaccaacaaauucuaau

SEQ ID NO: 2697380 - RNA, 13 nt, Haemophilus influenzae Rd
uuuucaccgcacu

SEQ ID NO: 2697381 - RNA, 18 nt, Haemophilus influenzae Rd
uuuucaccgcacuuucuu

SEQ ID NO: 2697382 - RNA, 18 nt, Haemophilus influenzae Rd
uuuucacgccuuugucuu

SEQ ID NO: 2697383 - RNA, 12 nt, Haemophilus influenzae Rd
uuuucagcacug

SEQ ID NO: 2697384 - RNA, 15 nt, Haemophilus influenzae Rd
uuuucagcuaaaauu

SEQ ID NO: 2697385 - RNA, 16 nt, Haemophilus influenzae Rd
uuuucagguacaacau

SEQ ID NO: 2697386 - RNA, 19 nt, Haemophilus influenzae Rd
uuuucagguacaacauuuu

SEQ ID NO: 2697387 - RNA, 14 nt, Haemophilus influenzae Rd
uuuucaggugcuau

SEQ ID NO: 2697388 - RNA, 20 nt, Haemophilus influenzae Rd
uuuucauagaagaguuuuaa

SEQ ID NO: 2697389 - RNA, 17 nt, Haemophilus influenzae Rd
uuuucaucaaugcaaca

SEQ ID NO: 2697390 - RNA, 22 nt, Haemophilus influenzae Rd
uuuucaucaaugccauuuuuua

SEQ ID NO: 2697391 - RNA, 13 nt, Haemophilus influenzae Rd
uuuucaucaauuu

SEQ ID NO: 2697392 - RNA, 23 nt, Haemophilus influenzae Rd
uuuucaucauaauuuauucaaaa

SEQ ID NO: 2697393 - RNA, 18 nt, Haemophilus influenzae Rd
uuuucaucuuuuuauaaa

SEQ ID NO: 2697394 - RNA, 19 nt, Haemophilus influenzae Rd
uuuucaucuuuuuauaaaa

SEQ ID NO: 2697395 - RNA, 20 nt, Haemophilus influenzae Rd
uuuucaugcauuaaaaaaca

SEQ ID NO: 2697396 - RNA, 18 nt, Haemophilus influenzae Rd
uuuucauguacaagugaa

SEQ ID NO: 2697397 - RNA, 15 nt, Haemophilus influenzae Rd
uuuucauuaucuuua

SEQ ID NO: 2697398 - RNA, 12 nt, Haemophilus influenzae Rd
uuuuccaaaauu

SEQ ID NO: 2697399 - RNA, 23 nt, Haemophilus influenzae Rd
uuuuccaauaaagagaaagugca

SEQ ID NO: 2697400 - RNA, 13 nt, Haemophilus influenzae Rd
uuuuccaauucuu

SEQ ID NO: 2697401 - RNA, 13 nt, Haemophilus influenzae Rd
uuuuccacauuuu

SEQ ID NO: 2697402 - RNA, 16 nt, Haemophilus influenzae Rd
uuuuccacauuuugau

SEQ ID NO: 2697403 - RNA, 20 nt, Haemophilus influenzae Rd
uuuuccagcaaaaaaauuuc

SEQ ID NO: 2697404 - RNA, 17 nt, Haemophilus influenzae Rd
uuuuccauaauaacgag

SEQ ID NO: 2697405 - RNA, 16 nt, Haemophilus influenzae Rd
uuuuccaucaccuuca

SEQ ID NO: 2697406 - RNA, 13 nt, Haemophilus influenzae Rd
uuuuccauuuuug

SEQ ID NO: 2697407 - RNA, 14 nt, Haemophilus influenzae Rd
uuuuccauuuuuuu

SEQ ID NO: 2697408 - RNA, 18 nt, Haemophilus influenzae Rd
uuuucccaaugcaccaaa

SEQ ID NO: 2697409 - RNA, 23 nt, Haemophilus influenzae Rd
uuuucccaaugcaccaaaaaucc

SEQ ID NO: 2697410 - RNA, 15 nt, Haemophilus influenzae Rd
uuuuccgaaaaaaca

SEQ ID NO: 2697411 - RNA, 16 nt, Haemophilus influenzae Rd
uuuuccgcguaaaguu

SEQ ID NO: 2697412 - RNA, 15 nt, Haemophilus influenzae Rd
uuuuccuaaaguuuu

SEQ ID NO: 2697413 - RNA, 20 nt, Haemophilus influenzae Rd
uuuuccugccuugcaaaaac

SEQ ID NO: 2697414 - RNA, 14 nt, Haemophilus influenzae Rd
uuuuccuguuaauu

SEQ ID NO: 2697415 - RNA, 16 nt, Haemophilus influenzae Rd
uuuuccuuaaucugaa

SEQ ID NO: 2697416 - RNA, 18 nt, Haemophilus influenzae Rd
uuuuccuucuauaucaga

SEQ ID NO: 2697417 - RNA, 15 nt, Haemophilus influenzae Rd
uuuuccuucugccau

SEQ ID NO: 2697418 - RNA, 22 nt, Haemophilus influenzae Rd
uuuuccuuuuucuaacaucucu

SEQ ID NO: 2697419 - RNA, 23 nt, Haemophilus influenzae Rd
uuuucgacauucgcauauuuuug

SEQ ID NO: 2697420 - RNA, 18 nt, Haemophilus influenzae Rd
uuuucgaccaagucagcu

SEQ ID NO: 2697421 - RNA, 14 nt, Haemophilus influenzae Rd
uuuucgcaaaaucu

SEQ ID NO: 2697422 - RNA, 22 nt, Haemophilus influenzae Rd
uuuucgcaagauagcaaaauau

SEQ ID NO: 2697423 - RNA, 17 nt, Haemophilus influenzae Rd
uuuucgcaauaucauca

SEQ ID NO: 2697424 - RNA, 23 nt, Haemophilus influenzae Rd
uuuucgcaauaucaucaucagac

SEQ ID NO: 2697425 - RNA, 18 nt, Haemophilus influenzae Rd
uuuucgcauuuuaacuca

SEQ ID NO: 2697426 - RNA, 23 nt, Haemophilus influenzae Rd
uuuucggcaagaaauucacucaa

SEQ ID NO: 2697427 - RNA, 23 nt, Haemophilus influenzae Rd
uuuucgugaggucugcaauaaua

SEQ ID NO: 2697428 - RNA, 14 nt, Haemophilus influenzae Rd
uuuucuaaaaaacg

SEQ ID NO: 2697429 - RNA, 13 nt, Haemophilus influenzae Rd
uuuucuaaaauca

SEQ ID NO: 2697430 - RNA, 16 nt, Haemophilus influenzae Rd
uuuucuaacaucucuu

SEQ ID NO: 2697431 - RNA, 22 nt, Haemophilus influenzae Rd
uuuucuaauaauucauuauuug

SEQ ID NO: 2697432 - RNA, 18 nt, Haemophilus influenzae Rd
uuuucuaaugaaauuucu

SEQ ID NO: 2697433 - RNA, 23 nt, Haemophilus influenzae Rd
uuuucuaaugguuguaaauuuuc

SEQ ID NO: 2697434 - RNA, 13 nt, Haemophilus influenzae Rd
uuuucuacagaaa

SEQ ID NO: 2697435 - RNA, 13 nt, Haemophilus influenzae Rd
uuuucuacauaau

SEQ ID NO: 2697436 - RNA, 13 nt, Haemophilus influenzae Rd
uuuuuauaaaaaa

SEQ ID NO: 2697437 - RNA, 13 nt, Haemophilus influenzae Rd
uuuuuauaaagua

SEQ ID NO: 2697438 - RNA, 21 nt, Haemophilus influenzae Rd
uuuuuauaaauuaccuuguuu

SEQ ID NO: 2697439 - RNA, 17 nt, Haemophilus influenzae Rd
uuuuuauagccuuguuc

SEQ ID NO: 2697440 - RNA, 17 nt, Haemophilus influenzae Rd
uuuuuauauaaauaacu

SEQ ID NO: 2697441 - RNA, 16 nt, Haemophilus influenzae Rd
uuuuuauaucuucucu

SEQ ID NO: 2697442 - RNA, 12 nt, Haemophilus influenzae Rd
uuuuuauauuuu

SEQ ID NO: 2697443 - RNA, 17 nt, Haemophilus influenzae Rd
uuuuuauauuuuuuacu

SEQ ID NO: 2697444 - RNA, 12 nt, Haemophilus influenzae Rd
uuuuuaucaaau

SEQ ID NO: 2697445 - RNA, 15 nt, Haemophilus influenzae Rd
uuuuuaucaauaacu

SEQ ID NO: 2697446 - RNA, 20 nt, Haemophilus influenzae Rd
uuuuuaugaccaaauacaau

SEQ ID NO: 2697447 - RNA, 12 nt, Haemophilus influenzae Rd
uuuuuauuaaaa

SEQ ID NO: 2697448 - RNA, 22 nt, Haemophilus influenzae Rd
uuuuuauuaauuauaaaauagc

SEQ ID NO: 2697449 - RNA, 12 nt, Haemophilus influenzae Rd
uuuuuauucaaa

SEQ ID NO: 2697450 - RNA, 13 nt, Haemophilus influenzae Rd
uuuuuauucaaua

SEQ ID NO: 2697451 - RNA, 22 nt, Haemophilus influenzae Rd
uuuuuauuuagaacaauacucu

SEQ ID NO: 2697452 - RNA, 12 nt, Haemophilus influenzae Rd
uuuuuauuucua

SEQ ID NO: 2697453 - RNA, 14 nt, Haemophilus influenzae Rd
uuuuuauuuuuccu

SEQ ID NO: 2697454 - RNA, 14 nt, Haemophilus influenzae Rd
uuuuucaaaaauuu

SEQ ID NO: 2697455 - RNA, 23 nt, Haemophilus influenzae Rd
uuuuucaaacugaucauaaucca

SEQ ID NO: 2697456 - RNA, 16 nt, Haemophilus influenzae Rd
uuuuucaaggccauau

SEQ ID NO: 2697457 - RNA, 15 nt, Haemophilus influenzae Rd
uuuuucacaagcaua

SEQ ID NO: 2697458 - RNA, 18 nt, Haemophilus influenzae Rd
uuuuucaccgcacuuaau

SEQ ID NO: 2697459 - RNA, 15 nt, Haemophilus influenzae Rd
uuuuucagauaauca

SEQ ID NO: 2697460 - RNA, 17 nt, Haemophilus influenzae Rd
uuuuucagauaaucaaa

SEQ ID NO: 2697461 - RNA, 17 nt, Haemophilus influenzae Rd
uuuuucagcaagcauuu

SEQ ID NO: 2697462 - RNA, 19 nt, Haemophilus influenzae Rd
uuuuucagucuauuauaaa

SEQ ID NO: 2697463 - RNA, 12 nt, Haemophilus influenzae Rd
uuuuucauaaau

SEQ ID NO: 2697464 - RNA, 18 nt, Haemophilus influenzae Rd
uuuuucauacaaucucua

SEQ ID NO: 2697465 - RNA, 13 nt, Haemophilus influenzae Rd
uuuuucaucaaug

SEQ ID NO: 2697466 - RNA, 22 nt, Haemophilus influenzae Rd
uuuuucauugcaucagguacgu

SEQ ID NO: 2697467 - RNA, 11 nt, Haemophilus influenzae Rd
uuuuucauuuu

SEQ ID NO: 2697468 - RNA, 14 nt, Haemophilus influenzae Rd
uuuuuccaauucuu

SEQ ID NO: 2697469 - RNA, 21 nt, Haemophilus influenzae Rd
uuuuuccagcaaaaaaauuuc

SEQ ID NO: 2697470 - RNA, 21 nt, Haemophilus influenzae Rd
uuuuuccccacuuaucuuaaa

SEQ ID NO: 2697471 - RNA, 20 nt, Haemophilus influenzae Rd
uuuuuccguuuucuacugaa

SEQ ID NO: 2697472 - RNA, 18 nt, Haemophilus influenzae Rd
uuuuuccugaucauaagu

SEQ ID NO: 2697473 - RNA, 15 nt, Haemophilus influenzae Rd
uuuuucgaucuaauc

SEQ ID NO: 2697474 - RNA, 18 nt, Haemophilus influenzae Rd
uuuuucgcaaaaucuugc

SEQ ID NO: 2697475 - RNA, 17 nt, Haemophilus influenzae Rd
uuuuucgccuaauucaa

SEQ ID NO: 2697476 - RNA, 18 nt, Haemophilus influenzae Rd
uuuuucgcugcagcugcu

SEQ ID NO: 2697477 - RNA, 14 nt, Haemophilus influenzae Rd
uuuuucuauuuaaa

SEQ ID NO: 2697478 - RNA, 23 nt, Haemophilus influenzae Rd
uuuuucuccacaaaccaagagcc

SEQ ID NO: 2697479 - RNA, 19 nt, Haemophilus influenzae Rd
uuuuucuucaaugccuuuu

SEQ ID NO: 2697480 - RNA, 12 nt, Haemophilus influenzae Rd
uuuuucuuuucu

SEQ ID NO: 2697481 - RNA, 14 nt, Haemophilus influenzae Rd
uuuuucuuuuuccu

SEQ ID NO: 2697482 - RNA, 19 nt, Haemophilus influenzae Rd
uuuuugaaacguccacaag

SEQ ID NO: 2697483 - RNA, 13 nt, Haemophilus influenzae Rd
uuuuugaauaaau

SEQ ID NO: 2697484 - RNA, 23 nt, Haemophilus influenzae Rd
uuuuugaauagcucgaugagaaa

SEQ ID NO: 2697485 - RNA, 19 nt, Haemophilus influenzae Rd
uuuuugacccgcuuuuaau

SEQ ID NO: 2697486 - RNA, 14 nt, Haemophilus influenzae Rd
uuuuugaccuuuuc

SEQ ID NO: 2697487 - RNA, 17 nt, Haemophilus influenzae Rd
uuuuugcaagauuuuuu

SEQ ID NO: 2697488 - RNA, 14 nt, Haemophilus influenzae Rd
uuuuugcaauggcu

SEQ ID NO: 2697489 - RNA, 21 nt, Haemophilus influenzae Rd
uuuuugcaauuuaacauaauu

SEQ ID NO: 2697490 - RNA, 13 nt, Haemophilus influenzae Rd
uuuuugcauagcc

SEQ ID NO: 2697491 - RNA, 15 nt, Haemophilus influenzae Rd
uuuuugccuuuuaau

SEQ ID NO: 2697492 - RNA, 23 nt, Haemophilus influenzae Rd
uuuuugcucaaaaucaaguuaaa

SEQ ID NO: 2697493 - RNA, 20 nt, Haemophilus influenzae Rd
uuuuuggacuuuauuugauu

SEQ ID NO: 2697494 - RNA, 21 nt, Haemophilus influenzae Rd
uuuuuguauaaaaauuauuuu

SEQ ID NO: 2697495 - RNA, 20 nt, Haemophilus influenzae Rd
uuuuugucguucuuuuucca

SEQ ID NO: 2697496 - RNA, 19 nt, Haemophilus influenzae Rd
uuuuugugccaauccauaa

SEQ ID NO: 2697497 - RNA, 13 nt, Haemophilus influenzae Rd
uuuuuguuuaauu

SEQ ID NO: 2697498 - RNA, 12 nt, Haemophilus influenzae Rd
uuuuuguuugag

SEQ ID NO: 2697499 - RNA, 12 nt, Haemophilus influenzae Rd
uuuuuuaaauau

SEQ ID NO: 2697500 - RNA, 13 nt, Haemophilus influenzae Rd
uuuuuuaaucaau

SEQ ID NO: 2697501 - RNA, 17 nt, Haemophilus influenzae Rd
uuuuuuaaucaauuaaa

SEQ ID NO: 2697502 - RNA, 19 nt, Haemophilus influenzae Rd
uuuuuuaaucaauuaaaga

SEQ ID NO: 2697503 - RNA, 14 nt, Haemophilus influenzae Rd
uuuuuuaauuuuuu

SEQ ID NO: 2697504 - RNA, 15 nt, Haemophilus influenzae Rd
uuuuuuagaauuaaa

SEQ ID NO: 2697505 - RNA, 22 nt, Haemophilus influenzae Rd
uuuuuuagauuaucauuaaaua

SEQ ID NO: 2697506 - RNA, 17 nt, Haemophilus influenzae Rd
uuuuuuauaaaccaauu

SEQ ID NO: 2697507 - RNA, 13 nt, Haemophilus influenzae Rd
uuuuuuaucuaau

SEQ ID NO: 2697508 - RNA, 12 nt, Haemophilus influenzae Rd
uuuuuuauuaaa

SEQ ID NO: 2697509 - RNA, 12 nt, Haemophilus influenzae Rd
uuuuuuauuaau

SEQ ID NO: 2697510 - RNA, 12 nt, Haemophilus influenzae Rd
uuuuuuauuuau

SEQ ID NO: 2697511 - RNA, 13 nt, Haemophilus influenzae Rd
uuuuuuauuuguu

SEQ ID NO: 2697512 - RNA, 14 nt, Haemophilus influenzae Rd
uuuuuuauuuguuu

SEQ ID NO: 2697513 - RNA, 12 nt, Haemophilus influenzae Rd
uuuuuucauaau

SEQ ID NO: 2697514 - RNA, 19 nt, Haemophilus influenzae Rd
uuuuuucauauuuuaaaua

SEQ ID NO: 2697515 - RNA, 12 nt, Haemophilus influenzae Rd
uuuuuucugaau

SEQ ID NO: 2697516 - RNA, 18 nt, Haemophilus influenzae Rd
uuuuuucugcauuugauu

SEQ ID NO: 2697517 - RNA, 13 nt, Haemophilus influenzae Rd
uuuuuucuuaaau

SEQ ID NO: 2697518 - RNA, 18 nt, Haemophilus influenzae Rd
uuuuuucuuaaauauauc

SEQ ID NO: 2697519 - RNA, 15 nt, Haemophilus influenzae Rd
uuuuuugaacgaauu

SEQ ID NO: 2697520 - RNA, 14 nt, Haemophilus influenzae Rd
uuuuuugaaucuca

SEQ ID NO: 2697521 - RNA, 12 nt, Haemophilus influenzae Rd
uuuuuugcuuca

SEQ ID NO: 2697522 - RNA, 11 nt, Haemophilus influenzae Rd
uuuuuuuguuu

SEQ ID NO: 2697523 - RNA, 12 nt, Haemophilus influenzae Rd
uuuuuuuuaaag

SEQ ID NO: 2697524 - RNA, 13 nt, Haemophilus influenzae Rd
uuuuuuuuuugcu

SEQ ID NO: 2697525 - RNA, 21 nt, Haemophilus influenzae Rd
aaaaaaacaggguguuuauaa

SEQ ID NO: 2697526 - RNA, 19 nt, Haemophilus influenzae Rd
aaaaaaacccaguuuuaaa

SEQ ID NO: 2697527 - RNA, 12 nt, Haemophilus influenzae Rd
aaaaaaagaaaa

SEQ ID NO: 2697528 - RNA, 14 nt, Haemophilus influenzae Rd
aaaaaaagaaaacc

SEQ ID NO: 2697529 - RNA, 12 nt, Haemophilus influenzae Rd
aaaaaaaugaaa

SEQ ID NO: 2697530 - RNA, 13 nt, Haemophilus influenzae Rd
aaaaaaauguaga

SEQ ID NO: 2697531 - RNA, 13 nt, Haemophilus influenzae Rd
aaaaaacauuaau

SEQ ID NO: 2697532 - RNA, 15 nt, Haemophilus influenzae Rd
aaaaaacauuaauuu

SEQ ID NO: 2697533 - RNA, 14 nt, Haemophilus influenzae Rd
aaaaaaccgacuuu

SEQ ID NO: 2697534 - RNA, 14 nt, Haemophilus influenzae Rd
aaaaaacguuaaau

SEQ ID NO: 2697535 - RNA, 16 nt, Haemophilus influenzae Rd
aaaaaacguuaaauuu

SEQ ID NO: 2697536 - RNA, 12 nt, Haemophilus influenzae Rd
aaaaaacucuuc

SEQ ID NO: 2697537 - RNA, 17 nt, Haemophilus influenzae Rd
aaaaaagaaaaccaaaa

SEQ ID NO: 2697538 - RNA, 20 nt, Haemophilus influenzae Rd
aaaaaagaccgcacuuuaaa

SEQ ID NO: 2697539 - RNA, 21 nt, Haemophilus influenzae Rd
aaaaaagcaaaacugaaagaa

SEQ ID NO: 2697540 - RNA, 13 nt, Haemophilus influenzae Rd
aaaaaaguaacaa

SEQ ID NO: 2697541 - RNA, 20 nt, Haemophilus influenzae Rd
aaaaaagugcgguaaaaauu

SEQ ID NO: 2697542 - RNA, 21 nt, Haemophilus influenzae Rd
aaaaaagugcgguuaaaauuu

SEQ ID NO: 2697543 - RNA, 19 nt, Haemophilus influenzae Rd
aaaaaaguuaaacuaaaua

SEQ ID NO: 2697544 - RNA, 14 nt, Haemophilus influenzae Rd
aaaaaauaauuuag

SEQ ID NO: 2697545 - RNA, 11 nt, Haemophilus influenzae Rd
aaaaaaucaau

SEQ ID NO: 2697546 - RNA, 12 nt, Haemophilus influenzae Rd
aaaaaaucauca

SEQ ID NO: 2697547 - RNA, 13 nt, Haemophilus influenzae Rd
aaaaaaucuccaa

SEQ ID NO: 2697548 - RNA, 16 nt, Haemophilus influenzae Rd
aaaaaaugaaauauuu

SEQ ID NO: 2697549 - RNA, 17 nt, Haemophilus influenzae Rd
aaaaaaugcgcugauuu

SEQ ID NO: 2697550 - RNA, 18 nt, Haemophilus influenzae Rd
aaaaaauggcuuuaauuu

SEQ ID NO: 2697551 - RNA, 16 nt, Haemophilus influenzae Rd
aaaaaauuaaaagauu

SEQ ID NO: 2697552 - RNA, 22 nt, Haemophilus influenzae Rd
aaaaaauuuauaggcuucguuu

SEQ ID NO: 2697553 - RNA, 22 nt, Haemophilus influenzae Rd
aaaaacaagugguggaauaaaa

SEQ ID NO: 2697554 - RNA, 16 nt, Haemophilus influenzae Rd
aaaaaccagauaaaaa

SEQ ID NO: 2697555 - RNA, 17 nt, Haemophilus influenzae Rd
aaaaaccagauaaggca

SEQ ID NO: 2697556 - RNA, 17 nt, Haemophilus influenzae Rd
aaaaaccccgcuaauuu

SEQ ID NO: 2697557 - RNA, 20 nt, Haemophilus influenzae Rd
aaaaaccccgcuaauuugcg

SEQ ID NO: 2697558 - RNA, 15 nt, Haemophilus influenzae Rd
aaaaacccgcuuauu

SEQ ID NO: 2697559 - RNA, 22 nt, Haemophilus influenzae Rd
aaaaacccgcuuuuaacaaaua

SEQ ID NO: 2697560 - RNA, 20 nt, Haemophilus influenzae Rd
aaaaacccguaauuaaaaau

SEQ ID NO: 2697561 - RNA, 17 nt, Haemophilus influenzae Rd
aaaaacccucaagaaac

SEQ ID NO: 2697562 - RNA, 22 nt, Haemophilus influenzae Rd
aaaaacccucaagaaacugacc

SEQ ID NO: 2697563 - RNA, 22 nt, Haemophilus influenzae Rd
aaaaaccgaccgcacuuuuuag

SEQ ID NO: 2697564 - RNA, 23 nt, Haemophilus influenzae Rd
aaaaaccgaccgcacuuuuuagc

SEQ ID NO: 2697565 - RNA, 17 nt, Haemophilus influenzae Rd
aaaaaccgcuuuuaugc

SEQ ID NO: 2697566 - RNA, 13 nt, Haemophilus influenzae Rd
aaaaaccuugugc

SEQ ID NO: 2697567 - RNA, 23 nt, Haemophilus influenzae Rd
aaaaacgccucaucuuuuuuaag

SEQ ID NO: 2697568 - RNA, 19 nt, Haemophilus influenzae Rd
aaaaacgcuggaauauuuu

SEQ ID NO: 2697569 - RNA, 14 nt, Haemophilus influenzae Rd
aaaaacguuaaauu

SEQ ID NO: 2697570 - RNA, 17 nt, Haemophilus influenzae Rd
aaaaacguuaaauuuag

SEQ ID NO: 2697571 - RNA, 14 nt, Haemophilus influenzae Rd
aaaaacuaaauauu

SEQ ID NO: 2697572 - RNA, 17 nt, Haemophilus influenzae Rd
aaaaacuaaccgcacuu

SEQ ID NO: 2697573 - RNA, 14 nt, Haemophilus influenzae Rd
aaaaacuaacgugc

SEQ ID NO: 2697574 - RNA, 20 nt, Haemophilus influenzae Rd
aaaaacugugcggucuguug

SEQ ID NO: 2697575 - RNA, 19 nt, Haemophilus influenzae Rd
aaaaacuuugggaaauugg

SEQ ID NO: 2697576 - RNA, 13 nt, Haemophilus influenzae Rd
aaaaagaaaacca

SEQ ID NO: 2697577 - RNA, 16 nt, Haemophilus influenzae Rd
aaaaagaaauaaaaga

SEQ ID NO: 2697578 - RNA, 14 nt, Haemophilus influenzae Rd
aaaaagaacgguca

SEQ ID NO: 2697579 - RNA, 21 nt, Haemophilus influenzae Rd
aaaaagaacggucaaaaugca

SEQ ID NO: 2697580 - RNA, 13 nt, Haemophilus influenzae Rd
aaaaagacaaaac

SEQ ID NO: 2697581 - RNA, 17 nt, Haemophilus influenzae Rd
aaaaagauaacuuagaa

SEQ ID NO: 2697582 - RNA, 15 nt, Haemophilus influenzae Rd
aaaaagcaaaaccau

SEQ ID NO: 2697583 - RNA, 13 nt, Haemophilus influenzae Rd
aaaaagccacuuu

SEQ ID NO: 2697584 - RNA, 16 nt, Haemophilus influenzae Rd
aaaaagcccaaaugca

SEQ ID NO: 2697585 - RNA, 22 nt, Haemophilus influenzae Rd
aaaaagcccaaaugcaacaaua

SEQ ID NO: 2697586 - RNA, 17 nt, Haemophilus influenzae Rd
aaaaagcccaaguaaua

SEQ ID NO: 2697587 - RNA, 20 nt, Haemophilus influenzae Rd
aaaaagcccaaguaauacac

SEQ ID NO: 2697588 - RNA, 18 nt, Haemophilus influenzae Rd
aaaaagcguugaaaauaa

SEQ ID NO: 2697589 - RNA, 13 nt, Haemophilus influenzae Rd
aaaaagcuaaaaa

SEQ ID NO: 2697590 - RNA, 16 nt, Haemophilus influenzae Rd
aaaaagcuaaaaaaac

SEQ ID NO: 2697591 - RNA, 17 nt, Haemophilus influenzae Rd
aaaaagcuaaaaaaaca

SEQ ID NO: 2697592 - RNA, 17 nt, Haemophilus influenzae Rd
aaaaagcuuaauggcuu

SEQ ID NO: 2697593 - RNA, 18 nt, Haemophilus influenzae Rd
aaaaaggcugcuugauau

SEQ ID NO: 2697594 - RNA, 21 nt, Haemophilus influenzae Rd
aaaaagggcagaauuaaaucu

SEQ ID NO: 2697595 - RNA, 14 nt, Haemophilus influenzae Rd
aaaaaguacuugca

SEQ ID NO: 2697596 - RNA, 14 nt, Haemophilus influenzae Rd
aaaaagucaaugaa

SEQ ID NO: 2697597 - RNA, 13 nt, Haemophilus influenzae Rd
aaaaagugaaaga

SEQ ID NO: 2697598 - RNA, 18 nt, Haemophilus influenzae Rd
aaaaagugcggaaaauuu

SEQ ID NO: 2697599 - RNA, 19 nt, Haemophilus influenzae Rd
aaaaagugcgguaaaauca

SEQ ID NO: 2697600 - RNA, 22 nt, Haemophilus influenzae Rd
aaaaagugcgguaaaauuucac

SEQ ID NO: 2697601 - RNA, 18 nt, Haemophilus influenzae Rd
aaaaagugcgguaaauuu

SEQ ID NO: 2697602 - RNA, 22 nt, Haemophilus influenzae Rd
aaaaagugcgguaaauuuuaaa

SEQ ID NO: 2697603 - RNA, 20 nt, Haemophilus influenzae Rd
aaaaagugcggucaauuuca

SEQ ID NO: 2697604 - RNA, 21 nt, Haemophilus influenzae Rd
aaaaagugcggucaauuucaa

SEQ ID NO: 2697605 - RNA, 20 nt, Haemophilus influenzae Rd
aaaaagugcggucauaaaaa

SEQ ID NO: 2697606 - RNA, 21 nt, Haemophilus influenzae Rd
aaaaagugcggucauaaaaaa

SEQ ID NO: 2697607 - RNA, 20 nt, Haemophilus influenzae Rd
aaaaagugcggugauuuuac

SEQ ID NO: 2697608 - RNA, 19 nt, Haemophilus influenzae Rd
aaaaagugcgguuaaaaua

SEQ ID NO: 2697609 - RNA, 22 nt, Haemophilus influenzae Rd
aaaaagugcgguuaaaauucac

SEQ ID NO: 2697610 - RNA, 18 nt, Haemophilus influenzae Rd
aaaaagugcgguuaauuu

SEQ ID NO: 2697611 - RNA, 18 nt, Haemophilus influenzae Rd
aaaaagugcgguugauuu

SEQ ID NO: 2697612 - RNA, 15 nt, Haemophilus influenzae Rd
aaaaaguucuuucug

SEQ ID NO: 2697613 - RNA, 14 nt, Haemophilus influenzae Rd
aaaaaguugaauuu

SEQ ID NO: 2697614 - RNA, 17 nt, Haemophilus influenzae Rd
aaaaaguugaauuuuca

SEQ ID NO: 2697615 - RNA, 13 nt, Haemophilus influenzae Rd
aaaaauaaaaaau

SEQ ID NO: 2697616 - RNA, 14 nt, Haemophilus influenzae Rd
aaaaauaaaaaaua

SEQ ID NO: 2697617 - RNA, 13 nt, Haemophilus influenzae Rd
aaaaauaaaaaca

SEQ ID NO: 2697618 - RNA, 15 nt, Haemophilus influenzae Rd
aaaaauaaaaacauu

SEQ ID NO: 2697619 - RNA, 14 nt, Haemophilus influenzae Rd
aaaaauaaauagau

SEQ ID NO: 2697620 - RNA, 18 nt, Haemophilus influenzae Rd
aaaaauaaccuaauuuca

SEQ ID NO: 2697621 - RNA, 23 nt, Haemophilus influenzae Rd
aaaaauaaucacuugauaaaaau

SEQ ID NO: 2697622 - RNA, 14 nt, Haemophilus influenzae Rd
aaaaauaaucaucu

SEQ ID NO: 2697623 - RNA, 18 nt, Haemophilus influenzae Rd
aaaaauaauuuuacuugu

SEQ ID NO: 2697624 - RNA, 20 nt, Haemophilus influenzae Rd
aaaaauaccgcuaucgucau

SEQ ID NO: 2697625 - RNA, 14 nt, Haemophilus influenzae Rd
aaaaauacuaacug

SEQ ID NO: 2697626 - RNA, 20 nt, Haemophilus influenzae Rd
aaaaauaggcugaaaaaaua

SEQ ID NO: 2697627 - RNA, 21 nt, Haemophilus influenzae Rd
aaaaauaggcugaaaaaauau

SEQ ID NO: 2697628 - RNA, 16 nt, Haemophilus influenzae Rd
aaaaauauaaaacuuu

SEQ ID NO: 2697629 - RNA, 15 nt, Haemophilus influenzae Rd
aaaaauauauuuaga

SEQ ID NO: 2697630 - RNA, 23 nt, Haemophilus influenzae Rd
aaaaauauccguuacauauuuca

SEQ ID NO: 2697631 - RNA, 12 nt, Haemophilus influenzae Rd
aaaaauauuaaa

SEQ ID NO: 2697632 - RNA, 14 nt, Haemophilus influenzae Rd
aaaaauauuaaaga

SEQ ID NO: 2697633 - RNA, 19 nt, Haemophilus influenzae Rd
aaaaaucaaccgcacuuuu

SEQ ID NO: 2697634 - RNA, 23 nt, Haemophilus influenzae Rd
aaaaaucaaccgcacuuuuauau

SEQ ID NO: 2697635 - RNA, 12 nt, Haemophilus influenzae Rd
aaaaaucaauca

SEQ ID NO: 2697636 - RNA, 21 nt, Haemophilus influenzae Rd
aaaaaucaccgcacuuugugc

SEQ ID NO: 2697637 - RNA, 13 nt, Haemophilus influenzae Rd
aaaaaucaucaau

SEQ ID NO: 2697638 - RNA, 21 nt, Haemophilus influenzae Rd
aaaaaucaucguauuaaaagu

SEQ ID NO: 2697639 - RNA, 16 nt, Haemophilus influenzae Rd
aaaaaucauuaaauaa

SEQ ID NO: 2697640 - RNA, 18 nt, Haemophilus influenzae Rd
aaaaaucauuaaauaacu

SEQ ID NO: 2697641 - RNA, 20 nt, Haemophilus influenzae Rd
aaaaauccacacuuuaauag

SEQ ID NO: 2697642 - RNA, 21 nt, Haemophilus influenzae Rd
aaaaauccacacuuuaauagu

SEQ ID NO: 2697643 - RNA, 16 nt, Haemophilus influenzae Rd
aaaaauccgccacuuu

SEQ ID NO: 2697644 - RNA, 16 nt, Haemophilus influenzae Rd
aaaaauccucaaaaac

SEQ ID NO: 2697645 - RNA, 15 nt, Haemophilus influenzae Rd
aaaaauccucaucug

SEQ ID NO: 2697646 - RNA, 17 nt, Haemophilus influenzae Rd
aaaaauccucaucugaa

SEQ ID NO: 2697647 - RNA, 17 nt, Haemophilus influenzae Rd
aaaaauccugaagauuu

SEQ ID NO: 2697648 - RNA, 21 nt, Haemophilus influenzae Rd
aaaaaucgaagaaauaugauu

SEQ ID NO: 2697649 - RNA, 22 nt, Haemophilus influenzae Rd
aaaaaucggugcaacaauauca

SEQ ID NO: 2697650 - RNA, 23 nt, Haemophilus influenzae Rd
aaaaaucggugcaacaauaucau

SEQ ID NO: 2697651 - RNA, 14 nt, Haemophilus influenzae Rd
aaaaaucuagagau

SEQ ID NO: 2697652 - RNA, 22 nt, Haemophilus influenzae Rd
aaaaaucuaucccaacagaaaa

SEQ ID NO: 2697653 - RNA, 19 nt, Haemophilus influenzae Rd
aaaaaucuuccaauacaau

SEQ ID NO: 2697654 - RNA, 23 nt, Haemophilus influenzae Rd
aaaaaucuuccaauacaaucagc

SEQ ID NO: 2697655 - RNA, 20 nt, Haemophilus influenzae Rd
aaaaaucuuuaccaaaaaau

SEQ ID NO: 2697656 - RNA, 15 nt, Haemophilus influenzae Rd
aaaaaugaauaaaau

SEQ ID NO: 2697657 - RNA, 22 nt, Haemophilus influenzae Rd
aaaaaugaauuaguuucaacuu

SEQ ID NO: 2697658 - RNA, 18 nt, Haemophilus influenzae Rd
aaaaaugagauuauuucu

SEQ ID NO: 2697659 - RNA, 19 nt, Haemophilus influenzae Rd
aaaaaugauuaaguuaaaa

SEQ ID NO: 2697660 - RNA, 10 nt, Haemophilus influenzae Rd
aaaaaugccu

SEQ ID NO: 2697661 - RNA, 21 nt, Haemophilus influenzae Rd
aaaaauggaaaaagcaaaacc

SEQ ID NO: 2697662 - RNA, 16 nt, Haemophilus influenzae Rd
aaaaauggaauaaaaa

SEQ ID NO: 2697663 - RNA, 20 nt, Haemophilus influenzae Rd
aaaaauggacagaauaacua

SEQ ID NO: 2697664 - RNA, 22 nt, Haemophilus influenzae Rd
aaaaauggcaacgccaauaaaa

SEQ ID NO: 2697665 - RNA, 23 nt, Haemophilus influenzae Rd
aaaaauggcaacgccaauaaaaa

SEQ ID NO: 2697666 - RNA, 15 nt, Haemophilus influenzae Rd
aaaaauggcuuuaau

SEQ ID NO: 2697667 - RNA, 16 nt, Haemophilus influenzae Rd
aaaaauggcuuuaauu

SEQ ID NO: 2697668 - RNA, 22 nt, Haemophilus influenzae Rd
aaaaauggguuaaagcuucauu

SEQ ID NO: 2697669 - RNA, 13 nt, Haemophilus influenzae Rd
aaaaauguaauuc

SEQ ID NO: 2697670 - RNA, 15 nt, Haemophilus influenzae Rd
aaaaauguuaauaca

SEQ ID NO: 2697671 - RNA, 17 nt, Haemophilus influenzae Rd
aaaaauguuauaaauaa

SEQ ID NO: 2697672 - RNA, 20 nt, Haemophilus influenzae Rd
aaaaauguuauaaauaaaaa

SEQ ID NO: 2697673 - RNA, 15 nt, Haemophilus influenzae Rd
aaaaauuaaauugua

SEQ ID NO: 2697674 - RNA, 19 nt, Haemophilus influenzae Rd
aaaaauuaaccgcacuuuu

SEQ ID NO: 2697675 - RNA, 16 nt, Haemophilus influenzae Rd
aaaaauuacuuaauua

SEQ ID NO: 2697676 - RNA, 15 nt, Haemophilus influenzae Rd
aaaaauuaucaaaag

SEQ ID NO: 2697677 - RNA, 21 nt, Haemophilus influenzae Rd
aaaaauuaucaaaagaaaaga

SEQ ID NO: 2697678 - RNA, 15 nt, Haemophilus influenzae Rd
aaaaauuaucaucau

SEQ ID NO: 2697679 - RNA, 16 nt, Haemophilus influenzae Rd
aaaaauuaucaucauu

SEQ ID NO: 2697680 - RNA, 14 nt, Haemophilus influenzae Rd
aaaaauuauuuucu

SEQ ID NO: 2697681 - RNA, 18 nt, Haemophilus influenzae Rd
aaaaauucaaugaaaugc

SEQ ID NO: 2697682 - RNA, 13 nt, Haemophilus influenzae Rd
aaaaauucuuugc

SEQ ID NO: 2697683 - RNA, 14 nt, Haemophilus influenzae Rd
aaaaauucuuuuau

SEQ ID NO: 2697684 - RNA, 21 nt, Haemophilus influenzae Rd
aaaaauugguacgagaaaaau

SEQ ID NO: 2697685 - RNA, 19 nt, Haemophilus influenzae Rd
aaaaauuguugauuccucu

SEQ ID NO: 2697686 - RNA, 13 nt, Haemophilus influenzae Rd
aaaaauuuaaaag

SEQ ID NO: 2697687 - RNA, 15 nt, Haemophilus influenzae Rd
aaaaauuuaaauaua

SEQ ID NO: 2697688 - RNA, 21 nt, Haemophilus influenzae Rd
aaaaauuuaauacuuucagcu

SEQ ID NO: 2697689 - RNA, 21 nt, Haemophilus influenzae Rd
aaaaauuugaauguaaaaaua

SEQ ID NO: 2697690 - RNA, 11 nt, Haemophilus influenzae Rd
aaaaauuuuug

SEQ ID NO: 2697691 - RNA, 23 nt, Haemophilus influenzae Rd
aaaacaaaagcaguuaaacagcu

SEQ ID NO: 2697692 - RNA, 17 nt, Haemophilus influenzae Rd
aaaacaagacaaaauaa

SEQ ID NO: 2697693 - RNA, 23 nt, Haemophilus influenzae Rd
aaaacaagcuuauguaaauuuau

SEQ ID NO: 2697694 - RNA, 21 nt, Haemophilus influenzae Rd
aaaacaaggaaucgaaauuaa

SEQ ID NO: 2697695 - RNA, 22 nt, Haemophilus influenzae Rd
aaaacaauggcugaaaaauuca

SEQ ID NO: 2697696 - RNA, 14 nt, Haemophilus influenzae Rd
aaaacacgaaaaaa

SEQ ID NO: 2697697 - RNA, 17 nt, Haemophilus influenzae Rd
aaaacacgaaaaaaacc

SEQ ID NO: 2697698 - RNA, 15 nt, Haemophilus influenzae Rd
aaaacagagaaaaaa

SEQ ID NO: 2697699 - RNA, 20 nt, Haemophilus influenzae Rd
aaaacagagaaaaaaauagu

SEQ ID NO: 2697700 - RNA, 15 nt, Haemophilus influenzae Rd
aaaacaguauuuucc

SEQ ID NO: 2697701 - RNA, 15 nt, Haemophilus influenzae Rd
aaaacauaauaaaau

SEQ ID NO: 2697702 - RNA, 21 nt, Haemophilus influenzae Rd
aaaacauaguaaauuuuaacc

SEQ ID NO: 2697703 - RNA, 14 nt, Haemophilus influenzae Rd
aaaacauauuccaa

SEQ ID NO: 2697704 - RNA, 14 nt, Haemophilus influenzae Rd
aaaacaucuuuaau

SEQ ID NO: 2697705 - RNA, 21 nt, Haemophilus influenzae Rd
aaaacauuaauugacaauuaa

SEQ ID NO: 2697706 - RNA, 20 nt, Haemophilus influenzae Rd
aaaacauugccaaagcauuu

SEQ ID NO: 2697707 - RNA, 16 nt, Haemophilus influenzae Rd
aaaaccaaacugccaa

SEQ ID NO: 2697708 - RNA, 18 nt, Haemophilus influenzae Rd
aaaaccaaucauuggaua

SEQ ID NO: 2697709 - RNA, 14 nt, Haemophilus influenzae Rd
aaaaccacaagaug

SEQ ID NO: 2697710 - RNA, 17 nt, Haemophilus influenzae Rd
aaaaccauuaaccccau

SEQ ID NO: 2697711 - RNA, 16 nt, Haemophilus influenzae Rd
aaaacccaguuuaaaa

SEQ ID NO: 2697712 - RNA, 20 nt, Haemophilus influenzae Rd
aaaaccccguucaauuugaa

SEQ ID NO: 2697713 - RNA, 21 nt, Haemophilus influenzae Rd
aaaacccgaaccgauuuuaaa

SEQ ID NO: 2697714 - RNA, 17 nt, Haemophilus influenzae Rd
aaaacccguaauuaaaa

SEQ ID NO: 2697715 - RNA, 20 nt, Haemophilus influenzae Rd
aaaaccgcuuuaucaaagaa

SEQ ID NO: 2697716 - RNA, 12 nt, Haemophilus influenzae Rd
aaaaccuaacau

SEQ ID NO: 2697717 - RNA, 18 nt, Haemophilus influenzae Rd
aaaaccugcugauuagca

SEQ ID NO: 2697718 - RNA, 23 nt, Haemophilus influenzae Rd
aaaaccuugggauauuccaaggu

SEQ ID NO: 2697719 - RNA, 19 nt, Haemophilus influenzae Rd
aaaaccuuguaaacgauuu

SEQ ID NO: 2697720 - RNA, 23 nt, Haemophilus influenzae Rd
aaaaccuuucuguaaauaugccu

SEQ ID NO: 2697721 - RNA, 14 nt, Haemophilus influenzae Rd
aaaacgaaauuuuu

SEQ ID NO: 2697722 - RNA, 15 nt, Haemophilus influenzae Rd
aaaacgaaauuuuuc

SEQ ID NO: 2697723 - RNA, 13 nt, Haemophilus influenzae Rd
aaaacgaauagaa

SEQ ID NO: 2697724 - RNA, 20 nt, Haemophilus influenzae Rd
aaaacgaugaaguuuucauu

SEQ ID NO: 2697725 - RNA, 21 nt, Haemophilus influenzae Rd
aaaacgcaaugcaaaaguaaa

SEQ ID NO: 2697726 - RNA, 13 nt, Haemophilus influenzae Rd
aaaacgccauuca

SEQ ID NO: 2697727 - RNA, 14 nt, Haemophilus influenzae Rd
aaaacggaaucagg

SEQ ID NO: 2697728 - RNA, 15 nt, Haemophilus influenzae Rd
aaaacggaaucaggu

SEQ ID NO: 2697729 - RNA, 18 nt, Haemophilus influenzae Rd
aaaacggcguuagguuuu

SEQ ID NO: 2697730 - RNA, 22 nt, Haemophilus influenzae Rd
aaaacggcguuagguuuugauu

SEQ ID NO: 2697731 - RNA, 14 nt, Haemophilus influenzae Rd
aaaacuaauugacu

SEQ ID NO: 2697732 - RNA, 13 nt, Haemophilus influenzae Rd
aaaacuaauuuga

SEQ ID NO: 2697733 - RNA, 12 nt, Haemophilus influenzae Rd
aaaacuacuugu

SEQ ID NO: 2697734 - RNA, 13 nt, Haemophilus influenzae Rd
aaaacuauuuuua

SEQ ID NO: 2697735 - RNA, 14 nt, Haemophilus influenzae Rd
aaaacuauuuuuaa

SEQ ID NO: 2697736 - RNA, 16 nt, Haemophilus influenzae Rd
aaaacuauuuuuaauu

SEQ ID NO: 2697737 - RNA, 21 nt, Haemophilus influenzae Rd
aaaacuauuuuuaauuuugaa

SEQ ID NO: 2697738 - RNA, 14 nt, Haemophilus influenzae Rd
aaaacucauccaau

SEQ ID NO: 2697739 - RNA, 24 nt, Haemophilus influenzae Rd
aaaacucuucguugguuuucgcca

SEQ ID NO: 2697740 - RNA, 21 nt, Haemophilus influenzae Rd
aaaacuguauuucgucuuaau

SEQ ID NO: 2697741 - RNA, 22 nt, Haemophilus influenzae Rd
aaaacuguauuucgucuuaauu

SEQ ID NO: 2697742 - RNA, 11 nt, Haemophilus influenzae Rd
aaaacuuaaag

SEQ ID NO: 2697743 - RNA, 23 nt, Haemophilus influenzae Rd
aaaacuuaucauuaaucuuauac

SEQ ID NO: 2697744 - RNA, 17 nt, Haemophilus influenzae Rd
aaaacuugcaaaccaac

SEQ ID NO: 2697745 - RNA, 19 nt, Haemophilus influenzae Rd
aaaacuugcaaaccaaccu

SEQ ID NO: 2697746 - RNA, 16 nt, Haemophilus influenzae Rd
aaaacuugcuacacga

SEQ ID NO: 2697747 - RNA, 18 nt, Haemophilus influenzae Rd
aaaacuugcuacacgaac

SEQ ID NO: 2697748 - RNA, 19 nt, Haemophilus influenzae Rd
aaaacuuuuguucuugcuu

SEQ ID NO: 2697749 - RNA, 13 nt, Haemophilus influenzae Rd
aaaagaaaacuua

SEQ ID NO: 2697750 - RNA, 14 nt, Haemophilus influenzae Rd
aaaagaaauucgcu

SEQ ID NO: 2697751 - RNA, 20 nt, Haemophilus influenzae Rd
aaaagaauaauauuaaagaa

SEQ ID NO: 2697752 - RNA, 12 nt, Haemophilus influenzae Rd
aaaagaauauuc

SEQ ID NO: 2697753 - RNA, 13 nt, Haemophilus influenzae Rd
aaaagaauuaaaa

SEQ ID NO: 2697754 - RNA, 12 nt, Haemophilus influenzae Rd
aaaagacaaaac

SEQ ID NO: 2697755 - RNA, 19 nt, Haemophilus influenzae Rd
aaaagaccgcacuuuaaaa

SEQ ID NO: 2697756 - RNA, 20 nt, Haemophilus influenzae Rd
aaaagaccgcacuuuaaaag

SEQ ID NO: 2697757 - RNA, 21 nt, Haemophilus influenzae Rd
aaaagaccgcacuuuaaaagu

SEQ ID NO: 2697758 - RNA, 20 nt, Haemophilus influenzae Rd
aaaagacgaagaaacaacca

SEQ ID NO: 2697759 - RNA, 21 nt, Haemophilus influenzae Rd
aaaagagagauaacucucucu

SEQ ID NO: 2697760 - RNA, 17 nt, Haemophilus influenzae Rd
aaaagagagcuaacucc

SEQ ID NO: 2697761 - RNA, 20 nt, Haemophilus influenzae Rd
aaaagagcgguuaaaaauag

SEQ ID NO: 2697762 - RNA, 19 nt, Haemophilus influenzae Rd
aaaagagugcgguuaauuu

SEQ ID NO: 2697763 - RNA, 21 nt, Haemophilus influenzae Rd
aaaagagugcgguuaauuuug

SEQ ID NO: 2697764 - RNA, 18 nt, Haemophilus influenzae Rd
aaaagauaaacaaaccua

SEQ ID NO: 2697765 - RNA, 19 nt, Haemophilus influenzae Rd
aaaagauaacuuagaaaau

SEQ ID NO: 2697766 - RNA, 23 nt, Haemophilus influenzae Rd
aaaagaucaggaucaaaaauauc

SEQ ID NO: 2697767 - RNA, 20 nt, Haemophilus influenzae Rd
aaaagaucauuuuuuuaaau

SEQ ID NO: 2697768 - RNA, 13 nt, Haemophilus influenzae Rd
aaaagaugaauga

SEQ ID NO: 2697769 - RNA, 19 nt, Haemophilus influenzae Rd
aaaagauucaacaauaauu

SEQ ID NO: 2697770 - RNA, 19 nt, Haemophilus influenzae Rd
aaaagauugcggcagaauu

SEQ ID NO: 2697771 - RNA, 14 nt, Haemophilus influenzae Rd
aaaagcaaaaccau

SEQ ID NO: 2697772 - RNA, 16 nt, Haemophilus influenzae Rd
aaaagcaaaacugaaa

SEQ ID NO: 2697773 - RNA, 16 nt, Haemophilus influenzae Rd
aaaagcaagaucuaaa

SEQ ID NO: 2697774 - RNA, 19 nt, Haemophilus influenzae Rd
aaaagcaagaucuaaaaac

SEQ ID NO: 2697775 - RNA, 18 nt, Haemophilus influenzae Rd
aaaagcaccuaaaaauuu

SEQ ID NO: 2697776 - RNA, 22 nt, Haemophilus influenzae Rd
aaaagcauggauuuuucuucua

SEQ ID NO: 2697777 - RNA, 14 nt, Haemophilus influenzae Rd
aaaagcauuacaaa

SEQ ID NO: 2697778 - RNA, 15 nt, Haemophilus influenzae Rd
aaaagccaauaagag

SEQ ID NO: 2697779 - RNA, 14 nt, Haemophilus influenzae Rd
aaaagccacuuuca

SEQ ID NO: 2697780 - RNA, 14 nt, Haemophilus influenzae Rd
aaaagcccaaaugc

SEQ ID NO: 2697781 - RNA, 19 nt, Haemophilus influenzae Rd
aaaagcccaaguaauacac

SEQ ID NO: 2697782 - RNA, 19 nt, Haemophilus influenzae Rd
aaaagcccuucuaugccaa

SEQ ID NO: 2697783 - RNA, 20 nt, Haemophilus influenzae Rd
aaaagccgcuaaagagauuu

SEQ ID NO: 2697784 - RNA, 17 nt, Haemophilus influenzae Rd
aaaagcgaaucuuucga

SEQ ID NO: 2697785 - RNA, 23 nt, Haemophilus influenzae Rd
aaaagcgugauuuuuuucauuuu

SEQ ID NO: 2697786 - RNA, 21 nt, Haemophilus influenzae Rd
aaaagcguugaguaaauagcu

SEQ ID NO: 2697787 - RNA, 14 nt, Haemophilus influenzae Rd
aaaagcuaaaaaaa

SEQ ID NO: 2697788 - RNA, 17 nt, Haemophilus influenzae Rd
aaaagcugauauaaaaa

SEQ ID NO: 2697789 - RNA, 16 nt, Haemophilus influenzae Rd
aaaagcuggauuaaau

SEQ ID NO: 2697790 - RNA, 13 nt, Haemophilus influenzae Rd
aaaagcuguuguu

SEQ ID NO: 2697791 - RNA, 13 nt, Haemophilus influenzae Rd
aaaagcuugagaa

SEQ ID NO: 2697792 - RNA, 19 nt, Haemophilus influenzae Rd
aaaagcuugagaagugccu

SEQ ID NO: 2697793 - RNA, 17 nt, Haemophilus influenzae Rd
aaaaggcaaagcaaaau

SEQ ID NO: 2697794 - RNA, 21 nt, Haemophilus influenzae Rd
aaaaggcggcuacuucuuuga

SEQ ID NO: 2697795 - RNA, 22 nt, Haemophilus influenzae Rd
aaaaggcuaaguucuaaaauua

SEQ ID NO: 2697796 - RNA, 22 nt, Haemophilus influenzae Rd
aaaaggcugcuugauauaauau

SEQ ID NO: 2697797 - RNA, 20 nt, Haemophilus influenzae Rd
aaaaggcuuuuuacguucau

SEQ ID NO: 2697798 - RNA, 15 nt, Haemophilus influenzae Rd
aaaagggcagaauua

SEQ ID NO: 2697799 - RNA, 23 nt, Haemophilus influenzae Rd
aaaaggguuauauucagcaaaau

SEQ ID NO: 2697800 - RNA, 13 nt, Haemophilus influenzae Rd
aaaaguaaaaaua

SEQ ID NO: 2697801 - RNA, 17 nt, Haemophilus influenzae Rd
aaaaguaaaaauaaaaa

SEQ ID NO: 2697802 - RNA, 21 nt, Haemophilus influenzae Rd
aaaaguaaaaauaaaaacauu

SEQ ID NO: 2697803 - RNA, 13 nt, Haemophilus influenzae Rd
aaaaguaaacaau

SEQ ID NO: 2697804 - RNA, 16 nt, Haemophilus influenzae Rd
aaaaguaaaugauaaa

SEQ ID NO: 2697805 - RNA, 20 nt, Haemophilus influenzae Rd
aaaaguacagcaaaccaagg

SEQ ID NO: 2697806 - RNA, 22 nt, Haemophilus influenzae Rd
aaaaguacagcaaaccaaggaa

SEQ ID NO: 2697807 - RNA, 15 nt, Haemophilus influenzae Rd
aaaaguagaagguuu

SEQ ID NO: 2697808 - RNA, 14 nt, Haemophilus influenzae Rd
aaaaguagcacuuu

SEQ ID NO: 2697809 - RNA, 19 nt, Haemophilus influenzae Rd
aaaaguauugagcgauaaa

SEQ ID NO: 2697810 - RNA, 16 nt, Haemophilus influenzae Rd
aaaagucuguuuaaaa

SEQ ID NO: 2697811 - RNA, 19 nt, Haemophilus influenzae Rd
aaaagucuguuuaaaaacg

SEQ ID NO: 2697812 - RNA, 21 nt, Haemophilus influenzae Rd
aaaagugcgaugacaaaaaau

SEQ ID NO: 2697813 - RNA, 18 nt, Haemophilus influenzae Rd
aaaagugcgguaaaaauu

SEQ ID NO: 2697814 - RNA, 20 nt, Haemophilus influenzae Rd
aaaagugcgguaaaaauuau

SEQ ID NO: 2697815 - RNA, 19 nt, Haemophilus influenzae Rd
aaaagugcgguaaaaauuc

SEQ ID NO: 2697816 - RNA, 19 nt, Haemophilus influenzae Rd
aaaagugcgguaaaaauuu

SEQ ID NO: 2697817 - RNA, 17 nt, Haemophilus influenzae Rd
aaaagugcgguaaauuu

SEQ ID NO: 2697818 - RNA, 19 nt, Haemophilus influenzae Rd
aaaagugcgguaaauuuuu

SEQ ID NO: 2697819 - RNA, 17 nt, Haemophilus influenzae Rd
aaaagugcggucuuuuu

SEQ ID NO: 2697820 - RNA, 20 nt, Haemophilus influenzae Rd
aaaagugcggugaaauuuca

SEQ ID NO: 2697821 - RNA, 17 nt, Haemophilus influenzae Rd
aaaagugcggugauuuu

SEQ ID NO: 2697822 - RNA, 19 nt, Haemophilus influenzae Rd
aaaagugcggugauuuuac

SEQ ID NO: 2697823 - RNA, 19 nt, Haemophilus influenzae Rd
aaaagugcgguuaaaaauu

SEQ ID NO: 2697824 - RNA, 18 nt, Haemophilus influenzae Rd
aaaagugcgguuaaaauu

SEQ ID NO: 2697825 - RNA, 18 nt, Haemophilus influenzae Rd
aaaagugcgguugauuuu

SEQ ID NO: 2697826 - RNA, 14 nt, Haemophilus influenzae Rd
aaaagugcuuaaau

SEQ ID NO: 2697827 - RNA, 18 nt, Haemophilus influenzae Rd
aaaaguguauaaauauuu

SEQ ID NO: 2697828 - RNA, 21 nt, Haemophilus influenzae Rd
aaaaguugaaacuguuuuggc

SEQ ID NO: 2697829 - RNA, 23 nt, Haemophilus influenzae Rd
aaaaguuugcaacauauggauag

SEQ ID NO: 2697830 - RNA, 21 nt, Haemophilus influenzae Rd
aaaaguuuuccgacaacacuu

SEQ ID NO: 2697831 - RNA, 12 nt, Haemophilus influenzae Rd
aaaauaaaaaau

SEQ ID NO: 2697832 - RNA, 13 nt, Haemophilus influenzae Rd
aaaauaaaaacau

SEQ ID NO: 2697833 - RNA, 14 nt, Haemophilus influenzae Rd
aaaauaaaaacauu

SEQ ID NO: 2697834 - RNA, 12 nt, Haemophilus influenzae Rd
aaaauaaaauga

SEQ ID NO: 2697835 - RNA, 15 nt, Haemophilus influenzae Rd
aaaauaaacacucca

SEQ ID NO: 2697836 - RNA, 12 nt, Haemophilus influenzae Rd
aaaauaaagaaa

SEQ ID NO: 2697837 - RNA, 13 nt, Haemophilus influenzae Rd
aaaauaaagaaac

SEQ ID NO: 2697838 - RNA, 15 nt, Haemophilus influenzae Rd
aaaauaaagaaacgu

SEQ ID NO: 2697839 - RNA, 22 nt, Haemophilus influenzae Rd
aaaauaaagggcgguuaaaaau

SEQ ID NO: 2697840 - RNA, 16 nt, Haemophilus influenzae Rd
aaaauaaaguaagcac

SEQ ID NO: 2697841 - RNA, 15 nt, Haemophilus influenzae Rd
aaaauaaagugcggu

SEQ ID NO: 2697842 - RNA, 22 nt, Haemophilus influenzae Rd
aaaauaaauuaacuuaucuaaa

SEQ ID NO: 2697843 - RNA, 15 nt, Haemophilus influenzae Rd
aaaauaaauugauuu

SEQ ID NO: 2697844 - RNA, 23 nt, Haemophilus influenzae Rd
aaaauaaauuuuaaaaucuuuga

SEQ ID NO: 2697845 - RNA, 15 nt, Haemophilus influenzae Rd
aaaauaacaaaaaag

SEQ ID NO: 2697846 - RNA, 12 nt, Haemophilus influenzae Rd
aaaauaacauaa

SEQ ID NO: 2697847 - RNA, 13 nt, Haemophilus influenzae Rd
aaaauaaccacua

SEQ ID NO: 2697848 - RNA, 23 nt, Haemophilus influenzae Rd
aaaauaaccgcacuuuaaucucu

SEQ ID NO: 2697849 - RNA, 20 nt, Haemophilus influenzae Rd
aaaauaaccgcacuuugggu

SEQ ID NO: 2697850 - RNA, 17 nt, Haemophilus influenzae Rd
aaaauaaccuauaauag

SEQ ID NO: 2697851 - RNA, 20 nt, Haemophilus influenzae Rd
aaaauaacuuucuguguguu

SEQ ID NO: 2697852 - RNA, 12 nt, Haemophilus influenzae Rd
aaaauaauauca

SEQ ID NO: 2697853 - RNA, 13 nt, Haemophilus influenzae Rd
aaaauaauaucca

SEQ ID NO: 2697854 - RNA, 15 nt, Haemophilus influenzae Rd
aaaauaauauccaaa

SEQ ID NO: 2697855 - RNA, 19 nt, Haemophilus influenzae Rd
aaaauaaucacuugauaaa

SEQ ID NO: 2697856 - RNA, 18 nt, Haemophilus influenzae Rd
aaaauaaugcaaaaacaa

SEQ ID NO: 2697857 - RNA, 12 nt, Haemophilus influenzae Rd
aaaauacccaua

SEQ ID NO: 2697858 - RNA, 20 nt, Haemophilus influenzae Rd
aaaauaccgcacuuuggcaa

SEQ ID NO: 2697859 - RNA, 15 nt, Haemophilus influenzae Rd
aaaauacuuucagaa

SEQ ID NO: 2697860 - RNA, 15 nt, Haemophilus influenzae Rd
aaaauagaaagaaua

SEQ ID NO: 2697861 - RNA, 18 nt, Haemophilus influenzae Rd
aaaauagaugucggcuau

SEQ ID NO: 2697862 - RNA, 17 nt, Haemophilus influenzae Rd
aaaauagccuaaauauu

SEQ ID NO: 2697863 - RNA, 15 nt, Haemophilus influenzae Rd
aaaauagcugauaau

SEQ ID NO: 2697864 - RNA, 20 nt, Haemophilus influenzae Rd
aaaauagucauaaaggcuac

SEQ ID NO: 2697865 - RNA, 15 nt, Haemophilus influenzae Rd
aaaauaguuuaauac

SEQ ID NO: 2697866 - RNA, 15 nt, Haemophilus influenzae Rd
aaaauaguuuucaca

SEQ ID NO: 2697867 - RNA, 16 nt, Haemophilus influenzae Rd
aaaauaguuuucacaa

SEQ ID NO: 2697868 - RNA, 21 nt, Haemophilus influenzae Rd
aaaauauaagauauaaaaaaa

SEQ ID NO: 2697869 - RNA, 22 nt, Haemophilus influenzae Rd
aaaauauaagauauaaaaaaag

SEQ ID NO: 2697870 - RNA, 23 nt, Haemophilus influenzae Rd
aaaauauaauuaaucugcaccuu

SEQ ID NO: 2697871 - RNA, 14 nt, Haemophilus influenzae Rd
aaaauauacaauuc

SEQ ID NO: 2697872 - RNA, 21 nt, Haemophilus influenzae Rd
aaaauauauuuagauacaaaa

SEQ ID NO: 2697873 - RNA, 15 nt, Haemophilus influenzae Rd
aaaauauccacauaa

SEQ ID NO: 2697874 - RNA, 22 nt, Haemophilus influenzae Rd
aaaauauccacauaaccaaagg

SEQ ID NO: 2697875 - RNA, 12 nt, Haemophilus influenzae Rd
aaaauaucugca

SEQ ID NO: 2697876 - RNA, 14 nt, Haemophilus influenzae Rd
aaaauaucugcuaa

SEQ ID NO: 2697877 - RNA, 14 nt, Haemophilus influenzae Rd
aaaauaucuggcaa

SEQ ID NO: 2697878 - RNA, 18 nt, Haemophilus influenzae Rd
aaaauaucuuguuuuaau

SEQ ID NO: 2697879 - RNA, 22 nt, Haemophilus influenzae Rd
aaaauaucuuguuuuaauauca

SEQ ID NO: 2697880 - RNA, 23 nt, Haemophilus influenzae Rd
aaaauauuaguuagcuaaaaaaa

SEQ ID NO: 2697881 - RNA, 22 nt, Haemophilus influenzae Rd
aaaauauucaaacagguguguu

SEQ ID NO: 2697882 - RNA, 22 nt, Haemophilus influenzae Rd
aaaauauuggaguuagaauaau

SEQ ID NO: 2697883 - RNA, 14 nt, Haemophilus influenzae Rd
aaaauauuucauuu

SEQ ID NO: 2697884 - RNA, 13 nt, Haemophilus influenzae Rd
aaaauauuuucaa

SEQ ID NO: 2697885 - RNA, 14 nt, Haemophilus influenzae Rd
aaaauauuuucccc

SEQ ID NO: 2697886 - RNA, 14 nt, Haemophilus influenzae Rd
aaaaucaaagauau

SEQ ID NO: 2697887 - RNA, 18 nt, Haemophilus influenzae Rd
aaaaucaaguuaaaaaau

SEQ ID NO: 2697888 - RNA, 19 nt, Haemophilus influenzae Rd
aaaaucacacuaaucuaaa

SEQ ID NO: 2697889 - RNA, 14 nt, Haemophilus influenzae Rd
aaaaucacauaaaa

SEQ ID NO: 2697890 - RNA, 16 nt, Haemophilus influenzae Rd
aaaaucacauaaaaaa

SEQ ID NO: 2697891 - RNA, 23 nt, Haemophilus influenzae Rd
aaaaucacaucgccaacuugaau

SEQ ID NO: 2697892 - RNA, 11 nt, Haemophilus influenzae Rd
aaaaucaccau

SEQ ID NO: 2697893 - RNA, 20 nt, Haemophilus influenzae Rd
aaaaucacgccagauaaaau

SEQ ID NO: 2697894 - RNA, 13 nt, Haemophilus influenzae Rd
aaaaucacuucuc

SEQ ID NO: 2697895 - RNA, 16 nt, Haemophilus influenzae Rd
aaaaucagauacauuu

SEQ ID NO: 2697896 - RNA, 16 nt, Haemophilus influenzae Rd
aaaaucagcgcauuuu

SEQ ID NO: 2697897 - RNA, 18 nt, Haemophilus influenzae Rd
aaaaucagcuaauaacac

SEQ ID NO: 2697898 - RNA, 13 nt, Haemophilus influenzae Rd
aaaaucagcuuuu

SEQ ID NO: 2697899 - RNA, 14 nt, Haemophilus influenzae Rd
aaaaucauagagac

SEQ ID NO: 2697900 - RNA, 13 nt, Haemophilus influenzae Rd
aaaaucaucacag

SEQ ID NO: 2697901 - RNA, 12 nt, Haemophilus influenzae Rd
aaaaucaucaua

SEQ ID NO: 2697902 - RNA, 23 nt, Haemophilus influenzae Rd
aaaaucaucauauucacuuucau

SEQ ID NO: 2697903 - RNA, 13 nt, Haemophilus influenzae Rd
aaaaucaucuaau

SEQ ID NO: 2697904 - RNA, 14 nt, Haemophilus influenzae Rd
aaaauccaaccgau

SEQ ID NO: 2697905 - RNA, 14 nt, Haemophilus influenzae Rd
aaaauccauaauuu

SEQ ID NO: 2697906 - RNA, 15 nt, Haemophilus influenzae Rd
aaaauccuguucagc

SEQ ID NO: 2697907 - RNA, 15 nt, Haemophilus influenzae Rd
aaaauccuugcacca

SEQ ID NO: 2697908 - RNA, 21 nt, Haemophilus influenzae Rd
aaaaucgaucuaaucuuaaaa

SEQ ID NO: 2697909 - RNA, 23 nt, Haemophilus influenzae Rd
aaaaucgaucuaaucuuaaaaaa

SEQ ID NO: 2697910 - RNA, 15 nt, Haemophilus influenzae Rd
aaaaucgcaauaaau

SEQ ID NO: 2697911 - RNA, 23 nt, Haemophilus influenzae Rd
aaaaucgccugacauuuuugcca

SEQ ID NO: 2697912 - RNA, 22 nt, Haemophilus influenzae Rd
aaaaucggugcaacaauaucau

SEQ ID NO: 2697913 - RNA, 17 nt, Haemophilus influenzae Rd
aaaaucguaauuuuaaa

SEQ ID NO: 2697914 - RNA, 19 nt, Haemophilus influenzae Rd
aaaaucguaauuuuaaaac

SEQ ID NO: 2697915 - RNA, 23 nt, Haemophilus influenzae Rd
aaaaucguacaucgaaaacauaa

SEQ ID NO: 2697916 - RNA, 20 nt, Haemophilus influenzae Rd
aaaaucuccaacuucauguu

SEQ ID NO: 2697917 - RNA, 19 nt, Haemophilus influenzae Rd
aaaaucucucaaaaaucaa

SEQ ID NO: 2697918 - RNA, 16 nt, Haemophilus influenzae Rd
aaaaucucuggagaaa

SEQ ID NO: 2697919 - RNA, 22 nt, Haemophilus influenzae Rd
aaaaucucuggagaaaauugcu

SEQ ID NO: 2697920 - RNA, 20 nt, Haemophilus influenzae Rd
aaaaucugcacucuaauaag

SEQ ID NO: 2697921 - RNA, 24 nt, Haemophilus influenzae Rd
aaaaucugugcaaaguuaccauuu

SEQ ID NO: 2697922 - RNA, 21 nt, Haemophilus influenzae Rd
aaaaucuugaacgcaaauacc

SEQ ID NO: 2697923 - RNA, 16 nt, Haemophilus influenzae Rd
aaaaucuugguuuaaa

SEQ ID NO: 2697924 - RNA, 18 nt, Haemophilus influenzae Rd
aaaaucuugguuuaaauu

SEQ ID NO: 2697925 - RNA, 18 nt, Haemophilus influenzae Rd
aaaaucuuuuauucugca

SEQ ID NO: 2697926 - RNA, 15 nt, Haemophilus influenzae Rd
aaaaugaauaaaauu

SEQ ID NO: 2697927 - RNA, 14 nt, Haemophilus influenzae Rd
aaaaugaauuaguu

SEQ ID NO: 2697928 - RNA, 17 nt, Haemophilus influenzae Rd
aaaaugagauuauuucu

SEQ ID NO: 2697929 - RNA, 17 nt, Haemophilus influenzae Rd
aaaaugcaaacaagaug

SEQ ID NO: 2697930 - RNA, 18 nt, Haemophilus influenzae Rd
aaaaugcaaaguaacuuu

SEQ ID NO: 2697931 - RNA, 15 nt, Haemophilus influenzae Rd
aaaaugcggcaaugg

SEQ ID NO: 2697932 - RNA, 23 nt, Haemophilus influenzae Rd
aaaaugcggcaaugguuaauaca

SEQ ID NO: 2697933 - RNA, 15 nt, Haemophilus influenzae Rd
aaaaugcgugcugug

SEQ ID NO: 2697934 - RNA, 16 nt, Haemophilus influenzae Rd
aaaaugcucuuuggga

SEQ ID NO: 2697935 - RNA, 15 nt, Haemophilus influenzae Rd
aaaaugcuuauaaaa

SEQ ID NO: 2697936 - RNA, 13 nt, Haemophilus influenzae Rd
aaaauggaaugag

SEQ ID NO: 2697937 - RNA, 16 nt, Haemophilus influenzae Rd
aaaauggcaaacaaaa

SEQ ID NO: 2697938 - RNA, 18 nt, Haemophilus influenzae Rd
aaaauggcaaacaaaaua

SEQ ID NO: 2697939 - RNA, 21 nt, Haemophilus influenzae Rd
aaaauggcgguuuuuuaauuu

SEQ ID NO: 2697940 - RNA, 20 nt, Haemophilus influenzae Rd
aaaauggcuguuguuuuggc

SEQ ID NO: 2697941 - RNA, 16 nt, Haemophilus influenzae Rd
aaaauggcuuuuuugc

SEQ ID NO: 2697942 - RNA, 24 nt, Haemophilus influenzae Rd
aaaauggguucacagagaauaaau

SEQ ID NO: 2697943 - RNA, 18 nt, Haemophilus influenzae Rd
aaaauggugcuuuuuaca

SEQ ID NO: 2697944 - RNA, 21 nt, Haemophilus influenzae Rd
aaaauguaagagugaaguuau

SEQ ID NO: 2697945 - RNA, 19 nt, Haemophilus influenzae Rd
aaaaugucgugaauacgcg

SEQ ID NO: 2697946 - RNA, 21 nt, Haemophilus influenzae Rd
aaaaugugguugcggcugaau

SEQ ID NO: 2697947 - RNA, 14 nt, Haemophilus influenzae Rd
aaaauguugaauau

SEQ ID NO: 2697948 - RNA, 20 nt, Haemophilus influenzae Rd
aaaauguuuaccucgccauu

SEQ ID NO: 2697949 - RNA, 20 nt, Haemophilus influenzae Rd
aaaauuaaaaauuuaauacu

SEQ ID NO: 2697950 - RNA, 16 nt, Haemophilus influenzae Rd
aaaauuaaauugaaaa

SEQ ID NO: 2697951 - RNA, 17 nt, Haemophilus influenzae Rd
aaaauuaaauugaaaaa

SEQ ID NO: 2697952 - RNA, 19 nt, Haemophilus influenzae Rd
aaaauuaaauugaaaaaau

SEQ ID NO: 2697953 - RNA, 16 nt, Haemophilus influenzae Rd
aaaauuaagaaaauaa

SEQ ID NO: 2697954 - RNA, 14 nt, Haemophilus influenzae Rd
aaaauuaagcaaua

SEQ ID NO: 2697955 - RNA, 17 nt, Haemophilus influenzae Rd
aaaauuaauacugaaau

SEQ ID NO: 2697956 - RNA, 19 nt, Haemophilus influenzae Rd
aaaauuaauacugaaauga

SEQ ID NO: 2697957 - RNA, 20 nt, Haemophilus influenzae Rd
aaaauuaauacugaaaugau

SEQ ID NO: 2697958 - RNA, 14 nt, Haemophilus influenzae Rd
aaaauuaaugccaa

SEQ ID NO: 2697959 - RNA, 14 nt, Haemophilus influenzae Rd
aaaauuauaauauu

SEQ ID NO: 2697960 - RNA, 23 nt, Haemophilus influenzae Rd
aaaauuauaauauuuaaauuagc

SEQ ID NO: 2697961 - RNA, 22 nt, Haemophilus influenzae Rd
aaaauuaucaaaagaaaagaug

SEQ ID NO: 2697962 - RNA, 22 nt, Haemophilus influenzae Rd
aaaauuaucuggcaaucgccaa

SEQ ID NO: 2697963 - RNA, 15 nt, Haemophilus influenzae Rd
aaaauuauugcauuu

SEQ ID NO: 2697964 - RNA, 13 nt, Haemophilus influenzae Rd
aaaauucaaagaa

SEQ ID NO: 2697965 - RNA, 15 nt, Haemophilus influenzae Rd
aaaauucaaagauua

SEQ ID NO: 2697966 - RNA, 18 nt, Haemophilus influenzae Rd
aaaauucaucauuacuuu

SEQ ID NO: 2697967 - RNA, 18 nt, Haemophilus influenzae Rd
aaaauucauuauuacuuu

SEQ ID NO: 2697968 - RNA, 12 nt, Haemophilus influenzae Rd
aaaauuccaguu

SEQ ID NO: 2697969 - RNA, 23 nt, Haemophilus influenzae Rd
aaaauuccaguucuccuucucca

SEQ ID NO: 2697970 - RNA, 16 nt, Haemophilus influenzae Rd
aaaauucuauuaaaau

SEQ ID NO: 2697971 - RNA, 17 nt, Haemophilus influenzae Rd
aaaauugaucgaaaaau

SEQ ID NO: 2697972 - RNA, 17 nt, Haemophilus influenzae Rd
aaaauugaucuaaauua

SEQ ID NO: 2697973 - RNA, 20 nt, Haemophilus influenzae Rd
aaaauugaugaaaauucucu

SEQ ID NO: 2697974 - RNA, 13 nt, Haemophilus influenzae Rd
aaaauugcaccuu

SEQ ID NO: 2697975 - RNA, 13 nt, Haemophilus influenzae Rd
aaaauugccacau

SEQ ID NO: 2697976 - RNA, 19 nt, Haemophilus influenzae Rd
aaaauugguacgagaaaaa

SEQ ID NO: 2697977 - RNA, 11 nt, Haemophilus influenzae Rd
aaaauuuaauc

SEQ ID NO: 2697978 - RNA, 19 nt, Haemophilus influenzae Rd
aaaauuuauuacaaacaaa

SEQ ID NO: 2697979 - RNA, 13 nt, Haemophilus influenzae Rd
aaaauuucgcuau

SEQ ID NO: 2697980 - RNA, 12 nt, Haemophilus influenzae Rd
aaaauuucugaa

SEQ ID NO: 2697981 - RNA, 19 nt, Haemophilus influenzae Rd
aaaauuuguaccauugugc

SEQ ID NO: 2697982 - RNA, 14 nt, Haemophilus influenzae Rd
aaaauuuuaaauaa

SEQ ID NO: 2697983 - RNA, 15 nt, Haemophilus influenzae Rd
aaaauuuuaaauaaa

SEQ ID NO: 2697984 - RNA, 14 nt, Haemophilus influenzae Rd
aaaauuuugccaau

SEQ ID NO: 2697985 - RNA, 18 nt, Haemophilus influenzae Rd
aaacaaaagccaccauuu

SEQ ID NO: 2697986 - RNA, 11 nt, Haemophilus influenzae Rd
aaacaaaaggc

SEQ ID NO: 2697987 - RNA, 13 nt, Haemophilus influenzae Rd
aaacaaaauaaau

SEQ ID NO: 2697988 - RNA, 15 nt, Haemophilus influenzae Rd
aaacaaacccuccca

SEQ ID NO: 2697989 - RNA, 21 nt, Haemophilus influenzae Rd
aaacaaagggcugauauuuaa

SEQ ID NO: 2697990 - RNA, 22 nt, Haemophilus influenzae Rd
aaacaaagggcugauauuuaaa

SEQ ID NO: 2697991 - RNA, 13 nt, Haemophilus influenzae Rd
aaacaaauaaaaa

SEQ ID NO: 2697992 - RNA, 15 nt, Haemophilus influenzae Rd
aaacaaauaaaaagu

SEQ ID NO: 2697993 - RNA, 15 nt, Haemophilus influenzae Rd
aaacaaauuuuuaca

SEQ ID NO: 2697994 - RNA, 19 nt, Haemophilus influenzae Rd
aaacaacaguagaaaucac

SEQ ID NO: 2697995 - RNA, 15 nt, Haemophilus influenzae Rd
aaacaacgaauaucc

SEQ ID NO: 2697996 - RNA, 20 nt, Haemophilus influenzae Rd
aaacaacgaauauccgcauu

SEQ ID NO: 2697997 - RNA, 18 nt, Haemophilus influenzae Rd
aaacaacgcguaagcggu

SEQ ID NO: 2697998 - RNA, 19 nt, Haemophilus influenzae Rd
aaacaacgcguacuuuuuu

SEQ ID NO: 2697999 - RNA, 19 nt, Haemophilus influenzae Rd
aaacaagcucuagaaaauc

SEQ ID NO: 2698000 - RNA, 23 nt, Haemophilus influenzae Rd
aaacaagcuuauguaaauuuauc

SEQ ID NO: 2698001 - RNA, 16 nt, Haemophilus influenzae Rd
aaacaaguauaaaaaa

SEQ ID NO: 2698002 - RNA, 21 nt, Haemophilus influenzae Rd
aaacaaguauaaaaaaucccu

SEQ ID NO: 2698003 - RNA, 16 nt, Haemophilus influenzae Rd
aaacaaguuucuaaaa

SEQ ID NO: 2698004 - RNA, 16 nt, Haemophilus influenzae Rd
aaacaauaaaaaaacu

SEQ ID NO: 2698005 - RNA, 19 nt, Haemophilus influenzae Rd
aaacaauaaaaaaacuugc

SEQ ID NO: 2698006 - RNA, 12 nt, Haemophilus influenzae Rd
aaacaauaaaac

SEQ ID NO: 2698007 - RNA, 12 nt, Haemophilus influenzae Rd
aaacaauauauu

SEQ ID NO: 2698008 - RNA, 22 nt, Haemophilus influenzae Rd
aaacaauauauucggaaaaaau

SEQ ID NO: 2698009 - RNA, 17 nt, Haemophilus influenzae Rd
aaacaauauguauaauu

SEQ ID NO: 2698010 - RNA, 14 nt, Haemophilus influenzae Rd
aaacaaucacugaa

SEQ ID NO: 2698011 - RNA, 15 nt, Haemophilus influenzae Rd
aaacaaucacugaaa

SEQ ID NO: 2698012 - RNA, 23 nt, Haemophilus influenzae Rd
aaacaaucuguggcguauuuaga

SEQ ID NO: 2698013 - RNA, 13 nt, Haemophilus influenzae Rd
aaacaaucuuaac

SEQ ID NO: 2698014 - RNA, 15 nt, Haemophilus influenzae Rd
aaacaaucuuaacug

SEQ ID NO: 2698015 - RNA, 21 nt, Haemophilus influenzae Rd
aaacaaugcaaauacaagugg

SEQ ID NO: 2698016 - RNA, 22 nt, Haemophilus influenzae Rd
aaacaauucuauauuauuuaag

SEQ ID NO: 2698017 - RNA, 17 nt, Haemophilus influenzae Rd
aaacacaacauaauuaa

SEQ ID NO: 2698018 - RNA, 20 nt, Haemophilus influenzae Rd
aaacacaacauaauuaaagc

SEQ ID NO: 2698019 - RNA, 13 nt, Haemophilus influenzae Rd
aaacaccuaaaau

SEQ ID NO: 2698020 - RNA, 13 nt, Haemophilus influenzae Rd
aaacaccuaauuc

SEQ ID NO: 2698021 - RNA, 20 nt, Haemophilus influenzae Rd
aaacaccuccagcaaaagca

SEQ ID NO: 2698022 - RNA, 23 nt, Haemophilus influenzae Rd
aaacacgcaagcgcguuuaucau

SEQ ID NO: 2698023 - RNA, 19 nt, Haemophilus influenzae Rd
aaacacgcauaaaaauaac

SEQ ID NO: 2698024 - RNA, 14 nt, Haemophilus influenzae Rd
aaacacguccgcaa

SEQ ID NO: 2698025 - RNA, 13 nt, Haemophilus influenzae Rd
aaacacuccaaca

SEQ ID NO: 2698026 - RNA, 15 nt, Haemophilus influenzae Rd
aaacacuugguucgc

SEQ ID NO: 2698027 - RNA, 23 nt, Haemophilus influenzae Rd
aaacagaauuuacgaaaacuuuc

SEQ ID NO: 2698028 - RNA, 19 nt, Haemophilus influenzae Rd
aaacagacugaaauucugu

SEQ ID NO: 2698029 - RNA, 20 nt, Haemophilus influenzae Rd
aaacagagcgucaaaauuau

SEQ ID NO: 2698030 - RNA, 17 nt, Haemophilus influenzae Rd
aaacagaucgugauauu

SEQ ID NO: 2698031 - RNA, 10 nt, Haemophilus influenzae Rd
aaacagcaaa

SEQ ID NO: 2698032 - RNA, 15 nt, Haemophilus influenzae Rd
aaacagcaauaaaua

SEQ ID NO: 2698033 - RNA, 18 nt, Haemophilus influenzae Rd
aaacagcaauaaauaaua

SEQ ID NO: 2698034 - RNA, 19 nt, Haemophilus influenzae Rd
aaacagccaaacaaauuag

SEQ ID NO: 2698035 - RNA, 22 nt, Haemophilus influenzae Rd
aaacaggaauacucacagagcc

SEQ ID NO: 2698036 - RNA, 18 nt, Haemophilus influenzae Rd
aaacagggcgacaauuua

SEQ ID NO: 2698037 - RNA, 23 nt, Haemophilus influenzae Rd
aaacaggguguuuauaagugcca

SEQ ID NO: 2698038 - RNA, 20 nt, Haemophilus influenzae Rd
aaacagguguguuuuucaaa

SEQ ID NO: 2698039 - RNA, 14 nt, Haemophilus influenzae Rd
aaacaguaaugaaa

SEQ ID NO: 2698040 - RNA, 17 nt, Haemophilus influenzae Rd
aaacagucugcgccuaa

SEQ ID NO: 2698041 - RNA, 18 nt, Haemophilus influenzae Rd
aaacagugagcuuauugc

SEQ ID NO: 2698042 - RNA, 18 nt, Haemophilus influenzae Rd
aaacaguucaauaaaaau

SEQ ID NO: 2698043 - RNA, 19 nt, Haemophilus influenzae Rd
aaacaguucaauaaaaaua

SEQ ID NO: 2698044 - RNA, 20 nt, Haemophilus influenzae Rd
aaacaguucaauaaaaauau

SEQ ID NO: 2698045 - RNA, 13 nt, Haemophilus influenzae Rd
aaacauaccacuu

SEQ ID NO: 2698046 - RNA, 16 nt, Haemophilus influenzae Rd
aaacauaccuaaaaau

SEQ ID NO: 2698047 - RNA, 11 nt, Haemophilus influenzae Rd
aaacaucauca

SEQ ID NO: 2698048 - RNA, 18 nt, Haemophilus influenzae Rd
aaacaucaucacccccac

SEQ ID NO: 2698049 - RNA, 18 nt, Haemophilus influenzae Rd
aaacauccgaauaaaugc

SEQ ID NO: 2698050 - RNA, 17 nt, Haemophilus influenzae Rd
aaacaucgcuucaucau

SEQ ID NO: 2698051 - RNA, 14 nt, Haemophilus influenzae Rd
aaacaugagguguu

SEQ ID NO: 2698052 - RNA, 13 nt, Haemophilus influenzae Rd
aaacauuacugcu

SEQ ID NO: 2698053 - RNA, 14 nt, Haemophilus influenzae Rd
aaacauuaugaaaa

SEQ ID NO: 2698054 - RNA, 16 nt, Haemophilus influenzae Rd
aaacauugccaaagca

SEQ ID NO: 2698055 - RNA, 16 nt, Haemophilus influenzae Rd
aaacauuguuuuguuc

SEQ ID NO: 2698056 - RNA, 17 nt, Haemophilus influenzae Rd
aaacauuguuuuguuca

SEQ ID NO: 2698057 - RNA, 22 nt, Haemophilus influenzae Rd
aaacauuucuaucgcauuuuac

SEQ ID NO: 2698058 - RNA, 23 nt, Haemophilus influenzae Rd
aaacauuucuaucgcauuuuaca

SEQ ID NO: 2698059 - RNA, 15 nt, Haemophilus influenzae Rd
aaacauuuuguaucu

SEQ ID NO: 2698060 - RNA, 17 nt, Haemophilus influenzae Rd
aaacauuuuguaucuaa

SEQ ID NO: 2698061 - RNA, 23 nt, Haemophilus influenzae Rd
aaacauuuuguaucuaaauauau

SEQ ID NO: 2698062 - RNA, 24 nt, Haemophilus influenzae Rd
aaacauuuuguaucuaaauauauu

SEQ ID NO: 2698063 - RNA, 14 nt, Haemophilus influenzae Rd
aaacauuuuucccu

SEQ ID NO: 2698064 - RNA, 15 nt, Haemophilus influenzae Rd
aaacauuuuuucaac

SEQ ID NO: 2698065 - RNA, 17 nt, Haemophilus influenzae Rd
aaaccaaacgagaaaau

SEQ ID NO: 2698066 - RNA, 22 nt, Haemophilus influenzae Rd
aaaccaaagaguuugaauaauu

SEQ ID NO: 2698067 - RNA, 12 nt, Haemophilus influenzae Rd
aaaccaaauaau

SEQ ID NO: 2698068 - RNA, 23 nt, Haemophilus influenzae Rd
aaaccaaauaugguaauuagccu

SEQ ID NO: 2698069 - RNA, 14 nt, Haemophilus influenzae Rd
aaaccaacaacugc

SEQ ID NO: 2698070 - RNA, 18 nt, Haemophilus influenzae Rd
aaaccaacacccacauca

SEQ ID NO: 2698071 - RNA, 14 nt, Haemophilus influenzae Rd
aaaccaacgaaaau

SEQ ID NO: 2698072 - RNA, 15 nt, Haemophilus influenzae Rd
aaaccaacgaaaaua

SEQ ID NO: 2698073 - RNA, 13 nt, Haemophilus influenzae Rd
aaaccaagugaaa

SEQ ID NO: 2698074 - RNA, 21 nt, Haemophilus influenzae Rd
aaaccaagugaaauucuaccu

SEQ ID NO: 2698075 - RNA, 15 nt, Haemophilus influenzae Rd
aaaccaauaagauag

SEQ ID NO: 2698076 - RNA, 12 nt, Haemophilus influenzae Rd
aaaccaauaaua

SEQ ID NO: 2698077 - RNA, 16 nt, Haemophilus influenzae Rd
aaaccaauuucguuuu

SEQ ID NO: 2698078 - RNA, 13 nt, Haemophilus influenzae Rd
aaaccaauuuuac

SEQ ID NO: 2698079 - RNA, 21 nt, Haemophilus influenzae Rd
aaaccaauuuuacaaaucgua

SEQ ID NO: 2698080 - RNA, 17 nt, Haemophilus influenzae Rd
aaaccacaucauuuuuu

SEQ ID NO: 2698081 - RNA, 19 nt, Haemophilus influenzae Rd
aaaccaccgauuaauaaaa

SEQ ID NO: 2698082 - RNA, 15 nt, Haemophilus influenzae Rd
aaaccacuaaaaaca

SEQ ID NO: 2698083 - RNA, 21 nt, Haemophilus influenzae Rd
aaaccauccaagcaaagaaau

SEQ ID NO: 2698084 - RNA, 17 nt, Haemophilus influenzae Rd
aaacccacaacuuuuuc

SEQ ID NO: 2698085 - RNA, 21 nt, Haemophilus influenzae Rd
aaacccacaacuuuuucaucu

SEQ ID NO: 2698086 - RNA, 20 nt, Haemophilus influenzae Rd
aaaccccguucaauuugaac

SEQ ID NO: 2698087 - RNA, 15 nt, Haemophilus influenzae Rd
aaacccgcuuuuaac

SEQ ID NO: 2698088 - RNA, 16 nt, Haemophilus influenzae Rd
aaacccgcuuuuaaca

SEQ ID NO: 2698089 - RNA, 16 nt, Haemophilus influenzae Rd
aaacccguaauuaaaa

SEQ ID NO: 2698090 - RNA, 18 nt, Haemophilus influenzae Rd
aaaccgaccgcacuuuuu

SEQ ID NO: 2698091 - RNA, 18 nt, Haemophilus influenzae Rd
aaaccgauagcuuuuguu

SEQ ID NO: 2698092 - RNA, 14 nt, Haemophilus influenzae Rd
aaaccgauuuugac

SEQ ID NO: 2698093 - RNA, 21 nt, Haemophilus influenzae Rd
aaaccgcaucaaaauuauaaa

SEQ ID NO: 2698094 - RNA, 12 nt, Haemophilus influenzae Rd
aaaccgccaaaa

SEQ ID NO: 2698095 - RNA, 18 nt, Haemophilus influenzae Rd
aaaccgcugucauauuca

SEQ ID NO: 2698096 - RNA, 20 nt, Haemophilus influenzae Rd
aaaccgcugucauauucauu

SEQ ID NO: 2698097 - RNA, 16 nt, Haemophilus influenzae Rd
aaaccguggcauaauu

SEQ ID NO: 2698098 - RNA, 16 nt, Haemophilus influenzae Rd
aaaccgugguuuaaac

SEQ ID NO: 2698099 - RNA, 21 nt, Haemophilus influenzae Rd
aaaccguuuagcaaacaaugg

SEQ ID NO: 2698100 - RNA, 14 nt, Haemophilus influenzae Rd
aaaccuaacauaau

SEQ ID NO: 2698101 - RNA, 21 nt, Haemophilus influenzae Rd
aaaccuacacccacugauuuu

SEQ ID NO: 2698102 - RNA, 19 nt, Haemophilus influenzae Rd
aaaccucagaagaaauuaa

SEQ ID NO: 2698103 - RNA, 20 nt, Haemophilus influenzae Rd
aaaccucagaagaaauuaag

SEQ ID NO: 2698104 - RNA, 16 nt, Haemophilus influenzae Rd
aaaccucgccuuguaa

SEQ ID NO: 2698105 - RNA, 17 nt, Haemophilus influenzae Rd
aaaccugaguaaauaaa

SEQ ID NO: 2698106 - RNA, 21 nt, Haemophilus influenzae Rd
aaaccugcaaggauauuucca

SEQ ID NO: 2698107 - RNA, 16 nt, Haemophilus influenzae Rd
aaaccugcugauuagc

SEQ ID NO: 2698108 - RNA, 17 nt, Haemophilus influenzae Rd
aaaccuguugguuguuc

SEQ ID NO: 2698109 - RNA, 15 nt, Haemophilus influenzae Rd
aaaccuuauuuuaaa

SEQ ID NO: 2698110 - RNA, 16 nt, Haemophilus influenzae Rd
aaaccuuauuuuaaau

SEQ ID NO: 2698111 - RNA, 22 nt, Haemophilus influenzae Rd
aaaccuuauuuuaaauaaaaaa

SEQ ID NO: 2698112 - RNA, 16 nt, Haemophilus influenzae Rd
aaaccuucaaacauca

SEQ ID NO: 2698113 - RNA, 21 nt, Haemophilus influenzae Rd
aaaccuucuggguaaaauaau

SEQ ID NO: 2698114 - RNA, 13 nt, Haemophilus influenzae Rd
aaaccuuggaaua

SEQ ID NO: 2698115 - RNA, 13 nt, Haemophilus influenzae Rd
aaaccuuguaaau

SEQ ID NO: 2698116 - RNA, 20 nt, Haemophilus influenzae Rd
aaaccuuucuguaaauaugc

SEQ ID NO: 2698117 - RNA, 16 nt, Haemophilus influenzae Rd
aaaccuuuuucuucca

SEQ ID NO: 2698118 - RNA, 18 nt, Haemophilus influenzae Rd
aaaccuuuuucuuccauu

SEQ ID NO: 2698119 - RNA, 13 nt, Haemophilus influenzae Rd
aaacgaaaaaaau

SEQ ID NO: 2698120 - RNA, 16 nt, Haemophilus influenzae Rd
aaacgaaaaaaauaaa

SEQ ID NO: 2698121 - RNA, 22 nt, Haemophilus influenzae Rd
aaacgaacuggcugagagaaga

SEQ ID NO: 2698122 - RNA, 19 nt, Haemophilus influenzae Rd
aaacgaaucgguaacauau

SEQ ID NO: 2698123 - RNA, 17 nt, Haemophilus influenzae Rd
aaacgacuuaauuuuau

SEQ ID NO: 2698124 - RNA, 12 nt, Haemophilus influenzae Rd
aaacgagaaaau

SEQ ID NO: 2698125 - RNA, 18 nt, Haemophilus influenzae Rd
aaacgagcauauuuucca

SEQ ID NO: 2698126 - RNA, 17 nt, Haemophilus influenzae Rd
aaacgaggcucgaacuc

SEQ ID NO: 2698127 - RNA, 23 nt, Haemophilus influenzae Rd
aaacgauaugguaagaacgacca

SEQ ID NO: 2698128 - RNA, 17 nt, Haemophilus influenzae Rd
aaacgaucaucuauacc

SEQ ID NO: 2698129 - RNA, 13 nt, Haemophilus influenzae Rd
aaacgaugaagaa

SEQ ID NO: 2698130 - RNA, 16 nt, Haemophilus influenzae Rd
aaacgaugaagaaaau

SEQ ID NO: 2698131 - RNA, 22 nt, Haemophilus influenzae Rd
aaacgaugaaguuuucauuaaa

SEQ ID NO: 2698132 - RNA, 21 nt, Haemophilus influenzae Rd
aaacgaugugcauugaauuuu

SEQ ID NO: 2698133 - RNA, 14 nt, Haemophilus influenzae Rd
aaacgauucacgaa

SEQ ID NO: 2698134 - RNA, 20 nt, Haemophilus influenzae Rd
aaacgauucacgaauacauc

SEQ ID NO: 2698135 - RNA, 13 nt, Haemophilus influenzae Rd
aaacgcaacaucg

SEQ ID NO: 2698136 - RNA, 23 nt, Haemophilus influenzae Rd
aaacgcaccacgaccuaagaaaa

SEQ ID NO: 2698137 - RNA, 23 nt, Haemophilus influenzae Rd
aaacgcacuugauuugcuuggaa

SEQ ID NO: 2698138 - RNA, 13 nt, Haemophilus influenzae Rd
aaacgcacuuuuu

SEQ ID NO: 2698139 - RNA, 19 nt, Haemophilus influenzae Rd
aaacgccaucaaccauaac

SEQ ID NO: 2698140 - RNA, 13 nt, Haemophilus influenzae Rd
aaacgcccauuua

SEQ ID NO: 2698141 - RNA, 16 nt, Haemophilus influenzae Rd
aaacgccguucaaaau

SEQ ID NO: 2698142 - RNA, 21 nt, Haemophilus influenzae Rd
aaacgccuugggcuaacauug

SEQ ID NO: 2698143 - RNA, 20 nt, Haemophilus influenzae Rd
aaacgcgaugaaauuaucau

SEQ ID NO: 2698144 - RNA, 23 nt, Haemophilus influenzae Rd
aaacgcggucuaaauagaccgca

SEQ ID NO: 2698145 - RNA, 22 nt, Haemophilus influenzae Rd
aaacgcguggaaagaauaccac

SEQ ID NO: 2698146 - RNA, 20 nt, Haemophilus influenzae Rd
aaacgcucaaauaaauugcc

SEQ ID NO: 2698147 - RNA, 14 nt, Haemophilus influenzae Rd
aaacgcucuuuaau

SEQ ID NO: 2698148 - RNA, 20 nt, Haemophilus influenzae Rd
aaacgcuggaauauuuuucu

SEQ ID NO: 2698149 - RNA, 14 nt, Haemophilus influenzae Rd
aaacggauuaacac

SEQ ID NO: 2698150 - RNA, 16 nt, Haemophilus influenzae Rd
aaacggcgaagauuac

SEQ ID NO: 2698151 - RNA, 22 nt, Haemophilus influenzae Rd
aaacggcgugcaccgauauuuu

SEQ ID NO: 2698152 - RNA, 20 nt, Haemophilus influenzae Rd
aaacggcugccgcaucaacu

SEQ ID NO: 2698153 - RNA, 22 nt, Haemophilus influenzae Rd
aaacggucgaguuuuucaaaaa

SEQ ID NO: 2698154 - RNA, 15 nt, Haemophilus influenzae Rd
aaacguaaacaaaau

SEQ ID NO: 2698155 - RNA, 18 nt, Haemophilus influenzae Rd
aaacguaaacaaaauacc

SEQ ID NO: 2698156 - RNA, 20 nt, Haemophilus influenzae Rd
aaacguaacuaaaaaaguuu

SEQ ID NO: 2698157 - RNA, 16 nt, Haemophilus influenzae Rd
aaacgucgauccauug

SEQ ID NO: 2698158 - RNA, 13 nt, Haemophilus influenzae Rd
aaacgugauuuac

SEQ ID NO: 2698159 - RNA, 20 nt, Haemophilus influenzae Rd
aaacguuggguuugauuuau

SEQ ID NO: 2698160 - RNA, 18 nt, Haemophilus influenzae Rd
aaacguugugaacuuugu

SEQ ID NO: 2698161 - RNA, 12 nt, Haemophilus influenzae Rd
aaacuaaaucuu

SEQ ID NO: 2698162 - RNA, 16 nt, Haemophilus influenzae Rd
aaacuaaaucuugcuu

SEQ ID NO: 2698163 - RNA, 18 nt, Haemophilus influenzae Rd
aaacuaacguuaucaucu

SEQ ID NO: 2698164 - RNA, 14 nt, Haemophilus influenzae Rd
aaacuaauaaaagc

SEQ ID NO: 2698165 - RNA, 21 nt, Haemophilus influenzae Rd
aaacuaauuaguuuuuaauuu

SEQ ID NO: 2698166 - RNA, 16 nt, Haemophilus influenzae Rd
aaacuaauuucauuuu

SEQ ID NO: 2698167 - RNA, 19 nt, Haemophilus influenzae Rd
aaacuaauuucauuuugca

SEQ ID NO: 2698168 - RNA, 22 nt, Haemophilus influenzae Rd
aaacuaauuugacgauaauauu

SEQ ID NO: 2698169 - RNA, 18 nt, Haemophilus influenzae Rd
aaacuacggacuaaauaa

SEQ ID NO: 2698170 - RNA, 20 nt, Haemophilus influenzae Rd
aaacuacuucuaaaggcuaa

SEQ ID NO: 2698171 - RNA, 15 nt, Haemophilus influenzae Rd
aaacuacuuucuauu

SEQ ID NO: 2698172 - RNA, 22 nt, Haemophilus influenzae Rd
aaacuacuuucuauuaaaaaau

SEQ ID NO: 2698173 - RNA, 23 nt, Haemophilus influenzae Rd
aaacuauauagccuguuguucuc

SEQ ID NO: 2698174 - RNA, 20 nt, Haemophilus influenzae Rd
aaacuaugcagaaucagaau

SEQ ID NO: 2698175 - RNA, 17 nt, Haemophilus influenzae Rd
aaacuauugaaaauuaa

SEQ ID NO: 2698176 - RNA, 19 nt, Haemophilus influenzae Rd
aaacuauuuuuaauuuuga

SEQ ID NO: 2698177 - RNA, 22 nt, Haemophilus influenzae Rd
aaacuauuuuuaauuuugaagu

SEQ ID NO: 2698178 - RNA, 18 nt, Haemophilus influenzae Rd
aaacucaaugaauuaaaa

SEQ ID NO: 2698179 - RNA, 19 nt, Haemophilus influenzae Rd
aaacucacuaaauuaggaa

SEQ ID NO: 2698180 - RNA, 21 nt, Haemophilus influenzae Rd
aaacucuaagcuuaauauguu

SEQ ID NO: 2698181 - RNA, 19 nt, Haemophilus influenzae Rd
aaacucuucguugguuuuc

SEQ ID NO: 2698182 - RNA, 20 nt, Haemophilus influenzae Rd
aaacucuugugccaaauuca

SEQ ID NO: 2698183 - RNA, 15 nt, Haemophilus influenzae Rd
aaacugauuuugauu

SEQ ID NO: 2698184 - RNA, 15 nt, Haemophilus influenzae Rd
aaacugcuuucaaaa

SEQ ID NO: 2698185 - RNA, 18 nt, Haemophilus influenzae Rd
aaacugcuuucaaaagga

SEQ ID NO: 2698186 - RNA, 23 nt, Haemophilus influenzae Rd
aaacuggguuuuuuuauuuuuau

SEQ ID NO: 2698187 - RNA, 20 nt, Haemophilus influenzae Rd
aaacugugcccgcagcaauu

SEQ ID NO: 2698188 - RNA, 21 nt, Haemophilus influenzae Rd
aaacuguuuuggcauuuucaa

SEQ ID NO: 2698189 - RNA, 19 nt, Haemophilus influenzae Rd
aaacuuaccgaucauuucu

SEQ ID NO: 2698190 - RNA, 23 nt, Haemophilus influenzae Rd
aaacuuacuacguguucaucauc

SEQ ID NO: 2698191 - RNA, 18 nt, Haemophilus influenzae Rd
aaacuuaguuuuaauucu

SEQ ID NO: 2698192 - RNA, 12 nt, Haemophilus influenzae Rd
aaacuuccaaaa

SEQ ID NO: 2698193 - RNA, 21 nt, Haemophilus influenzae Rd
aaacuucucuuauuugugugg

SEQ ID NO: 2698194 - RNA, 13 nt, Haemophilus influenzae Rd
aaacuugagauuu

SEQ ID NO: 2698195 - RNA, 16 nt, Haemophilus influenzae Rd
aaacuugcaaaccaac

SEQ ID NO: 2698196 - RNA, 20 nt, Haemophilus influenzae Rd
aaacuuguuaaauaaacaca

SEQ ID NO: 2698197 - RNA, 16 nt, Haemophilus influenzae Rd
aaacuuuauuuuauuc

SEQ ID NO: 2698198 - RNA, 16 nt, Haemophilus influenzae Rd
aaacuuuuaauagcgc

SEQ ID NO: 2698199 - RNA, 20 nt, Haemophilus influenzae Rd
aaacuuuucuuauaauuaca

SEQ ID NO: 2698200 - RNA, 13 nt, Haemophilus influenzae Rd
aaagaaaaccaaa

SEQ ID NO: 2698201 - RNA, 22 nt, Haemophilus influenzae Rd
aaagaaaacuuauaaagauauu

SEQ ID NO: 2698202 - RNA, 20 nt, Haemophilus influenzae Rd
aaagaaaagcgaauuucuua

SEQ ID NO: 2698203 - RNA, 14 nt, Haemophilus influenzae Rd
aaagaaaagugcgg

SEQ ID NO: 2698204 - RNA, 13 nt, Haemophilus influenzae Rd
aaagaaacaccac

SEQ ID NO: 2698205 - RNA, 16 nt, Haemophilus influenzae Rd
aaagaaacguaaacaa

SEQ ID NO: 2698206 - RNA, 19 nt, Haemophilus influenzae Rd
aaagaaacguaaacaaaau

SEQ ID NO: 2698207 - RNA, 15 nt, Haemophilus influenzae Rd
aaagaaaguauuaaa

SEQ ID NO: 2698208 - RNA, 13 nt, Haemophilus influenzae Rd
aaagaaauauaau

SEQ ID NO: 2698209 - RNA, 18 nt, Haemophilus influenzae Rd
aaagaaauauauuauugu

SEQ ID NO: 2698210 - RNA, 23 nt, Haemophilus influenzae Rd
aaagaaauauauuauugugauaa

SEQ ID NO: 2698211 - RNA, 22 nt, Haemophilus influenzae Rd
aaagaaaucaccgcacuuugug

SEQ ID NO: 2698212 - RNA, 14 nt, Haemophilus influenzae Rd
aaagaaauuuuaau

SEQ ID NO: 2698213 - RNA, 12 nt, Haemophilus influenzae Rd
aaagaacaucuu

SEQ ID NO: 2698214 - RNA, 23 nt, Haemophilus influenzae Rd
aaagaaccuaucucauccacuaa

SEQ ID NO: 2698215 - RNA, 21 nt, Haemophilus influenzae Rd
aaagaacggucaaaaugcagu

SEQ ID NO: 2698216 - RNA, 15 nt, Haemophilus influenzae Rd
aaagaacuauuauuc

SEQ ID NO: 2698217 - RNA, 14 nt, Haemophilus influenzae Rd
aaagaagaaaaucu

SEQ ID NO: 2698218 - RNA, 23 nt, Haemophilus influenzae Rd
aaagaagcuauuacucuuaauuu

SEQ ID NO: 2698219 - RNA, 14 nt, Haemophilus influenzae Rd
aaagaauaauaagu

SEQ ID NO: 2698220 - RNA, 22 nt, Haemophilus influenzae Rd
aaagaauaauauuaaagaaaau

SEQ ID NO: 2698221 - RNA, 19 nt, Haemophilus influenzae Rd
aaagaauauaaauaaaaca

SEQ ID NO: 2698222 - RNA, 21 nt, Haemophilus influenzae Rd
aaagaauaucgccuuauccca

SEQ ID NO: 2698223 - RNA, 20 nt, Haemophilus influenzae Rd
aaagaauauucuuuucucca

SEQ ID NO: 2698224 - RNA, 13 nt, Haemophilus influenzae Rd
aaagaauauuuua

SEQ ID NO: 2698225 - RNA, 14 nt, Haemophilus influenzae Rd
aaagaauauuuuaa

SEQ ID NO: 2698226 - RNA, 16 nt, Haemophilus influenzae Rd
aaagaauauuuuaaug

SEQ ID NO: 2698227 - RNA, 19 nt, Haemophilus influenzae Rd
aaagaauauuuuaaugaaa

SEQ ID NO: 2698228 - RNA, 21 nt, Haemophilus influenzae Rd
aaagaauauuuuaaugaaagu

SEQ ID NO: 2698229 - RNA, 23 nt, Haemophilus influenzae Rd
aaagaauauuuuaaugaaaguaa

SEQ ID NO: 2698230 - RNA, 19 nt, Haemophilus influenzae Rd
aaagaaucaucuucaucug

SEQ ID NO: 2698231 - RNA, 15 nt, Haemophilus influenzae Rd
aaagaaucuuaaauu

SEQ ID NO: 2698232 - RNA, 23 nt, Haemophilus influenzae Rd
aaagaauuggcgaaccuucacuu

SEQ ID NO: 2698233 - RNA, 22 nt, Haemophilus influenzae Rd
aaagaauuucaucgcauuuuua

SEQ ID NO: 2698234 - RNA, 16 nt, Haemophilus influenzae Rd
aaagaauuuuuucaca

SEQ ID NO: 2698235 - RNA, 17 nt, Haemophilus influenzae Rd
aaagacagaagaaguaa

SEQ ID NO: 2698236 - RNA, 21 nt, Haemophilus influenzae Rd
aaagacagcuauuaaaaaaag

SEQ ID NO: 2698237 - RNA, 20 nt, Haemophilus influenzae Rd
aaagacccaccgcaaaagcc

SEQ ID NO: 2698238 - RNA, 20 nt, Haemophilus influenzae Rd
aaagaccgcacuuuaaaagu

SEQ ID NO: 2698239 - RNA, 14 nt, Haemophilus influenzae Rd
aaagacgaagaaac

SEQ ID NO: 2698240 - RNA, 17 nt, Haemophilus influenzae Rd
aaagacgauauuuuccu

SEQ ID NO: 2698241 - RNA, 20 nt, Haemophilus influenzae Rd
aaagacggcgcguucuucug

SEQ ID NO: 2698242 - RNA, 21 nt, Haemophilus influenzae Rd
aaagacggcgcguucuucugc

SEQ ID NO: 2698243 - RNA, 20 nt, Haemophilus influenzae Rd
aaagacguuugauuguaaaa

SEQ ID NO: 2698244 - RNA, 22 nt, Haemophilus influenzae Rd
aaagacguuugauuguaaaagu

SEQ ID NO: 2698245 - RNA, 23 nt, Haemophilus influenzae Rd
aaagacuaaacucaaugaauuaa

SEQ ID NO: 2698246 - RNA, 14 nt, Haemophilus influenzae Rd
aaagagaaacauug

SEQ ID NO: 2698247 - RNA, 13 nt, Haemophilus influenzae Rd
aaagagacucugu

SEQ ID NO: 2698248 - RNA, 14 nt, Haemophilus influenzae Rd
aaagagauuauuuc

SEQ ID NO: 2698249 - RNA, 18 nt, Haemophilus influenzae Rd
aaagagcgguugaaaauu

SEQ ID NO: 2698250 - RNA, 15 nt, Haemophilus influenzae Rd
aaagaguaagcaagu

SEQ ID NO: 2698251 - RNA, 16 nt, Haemophilus influenzae Rd
aaagaguaagcaagua

SEQ ID NO: 2698252 - RNA, 21 nt, Haemophilus influenzae Rd
aaagaguaccacuuucaacug

SEQ ID NO: 2698253 - RNA, 15 nt, Haemophilus influenzae Rd
aaagagugaccaguc

SEQ ID NO: 2698254 - RNA, 23 nt, Haemophilus influenzae Rd
aaagauaaaacagagaaaaaaau

SEQ ID NO: 2698255 - RNA, 18 nt, Haemophilus influenzae Rd
aaagauaacuaagaugau

SEQ ID NO: 2698256 - RNA, 21 nt, Haemophilus influenzae Rd
aaagauaauuacgccuaacca

SEQ ID NO: 2698257 - RNA, 17 nt, Haemophilus influenzae Rd
aaagauacacucacuuu

SEQ ID NO: 2698258 - RNA, 14 nt, Haemophilus influenzae Rd
aaagauauuacuua

SEQ ID NO: 2698259 - RNA, 16 nt, Haemophilus influenzae Rd
aaagaucaggaucaaa

SEQ ID NO: 2698260 - RNA, 18 nt, Haemophilus influenzae Rd
aaagaucauuuuuuuaaa

SEQ ID NO: 2698261 - RNA, 20 nt, Haemophilus influenzae Rd
aaagauccuuccaccacaac

SEQ ID NO: 2698262 - RNA, 17 nt, Haemophilus influenzae Rd
aaagaugaaugaacgag

SEQ ID NO: 2698263 - RNA, 23 nt, Haemophilus influenzae Rd
aaagaugguugucgaaaaaagag

SEQ ID NO: 2698264 - RNA, 19 nt, Haemophilus influenzae Rd
aaagauguuccuacagaac

SEQ ID NO: 2698265 - RNA, 15 nt, Haemophilus influenzae Rd
aaagauucaacaaua

SEQ ID NO: 2698266 - RNA, 21 nt, Haemophilus influenzae Rd
aaagauuguccuuuugccauu

SEQ ID NO: 2698267 - RNA, 18 nt, Haemophilus influenzae Rd
aaagauuuauguugaauu

SEQ ID NO: 2698268 - RNA, 13 nt, Haemophilus influenzae Rd
aaagauuuuaaaa

SEQ ID NO: 2698269 - RNA, 16 nt, Haemophilus influenzae Rd
aaagauuuuaaaauuu

SEQ ID NO: 2698270 - RNA, 15 nt, Haemophilus influenzae Rd
aaagauuuugcagau

SEQ ID NO: 2698271 - RNA, 15 nt, Haemophilus influenzae Rd
aaagauuuuucuugc

SEQ ID NO: 2698272 - RNA, 23 nt, Haemophilus influenzae Rd
aaagcaaaacugaaagaaaaaga

SEQ ID NO: 2698273 - RNA, 21 nt, Haemophilus influenzae Rd
aaagcaaaugaggaaaauaaa

SEQ ID NO: 2698274 - RNA, 16 nt, Haemophilus influenzae Rd
aaagcaaccaaugcaa

SEQ ID NO: 2698275 - RNA, 22 nt, Haemophilus influenzae Rd
aaagcaauauggguucaauaua

SEQ ID NO: 2698276 - RNA, 13 nt, Haemophilus influenzae Rd
aaagcaauauuua

SEQ ID NO: 2698277 - RNA, 16 nt, Haemophilus influenzae Rd
aaagcaaucaaaaaug

SEQ ID NO: 2698278 - RNA, 21 nt, Haemophilus influenzae Rd
aaagcaauguugcaacuaaua

SEQ ID NO: 2698279 - RNA, 14 nt, Haemophilus influenzae Rd
aaagcaccauaaug

SEQ ID NO: 2698280 - RNA, 20 nt, Haemophilus influenzae Rd
aaagcacccaucacauuuuc

SEQ ID NO: 2698281 - RNA, 18 nt, Haemophilus influenzae Rd
aaagcaccgcauuaauau

SEQ ID NO: 2698282 - RNA, 23 nt, Haemophilus influenzae Rd
aaagcaccuuuaggaugugaaua

SEQ ID NO: 2698283 - RNA, 18 nt, Haemophilus influenzae Rd
aaagcacugaaauucauu

SEQ ID NO: 2698284 - RNA, 16 nt, Haemophilus influenzae Rd
aaagcagguuuuucuu

SEQ ID NO: 2698285 - RNA, 22 nt, Haemophilus influenzae Rd
aaagcagguuuuucuuuuaauu

SEQ ID NO: 2698286 - RNA, 18 nt, Haemophilus influenzae Rd
aaagcaugaauaaaaaug

SEQ ID NO: 2698287 - RNA, 17 nt, Haemophilus influenzae Rd
aaagcauuaaguuuuua

SEQ ID NO: 2698288 - RNA, 22 nt, Haemophilus influenzae Rd
aaagcauuuagagcaagcaaua

SEQ ID NO: 2698289 - RNA, 13 nt, Haemophilus influenzae Rd
aaagccaacuuuu

SEQ ID NO: 2698290 - RNA, 16 nt, Haemophilus influenzae Rd
aaagccaacuuuuucu

SEQ ID NO: 2698291 - RNA, 16 nt, Haemophilus influenzae Rd
aaagcccaaaugcaac

SEQ ID NO: 2698292 - RNA, 13 nt, Haemophilus influenzae Rd
aaagcccaaguaa

SEQ ID NO: 2698293 - RNA, 16 nt, Haemophilus influenzae Rd
aaagccccauuucuuu

SEQ ID NO: 2698294 - RNA, 23 nt, Haemophilus influenzae Rd
aaagcccuucuaugccaaucaca

SEQ ID NO: 2698295 - RNA, 16 nt, Haemophilus influenzae Rd
aaagccguagucugcu

SEQ ID NO: 2698296 - RNA, 15 nt, Haemophilus influenzae Rd
aaagccuuuuauuuc

SEQ ID NO: 2698297 - RNA, 21 nt, Haemophilus influenzae Rd
aaagcgaguaagggcaaaaaa

SEQ ID NO: 2698298 - RNA, 22 nt, Haemophilus influenzae Rd
aaagcgcauauuaucucgaaua

SEQ ID NO: 2698299 - RNA, 15 nt, Haemophilus influenzae Rd
aaagcguaaauuaug

SEQ ID NO: 2698300 - RNA, 22 nt, Haemophilus influenzae Rd
aaagcgugugcuugcauuuaca

SEQ ID NO: 2698301 - RNA, 17 nt, Haemophilus influenzae Rd
aaagcguugaaaauaaa

SEQ ID NO: 2698302 - RNA, 19 nt, Haemophilus influenzae Rd
aaagcguugaaaauaaauu

SEQ ID NO: 2698303 - RNA, 14 nt, Haemophilus influenzae Rd
aaagcguuuuaaaa

SEQ ID NO: 2698304 - RNA, 17 nt, Haemophilus influenzae Rd
aaagcuacaucaacaaa

SEQ ID NO: 2698305 - RNA, 20 nt, Haemophilus influenzae Rd
aaagcuacaucaacaaaugu

SEQ ID NO: 2698306 - RNA, 15 nt, Haemophilus influenzae Rd
aaagcuacuaaaaau

SEQ ID NO: 2698307 - RNA, 16 nt, Haemophilus influenzae Rd
aaagcuacuaaaaauu

SEQ ID NO: 2698308 - RNA, 21 nt, Haemophilus influenzae Rd
aaagcuagaacaccgagaugc

SEQ ID NO: 2698309 - RNA, 16 nt, Haemophilus influenzae Rd
aaagcuauaaguaacu

SEQ ID NO: 2698310 - RNA, 19 nt, Haemophilus influenzae Rd
aaagcuauaaguaacuuua

SEQ ID NO: 2698311 - RNA, 20 nt, Haemophilus influenzae Rd
aaagcugaccgcacuuuuug

SEQ ID NO: 2698312 - RNA, 22 nt, Haemophilus influenzae Rd
aaagcugcacuauauacauuaa

SEQ ID NO: 2698313 - RNA, 21 nt, Haemophilus influenzae Rd
aaagcugccaucugauuuugu

SEQ ID NO: 2698314 - RNA, 16 nt, Haemophilus influenzae Rd
aaagcuggcucuucuu

SEQ ID NO: 2698315 - RNA, 21 nt, Haemophilus influenzae Rd
aaagcuuaauggcuugcucug

SEQ ID NO: 2698316 - RNA, 23 nt, Haemophilus influenzae Rd
aaagcuucauuugcuuuaaccca

SEQ ID NO: 2698317 - RNA, 21 nt, Haemophilus influenzae Rd
aaagcuugcuuucuugcugac

SEQ ID NO: 2698318 - RNA, 13 nt, Haemophilus influenzae Rd
aaaggaaagugcg

SEQ ID NO: 2698319 - RNA, 21 nt, Haemophilus influenzae Rd
aaaggaaagugcggucaacau

SEQ ID NO: 2698320 - RNA, 14 nt, Haemophilus influenzae Rd
aaaggaaucccaua

SEQ ID NO: 2698321 - RNA, 17 nt, Haemophilus influenzae Rd
aaaggaauggcaaagaa

SEQ ID NO: 2698322 - RNA, 20 nt, Haemophilus influenzae Rd
aaaggaauggcaaagaauac

SEQ ID NO: 2698323 - RNA, 22 nt, Haemophilus influenzae Rd
aaaggacuaaaccuaugauuau

SEQ ID NO: 2698324 - RNA, 16 nt, Haemophilus influenzae Rd
aaaggacuaagcccug

SEQ ID NO: 2698325 - RNA, 20 nt, Haemophilus influenzae Rd
aaaggacuaagcccuguaga

SEQ ID NO: 2698326 - RNA, 17 nt, Haemophilus influenzae Rd
aaaggacuaagcuuuuu

SEQ ID NO: 2698327 - RNA, 17 nt, Haemophilus influenzae Rd
aaaggauuaaauaacaa

SEQ ID NO: 2698328 - RNA, 23 nt, Haemophilus influenzae Rd
aaaggcacaggaugcaccaauac

SEQ ID NO: 2698329 - RNA, 15 nt, Haemophilus influenzae Rd
aaaggcacugcgggu

SEQ ID NO: 2698330 - RNA, 17 nt, Haemophilus influenzae Rd
aaaggcauuuuuuauaa

SEQ ID NO: 2698331 - RNA, 18 nt, Haemophilus influenzae Rd
aaaggcgaacauaacuuu

SEQ ID NO: 2698332 - RNA, 20 nt, Haemophilus influenzae Rd
aaaggcgagggauuuuaaau

SEQ ID NO: 2698333 - RNA, 15 nt, Haemophilus influenzae Rd
aaaggcgcuuccaua

SEQ ID NO: 2698334 - RNA, 23 nt, Haemophilus influenzae Rd
aaaggcggauuuauuauuuaaua

SEQ ID NO: 2698335 - RNA, 23 nt, Haemophilus influenzae Rd
aaaggcugagguucaaaacuauc

SEQ ID NO: 2698336 - RNA, 17 nt, Haemophilus influenzae Rd
aaaggcugcuugauaua

SEQ ID NO: 2698337 - RNA, 17 nt, Haemophilus influenzae Rd
aaaggcuucauuugcuu

SEQ ID NO: 2698338 - RNA, 19 nt, Haemophilus influenzae Rd
aaaggcuucauuugcuucu

SEQ ID NO: 2698339 - RNA, 20 nt, Haemophilus influenzae Rd
aaaggcuuucuaacacagaa

SEQ ID NO: 2698340 - RNA, 16 nt, Haemophilus influenzae Rd
aaaggcuuucuguguu

SEQ ID NO: 2698341 - RNA, 13 nt, Haemophilus influenzae Rd
aaagggaaauaac

SEQ ID NO: 2698342 - RNA, 14 nt, Haemophilus influenzae Rd
aaagggaaauaaca

SEQ ID NO: 2698343 - RNA, 18 nt, Haemophilus influenzae Rd
aaagggaaauuuauuaua

SEQ ID NO: 2698344 - RNA, 16 nt, Haemophilus influenzae Rd
aaagggauuuuaauua

SEQ ID NO: 2698345 - RNA, 23 nt, Haemophilus influenzae Rd
aaaggguuuguuggcaacaacag

SEQ ID NO: 2698346 - RNA, 13 nt, Haemophilus influenzae Rd
aaagguaaaaauu

SEQ ID NO: 2698347 - RNA, 14 nt, Haemophilus influenzae Rd
aaagguaaaacuuu

SEQ ID NO: 2698348 - RNA, 19 nt, Haemophilus influenzae Rd
aaaggugguuucaagagga

SEQ ID NO: 2698349 - RNA, 22 nt, Haemophilus influenzae Rd
aaaggugguuuugcaaaccaaa

SEQ ID NO: 2698350 - RNA, 20 nt, Haemophilus influenzae Rd
aaagguugaaugcgccgaua

SEQ ID NO: 2698351 - RNA, 13 nt, Haemophilus influenzae Rd
aaagguugguuga

SEQ ID NO: 2698352 - RNA, 14 nt, Haemophilus influenzae Rd
aaaguaaaaauaaa

SEQ ID NO: 2698353 - RNA, 18 nt, Haemophilus influenzae Rd
aaaguaaaaauaaaaaca

SEQ ID NO: 2698354 - RNA, 15 nt, Haemophilus influenzae Rd
aaaguaaaugauaaa

SEQ ID NO: 2698355 - RNA, 14 nt, Haemophilus influenzae Rd
aaaguaacaaugua

SEQ ID NO: 2698356 - RNA, 16 nt, Haemophilus influenzae Rd
aaaguaacaauguaga

SEQ ID NO: 2698357 - RNA, 13 nt, Haemophilus influenzae Rd
aaaguaagaaacu

SEQ ID NO: 2698358 - RNA, 12 nt, Haemophilus influenzae Rd
aaaguaagaauu

SEQ ID NO: 2698359 - RNA, 19 nt, Haemophilus influenzae Rd
aaaguaaggcgagauuaaa

SEQ ID NO: 2698360 - RNA, 22 nt, Haemophilus influenzae Rd
aaaguaguuuuaguaauuuuaa

SEQ ID NO: 2698361 - RNA, 23 nt, Haemophilus influenzae Rd
aaaguauaacguagcgauaaaau

SEQ ID NO: 2698362 - RNA, 13 nt, Haemophilus influenzae Rd
aaaguauacuuuu

SEQ ID NO: 2698363 - RNA, 16 nt, Haemophilus influenzae Rd
aaaguauuaaauauaa

SEQ ID NO: 2698364 - RNA, 14 nt, Haemophilus influenzae Rd
aaaguauuaaauuu

SEQ ID NO: 2698365 - RNA, 16 nt, Haemophilus influenzae Rd
aaaguauuaaauuuuu

SEQ ID NO: 2698366 - RNA, 21 nt, Haemophilus influenzae Rd
aaaguauucauauaauucauu

SEQ ID NO: 2698367 - RNA, 22 nt, Haemophilus influenzae Rd
aaaguauuuucuuuccaaccag

SEQ ID NO: 2698368 - RNA, 19 nt, Haemophilus influenzae Rd
aaaguauuuuucuaaaucg

SEQ ID NO: 2698369 - RNA, 14 nt, Haemophilus influenzae Rd
aaagucaaaauaag

SEQ ID NO: 2698370 - RNA, 13 nt, Haemophilus influenzae Rd
aaagucccaaaag

SEQ ID NO: 2698371 - RNA, 18 nt, Haemophilus influenzae Rd
aaagucgauucaaauaac

SEQ ID NO: 2698372 - RNA, 15 nt, Haemophilus influenzae Rd
aaagucgcuuaaguc

SEQ ID NO: 2698373 - RNA, 24 nt, Haemophilus influenzae Rd
aaagucgguuuuuucauagauaaa

SEQ ID NO: 2698374 - RNA, 15 nt, Haemophilus influenzae Rd
aaagucuguuuaaaa

SEQ ID NO: 2698375 - RNA, 12 nt, Haemophilus influenzae Rd
aaagucuuaaug

SEQ ID NO: 2698376 - RNA, 23 nt, Haemophilus influenzae Rd
aaagugcagaucgcuauuuaaua

SEQ ID NO: 2698377 - RNA, 16 nt, Haemophilus influenzae Rd
aaagugcagauuuuuu

SEQ ID NO: 2698378 - RNA, 18 nt, Haemophilus influenzae Rd
aaagugcagcccaaauaa

SEQ ID NO: 2698379 - RNA, 15 nt, Haemophilus influenzae Rd
aaagugcgauauuuu

SEQ ID NO: 2698380 - RNA, 17 nt, Haemophilus influenzae Rd
aaagugcgauauuuuuu

SEQ ID NO: 2698381 - RNA, 15 nt, Haemophilus influenzae Rd
aaagugcggaaaauu

SEQ ID NO: 2698382 - RNA, 22 nt, Haemophilus influenzae Rd
aaagugcggaaaauuuuccgca

SEQ ID NO: 2698383 - RNA, 22 nt, Haemophilus influenzae Rd
aaagugcggaaauauuuuaaua

SEQ ID NO: 2698384 - RNA, 15 nt, Haemophilus influenzae Rd
aaagugcggcaaaaa

SEQ ID NO: 2698385 - RNA, 18 nt, Haemophilus influenzae Rd
aaagugcggcuucauuuu

SEQ ID NO: 2698386 - RNA, 17 nt, Haemophilus influenzae Rd
aaagugcgguaaaaauu

SEQ ID NO: 2698387 - RNA, 18 nt, Haemophilus influenzae Rd
aaagugcgguaaaaauua

SEQ ID NO: 2698388 - RNA, 17 nt, Haemophilus influenzae Rd
aaagugcgguaaaauca

SEQ ID NO: 2698389 - RNA, 18 nt, Haemophilus influenzae Rd
aaagugcgguaaaaucac

SEQ ID NO: 2698390 - RNA, 16 nt, Haemophilus influenzae Rd
aaagugcgguaaauuu

SEQ ID NO: 2698391 - RNA, 21 nt, Haemophilus influenzae Rd
aaagugcgguaaauuuuaaaa

SEQ ID NO: 2698392 - RNA, 18 nt, Haemophilus influenzae Rd
aaagugcgguaaauuuuu

SEQ ID NO: 2698393 - RNA, 18 nt, Haemophilus influenzae Rd
aaagugcgguaagaaaau

SEQ ID NO: 2698394 - RNA, 20 nt, Haemophilus influenzae Rd
aaagugcgguaagaaaauca

SEQ ID NO: 2698395 - RNA, 22 nt, Haemophilus influenzae Rd
aaagugcgguaagaaaaucaac

SEQ ID NO: 2698396 - RNA, 17 nt, Haemophilus influenzae Rd
aaagugcgguaauuuuu

SEQ ID NO: 2698397 - RNA, 17 nt, Haemophilus influenzae Rd
aaagugcgguauuuuuu

SEQ ID NO: 2698398 - RNA, 21 nt, Haemophilus influenzae Rd
aaagugcggucaauaaaaaua

SEQ ID NO: 2698399 - RNA, 17 nt, Haemophilus influenzae Rd
aaagugcggucauuuuu

SEQ ID NO: 2698400 - RNA, 21 nt, Haemophilus influenzae Rd
aaagugcggugcaauuugaaa

SEQ ID NO: 2698401 - RNA, 22 nt, Haemophilus influenzae Rd
aaagugcgguuaaaauuuaaua

SEQ ID NO: 2698402 - RNA, 20 nt, Haemophilus influenzae Rd
aaagugcgguuaauuuuuac

SEQ ID NO: 2698403 - RNA, 19 nt, Haemophilus influenzae Rd
aaagugcgguuaauuuuuu

SEQ ID NO: 2698404 - RNA, 23 nt, Haemophilus influenzae Rd
aaagugcgguuaauuuuuuguuc

SEQ ID NO: 2698405 - RNA, 18 nt, Haemophilus influenzae Rd
aaagugcgguuauuuuuu

SEQ ID NO: 2698406 - RNA, 20 nt, Haemophilus influenzae Rd
aaagugcgguugaauuuuuu

SEQ ID NO: 2698407 - RNA, 20 nt, Haemophilus influenzae Rd
aaagugcgguugauuuuccu

SEQ ID NO: 2698408 - RNA, 18 nt, Haemophilus influenzae Rd
aaaguggagaaacauuuu

SEQ ID NO: 2698409 - RNA, 22 nt, Haemophilus influenzae Rd
aaaguggagaaacauuuuuccc

SEQ ID NO: 2698410 - RNA, 21 nt, Haemophilus influenzae Rd
aaaguggguagcuuucgcuau

SEQ ID NO: 2698411 - RNA, 20 nt, Haemophilus influenzae Rd
aaaguguagcaaguccaagu

SEQ ID NO: 2698412 - RNA, 14 nt, Haemophilus influenzae Rd
aaaguguauaaaua

SEQ ID NO: 2698413 - RNA, 17 nt, Haemophilus influenzae Rd
aaaguuaaucaaacuuu

SEQ ID NO: 2698414 - RNA, 19 nt, Haemophilus influenzae Rd
aaaguuaaucaaacuuuua

SEQ ID NO: 2698415 - RNA, 22 nt, Haemophilus influenzae Rd
aaaguuacgauuguauuuuaaa

SEQ ID NO: 2698416 - RNA, 17 nt, Haemophilus influenzae Rd
aaaguuacuuugcauuu

SEQ ID NO: 2698417 - RNA, 21 nt, Haemophilus influenzae Rd
aaaguuagauugauuuaguuc

SEQ ID NO: 2698418 - RNA, 23 nt, Haemophilus influenzae Rd
aaaguuaggcuaagguuuaacug

SEQ ID NO: 2698419 - RNA, 19 nt, Haemophilus influenzae Rd
aaaguuccuagaauuaaaa

SEQ ID NO: 2698420 - RNA, 21 nt, Haemophilus influenzae Rd
aaaguucucgcaaaagugcgg

SEQ ID NO: 2698421 - RNA, 22 nt, Haemophilus influenzae Rd
aaaguucucgcaaaagugcggu

SEQ ID NO: 2698422 - RNA, 18 nt, Haemophilus influenzae Rd
aaaguucuuuuuuggcuu

SEQ ID NO: 2698423 - RNA, 15 nt, Haemophilus influenzae Rd
aaaguugaauauuuu

SEQ ID NO: 2698424 - RNA, 16 nt, Haemophilus influenzae Rd
aaaguugagaauuuuu

SEQ ID NO: 2698425 - RNA, 23 nt, Haemophilus influenzae Rd
aaaguugagacaaauuuuauaua

SEQ ID NO: 2698426 - RNA, 21 nt, Haemophilus influenzae Rd
aaaguuggacuaaacaacuaa

SEQ ID NO: 2698427 - RNA, 13 nt, Haemophilus influenzae Rd
aaaguuggauuaa

SEQ ID NO: 2698428 - RNA, 20 nt, Haemophilus influenzae Rd
aaaguuggcuuacagcaaaa

SEQ ID NO: 2698429 - RNA, 16 nt, Haemophilus influenzae Rd
aaaguuguacuauuuu

SEQ ID NO: 2698430 - RNA, 23 nt, Haemophilus influenzae Rd
aaaguuuccuucgccauuuuuaa

SEQ ID NO: 2698431 - RNA, 23 nt, Haemophilus influenzae Rd
aaaguuucuguugauuuaucaua

SEQ ID NO: 2698432 - RNA, 13 nt, Haemophilus influenzae Rd
aaaguuucuuuua

SEQ ID NO: 2698433 - RNA, 18 nt, Haemophilus influenzae Rd
aaaguuugacuauucuaa

SEQ ID NO: 2698434 - RNA, 18 nt, Haemophilus influenzae Rd
aaaguuugauuaacuuuc

SEQ ID NO: 2698435 - RNA, 14 nt, Haemophilus influenzae Rd
aaauaaaaaauaaa

SEQ ID NO: 2698436 - RNA, 23 nt, Haemophilus influenzae Rd
aaauaaaaaauccacacuuuaau

SEQ ID NO: 2698437 - RNA, 12 nt, Haemophilus influenzae Rd
aaauaaaaacau

SEQ ID NO: 2698438 - RNA, 19 nt, Haemophilus influenzae Rd
aaauaaaaaugaauaaaau

SEQ ID NO: 2698439 - RNA, 16 nt, Haemophilus influenzae Rd
aaauaaaaaugaugau

SEQ ID NO: 2698440 - RNA, 12 nt, Haemophilus influenzae Rd
aaauaaaacaag

SEQ ID NO: 2698441 - RNA, 20 nt, Haemophilus influenzae Rd
aaauaaaacccaguuuaaaa

SEQ ID NO: 2698442 - RNA, 17 nt, Haemophilus influenzae Rd
aaauaaaagaauuuuua

SEQ ID NO: 2698443 - RNA, 16 nt, Haemophilus influenzae Rd
aaauaaaauagacaau

SEQ ID NO: 2698444 - RNA, 18 nt, Haemophilus influenzae Rd
aaauaaaauagacaauau

SEQ ID NO: 2698445 - RNA, 13 nt, Haemophilus influenzae Rd
aaauaaaauauuu

SEQ ID NO: 2698446 - RNA, 13 nt, Haemophilus influenzae Rd
aaauaaaauuaca

SEQ ID NO: 2698447 - RNA, 16 nt, Haemophilus influenzae Rd
aaauaaaauuacaaaa

SEQ ID NO: 2698448 - RNA, 17 nt, Haemophilus influenzae Rd
aaauaaacaaacuuuca

SEQ ID NO: 2698449 - RNA, 14 nt, Haemophilus influenzae Rd
aaauaaacacaaac

SEQ ID NO: 2698450 - RNA, 20 nt, Haemophilus influenzae Rd
aaauaaaccgcaucaaaauu

SEQ ID NO: 2698451 - RNA, 11 nt, Haemophilus influenzae Rd
aaauaaagaag

SEQ ID NO: 2698452 - RNA, 22 nt, Haemophilus influenzae Rd
aaauaaagauagguacaaguaa

SEQ ID NO: 2698453 - RNA, 14 nt, Haemophilus influenzae Rd
aaauaaagcccugu

SEQ ID NO: 2698454 - RNA, 14 nt, Haemophilus influenzae Rd
aaauaaaggauuaa

SEQ ID NO: 2698455 - RNA, 17 nt, Haemophilus influenzae Rd
aaauaaaggauuaaaua

SEQ ID NO: 2698456 - RNA, 23 nt, Haemophilus influenzae Rd
aaauaaagugcggucaauuuuca

SEQ ID NO: 2698457 - RNA, 13 nt, Haemophilus influenzae Rd
aaauaaauaaaau

SEQ ID NO: 2698458 - RNA, 15 nt, Haemophilus influenzae Rd
aaauaaauaaaauau

SEQ ID NO: 2698459 - RNA, 12 nt, Haemophilus influenzae Rd
aaauaaauaaua

SEQ ID NO: 2698460 - RNA, 12 nt, Haemophilus influenzae Rd
aaauaaaucaau

SEQ ID NO: 2698461 - RNA, 21 nt, Haemophilus influenzae Rd
aaauaaauggucaaugccaaa

SEQ ID NO: 2698462 - RNA, 21 nt, Haemophilus influenzae Rd
aaauaaauuaacuuaucuaaa

SEQ ID NO: 2698463 - RNA, 20 nt, Haemophilus influenzae Rd
aaauaaauuuauuuaauaau

SEQ ID NO: 2698464 - RNA, 14 nt, Haemophilus influenzae Rd
aaauaaauuuuaaa

SEQ ID NO: 2698465 - RNA, 24 nt, Haemophilus influenzae Rd
aaauaacaaaaaagcuaagacauu

SEQ ID NO: 2698466 - RNA, 18 nt, Haemophilus influenzae Rd
aaauaacauaacuaucac

SEQ ID NO: 2698467 - RNA, 19 nt, Haemophilus influenzae Rd
aaauaacaucgcuaaaucu

SEQ ID NO: 2698468 - RNA, 16 nt, Haemophilus influenzae Rd
aaauaaccaauauaau

SEQ ID NO: 2698469 - RNA, 12 nt, Haemophilus influenzae Rd
aaauaaccacua

SEQ ID NO: 2698470 - RNA, 17 nt, Haemophilus influenzae Rd
aaauaaccgcacuuuau

SEQ ID NO: 2698471 - RNA, 23 nt, Haemophilus influenzae Rd
aaauaaccuaauuucauaaaaau

SEQ ID NO: 2698472 - RNA, 16 nt, Haemophilus influenzae Rd
aaauaaccuauaauag

SEQ ID NO: 2698473 - RNA, 18 nt, Haemophilus influenzae Rd
aaauaaccuaucccaaaa

SEQ ID NO: 2698474 - RNA, 21 nt, Haemophilus influenzae Rd
aaauaacgucauuaauuuuuu

SEQ ID NO: 2698475 - RNA, 18 nt, Haemophilus influenzae Rd
aaauaacuucauccauuu

SEQ ID NO: 2698476 - RNA, 14 nt, Haemophilus influenzae Rd
aaauaagcauaaaa

SEQ ID NO: 2698477 - RNA, 17 nt, Haemophilus influenzae Rd
aaauaaggcguaaaacu

SEQ ID NO: 2698478 - RNA, 19 nt, Haemophilus influenzae Rd
aaauaaggcguaaaacuau

SEQ ID NO: 2698479 - RNA, 17 nt, Haemophilus influenzae Rd
aaauaaggcucaacacc

SEQ ID NO: 2698480 - RNA, 19 nt, Haemophilus influenzae Rd
aaauaagggauauuuuuua

SEQ ID NO: 2698481 - RNA, 17 nt, Haemophilus influenzae Rd
aaauaagggcugauuuu

SEQ ID NO: 2698482 - RNA, 16 nt, Haemophilus influenzae Rd
aaauaagguucgucau

SEQ ID NO: 2698483 - RNA, 17 nt, Haemophilus influenzae Rd
aaauaaguucaucaacu

SEQ ID NO: 2698484 - RNA, 15 nt, Haemophilus influenzae Rd
aaauaauaaaauagc

SEQ ID NO: 2698485 - RNA, 24 nt, Haemophilus influenzae Rd
aaauaauaggauaaauaaacuauu

SEQ ID NO: 2698486 - RNA, 14 nt, Haemophilus influenzae Rd
aaauaauauauuau

SEQ ID NO: 2698487 - RNA, 17 nt, Haemophilus influenzae Rd
aaauaauauucaaaaca

SEQ ID NO: 2698488 - RNA, 18 nt, Haemophilus influenzae Rd
aaauaauauucaaaacau

SEQ ID NO: 2698489 - RNA, 21 nt, Haemophilus influenzae Rd
aaauaauauucaaaacauuaa

SEQ ID NO: 2698490 - RNA, 17 nt, Haemophilus influenzae Rd
aaauaaucacuugaagu

SEQ ID NO: 2698491 - RNA, 21 nt, Haemophilus influenzae Rd
aaauaaucacuugaagucuau

SEQ ID NO: 2698492 - RNA, 17 nt, Haemophilus influenzae Rd
aaauaaucguuuuucca

SEQ ID NO: 2698493 - RNA, 21 nt, Haemophilus influenzae Rd
aaauaaugcccgcacuuuuaa

SEQ ID NO: 2698494 - RNA, 22 nt, Haemophilus influenzae Rd
aaauaaugcccgcacuuuuaac

SEQ ID NO: 2698495 - RNA, 18 nt, Haemophilus influenzae Rd
aaauaaugcccuaauucu

SEQ ID NO: 2698496 - RNA, 15 nt, Haemophilus influenzae Rd
aaauaauguguugau

SEQ ID NO: 2698497 - RNA, 17 nt, Haemophilus influenzae Rd
aaauaauguuaaaucua

SEQ ID NO: 2698498 - RNA, 13 nt, Haemophilus influenzae Rd
aaauaauuaaaaa

SEQ ID NO: 2698499 - RNA, 16 nt, Haemophilus influenzae Rd
aaauaauuaaaaauaa

SEQ ID NO: 2698500 - RNA, 23 nt, Haemophilus influenzae Rd
aaauaauuauggugaauaaaacc

SEQ ID NO: 2698501 - RNA, 22 nt, Haemophilus influenzae Rd
aaauaauucaagaugauauuua

SEQ ID NO: 2698502 - RNA, 14 nt, Haemophilus influenzae Rd
aaauaauuuccuuu

SEQ ID NO: 2698503 - RNA, 22 nt, Haemophilus influenzae Rd
aaauaauuuccuuuuuuauuua

SEQ ID NO: 2698504 - RNA, 15 nt, Haemophilus influenzae Rd
aaauaauuuuacuug

SEQ ID NO: 2698505 - RNA, 20 nt, Haemophilus influenzae Rd
aaauaauuuuacuugugcau

SEQ ID NO: 2698506 - RNA, 13 nt, Haemophilus influenzae Rd
aaauaauuuucuu

SEQ ID NO: 2698507 - RNA, 15 nt, Haemophilus influenzae Rd
aaauaauuuucuuug

SEQ ID NO: 2698508 - RNA, 16 nt, Haemophilus influenzae Rd
aaauaauuuucuuugc

SEQ ID NO: 2698509 - RNA, 12 nt, Haemophilus influenzae Rd
aaauaauuuuuu

SEQ ID NO: 2698510 - RNA, 18 nt, Haemophilus influenzae Rd
aaauaauuuuuugaauau

SEQ ID NO: 2698511 - RNA, 14 nt, Haemophilus influenzae Rd
aaauacaauuuuuu

SEQ ID NO: 2698512 - RNA, 21 nt, Haemophilus influenzae Rd
aaauacaauuuuuuucaagca

SEQ ID NO: 2698513 - RNA, 17 nt, Haemophilus influenzae Rd
aaauacaccaagcauua

SEQ ID NO: 2698514 - RNA, 17 nt, Haemophilus influenzae Rd
aaauacagccacuauua

SEQ ID NO: 2698515 - RNA, 13 nt, Haemophilus influenzae Rd
aaauacagcucaa

SEQ ID NO: 2698516 - RNA, 15 nt, Haemophilus influenzae Rd
aaauacauauuuuua

SEQ ID NO: 2698517 - RNA, 14 nt, Haemophilus influenzae Rd
aaauacauuuuuau

SEQ ID NO: 2698518 - RNA, 14 nt, Haemophilus influenzae Rd
aaauacauuuuuga

SEQ ID NO: 2698519 - RNA, 19 nt, Haemophilus influenzae Rd
aaauaccccaauuaaguca

SEQ ID NO: 2698520 - RNA, 17 nt, Haemophilus influenzae Rd
aaauaccgcacuuuuau

SEQ ID NO: 2698521 - RNA, 18 nt, Haemophilus influenzae Rd
aaauaccgcacuuuuauu

SEQ ID NO: 2698522 - RNA, 15 nt, Haemophilus influenzae Rd
aaauaccgcuugaau

SEQ ID NO: 2698523 - RNA, 19 nt, Haemophilus influenzae Rd
aaauacgauagguaaacuu

SEQ ID NO: 2698524 - RNA, 13 nt, Haemophilus influenzae Rd
aaauacguuguuu

SEQ ID NO: 2698525 - RNA, 16 nt, Haemophilus influenzae Rd
aaauacguuguuuuuc

SEQ ID NO: 2698526 - RNA, 18 nt, Haemophilus influenzae Rd
aaauacuaauaggaguaa

SEQ ID NO: 2698527 - RNA, 21 nt, Haemophilus influenzae Rd
aaauacuaauaggaguaaaaa

SEQ ID NO: 2698528 - RNA, 23 nt, Haemophilus influenzae Rd
aaauacugcacaaucaaaccaau

SEQ ID NO: 2698529 - RNA, 14 nt, Haemophilus influenzae Rd
aaauacuguuuuau

SEQ ID NO: 2698530 - RNA, 19 nt, Haemophilus influenzae Rd
aaauacuugcuuaugcaaa

SEQ ID NO: 2698531 - RNA, 21 nt, Haemophilus influenzae Rd
aaauacuugcuuaugcaaagu

SEQ ID NO: 2698532 - RNA, 23 nt, Haemophilus influenzae Rd
aaauagaagcguucaucuuauaa

SEQ ID NO: 2698533 - RNA, 18 nt, Haemophilus influenzae Rd
aaauagaaugaaaaacau

SEQ ID NO: 2698534 - RNA, 19 nt, Haemophilus influenzae Rd
aaauagaccgcuauuuuua

SEQ ID NO: 2698535 - RNA, 23 nt, Haemophilus influenzae Rd
aaauagaccgcuauuuuuaauuu

SEQ ID NO: 2698536 - RNA, 16 nt, Haemophilus influenzae Rd
aaauagacuacuuaaa

SEQ ID NO: 2698537 - RNA, 17 nt, Haemophilus influenzae Rd
aaauagacuacuuaaaa

SEQ ID NO: 2698538 - RNA, 19 nt, Haemophilus influenzae Rd
aaauagagcaaauauaaau

SEQ ID NO: 2698539 - RNA, 23 nt, Haemophilus influenzae Rd
aaauagaggacuugcguugauuu

SEQ ID NO: 2698540 - RNA, 16 nt, Haemophilus influenzae Rd
aaauagauacaagaaa

SEQ ID NO: 2698541 - RNA, 19 nt, Haemophilus influenzae Rd
aaauagauacaagaaagaa

SEQ ID NO: 2698542 - RNA, 20 nt, Haemophilus influenzae Rd
aaauagauacaagaaagaaa

SEQ ID NO: 2698543 - RNA, 23 nt, Haemophilus influenzae Rd
aaauagauacaagaaagaaauau

SEQ ID NO: 2698544 - RNA, 16 nt, Haemophilus influenzae Rd
aaauagaugaaauuua

SEQ ID NO: 2698545 - RNA, 19 nt, Haemophilus influenzae Rd
aaauagaugaaauuuauua

SEQ ID NO: 2698546 - RNA, 22 nt, Haemophilus influenzae Rd
aaauagcccuacuuaguaauau

SEQ ID NO: 2698547 - RNA, 21 nt, Haemophilus influenzae Rd
aaauagcgaucugcacuuuaa

SEQ ID NO: 2698548 - RNA, 18 nt, Haemophilus influenzae Rd
aaauagcugauaauaaag

SEQ ID NO: 2698549 - RNA, 12 nt, Haemophilus influenzae Rd
aaauaggaaagg

SEQ ID NO: 2698550 - RNA, 17 nt, Haemophilus influenzae Rd
aaauaggcacauaagua

SEQ ID NO: 2698551 - RNA, 16 nt, Haemophilus influenzae Rd
aaauagucauaaaggc

SEQ ID NO: 2698552 - RNA, 15 nt, Haemophilus influenzae Rd
aaauaguuaaagaaa

SEQ ID NO: 2698553 - RNA, 17 nt, Haemophilus influenzae Rd
aaauaguuaaagaaaau

SEQ ID NO: 2698554 - RNA, 21 nt, Haemophilus influenzae Rd
aaauaguuaaucgaaaauuua

SEQ ID NO: 2698555 - RNA, 19 nt, Haemophilus influenzae Rd
aaauaguuaauugauuuaa

SEQ ID NO: 2698556 - RNA, 18 nt, Haemophilus influenzae Rd
aaauaguuauuuauuccu

SEQ ID NO: 2698557 - RNA, 13 nt, Haemophilus influenzae Rd
aaauaguuuaaua

SEQ ID NO: 2698558 - RNA, 16 nt, Haemophilus influenzae Rd
aaauaguuuucacaau

SEQ ID NO: 2698559 - RNA, 17 nt, Haemophilus influenzae Rd
aaauaguuuucacaauc

SEQ ID NO: 2698560 - RNA, 18 nt, Haemophilus influenzae Rd
aaauauaaaacuuuucuu

SEQ ID NO: 2698561 - RNA, 13 nt, Haemophilus influenzae Rd
aaauauaaaauaa

SEQ ID NO: 2698562 - RNA, 14 nt, Haemophilus influenzae Rd
aaauauaaaauaaa

SEQ ID NO: 2698563 - RNA, 15 nt, Haemophilus influenzae Rd
aaauauaaaauaaaa

SEQ ID NO: 2698564 - RNA, 14 nt, Haemophilus influenzae Rd
aaauauaaauaguu

SEQ ID NO: 2698565 - RNA, 17 nt, Haemophilus influenzae Rd
aaauauaagaaaaacau

SEQ ID NO: 2698566 - RNA, 14 nt, Haemophilus influenzae Rd
aaauauaauaaaua

SEQ ID NO: 2698567 - RNA, 13 nt, Haemophilus influenzae Rd
aaauauaaugaaa

SEQ ID NO: 2698568 - RNA, 14 nt, Haemophilus influenzae Rd
aaauauaauuaauc

SEQ ID NO: 2698569 - RNA, 18 nt, Haemophilus influenzae Rd
aaauauacaauucuuguu

SEQ ID NO: 2698570 - RNA, 16 nt, Haemophilus influenzae Rd
aaauauacagcacuaa

SEQ ID NO: 2698571 - RNA, 18 nt, Haemophilus influenzae Rd
aaauauaggguaaauaaa

SEQ ID NO: 2698572 - RNA, 19 nt, Haemophilus influenzae Rd
aaauauaggguaaauaaaa

SEQ ID NO: 2698573 - RNA, 21 nt, Haemophilus influenzae Rd
aaauauaggguaaauaaaaau

SEQ ID NO: 2698574 - RNA, 14 nt, Haemophilus influenzae Rd
aaauauaucaagca

SEQ ID NO: 2698575 - RNA, 15 nt, Haemophilus influenzae Rd
aaauauauccauaaa

SEQ ID NO: 2698576 - RNA, 18 nt, Haemophilus influenzae Rd
aaauauaugggaaacaau

SEQ ID NO: 2698577 - RNA, 19 nt, Haemophilus influenzae Rd
aaauauaugggaaacaaua

SEQ ID NO: 2698578 - RNA, 23 nt, Haemophilus influenzae Rd
aaauauauuauugugauaauuaa

SEQ ID NO: 2698579 - RNA, 19 nt, Haemophilus influenzae Rd
aaauauauuuagauacaaa

SEQ ID NO: 2698580 - RNA, 20 nt, Haemophilus influenzae Rd
aaauauauuuagauacaaaa

SEQ ID NO: 2698581 - RNA, 13 nt, Haemophilus influenzae Rd
aaauauauuuuua

SEQ ID NO: 2698582 - RNA, 15 nt, Haemophilus influenzae Rd
aaauaucaaaaaaau

SEQ ID NO: 2698583 - RNA, 14 nt, Haemophilus influenzae Rd
aaauaucaaaguuc

SEQ ID NO: 2698584 - RNA, 19 nt, Haemophilus influenzae Rd
aaauaucaacagcuucucc

SEQ ID NO: 2698585 - RNA, 20 nt, Haemophilus influenzae Rd
aaauaucaacagcuucuccu

SEQ ID NO: 2698586 - RNA, 13 nt, Haemophilus influenzae Rd
aaauaucacuuuu

SEQ ID NO: 2698587 - RNA, 23 nt, Haemophilus influenzae Rd
aaauaucagcccuuuguuuuaau

SEQ ID NO: 2698588 - RNA, 23 nt, Haemophilus influenzae Rd
aaauauccccauugaauuaaaaa

SEQ ID NO: 2698589 - RNA, 22 nt, Haemophilus influenzae Rd
aaauauccguuacauauuucac

SEQ ID NO: 2698590 - RNA, 15 nt, Haemophilus influenzae Rd
aaauaucgcaaucaa

SEQ ID NO: 2698591 - RNA, 21 nt, Haemophilus influenzae Rd
aaauaucggcaucuacaccuu

SEQ ID NO: 2698592 - RNA, 16 nt, Haemophilus influenzae Rd
aaauaucuacuuucag

SEQ ID NO: 2698593 - RNA, 13 nt, Haemophilus influenzae Rd
aaauaucuucaau

SEQ ID NO: 2698594 - RNA, 21 nt, Haemophilus influenzae Rd
aaauaucuucaauuucuaccg

SEQ ID NO: 2698595 - RNA, 21 nt, Haemophilus influenzae Rd
aaauaucuucauaucuuugaa

SEQ ID NO: 2698596 - RNA, 15 nt, Haemophilus influenzae Rd
aaauaucuuguuuua

SEQ ID NO: 2698597 - RNA, 22 nt, Haemophilus influenzae Rd
aaauaucuuugauuuucuuauu

SEQ ID NO: 2698598 - RNA, 12 nt, Haemophilus influenzae Rd
aaauaugauaaa

SEQ ID NO: 2698599 - RNA, 16 nt, Haemophilus influenzae Rd
aaauaugauaaaugca

SEQ ID NO: 2698600 - RNA, 19 nt, Haemophilus influenzae Rd
aaauaugauuuagaacaau

SEQ ID NO: 2698601 - RNA, 23 nt, Haemophilus influenzae Rd
aaauaugcaucagauuuuucgca

SEQ ID NO: 2698602 - RNA, 15 nt, Haemophilus influenzae Rd
aaauaugccuuauau

SEQ ID NO: 2698603 - RNA, 20 nt, Haemophilus influenzae Rd
aaauaugccuuauauuucac

SEQ ID NO: 2698604 - RNA, 16 nt, Haemophilus influenzae Rd
aaauauuaaagaguua

SEQ ID NO: 2698605 - RNA, 15 nt, Haemophilus influenzae Rd
aaauauuacuuaaca

SEQ ID NO: 2698606 - RNA, 15 nt, Haemophilus influenzae Rd
aaauauucaauuaca

SEQ ID NO: 2698607 - RNA, 17 nt, Haemophilus influenzae Rd
aaauauuccaacgauuu

SEQ ID NO: 2698608 - RNA, 21 nt, Haemophilus influenzae Rd
aaauauuccaacgauuuugca

SEQ ID NO: 2698609 - RNA, 15 nt, Haemophilus influenzae Rd
aaauauucuauuuau

SEQ ID NO: 2698610 - RNA, 21 nt, Haemophilus influenzae Rd
aaauauucucucgcugaauua

SEQ ID NO: 2698611 - RNA, 22 nt, Haemophilus influenzae Rd
aaauauucucucgcugaauuau

SEQ ID NO: 2698612 - RNA, 15 nt, Haemophilus influenzae Rd
aaauauucuucauaa

SEQ ID NO: 2698613 - RNA, 16 nt, Haemophilus influenzae Rd
aaauauucuucauaaa

SEQ ID NO: 2698614 - RNA, 18 nt, Haemophilus influenzae Rd
aaauauugaguauucccc

SEQ ID NO: 2698615 - RNA, 13 nt, Haemophilus influenzae Rd
aaauauugauuau

SEQ ID NO: 2698616 - RNA, 18 nt, Haemophilus influenzae Rd
aaauauugccugaguuau

SEQ ID NO: 2698617 - RNA, 16 nt, Haemophilus influenzae Rd
aaauauugcucucccu

SEQ ID NO: 2698618 - RNA, 21 nt, Haemophilus influenzae Rd
aaauauuggaguuagaauaau

SEQ ID NO: 2698619 - RNA, 18 nt, Haemophilus influenzae Rd
aaauauugguuauuuaaa

SEQ ID NO: 2698620 - RNA, 23 nt, Haemophilus influenzae Rd
aaauauugguuauuuaaaccauu

SEQ ID NO: 2698621 - RNA, 15 nt, Haemophilus influenzae Rd
aaauauuguccuaau

SEQ ID NO: 2698622 - RNA, 22 nt, Haemophilus influenzae Rd
aaauauuguccuaauuaauuua

SEQ ID NO: 2698623 - RNA, 23 nt, Haemophilus influenzae Rd
aaauauugucuauuugcuuuccc

SEQ ID NO: 2698624 - RNA, 11 nt, Haemophilus influenzae Rd
aaauauuuaaa

SEQ ID NO: 2698625 - RNA, 12 nt, Haemophilus influenzae Rd
aaauauuuaaaa

SEQ ID NO: 2698626 - RNA, 17 nt, Haemophilus influenzae Rd
aaauauuuaaaaagaau

SEQ ID NO: 2698627 - RNA, 16 nt, Haemophilus influenzae Rd
aaauauuuacgacuaa

SEQ ID NO: 2698628 - RNA, 21 nt, Haemophilus influenzae Rd
aaauauuuacgacuaaaauua

SEQ ID NO: 2698629 - RNA, 21 nt, Haemophilus influenzae Rd
aaauauuuauacacuuuuaac

SEQ ID NO: 2698630 - RNA, 20 nt, Haemophilus influenzae Rd
aaauauuucaguauuuuaau

SEQ ID NO: 2698631 - RNA, 20 nt, Haemophilus influenzae Rd
aaauauuuccgcacuuuacg

SEQ ID NO: 2698632 - RNA, 23 nt, Haemophilus influenzae Rd
aaauauuuggcugauauauuaac

SEQ ID NO: 2698633 - RNA, 12 nt, Haemophilus influenzae Rd
aaauauuuuaau

SEQ ID NO: 2698634 - RNA, 14 nt, Haemophilus influenzae Rd
aaauauuuuaauaa

SEQ ID NO: 2698635 - RNA, 20 nt, Haemophilus influenzae Rd
aaauauuuucauuuauguua

SEQ ID NO: 2698636 - RNA, 18 nt, Haemophilus influenzae Rd
aaauauuuuccccuuucc

SEQ ID NO: 2698637 - RNA, 12 nt, Haemophilus influenzae Rd
aaauauuuuuau

SEQ ID NO: 2698638 - RNA, 19 nt, Haemophilus influenzae Rd
aaauauuuuuuaguuuguu

SEQ ID NO: 2698639 - RNA, 19 nt, Haemophilus influenzae Rd
aaauauuuuuuauuuuuuu

SEQ ID NO: 2698640 - RNA, 13 nt, Haemophilus influenzae Rd
aaaucaaaaauaa

SEQ ID NO: 2698641 - RNA, 15 nt, Haemophilus influenzae Rd
aaaucaaaaauuaag

SEQ ID NO: 2698642 - RNA, 22 nt, Haemophilus influenzae Rd
aaaucaaaacgaucuaaaaaug

SEQ ID NO: 2698643 - RNA, 15 nt, Haemophilus influenzae Rd
aaaucaaaagaaauu

SEQ ID NO: 2698644 - RNA, 17 nt, Haemophilus influenzae Rd
aaaucaaaagaaauuaa

SEQ ID NO: 2698645 - RNA, 17 nt, Haemophilus influenzae Rd
aaaucaaagugcgguaa

SEQ ID NO: 2698646 - RNA, 22 nt, Haemophilus influenzae Rd
aaaucaaagugcgguaaauuuu

SEQ ID NO: 2698647 - RNA, 13 nt, Haemophilus influenzae Rd
aaaucaaauaauu

SEQ ID NO: 2698648 - RNA, 19 nt, Haemophilus influenzae Rd
aaaucaaauaauucaagau

SEQ ID NO: 2698649 - RNA, 15 nt, Haemophilus influenzae Rd
aaaucaaauuuagga

SEQ ID NO: 2698650 - RNA, 15 nt, Haemophilus influenzae Rd
aaaucaaauuuuccu

SEQ ID NO: 2698651 - RNA, 13 nt, Haemophilus influenzae Rd
aaaucaacaagac

SEQ ID NO: 2698652 - RNA, 22 nt, Haemophilus influenzae Rd
aaaucaagcccucgaauauuga

SEQ ID NO: 2698653 - RNA, 13 nt, Haemophilus influenzae Rd
aaaucaagcuaag

SEQ ID NO: 2698654 - RNA, 21 nt, Haemophilus influenzae Rd
aaaucaagcuaagauugacaa

SEQ ID NO: 2698655 - RNA, 14 nt, Haemophilus influenzae Rd
aaaucaaguuaaaa

SEQ ID NO: 2698656 - RNA, 15 nt, Haemophilus influenzae Rd
aaaucaaguuaaaaa

SEQ ID NO: 2698657 - RNA, 17 nt, Haemophilus influenzae Rd
aaaucaaguuaaaaaau

SEQ ID NO: 2698658 - RNA, 20 nt, Haemophilus influenzae Rd
aaaucaaucaggcuuucauu

SEQ ID NO: 2698659 - RNA, 22 nt, Haemophilus influenzae Rd
aaaucaaucaggcuuucauuuu

SEQ ID NO: 2698660 - RNA, 23 nt, Haemophilus influenzae Rd
aaaucaauguuuucagcuucaau

SEQ ID NO: 2698661 - RNA, 13 nt, Haemophilus influenzae Rd
aaaucaauuaacu

SEQ ID NO: 2698662 - RNA, 16 nt, Haemophilus influenzae Rd
aaaucaauuaacuauu

SEQ ID NO: 2698663 - RNA, 15 nt, Haemophilus influenzae Rd
aaaucacauaaaaaa

SEQ ID NO: 2698664 - RNA, 19 nt, Haemophilus influenzae Rd
aaaucaccgcacuuuuauu

SEQ ID NO: 2698665 - RNA, 18 nt, Haemophilus influenzae Rd
aaaucaccuaaaucuuua

SEQ ID NO: 2698666 - RNA, 15 nt, Haemophilus influenzae Rd
aaaucacgaauugau

SEQ ID NO: 2698667 - RNA, 20 nt, Haemophilus influenzae Rd
aaaucacgccagauaaaauu

SEQ ID NO: 2698668 - RNA, 17 nt, Haemophilus influenzae Rd
aaaucagcgcauuuuuu

SEQ ID NO: 2698669 - RNA, 17 nt, Haemophilus influenzae Rd
aaaucagcuaauaacac

SEQ ID NO: 2698670 - RNA, 18 nt, Haemophilus influenzae Rd
aaaucagcuaauaacaca

SEQ ID NO: 2698671 - RNA, 15 nt, Haemophilus influenzae Rd
aaaucagcuuuuguu

SEQ ID NO: 2698672 - RNA, 15 nt, Haemophilus influenzae Rd
aaaucauaaucugaa

SEQ ID NO: 2698673 - RNA, 18 nt, Haemophilus influenzae Rd
aaaucauaaucugaaagu

SEQ ID NO: 2698674 - RNA, 14 nt, Haemophilus influenzae Rd
aaaucauaccaauu

SEQ ID NO: 2698675 - RNA, 16 nt, Haemophilus influenzae Rd
aaaucauauugauuua

SEQ ID NO: 2698676 - RNA, 20 nt, Haemophilus influenzae Rd
aaaucauauuucuucgauuu

SEQ ID NO: 2698677 - RNA, 16 nt, Haemophilus influenzae Rd
aaaucaucaaagcuca

SEQ ID NO: 2698678 - RNA, 13 nt, Haemophilus influenzae Rd
aaaucaucauauu

SEQ ID NO: 2698679 - RNA, 21 nt, Haemophilus influenzae Rd
aaaucaucauauucacuuuca

SEQ ID NO: 2698680 - RNA, 22 nt, Haemophilus influenzae Rd
aaaucaucauauucacuuucau

SEQ ID NO: 2698681 - RNA, 17 nt, Haemophilus influenzae Rd
aaaucaucgaaaucuaa

SEQ ID NO: 2698682 - RNA, 20 nt, Haemophilus influenzae Rd
aaaucaucggcuacagguuc

SEQ ID NO: 2698683 - RNA, 15 nt, Haemophilus influenzae Rd
aaaucaugaauaauu

SEQ ID NO: 2698684 - RNA, 13 nt, Haemophilus influenzae Rd
aaaucauuaaaua

SEQ ID NO: 2698685 - RNA, 15 nt, Haemophilus influenzae Rd
aaaucauuaaauaac

SEQ ID NO: 2698686 - RNA, 12 nt, Haemophilus influenzae Rd
aaaucauuacac

SEQ ID NO: 2698687 - RNA, 22 nt, Haemophilus influenzae Rd
aaaucauuacacagaugccauu

SEQ ID NO: 2698688 - RNA, 20 nt, Haemophilus influenzae Rd
aaaucauuuauauaaaagaa

SEQ ID NO: 2698689 - RNA, 11 nt, Haemophilus influenzae Rd
aaauccaaaac

SEQ ID NO: 2698690 - RNA, 17 nt, Haemophilus influenzae Rd
aaauccacaaaaucuga

SEQ ID NO: 2698691 - RNA, 20 nt, Haemophilus influenzae Rd
aaauccacaaucaaucuuua

SEQ ID NO: 2698692 - RNA, 13 nt, Haemophilus influenzae Rd
aaauccacacuuu

SEQ ID NO: 2698693 - RNA, 20 nt, Haemophilus influenzae Rd
aaauccaucaauucuuccca

SEQ ID NO: 2698694 - RNA, 16 nt, Haemophilus influenzae Rd
aaaucccaccuuuuag

SEQ ID NO: 2698695 - RNA, 17 nt, Haemophilus influenzae Rd
aaauccccccauuacaa

SEQ ID NO: 2698696 - RNA, 17 nt, Haemophilus influenzae Rd
aaaucccgcagggaugc

SEQ ID NO: 2698697 - RNA, 15 nt, Haemophilus influenzae Rd
aaaucccuuagaaaa

SEQ ID NO: 2698698 - RNA, 21 nt, Haemophilus influenzae Rd
aaaucccuuucucaggaaagg

SEQ ID NO: 2698699 - RNA, 22 nt, Haemophilus influenzae Rd
aaauccgccaaucauacuaaau

SEQ ID NO: 2698700 - RNA, 16 nt, Haemophilus influenzae Rd
aaauccuaaauaaaga

SEQ ID NO: 2698701 - RNA, 16 nt, Haemophilus influenzae Rd
aaauccugaagauuuu

SEQ ID NO: 2698702 - RNA, 18 nt, Haemophilus influenzae Rd
aaauccuugaaucauuuc

SEQ ID NO: 2698703 - RNA, 20 nt, Haemophilus influenzae Rd
aaauccuuguuuuucaaaaa

SEQ ID NO: 2698704 - RNA, 17 nt, Haemophilus influenzae Rd
aaauccuuuugcacauu

SEQ ID NO: 2698705 - RNA, 13 nt, Haemophilus influenzae Rd
aaaucgaaauaug

SEQ ID NO: 2698706 - RNA, 15 nt, Haemophilus influenzae Rd
aaaucgaucacuuaa

SEQ ID NO: 2698707 - RNA, 16 nt, Haemophilus influenzae Rd
aaaucgauuacucugc

SEQ ID NO: 2698708 - RNA, 15 nt, Haemophilus influenzae Rd
aaaucgcaauauuaa

SEQ ID NO: 2698709 - RNA, 16 nt, Haemophilus influenzae Rd
aaaucgcaauauuaaa

SEQ ID NO: 2698710 - RNA, 17 nt, Haemophilus influenzae Rd
aaaucgcaauauuaaac

SEQ ID NO: 2698711 - RNA, 14 nt, Haemophilus influenzae Rd
aaaucgcaauuuuu

SEQ ID NO: 2698712 - RNA, 18 nt, Haemophilus influenzae Rd
aaaucgcugggauuuugu

SEQ ID NO: 2698713 - RNA, 17 nt, Haemophilus influenzae Rd
aaaucggcguauuuuac

SEQ ID NO: 2698714 - RNA, 18 nt, Haemophilus influenzae Rd
aaaucggcguauuuuaca

SEQ ID NO: 2698715 - RNA, 21 nt, Haemophilus influenzae Rd
aaaucguaauuuuaaaaccac

SEQ ID NO: 2698716 - RNA, 13 nt, Haemophilus influenzae Rd
aaaucuaaaaaua

SEQ ID NO: 2698717 - RNA, 14 nt, Haemophilus influenzae Rd
aaaucuaacauuuc

SEQ ID NO: 2698718 - RNA, 14 nt, Haemophilus influenzae Rd
aaaucuaagccuug

SEQ ID NO: 2698719 - RNA, 15 nt, Haemophilus influenzae Rd
aaaucuaagccuugu

SEQ ID NO: 2698720 - RNA, 14 nt, Haemophilus influenzae Rd
aaaucuaaugccuu

SEQ ID NO: 2698721 - RNA, 16 nt, Haemophilus influenzae Rd
aaaucuaauuuugcca

SEQ ID NO: 2698722 - RNA, 18 nt, Haemophilus influenzae Rd
aaaucuacuaaaauaagg

SEQ ID NO: 2698723 - RNA, 18 nt, Haemophilus influenzae Rd
aaaucuacucguuuacua

SEQ ID NO: 2698724 - RNA, 22 nt, Haemophilus influenzae Rd
aaaucuagagauuguaugaaaa

SEQ ID NO: 2698725 - RNA, 14 nt, Haemophilus influenzae Rd
aaaucucucaaaaa

SEQ ID NO: 2698726 - RNA, 18 nt, Haemophilus influenzae Rd
aaaucucucaaaaaucaa

SEQ ID NO: 2698727 - RNA, 19 nt, Haemophilus influenzae Rd
aaaucucucaaaaaucaac

SEQ ID NO: 2698728 - RNA, 23 nt, Haemophilus influenzae Rd
aaaucugauucagaaaaagcuuc

SEQ ID NO: 2698729 - RNA, 11 nt, Haemophilus influenzae Rd
aaaucugcacu

SEQ ID NO: 2698730 - RNA, 22 nt, Haemophilus influenzae Rd
aaaucugcacucuaauaaguga

SEQ ID NO: 2698731 - RNA, 16 nt, Haemophilus influenzae Rd
aaaucugccugauuuu

SEQ ID NO: 2698732 - RNA, 19 nt, Haemophilus influenzae Rd
aaaucugccugauuuuuuu

SEQ ID NO: 2698733 - RNA, 22 nt, Haemophilus influenzae Rd
aaaucugugcaaaguuaccauu

SEQ ID NO: 2698734 - RNA, 17 nt, Haemophilus influenzae Rd
aaaucuguugaaucuca

SEQ ID NO: 2698735 - RNA, 19 nt, Haemophilus influenzae Rd
aaaucuguugaaucucagc

SEQ ID NO: 2698736 - RNA, 14 nt, Haemophilus influenzae Rd
aaaucuuacugcgc

SEQ ID NO: 2698737 - RNA, 20 nt, Haemophilus influenzae Rd
aaaucuuauuaauaaaaaug

SEQ ID NO: 2698738 - RNA, 21 nt, Haemophilus influenzae Rd
aaaucuuauuaauaaaaaugc

SEQ ID NO: 2698739 - RNA, 15 nt, Haemophilus influenzae Rd
aaaucuucauuuuca

SEQ ID NO: 2698740 - RNA, 13 nt, Haemophilus influenzae Rd
aaaucuucuaucu

SEQ ID NO: 2698741 - RNA, 16 nt, Haemophilus influenzae Rd
aaaucuugaacgcaaa

SEQ ID NO: 2698742 - RNA, 24 nt, Haemophilus influenzae Rd
aaaucuuggcucauuuuaaagagu

SEQ ID NO: 2698743 - RNA, 18 nt, Haemophilus influenzae Rd
aaaucuuuaccaaaaaau

SEQ ID NO: 2698744 - RNA, 19 nt, Haemophilus influenzae Rd
aaaucuuuaccaaaaaauu

SEQ ID NO: 2698745 - RNA, 21 nt, Haemophilus influenzae Rd
aaaucuuuacgaauuguaccu

SEQ ID NO: 2698746 - RNA, 20 nt, Haemophilus influenzae Rd
aaaucuuuaucugauuuaau

SEQ ID NO: 2698747 - RNA, 22 nt, Haemophilus influenzae Rd
aaaucuuuugaaagauuuucua

SEQ ID NO: 2698748 - RNA, 18 nt, Haemophilus influenzae Rd
aaaugaaaccaaauccuu

SEQ ID NO: 2698749 - RNA, 14 nt, Haemophilus influenzae Rd
aaaugaaaugcaag

SEQ ID NO: 2698750 - RNA, 13 nt, Haemophilus influenzae Rd
aaaugaaauguuu

SEQ ID NO: 2698751 - RNA, 15 nt, Haemophilus influenzae Rd
aaaugaacaaaaaau

SEQ ID NO: 2698752 - RNA, 22 nt, Haemophilus influenzae Rd
aaaugaaguaauaaucuucuuc

SEQ ID NO: 2698753 - RNA, 22 nt, Haemophilus influenzae Rd
aaaugaagugcgguugaaauuu

SEQ ID NO: 2698754 - RNA, 21 nt, Haemophilus influenzae Rd
aaaugaaguucacuucaucua

SEQ ID NO: 2698755 - RNA, 22 nt, Haemophilus influenzae Rd
aaaugaaguucacuucaucuau

SEQ ID NO: 2698756 - RNA, 15 nt, Haemophilus influenzae Rd
aaaugaaguuuuacu

SEQ ID NO: 2698757 - RNA, 13 nt, Haemophilus influenzae Rd
aaaugaauaaaac

SEQ ID NO: 2698758 - RNA, 18 nt, Haemophilus influenzae Rd
aaaugaauaaaacuuccu

SEQ ID NO: 2698759 - RNA, 20 nt, Haemophilus influenzae Rd
aaaugaauaaaacuuccuaa

SEQ ID NO: 2698760 - RNA, 20 nt, Haemophilus influenzae Rd
aaaugacagucgauuacaaa

SEQ ID NO: 2698761 - RNA, 21 nt, Haemophilus influenzae Rd
aaaugacagucgauuacaaaa

SEQ ID NO: 2698762 - RNA, 24 nt, Haemophilus influenzae Rd
aaaugacauauaauauuaauccau

SEQ ID NO: 2698763 - RNA, 15 nt, Haemophilus influenzae Rd
aaaugaccuucacuu

SEQ ID NO: 2698764 - RNA, 17 nt, Haemophilus influenzae Rd
aaaugagaaaaauccug

SEQ ID NO: 2698765 - RNA, 15 nt, Haemophilus influenzae Rd
aaaugaggaaaauaa

SEQ ID NO: 2698766 - RNA, 20 nt, Haemophilus influenzae Rd
aaaugaguaaaccgauuaau

SEQ ID NO: 2698767 - RNA, 17 nt, Haemophilus influenzae Rd
aaaugaucaaaucaaau

SEQ ID NO: 2698768 - RNA, 14 nt, Haemophilus influenzae Rd
aaaugaucuaaugg

SEQ ID NO: 2698769 - RNA, 18 nt, Haemophilus influenzae Rd
aaaugaugauaauuuuua

SEQ ID NO: 2698770 - RNA, 22 nt, Haemophilus influenzae Rd
aaaugauguaggcaaaaacacu

SEQ ID NO: 2698771 - RNA, 21 nt, Haemophilus influenzae Rd
aaaugcaaaguaacuuuaauu

SEQ ID NO: 2698772 - RNA, 23 nt, Haemophilus influenzae Rd
aaaugcaaaguaacuuuaauuau

SEQ ID NO: 2698773 - RNA, 19 nt, Haemophilus influenzae Rd
aaaugcaggggcuuuuaau

SEQ ID NO: 2698774 - RNA, 22 nt, Haemophilus influenzae Rd
aaaugccacugcccuauuugug

SEQ ID NO: 2698775 - RNA, 13 nt, Haemophilus influenzae Rd
aaaugccgauaau

SEQ ID NO: 2698776 - RNA, 18 nt, Haemophilus influenzae Rd
aaaugccgauaauagaca

SEQ ID NO: 2698777 - RNA, 23 nt, Haemophilus influenzae Rd
aaaugccgauaauagacauagaa

SEQ ID NO: 2698778 - RNA, 18 nt, Haemophilus influenzae Rd
aaaugccgcuaaugguug

SEQ ID NO: 2698779 - RNA, 22 nt, Haemophilus influenzae Rd
aaaugccgcuaaugguugcauu

SEQ ID NO: 2698780 - RNA, 14 nt, Haemophilus influenzae Rd
aaaugccuacuaaa

SEQ ID NO: 2698781 - RNA, 15 nt, Haemophilus influenzae Rd
aaaugcggacuuuuu

SEQ ID NO: 2698782 - RNA, 22 nt, Haemophilus influenzae Rd
aaaugcggcaaugguuaauaca

SEQ ID NO: 2698783 - RNA, 22 nt, Haemophilus influenzae Rd
aaaugcgucgcagccuuguucu

SEQ ID NO: 2698784 - RNA, 14 nt, Haemophilus influenzae Rd
aaaugcuaaaauua

SEQ ID NO: 2698785 - RNA, 18 nt, Haemophilus influenzae Rd
aaaugcuaaauuccccaa

SEQ ID NO: 2698786 - RNA, 23 nt, Haemophilus influenzae Rd
aaaugcucuuugggaaugccauu

SEQ ID NO: 2698787 - RNA, 19 nt, Haemophilus influenzae Rd
aaaugcuuuugccgaaaau

SEQ ID NO: 2698788 - RNA, 16 nt, Haemophilus influenzae Rd
aaauggaaauuugaga

SEQ ID NO: 2698789 - RNA, 22 nt, Haemophilus influenzae Rd
aaauggaauucuucuggcauau

SEQ ID NO: 2698790 - RNA, 18 nt, Haemophilus influenzae Rd
aaauggacagaauaacua

SEQ ID NO: 2698791 - RNA, 16 nt, Haemophilus influenzae Rd
aaauggcccugaaagu

SEQ ID NO: 2698792 - RNA, 19 nt, Haemophilus influenzae Rd
aaauggcgaccacgaaaau

SEQ ID NO: 2698793 - RNA, 15 nt, Haemophilus influenzae Rd
aaaugggccucuuua

SEQ ID NO: 2698794 - RNA, 22 nt, Haemophilus influenzae Rd
aaauggucaaugccaaaugcgg

SEQ ID NO: 2698795 - RNA, 22 nt, Haemophilus influenzae Rd
aaauguaagagugaaguuauag

SEQ ID NO: 2698796 - RNA, 21 nt, Haemophilus influenzae Rd
aaauguaauagccauuuugga

SEQ ID NO: 2698797 - RNA, 21 nt, Haemophilus influenzae Rd
aaauguagagauaauaaauau

SEQ ID NO: 2698798 - RNA, 23 nt, Haemophilus influenzae Rd
aaauguagaucgacuccacuuug

SEQ ID NO: 2698799 - RNA, 23 nt, Haemophilus influenzae Rd
aaauguaucugauuuuuuaagau

SEQ ID NO: 2698800 - RNA, 15 nt, Haemophilus influenzae Rd
aaaugucgaaauuuu

SEQ ID NO: 2698801 - RNA, 13 nt, Haemophilus influenzae Rd
aaaugugaaaacu

SEQ ID NO: 2698802 - RNA, 22 nt, Haemophilus influenzae Rd
aaaugugaaaacuacuuuccaa

SEQ ID NO: 2698803 - RNA, 14 nt, Haemophilus influenzae Rd
aaaugugauuucca

SEQ ID NO: 2698804 - RNA, 15 nt, Haemophilus influenzae Rd
aaauguggucaaaga

SEQ ID NO: 2698805 - RNA, 22 nt, Haemophilus influenzae Rd
aaauguguuucgauacuuucuu

SEQ ID NO: 2698806 - RNA, 16 nt, Haemophilus influenzae Rd
aaauguuuaauuauag

SEQ ID NO: 2698807 - RNA, 18 nt, Haemophilus influenzae Rd
aaauguuugaaggcaaaa

SEQ ID NO: 2698808 - RNA, 18 nt, Haemophilus influenzae Rd
aaauuaaaaaaauaguua

SEQ ID NO: 2698809 - RNA, 17 nt, Haemophilus influenzae Rd
aaauuaaaaaagcaaaa

SEQ ID NO: 2698810 - RNA, 18 nt, Haemophilus influenzae Rd
aaauuaaaaagacuaaac

SEQ ID NO: 2698811 - RNA, 15 nt, Haemophilus influenzae Rd
aaauuaaaaauauac

SEQ ID NO: 2698812 - RNA, 13 nt, Haemophilus influenzae Rd
aaauuaaaaauuu

SEQ ID NO: 2698813 - RNA, 15 nt, Haemophilus influenzae Rd
aaauuaaaauaauau

SEQ ID NO: 2698814 - RNA, 15 nt, Haemophilus influenzae Rd
aaauuaaacgauaaa

SEQ ID NO: 2698815 - RNA, 15 nt, Haemophilus influenzae Rd
aaauuaaauugaaaa

SEQ ID NO: 2698816 - RNA, 18 nt, Haemophilus influenzae Rd
aaauuaaauugaaaaaau

SEQ ID NO: 2698817 - RNA, 18 nt, Haemophilus influenzae Rd
aaauuaaauuguaacuau

SEQ ID NO: 2698818 - RNA, 12 nt, Haemophilus influenzae Rd
aaauuaacaaua

SEQ ID NO: 2698819 - RNA, 19 nt, Haemophilus influenzae Rd
aaauuaaccgcacuuuaga

SEQ ID NO: 2698820 - RNA, 23 nt, Haemophilus influenzae Rd
aaauuaaccgcacuuuagaaaau

SEQ ID NO: 2698821 - RNA, 17 nt, Haemophilus influenzae Rd
aaauuaaccgcacuuuc

SEQ ID NO: 2698822 - RNA, 21 nt, Haemophilus influenzae Rd
aaauuaacuuaucuaaaaaga

SEQ ID NO: 2698823 - RNA, 19 nt, Haemophilus influenzae Rd
aaauuaagaaaauaauaua

SEQ ID NO: 2698824 - RNA, 15 nt, Haemophilus influenzae Rd
aaauuaagcagcgaa

SEQ ID NO: 2698825 - RNA, 13 nt, Haemophilus influenzae Rd
aaauuaaggacua

SEQ ID NO: 2698826 - RNA, 20 nt, Haemophilus influenzae Rd
aaauuaaggggauucgauuu

SEQ ID NO: 2698827 - RNA, 16 nt, Haemophilus influenzae Rd
aaauuaauaagaaaau

SEQ ID NO: 2698828 - RNA, 16 nt, Haemophilus influenzae Rd
aaauuaauacugaaau

SEQ ID NO: 2698829 - RNA, 21 nt, Haemophilus influenzae Rd
aaauuaaucugcauucuaaaa

SEQ ID NO: 2698830 - RNA, 20 nt, Haemophilus influenzae Rd
aaauuaaugucgcauuugua

SEQ ID NO: 2698831 - RNA, 22 nt, Haemophilus influenzae Rd
aaauuaauuaaucaauaagaaa

SEQ ID NO: 2698832 - RNA, 20 nt, Haemophilus influenzae Rd
aaauuaauucucauacaaaa

SEQ ID NO: 2698833 - RNA, 24 nt, Haemophilus influenzae Rd
aaauuaauuuacucguucaucuua

SEQ ID NO: 2698834 - RNA, 13 nt, Haemophilus influenzae Rd
aaauuaccacguu

SEQ ID NO: 2698835 - RNA, 18 nt, Haemophilus influenzae Rd
aaauuaccguguuuuuca

SEQ ID NO: 2698836 - RNA, 20 nt, Haemophilus influenzae Rd
aaauuaccguguuuuucacg

SEQ ID NO: 2698837 - RNA, 15 nt, Haemophilus influenzae Rd
aaauuacuugaaucu

SEQ ID NO: 2698838 - RNA, 13 nt, Haemophilus influenzae Rd
aaauuacuuuucg

SEQ ID NO: 2698839 - RNA, 12 nt, Haemophilus influenzae Rd
aaauuagacaaa

SEQ ID NO: 2698840 - RNA, 18 nt, Haemophilus influenzae Rd
aaauuagacaaaaaugca

SEQ ID NO: 2698841 - RNA, 22 nt, Haemophilus influenzae Rd
aaauuagcguaaacauuuugua

SEQ ID NO: 2698842 - RNA, 22 nt, Haemophilus influenzae Rd
aaauuagcucaauagauuuaau

SEQ ID NO: 2698843 - RNA, 18 nt, Haemophilus influenzae Rd
aaauuaggaauuugauca

SEQ ID NO: 2698844 - RNA, 21 nt, Haemophilus influenzae Rd
aaauuaguaguuagaauuuua

SEQ ID NO: 2698845 - RNA, 13 nt, Haemophilus influenzae Rd
aaauuauaauauu

SEQ ID NO: 2698846 - RNA, 18 nt, Haemophilus influenzae Rd
aaauuauagaacuuagcc

SEQ ID NO: 2698847 - RNA, 14 nt, Haemophilus influenzae Rd
aaauuauagauaaa

SEQ ID NO: 2698848 - RNA, 19 nt, Haemophilus influenzae Rd
aaauuauagauaaauauca

SEQ ID NO: 2698849 - RNA, 14 nt, Haemophilus influenzae Rd
aaauuauauuuuua

SEQ ID NO: 2698850 - RNA, 21 nt, Haemophilus influenzae Rd
aaauuauauuuuuaauuuaua

SEQ ID NO: 2698851 - RNA, 14 nt, Haemophilus influenzae Rd
aaauuaucaaagaa

SEQ ID NO: 2698852 - RNA, 23 nt, Haemophilus influenzae Rd
aaauuaucguuuacuuaaaaucu

SEQ ID NO: 2698853 - RNA, 18 nt, Haemophilus influenzae Rd
aaauuaucugcucucauu

SEQ ID NO: 2698854 - RNA, 18 nt, Haemophilus influenzae Rd
aaauuauugcauuuuuaa

SEQ ID NO: 2698855 - RNA, 19 nt, Haemophilus influenzae Rd
aaauuauugcuuaugauuu

SEQ ID NO: 2698856 - RNA, 22 nt, Haemophilus influenzae Rd
aaauuauugugagauaugaaau

SEQ ID NO: 2698857 - RNA, 13 nt, Haemophilus influenzae Rd
aaauuauuuuaau

SEQ ID NO: 2698858 - RNA, 15 nt, Haemophilus influenzae Rd
aaauuauuuuaauaa

SEQ ID NO: 2698859 - RNA, 13 nt, Haemophilus influenzae Rd
aaauuauuuucua

SEQ ID NO: 2698860 - RNA, 22 nt, Haemophilus influenzae Rd
aaauucaaagaagcguucaaaa

SEQ ID NO: 2698861 - RNA, 15 nt, Haemophilus influenzae Rd
aaauucaaagauuau

SEQ ID NO: 2698862 - RNA, 13 nt, Haemophilus influenzae Rd
aaauucaaauacu

SEQ ID NO: 2698863 - RNA, 22 nt, Haemophilus influenzae Rd
aaauucaacacgccuaacauaa

SEQ ID NO: 2698864 - RNA, 12 nt, Haemophilus influenzae Rd
aaauucaauacu

SEQ ID NO: 2698865 - RNA, 17 nt, Haemophilus influenzae Rd
aaauucaccgcacuuuu

SEQ ID NO: 2698866 - RNA, 20 nt, Haemophilus influenzae Rd
aaauucaccgcacuuuucuu

SEQ ID NO: 2698867 - RNA, 14 nt, Haemophilus influenzae Rd
aaauucacugucuu

SEQ ID NO: 2698868 - RNA, 19 nt, Haemophilus influenzae Rd
aaauucaguaagaaaccaa

SEQ ID NO: 2698869 - RNA, 17 nt, Haemophilus influenzae Rd
aaauucaguaucaaaua

SEQ ID NO: 2698870 - RNA, 17 nt, Haemophilus influenzae Rd
aaauucaguuaagaaaa

SEQ ID NO: 2698871 - RNA, 13 nt, Haemophilus influenzae Rd
aaauucaucagaa

SEQ ID NO: 2698872 - RNA, 12 nt, Haemophilus influenzae Rd
aaauucauccaa

SEQ ID NO: 2698873 - RNA, 14 nt, Haemophilus influenzae Rd
aaauucauucuugc

SEQ ID NO: 2698874 - RNA, 22 nt, Haemophilus influenzae Rd
aaauucauucuugcuugaucau

SEQ ID NO: 2698875 - RNA, 14 nt, Haemophilus influenzae Rd
aaauucauuuaaaa

SEQ ID NO: 2698876 - RNA, 17 nt, Haemophilus influenzae Rd
aaauucauuuaaaauau

SEQ ID NO: 2698877 - RNA, 12 nt, Haemophilus influenzae Rd
aaauucauuuuu

SEQ ID NO: 2698878 - RNA, 17 nt, Haemophilus influenzae Rd
aaauucauuuuuuauuu

SEQ ID NO: 2698879 - RNA, 16 nt, Haemophilus influenzae Rd
aaauuccaguucuccu

SEQ ID NO: 2698880 - RNA, 12 nt, Haemophilus influenzae Rd
aaauuccauuca

SEQ ID NO: 2698881 - RNA, 22 nt, Haemophilus influenzae Rd
aaauucccauuucuaaugcaau

SEQ ID NO: 2698882 - RNA, 16 nt, Haemophilus influenzae Rd
aaauuccgcaauauuu

SEQ ID NO: 2698883 - RNA, 21 nt, Haemophilus influenzae Rd
aaauuccuuauuuuacuucaa

SEQ ID NO: 2698884 - RNA, 18 nt, Haemophilus influenzae Rd
aaauucgacgauaaccau

SEQ ID NO: 2698885 - RNA, 16 nt, Haemophilus influenzae Rd
aaauucgcacacuuuc

SEQ ID NO: 2698886 - RNA, 15 nt, Haemophilus influenzae Rd
aaauucguaaagcga

SEQ ID NO: 2698887 - RNA, 19 nt, Haemophilus influenzae Rd
aaauucguacaaaugaaaa

SEQ ID NO: 2698888 - RNA, 19 nt, Haemophilus influenzae Rd
aaauucguuguaauugauu

SEQ ID NO: 2698889 - RNA, 20 nt, Haemophilus influenzae Rd
aaauucuacgccauuuucua

SEQ ID NO: 2698890 - RNA, 19 nt, Haemophilus influenzae Rd
aaauucucgccauaauaaa

SEQ ID NO: 2698891 - RNA, 23 nt, Haemophilus influenzae Rd
aaauucucgccauaauaaaaauu

SEQ ID NO: 2698892 - RNA, 18 nt, Haemophilus influenzae Rd
aaauucucggcaaugguu

SEQ ID NO: 2698893 - RNA, 19 nt, Haemophilus influenzae Rd
aaauucucgguuguuucau

SEQ ID NO: 2698894 - RNA, 17 nt, Haemophilus influenzae Rd
aaauucucuguuucuuu

SEQ ID NO: 2698895 - RNA, 24 nt, Haemophilus influenzae Rd
aaauucucuguuucuuuaaauagu

SEQ ID NO: 2698896 - RNA, 18 nt, Haemophilus influenzae Rd
aaauucuguuuuugguaa

SEQ ID NO: 2698897 - RNA, 13 nt, Haemophilus influenzae Rd
aaauucuuguucu

SEQ ID NO: 2698898 - RNA, 14 nt, Haemophilus influenzae Rd
aaauucuuuugcca

SEQ ID NO: 2698899 - RNA, 11 nt, Haemophilus influenzae Rd
aaauucuuuuu

SEQ ID NO: 2698900 - RNA, 15 nt, Haemophilus influenzae Rd
aaauugaaaaaauaa

SEQ ID NO: 2698901 - RNA, 15 nt, Haemophilus influenzae Rd
aaauugaaaaaaucu

SEQ ID NO: 2698902 - RNA, 18 nt, Haemophilus influenzae Rd
aaauugaaaaaaucuucc

SEQ ID NO: 2698903 - RNA, 20 nt, Haemophilus influenzae Rd
aaauugaaaaaaucuuccaa

SEQ ID NO: 2698904 - RNA, 20 nt, Haemophilus influenzae Rd
aaauugaacugaauuaaaaa

SEQ ID NO: 2698905 - RNA, 19 nt, Haemophilus influenzae Rd
aaauugaagagauugauuu

SEQ ID NO: 2698906 - RNA, 16 nt, Haemophilus influenzae Rd
aaauugacggcuucag

SEQ ID NO: 2698907 - RNA, 19 nt, Haemophilus influenzae Rd
aaauugacggcuucagaaa

SEQ ID NO: 2698908 - RNA, 15 nt, Haemophilus influenzae Rd
aaauugacuugcaca

SEQ ID NO: 2698909 - RNA, 20 nt, Haemophilus influenzae Rd
aaauugagaaugaaaauaac

SEQ ID NO: 2698910 - RNA, 16 nt, Haemophilus influenzae Rd
aaauugagaucaaaaa

SEQ ID NO: 2698911 - RNA, 18 nt, Haemophilus influenzae Rd
aaauugaggauuugccuc

SEQ ID NO: 2698912 - RNA, 17 nt, Haemophilus influenzae Rd
aaauugaugaaaauucu

SEQ ID NO: 2698913 - RNA, 12 nt, Haemophilus influenzae Rd
aaauugauuaag

SEQ ID NO: 2698914 - RNA, 15 nt, Haemophilus influenzae Rd
aaauugcaaaaaacu

SEQ ID NO: 2698915 - RNA, 13 nt, Haemophilus influenzae Rd
aaauugcaccuuc

SEQ ID NO: 2698916 - RNA, 22 nt, Haemophilus influenzae Rd
aaauugcaccuucuuuuggaua

SEQ ID NO: 2698917 - RNA, 13 nt, Haemophilus influenzae Rd
aaauugccaaaaa

SEQ ID NO: 2698918 - RNA, 14 nt, Haemophilus influenzae Rd
aaauugccaaaaaa

SEQ ID NO: 2698919 - RNA, 15 nt, Haemophilus influenzae Rd
aaauugccaaaaaag

SEQ ID NO: 2698920 - RNA, 17 nt, Haemophilus influenzae Rd
aaauugccccuucaccu

SEQ ID NO: 2698921 - RNA, 22 nt, Haemophilus influenzae Rd
aaauugcccuguugaaacaggu

SEQ ID NO: 2698922 - RNA, 18 nt, Haemophilus influenzae Rd
aaauugcguguuuauaua

SEQ ID NO: 2698923 - RNA, 20 nt, Haemophilus influenzae Rd
aaauugcuggcuugccaauu

SEQ ID NO: 2698924 - RNA, 12 nt, Haemophilus influenzae Rd
aaauugcuuuca

SEQ ID NO: 2698925 - RNA, 14 nt, Haemophilus influenzae Rd
aaauuggcuuguug

SEQ ID NO: 2698926 - RNA, 20 nt, Haemophilus influenzae Rd
aaauuggguucgcaaauaac

SEQ ID NO: 2698927 - RNA, 19 nt, Haemophilus influenzae Rd
aaauugguacgagaaaaau

SEQ ID NO: 2698928 - RNA, 12 nt, Haemophilus influenzae Rd
aaauuguaaaac

SEQ ID NO: 2698929 - RNA, 19 nt, Haemophilus influenzae Rd
aaauuguaacuauaugaua

SEQ ID NO: 2698930 - RNA, 21 nt, Haemophilus influenzae Rd
aaauugucguccuucaaauuc

SEQ ID NO: 2698931 - RNA, 17 nt, Haemophilus influenzae Rd
aaauuguggcaauaguu

SEQ ID NO: 2698932 - RNA, 14 nt, Haemophilus influenzae Rd
aaauugugucacau

SEQ ID NO: 2698933 - RNA, 23 nt, Haemophilus influenzae Rd
aaauuguguguuuuaaaccaccg

SEQ ID NO: 2698934 - RNA, 16 nt, Haemophilus influenzae Rd
aaauuguuugaaauca

SEQ ID NO: 2698935 - RNA, 18 nt, Haemophilus influenzae Rd
aaauuguuugaaaucaaa

SEQ ID NO: 2698936 - RNA, 15 nt, Haemophilus influenzae Rd
aaauuguuuuuccca

SEQ ID NO: 2698937 - RNA, 11 nt, Haemophilus influenzae Rd
aaauuuaaaaa

SEQ ID NO: 2698938 - RNA, 13 nt, Haemophilus influenzae Rd
aaauuuaaaaaag

SEQ ID NO: 2698939 - RNA, 17 nt, Haemophilus influenzae Rd
aaauuuaaaagcaccua

SEQ ID NO: 2698940 - RNA, 20 nt, Haemophilus influenzae Rd
aaauuuaaaaucgcaauuuu

SEQ ID NO: 2698941 - RNA, 13 nt, Haemophilus influenzae Rd
aaauuuaaauaua

SEQ ID NO: 2698942 - RNA, 18 nt, Haemophilus influenzae Rd
aaauuuaaauauaauuua

SEQ ID NO: 2698943 - RNA, 20 nt, Haemophilus influenzae Rd
aaauuuaauaagaauuuuaa

SEQ ID NO: 2698944 - RNA, 14 nt, Haemophilus influenzae Rd
aaauuuaauacuuu

SEQ ID NO: 2698945 - RNA, 21 nt, Haemophilus influenzae Rd
aaauuuaccgcacuuugauuu

SEQ ID NO: 2698946 - RNA, 14 nt, Haemophilus influenzae Rd
aaauuuacgauuaa

SEQ ID NO: 2698947 - RNA, 21 nt, Haemophilus influenzae Rd
aaauuuagcguauuuuguucu

SEQ ID NO: 2698948 - RNA, 17 nt, Haemophilus influenzae Rd
aaauuuaggguauuuau

SEQ ID NO: 2698949 - RNA, 16 nt, Haemophilus influenzae Rd
aaauuuagugauuucu

SEQ ID NO: 2698950 - RNA, 19 nt, Haemophilus influenzae Rd
aaauuuauaauagacugaa

SEQ ID NO: 2698951 - RNA, 22 nt, Haemophilus influenzae Rd
aaauuuauauaugauaaaaaua

SEQ ID NO: 2698952 - RNA, 18 nt, Haemophilus influenzae Rd
aaauuuaucgggaauaau

SEQ ID NO: 2698953 - RNA, 20 nt, Haemophilus influenzae Rd
aaauuuaucgggaauaauau

SEQ ID NO: 2698954 - RNA, 19 nt, Haemophilus influenzae Rd
aaauuuaucuaaaaguaau

SEQ ID NO: 2698955 - RNA, 18 nt, Haemophilus influenzae Rd
aaauuuaugcuguuuuau

SEQ ID NO: 2698956 - RNA, 16 nt, Haemophilus influenzae Rd
aaauuuauuauaaaaa

SEQ ID NO: 2698957 - RNA, 21 nt, Haemophilus influenzae Rd
aaauuuauuauaaaaauauuu

SEQ ID NO: 2698958 - RNA, 17 nt, Haemophilus influenzae Rd
aaauuuauuauauaaaa

SEQ ID NO: 2698959 - RNA, 13 nt, Haemophilus influenzae Rd
aaauuuauuuuaa

SEQ ID NO: 2698960 - RNA, 17 nt, Haemophilus influenzae Rd
aaauuuauuuuuuaaaa

SEQ ID NO: 2698961 - RNA, 13 nt, Haemophilus influenzae Rd
aaauuucaauuaa

SEQ ID NO: 2698962 - RNA, 20 nt, Haemophilus influenzae Rd
aaauuucaauuaaaucaaaa

SEQ ID NO: 2698963 - RNA, 20 nt, Haemophilus influenzae Rd
aaauuucaccgcauucuucu

SEQ ID NO: 2698964 - RNA, 14 nt, Haemophilus influenzae Rd
aaauuucagacaaa

SEQ ID NO: 2698965 - RNA, 21 nt, Haemophilus influenzae Rd
aaauuuccauaugaccauuaa

SEQ ID NO: 2698966 - RNA, 15 nt, Haemophilus influenzae Rd
aaauuuccgcaggug

SEQ ID NO: 2698967 - RNA, 19 nt, Haemophilus influenzae Rd
aaauuucgcaggcuuucac

SEQ ID NO: 2698968 - RNA, 18 nt, Haemophilus influenzae Rd
aaauuucgcuauuuucua

SEQ ID NO: 2698969 - RNA, 21 nt, Haemophilus influenzae Rd
aaauuucuccguuagcaauaa

SEQ ID NO: 2698970 - RNA, 12 nt, Haemophilus influenzae Rd
aaauuucugaac

SEQ ID NO: 2698971 - RNA, 18 nt, Haemophilus influenzae Rd
aaauuucuguugaaauca

SEQ ID NO: 2698972 - RNA, 23 nt, Haemophilus influenzae Rd
aaauuucuugcucuaauuuuacc

SEQ ID NO: 2698973 - RNA, 19 nt, Haemophilus influenzae Rd
aaauuucuuuaauugauua

SEQ ID NO: 2698974 - RNA, 20 nt, Haemophilus influenzae Rd
aaauuucuuuuguuuuaacc

SEQ ID NO: 2698975 - RNA, 21 nt, Haemophilus influenzae Rd
aaauuucuuuuuuaucaaaaa

SEQ ID NO: 2698976 - RNA, 20 nt, Haemophilus influenzae Rd
aaauuugaauguaaaaauaa

SEQ ID NO: 2698977 - RNA, 21 nt, Haemophilus influenzae Rd
aaauuugaauguaaaaauaac

SEQ ID NO: 2698978 - RNA, 19 nt, Haemophilus influenzae Rd
aaauuuggcaauccugcuu

SEQ ID NO: 2698979 - RNA, 17 nt, Haemophilus influenzae Rd
aaauuuuaaaaaauaau

SEQ ID NO: 2698980 - RNA, 15 nt, Haemophilus influenzae Rd
aaauuuuaaaauagu

SEQ ID NO: 2698981 - RNA, 14 nt, Haemophilus influenzae Rd
aaauuuuaaaaucu

SEQ ID NO: 2698982 - RNA, 12 nt, Haemophilus influenzae Rd
aaauuuuaaaua

SEQ ID NO: 2698983 - RNA, 17 nt, Haemophilus influenzae Rd
aaauuuucaaauugaaa

SEQ ID NO: 2698984 - RNA, 18 nt, Haemophilus influenzae Rd
aaauuuucaauggcauca

SEQ ID NO: 2698985 - RNA, 19 nt, Haemophilus influenzae Rd
aaauuuuccgcauaaauaa

SEQ ID NO: 2698986 - RNA, 22 nt, Haemophilus influenzae Rd
aaauuuuccgcauaaauaauaa

SEQ ID NO: 2698987 - RNA, 23 nt, Haemophilus influenzae Rd
aaauuuuccgcauaaauaauaaa

SEQ ID NO: 2698988 - RNA, 19 nt, Haemophilus influenzae Rd
aaauuuucggcaagaaauu

SEQ ID NO: 2698989 - RNA, 21 nt, Haemophilus influenzae Rd
aaauuuucugcguuuggcaca

SEQ ID NO: 2698990 - RNA, 12 nt, Haemophilus influenzae Rd
aaauuuugccaa

SEQ ID NO: 2698991 - RNA, 17 nt, Haemophilus influenzae Rd
aaauuuugccaauuaca

SEQ ID NO: 2698992 - RNA, 17 nt, Haemophilus influenzae Rd
aaauuuuguccguauaa

SEQ ID NO: 2698993 - RNA, 21 nt, Haemophilus influenzae Rd
aaauuuuuaauaaaguaaaau

SEQ ID NO: 2698994 - RNA, 22 nt, Haemophilus influenzae Rd
aaauuuuuaauaaaguaaaaua

SEQ ID NO: 2698995 - RNA, 21 nt, Haemophilus influenzae Rd
aaauuuuuaaugcuuacaaaa

SEQ ID NO: 2698996 - RNA, 18 nt, Haemophilus influenzae Rd
aaauuuuuaauuuucucg

SEQ ID NO: 2698997 - RNA, 15 nt, Haemophilus influenzae Rd
aaauuuuuaggugcu

SEQ ID NO: 2698998 - RNA, 14 nt, Haemophilus influenzae Rd
aaauuuuuauaaag

SEQ ID NO: 2698999 - RNA, 18 nt, Haemophilus influenzae Rd
aaauuuuuaucuaaauua

SEQ ID NO: 2699000 - RNA, 19 nt, Haemophilus influenzae Rd
aaauuuuuccguuuucuac

SEQ ID NO: 2699001 - RNA, 16 nt, Haemophilus influenzae Rd
aaauuuuucuuuucuu

SEQ ID NO: 2699002 - RNA, 14 nt, Haemophilus influenzae Rd
aaauuuuugcaaaa

SEQ ID NO: 2699003 - RNA, 18 nt, Haemophilus influenzae Rd
aaauuuuuguugauaaac

SEQ ID NO: 2699004 - RNA, 22 nt, Haemophilus influenzae Rd
aaauuuuuguugauaaacauaa

SEQ ID NO: 2699005 - RNA, 13 nt, Haemophilus influenzae Rd
aaauuuuuuugca

SEQ ID NO: 2699006 - RNA, 17 nt, Haemophilus influenzae Rd
aaauuuuuuugcuggaa

SEQ ID NO: 2699007 - RNA, 21 nt, Haemophilus influenzae Rd
aacaaaaaagugcgguaaaaa

SEQ ID NO: 2699008 - RNA, 12 nt, Haemophilus influenzae Rd
aacaaaaaccau

SEQ ID NO: 2699009 - RNA, 18 nt, Haemophilus influenzae Rd
aacaaaaaccauccauaa

SEQ ID NO: 2699010 - RNA, 13 nt, Haemophilus influenzae Rd
aacaaaaagauug

SEQ ID NO: 2699011 - RNA, 11 nt, Haemophilus influenzae Rd
aacaaaaauac

SEQ ID NO: 2699012 - RNA, 16 nt, Haemophilus influenzae Rd
aacaaaaauacagcca

SEQ ID NO: 2699013 - RNA, 12 nt, Haemophilus influenzae Rd
aacaaaaauacg

SEQ ID NO: 2699014 - RNA, 14 nt, Haemophilus influenzae Rd
aacaaaagaaauuu

SEQ ID NO: 2699015 - RNA, 14 nt, Haemophilus influenzae Rd
aacaaaagccacca

SEQ ID NO: 2699016 - RNA, 22 nt, Haemophilus influenzae Rd
aacaaaaggcuuuuuacguuca

SEQ ID NO: 2699017 - RNA, 20 nt, Haemophilus influenzae Rd
aacaaaagggcgauuaaaaa

SEQ ID NO: 2699018 - RNA, 21 nt, Haemophilus influenzae Rd
aacaaaagugcgguaaaaauu

SEQ ID NO: 2699019 - RNA, 13 nt, Haemophilus influenzae Rd
aacaaaauggcuu

SEQ ID NO: 2699020 - RNA, 17 nt, Haemophilus influenzae Rd
aacaaaauuaaugccaa

SEQ ID NO: 2699021 - RNA, 21 nt, Haemophilus influenzae Rd
aacaaaauuuuaaauaaaaua

SEQ ID NO: 2699022 - RNA, 23 nt, Haemophilus influenzae Rd
aacaaagaaucuuaaauucauaa

SEQ ID NO: 2699023 - RNA, 22 nt, Haemophilus influenzae Rd
aacaaagguuaaaccuaaaucc

SEQ ID NO: 2699024 - RNA, 20 nt, Haemophilus influenzae Rd
aacaaagucaauacacauuu

SEQ ID NO: 2699025 - RNA, 23 nt, Haemophilus influenzae Rd
aacaaagucaauacacauuucuu

SEQ ID NO: 2699026 - RNA, 22 nt, Haemophilus influenzae Rd
aacaaagugcggcaaaaaaugg

SEQ ID NO: 2699027 - RNA, 16 nt, Haemophilus influenzae Rd
aacaaauaaaaagugg

SEQ ID NO: 2699028 - RNA, 14 nt, Haemophilus influenzae Rd
aacaaauaagccca

SEQ ID NO: 2699029 - RNA, 16 nt, Haemophilus influenzae Rd
aacaaauaauuauuau

SEQ ID NO: 2699030 - RNA, 23 nt, Haemophilus influenzae Rd
aacaaauacaucuucacaaaaca

SEQ ID NO: 2699031 - RNA, 14 nt, Haemophilus influenzae Rd
aacaaauccgcuuu

SEQ ID NO: 2699032 - RNA, 20 nt, Haemophilus influenzae Rd
aacaaauuacagaacgauuu

SEQ ID NO: 2699033 - RNA, 20 nt, Haemophilus influenzae Rd
aacaaauuagcgauuaaagu

SEQ ID NO: 2699034 - RNA, 10 nt, Haemophilus influenzae Rd
aacaaauuca

SEQ ID NO: 2699035 - RNA, 20 nt, Haemophilus influenzae Rd
aacaacaguagaaaucacaa

SEQ ID NO: 2699036 - RNA, 14 nt, Haemophilus influenzae Rd
aacaacagugaauu

SEQ ID NO: 2699037 - RNA, 15 nt, Haemophilus influenzae Rd
aacaacgcacgaccu

SEQ ID NO: 2699038 - RNA, 18 nt, Haemophilus influenzae Rd
aacaacgcguacuuuuuu

SEQ ID NO: 2699039 - RNA, 15 nt, Haemophilus influenzae Rd
aacaacuaaauaagg

SEQ ID NO: 2699040 - RNA, 23 nt, Haemophilus influenzae Rd
aacaacuaacuaaggugcagauu

SEQ ID NO: 2699041 - RNA, 17 nt, Haemophilus influenzae Rd
aacaacuggaauuugua

SEQ ID NO: 2699042 - RNA, 13 nt, Haemophilus influenzae Rd
aacaagaaucauc

SEQ ID NO: 2699043 - RNA, 14 nt, Haemophilus influenzae Rd
aacaagauucugaa

SEQ ID NO: 2699044 - RNA, 13 nt, Haemophilus influenzae Rd
aacaagcacaaga

SEQ ID NO: 2699045 - RNA, 20 nt, Haemophilus influenzae Rd
aacaagcacaagauuugcca

SEQ ID NO: 2699046 - RNA, 16 nt, Haemophilus influenzae Rd
aacaagccccacaggu

SEQ ID NO: 2699047 - RNA, 15 nt, Haemophilus influenzae Rd
aacaagcgcgauaaa

SEQ ID NO: 2699048 - RNA, 19 nt, Haemophilus influenzae Rd
aacaagcgcgauaaagagu

SEQ ID NO: 2699049 - RNA, 15 nt, Haemophilus influenzae Rd
aacaagcucuagaaa

SEQ ID NO: 2699050 - RNA, 18 nt, Haemophilus influenzae Rd
aacaagcucuagaaaauc

SEQ ID NO: 2699051 - RNA, 16 nt, Haemophilus influenzae Rd
aacaagcuggcuuucu

SEQ ID NO: 2699052 - RNA, 15 nt, Haemophilus influenzae Rd
aacaaguaauuuauc

SEQ ID NO: 2699053 - RNA, 19 nt, Haemophilus influenzae Rd
aacaagugguggaauaaaa

SEQ ID NO: 2699054 - RNA, 23 nt, Haemophilus influenzae Rd
aacaaguuucuaaaaucacuuuu

SEQ ID NO: 2699055 - RNA, 20 nt, Haemophilus influenzae Rd
aacaauaacugccacaucau

SEQ ID NO: 2699056 - RNA, 15 nt, Haemophilus influenzae Rd
aacaauaauuuuuaa

SEQ ID NO: 2699057 - RNA, 23 nt, Haemophilus influenzae Rd
aacaauacgauucguuucaguac

SEQ ID NO: 2699058 - RNA, 16 nt, Haemophilus influenzae Rd
aacaauauaucagaca

SEQ ID NO: 2699059 - RNA, 21 nt, Haemophilus influenzae Rd
aacaauauauucggaaaaaau

SEQ ID NO: 2699060 - RNA, 15 nt, Haemophilus influenzae Rd
aacaaucgcuucauu

SEQ ID NO: 2699061 - RNA, 21 nt, Haemophilus influenzae Rd
aacaaucgcuucauucucuuc

SEQ ID NO: 2699062 - RNA, 23 nt, Haemophilus influenzae Rd
aacaaucgcuucauucucuucug

SEQ ID NO: 2699063 - RNA, 15 nt, Haemophilus influenzae Rd
aacaaucuuguugga

SEQ ID NO: 2699064 - RNA, 13 nt, Haemophilus influenzae Rd
aacaaugaaauua

SEQ ID NO: 2699065 - RNA, 15 nt, Haemophilus influenzae Rd
aacaaugcaaauaca

SEQ ID NO: 2699066 - RNA, 16 nt, Haemophilus influenzae Rd
aacaaugcaaauacaa

SEQ ID NO: 2699067 - RNA, 14 nt, Haemophilus influenzae Rd
aacaaugcuauaaa

SEQ ID NO: 2699068 - RNA, 16 nt, Haemophilus influenzae Rd
aacaaugcuauaaaac

SEQ ID NO: 2699069 - RNA, 18 nt, Haemophilus influenzae Rd
aacaaugcuauaaaaccu

SEQ ID NO: 2699070 - RNA, 18 nt, Haemophilus influenzae Rd
aacaauggcaacaaauau

SEQ ID NO: 2699071 - RNA, 20 nt, Haemophilus influenzae Rd
aacaauggcaacaaauauug

SEQ ID NO: 2699072 - RNA, 20 nt, Haemophilus influenzae Rd
aacaauggcugaaaaauuca

SEQ ID NO: 2699073 - RNA, 22 nt, Haemophilus influenzae Rd
aacaauggcugaaaaauucaaa

SEQ ID NO: 2699074 - RNA, 14 nt, Haemophilus influenzae Rd
aacaaugucagaaa

SEQ ID NO: 2699075 - RNA, 19 nt, Haemophilus influenzae Rd
aacaaugucagaaaagauu

SEQ ID NO: 2699076 - RNA, 17 nt, Haemophilus influenzae Rd
aacaauucauaaauaau

SEQ ID NO: 2699077 - RNA, 23 nt, Haemophilus influenzae Rd
aacaauuccccuuccuugacaua

SEQ ID NO: 2699078 - RNA, 17 nt, Haemophilus influenzae Rd
aacaauuucacugaaag

SEQ ID NO: 2699079 - RNA, 21 nt, Haemophilus influenzae Rd
aacaauuucacugaaaguaag

SEQ ID NO: 2699080 - RNA, 13 nt, Haemophilus influenzae Rd
aacaauuucuaac

SEQ ID NO: 2699081 - RNA, 17 nt, Haemophilus influenzae Rd
aacaauuucuuuaccuu

SEQ ID NO: 2699082 - RNA, 18 nt, Haemophilus influenzae Rd
aacaauuuuugcauuuuc

SEQ ID NO: 2699083 - RNA, 20 nt, Haemophilus influenzae Rd
aacaauuuuugcauuuucag

SEQ ID NO: 2699084 - RNA, 18 nt, Haemophilus influenzae Rd
aacacaacauaauuaaag

SEQ ID NO: 2699085 - RNA, 20 nt, Haemophilus influenzae Rd
aacacaccuauuuuuuccug

SEQ ID NO: 2699086 - RNA, 21 nt, Haemophilus influenzae Rd
aacacagauuuuuacuucauc

SEQ ID NO: 2699087 - RNA, 22 nt, Haemophilus influenzae Rd
aacacagauuuuuacuucauca

SEQ ID NO: 2699088 - RNA, 15 nt, Haemophilus influenzae Rd
aacacauaauauuuu

SEQ ID NO: 2699089 - RNA, 18 nt, Haemophilus influenzae Rd
aacacauaauauuuuuac

SEQ ID NO: 2699090 - RNA, 19 nt, Haemophilus influenzae Rd
aacacaucagaaaaucaaa

SEQ ID NO: 2699091 - RNA, 20 nt, Haemophilus influenzae Rd
aacacaucagaaaaucaaaa

SEQ ID NO: 2699092 - RNA, 17 nt, Haemophilus influenzae Rd
aacacauccguuaagaa

SEQ ID NO: 2699093 - RNA, 20 nt, Haemophilus influenzae Rd
aacacaucgcuugcauuucu

SEQ ID NO: 2699094 - RNA, 18 nt, Haemophilus influenzae Rd
aacaccaaauauucuucu

SEQ ID NO: 2699095 - RNA, 13 nt, Haemophilus influenzae Rd
aacacccacauca

SEQ ID NO: 2699096 - RNA, 17 nt, Haemophilus influenzae Rd
aacaccgcaaaaauacu

SEQ ID NO: 2699097 - RNA, 19 nt, Haemophilus influenzae Rd
aacaccgcuaauaaaaauc

SEQ ID NO: 2699098 - RNA, 21 nt, Haemophilus influenzae Rd
aacaccgcuaauaaaaauccu

SEQ ID NO: 2699099 - RNA, 14 nt, Haemophilus influenzae Rd
aacaccuuccuugu

SEQ ID NO: 2699100 - RNA, 15 nt, Haemophilus influenzae Rd
aacacgaccauugaa

SEQ ID NO: 2699101 - RNA, 17 nt, Haemophilus influenzae Rd
aacacgcccuugugaaa

SEQ ID NO: 2699102 - RNA, 21 nt, Haemophilus influenzae Rd
aacacgcccuugugaaaggga

SEQ ID NO: 2699103 - RNA, 14 nt, Haemophilus influenzae Rd
aacacgguuccauu

SEQ ID NO: 2699104 - RNA, 14 nt, Haemophilus influenzae Rd
aacacguuugccag

SEQ ID NO: 2699105 - RNA, 14 nt, Haemophilus influenzae Rd
aacacuaugauuuu

SEQ ID NO: 2699106 - RNA, 16 nt, Haemophilus influenzae Rd
aacacuaugauuuuua

SEQ ID NO: 2699107 - RNA, 19 nt, Haemophilus influenzae Rd
aacacuaugauuuuuaacc

SEQ ID NO: 2699108 - RNA, 13 nt, Haemophilus influenzae Rd
aacacucuaucua

SEQ ID NO: 2699109 - RNA, 14 nt, Haemophilus influenzae Rd
aacacucucagaau

SEQ ID NO: 2699110 - RNA, 13 nt, Haemophilus influenzae Rd
aacacuguaaaua

SEQ ID NO: 2699111 - RNA, 17 nt, Haemophilus influenzae Rd
aacacuugcagcccaac

SEQ ID NO: 2699112 - RNA, 18 nt, Haemophilus influenzae Rd
aacacuugcuguuuuucc

SEQ ID NO: 2699113 - RNA, 19 nt, Haemophilus influenzae Rd
aacacuuuauuacuuuuau

SEQ ID NO: 2699114 - RNA, 14 nt, Haemophilus influenzae Rd
aacagaaauaacac

SEQ ID NO: 2699115 - RNA, 23 nt, Haemophilus influenzae Rd
aacagaaguauuuacugauuuua

SEQ ID NO: 2699116 - RNA, 15 nt, Haemophilus influenzae Rd
aacagaaguugaaaa

SEQ ID NO: 2699117 - RNA, 13 nt, Haemophilus influenzae Rd
aacagagaaaaaa

SEQ ID NO: 2699118 - RNA, 18 nt, Haemophilus influenzae Rd
aacagagcgucaaaauua

SEQ ID NO: 2699119 - RNA, 23 nt, Haemophilus influenzae Rd
aacagauuuaauaccauacauaa

SEQ ID NO: 2699120 - RNA, 16 nt, Haemophilus influenzae Rd
aacagcaauaaauaau

SEQ ID NO: 2699121 - RNA, 21 nt, Haemophilus influenzae Rd
aacagcaauaaauaauaggau

SEQ ID NO: 2699122 - RNA, 15 nt, Haemophilus influenzae Rd
aacagcacacuaaua

SEQ ID NO: 2699123 - RNA, 13 nt, Haemophilus influenzae Rd
aacagcagacauu

SEQ ID NO: 2699124 - RNA, 16 nt, Haemophilus influenzae Rd
aacagccaaacaaauu

SEQ ID NO: 2699125 - RNA, 17 nt, Haemophilus influenzae Rd
aacagccaguaaauugg

SEQ ID NO: 2699126 - RNA, 16 nt, Haemophilus influenzae Rd
aacagcggucaaaaua

SEQ ID NO: 2699127 - RNA, 13 nt, Haemophilus influenzae Rd
aacagcuaaaaau

SEQ ID NO: 2699128 - RNA, 19 nt, Haemophilus influenzae Rd
aacagcuaaaaaugaauua

SEQ ID NO: 2699129 - RNA, 18 nt, Haemophilus influenzae Rd
aacagcuaccaauucaaa

SEQ ID NO: 2699130 - RNA, 15 nt, Haemophilus influenzae Rd
aacagcucuguaaaa

SEQ ID NO: 2699131 - RNA, 17 nt, Haemophilus influenzae Rd
aacaggaauuugcucaa

SEQ ID NO: 2699132 - RNA, 15 nt, Haemophilus influenzae Rd
aacagggcauucauu

SEQ ID NO: 2699133 - RNA, 21 nt, Haemophilus influenzae Rd
aacagggugucguagaaauaa

SEQ ID NO: 2699134 - RNA, 22 nt, Haemophilus influenzae Rd
aacaggguguuuauaagugcca

SEQ ID NO: 2699135 - RNA, 23 nt, Haemophilus influenzae Rd
aacaggguguuuauaagugccaa

SEQ ID NO: 2699136 - RNA, 14 nt, Haemophilus influenzae Rd
aacagguaaaauac

SEQ ID NO: 2699137 - RNA, 12 nt, Haemophilus influenzae Rd
aacaguaaauuu

SEQ ID NO: 2699138 - RNA, 19 nt, Haemophilus influenzae Rd
aacaguaaugaaagaaaca

SEQ ID NO: 2699139 - RNA, 19 nt, Haemophilus influenzae Rd
aacaguaguacgaccugaa

SEQ ID NO: 2699140 - RNA, 21 nt, Haemophilus influenzae Rd
aacagucugcgccuaaaauau

SEQ ID NO: 2699141 - RNA, 21 nt, Haemophilus influenzae Rd
aacaguuaagcuaccugccau

SEQ ID NO: 2699142 - RNA, 19 nt, Haemophilus influenzae Rd
aacaguucaauaaaaauau

SEQ ID NO: 2699143 - RNA, 22 nt, Haemophilus influenzae Rd
aacaguucaauaaaaauauauu

SEQ ID NO: 2699144 - RNA, 15 nt, Haemophilus influenzae Rd
aacauaagaaauguu

SEQ ID NO: 2699145 - RNA, 18 nt, Haemophilus influenzae Rd
aacauaauaaaauuuauu

SEQ ID NO: 2699146 - RNA, 18 nt, Haemophilus influenzae Rd
aacauaauuguguuggaa

SEQ ID NO: 2699147 - RNA, 21 nt, Haemophilus influenzae Rd
aacauaccccuguugcgacag

SEQ ID NO: 2699148 - RNA, 14 nt, Haemophilus influenzae Rd
aacauagaaaucac

SEQ ID NO: 2699149 - RNA, 17 nt, Haemophilus influenzae Rd
aacauagcugaaaaaua

SEQ ID NO: 2699150 - RNA, 22 nt, Haemophilus influenzae Rd
aacauaguaaauuuuaaccgca

SEQ ID NO: 2699151 - RNA, 12 nt, Haemophilus influenzae Rd
aacauaguuaau

SEQ ID NO: 2699152 - RNA, 15 nt, Haemophilus influenzae Rd
aacauauaacccaua

SEQ ID NO: 2699153 - RNA, 20 nt, Haemophilus influenzae Rd
aacauaucaaaaaguugaau

SEQ ID NO: 2699154 - RNA, 20 nt, Haemophilus influenzae Rd
aacauaucguuaucuuuaaa

SEQ ID NO: 2699155 - RNA, 21 nt, Haemophilus influenzae Rd
aacauaugacagauagcauaa

SEQ ID NO: 2699156 - RNA, 14 nt, Haemophilus influenzae Rd
aacaucaaaaccau

SEQ ID NO: 2699157 - RNA, 21 nt, Haemophilus influenzae Rd
aacaucaacgguuuucauugc

SEQ ID NO: 2699158 - RNA, 19 nt, Haemophilus influenzae Rd
aacaucaauaagaauuacc

SEQ ID NO: 2699159 - RNA, 20 nt, Haemophilus influenzae Rd
aacaucaccgauaauaugca

SEQ ID NO: 2699160 - RNA, 20 nt, Haemophilus influenzae Rd
aacaucaccuguaaacaaau

SEQ ID NO: 2699161 - RNA, 22 nt, Haemophilus influenzae Rd
aacaucaccuguaaacaaauau

SEQ ID NO: 2699162 - RNA, 18 nt, Haemophilus influenzae Rd
aacaucacgccaucgcca

SEQ ID NO: 2699163 - RNA, 19 nt, Haemophilus influenzae Rd
aacaucacgccaucgccau

SEQ ID NO: 2699164 - RNA, 20 nt, Haemophilus influenzae Rd
aacaucacgccaucgccauu

SEQ ID NO: 2699165 - RNA, 21 nt, Haemophilus influenzae Rd
aacaucauaagguacaacaga

SEQ ID NO: 2699166 - RNA, 14 nt, Haemophilus influenzae Rd
aacaucaucaucgc

SEQ ID NO: 2699167 - RNA, 19 nt, Haemophilus influenzae Rd
aacauccgaauaaaugcau

SEQ ID NO: 2699168 - RNA, 20 nt, Haemophilus influenzae Rd
aacaucgcagugaucccagc

SEQ ID NO: 2699169 - RNA, 15 nt, Haemophilus influenzae Rd
aacaucgcuucauca

SEQ ID NO: 2699170 - RNA, 16 nt, Haemophilus influenzae Rd
aacaucgcuucaucau

SEQ ID NO: 2699171 - RNA, 16 nt, Haemophilus influenzae Rd
aacaucuuaguauuuu

SEQ ID NO: 2699172 - RNA, 22 nt, Haemophilus influenzae Rd
aacaucuucugcagaaaaaugu

SEQ ID NO: 2699173 - RNA, 13 nt, Haemophilus influenzae Rd
aacauuaaccugc

SEQ ID NO: 2699174 - RNA, 12 nt, Haemophilus influenzae Rd
aacauucaguuu

SEQ ID NO: 2699175 - RNA, 14 nt, Haemophilus influenzae Rd
aacauucccuuucc

SEQ ID NO: 2699176 - RNA, 19 nt, Haemophilus influenzae Rd
aacauugcaucagccaccu

SEQ ID NO: 2699177 - RNA, 21 nt, Haemophilus influenzae Rd
aacauuggcaccuucucgacc

SEQ ID NO: 2699178 - RNA, 12 nt, Haemophilus influenzae Rd
aacauugucaua

SEQ ID NO: 2699179 - RNA, 21 nt, Haemophilus influenzae Rd
aacauuuccaagcguaaaagu

SEQ ID NO: 2699180 - RNA, 18 nt, Haemophilus influenzae Rd
aacauuucuaucgcauuu

SEQ ID NO: 2699181 - RNA, 11 nt, Haemophilus influenzae Rd
aacauuuugac

SEQ ID NO: 2699182 - RNA, 20 nt, Haemophilus influenzae Rd
aacauuuuguaucuaaauau

SEQ ID NO: 2699183 - RNA, 16 nt, Haemophilus influenzae Rd
aacauuuuuauuuuua

SEQ ID NO: 2699184 - RNA, 17 nt, Haemophilus influenzae Rd
aacauuuuuauuuuuac

SEQ ID NO: 2699185 - RNA, 16 nt, Haemophilus influenzae Rd
aacauuuuucauuuuc

SEQ ID NO: 2699186 - RNA, 13 nt, Haemophilus influenzae Rd
aacauuuuucccu

SEQ ID NO: 2699187 - RNA, 21 nt, Haemophilus influenzae Rd
aacauuuuuuuuauccaaaau

SEQ ID NO: 2699188 - RNA, 13 nt, Haemophilus influenzae Rd
aaccaaaauacaa

SEQ ID NO: 2699189 - RNA, 17 nt, Haemophilus influenzae Rd
aaccaaaauauuucauu

SEQ ID NO: 2699190 - RNA, 15 nt, Haemophilus influenzae Rd
aaccaaacgagaaaa

SEQ ID NO: 2699191 - RNA, 12 nt, Haemophilus influenzae Rd
aaccaaagaaag

SEQ ID NO: 2699192 - RNA, 23 nt, Haemophilus influenzae Rd
aaccaaauaggcacauaaguaaa

SEQ ID NO: 2699193 - RNA, 22 nt, Haemophilus influenzae Rd
aaccaaauugauucauuugaug

SEQ ID NO: 2699194 - RNA, 18 nt, Haemophilus influenzae Rd
aaccaacguggcuuuucu

SEQ ID NO: 2699195 - RNA, 20 nt, Haemophilus influenzae Rd
aaccaacguggcuuuucuga

SEQ ID NO: 2699196 - RNA, 11 nt, Haemophilus influenzae Rd
aaccaagaaag

SEQ ID NO: 2699197 - RNA, 15 nt, Haemophilus influenzae Rd
aaccaagagccucca

SEQ ID NO: 2699198 - RNA, 18 nt, Haemophilus influenzae Rd
aaccaagccauuuaacua

SEQ ID NO: 2699199 - RNA, 13 nt, Haemophilus influenzae Rd
aaccaauaagaua

SEQ ID NO: 2699200 - RNA, 18 nt, Haemophilus influenzae Rd
aaccaauaauccuuuuuu

SEQ ID NO: 2699201 - RNA, 23 nt, Haemophilus influenzae Rd
aaccaauauugggaauauaauuc

SEQ ID NO: 2699202 - RNA, 16 nt, Haemophilus influenzae Rd
aaccaaucauaaaauu

SEQ ID NO: 2699203 - RNA, 23 nt, Haemophilus influenzae Rd
aaccaauggcaaucacaaaucca

SEQ ID NO: 2699204 - RNA, 15 nt, Haemophilus influenzae Rd
aaccacaauaaaaua

SEQ ID NO: 2699205 - RNA, 16 nt, Haemophilus influenzae Rd
aaccacaguguccagc

SEQ ID NO: 2699206 - RNA, 17 nt, Haemophilus influenzae Rd
aaccacauucaaaucca

SEQ ID NO: 2699207 - RNA, 16 nt, Haemophilus influenzae Rd
aaccacccauacuuua

SEQ ID NO: 2699208 - RNA, 16 nt, Haemophilus influenzae Rd
aaccaccccauuucuu

SEQ ID NO: 2699209 - RNA, 22 nt, Haemophilus influenzae Rd
aaccaccguagucagauaauac

SEQ ID NO: 2699210 - RNA, 14 nt, Haemophilus influenzae Rd
aaccacuaaaaaca

SEQ ID NO: 2699211 - RNA, 17 nt, Haemophilus influenzae Rd
aaccacuaucggugaag

SEQ ID NO: 2699212 - RNA, 17 nt, Haemophilus influenzae Rd
aaccacuucaaauaccu

SEQ ID NO: 2699213 - RNA, 18 nt, Haemophilus influenzae Rd
aaccacuugucauuaaaa

SEQ ID NO: 2699214 - RNA, 19 nt, Haemophilus influenzae Rd
aaccacuugucauuaaaaa

SEQ ID NO: 2699215 - RNA, 23 nt, Haemophilus influenzae Rd
aaccagaaauagaguuaaguugg

SEQ ID NO: 2699216 - RNA, 19 nt, Haemophilus influenzae Rd
aaccagccugaaaaagcua

SEQ ID NO: 2699217 - RNA, 16 nt, Haemophilus influenzae Rd
aaccagcgcaccacac

SEQ ID NO: 2699218 - RNA, 20 nt, Haemophilus influenzae Rd
aaccagcuuuccaaugcgcg

SEQ ID NO: 2699219 - RNA, 21 nt, Haemophilus influenzae Rd
aaccauacaacgaguuaagua

SEQ ID NO: 2699220 - RNA, 17 nt, Haemophilus influenzae Rd
aaccauaucguaaccau

SEQ ID NO: 2699221 - RNA, 18 nt, Haemophilus influenzae Rd
aaccauaucguaaccauc

SEQ ID NO: 2699222 - RNA, 16 nt, Haemophilus influenzae Rd
aaccaucacaaaggaa

SEQ ID NO: 2699223 - RNA, 16 nt, Haemophilus influenzae Rd
aaccaucauaggcuuu

SEQ ID NO: 2699224 - RNA, 23 nt, Haemophilus influenzae Rd
aaccaucuguugcgacaccacca

SEQ ID NO: 2699225 - RNA, 18 nt, Haemophilus influenzae Rd
aaccaucuuuuuuugcaa

SEQ ID NO: 2699226 - RNA, 16 nt, Haemophilus influenzae Rd
aaccauuaaauaggca

SEQ ID NO: 2699227 - RNA, 14 nt, Haemophilus influenzae Rd
aaccauuaacccca

SEQ ID NO: 2699228 - RNA, 13 nt, Haemophilus influenzae Rd
aaccauucccauu

SEQ ID NO: 2699229 - RNA, 21 nt, Haemophilus influenzae Rd
aaccauucccauuccaguaau

SEQ ID NO: 2699230 - RNA, 14 nt, Haemophilus influenzae Rd
aaccauuguuuaau

SEQ ID NO: 2699231 - RNA, 15 nt, Haemophilus influenzae Rd
aaccauuuauaaugc

SEQ ID NO: 2699232 - RNA, 13 nt, Haemophilus influenzae Rd
aaccauuuguugg

SEQ ID NO: 2699233 - RNA, 16 nt, Haemophilus influenzae Rd
aaccauuuuaaucaua

SEQ ID NO: 2699234 - RNA, 14 nt, Haemophilus influenzae Rd
aaccauuuuacaau

SEQ ID NO: 2699235 - RNA, 13 nt, Haemophilus influenzae Rd
aaccauuuucucu

SEQ ID NO: 2699236 - RNA, 22 nt, Haemophilus influenzae Rd
aaccauuuucucugcgauuucu

SEQ ID NO: 2699237 - RNA, 21 nt, Haemophilus influenzae Rd
aacccaaaaaagcguugaaaa

SEQ ID NO: 2699238 - RNA, 15 nt, Haemophilus influenzae Rd
aacccauaauugugg

SEQ ID NO: 2699239 - RNA, 12 nt, Haemophilus influenzae Rd
aacccauuuauu

SEQ ID NO: 2699240 - RNA, 13 nt, Haemophilus influenzae Rd
aaccccuuuucug

SEQ ID NO: 2699241 - RNA, 21 nt, Haemophilus influenzae Rd
aacccgcuugcuuacauuuug

SEQ ID NO: 2699242 - RNA, 13 nt, Haemophilus influenzae Rd
aacccgcuuuuaa

SEQ ID NO: 2699243 - RNA, 22 nt, Haemophilus influenzae Rd
aacccgcuuuuaacaaauacau

SEQ ID NO: 2699244 - RNA, 20 nt, Haemophilus influenzae Rd
aacccuacaggcuuccaaca

SEQ ID NO: 2699245 - RNA, 16 nt, Haemophilus influenzae Rd
aacccuccgcauuaau

SEQ ID NO: 2699246 - RNA, 15 nt, Haemophilus influenzae Rd
aaccgaaaaaauagu

SEQ ID NO: 2699247 - RNA, 20 nt, Haemophilus influenzae Rd
aaccgacucguccaucaaaa

SEQ ID NO: 2699248 - RNA, 15 nt, Haemophilus influenzae Rd
aaccgacugagcuaa

SEQ ID NO: 2699249 - RNA, 24 nt, Haemophilus influenzae Rd
aaccgagcuacauggauuugcaau

SEQ ID NO: 2699250 - RNA, 17 nt, Haemophilus influenzae Rd
aaccgauagcuuuuguu

SEQ ID NO: 2699251 - RNA, 18 nt, Haemophilus influenzae Rd
aaccgauuaauuccagug

SEQ ID NO: 2699252 - RNA, 14 nt, Haemophilus influenzae Rd
aaccgauuuuaaau

SEQ ID NO: 2699253 - RNA, 24 nt, Haemophilus influenzae Rd
aaccgcacuuaauaaauauugauu

SEQ ID NO: 2699254 - RNA, 23 nt, Haemophilus influenzae Rd
aaccgcacuucuaugaagaacaa

SEQ ID NO: 2699255 - RNA, 16 nt, Haemophilus influenzae Rd
aaccgcacuuuaaaua

SEQ ID NO: 2699256 - RNA, 20 nt, Haemophilus influenzae Rd
aaccgcacuuuaaauauuua

SEQ ID NO: 2699257 - RNA, 19 nt, Haemophilus influenzae Rd
aaccgcacuuucauuccau

SEQ ID NO: 2699258 - RNA, 15 nt, Haemophilus influenzae Rd
aaccgcacuuuuuaa

SEQ ID NO: 2699259 - RNA, 21 nt, Haemophilus influenzae Rd
aaccgcagcuaauccaaauca

SEQ ID NO: 2699260 - RNA, 19 nt, Haemophilus influenzae Rd
aaccgcccgguaaaucuac

SEQ ID NO: 2699261 - RNA, 21 nt, Haemophilus influenzae Rd
aaccgccguauugaauaauua

SEQ ID NO: 2699262 - RNA, 21 nt, Haemophilus influenzae Rd
aaccgccuaaaguuacacaau

SEQ ID NO: 2699263 - RNA, 21 nt, Haemophilus influenzae Rd
aaccgcucuuuuuauuuagaa

SEQ ID NO: 2699264 - RNA, 21 nt, Haemophilus influenzae Rd
aaccgcuguaccagugccaau

SEQ ID NO: 2699265 - RNA, 13 nt, Haemophilus influenzae Rd
aaccgcugucaua

SEQ ID NO: 2699266 - RNA, 18 nt, Haemophilus influenzae Rd
aaccgcuucaggugcuuu

SEQ ID NO: 2699267 - RNA, 15 nt, Haemophilus influenzae Rd
aaccgcuuuaucaaa

SEQ ID NO: 2699268 - RNA, 19 nt, Haemophilus influenzae Rd
aaccgcuuuaucaaagaau

SEQ ID NO: 2699269 - RNA, 19 nt, Haemophilus influenzae Rd
aaccguaauuucaaaucuu

SEQ ID NO: 2699270 - RNA, 20 nt, Haemophilus influenzae Rd
aaccguacacgcgcaaauuu

SEQ ID NO: 2699271 - RNA, 14 nt, Haemophilus influenzae Rd
aaccgucuuuaaau

SEQ ID NO: 2699272 - RNA, 17 nt, Haemophilus influenzae Rd
aaccgugcucaauuucu

SEQ ID NO: 2699273 - RNA, 20 nt, Haemophilus influenzae Rd
aaccguuuuuauuuguucua

SEQ ID NO: 2699274 - RNA, 22 nt, Haemophilus influenzae Rd
aaccguuuuuauuuguucuacu

SEQ ID NO: 2699275 - RNA, 23 nt, Haemophilus influenzae Rd
aaccguuuuuauuuguucuacuu

SEQ ID NO: 2699276 - RNA, 12 nt, Haemophilus influenzae Rd
aaccuaaaauag

SEQ ID NO: 2699277 - RNA, 15 nt, Haemophilus influenzae Rd
aaccuaaaauauuua

SEQ ID NO: 2699278 - RNA, 16 nt, Haemophilus influenzae Rd
aaccuaaaauugauuu

SEQ ID NO: 2699279 - RNA, 20 nt, Haemophilus influenzae Rd
aaccuaaaccuuauuuuaaa

SEQ ID NO: 2699280 - RNA, 21 nt, Haemophilus influenzae Rd
aaccuaaaccuuauuuuaaau

SEQ ID NO: 2699281 - RNA, 19 nt, Haemophilus influenzae Rd
aaccuaaagccaaggcgau

SEQ ID NO: 2699282 - RNA, 13 nt, Haemophilus influenzae Rd
aaccuaauuucau

SEQ ID NO: 2699283 - RNA, 23 nt, Haemophilus influenzae Rd
aaccuacaacaaaggguaaauaa

SEQ ID NO: 2699284 - RNA, 17 nt, Haemophilus influenzae Rd
aaccuacauuaaucacc

SEQ ID NO: 2699285 - RNA, 20 nt, Haemophilus influenzae Rd
aaccucccaaaaacuaaaua

SEQ ID NO: 2699286 - RNA, 17 nt, Haemophilus influenzae Rd
aaccugaguaaauaaac

SEQ ID NO: 2699287 - RNA, 18 nt, Haemophilus influenzae Rd
aaccugauaaguagaaaa

SEQ ID NO: 2699288 - RNA, 13 nt, Haemophilus influenzae Rd
aaccugcaaggau

SEQ ID NO: 2699289 - RNA, 20 nt, Haemophilus influenzae Rd
aaccugcaaggauauuucca

SEQ ID NO: 2699290 - RNA, 11 nt, Haemophilus influenzae Rd
aaccugcccuu

SEQ ID NO: 2699291 - RNA, 21 nt, Haemophilus influenzae Rd
aaccugucgcaaugaagauua

SEQ ID NO: 2699292 - RNA, 17 nt, Haemophilus influenzae Rd
aaccuguggcagguggg

SEQ ID NO: 2699293 - RNA, 18 nt, Haemophilus influenzae Rd
aaccuguggcaggugggu

SEQ ID NO: 2699294 - RNA, 22 nt, Haemophilus influenzae Rd
aaccuguuugggauaagcaauc

SEQ ID NO: 2699295 - RNA, 22 nt, Haemophilus influenzae Rd
aaccuuacugccuuuuucuucu

SEQ ID NO: 2699296 - RNA, 21 nt, Haemophilus influenzae Rd
aaccuuauugcauaguuuuau

SEQ ID NO: 2699297 - RNA, 19 nt, Haemophilus influenzae Rd
aaccuuauuuuaaauaaaa

SEQ ID NO: 2699298 - RNA, 18 nt, Haemophilus influenzae Rd
aaccuucacuuaaauuca

SEQ ID NO: 2699299 - RNA, 19 nt, Haemophilus influenzae Rd
aaccuucuggguaaaauaa

SEQ ID NO: 2699300 - RNA, 20 nt, Haemophilus influenzae Rd
aaccuucuggguaaaauaau

SEQ ID NO: 2699301 - RNA, 23 nt, Haemophilus influenzae Rd
aaccuuggaaauuaacaauacga

SEQ ID NO: 2699302 - RNA, 14 nt, Haemophilus influenzae Rd
aaccuuguaaauac

SEQ ID NO: 2699303 - RNA, 19 nt, Haemophilus influenzae Rd
aaccuuuaccgucaauaaa

SEQ ID NO: 2699304 - RNA, 18 nt, Haemophilus influenzae Rd
aaccuuucauauaaauaa

SEQ ID NO: 2699305 - RNA, 22 nt, Haemophilus influenzae Rd
aaccuuugguaaaagaaauggc

SEQ ID NO: 2699306 - RNA, 20 nt, Haemophilus influenzae Rd
aaccuuuuucuuccauuuca

SEQ ID NO: 2699307 - RNA, 14 nt, Haemophilus influenzae Rd
aacgaaaaaaauaa

SEQ ID NO: 2699308 - RNA, 17 nt, Haemophilus influenzae Rd
aacgaaaaaaauaaaaa

SEQ ID NO: 2699309 - RNA, 23 nt, Haemophilus influenzae Rd
aacgaacuggcugagagaagaaa

SEQ ID NO: 2699310 - RNA, 21 nt, Haemophilus influenzae Rd
aacgaaucgguaacauaugau

SEQ ID NO: 2699311 - RNA, 22 nt, Haemophilus influenzae Rd
aacgaaucgguaacauaugauu

SEQ ID NO: 2699312 - RNA, 20 nt, Haemophilus influenzae Rd
aacgaauuuagggaaaauuu

SEQ ID NO: 2699313 - RNA, 12 nt, Haemophilus influenzae Rd
aacgacaaaacu

SEQ ID NO: 2699314 - RNA, 14 nt, Haemophilus influenzae Rd
aacgacaauuaaag

SEQ ID NO: 2699315 - RNA, 15 nt, Haemophilus influenzae Rd
aacgacaauuaaagu

SEQ ID NO: 2699316 - RNA, 23 nt, Haemophilus influenzae Rd
aacgacccaauuagaugauuuua

SEQ ID NO: 2699317 - RNA, 20 nt, Haemophilus influenzae Rd
aacgacgcacuguugugaag

SEQ ID NO: 2699318 - RNA, 21 nt, Haemophilus influenzae Rd
aacgacgccacuguugugaag

SEQ ID NO: 2699319 - RNA, 19 nt, Haemophilus influenzae Rd
aacgacguuugcuaccuuc

SEQ ID NO: 2699320 - RNA, 15 nt, Haemophilus influenzae Rd
aacgagcaauauuca

SEQ ID NO: 2699321 - RNA, 14 nt, Haemophilus influenzae Rd
aacgagcauauuuu

SEQ ID NO: 2699322 - RNA, 23 nt, Haemophilus influenzae Rd
aacgauaacacccucaaccacuu

SEQ ID NO: 2699323 - RNA, 22 nt, Haemophilus influenzae Rd
aacgauagccguccauuucaau

SEQ ID NO: 2699324 - RNA, 14 nt, Haemophilus influenzae Rd
aacgaugaagaaaa

SEQ ID NO: 2699325 - RNA, 16 nt, Haemophilus influenzae Rd
aacgaugaagaaaauu

SEQ ID NO: 2699326 - RNA, 20 nt, Haemophilus influenzae Rd
aacgaugggcaauggcaauc

SEQ ID NO: 2699327 - RNA, 20 nt, Haemophilus influenzae Rd
aacgauguugcaaccuucag

SEQ ID NO: 2699328 - RNA, 19 nt, Haemophilus influenzae Rd
aacgcaaauaccaggagaa

SEQ ID NO: 2699329 - RNA, 22 nt, Haemophilus influenzae Rd
aacgcaagcugugcaagcauuu

SEQ ID NO: 2699330 - RNA, 13 nt, Haemophilus influenzae Rd
aacgcacacaaca

SEQ ID NO: 2699331 - RNA, 21 nt, Haemophilus influenzae Rd
aacgcaccacgaccuaagaaa

SEQ ID NO: 2699332 - RNA, 18 nt, Haemophilus influenzae Rd
aacgcacgccuacuauug

SEQ ID NO: 2699333 - RNA, 16 nt, Haemophilus influenzae Rd
aacgcacguaacaaau

SEQ ID NO: 2699334 - RNA, 21 nt, Haemophilus influenzae Rd
aacgcacuucaaaugaagugc

SEQ ID NO: 2699335 - RNA, 15 nt, Haemophilus influenzae Rd
aacgcauauuuuguu

SEQ ID NO: 2699336 - RNA, 18 nt, Haemophilus influenzae Rd
aacgcauuguuacaaauu

SEQ ID NO: 2699337 - RNA, 22 nt, Haemophilus influenzae Rd
aacgccagaaguuguuuuucuu

SEQ ID NO: 2699338 - RNA, 20 nt, Haemophilus influenzae Rd
aacgccauucacauucuuuu

SEQ ID NO: 2699339 - RNA, 18 nt, Haemophilus influenzae Rd
aacgccauucguucccaa

SEQ ID NO: 2699340 - RNA, 18 nt, Haemophilus influenzae Rd
aacgccauuggauacaua

SEQ ID NO: 2699341 - RNA, 18 nt, Haemophilus influenzae Rd
aacgcccccgccauuuug

SEQ ID NO: 2699342 - RNA, 20 nt, Haemophilus influenzae Rd
aacgccgauaaguccaucac

SEQ ID NO: 2699343 - RNA, 22 nt, Haemophilus influenzae Rd
aacgccgcaacuaauaaaccaa

SEQ ID NO: 2699344 - RNA, 13 nt, Haemophilus influenzae Rd
aacgccguucaaa

SEQ ID NO: 2699345 - RNA, 16 nt, Haemophilus influenzae Rd
aacgccguucaaaauc

SEQ ID NO: 2699346 - RNA, 15 nt, Haemophilus influenzae Rd
aacgccuacaucuua

SEQ ID NO: 2699347 - RNA, 16 nt, Haemophilus influenzae Rd
aacgccugcugcaguu

SEQ ID NO: 2699348 - RNA, 14 nt, Haemophilus influenzae Rd
aacgcgagguugaa

SEQ ID NO: 2699349 - RNA, 17 nt, Haemophilus influenzae Rd
aacgcgaguaaaauaaa

SEQ ID NO: 2699350 - RNA, 18 nt, Haemophilus influenzae Rd
aacgcgaguaaaauaaaa

SEQ ID NO: 2699351 - RNA, 14 nt, Haemophilus influenzae Rd
aacgcguuaaauca

SEQ ID NO: 2699352 - RNA, 19 nt, Haemophilus influenzae Rd
aacgcucaaauaaauugcc

SEQ ID NO: 2699353 - RNA, 17 nt, Haemophilus influenzae Rd
aacgcucgcgauauugc

SEQ ID NO: 2699354 - RNA, 14 nt, Haemophilus influenzae Rd
aacgcucgcuggaa

SEQ ID NO: 2699355 - RNA, 17 nt, Haemophilus influenzae Rd
aacgcucgcuggaauca

SEQ ID NO: 2699356 - RNA, 17 nt, Haemophilus influenzae Rd
aacgcucugcaccuuca

SEQ ID NO: 2699357 - RNA, 18 nt, Haemophilus influenzae Rd
aacgcucugcaccuucac

SEQ ID NO: 2699358 - RNA, 21 nt, Haemophilus influenzae Rd
aacgcucugcaccuucaccac

SEQ ID NO: 2699359 - RNA, 23 nt, Haemophilus influenzae Rd
aacgcugaaacgggcucaucaca

SEQ ID NO: 2699360 - RNA, 20 nt, Haemophilus influenzae Rd
aacgcuggaauauuuuucuc

SEQ ID NO: 2699361 - RNA, 14 nt, Haemophilus influenzae Rd
aacgcuuaaugaac

SEQ ID NO: 2699362 - RNA, 22 nt, Haemophilus influenzae Rd
aacgcuuaggcguucuaaagca

SEQ ID NO: 2699363 - RNA, 13 nt, Haemophilus influenzae Rd
aacggauuaaaag

SEQ ID NO: 2699364 - RNA, 14 nt, Haemophilus influenzae Rd
aacggauuaaaagu

SEQ ID NO: 2699365 - RNA, 16 nt, Haemophilus influenzae Rd
aacggcagccagcagc

SEQ ID NO: 2699366 - RNA, 17 nt, Haemophilus influenzae Rd
aacgguagcaggagaaa

SEQ ID NO: 2699367 - RNA, 13 nt, Haemophilus influenzae Rd
aacggucaaaaug

SEQ ID NO: 2699368 - RNA, 20 nt, Haemophilus influenzae Rd
aacggugggcugaagcccac

SEQ ID NO: 2699369 - RNA, 17 nt, Haemophilus influenzae Rd
aacgguuaauaaauucu

SEQ ID NO: 2699370 - RNA, 20 nt, Haemophilus influenzae Rd
aacgguucacguaaaaucau

SEQ ID NO: 2699371 - RNA, 15 nt, Haemophilus influenzae Rd
aacgguugaaauugc

SEQ ID NO: 2699372 - RNA, 16 nt, Haemophilus influenzae Rd
aacgguugaaauugcg

SEQ ID NO: 2699373 - RNA, 14 nt, Haemophilus influenzae Rd
aacguaaaaguaaa

SEQ ID NO: 2699374 - RNA, 22 nt, Haemophilus influenzae Rd
aacguaaaaguaaauaagccau

SEQ ID NO: 2699375 - RNA, 14 nt, Haemophilus influenzae Rd
aacguaaauuaugu

SEQ ID NO: 2699376 - RNA, 13 nt, Haemophilus influenzae Rd
aacguaaauucag

SEQ ID NO: 2699377 - RNA, 15 nt, Haemophilus influenzae Rd
aacguaacaacgcac

SEQ ID NO: 2699378 - RNA, 19 nt, Haemophilus influenzae Rd
aacguaacuaaaaaaguuu

SEQ ID NO: 2699379 - RNA, 13 nt, Haemophilus influenzae Rd
aacguaagaucag

SEQ ID NO: 2699380 - RNA, 13 nt, Haemophilus influenzae Rd
aacguaagcacca

SEQ ID NO: 2699381 - RNA, 16 nt, Haemophilus influenzae Rd
aacguaauagauaaag

SEQ ID NO: 2699382 - RNA, 20 nt, Haemophilus influenzae Rd
aacguagguaguuuucaaua

SEQ ID NO: 2699383 - RNA, 17 nt, Haemophilus influenzae Rd
aacguauuuauaccaga

SEQ ID NO: 2699384 - RNA, 18 nt, Haemophilus influenzae Rd
aacgucgaauaacuuuau

SEQ ID NO: 2699385 - RNA, 15 nt, Haemophilus influenzae Rd
aacgucgugggauuu

SEQ ID NO: 2699386 - RNA, 17 nt, Haemophilus influenzae Rd
aacgugggaauuuuccc

SEQ ID NO: 2699387 - RNA, 14 nt, Haemophilus influenzae Rd
aacguuaaaugaac

SEQ ID NO: 2699388 - RNA, 16 nt, Haemophilus influenzae Rd
aacguuauaaacaaca

SEQ ID NO: 2699389 - RNA, 23 nt, Haemophilus influenzae Rd
aacguucauauuguuucaacaua

SEQ ID NO: 2699390 - RNA, 15 nt, Haemophilus influenzae Rd
aacguucuaagaauu

SEQ ID NO: 2699391 - RNA, 19 nt, Haemophilus influenzae Rd
aacguugcucuuucaaguu

SEQ ID NO: 2699392 - RNA, 21 nt, Haemophilus influenzae Rd
aacguuggguuugauuuauac

SEQ ID NO: 2699393 - RNA, 21 nt, Haemophilus influenzae Rd
aacguuuauggcuuucaauuu

SEQ ID NO: 2699394 - RNA, 19 nt, Haemophilus influenzae Rd
aacguuuauuuauuccauc

SEQ ID NO: 2699395 - RNA, 21 nt, Haemophilus influenzae Rd
aacguuucaucacuucaaaaa

SEQ ID NO: 2699396 - RNA, 18 nt, Haemophilus influenzae Rd
aacguuuuaaguuuucac

SEQ ID NO: 2699397 - RNA, 19 nt, Haemophilus influenzae Rd
aacguuuuaaguuuucacc

SEQ ID NO: 2699398 - RNA, 15 nt, Haemophilus influenzae Rd
aacguuuuuuacuug

SEQ ID NO: 2699399 - RNA, 17 nt, Haemophilus influenzae Rd
aacuaaaaaaguuuaag

SEQ ID NO: 2699400 - RNA, 14 nt, Haemophilus influenzae Rd
aacuaaaaaauagu

SEQ ID NO: 2699401 - RNA, 18 nt, Haemophilus influenzae Rd
aacuaaaaaucccauuua

SEQ ID NO: 2699402 - RNA, 11 nt, Haemophilus influenzae Rd
aacuaaaauaa

SEQ ID NO: 2699403 - RNA, 14 nt, Haemophilus influenzae Rd
aacuaaaccauuua

SEQ ID NO: 2699404 - RNA, 23 nt, Haemophilus influenzae Rd
aacuaaacuguaaucuaaauauu

SEQ ID NO: 2699405 - RNA, 13 nt, Haemophilus influenzae Rd
aacuaaagaauca

SEQ ID NO: 2699406 - RNA, 17 nt, Haemophilus influenzae Rd
aacuaaagaaucaaauu

SEQ ID NO: 2699407 - RNA, 17 nt, Haemophilus influenzae Rd
aacuaaaggcacaaaaa

SEQ ID NO: 2699408 - RNA, 11 nt, Haemophilus influenzae Rd
aacuaaauauu

SEQ ID NO: 2699409 - RNA, 14 nt, Haemophilus influenzae Rd
aacuaaauauucaa

SEQ ID NO: 2699410 - RNA, 23 nt, Haemophilus influenzae Rd
aacuaaccacgcuggaauuuuca

SEQ ID NO: 2699411 - RNA, 19 nt, Haemophilus influenzae Rd
aacuaaccgcacuuuggaa

SEQ ID NO: 2699412 - RNA, 14 nt, Haemophilus influenzae Rd
aacuaagaugauca

SEQ ID NO: 2699413 - RNA, 17 nt, Haemophilus influenzae Rd
aacuaaggugcagauuu

SEQ ID NO: 2699414 - RNA, 21 nt, Haemophilus influenzae Rd
aacuaaggugcagauuuuuua

SEQ ID NO: 2699415 - RNA, 14 nt, Haemophilus influenzae Rd
aacuaauaaaccaa

SEQ ID NO: 2699416 - RNA, 15 nt, Haemophilus influenzae Rd
aacuaauaaaccaau

SEQ ID NO: 2699417 - RNA, 17 nt, Haemophilus influenzae Rd
aacuaauaaaccaauaa

SEQ ID NO: 2699418 - RNA, 17 nt, Haemophilus influenzae Rd
aacuaauagcgugaaaa

SEQ ID NO: 2699419 - RNA, 18 nt, Haemophilus influenzae Rd
aacuaauaucacuuugua

SEQ ID NO: 2699420 - RNA, 13 nt, Haemophilus influenzae Rd
aacuaauucggaa

SEQ ID NO: 2699421 - RNA, 15 nt, Haemophilus influenzae Rd
aacuaauuuauuaaa

SEQ ID NO: 2699422 - RNA, 14 nt, Haemophilus influenzae Rd
aacuaauuucauuu

SEQ ID NO: 2699423 - RNA, 17 nt, Haemophilus influenzae Rd
aacuaauuugacgauaa

SEQ ID NO: 2699424 - RNA, 12 nt, Haemophilus influenzae Rd
aacuacaaguac

SEQ ID NO: 2699425 - RNA, 14 nt, Haemophilus influenzae Rd
aacuacauaaacuu

SEQ ID NO: 2699426 - RNA, 15 nt, Haemophilus influenzae Rd
aacuaccacagguuu

SEQ ID NO: 2699427 - RNA, 23 nt, Haemophilus influenzae Rd
aacuaccgcacuuagauuugaac

SEQ ID NO: 2699428 - RNA, 16 nt, Haemophilus influenzae Rd
aacuacggacuaaaua

SEQ ID NO: 2699429 - RNA, 18 nt, Haemophilus influenzae Rd
aacuacggacuaaauaaa

SEQ ID NO: 2699430 - RNA, 23 nt, Haemophilus influenzae Rd
aacuacggacuaaauaaaucaca

SEQ ID NO: 2699431 - RNA, 22 nt, Haemophilus influenzae Rd
aauaaaauaaucuggcaagcca

SEQ ID NO: 2699432 - RNA, 16 nt, Haemophilus influenzae Rd
aauaaaauagcuaaca

SEQ ID NO: 2699433 - RNA, 13 nt, Haemophilus influenzae Rd
aauaaaauguuua

SEQ ID NO: 2699434 - RNA, 13 nt, Haemophilus influenzae Rd
aauaaaauugcuu

SEQ ID NO: 2699435 - RNA, 21 nt, Haemophilus influenzae Rd
aauaaaauugcuuuguuaauu

SEQ ID NO: 2699436 - RNA, 18 nt, Haemophilus influenzae Rd
aauaaaauuuauuacaaa

SEQ ID NO: 2699437 - RNA, 13 nt, Haemophilus influenzae Rd
aauaaaauuugcg

SEQ ID NO: 2699438 - RNA, 13 nt, Haemophilus influenzae Rd
aauaaacacaaac

SEQ ID NO: 2699439 - RNA, 17 nt, Haemophilus influenzae Rd
aauaaacacaaacuggu

SEQ ID NO: 2699440 - RNA, 19 nt, Haemophilus influenzae Rd
aauaaacauacaucuaauu

SEQ ID NO: 2699441 - RNA, 18 nt, Haemophilus influenzae Rd
aauaaacauauugaugau

SEQ ID NO: 2699442 - RNA, 13 nt, Haemophilus influenzae Rd
aauaaaccaacau

SEQ ID NO: 2699443 - RNA, 14 nt, Haemophilus influenzae Rd
aauaaaccaacaua

SEQ ID NO: 2699444 - RNA, 21 nt, Haemophilus influenzae Rd
aauaaaccaacauacauuaau

SEQ ID NO: 2699445 - RNA, 13 nt, Haemophilus influenzae Rd
aauaaaccaauaa

SEQ ID NO: 2699446 - RNA, 17 nt, Haemophilus influenzae Rd
aauaaaccaauaagaua

SEQ ID NO: 2699447 - RNA, 22 nt, Haemophilus influenzae Rd
aauaaaccaccgauuaauaaaa

SEQ ID NO: 2699448 - RNA, 17 nt, Haemophilus influenzae Rd
aauaaaccguuagguuu

SEQ ID NO: 2699449 - RNA, 20 nt, Haemophilus influenzae Rd
aauaaaccguuagguuuaaa

SEQ ID NO: 2699450 - RNA, 14 nt, Haemophilus influenzae Rd
aauaaagaagaaaa

SEQ ID NO: 2699451 - RNA, 11 nt, Haemophilus influenzae Rd
aauaaagauag

SEQ ID NO: 2699452 - RNA, 18 nt, Haemophilus influenzae Rd
aauaaagauagguacaag

SEQ ID NO: 2699453 - RNA, 16 nt, Haemophilus influenzae Rd
aauaaagcuccuugaa

SEQ ID NO: 2699454 - RNA, 21 nt, Haemophilus influenzae Rd
aauaaagcugaccgcacuuuu

SEQ ID NO: 2699455 - RNA, 14 nt, Haemophilus influenzae Rd
aauaaaggauuaaa

SEQ ID NO: 2699456 - RNA, 18 nt, Haemophilus influenzae Rd
aauaaaggauuaaauaac

SEQ ID NO: 2699457 - RNA, 14 nt, Haemophilus influenzae Rd
aauaaaguaaaaua

SEQ ID NO: 2699458 - RNA, 16 nt, Haemophilus influenzae Rd
aauaaaguaaaauauu

SEQ ID NO: 2699459 - RNA, 17 nt, Haemophilus influenzae Rd
aauaaaguaaaauauug

SEQ ID NO: 2699460 - RNA, 16 nt, Haemophilus influenzae Rd
aauaaagucgguucau

SEQ ID NO: 2699461 - RNA, 12 nt, Haemophilus influenzae Rd
aauaaaguugag

SEQ ID NO: 2699462 - RNA, 12 nt, Haemophilus influenzae Rd
aauaaauauaau

SEQ ID NO: 2699463 - RNA, 22 nt, Haemophilus influenzae Rd
aauaaauauguugaauaguaaa

SEQ ID NO: 2699464 - RNA, 21 nt, Haemophilus influenzae Rd
aauaaauauuauuaaaaacua

SEQ ID NO: 2699465 - RNA, 21 nt, Haemophilus influenzae Rd
aauaaauauucugcauuaaau

SEQ ID NO: 2699466 - RNA, 22 nt, Haemophilus influenzae Rd
aauaaauauucugcauuaaauu

SEQ ID NO: 2699467 - RNA, 11 nt, Haemophilus influenzae Rd
aauaaaucaaa

SEQ ID NO: 2699468 - RNA, 21 nt, Haemophilus influenzae Rd
aauaaaucuuuugaaagauuu

SEQ ID NO: 2699469 - RNA, 22 nt, Haemophilus influenzae Rd
aauaaaugauguaggcaaaaac

SEQ ID NO: 2699470 - RNA, 21 nt, Haemophilus influenzae Rd
aauaaaugcaucauuaauaca

SEQ ID NO: 2699471 - RNA, 23 nt, Haemophilus influenzae Rd
aauaaaugcaucauuaauacaca

SEQ ID NO: 2699472 - RNA, 13 nt, Haemophilus influenzae Rd
aauaaauuaaaaa

SEQ ID NO: 2699473 - RNA, 15 nt, Haemophilus influenzae Rd
aauaaauuaaaaaaa

SEQ ID NO: 2699474 - RNA, 16 nt, Haemophilus influenzae Rd
aauaaauuaaaaaaau

SEQ ID NO: 2699475 - RNA, 20 nt, Haemophilus influenzae Rd
aauaaauuaacuuaucuaaa

SEQ ID NO: 2699476 - RNA, 21 nt, Haemophilus influenzae Rd
aauaaauuaacuuaucuaaaa

SEQ ID NO: 2699477 - RNA, 16 nt, Haemophilus influenzae Rd
aauaaauucaaaaaau

SEQ ID NO: 2699478 - RNA, 17 nt, Haemophilus influenzae Rd
aauaaauucaaaaaaug

SEQ ID NO: 2699479 - RNA, 15 nt, Haemophilus influenzae Rd
aauaaauucaccacu

SEQ ID NO: 2699480 - RNA, 19 nt, Haemophilus influenzae Rd
aauaaauuggggaaguaau

SEQ ID NO: 2699481 - RNA, 13 nt, Haemophilus influenzae Rd
aauaaauuuuaaa

SEQ ID NO: 2699482 - RNA, 17 nt, Haemophilus influenzae Rd
aauaaauuuuaaaaucu

SEQ ID NO: 2699483 - RNA, 22 nt, Haemophilus influenzae Rd
aauaaauuuuucgccuaauuca

SEQ ID NO: 2699484 - RNA, 14 nt, Haemophilus influenzae Rd
aauaacaaaaacaa

SEQ ID NO: 2699485 - RNA, 14 nt, Haemophilus influenzae Rd
aauaacaacaaaag

SEQ ID NO: 2699486 - RNA, 18 nt, Haemophilus influenzae Rd
aauaacaacaaaagugcg

SEQ ID NO: 2699487 - RNA, 20 nt, Haemophilus influenzae Rd
aauaacaacuggaauuugua

SEQ ID NO: 2699488 - RNA, 13 nt, Haemophilus influenzae Rd
aauaacaagcaca

SEQ ID NO: 2699489 - RNA, 19 nt, Haemophilus influenzae Rd
aauaacaagcgaaaaacgu

SEQ ID NO: 2699490 - RNA, 13 nt, Haemophilus influenzae Rd
aauaacaagcuca

SEQ ID NO: 2699491 - RNA, 17 nt, Haemophilus influenzae Rd
aauaacaagcucagguu

SEQ ID NO: 2699492 - RNA, 21 nt, Haemophilus influenzae Rd
aauaacaagcucagguucaaa

SEQ ID NO: 2699493 - RNA, 17 nt, Haemophilus influenzae Rd
aauaacacagaaaccaa

SEQ ID NO: 2699494 - RNA, 21 nt, Haemophilus influenzae Rd
aauaacauagaaaucacuaaa

SEQ ID NO: 2699495 - RNA, 19 nt, Haemophilus influenzae Rd
aauaacaugguuaaaauau

SEQ ID NO: 2699496 - RNA, 12 nt, Haemophilus influenzae Rd
aauaaccaauaa

SEQ ID NO: 2699497 - RNA, 19 nt, Haemophilus influenzae Rd
aauaaccacuccaaauaau

SEQ ID NO: 2699498 - RNA, 13 nt, Haemophilus influenzae Rd
aauaacccuugua

SEQ ID NO: 2699499 - RNA, 20 nt, Haemophilus influenzae Rd
aauaaccuaauuucauaaaa

SEQ ID NO: 2699500 - RNA, 21 nt, Haemophilus influenzae Rd
aauaaccuugcugauaaauuc

SEQ ID NO: 2699501 - RNA, 19 nt, Haemophilus influenzae Rd
aauaacgauaagauuugcu

SEQ ID NO: 2699502 - RNA, 21 nt, Haemophilus influenzae Rd
aauaacgcaucaccacaaaau

SEQ ID NO: 2699503 - RNA, 15 nt, Haemophilus influenzae Rd
aauaacguaaccauu

SEQ ID NO: 2699504 - RNA, 15 nt, Haemophilus influenzae Rd
aauaacgucauuaau

SEQ ID NO: 2699505 - RNA, 16 nt, Haemophilus influenzae Rd
aauaacguuacuaaaa

SEQ ID NO: 2699506 - RNA, 13 nt, Haemophilus influenzae Rd
aauaacuaaaaau

SEQ ID NO: 2699507 - RNA, 14 nt, Haemophilus influenzae Rd
aauaacuaaaaaua

SEQ ID NO: 2699508 - RNA, 13 nt, Haemophilus influenzae Rd
aauaacuacauaa

SEQ ID NO: 2699509 - RNA, 14 nt, Haemophilus influenzae Rd
aauaacucaagcaa

SEQ ID NO: 2699510 - RNA, 20 nt, Haemophilus influenzae Rd
aauaacugaauaauuuccaa

SEQ ID NO: 2699511 - RNA, 18 nt, Haemophilus influenzae Rd
aauaacugauuuugaguu

SEQ ID NO: 2699512 - RNA, 19 nt, Haemophilus influenzae Rd
aauaacugccacaucaucg

SEQ ID NO: 2699513 - RNA, 15 nt, Haemophilus influenzae Rd
aauaacuucauccau

SEQ ID NO: 2699514 - RNA, 13 nt, Haemophilus influenzae Rd
aauaacuuuauuu

SEQ ID NO: 2699515 - RNA, 17 nt, Haemophilus influenzae Rd
aauaacuuuauuuacaa

SEQ ID NO: 2699516 - RNA, 19 nt, Haemophilus influenzae Rd
aauaagaauuaccgcacuu

SEQ ID NO: 2699517 - RNA, 14 nt, Haemophilus influenzae Rd
aauaagaauuuuaa

SEQ ID NO: 2699518 - RNA, 15 nt, Haemophilus influenzae Rd
aauaagaugguaucc

SEQ ID NO: 2699519 - RNA, 14 nt, Haemophilus influenzae Rd
aauaagauuuuuaa

SEQ ID NO: 2699520 - RNA, 21 nt, Haemophilus influenzae Rd
aauaagauuuuugauaaaaaa

SEQ ID NO: 2699521 - RNA, 21 nt, Haemophilus influenzae Rd
aauaagcaacgcaucgcccaa

SEQ ID NO: 2699522 - RNA, 19 nt, Haemophilus influenzae Rd
aauaagcaaguaauuuaaa

SEQ ID NO: 2699523 - RNA, 23 nt, Haemophilus influenzae Rd
aauaagcaaguaauuuaaaaagu

SEQ ID NO: 2699524 - RNA, 15 nt, Haemophilus influenzae Rd
aauaagcauaaaagu

SEQ ID NO: 2699525 - RNA, 13 nt, Haemophilus influenzae Rd
aauaagcccaacu

SEQ ID NO: 2699526 - RNA, 16 nt, Haemophilus influenzae Rd
aauaagcccaacuuaa

SEQ ID NO: 2699527 - RNA, 16 nt, Haemophilus influenzae Rd
aauaagcgaaaaacau

SEQ ID NO: 2699528 - RNA, 17 nt, Haemophilus influenzae Rd
aauaagcgaaaaacaua

SEQ ID NO: 2699529 - RNA, 13 nt, Haemophilus influenzae Rd
aauaagcgauugc

SEQ ID NO: 2699530 - RNA, 21 nt, Haemophilus influenzae Rd
aauaagcuaaguacaaaagag

SEQ ID NO: 2699531 - RNA, 19 nt, Haemophilus influenzae Rd
aauaagcuuggcuuauuua

SEQ ID NO: 2699532 - RNA, 19 nt, Haemophilus influenzae Rd
aauaaggcguaaaacuauu

SEQ ID NO: 2699533 - RNA, 18 nt, Haemophilus influenzae Rd
aauaaggcuagauaacac

SEQ ID NO: 2699534 - RNA, 16 nt, Haemophilus influenzae Rd
aauaagggcugauuuu

SEQ ID NO: 2699535 - RNA, 21 nt, Haemophilus influenzae Rd
aauaagggcugauuuuaaaua

SEQ ID NO: 2699536 - RNA, 19 nt, Haemophilus influenzae Rd
aauaaggucagcaaauuau

SEQ ID NO: 2699537 - RNA, 13 nt, Haemophilus influenzae Rd
aauaaguaguuac

SEQ ID NO: 2699538 - RNA, 16 nt, Haemophilus influenzae Rd
aauaagugagaaaguu

SEQ ID NO: 2699539 - RNA, 18 nt, Haemophilus influenzae Rd
aauaagugagaaaguuaa

SEQ ID NO: 2699540 - RNA, 17 nt, Haemophilus influenzae Rd
aauaagugcgguuaauu

SEQ ID NO: 2699541 - RNA, 17 nt, Haemophilus influenzae Rd
aauaaguuuucaucaau

SEQ ID NO: 2699542 - RNA, 23 nt, Haemophilus influenzae Rd
aauaaguuuucaucaaugccauu

SEQ ID NO: 2699543 - RNA, 13 nt, Haemophilus influenzae Rd
aauaauaaaaagu

SEQ ID NO: 2699544 - RNA, 15 nt, Haemophilus influenzae Rd
aauaauaaauccaaa

SEQ ID NO: 2699545 - RNA, 13 nt, Haemophilus influenzae Rd
aauaauaaauccu

SEQ ID NO: 2699546 - RNA, 16 nt, Haemophilus influenzae Rd
aauaauaagauuuuug

SEQ ID NO: 2699547 - RNA, 17 nt, Haemophilus influenzae Rd
aauaauaccuuuccauu

SEQ ID NO: 2699548 - RNA, 18 nt, Haemophilus influenzae Rd
aauaauacguucguaacu

SEQ ID NO: 2699549 - RNA, 16 nt, Haemophilus influenzae Rd
aauaauagccauaucc

SEQ ID NO: 2699550 - RNA, 16 nt, Haemophilus influenzae Rd
aauaauaggcgaauca

SEQ ID NO: 2699551 - RNA, 18 nt, Haemophilus influenzae Rd
aauaauaggcgaaucaaa

SEQ ID NO: 2699552 - RNA, 15 nt, Haemophilus influenzae Rd
aauaauaguaguaau

SEQ ID NO: 2699553 - RNA, 20 nt, Haemophilus influenzae Rd
aauaauauaggcgaacaaaa

SEQ ID NO: 2699554 - RNA, 14 nt, Haemophilus influenzae Rd
aauaauauauuuaa

SEQ ID NO: 2699555 - RNA, 11 nt, Haemophilus influenzae Rd
aauaauaucaa

SEQ ID NO: 2699556 - RNA, 12 nt, Haemophilus influenzae Rd
aauaauaucaau

SEQ ID NO: 2699557 - RNA, 15 nt, Haemophilus influenzae Rd
aauaauaucgcccga

SEQ ID NO: 2699558 - RNA, 22 nt, Haemophilus influenzae Rd
aauaauaucgcccgauuuuaaa

SEQ ID NO: 2699559 - RNA, 14 nt, Haemophilus influenzae Rd
aauaauaucugcuu

SEQ ID NO: 2699560 - RNA, 22 nt, Haemophilus influenzae Rd
aauaauauucaaaacauuaauu

SEQ ID NO: 2699561 - RNA, 23 nt, Haemophilus influenzae Rd
aauaauauuugguguauuuauaa

SEQ ID NO: 2699562 - RNA, 12 nt, Haemophilus influenzae Rd
aauaaucaaauc

SEQ ID NO: 2699563 - RNA, 21 nt, Haemophilus influenzae Rd
aauaaucacaacaaaccagcc

SEQ ID NO: 2699564 - RNA, 18 nt, Haemophilus influenzae Rd
aauaaucacaauuuuuaa

SEQ ID NO: 2699565 - RNA, 15 nt, Haemophilus influenzae Rd
aauaaucacaguacc

SEQ ID NO: 2699566 - RNA, 18 nt, Haemophilus influenzae Rd
aauaaucacuugauaaaa

SEQ ID NO: 2699567 - RNA, 18 nt, Haemophilus influenzae Rd
aauaaucaggauauuuua

SEQ ID NO: 2699568 - RNA, 17 nt, Haemophilus influenzae Rd
aauaauccccuaaacua

SEQ ID NO: 2699569 - RNA, 19 nt, Haemophilus influenzae Rd
aauaauccucuuuaaaauu

SEQ ID NO: 2699570 - RNA, 20 nt, Haemophilus influenzae Rd
aauaauccugguauuuacaa

SEQ ID NO: 2699571 - RNA, 14 nt, Haemophilus influenzae Rd
aauaaucgaaaaag

SEQ ID NO: 2699572 - RNA, 16 nt, Haemophilus influenzae Rd
aauaaucuucuuccca

SEQ ID NO: 2699573 - RNA, 16 nt, Haemophilus influenzae Rd
aauaaugaaagggaaa

SEQ ID NO: 2699574 - RNA, 17 nt, Haemophilus influenzae Rd
aauaaugaaauauucca

SEQ ID NO: 2699575 - RNA, 18 nt, Haemophilus influenzae Rd
aauaaugaauaauuuuua

SEQ ID NO: 2699576 - RNA, 12 nt, Haemophilus influenzae Rd
aauaaugcaaaa

SEQ ID NO: 2699577 - RNA, 21 nt, Haemophilus influenzae Rd
aauaaugccauuggacacaau

SEQ ID NO: 2699578 - RNA, 17 nt, Haemophilus influenzae Rd
aauaaugccucaucuuu

SEQ ID NO: 2699579 - RNA, 18 nt, Haemophilus influenzae Rd
aauaaugcuaauuucaaa

SEQ ID NO: 2699580 - RNA, 19 nt, Haemophilus influenzae Rd
aauaaugcuaauuucaaac

SEQ ID NO: 2699581 - RNA, 18 nt, Haemophilus influenzae Rd
aauaauggauuaauucga

SEQ ID NO: 2699582 - RNA, 14 nt, Haemophilus influenzae Rd
aauaauguauuucu

SEQ ID NO: 2699583 - RNA, 15 nt, Haemophilus influenzae Rd
aauaauguauuucua

SEQ ID NO: 2699584 - RNA, 20 nt, Haemophilus influenzae Rd
aauaauguuaccgacaacca

SEQ ID NO: 2699585 - RNA, 11 nt, Haemophilus influenzae Rd
aauaauguuuu

SEQ ID NO: 2699586 - RNA, 18 nt, Haemophilus influenzae Rd
aauaauguuuucauuaau

SEQ ID NO: 2699587 - RNA, 17 nt, Haemophilus influenzae Rd
aauaauuaaaaauaaau

SEQ ID NO: 2699588 - RNA, 13 nt, Haemophilus influenzae Rd
aauaauuaagaaa

SEQ ID NO: 2699589 - RNA, 24 nt, Haemophilus influenzae Rd
aauaauuauuauccuauaguagaa

SEQ ID NO: 2699590 - RNA, 11 nt, Haemophilus influenzae Rd
aauaauucagc

SEQ ID NO: 2699591 - RNA, 23 nt, Haemophilus influenzae Rd
aauaauucagcgagagaauauuu

SEQ ID NO: 2699592 - RNA, 23 nt, Haemophilus influenzae Rd
aauaauucauguuuuuuagauuu

SEQ ID NO: 2699593 - RNA, 14 nt, Haemophilus influenzae Rd
aauaauucuuuaau

SEQ ID NO: 2699594 - RNA, 15 nt, Haemophilus influenzae Rd
aauaauugaagcaau

SEQ ID NO: 2699595 - RNA, 16 nt, Haemophilus influenzae Rd
aauaauugaugcuaaa

SEQ ID NO: 2699596 - RNA, 23 nt, Haemophilus influenzae Rd
aauaauugguaaucaaauucugu

SEQ ID NO: 2699597 - RNA, 16 nt, Haemophilus influenzae Rd
aauaauuucauuguua

SEQ ID NO: 2699598 - RNA, 16 nt, Haemophilus influenzae Rd
aauaauuuccaacaca

SEQ ID NO: 2699599 - RNA, 23 nt, Haemophilus influenzae Rd
aauaauuuccuuuccuugacaua

SEQ ID NO: 2699600 - RNA, 22 nt, Haemophilus influenzae Rd
aauaauuuccuuuuuuauuuau

SEQ ID NO: 2699601 - RNA, 21 nt, Haemophilus influenzae Rd
  misc_feature (9)..(11): n is a, c, g or u
aauaauuunnngcaaaaagua

SEQ ID NO: 2699602 - RNA, 22 nt, Haemophilus influenzae Rd
aauaauuuuacguuucauuuuu

SEQ ID NO: 2699603 - RNA, 18 nt, Haemophilus influenzae Rd
aauaauuuucauugaaaa

SEQ ID NO: 2699604 - RNA, 17 nt, Haemophilus influenzae Rd
aauaauuuuuaauucuu

SEQ ID NO: 2699605 - RNA, 19 nt, Haemophilus influenzae Rd
aauaauuuuuaauucuuuu

SEQ ID NO: 2699606 - RNA, 18 nt, Haemophilus influenzae Rd
aauaauuuuuugaauaug

SEQ ID NO: 2699607 - RNA, 12 nt, Haemophilus influenzae Rd
aauacaaaauau

SEQ ID NO: 2699608 - RNA, 13 nt, Haemophilus influenzae Rd
aauacaaagcacu

SEQ ID NO: 2699609 - RNA, 17 nt, Haemophilus influenzae Rd
aauacaaauacugaccu

SEQ ID NO: 2699610 - RNA, 14 nt, Haemophilus influenzae Rd
aauacaacaagaaa

SEQ ID NO: 2699611 - RNA, 22 nt, Haemophilus influenzae Rd
aauacaagcgauuuuuauauaa

SEQ ID NO: 2699612 - RNA, 16 nt, Haemophilus influenzae Rd
aauacaaucagcugcu

SEQ ID NO: 2699613 - RNA, 16 nt, Haemophilus influenzae Rd
aauacaauuuucuuuu

SEQ ID NO: 2699614 - RNA, 20 nt, Haemophilus influenzae Rd
aauacaauuuuuuucaagca

SEQ ID NO: 2699615 - RNA, 18 nt, Haemophilus influenzae Rd
aauacaccaauaauuaaa

SEQ ID NO: 2699616 - RNA, 14 nt, Haemophilus influenzae Rd
aauacaccccaaaa

SEQ ID NO: 2699617 - RNA, 13 nt, Haemophilus influenzae Rd
aauacacgaggaa

SEQ ID NO: 2699618 - RNA, 13 nt, Haemophilus influenzae Rd
aauacacuucuaa

SEQ ID NO: 2699619 - RNA, 14 nt, Haemophilus influenzae Rd
aauacacuucuaaa

SEQ ID NO: 2699620 - RNA, 15 nt, Haemophilus influenzae Rd
aauacacuucuaaaa

SEQ ID NO: 2699621 - RNA, 17 nt, Haemophilus influenzae Rd
aauacacuucuaaaaua

SEQ ID NO: 2699622 - RNA, 15 nt, Haemophilus influenzae Rd
aauacacuuuaaauu

SEQ ID NO: 2699623 - RNA, 20 nt, Haemophilus influenzae Rd
aauacacuuuaaauuuuccu

SEQ ID NO: 2699624 - RNA, 22 nt, Haemophilus influenzae Rd
aauacacuuuuacuuugauucg

SEQ ID NO: 2699625 - RNA, 21 nt, Haemophilus influenzae Rd
aauacagccgcuggaaacaaa

SEQ ID NO: 2699626 - RNA, 22 nt, Haemophilus influenzae Rd
aauacagccgcuggaaacaaac

SEQ ID NO: 2699627 - RNA, 18 nt, Haemophilus influenzae Rd
aauacagcucaaaaugcu

SEQ ID NO: 2699628 - RNA, 16 nt, Haemophilus influenzae Rd
aauacaguuucugguu

SEQ ID NO: 2699629 - RNA, 16 nt, Haemophilus influenzae Rd
aauacauaaagaauaa

SEQ ID NO: 2699630 - RNA, 15 nt, Haemophilus influenzae Rd
aauacauaauuaaau

SEQ ID NO: 2699631 - RNA, 21 nt, Haemophilus influenzae Rd
aauacauaauuaaauuaagga

SEQ ID NO: 2699632 - RNA, 15 nt, Haemophilus influenzae Rd
aauacauauuuuuag

SEQ ID NO: 2699633 - RNA, 19 nt, Haemophilus influenzae Rd
aauacaucuucacaaaaca

SEQ ID NO: 2699634 - RNA, 17 nt, Haemophilus influenzae Rd
aauacauuaaguauauu

SEQ ID NO: 2699635 - RNA, 16 nt, Haemophilus influenzae Rd
aauacauuauuaaaag

SEQ ID NO: 2699636 - RNA, 17 nt, Haemophilus influenzae Rd
aauacauuauuaaaagc

SEQ ID NO: 2699637 - RNA, 21 nt, Haemophilus influenzae Rd
aauacauuggguuacggcuaa

SEQ ID NO: 2699638 - RNA, 15 nt, Haemophilus influenzae Rd
aauacauuuucauaa

SEQ ID NO: 2699639 - RNA, 14 nt, Haemophilus influenzae Rd
aauaccaauaauaa

SEQ ID NO: 2699640 - RNA, 15 nt, Haemophilus influenzae Rd
aauaccaauaauuaa

SEQ ID NO: 2699641 - RNA, 13 nt, Haemophilus influenzae Rd
aauaccauguaaa

SEQ ID NO: 2699642 - RNA, 16 nt, Haemophilus influenzae Rd
aauaccauguaaaccc

SEQ ID NO: 2699643 - RNA, 20 nt, Haemophilus influenzae Rd
aauaccauguaaacccacaa

SEQ ID NO: 2699644 - RNA, 18 nt, Haemophilus influenzae Rd
aauaccgcacuuuggcaa

SEQ ID NO: 2699645 - RNA, 18 nt, Haemophilus influenzae Rd
aauaccgcacuuuuauug

SEQ ID NO: 2699646 - RNA, 21 nt, Haemophilus influenzae Rd
aauaccgcagcagguuuuccu

SEQ ID NO: 2699647 - RNA, 17 nt, Haemophilus influenzae Rd
aauaccgcuugaauauc

SEQ ID NO: 2699648 - RNA, 17 nt, Haemophilus influenzae Rd
aauaccgcuugcaacca

SEQ ID NO: 2699649 - RNA, 14 nt, Haemophilus influenzae Rd
aauaccugauuucg

SEQ ID NO: 2699650 - RNA, 22 nt, Haemophilus influenzae Rd
aauaccuucuugauuauuuaau

SEQ ID NO: 2699651 - RNA, 17 nt, Haemophilus influenzae Rd
aauacgacaucugguuu

SEQ ID NO: 2699652 - RNA, 15 nt, Haemophilus influenzae Rd
aauacgaucugcauc

SEQ ID NO: 2699653 - RNA, 20 nt, Haemophilus influenzae Rd
aauacgauucguuucaguac

SEQ ID NO: 2699654 - RNA, 18 nt, Haemophilus influenzae Rd
aauacgcgucuuucugca

SEQ ID NO: 2699655 - RNA, 20 nt, Haemophilus influenzae Rd
aauacgcgucuuucugcaau

SEQ ID NO: 2699656 - RNA, 22 nt, Haemophilus influenzae Rd
aauacguaaucccauuucaucu

SEQ ID NO: 2699657 - RNA, 16 nt, Haemophilus influenzae Rd
aauacguauaauugac

SEQ ID NO: 2699658 - RNA, 15 nt, Haemophilus influenzae Rd
aauacgucaauugcu

SEQ ID NO: 2699659 - RNA, 20 nt, Haemophilus influenzae Rd
aauacgucuaauuuagucau

SEQ ID NO: 2699660 - RNA, 21 nt, Haemophilus influenzae Rd
aauacgucuaauuuagucaua

SEQ ID NO: 2699661 - RNA, 17 nt, Haemophilus influenzae Rd
aauacguugaacuuaau

SEQ ID NO: 2699662 - RNA, 18 nt, Haemophilus influenzae Rd
aauacguugcugugguuu

SEQ ID NO: 2699663 - RNA, 19 nt, Haemophilus influenzae Rd
aauacguuguuuuucuacc

SEQ ID NO: 2699664 - RNA, 14 nt, Haemophilus influenzae Rd
aauacguuuaauau

SEQ ID NO: 2699665 - RNA, 14 nt, Haemophilus influenzae Rd
aauacuaacuggaa

SEQ ID NO: 2699666 - RNA, 20 nt, Haemophilus influenzae Rd
aauacuaauaggaguaaaaa

SEQ ID NO: 2699667 - RNA, 21 nt, Haemophilus influenzae Rd
aauacuagcucguaaagauca

SEQ ID NO: 2699668 - RNA, 22 nt, Haemophilus influenzae Rd
aauacugcaccguauucuuuac

SEQ ID NO: 2699669 - RNA, 21 nt, Haemophilus influenzae Rd
aauacugcgacuuucccugca

SEQ ID NO: 2699670 - RNA, 22 nt, Haemophilus influenzae Rd
aauacuggcacuaaaccugcuu

SEQ ID NO: 2699671 - RNA, 21 nt, Haemophilus influenzae Rd
aauacuguuaccaauaacuaa

SEQ ID NO: 2699672 - RNA, 22 nt, Haemophilus influenzae Rd
aauacuuagcgugcuaauucca

SEQ ID NO: 2699673 - RNA, 17 nt, Haemophilus influenzae Rd
aauacuugaccaaaauu

SEQ ID NO: 2699674 - RNA, 14 nt, Haemophilus influenzae Rd
aauacuuucagaau

SEQ ID NO: 2699675 - RNA, 21 nt, Haemophilus influenzae Rd
aauacuuucagcuuccaucca

SEQ ID NO: 2699676 - RNA, 19 nt, Haemophilus influenzae Rd
aauacuuuuagcuccuaaa

SEQ ID NO: 2699677 - RNA, 22 nt, Haemophilus influenzae Rd
aauacuuuucccaaugcaccaa

SEQ ID NO: 2699678 - RNA, 24 nt, Haemophilus influenzae Rd
aauagaaaguggcuuaauuuauua

SEQ ID NO: 2699679 - RNA, 17 nt, Haemophilus influenzae Rd
aauagaagcguucaucu

SEQ ID NO: 2699680 - RNA, 17 nt, Haemophilus influenzae Rd
aauagaaugaaaaacau

SEQ ID NO: 2699681 - RNA, 13 nt, Haemophilus influenzae Rd
aauagaauuuuac

SEQ ID NO: 2699682 - RNA, 20 nt, Haemophilus influenzae Rd
aauagaauuuugcaagccaa

SEQ ID NO: 2699683 - RNA, 16 nt, Haemophilus influenzae Rd
aauagacuacuuaaaa

SEQ ID NO: 2699684 - RNA, 14 nt, Haemophilus influenzae Rd
aauagacucuugca

SEQ ID NO: 2699685 - RNA, 20 nt, Haemophilus influenzae Rd
aauagacugaaaaaagugcg

SEQ ID NO: 2699686 - RNA, 20 nt, Haemophilus influenzae Rd
aauagacuuaauaauauauu

SEQ ID NO: 2699687 - RNA, 19 nt, Haemophilus influenzae Rd
aauagagaauaauuaaguu

SEQ ID NO: 2699688 - RNA, 15 nt, Haemophilus influenzae Rd
aauagaguaccaaaa

SEQ ID NO: 2699689 - RNA, 16 nt, Haemophilus influenzae Rd
aauagauacaagaaag

SEQ ID NO: 2699690 - RNA, 17 nt, Haemophilus influenzae Rd
aauagauccgcaauaua

SEQ ID NO: 2699691 - RNA, 21 nt, Haemophilus influenzae Rd
aauagauuacguagaaaacaa

SEQ ID NO: 2699692 - RNA, 23 nt, Haemophilus influenzae Rd
aauagauuacguagaaaacaaua

SEQ ID NO: 2699693 - RNA, 13 nt, Haemophilus influenzae Rd
aauagauucuugc

SEQ ID NO: 2699694 - RNA, 22 nt, Haemophilus influenzae Rd
aauagauuuauacuuaauuucu

SEQ ID NO: 2699695 - RNA, 13 nt, Haemophilus influenzae Rd
aauagauuugcuc

SEQ ID NO: 2699696 - RNA, 23 nt, Haemophilus influenzae Rd
aauagcaagaacaauuaauacgu

SEQ ID NO: 2699697 - RNA, 17 nt, Haemophilus influenzae Rd
aauagcaauaucugcua

SEQ ID NO: 2699698 - RNA, 14 nt, Haemophilus influenzae Rd
aauagcacagaaaa

SEQ ID NO: 2699699 - RNA, 19 nt, Haemophilus influenzae Rd
aauagccauauuaucugcu

SEQ ID NO: 2699700 - RNA, 23 nt, Haemophilus influenzae Rd
aauagccgacaucuauuuugcuu

SEQ ID NO: 2699701 - RNA, 23 nt, Haemophilus influenzae Rd
aauagccgcucuuuuuguugauc

SEQ ID NO: 2699702 - RNA, 17 nt, Haemophilus influenzae Rd
aauagccuaaauauuua

SEQ ID NO: 2699703 - RNA, 18 nt, Haemophilus influenzae Rd
aauagccuaaauauuuau

SEQ ID NO: 2699704 - RNA, 21 nt, Haemophilus influenzae Rd
aauagccuaaauauuuauaca

SEQ ID NO: 2699705 - RNA, 15 nt, Haemophilus influenzae Rd
aauagccuucaucac

SEQ ID NO: 2699706 - RNA, 17 nt, Haemophilus influenzae Rd
aauagcgacuugccgcu

SEQ ID NO: 2699707 - RNA, 23 nt, Haemophilus influenzae Rd
aauagcgugcauuccuaaaaucg

SEQ ID NO: 2699708 - RNA, 14 nt, Haemophilus influenzae Rd
aauagcuaacaaau

SEQ ID NO: 2699709 - RNA, 18 nt, Haemophilus influenzae Rd
aauagcuaacaaauuuaa

SEQ ID NO: 2699710 - RNA, 23 nt, Haemophilus influenzae Rd
aauagcucaacgcuuuucguuuc

SEQ ID NO: 2699711 - RNA, 12 nt, Haemophilus influenzae Rd
aauagcugauaa

SEQ ID NO: 2699712 - RNA, 18 nt, Haemophilus influenzae Rd
aauagcugggcaaaauca

SEQ ID NO: 2699713 - RNA, 16 nt, Haemophilus influenzae Rd
aauagcuguaagauaa

SEQ ID NO: 2699714 - RNA, 18 nt, Haemophilus influenzae Rd
aauagcuguaagauaaac

SEQ ID NO: 2699715 - RNA, 17 nt, Haemophilus influenzae Rd
aauagcugugcaaaauc

SEQ ID NO: 2699716 - RNA, 19 nt, Haemophilus influenzae Rd
aauagcuuccgcuuuuuuc

SEQ ID NO: 2699717 - RNA, 13 nt, Haemophilus influenzae Rd
aauagcuucuuuu

SEQ ID NO: 2699718 - RNA, 14 nt, Haemophilus influenzae Rd
aauagcuucuuuua

SEQ ID NO: 2699719 - RNA, 13 nt, Haemophilus influenzae Rd
aauagcuuuuuaa

SEQ ID NO: 2699720 - RNA, 17 nt, Haemophilus influenzae Rd
aauaggcgaaucaaaau

SEQ ID NO: 2699721 - RNA, 22 nt, Haemophilus influenzae Rd
aauaggugcuuaacugaaaauu

SEQ ID NO: 2699722 - RNA, 21 nt, Haemophilus influenzae Rd
aauagguuauaaguuuuuugc

SEQ ID NO: 2699723 - RNA, 17 nt, Haemophilus influenzae Rd
aauagguuuguacuguu

SEQ ID NO: 2699724 - RNA, 14 nt, Haemophilus influenzae Rd
aauaguaaagaaua

SEQ ID NO: 2699725 - RNA, 15 nt, Haemophilus influenzae Rd
aauaguaaagaauau

SEQ ID NO: 2699726 - RNA, 17 nt, Haemophilus influenzae Rd
aauaguaaagaauauuu

SEQ ID NO: 2699727 - RNA, 16 nt, Haemophilus influenzae Rd
aauagucauaaaggcu

SEQ ID NO: 2699728 - RNA, 14 nt, Haemophilus influenzae Rd
aauaguuaaagccu

SEQ ID NO: 2699729 - RNA, 20 nt, Haemophilus influenzae Rd
aauaguuaauaaucacaauu

SEQ ID NO: 2699730 - RNA, 21 nt, Haemophilus influenzae Rd
aauaguuaauaaucacaauuu

SEQ ID NO: 2699731 - RNA, 22 nt, Haemophilus influenzae Rd
aauaguuaauugauuuaaaaau

SEQ ID NO: 2699732 - RNA, 15 nt, Haemophilus influenzae Rd
aauaguugaaauuug

SEQ ID NO: 2699733 - RNA, 19 nt, Haemophilus influenzae Rd
aauaguuggguaaucaaau

SEQ ID NO: 2699734 - RNA, 22 nt, Haemophilus influenzae Rd
aauaguuggguaaucaaauuca

SEQ ID NO: 2699735 - RNA, 22 nt, Haemophilus influenzae Rd
aauaguuguuugugaaguuuau

SEQ ID NO: 2699736 - RNA, 21 nt, Haemophilus influenzae Rd
aauaguuuucacaaucgccaa

SEQ ID NO: 2699737 - RNA, 12 nt, Haemophilus influenzae Rd
aauauaaaaaau

SEQ ID NO: 2699738 - RNA, 17 nt, Haemophilus influenzae Rd
aauauaaacugacagaa

SEQ ID NO: 2699739 - RNA, 13 nt, Haemophilus influenzae Rd
aauauaaauggaa

SEQ ID NO: 2699740 - RNA, 19 nt, Haemophilus influenzae Rd
aauauaaauggaaaccauu

SEQ ID NO: 2699741 - RNA, 12 nt, Haemophilus influenzae Rd
aauauaaauuau

SEQ ID NO: 2699742 - RNA, 16 nt, Haemophilus influenzae Rd
aauauaaauuauguua

SEQ ID NO: 2699743 - RNA, 16 nt, Haemophilus influenzae Rd
aauauaagugauuaaa

SEQ ID NO: 2699744 - RNA, 17 nt, Haemophilus influenzae Rd
aauauaaguuauuuaua

SEQ ID NO: 2699745 - RNA, 20 nt, Haemophilus influenzae Rd
aauauaaguuauuuauauaa

SEQ ID NO: 2699746 - RNA, 22 nt, Haemophilus influenzae Rd
aauauaaguuauuuauauaauu

SEQ ID NO: 2699747 - RNA, 13 nt, Haemophilus influenzae Rd
aauauaauaaaua

SEQ ID NO: 2699748 - RNA, 13 nt, Haemophilus influenzae Rd
aauauaaucuuuu

SEQ ID NO: 2699749 - RNA, 15 nt, Haemophilus influenzae Rd
aauauaauuaucaac

SEQ ID NO: 2699750 - RNA, 22 nt, Haemophilus influenzae Rd
aauauaauuaucaacaucaacu

SEQ ID NO: 2699751 - RNA, 14 nt, Haemophilus influenzae Rd
aauauaauuuccua

SEQ ID NO: 2699752 - RNA, 18 nt, Haemophilus influenzae Rd
aauauagcaaacuaggua

SEQ ID NO: 2699753 - RNA, 21 nt, Haemophilus influenzae Rd
aauauaggauuuuaauguuug

SEQ ID NO: 2699754 - RNA, 17 nt, Haemophilus influenzae Rd
aauauaggcgaacaaaa

SEQ ID NO: 2699755 - RNA, 17 nt, Haemophilus influenzae Rd
aauauaggguaaauaaa

SEQ ID NO: 2699756 - RNA, 18 nt, Haemophilus influenzae Rd
aauauaggguaaauaaaa

SEQ ID NO: 2699757 - RNA, 19 nt, Haemophilus influenzae Rd
aauauaggguaaauaaaaa

SEQ ID NO: 2699758 - RNA, 13 nt, Haemophilus influenzae Rd
aauauagucaaau

SEQ ID NO: 2699759 - RNA, 23 nt, Haemophilus influenzae Rd
aauauauaucauggcacaaaaua

SEQ ID NO: 2699760 - RNA, 15 nt, Haemophilus influenzae Rd
aauauaucagacaau

SEQ ID NO: 2699761 - RNA, 18 nt, Haemophilus influenzae Rd
aauauaugggaaacaaua

SEQ ID NO: 2699762 - RNA, 16 nt, Haemophilus influenzae Rd
aauauauuaagugcgg

SEQ ID NO: 2699763 - RNA, 19 nt, Haemophilus influenzae Rd
aauauauuaauuauuuuag

SEQ ID NO: 2699764 - RNA, 20 nt, Haemophilus influenzae Rd
aauauauuaauuauuuuaga

SEQ ID NO: 2699765 - RNA, 16 nt, Haemophilus influenzae Rd
aauauauuauuaaguc

SEQ ID NO: 2699766 - RNA, 20 nt, Haemophilus influenzae Rd
aauauauucggaaaaaauuu

SEQ ID NO: 2699767 - RNA, 19 nt, Haemophilus influenzae Rd
aauauauuucuaauaaagu

SEQ ID NO: 2699768 - RNA, 20 nt, Haemophilus influenzae Rd
aauauauuucuuuucaaaca

SEQ ID NO: 2699769 - RNA, 13 nt, Haemophilus influenzae Rd
aauaucaaaaaaa

SEQ ID NO: 2699770 - RNA, 17 nt, Haemophilus influenzae Rd
aauaucaaaaaaauuua

SEQ ID NO: 2699771 - RNA, 12 nt, Haemophilus influenzae Rd
aauaucaaaauu

SEQ ID NO: 2699772 - RNA, 15 nt, Haemophilus influenzae Rd
aauaucaaaauuaug

SEQ ID NO: 2699773 - RNA, 18 nt, Haemophilus influenzae Rd
aauaucaaaauuauguuu

SEQ ID NO: 2699774 - RNA, 12 nt, Haemophilus influenzae Rd
aauaucaaagaa

SEQ ID NO: 2699775 - RNA, 14 nt, Haemophilus influenzae Rd
aauaucaaagaaaa

SEQ ID NO: 2699776 - RNA, 15 nt, Haemophilus influenzae Rd
aauaucaagucaaaa

SEQ ID NO: 2699777 - RNA, 18 nt, Haemophilus influenzae Rd
aauaucaagucaaaaacc

SEQ ID NO: 2699778 - RNA, 17 nt, Haemophilus influenzae Rd
aauaucaaucacuucuc

SEQ ID NO: 2699779 - RNA, 20 nt, Haemophilus influenzae Rd
aauaucaaucgguuucacaa

SEQ ID NO: 2699780 - RNA, 22 nt, Haemophilus influenzae Rd
aauaucacuucuguaagcagcu

SEQ ID NO: 2699781 - RNA, 18 nt, Haemophilus influenzae Rd
aauaucagcccuuuguuu

SEQ ID NO: 2699782 - RNA, 14 nt, Haemophilus influenzae Rd
aauaucauuagcau

SEQ ID NO: 2699783 - RNA, 16 nt, Haemophilus influenzae Rd
aauauccaaaauguuc

SEQ ID NO: 2699784 - RNA, 17 nt, Haemophilus influenzae Rd
aauauccacauaaccaa

SEQ ID NO: 2699785 - RNA, 23 nt, Haemophilus influenzae Rd
aauaucccuuauuuuaguagauu

SEQ ID NO: 2699786 - RNA, 21 nt, Haemophilus influenzae Rd
aauaucgcaaucaauucuuuc

SEQ ID NO: 2699787 - RNA, 23 nt, Haemophilus influenzae Rd
aauaucggcaucuacaccuucug

SEQ ID NO: 2699788 - RNA, 17 nt, Haemophilus influenzae Rd
aauaucguaaaaaauua

SEQ ID NO: 2699789 - RNA, 17 nt, Haemophilus influenzae Rd
aauaucuaagauuuuag

SEQ ID NO: 2699790 - RNA, 22 nt, Haemophilus influenzae Rd
aauaucuaaggcgacaaaaugu

SEQ ID NO: 2699791 - RNA, 16 nt, Haemophilus influenzae Rd
aauaucucgugaugca

SEQ ID NO: 2699792 - RNA, 20 nt, Haemophilus influenzae Rd
aauaucugcacguaaaguug

SEQ ID NO: 2699793 - RNA, 12 nt, Haemophilus influenzae Rd
aauaucugcuaa

SEQ ID NO: 2699794 - RNA, 16 nt, Haemophilus influenzae Rd
aauaucugcuuuuucu

SEQ ID NO: 2699795 - RNA, 15 nt, Haemophilus influenzae Rd
aauaucuucaauuuc

SEQ ID NO: 2699796 - RNA, 19 nt, Haemophilus influenzae Rd
aauaucuuccacaacaacc

SEQ ID NO: 2699797 - RNA, 22 nt, Haemophilus influenzae Rd
aauaucuuccguuuuuuucacg

SEQ ID NO: 2699798 - RNA, 18 nt, Haemophilus influenzae Rd
aauaucuucuaauaaaau

SEQ ID NO: 2699799 - RNA, 14 nt, Haemophilus influenzae Rd
aauaucuuucucuu

SEQ ID NO: 2699800 - RNA, 16 nt, Haemophilus influenzae Rd
aauaucuuucucuugc

SEQ ID NO: 2699801 - RNA, 15 nt, Haemophilus influenzae Rd
aauaucuuugacuaa

SEQ ID NO: 2699802 - RNA, 14 nt, Haemophilus influenzae Rd
aauaugaaauuucu

SEQ ID NO: 2699803 - RNA, 17 nt, Haemophilus influenzae Rd
aauaugaaauuucuuua

SEQ ID NO: 2699804 - RNA, 18 nt, Haemophilus influenzae Rd
aauaugauaaaugcaaua

SEQ ID NO: 2699805 - RNA, 24 nt, Haemophilus influenzae Rd
aauaugauuagucuacaagaaacc

SEQ ID NO: 2699806 - RNA, 22 nt, Haemophilus influenzae Rd
aauaugauucugugcaauauuu

SEQ ID NO: 2699807 - RNA, 19 nt, Haemophilus influenzae Rd
aauaugauuucuucaaagc

SEQ ID NO: 2699808 - RNA, 23 nt, Haemophilus influenzae Rd
aauaugcaaagguaauugccaau

SEQ ID NO: 2699809 - RNA, 18 nt, Haemophilus influenzae Rd
aauaugccaaauaaaauu

SEQ ID NO: 2699810 - RNA, 19 nt, Haemophilus influenzae Rd
aauaugccaaauaaaauua

SEQ ID NO: 2699811 - RNA, 18 nt, Haemophilus influenzae Rd
aauaugccuuauauuuca

SEQ ID NO: 2699812 - RNA, 23 nt, Haemophilus influenzae Rd
aauaugcgcuucaucaaauugau

SEQ ID NO: 2699813 - RNA, 14 nt, Haemophilus influenzae Rd
aauauggaaaugcu

SEQ ID NO: 2699814 - RNA, 20 nt, Haemophilus influenzae Rd
aauauggguucaauauaacu

SEQ ID NO: 2699815 - RNA, 20 nt, Haemophilus influenzae Rd
aauauguaauauuuucccuc

SEQ ID NO: 2699816 - RNA, 18 nt, Haemophilus influenzae Rd
aauauguucaacaaguaa

SEQ ID NO: 2699817 - RNA, 15 nt, Haemophilus influenzae Rd
aauauguucuuuguu

SEQ ID NO: 2699818 - RNA, 19 nt, Haemophilus influenzae Rd
aauauguuuaccaccgaua

SEQ ID NO: 2699819 - RNA, 22 nt, Haemophilus influenzae Rd
aauauguuuaccaccgauaaac

SEQ ID NO: 2699820 - RNA, 23 nt, Haemophilus influenzae Rd
aauauguuuaccaccgauaaaca

SEQ ID NO: 2699821 - RNA, 13 nt, Haemophilus influenzae Rd
aauauuaaagaaa

SEQ ID NO: 2699822 - RNA, 16 nt, Haemophilus influenzae Rd
aauauuaaagaaaaua

SEQ ID NO: 2699823 - RNA, 18 nt, Haemophilus influenzae Rd
aauauuaaagaaaauaca

SEQ ID NO: 2699824 - RNA, 20 nt, Haemophilus influenzae Rd
aauauuaauuaaaagugcgg

SEQ ID NO: 2699825 - RNA, 18 nt, Haemophilus influenzae Rd
aauauuaguuagcuaaaa

SEQ ID NO: 2699826 - RNA, 21 nt, Haemophilus influenzae Rd
aauauuaguuagcuaaaaaaa

SEQ ID NO: 2699827 - RNA, 19 nt, Haemophilus influenzae Rd
aauauuaucgaauagauuu

SEQ ID NO: 2699828 - RNA, 19 nt, Haemophilus influenzae Rd
aauauuaucuccaagaaua

SEQ ID NO: 2699829 - RNA, 14 nt, Haemophilus influenzae Rd
aauauucaaaacau

SEQ ID NO: 2699830 - RNA, 19 nt, Haemophilus influenzae Rd
aauauucaccccuucuguu

SEQ ID NO: 2699831 - RNA, 13 nt, Haemophilus influenzae Rd
aauauuccaaaaa

SEQ ID NO: 2699832 - RNA, 15 nt, Haemophilus influenzae Rd
aauauuccaaaaaau

SEQ ID NO: 2699833 - RNA, 16 nt, Haemophilus influenzae Rd
aauauuccaaaaaaua

SEQ ID NO: 2699834 - RNA, 14 nt, Haemophilus influenzae Rd
aauauuccauuaac

SEQ ID NO: 2699835 - RNA, 16 nt, Haemophilus influenzae Rd
aauauucgcuucuuuu

SEQ ID NO: 2699836 - RNA, 16 nt, Haemophilus influenzae Rd
aauauucugaggauuu

SEQ ID NO: 2699837 - RNA, 17 nt, Haemophilus influenzae Rd
aauauucuuuaaaacau

SEQ ID NO: 2699838 - RNA, 16 nt, Haemophilus influenzae Rd
aauauucuuuaaauau

SEQ ID NO: 2699839 - RNA, 17 nt, Haemophilus influenzae Rd
aauauucuuuacgauuu

SEQ ID NO: 2699840 - RNA, 15 nt, Haemophilus influenzae Rd
aauauucuuuuuaaa

SEQ ID NO: 2699841 - RNA, 16 nt, Haemophilus influenzae Rd
aauauucuuuuuaaau

SEQ ID NO: 2699842 - RNA, 22 nt, Haemophilus influenzae Rd
aauauugaccguuugaccauuc

SEQ ID NO: 2699843 - RNA, 12 nt, Haemophilus influenzae Rd
aauauugagcaa

SEQ ID NO: 2699844 - RNA, 20 nt, Haemophilus influenzae Rd
aauauugaguauuccccgcu

SEQ ID NO: 2699845 - RNA, 22 nt, Haemophilus influenzae Rd
aauauugauguuuguaggaaau

SEQ ID NO: 2699846 - RNA, 17 nt, Haemophilus influenzae Rd
aauauugauuacccauu

SEQ ID NO: 2699847 - RNA, 23 nt, Haemophilus influenzae Rd
aauauugauuauguaaacuucca

SEQ ID NO: 2699848 - RNA, 21 nt, Haemophilus influenzae Rd
aauauugguagcuaaaaauaa

SEQ ID NO: 2699849 - RNA, 17 nt, Haemophilus influenzae Rd
aauauugguuauuuaaa

SEQ ID NO: 2699850 - RNA, 18 nt, Haemophilus influenzae Rd
aauauugucuauuugcuu

SEQ ID NO: 2699851 - RNA, 22 nt, Haemophilus influenzae Rd
aauauuuaaaaagaauauucca

SEQ ID NO: 2699852 - RNA, 14 nt, Haemophilus influenzae Rd
aauauuuaaauaca

SEQ ID NO: 2699853 - RNA, 18 nt, Haemophilus influenzae Rd
aauauuuacgacuaaaau

SEQ ID NO: 2699854 - RNA, 22 nt, Haemophilus influenzae Rd
aauauuuacgacuaaaauuaga

SEQ ID NO: 2699855 - RNA, 23 nt, Haemophilus influenzae Rd
aauauuuauuucuauagauuuau

SEQ ID NO: 2699856 - RNA, 13 nt, Haemophilus influenzae Rd
aauauuucaguau

SEQ ID NO: 2699857 - RNA, 18 nt, Haemophilus influenzae Rd
aauauuucuucauuuuaa

SEQ ID NO: 2699858 - RNA, 22 nt, Haemophilus influenzae Rd
aauauuucuucauuuuaaauua

SEQ ID NO: 2699859 - RNA, 16 nt, Haemophilus influenzae Rd
aauauuugacgaaaua

SEQ ID NO: 2699860 - RNA, 22 nt, Haemophilus influenzae Rd
aauauuuguugccauuguuaaa

SEQ ID NO: 2699861 - RNA, 14 nt, Haemophilus influenzae Rd
aauauuuuaauaaa

SEQ ID NO: 2699862 - RNA, 19 nt, Haemophilus influenzae Rd
aauauuuuagcaagugcgc

SEQ ID NO: 2699863 - RNA, 14 nt, Haemophilus influenzae Rd
aauauuuucaaaua

SEQ ID NO: 2699864 - RNA, 18 nt, Haemophilus influenzae Rd
aauauuuuccccuuucca

SEQ ID NO: 2699865 - RNA, 14 nt, Haemophilus influenzae Rd
aauauuuucuuuua

SEQ ID NO: 2699866 - RNA, 16 nt, Haemophilus influenzae Rd
aauauuuuguugaaga

SEQ ID NO: 2699867 - RNA, 15 nt, Haemophilus influenzae Rd
aauauuuuugccaau

SEQ ID NO: 2699868 - RNA, 20 nt, Haemophilus influenzae Rd
aauauuuuugccaauuuuuu

SEQ ID NO: 2699869 - RNA, 13 nt, Haemophilus influenzae Rd
aauauuuuuuugc

SEQ ID NO: 2699870 - RNA, 21 nt, Haemophilus influenzae Rd
aauauuuuuuugcuuuucccu

SEQ ID NO: 2699871 - RNA, 22 nt, Haemophilus influenzae Rd
aauauuuuuuugcuuuucccuu

SEQ ID NO: 2699872 - RNA, 15 nt, Haemophilus influenzae Rd
aaucaaaaaaucuac

SEQ ID NO: 2699873 - RNA, 15 nt, Haemophilus influenzae Rd
aaucaaaaaugcuuu

SEQ ID NO: 2699874 - RNA, 20 nt, Haemophilus influenzae Rd
aaucaaaaauuggguuaaua

SEQ ID NO: 2699875 - RNA, 17 nt, Haemophilus influenzae Rd
aaucaaaagaauuaaaa

SEQ ID NO: 2699876 - RNA, 19 nt, Haemophilus influenzae Rd
aaucaaaagaauuaaaaau

SEQ ID NO: 2699877 - RNA, 15 nt, Haemophilus influenzae Rd
aaucaaaauagcuuu

SEQ ID NO: 2699878 - RNA, 13 nt, Haemophilus influenzae Rd
aaucaaaccaaua

SEQ ID NO: 2699879 - RNA, 12 nt, Haemophilus influenzae Rd
aaucaaauaaaa

SEQ ID NO: 2699880 - RNA, 22 nt, Haemophilus influenzae Rd
aaucaaauaaaauauuuuuuau

SEQ ID NO: 2699881 - RNA, 22 nt, Haemophilus influenzae Rd
aaucaaaugggaaagcguugaa

SEQ ID NO: 2699882 - RNA, 14 nt, Haemophilus influenzae Rd
aaucaaauucaauu

SEQ ID NO: 2699883 - RNA, 17 nt, Haemophilus influenzae Rd
aaucaaauucucuguuu

SEQ ID NO: 2699884 - RNA, 17 nt, Haemophilus influenzae Rd
aaucaacaauuucugca

SEQ ID NO: 2699885 - RNA, 23 nt, Haemophilus influenzae Rd
aaucaacacaccuauuuuuuccu

SEQ ID NO: 2699886 - RNA, 13 nt, Haemophilus influenzae Rd
aaucaaccauuug

SEQ ID NO: 2699887 - RNA, 15 nt, Haemophilus influenzae Rd
aaucaagcauaaauc

SEQ ID NO: 2699888 - RNA, 16 nt, Haemophilus influenzae Rd
aaucaaguuaaaaaau

SEQ ID NO: 2699889 - RNA, 17 nt, Haemophilus influenzae Rd
aaucaaguuaaaaaaug

SEQ ID NO: 2699890 - RNA, 22 nt, Haemophilus influenzae Rd
aaucaaguuaaaaaaugauuaa

SEQ ID NO: 2699891 - RNA, 20 nt, Haemophilus influenzae Rd
aaucaauacuccaacccaga

SEQ ID NO: 2699892 - RNA, 19 nt, Haemophilus influenzae Rd
aaucaauccccgcaucuuu

SEQ ID NO: 2699893 - RNA, 15 nt, Haemophilus influenzae Rd
aaucaaucuuuaaaa

SEQ ID NO: 2699894 - RNA, 17 nt, Haemophilus influenzae Rd
aaucaaucuuuaaaacu

SEQ ID NO: 2699895 - RNA, 20 nt, Haemophilus influenzae Rd
aaucaaugucguuauucauc

SEQ ID NO: 2699896 - RNA, 17 nt, Haemophilus influenzae Rd
aaucaauguuuucagcu

SEQ ID NO: 2699897 - RNA, 21 nt, Haemophilus influenzae Rd
aaucaauguuuucagcuucaa

SEQ ID NO: 2699898 - RNA, 12 nt, Haemophilus influenzae Rd
aaucaauuaaag

SEQ ID NO: 2699899 - RNA, 23 nt, Haemophilus influenzae Rd
aaucaauuaaguagauaacaaaa

SEQ ID NO: 2699900 - RNA, 14 nt, Haemophilus influenzae Rd
aaucaauuauuuca

SEQ ID NO: 2699901 - RNA, 20 nt, Haemophilus influenzae Rd
aaucaauuauuucagcugca

SEQ ID NO: 2699902 - RNA, 12 nt, Haemophilus influenzae Rd
aaucaauuuuuu

SEQ ID NO: 2699903 - RNA, 21 nt, Haemophilus influenzae Rd
aaucacaaaauggcaaacaaa

SEQ ID NO: 2699904 - RNA, 15 nt, Haemophilus influenzae Rd
aaucacaaauccaua

SEQ ID NO: 2699905 - RNA, 15 nt, Haemophilus influenzae Rd
aaucacaacaaacca

SEQ ID NO: 2699906 - RNA, 15 nt, Haemophilus influenzae Rd
aaucacaacacaauc

SEQ ID NO: 2699907 - RNA, 16 nt, Haemophilus influenzae Rd
aaucacaacuugacca

SEQ ID NO: 2699908 - RNA, 22 nt, Haemophilus influenzae Rd
aaucacaaugagacuuaaccaa

SEQ ID NO: 2699909 - RNA, 16 nt, Haemophilus influenzae Rd
aaucacaauuuuuaac

SEQ ID NO: 2699910 - RNA, 18 nt, Haemophilus influenzae Rd
aaucacaauuuuuaacgc

SEQ ID NO: 2699911 - RNA, 14 nt, Haemophilus influenzae Rd
aaucacacgugcuu

SEQ ID NO: 2699912 - RNA, 16 nt, Haemophilus influenzae Rd
aaucacacuugcacca

SEQ ID NO: 2699913 - RNA, 18 nt, Haemophilus influenzae Rd
aaucacauagauuuaagc

SEQ ID NO: 2699914 - RNA, 23 nt, Haemophilus influenzae Rd
aaucacaucgccaacuugaauac

SEQ ID NO: 2699915 - RNA, 15 nt, Haemophilus influenzae Rd
aaucaccauaucaau

SEQ ID NO: 2699916 - RNA, 15 nt, Haemophilus influenzae Rd
aaucacgaucugcaa

SEQ ID NO: 2699917 - RNA, 20 nt, Haemophilus influenzae Rd
aaucacgcucaaucucuuua

SEQ ID NO: 2699918 - RNA, 14 nt, Haemophilus influenzae Rd
aaucacuagccaua

SEQ ID NO: 2699919 - RNA, 19 nt, Haemophilus influenzae Rd
aaucacucgcaggaagcuc

SEQ ID NO: 2699920 - RNA, 15 nt, Haemophilus influenzae Rd
aaucacugaaaaaug

SEQ ID NO: 2699921 - RNA, 14 nt, Haemophilus influenzae Rd
aaucacugaauuuc

SEQ ID NO: 2699922 - RNA, 16 nt, Haemophilus influenzae Rd
aaucacuggcauauca

SEQ ID NO: 2699923 - RNA, 16 nt, Haemophilus influenzae Rd
aaucacuuucauuaaa

SEQ ID NO: 2699924 - RNA, 19 nt, Haemophilus influenzae Rd
aaucagaacaagcauuuuu

SEQ ID NO: 2699925 - RNA, 18 nt, Haemophilus influenzae Rd
aaucagaauagccgcaau

SEQ ID NO: 2699926 - RNA, 24 nt, Haemophilus influenzae Rd
aaucagaauagccgcaaucacaaa

SEQ ID NO: 2699927 - RNA, 20 nt, Haemophilus influenzae Rd
aaucagauuauguucauuuu

SEQ ID NO: 2699928 - RNA, 20 nt, Haemophilus influenzae Rd
aaucagcgaauuaaagugca

SEQ ID NO: 2699929 - RNA, 18 nt, Haemophilus influenzae Rd
aaucagcuaauaacacau

SEQ ID NO: 2699930 - RNA, 20 nt, Haemophilus influenzae Rd
aaucagcuaauaacacaucu

SEQ ID NO: 2699931 - RNA, 15 nt, Haemophilus influenzae Rd
aaucaggcuuucauu

SEQ ID NO: 2699932 - RNA, 19 nt, Haemophilus influenzae Rd
aaucaggguuauuugcaau

SEQ ID NO: 2699933 - RNA, 22 nt, Haemophilus influenzae Rd
aaucaggguuauuugcaauaaa

SEQ ID NO: 2699934 - RNA, 18 nt, Haemophilus influenzae Rd
aaucagugucuuaacuua

SEQ ID NO: 2699935 - RNA, 16 nt, Haemophilus influenzae Rd
aaucauaaaaaaaucu

SEQ ID NO: 2699936 - RNA, 19 nt, Haemophilus influenzae Rd
aaucauaaaaaaaucugca

SEQ ID NO: 2699937 - RNA, 16 nt, Haemophilus influenzae Rd
aaucauaaaaacaaua

SEQ ID NO: 2699938 - RNA, 15 nt, Haemophilus influenzae Rd
aaucauaaaauuucc

SEQ ID NO: 2699939 - RNA, 14 nt, Haemophilus influenzae Rd
aaucauaagcaaua

SEQ ID NO: 2699940 - RNA, 20 nt, Haemophilus influenzae Rd
aaucauaagcaauaauuuca

SEQ ID NO: 2699941 - RNA, 17 nt, Haemophilus influenzae Rd
aaucauaaucgccaaaa

SEQ ID NO: 2699942 - RNA, 16 nt, Haemophilus influenzae Rd
aaucauaaucugaaag

SEQ ID NO: 2699943 - RNA, 12 nt, Haemophilus influenzae Rd
aaucauacuaaa

SEQ ID NO: 2699944 - RNA, 21 nt, Haemophilus influenzae Rd
aaucauauacucguucguuau

SEQ ID NO: 2699945 - RNA, 15 nt, Haemophilus influenzae Rd
aaucauaucaucaac

SEQ ID NO: 2699946 - RNA, 16 nt, Haemophilus influenzae Rd
aaucauaucaucaacc

SEQ ID NO: 2699947 - RNA, 15 nt, Haemophilus influenzae Rd
aaucauaucuaacau

SEQ ID NO: 2699948 - RNA, 22 nt, Haemophilus influenzae Rd
aaucauauugauuuacauuaau

SEQ ID NO: 2699949 - RNA, 12 nt, Haemophilus influenzae Rd
aaucauauuucu

SEQ ID NO: 2699950 - RNA, 13 nt, Haemophilus influenzae Rd
aaucaucaaacac

SEQ ID NO: 2699951 - RNA, 15 nt, Haemophilus influenzae Rd
aaucaucaaacaccc

SEQ ID NO: 2699952 - RNA, 14 nt, Haemophilus influenzae Rd
aaucaucaaagcuc

SEQ ID NO: 2699953 - RNA, 14 nt, Haemophilus influenzae Rd
aaucaucagaauaa

SEQ ID NO: 2699954 - RNA, 20 nt, Haemophilus influenzae Rd
aaucaucccuguauaaagau

SEQ ID NO: 2699955 - RNA, 13 nt, Haemophilus influenzae Rd
aaucaucccuucu

SEQ ID NO: 2699956 - RNA, 22 nt, Haemophilus influenzae Rd
aaucaucgaaaucuaauuugcu

SEQ ID NO: 2699957 - RNA, 18 nt, Haemophilus influenzae Rd
aaucaucguauuaaaagu

SEQ ID NO: 2699958 - RNA, 20 nt, Haemophilus influenzae Rd
aaucaucuaguucaguuuug

SEQ ID NO: 2699959 - RNA, 15 nt, Haemophilus influenzae Rd
aaucaucucuaaccu

SEQ ID NO: 2699960 - RNA, 20 nt, Haemophilus influenzae Rd
aaucaucucuaaccuaaaau

SEQ ID NO: 2699961 - RNA, 15 nt, Haemophilus influenzae Rd
aaucauuaaauaacu

SEQ ID NO: 2699962 - RNA, 12 nt, Haemophilus influenzae Rd
aaucauuaacuu

SEQ ID NO: 2699963 - RNA, 16 nt, Haemophilus influenzae Rd
aaucauuaacuuacca

SEQ ID NO: 2699964 - RNA, 20 nt, Haemophilus influenzae Rd
aaucauuaacuuaccacguu

SEQ ID NO: 2699965 - RNA, 15 nt, Haemophilus influenzae Rd
aaucauugcugcaau

SEQ ID NO: 2699966 - RNA, 19 nt, Haemophilus influenzae Rd
aaucauuggauaauugcca

SEQ ID NO: 2699967 - RNA, 21 nt, Haemophilus influenzae Rd
aaucauuggauaauugccacu

SEQ ID NO: 2699968 - RNA, 12 nt, Haemophilus influenzae Rd
aaucauuucaau

SEQ ID NO: 2699969 - RNA, 16 nt, Haemophilus influenzae Rd
aaucauuucaauauca

SEQ ID NO: 2699970 - RNA, 16 nt, Haemophilus influenzae Rd
aaucauuucaucuaca

SEQ ID NO: 2699971 - RNA, 16 nt, Haemophilus influenzae Rd
aaucauuucuaagccu

SEQ ID NO: 2699972 - RNA, 14 nt, Haemophilus influenzae Rd
aaucauuuucacuc

SEQ ID NO: 2699973 - RNA, 14 nt, Haemophilus influenzae Rd
aaucauuuuuuaac

SEQ ID NO: 2699974 - RNA, 19 nt, Haemophilus influenzae Rd
aaucauuuuuuaacuugau

SEQ ID NO: 2699975 - RNA, 20 nt, Haemophilus influenzae Rd
aaucauuuuuuaacuugauu

SEQ ID NO: 2699976 - RNA, 23 nt, Haemophilus influenzae Rd
aaucauuuuuuaacuugauuuug

SEQ ID NO: 2699977 - RNA, 20 nt, Haemophilus influenzae Rd
aauccaaauuguccgccauc

SEQ ID NO: 2699978 - RNA, 17 nt, Haemophilus influenzae Rd
aauccaacguuuuaauc

SEQ ID NO: 2699979 - RNA, 13 nt, Haemophilus influenzae Rd
aauccaaguauaa

SEQ ID NO: 2699980 - RNA, 15 nt, Haemophilus influenzae Rd
aauccaaguauaaaa

SEQ ID NO: 2699981 - RNA, 14 nt, Haemophilus influenzae Rd
aauccaauuucaca

SEQ ID NO: 2699982 - RNA, 22 nt, Haemophilus influenzae Rd
aauccacacuuuaaaaguuuac

SEQ ID NO: 2699983 - RNA, 15 nt, Haemophilus influenzae Rd
aauccacacuuuaau

SEQ ID NO: 2699984 - RNA, 19 nt, Haemophilus influenzae Rd
aauccacauuuuuuguaau

SEQ ID NO: 2699985 - RNA, 17 nt, Haemophilus influenzae Rd
aauccagauaacaaacc

SEQ ID NO: 2699986 - RNA, 20 nt, Haemophilus influenzae Rd
aauccagcaugagcuucaaa

SEQ ID NO: 2699987 - RNA, 23 nt, Haemophilus influenzae Rd
aauccauaauuucagcaucagaa

SEQ ID NO: 2699988 - RNA, 22 nt, Haemophilus influenzae Rd
aauccaucauuuuucgcaaaau

SEQ ID NO: 2699989 - RNA, 15 nt, Haemophilus influenzae Rd
aauccauuuuuaaau

SEQ ID NO: 2699990 - RNA, 13 nt, Haemophilus influenzae Rd
aaucccaauaggu

SEQ ID NO: 2699991 - RNA, 15 nt, Haemophilus influenzae Rd
aaucccacuuguugg

SEQ ID NO: 2699992 - RNA, 20 nt, Haemophilus influenzae Rd
aaucccacuuguuggauauc

SEQ ID NO: 2699993 - RNA, 18 nt, Haemophilus influenzae Rd
aaucccacuuguuuuuuc

SEQ ID NO: 2699994 - RNA, 20 nt, Haemophilus influenzae Rd
aaucccauauuuaaaaccaa

SEQ ID NO: 2699995 - RNA, 15 nt, Haemophilus influenzae Rd
aauccccccauuaca

SEQ ID NO: 2699996 - RNA, 14 nt, Haemophilus influenzae Rd
aauccccuaaacua

SEQ ID NO: 2699997 - RNA, 15 nt, Haemophilus influenzae Rd
aaucccucaaauaca

SEQ ID NO: 2699998 - RNA, 20 nt, Haemophilus influenzae Rd
aaucccucgccuuucgaggc

SEQ ID NO: 2699999 - RNA, 15 nt, Haemophilus influenzae Rd
aaucccuuagaaaau

SEQ ID NO: 2700000 - RNA, 20 nt, Haemophilus influenzae Rd
aaucccuucugcuccacaaa

SEQ ID NO: 2700001 - RNA, 13 nt, Haemophilus influenzae Rd
aaucccuugcugg

SEQ ID NO: 2700002 - RNA, 17 nt, Haemophilus influenzae Rd
aauccguuaaauuuaga

SEQ ID NO: 2700003 - RNA, 17 nt, Haemophilus influenzae Rd
aauccuagaguaaguaa

SEQ ID NO: 2700004 - RNA, 14 nt, Haemophilus influenzae Rd
aauccucaaaaaca

SEQ ID NO: 2700005 - RNA, 14 nt, Haemophilus influenzae Rd
aauccucuuuaaaa

SEQ ID NO: 2700006 - RNA, 18 nt, Haemophilus influenzae Rd
aauccugcauuuucuuuc

SEQ ID NO: 2700007 - RNA, 19 nt, Haemophilus influenzae Rd
aauccugccaguagaaaau

SEQ ID NO: 2700008 - RNA, 24 nt, Haemophilus influenzae Rd
aauccugcgugaaugacuuucacu

SEQ ID NO: 2700009 - RNA, 15 nt, Haemophilus influenzae Rd
aauccugcuucuuua

SEQ ID NO: 2700010 - RNA, 23 nt, Haemophilus influenzae Rd
aauccugguauuuacaagucucu

SEQ ID NO: 2700011 - RNA, 13 nt, Haemophilus influenzae Rd
aauccuuaauugg

SEQ ID NO: 2700012 - RNA, 21 nt, Haemophilus influenzae Rd
aauccuugaaucauuucaucu

SEQ ID NO: 2700013 - RNA, 21 nt, Haemophilus influenzae Rd
aauccuuuacgggauuuuuuc

SEQ ID NO: 2700014 - RNA, 20 nt, Haemophilus influenzae Rd
aauccuuuugcacauuaaua

SEQ ID NO: 2700015 - RNA, 23 nt, Haemophilus influenzae Rd
aauccuuuuguuuuaucagaaug

SEQ ID NO: 2700016 - RNA, 14 nt, Haemophilus influenzae Rd
aaucgaaauuaaaa

SEQ ID NO: 2700017 - RNA, 17 nt, Haemophilus influenzae Rd
aaucgaaauuaaaauaa

SEQ ID NO: 2700018 - RNA, 21 nt, Haemophilus influenzae Rd
aaucgaacacuguaaauaaac

SEQ ID NO: 2700019 - RNA, 19 nt, Haemophilus influenzae Rd
aaucgaagaaauaugauuu

SEQ ID NO: 2700020 - RNA, 15 nt, Haemophilus influenzae Rd
aaucgaaguaugaaa

SEQ ID NO: 2700021 - RNA, 14 nt, Haemophilus influenzae Rd
aaucgacucaggug

SEQ ID NO: 2700022 - RNA, 20 nt, Haemophilus influenzae Rd
aaucgcaaagaauuugccug

SEQ ID NO: 2700023 - RNA, 13 nt, Haemophilus influenzae Rd
aaucgcacucaca

SEQ ID NO: 2700024 - RNA, 15 nt, Haemophilus influenzae Rd
aaucgcacuuaaaaa

SEQ ID NO: 2700025 - RNA, 16 nt, Haemophilus influenzae Rd
aaucgcacuuaaaaga

SEQ ID NO: 2700026 - RNA, 20 nt, Haemophilus influenzae Rd
aaucgcaucauucaaugcaa

SEQ ID NO: 2700027 - RNA, 19 nt, Haemophilus influenzae Rd
aaucgcaucgucuuuaccu

SEQ ID NO: 2700028 - RNA, 20 nt, Haemophilus influenzae Rd
aaucgcaucgucuuuaccug

SEQ ID NO: 2700029 - RNA, 19 nt, Haemophilus influenzae Rd
aaucgccaauucuucagau

SEQ ID NO: 2700030 - RNA, 15 nt, Haemophilus influenzae Rd
aaucgccccaaaagc

SEQ ID NO: 2700031 - RNA, 21 nt, Haemophilus influenzae Rd
aaucgccccaaaagcugccau

SEQ ID NO: 2700032 - RNA, 18 nt, Haemophilus influenzae Rd
aaucgccuugugcgauaa

SEQ ID NO: 2700033 - RNA, 14 nt, Haemophilus influenzae Rd
aaucgccuuuuuga

SEQ ID NO: 2700034 - RNA, 15 nt, Haemophilus influenzae Rd
aaucgcguagugugc

SEQ ID NO: 2700035 - RNA, 19 nt, Haemophilus influenzae Rd
aaucgcuuuauacugcucu

SEQ ID NO: 2700036 - RNA, 18 nt, Haemophilus influenzae Rd
aaucgggcguucuuuaau

SEQ ID NO: 2700037 - RNA, 14 nt, Haemophilus influenzae Rd
aaucggugcaacaa

SEQ ID NO: 2700038 - RNA, 20 nt, Haemophilus influenzae Rd
aaucguacaucgaaaacaua

SEQ ID NO: 2700039 - RNA, 15 nt, Haemophilus influenzae Rd
aaucgucaaaaucau

SEQ ID NO: 2700040 - RNA, 15 nt, Haemophilus influenzae Rd
aaucguccaauuuca

SEQ ID NO: 2700041 - RNA, 23 nt, Haemophilus influenzae Rd
aaucguccaauuucaucccaauu

SEQ ID NO: 2700042 - RNA, 22 nt, Haemophilus influenzae Rd
aaucgugucaguaacuacaacu

SEQ ID NO: 2700043 - RNA, 18 nt, Haemophilus influenzae Rd
aaucguuugucguaauaa

SEQ ID NO: 2700044 - RNA, 20 nt, Haemophilus influenzae Rd
aaucguuuguucugacacuu

SEQ ID NO: 2700045 - RNA, 13 nt, Haemophilus influenzae Rd
aaucuaaaaaacc

SEQ ID NO: 2700046 - RNA, 16 nt, Haemophilus influenzae Rd
aaucuaaaaaaccuug

SEQ ID NO: 2700047 - RNA, 13 nt, Haemophilus influenzae Rd
aaucuaaaaauau

SEQ ID NO: 2700048 - RNA, 16 nt, Haemophilus influenzae Rd
aaucuaaaaauaugua

SEQ ID NO: 2700049 - RNA, 23 nt, Haemophilus influenzae Rd
aaucuaaaaauauguauuugcau

SEQ ID NO: 2700050 - RNA, 15 nt, Haemophilus influenzae Rd
aaucuaaaacuauau

SEQ ID NO: 2700051 - RNA, 19 nt, Haemophilus influenzae Rd
aaucuaaacuuguuaaaua

SEQ ID NO: 2700052 - RNA, 16 nt, Haemophilus influenzae Rd
aaucuaaauauucucu

SEQ ID NO: 2700053 - RNA, 14 nt, Haemophilus influenzae Rd
aaucuaacaaucga

SEQ ID NO: 2700054 - RNA, 17 nt, Haemophilus influenzae Rd
aaucuaacguauuuaaa

SEQ ID NO: 2700055 - RNA, 14 nt, Haemophilus influenzae Rd
aaucuaagccuugu

SEQ ID NO: 2700056 - RNA, 23 nt, Haemophilus influenzae Rd
aaucuaagcgaccugaacgguca

SEQ ID NO: 2700057 - RNA, 17 nt, Haemophilus influenzae Rd
aaucuaauccuaaaaug

SEQ ID NO: 2700058 - RNA, 21 nt, Haemophilus influenzae Rd
aaucuaaucgggcuuuaucau

SEQ ID NO: 2700059 - RNA, 14 nt, Haemophilus influenzae Rd
aaucuacaaaacau

SEQ ID NO: 2700060 - RNA, 20 nt, Haemophilus influenzae Rd
aaucuacauuuuuagucucu

SEQ ID NO: 2700061 - RNA, 15 nt, Haemophilus influenzae Rd
aaucuaccgcaucua

SEQ ID NO: 2700062 - RNA, 18 nt, Haemophilus influenzae Rd
aaucuacguggauuuguu

SEQ ID NO: 2700063 - RNA, 13 nt, Haemophilus influenzae Rd
aaucuacuaaaau

SEQ ID NO: 2700064 - RNA, 14 nt, Haemophilus influenzae Rd
aaucuacuaaaaua

SEQ ID NO: 2700065 - RNA, 16 nt, Haemophilus influenzae Rd
aaucuacuaaaauaag

SEQ ID NO: 2700066 - RNA, 16 nt, Haemophilus influenzae Rd
aaucuacucguuuacu

SEQ ID NO: 2700067 - RNA, 18 nt, Haemophilus influenzae Rd
aaucuacucguuuacuau

SEQ ID NO: 2700068 - RNA, 19 nt, Haemophilus influenzae Rd
aaucuacuuggacauuguu

SEQ ID NO: 2700069 - RNA, 15 nt, Haemophilus influenzae Rd
aaucuagaagaucaa

SEQ ID NO: 2700070 - RNA, 15 nt, Haemophilus influenzae Rd
aaucuauuucuuuga

SEQ ID NO: 2700071 - RNA, 22 nt, Haemophilus influenzae Rd
aaucuauuucuuugaguaaaaa

SEQ ID NO: 2700072 - RNA, 14 nt, Haemophilus influenzae Rd
aaucucucaaaaau

SEQ ID NO: 2700073 - RNA, 15 nt, Haemophilus influenzae Rd
aaucucuggagaaaa

SEQ ID NO: 2700074 - RNA, 16 nt, Haemophilus influenzae Rd
aaucucuucuaaaaau

SEQ ID NO: 2700075 - RNA, 19 nt, Haemophilus influenzae Rd
aaucucuucuaaaaauuac

SEQ ID NO: 2700076 - RNA, 23 nt, Haemophilus influenzae Rd
aaucucuuuacuguucaaauaag

SEQ ID NO: 2700077 - RNA, 20 nt, Haemophilus influenzae Rd
aaucugaugggaauucauaa

SEQ ID NO: 2700078 - RNA, 16 nt, Haemophilus influenzae Rd
aaucugauugagaaaa

SEQ ID NO: 2700079 - RNA, 15 nt, Haemophilus influenzae Rd
aaucugcacuuuaau

SEQ ID NO: 2700080 - RNA, 17 nt, Haemophilus influenzae Rd
aaucugcacuuuaauuc

SEQ ID NO: 2700081 - RNA, 18 nt, Haemophilus influenzae Rd
aaucugcauucuaaaagu

SEQ ID NO: 2700082 - RNA, 20 nt, Haemophilus influenzae Rd
aaucugcucuugaaauaguu

SEQ ID NO: 2700083 - RNA, 21 nt, Haemophilus influenzae Rd
aaucugucacgagcuaaaaaa

SEQ ID NO: 2700084 - RNA, 22 nt, Haemophilus influenzae Rd
aaucugucacgagcuaaaaaau

SEQ ID NO: 2700085 - RNA, 13 nt, Haemophilus influenzae Rd
aaucugugauaua

SEQ ID NO: 2700086 - RNA, 15 nt, Haemophilus influenzae Rd
aaucugugauauaua

SEQ ID NO: 2700087 - RNA, 20 nt, Haemophilus influenzae Rd
aaucugugauauauaucaca

SEQ ID NO: 2700088 - RNA, 22 nt, Haemophilus influenzae Rd
aaucugugcaaaguuaccauuu

SEQ ID NO: 2700089 - RNA, 19 nt, Haemophilus influenzae Rd
aaucugugccuuaaagcug

SEQ ID NO: 2700090 - RNA, 19 nt, Haemophilus influenzae Rd
aaucuguuucauuuguuag

SEQ ID NO: 2700091 - RNA, 15 nt, Haemophilus influenzae Rd
aaucuuaaagaauuu

SEQ ID NO: 2700092 - RNA, 14 nt, Haemophilus influenzae Rd
aaucuuaacugcaa

SEQ ID NO: 2700093 - RNA, 22 nt, Haemophilus influenzae Rd
aaucuuacgaagaauccacauu

SEQ ID NO: 2700094 - RNA, 23 nt, Haemophilus influenzae Rd
aaucuuacgaagaauccacauuu

SEQ ID NO: 2700095 - RNA, 16 nt, Haemophilus influenzae Rd
aaucuuauacaacaaa

SEQ ID NO: 2700096 - RNA, 17 nt, Haemophilus influenzae Rd
aaucuuaucaaacacuu

SEQ ID NO: 2700097 - RNA, 21 nt, Haemophilus influenzae Rd
aaucuucagcaguuuggcaag

SEQ ID NO: 2700098 - RNA, 23 nt, Haemophilus influenzae Rd
aaucuucagcaguuuggcaaguc

SEQ ID NO: 2700099 - RNA, 19 nt, Haemophilus influenzae Rd
aaucuucuaauuugccauc

SEQ ID NO: 2700100 - RNA, 17 nt, Haemophilus influenzae Rd
aaucuucuuuaccaacu

SEQ ID NO: 2700101 - RNA, 19 nt, Haemophilus influenzae Rd
aaucuugaacgcaaauacc

SEQ ID NO: 2700102 - RNA, 21 nt, Haemophilus influenzae Rd
aaucuugcccaucuugccaau

SEQ ID NO: 2700103 - RNA, 21 nt, Haemophilus influenzae Rd
aaucuugcugaaguuguaaua

SEQ ID NO: 2700104 - RNA, 23 nt, Haemophilus influenzae Rd
aaucuugcugaaguuguaauaaa

SEQ ID NO: 2700105 - RNA, 23 nt, Haemophilus influenzae Rd
aaucuugcuuuugguuuucuggu

SEQ ID NO: 2700106 - RNA, 23 nt, Haemophilus influenzae Rd
aaucuuggcucauuuuaaagagu

SEQ ID NO: 2700107 - RNA, 20 nt, Haemophilus influenzae Rd
aaucuuggugccaauccauu

SEQ ID NO: 2700108 - RNA, 22 nt, Haemophilus influenzae Rd
aaucuugguuuaaauuuuaaaa

SEQ ID NO: 2700109 - RNA, 19 nt, Haemophilus influenzae Rd
aaucuuguuggaucuucca

SEQ ID NO: 2700110 - RNA, 21 nt, Haemophilus influenzae Rd
aaucuuuaaaacuauaaaaau

SEQ ID NO: 2700111 - RNA, 17 nt, Haemophilus influenzae Rd
aaucuuuaaauuuugcu

SEQ ID NO: 2700112 - RNA, 12 nt, Haemophilus influenzae Rd
aaucuuuaagug

SEQ ID NO: 2700113 - RNA, 23 nt, Haemophilus influenzae Rd
aaucuuuaaguguuguuccaccu

SEQ ID NO: 2700114 - RNA, 20 nt, Haemophilus influenzae Rd
aaucuuuaccuuguaaacuu

SEQ ID NO: 2700115 - RNA, 16 nt, Haemophilus influenzae Rd
aaucuuuaucaaucaa

SEQ ID NO: 2700116 - RNA, 17 nt, Haemophilus influenzae Rd
aaucuuuggcaaaaaau

SEQ ID NO: 2700117 - RNA, 16 nt, Haemophilus influenzae Rd
aaucuuuuuguuaaua

SEQ ID NO: 2700118 - RNA, 20 nt, Haemophilus influenzae Rd
aaucuuuuuguuaauaaaag

SEQ ID NO: 2700119 - RNA, 17 nt, Haemophilus influenzae Rd
aaugaaaacuaugcucu

SEQ ID NO: 2700120 - RNA, 18 nt, Haemophilus influenzae Rd
aaugaaaacuaugcucua

SEQ ID NO: 2700121 - RNA, 13 nt, Haemophilus influenzae Rd
aaugaaagggaaa

SEQ ID NO: 2700122 - RNA, 17 nt, Haemophilus influenzae Rd
aaugaaagggaaauaac

SEQ ID NO: 2700123 - RNA, 20 nt, Haemophilus influenzae Rd
aaugaaagggaaauaacaaa

SEQ ID NO: 2700124 - RNA, 23 nt, Haemophilus influenzae Rd
aaugaaagggaaauuuauuauau

SEQ ID NO: 2700125 - RNA, 22 nt, Haemophilus influenzae Rd
aaugaaauuaaccccagaaaug

SEQ ID NO: 2700126 - RNA, 19 nt, Haemophilus influenzae Rd
aaugaaauuaauaagcccu

SEQ ID NO: 2700127 - RNA, 16 nt, Haemophilus influenzae Rd
aaugaaauuauugcuu

SEQ ID NO: 2700128 - RNA, 16 nt, Haemophilus influenzae Rd
aaugaaauucagugau

SEQ ID NO: 2700129 - RNA, 18 nt, Haemophilus influenzae Rd
aaugaaauuucuugcucu

SEQ ID NO: 2700130 - RNA, 14 nt, Haemophilus influenzae Rd
aaugaaauuuuuga

SEQ ID NO: 2700131 - RNA, 15 nt, Haemophilus influenzae Rd
aaugaacaaaaaauu

SEQ ID NO: 2700132 - RNA, 13 nt, Haemophilus influenzae Rd
aaugaacuuucua

SEQ ID NO: 2700133 - RNA, 15 nt, Haemophilus influenzae Rd
aaugaagugaaagau

SEQ ID NO: 2700134 - RNA, 21 nt, Haemophilus influenzae Rd
aaugaagugcgguugaaauuu

SEQ ID NO: 2700135 - RNA, 21 nt, Haemophilus influenzae Rd
aaugaaguuagaaacagaagu

SEQ ID NO: 2700136 - RNA, 23 nt, Haemophilus influenzae Rd
aaugaaguucacuucaucuauau

SEQ ID NO: 2700137 - RNA, 16 nt, Haemophilus influenzae Rd
aaugaauuaaaaguuu

SEQ ID NO: 2700138 - RNA, 18 nt, Haemophilus influenzae Rd
aaugacagaaacaaaucc

SEQ ID NO: 2700139 - RNA, 21 nt, Haemophilus influenzae Rd
aaugacagaaucuaaagaaaa

SEQ ID NO: 2700140 - RNA, 21 nt, Haemophilus influenzae Rd
aaugacagucgauuacaaaaa

SEQ ID NO: 2700141 - RNA, 22 nt, Haemophilus influenzae Rd
aaugacagucgauuacaaaaac

SEQ ID NO: 2700142 - RNA, 19 nt, Haemophilus influenzae Rd
aaugacgcguuaauuuuua

SEQ ID NO: 2700143 - RNA, 20 nt, Haemophilus influenzae Rd
aaugacgcguuaauuuuuaa

SEQ ID NO: 2700144 - RNA, 18 nt, Haemophilus influenzae Rd
aaugacuggcuugugaaa

SEQ ID NO: 2700145 - RNA, 22 nt, Haemophilus influenzae Rd
aaugacuggcuugugaaauaaa

SEQ ID NO: 2700146 - RNA, 12 nt, Haemophilus influenzae Rd
aaugacuuucac

SEQ ID NO: 2700147 - RNA, 14 nt, Haemophilus influenzae Rd
aaugacuuucacua

SEQ ID NO: 2700148 - RNA, 18 nt, Haemophilus influenzae Rd
aaugaggaaaauaaagga

SEQ ID NO: 2700149 - RNA, 17 nt, Haemophilus influenzae Rd
aaugagguauaaaaugg

SEQ ID NO: 2700150 - RNA, 10 nt, Haemophilus influenzae Rd
aaugauaauc

SEQ ID NO: 2700151 - RNA, 16 nt, Haemophilus influenzae Rd
aaugaucauuuugggc

SEQ ID NO: 2700152 - RNA, 20 nt, Haemophilus influenzae Rd
aaugaucauuuugggcucaa

SEQ ID NO: 2700153 - RNA, 19 nt, Haemophilus influenzae Rd
aaugaucgaguaaaaauaa

SEQ ID NO: 2700154 - RNA, 22 nt, Haemophilus influenzae Rd
aaugaucgaguaaaaauaaaau

SEQ ID NO: 2700155 - RNA, 13 nt, Haemophilus influenzae Rd
aaugaugaaacaa

SEQ ID NO: 2700156 - RNA, 14 nt, Haemophilus influenzae Rd
aaugaugaaacaag

SEQ ID NO: 2700157 - RNA, 23 nt, Haemophilus influenzae Rd
aaugaugaaacugaaccagccau

SEQ ID NO: 2700158 - RNA, 16 nt, Haemophilus influenzae Rd
aaugaugaguagauuu

SEQ ID NO: 2700159 - RNA, 17 nt, Haemophilus influenzae Rd
aaugauguaccaaaaug

SEQ ID NO: 2700160 - RNA, 19 nt, Haemophilus influenzae Rd
aaugauguaggcaaaaaca

SEQ ID NO: 2700161 - RNA, 20 nt, Haemophilus influenzae Rd
aaugauuaaccauuaauaaa

SEQ ID NO: 2700162 - RNA, 20 nt, Haemophilus influenzae Rd
aaugauuauccacuaaaaaa

SEQ ID NO: 2700163 - RNA, 19 nt, Haemophilus influenzae Rd
aaugauuaucuagaaaacu

SEQ ID NO: 2700164 - RNA, 18 nt, Haemophilus influenzae Rd
aaugauucaauuugaccu

SEQ ID NO: 2700165 - RNA, 22 nt, Haemophilus influenzae Rd
aaugauucaauuugaccuugaa

SEQ ID NO: 2700166 - RNA, 21 nt, Haemophilus influenzae Rd
aaugauucguggcaauuuuuc

SEQ ID NO: 2700167 - RNA, 19 nt, Haemophilus influenzae Rd
aaugauugagcgauagaaa

SEQ ID NO: 2700168 - RNA, 22 nt, Haemophilus influenzae Rd
aaugauuuuuucagguugguuu

SEQ ID NO: 2700169 - RNA, 14 nt, Haemophilus influenzae Rd
aaugcaaacauuug

SEQ ID NO: 2700170 - RNA, 22 nt, Haemophilus influenzae Rd
aaugcaaaccauuuauccauga

SEQ ID NO: 2700171 - RNA, 19 nt, Haemophilus influenzae Rd
aaugcaaaguaacuuuaau

SEQ ID NO: 2700172 - RNA, 18 nt, Haemophilus influenzae Rd
aaugcaaccaaacaaaaa

SEQ ID NO: 2700173 - RNA, 15 nt, Haemophilus influenzae Rd
aaugcaagcaccgcu

SEQ ID NO: 2700174 - RNA, 20 nt, Haemophilus influenzae Rd
aaugcaauauuauucagcac

SEQ ID NO: 2700175 - RNA, 12 nt, Haemophilus influenzae Rd
aaugcaauuuca

SEQ ID NO: 2700176 - RNA, 22 nt, Haemophilus influenzae Rd
aaugcacauaacaaaauggcuu

SEQ ID NO: 2700177 - RNA, 18 nt, Haemophilus influenzae Rd
aaugcaccagaugcaaua

SEQ ID NO: 2700178 - RNA, 14 nt, Haemophilus influenzae Rd
aaugcacuuguggc

SEQ ID NO: 2700179 - RNA, 15 nt, Haemophilus influenzae Rd
aaugcagaccaacgu

SEQ ID NO: 2700180 - RNA, 21 nt, Haemophilus influenzae Rd
aaugcagaccaacguaaaauc

SEQ ID NO: 2700181 - RNA, 23 nt, Haemophilus influenzae Rd
aaugcagauccuuucacaaaaua

SEQ ID NO: 2700182 - RNA, 16 nt, Haemophilus influenzae Rd
aaugcagcagcuucuu

SEQ ID NO: 2700183 - RNA, 17 nt, Haemophilus influenzae Rd
aaugcagcagcuucuuc

SEQ ID NO: 2700184 - RNA, 18 nt, Haemophilus influenzae Rd
aaugcagcagcuucuucu

SEQ ID NO: 2700185 - RNA, 18 nt, Haemophilus influenzae Rd
aaugcagccaucaauaaa

SEQ ID NO: 2700186 - RNA, 18 nt, Haemophilus influenzae Rd
aaugcaguaacgcgauaa

SEQ ID NO: 2700187 - RNA, 14 nt, Haemophilus influenzae Rd
aaugcaguaauaaa

SEQ ID NO: 2700188 - RNA, 15 nt, Haemophilus influenzae Rd
aaugcaguaauaaau

SEQ ID NO: 2700189 - RNA, 18 nt, Haemophilus influenzae Rd
aaugcaguaauaaauccu

SEQ ID NO: 2700190 - RNA, 22 nt, Haemophilus influenzae Rd
aaugcauugauugcuaaauaaa

SEQ ID NO: 2700191 - RNA, 23 nt, Haemophilus influenzae Rd
aaugcauugauugcuaaauaaau

SEQ ID NO: 2700192 - RNA, 23 nt, Haemophilus influenzae Rd
aaugcauuggcugaauuuaauuc

SEQ ID NO: 2700193 - RNA, 21 nt, Haemophilus influenzae Rd
aaugccacaaauaaacaaacu

SEQ ID NO: 2700194 - RNA, 13 nt, Haemophilus influenzae Rd
aaugccacugccc

SEQ ID NO: 2700195 - RNA, 22 nt, Haemophilus influenzae Rd
aaugccagaaagcagguuuuuc

SEQ ID NO: 2700196 - RNA, 20 nt, Haemophilus influenzae Rd
aaugccagcgcuugcaccaa

SEQ ID NO: 2700197 - RNA, 22 nt, Haemophilus influenzae Rd
aaugccaguuaaggauuuuuga

SEQ ID NO: 2700198 - RNA, 16 nt, Haemophilus influenzae Rd
aaugccauuuuuuaua

SEQ ID NO: 2700199 - RNA, 23 nt, Haemophilus influenzae Rd
aaugcccacguccacuucaucga

SEQ ID NO: 2700200 - RNA, 23 nt, Haemophilus influenzae Rd
aaugcccacuaacucacauugcc

SEQ ID NO: 2700201 - RNA, 14 nt, Haemophilus influenzae Rd
aaugcccagcaauu

SEQ ID NO: 2700202 - RNA, 20 nt, Haemophilus influenzae Rd
aaugcccagcaauuuauugu

SEQ ID NO: 2700203 - RNA, 19 nt, Haemophilus influenzae Rd
aaugcccgcacuuuuaacc

SEQ ID NO: 2700204 - RNA, 18 nt, Haemophilus influenzae Rd
aaugcccguuacuuuuau

SEQ ID NO: 2700205 - RNA, 15 nt, Haemophilus influenzae Rd
aaugccgaagccuug

SEQ ID NO: 2700206 - RNA, 18 nt, Haemophilus influenzae Rd
aaugccgauaauagacau

SEQ ID NO: 2700207 - RNA, 17 nt, Haemophilus influenzae Rd
aaugccugcauuaauaa

SEQ ID NO: 2700208 - RNA, 20 nt, Haemophilus influenzae Rd
aaugccugcauuaauaaucu

SEQ ID NO: 2700209 - RNA, 13 nt, Haemophilus influenzae Rd
aaugccuguuacg

SEQ ID NO: 2700210 - RNA, 19 nt, Haemophilus influenzae Rd
aaugccuugugcauaaaca

SEQ ID NO: 2700211 - RNA, 19 nt, Haemophilus influenzae Rd
aaugcgguaaguucaacac

SEQ ID NO: 2700212 - RNA, 15 nt, Haemophilus influenzae Rd
aaugcgugaacugcu

SEQ ID NO: 2700213 - RNA, 23 nt, Haemophilus influenzae Rd
aaugcuaaacguucuuggaaauc

SEQ ID NO: 2700214 - RNA, 17 nt, Haemophilus influenzae Rd
aaugcuaaauauauauc

SEQ ID NO: 2700215 - RNA, 22 nt, Haemophilus influenzae Rd
aaugcuauuaucauaaacaauu

SEQ ID NO: 2700216 - RNA, 12 nt, Haemophilus influenzae Rd
aaugcuauucuc

SEQ ID NO: 2700217 - RNA, 16 nt, Haemophilus influenzae Rd
aaugcucacuucgcuu

SEQ ID NO: 2700218 - RNA, 17 nt, Haemophilus influenzae Rd
aaugcucucuuuuaauc

SEQ ID NO: 2700219 - RNA, 22 nt, Haemophilus influenzae Rd
aaugcugaagucguuucaucga

SEQ ID NO: 2700220 - RNA, 9 nt, Haemophilus influenzae Rd
aaugcugag

SEQ ID NO: 2700221 - RNA, 13 nt, Haemophilus influenzae Rd
aaugcugagugca

SEQ ID NO: 2700222 - RNA, 15 nt, Haemophilus influenzae Rd
aaugcuggagcaguu

SEQ ID NO: 2700223 - RNA, 21 nt, Haemophilus influenzae Rd
aaugcuggaucggcuauuuca

SEQ ID NO: 2700224 - RNA, 16 nt, Haemophilus influenzae Rd
aaugcuguaaugauca

SEQ ID NO: 2700225 - RNA, 19 nt, Haemophilus influenzae Rd
aaugcuguaaugaucacuu

SEQ ID NO: 2700226 - RNA, 14 nt, Haemophilus influenzae Rd
aaugcuguagaaau

SEQ ID NO: 2700227 - RNA, 15 nt, Haemophilus influenzae Rd
aaugcuguagaaauu

SEQ ID NO: 2700228 - RNA, 18 nt, Haemophilus influenzae Rd
aaugcuguagaaauuaau

SEQ ID NO: 2700229 - RNA, 15 nt, Haemophilus influenzae Rd
aaugcuguuuaaauc

SEQ ID NO: 2700230 - RNA, 18 nt, Haemophilus influenzae Rd
aaugcuguuuaaaucuaa

SEQ ID NO: 2700231 - RNA, 17 nt, Haemophilus influenzae Rd
aaugcuuacaaaauuag

SEQ ID NO: 2700232 - RNA, 17 nt, Haemophilus influenzae Rd
aaugcuuacaggaaagu

SEQ ID NO: 2700233 - RNA, 17 nt, Haemophilus influenzae Rd
aaugcuucuaaucccau

SEQ ID NO: 2700234 - RNA, 21 nt, Haemophilus influenzae Rd
aaugcuugaccuguuaaugaa

SEQ ID NO: 2700235 - RNA, 16 nt, Haemophilus influenzae Rd
aaugcuugguuuuaua

SEQ ID NO: 2700236 - RNA, 19 nt, Haemophilus influenzae Rd
aaugcuuguucugauuacu

SEQ ID NO: 2700237 - RNA, 14 nt, Haemophilus influenzae Rd
aaugcuuuaaucau

SEQ ID NO: 2700238 - RNA, 15 nt, Haemophilus influenzae Rd
aaugcuuuaaucauu

SEQ ID NO: 2700239 - RNA, 17 nt, Haemophilus influenzae Rd
aaugcuuuaaucauuuu

SEQ ID NO: 2700240 - RNA, 13 nt, Haemophilus influenzae Rd
aaugcuuuaauuu

SEQ ID NO: 2700241 - RNA, 22 nt, Haemophilus influenzae Rd
aaugcuuuauuuaaauuaaaaa

SEQ ID NO: 2700242 - RNA, 17 nt, Haemophilus influenzae Rd
aaugcuuugacugaggu

SEQ ID NO: 2700243 - RNA, 20 nt, Haemophilus influenzae Rd
aaugcuuuuauaagugaaau

SEQ ID NO: 2700244 - RNA, 18 nt, Haemophilus influenzae Rd
aaugcuuuugccgaaaau

SEQ ID NO: 2700245 - RNA, 13 nt, Haemophilus influenzae Rd
aaugcuuuugcuu

SEQ ID NO: 2700246 - RNA, 15 nt, Haemophilus influenzae Rd
aaugcuuuuugcguu

SEQ ID NO: 2700247 - RNA, 20 nt, Haemophilus influenzae Rd
aauggaaaccauugaugaaa

SEQ ID NO: 2700248 - RNA, 15 nt, Haemophilus influenzae Rd
aauggaauguagaua

SEQ ID NO: 2700249 - RNA, 20 nt, Haemophilus influenzae Rd
aauggaauucuucuggcaua

SEQ ID NO: 2700250 - RNA, 20 nt, Haemophilus influenzae Rd
aauggagugagcgguuuuuc

SEQ ID NO: 2700251 - RNA, 14 nt, Haemophilus influenzae Rd
aauggauauagaaa

SEQ ID NO: 2700252 - RNA, 21 nt, Haemophilus influenzae Rd
aauggauauagaaaucauaaa

SEQ ID NO: 2700253 - RNA, 15 nt, Haemophilus influenzae Rd
aauggaugaauacaa

SEQ ID NO: 2700254 - RNA, 14 nt, Haemophilus influenzae Rd
aauggcaaaauuuu

SEQ ID NO: 2700255 - RNA, 19 nt, Haemophilus influenzae Rd
aauggcaaacaaaauaaau

SEQ ID NO: 2700256 - RNA, 23 nt, Haemophilus influenzae Rd
aauggcaaacaaaauaaaugaug

SEQ ID NO: 2700257 - RNA, 19 nt, Haemophilus influenzae Rd
aauggcaaucacaaaucca

SEQ ID NO: 2700258 - RNA, 17 nt, Haemophilus influenzae Rd
aauggcaaucacaguuu

SEQ ID NO: 2700259 - RNA, 15 nt, Haemophilus influenzae Rd
aauggcaauuuuaua

SEQ ID NO: 2700260 - RNA, 13 nt, Haemophilus influenzae Rd
aauggcaucaaua

SEQ ID NO: 2700261 - RNA, 23 nt, Haemophilus influenzae Rd
aauggcaucgcuggcuaaauuuu

SEQ ID NO: 2700262 - RNA, 21 nt, Haemophilus influenzae Rd
aauggcccguguuucaauucu

SEQ ID NO: 2700263 - RNA, 22 nt, Haemophilus influenzae Rd
aauggcgacggcaucaaaccaa

SEQ ID NO: 2700264 - RNA, 23 nt, Haemophilus influenzae Rd
aauggcgacggcaucaaaccaac

SEQ ID NO: 2700265 - RNA, 14 nt, Haemophilus influenzae Rd
aauggcgguauauu

SEQ ID NO: 2700266 - RNA, 17 nt, Haemophilus influenzae Rd
aauggcgguuuuuuaau

SEQ ID NO: 2700267 - RNA, 21 nt, Haemophilus influenzae Rd
aauggcgucugcaauuagaaa

SEQ ID NO: 2700268 - RNA, 19 nt, Haemophilus influenzae Rd
aauggcgugccauuacaag

SEQ ID NO: 2700269 - RNA, 13 nt, Haemophilus influenzae Rd
aauggcuugcucu

SEQ ID NO: 2700270 - RNA, 15 nt, Haemophilus influenzae Rd
aauggcuugcucugu

SEQ ID NO: 2700271 - RNA, 14 nt, Haemophilus influenzae Rd
aauggcuuuaauuu

SEQ ID NO: 2700272 - RNA, 17 nt, Haemophilus influenzae Rd
aauggcuuuaauuuaca

SEQ ID NO: 2700273 - RNA, 22 nt, Haemophilus influenzae Rd
aauggcuuuucucaaaacaucu

SEQ ID NO: 2700274 - RNA, 15 nt, Haemophilus influenzae Rd
aauggcuuuuuugcc

SEQ ID NO: 2700275 - RNA, 22 nt, Haemophilus influenzae Rd
aaugggauuuucacuaauuugc

SEQ ID NO: 2700276 - RNA, 15 nt, Haemophilus influenzae Rd
aauggggcaauuuuu

SEQ ID NO: 2700277 - RNA, 18 nt, Haemophilus influenzae Rd
aaugggggaauaaauucu

SEQ ID NO: 2700278 - RNA, 17 nt, Haemophilus influenzae Rd
aaugguacaucuggaua

SEQ ID NO: 2700279 - RNA, 18 nt, Haemophilus influenzae Rd
aaugguguguaaugucuu

SEQ ID NO: 2700280 - RNA, 15 nt, Haemophilus influenzae Rd
aaugguuaauacaaa

SEQ ID NO: 2700281 - RNA, 17 nt, Haemophilus influenzae Rd
aaugguuacagaaauau

SEQ ID NO: 2700282 - RNA, 18 nt, Haemophilus influenzae Rd
aaugguuacagaaauauu

SEQ ID NO: 2700283 - RNA, 19 nt, Haemophilus influenzae Rd
aaugguuacuuuaucacaa

SEQ ID NO: 2700284 - RNA, 17 nt, Haemophilus influenzae Rd
aaugguugcauuugcuc

SEQ ID NO: 2700285 - RNA, 12 nt, Haemophilus influenzae Rd
aaugguuguucu

SEQ ID NO: 2700286 - RNA, 15 nt, Haemophilus influenzae Rd
aaugguuuaaauaac

SEQ ID NO: 2700287 - RNA, 19 nt, Haemophilus influenzae Rd
aaugguuucaguugcuucg

SEQ ID NO: 2700288 - RNA, 15 nt, Haemophilus influenzae Rd
aaugguuugcugguc

SEQ ID NO: 2700289 - RNA, 12 nt, Haemophilus influenzae Rd
aauguaaaaaau

SEQ ID NO: 2700290 - RNA, 15 nt, Haemophilus influenzae Rd
aauguaaaaaauaau

SEQ ID NO: 2700291 - RNA, 19 nt, Haemophilus influenzae Rd
aauguaaaaauuggaaaau

SEQ ID NO: 2700292 - RNA, 17 nt, Haemophilus influenzae Rd
aauguaaaauuggguuu

SEQ ID NO: 2700293 - RNA, 19 nt, Haemophilus influenzae Rd
aauguaaauuggcauuuuc

SEQ ID NO: 2700294 - RNA, 13 nt, Haemophilus influenzae Rd
aauguaaucaauu

SEQ ID NO: 2700295 - RNA, 15 nt, Haemophilus influenzae Rd
aauguagagauaaua

SEQ ID NO: 2700296 - RNA, 20 nt, Haemophilus influenzae Rd
aauguagagauaauaaauau

SEQ ID NO: 2700297 - RNA, 21 nt, Haemophilus influenzae Rd
aauguagagauaauaaauaua

SEQ ID NO: 2700298 - RNA, 16 nt, Haemophilus influenzae Rd
aauguagauaaugaua

SEQ ID NO: 2700299 - RNA, 15 nt, Haemophilus influenzae Rd
aauguaguuggcaua

SEQ ID NO: 2700300 - RNA, 13 nt, Haemophilus influenzae Rd
aauguauaaagca

SEQ ID NO: 2700301 - RNA, 18 nt, Haemophilus influenzae Rd
aauguauuucuaacaaau

SEQ ID NO: 2700302 - RNA, 21 nt, Haemophilus influenzae Rd
aaugucaggcgauuuuacguu

SEQ ID NO: 2700303 - RNA, 22 nt, Haemophilus influenzae Rd
aaugucgcauuuguaccaccaa

SEQ ID NO: 2700304 - RNA, 17 nt, Haemophilus influenzae Rd
aaugucgccauuuaagc

SEQ ID NO: 2700305 - RNA, 21 nt, Haemophilus influenzae Rd
aaugucgccauuuaagccuuu

SEQ ID NO: 2700306 - RNA, 16 nt, Haemophilus influenzae Rd
aaugucuuuuucuuac

SEQ ID NO: 2700307 - RNA, 21 nt, Haemophilus influenzae Rd
aaugugaucaugguuguaaua

SEQ ID NO: 2700308 - RNA, 16 nt, Haemophilus influenzae Rd
aaugugcgguagauuu

SEQ ID NO: 2700309 - RNA, 23 nt, Haemophilus influenzae Rd
aaugugcgguagauuuucaucgu

SEQ ID NO: 2700310 - RNA, 15 nt, Haemophilus influenzae Rd
aauguguugauuucu

SEQ ID NO: 2700311 - RNA, 15 nt, Haemophilus influenzae Rd
aauguuaauaauuua

SEQ ID NO: 2700312 - RNA, 19 nt, Haemophilus influenzae Rd
aauguuauugccuaauaaa

SEQ ID NO: 2700313 - RNA, 21 nt, Haemophilus influenzae Rd
aauguuauugccuaauaaaaa

SEQ ID NO: 2700314 - RNA, 22 nt, Haemophilus influenzae Rd
aauguuccaccacucacuggcu

SEQ ID NO: 2700315 - RNA, 15 nt, Haemophilus influenzae Rd
aauguucuuuuaaaa

SEQ ID NO: 2700316 - RNA, 13 nt, Haemophilus influenzae Rd
aauguugaauaua

SEQ ID NO: 2700317 - RNA, 16 nt, Haemophilus influenzae Rd
aauguuggaucccaau

SEQ ID NO: 2700318 - RNA, 14 nt, Haemophilus influenzae Rd
aauguuuaaaguaa

SEQ ID NO: 2700319 - RNA, 17 nt, Haemophilus influenzae Rd
aauguuuaauuauagaa

SEQ ID NO: 2700320 - RNA, 20 nt, Haemophilus influenzae Rd
aauguuuaauuauagaaaag

SEQ ID NO: 2700321 - RNA, 19 nt, Haemophilus influenzae Rd
aauguuuaccucgccauuu

SEQ ID NO: 2700322 - RNA, 12 nt, Haemophilus influenzae Rd
aauguuucaaac

SEQ ID NO: 2700323 - RNA, 14 nt, Haemophilus influenzae Rd
aauguuucacuuug

SEQ ID NO: 2700324 - RNA, 16 nt, Haemophilus influenzae Rd
aauguuuggauaaugu

SEQ ID NO: 2700325 - RNA, 18 nt, Haemophilus influenzae Rd
aauguuuuaaagaauauu

SEQ ID NO: 2700326 - RNA, 23 nt, Haemophilus influenzae Rd
aauguuuucuugaccuucaauug

SEQ ID NO: 2700327 - RNA, 14 nt, Haemophilus influenzae Rd
aauuaaaaagacua

SEQ ID NO: 2700328 - RNA, 13 nt, Haemophilus influenzae Rd
aauuaaaaauaaa

SEQ ID NO: 2700329 - RNA, 14 nt, Haemophilus influenzae Rd
aauuaaaaauaaau

SEQ ID NO: 2700330 - RNA, 13 nt, Haemophilus influenzae Rd
aauuaaaaauaac

SEQ ID NO: 2700331 - RNA, 14 nt, Haemophilus influenzae Rd
aauuaaaacguucu

SEQ ID NO: 2700332 - RNA, 12 nt, Haemophilus influenzae Rd
aauuaaaaguuu

SEQ ID NO: 2700333 - RNA, 13 nt, Haemophilus influenzae Rd
aauuaaaauaaua

SEQ ID NO: 2700334 - RNA, 13 nt, Haemophilus influenzae Rd
aauuaaacaaaau

SEQ ID NO: 2700335 - RNA, 19 nt, Haemophilus influenzae Rd
aauuaaacagccaaacaaa

SEQ ID NO: 2700336 - RNA, 22 nt, Haemophilus influenzae Rd
aauuaaacgugauuuaccaaua

SEQ ID NO: 2700337 - RNA, 13 nt, Haemophilus influenzae Rd
aauuaaacuuuca

SEQ ID NO: 2700338 - RNA, 14 nt, Haemophilus influenzae Rd
aauuaaacuuucaa

SEQ ID NO: 2700339 - RNA, 20 nt, Haemophilus influenzae Rd
aauuaaacuuucaauuuuuc

SEQ ID NO: 2700340 - RNA, 13 nt, Haemophilus influenzae Rd
aauuaaagaaaaa

SEQ ID NO: 2700341 - RNA, 15 nt, Haemophilus influenzae Rd
aauuaaagaaauuuc

SEQ ID NO: 2700342 - RNA, 14 nt, Haemophilus influenzae Rd
aauuaaaucaaaaa

SEQ ID NO: 2700343 - RNA, 16 nt, Haemophilus influenzae Rd
aauuaaaucaaaaauu

SEQ ID NO: 2700344 - RNA, 20 nt, Haemophilus influenzae Rd
aauuaaaucaaaaauuaaga

SEQ ID NO: 2700345 - RNA, 11 nt, Haemophilus influenzae Rd
aauuaaaucca

SEQ ID NO: 2700346 - RNA, 17 nt, Haemophilus influenzae Rd
aauuaaauucauuuaaa

SEQ ID NO: 2700347 - RNA, 13 nt, Haemophilus influenzae Rd
aauuaaauugaaa

SEQ ID NO: 2700348 - RNA, 13 nt, Haemophilus influenzae Rd
aauuaacaaauaa

SEQ ID NO: 2700349 - RNA, 12 nt, Haemophilus influenzae Rd
aauuaacaauau

SEQ ID NO: 2700350 - RNA, 17 nt, Haemophilus influenzae Rd
aauuaaccauaaaaaau

SEQ ID NO: 2700351 - RNA, 20 nt, Haemophilus influenzae Rd
aauuaaccgcacuuuaaaua

SEQ ID NO: 2700352 - RNA, 21 nt, Haemophilus influenzae Rd
aauuaaccgcacuuuaaauau

SEQ ID NO: 2700353 - RNA, 16 nt, Haemophilus influenzae Rd
aauuaaccgcacuuuu

SEQ ID NO: 2700354 - RNA, 14 nt, Haemophilus influenzae Rd
aauuaacgggcuua

SEQ ID NO: 2700355 - RNA, 21 nt, Haemophilus influenzae Rd
aauuaacgugcauuuuuauga

SEQ ID NO: 2700356 - RNA, 20 nt, Haemophilus influenzae Rd
aauuaacguuauaaacaaca

SEQ ID NO: 2700357 - RNA, 22 nt, Haemophilus influenzae Rd
aauuaacguuauaaacaacaaa

SEQ ID NO: 2700358 - RNA, 15 nt, Haemophilus influenzae Rd
aauuaagaaaauaau

SEQ ID NO: 2700359 - RNA, 19 nt, Haemophilus influenzae Rd
aauuaagaaaauaauauaa

SEQ ID NO: 2700360 - RNA, 18 nt, Haemophilus influenzae Rd
aauuaagaguaauagcuu

SEQ ID NO: 2700361 - RNA, 12 nt, Haemophilus influenzae Rd
aauuaagauaau

SEQ ID NO: 2700362 - RNA, 20 nt, Haemophilus influenzae Rd
aauuaaggauuuauuuaaca

SEQ ID NO: 2700363 - RNA, 22 nt, Haemophilus influenzae Rd
aauuaaggauuucuuaugaaaa

SEQ ID NO: 2700364 - RNA, 15 nt, Haemophilus influenzae Rd
aauuaaggcauuuuc

SEQ ID NO: 2700365 - RNA, 19 nt, Haemophilus influenzae Rd
aauuaaguagauaacaaaa

SEQ ID NO: 2700366 - RNA, 16 nt, Haemophilus influenzae Rd
aauuaagucaaaaauu

SEQ ID NO: 2700367 - RNA, 19 nt, Haemophilus influenzae Rd
aauuaaguuugagcaaauc

SEQ ID NO: 2700368 - RNA, 22 nt, Haemophilus influenzae Rd
aauuaaguuugagcaaaucaaa

SEQ ID NO: 2700369 - RNA, 15 nt, Haemophilus influenzae Rd
aauuaauaaaaaauc

SEQ ID NO: 2700370 - RNA, 14 nt, Haemophilus influenzae Rd
aauuaauaagaaaa

SEQ ID NO: 2700371 - RNA, 14 nt, Haemophilus influenzae Rd
aauuaauaagcccu

SEQ ID NO: 2700372 - RNA, 23 nt, Haemophilus influenzae Rd
aauuaauaauaagccgaagaaga

SEQ ID NO: 2700373 - RNA, 20 nt, Haemophilus influenzae Rd
aauuaauacgucaauugcua

SEQ ID NO: 2700374 - RNA, 23 nt, Haemophilus influenzae Rd
aauuaauacgucaauugcuaaac

SEQ ID NO: 2700375 - RNA, 14 nt, Haemophilus influenzae Rd
aauuaauacugaaa

SEQ ID NO: 2700376 - RNA, 11 nt, Haemophilus influenzae Rd
aauuaaugaac

SEQ ID NO: 2700377 - RNA, 20 nt, Haemophilus influenzae Rd
aauuaauggcucgauuaaac

SEQ ID NO: 2700378 - RNA, 21 nt, Haemophilus influenzae Rd
aauuaaugugcuauagcuugc

SEQ ID NO: 2700379 - RNA, 23 nt, Haemophilus influenzae Rd
aauuaauucgaucagcacgauaa

SEQ ID NO: 2700380 - RNA, 18 nt, Haemophilus influenzae Rd
aauuaauucguccauucu

SEQ ID NO: 2700381 - RNA, 16 nt, Haemophilus influenzae Rd
aauuaauucucccuca

SEQ ID NO: 2700382 - RNA, 14 nt, Haemophilus influenzae Rd
aauuaauugcucug

SEQ ID NO: 2700383 - RNA, 17 nt, Haemophilus influenzae Rd
aauuaauuuauaaauua

SEQ ID NO: 2700384 - RNA, 14 nt, Haemophilus influenzae Rd
aauuacaaaaccaa

SEQ ID NO: 2700385 - RNA, 14 nt, Haemophilus influenzae Rd
aauuacaauacgau

SEQ ID NO: 2700386 - RNA, 21 nt, Haemophilus influenzae Rd
aauuacaucauuccgcccauu

SEQ ID NO: 2700387 - RNA, 22 nt, Haemophilus influenzae Rd
aauuacauuuuuucuacgguuu

SEQ ID NO: 2700388 - RNA, 15 nt, Haemophilus influenzae Rd
aauuaccaauuccaa

SEQ ID NO: 2700389 - RNA, 13 nt, Haemophilus influenzae Rd
aauuaccacauca

SEQ ID NO: 2700390 - RNA, 14 nt, Haemophilus influenzae Rd
aauuaccacaugca

SEQ ID NO: 2700391 - RNA, 15 nt, Haemophilus influenzae Rd
aauuaccacguucau

SEQ ID NO: 2700392 - RNA, 24 nt, Haemophilus influenzae Rd
aauuaccacguucauuucguauaa

SEQ ID NO: 2700393 - RNA, 18 nt, Haemophilus influenzae Rd
aauuacccaaaugaugaa

SEQ ID NO: 2700394 - RNA, 19 nt, Haemophilus influenzae Rd
aauuacccaaaugaugaaa

SEQ ID NO: 2700395 - RNA, 17 nt, Haemophilus influenzae Rd
aauuaccgcacuuuaaa

SEQ ID NO: 2700396 - RNA, 15 nt, Haemophilus influenzae Rd
aauuaccgcucuuuu

SEQ ID NO: 2700397 - RNA, 20 nt, Haemophilus influenzae Rd
aauuaccugaugaaaucauu

SEQ ID NO: 2700398 - RNA, 17 nt, Haemophilus influenzae Rd
aauuaccugugaaaaca

SEQ ID NO: 2700399 - RNA, 19 nt, Haemophilus influenzae Rd
aauuaccugugaaaacacg

SEQ ID NO: 2700400 - RNA, 13 nt, Haemophilus influenzae Rd
aauuaccuuguuu

SEQ ID NO: 2700401 - RNA, 23 nt, Haemophilus influenzae Rd
aauuacgaaguggcguuugcucu

SEQ ID NO: 2700402 - RNA, 18 nt, Haemophilus influenzae Rd
aauuacgacauucuuuag

SEQ ID NO: 2700403 - RNA, 19 nt, Haemophilus influenzae Rd
aauuacgccugcaaauaag

SEQ ID NO: 2700404 - RNA, 15 nt, Haemophilus influenzae Rd
aauuacguagauaau

SEQ ID NO: 2700405 - RNA, 22 nt, Haemophilus influenzae Rd
aauuacguuguuguucuaacau

SEQ ID NO: 2700406 - RNA, 21 nt, Haemophilus influenzae Rd
aauuacucacuauaacuuuuc

SEQ ID NO: 2700407 - RNA, 23 nt, Haemophilus influenzae Rd
aauuacucacuauaacuuuucaa

SEQ ID NO: 2700408 - RNA, 19 nt, Haemophilus influenzae Rd
aauuacugcaaaugcaggg

SEQ ID NO: 2700409 - RNA, 21 nt, Haemophilus influenzae Rd
aauuacuuaauuaaauaaaca

SEQ ID NO: 2700410 - RNA, 18 nt, Haemophilus influenzae Rd
aauuacuucuuacaacaa

SEQ ID NO: 2700411 - RNA, 16 nt, Haemophilus influenzae Rd
aauuacuugaaucuaa

SEQ ID NO: 2700412 - RNA, 22 nt, Haemophilus influenzae Rd
aauuacuuggggcuaauuuuua

SEQ ID NO: 2700413 - RNA, 16 nt, Haemophilus influenzae Rd
aauuacuuuuauaucu

SEQ ID NO: 2700414 - RNA, 12 nt, Haemophilus influenzae Rd
aauuagaauaac

SEQ ID NO: 2700415 - RNA, 14 nt, Haemophilus influenzae Rd
aauuagacuuucuu

SEQ ID NO: 2700416 - RNA, 16 nt, Haemophilus influenzae Rd
aauuagacuuucuuaa

SEQ ID NO: 2700417 - RNA, 16 nt, Haemophilus influenzae Rd
aauuagauaauacaga

SEQ ID NO: 2700418 - RNA, 22 nt, Haemophilus influenzae Rd
aauuagaucauaaaaaaaugua

SEQ ID NO: 2700419 - RNA, 19 nt, Haemophilus influenzae Rd
aauuagaugacuggcaaaa

SEQ ID NO: 2700420 - RNA, 20 nt, Haemophilus influenzae Rd
aauuagaugacuggcaaaaa

SEQ ID NO: 2700421 - RNA, 15 nt, Haemophilus influenzae Rd
aauuagaugauuuua

SEQ ID NO: 2700422 - RNA, 20 nt, Haemophilus influenzae Rd
aauuagaugauuuuaaaaua

SEQ ID NO: 2700423 - RNA, 20 nt, Haemophilus influenzae Rd
aauuagaugauuuuaaagua

SEQ ID NO: 2700424 - RNA, 23 nt, Haemophilus influenzae Rd
aauuagcgauuaaagucccaaaa

SEQ ID NO: 2700425 - RNA, 20 nt, Haemophilus influenzae Rd
aauuagcuaaauacuugcuu

SEQ ID NO: 2700426 - RNA, 21 nt, Haemophilus influenzae Rd
aauuagcucaauagauuuaau

SEQ ID NO: 2700427 - RNA, 23 nt, Haemophilus influenzae Rd
aauuagguacagugaucacaagg

SEQ ID NO: 2700428 - RNA, 16 nt, Haemophilus influenzae Rd
aauuaguaaagaaaua

SEQ ID NO: 2700429 - RNA, 22 nt, Haemophilus influenzae Rd
aauuaguauaaacaucagugau

SEQ ID NO: 2700430 - RNA, 18 nt, Haemophilus influenzae Rd
aauuagucggcgcauugc

SEQ ID NO: 2700431 - RNA, 16 nt, Haemophilus influenzae Rd
aauuaguuugauuaca

SEQ ID NO: 2700432 - RNA, 21 nt, Haemophilus influenzae Rd
aauuaguuugauuacaguaca

SEQ ID NO: 2700433 - RNA, 17 nt, Haemophilus influenzae Rd
aauuaguuuuuuauuuc

SEQ ID NO: 2700434 - RNA, 22 nt, Haemophilus influenzae Rd
aauuauaaaauagccuaaauau

SEQ ID NO: 2700435 - RNA, 14 nt, Haemophilus influenzae Rd
aauuauaauauuua

SEQ ID NO: 2700436 - RNA, 12 nt, Haemophilus influenzae Rd
aauuauagaaaa

SEQ ID NO: 2700437 - RNA, 20 nt, Haemophilus influenzae Rd
aauuauagaaaagacaauaa

SEQ ID NO: 2700438 - RNA, 23 nt, Haemophilus influenzae Rd
aauuauagaaaagacaauaauuc

SEQ ID NO: 2700439 - RNA, 13 nt, Haemophilus influenzae Rd
aauuauagagaaa

SEQ ID NO: 2700440 - RNA, 15 nt, Haemophilus influenzae Rd
aauuauagagaaaua

SEQ ID NO: 2700441 - RNA, 16 nt, Haemophilus influenzae Rd
aauuauagagaaauaa

SEQ ID NO: 2700442 - RNA, 15 nt, Haemophilus influenzae Rd
aauuauagauaaaua

SEQ ID NO: 2700443 - RNA, 21 nt, Haemophilus influenzae Rd
aauuauaggcuauaaagagau

SEQ ID NO: 2700444 - RNA, 15 nt, Haemophilus influenzae Rd
aauuaucaaaaagaa

SEQ ID NO: 2700445 - RNA, 19 nt, Haemophilus influenzae Rd
aauuaucaaaaagaaauau

SEQ ID NO: 2700446 - RNA, 14 nt, Haemophilus influenzae Rd
aauuaucaaaagaa

SEQ ID NO: 2700447 - RNA, 21 nt, Haemophilus influenzae Rd
aauuaucaaaagaaaagauga

SEQ ID NO: 2700448 - RNA, 15 nt, Haemophilus influenzae Rd
aauuaucaaagaauu

SEQ ID NO: 2700449 - RNA, 13 nt, Haemophilus influenzae Rd
aauuaucaauguu

SEQ ID NO: 2700450 - RNA, 14 nt, Haemophilus influenzae Rd
aauuaucaucauuu

SEQ ID NO: 2700451 - RNA, 20 nt, Haemophilus influenzae Rd
aauuaucguuuacuuaaaau

SEQ ID NO: 2700452 - RNA, 22 nt, Haemophilus influenzae Rd
aauuaucugauguagcuugaau

SEQ ID NO: 2700453 - RNA, 20 nt, Haemophilus influenzae Rd
aauuaucuggcaaucgccaa

SEQ ID NO: 2700454 - RNA, 21 nt, Haemophilus influenzae Rd
aauuauguuaaauugcaaaaa

SEQ ID NO: 2700455 - RNA, 20 nt, Haemophilus influenzae Rd
aauuauguuuacggaugcaa

SEQ ID NO: 2700456 - RNA, 15 nt, Haemophilus influenzae Rd
aauuauucugcaaca

SEQ ID NO: 2700457 - RNA, 18 nt, Haemophilus influenzae Rd
aauuauucuucaucuucu

SEQ ID NO: 2700458 - RNA, 15 nt, Haemophilus influenzae Rd
aauuauugcauuuuu

SEQ ID NO: 2700459 - RNA, 23 nt, Haemophilus influenzae Rd
aauuauugcuuaugauuuagugc

SEQ ID NO: 2700460 - RNA, 17 nt, Haemophilus influenzae Rd
aauuauuggcaauuucc

SEQ ID NO: 2700461 - RNA, 21 nt, Haemophilus influenzae Rd
aauuauugugagauaugaaau

SEQ ID NO: 2700462 - RNA, 23 nt, Haemophilus influenzae Rd
aauuauugugagauaugaaauaa

SEQ ID NO: 2700463 - RNA, 16 nt, Haemophilus influenzae Rd
aauuauuucaguaacu

SEQ ID NO: 2700464 - RNA, 20 nt, Haemophilus influenzae Rd
aauuauuucaguaacuuuaa

SEQ ID NO: 2700465 - RNA, 17 nt, Haemophilus influenzae Rd
aauuauuuuaaauaaau

SEQ ID NO: 2700466 - RNA, 12 nt, Haemophilus influenzae Rd
aauucaaaaacc

SEQ ID NO: 2700467 - RNA, 14 nt, Haemophilus influenzae Rd
aauucaaaaaccaa

SEQ ID NO: 2700468 - RNA, 15 nt, Haemophilus influenzae Rd
aauucaaaaaccaaa

SEQ ID NO: 2700469 - RNA, 16 nt, Haemophilus influenzae Rd
aauucaaaaaccaaac

SEQ ID NO: 2700470 - RNA, 21 nt, Haemophilus influenzae Rd
aauucaaaacggucagucacu

SEQ ID NO: 2700471 - RNA, 13 nt, Haemophilus influenzae Rd
aauucaaacaaua

SEQ ID NO: 2700472 - RNA, 19 nt, Haemophilus influenzae Rd
aauucaaagauuauuuaau

SEQ ID NO: 2700473 - RNA, 13 nt, Haemophilus influenzae Rd
aauucaaagauuu

SEQ ID NO: 2700474 - RNA, 20 nt, Haemophilus influenzae Rd
aauucaaagauuuuaaaauu

SEQ ID NO: 2700475 - RNA, 18 nt, Haemophilus influenzae Rd
aauucaaaucuugacaua

SEQ ID NO: 2700476 - RNA, 11 nt, Haemophilus influenzae Rd
aauucaacacg

SEQ ID NO: 2700477 - RNA, 15 nt, Haemophilus influenzae Rd
aauucaacacgccua

SEQ ID NO: 2700478 - RNA, 16 nt, Haemophilus influenzae Rd
aauucaacacgccuaa

SEQ ID NO: 2700479 - RNA, 18 nt, Haemophilus influenzae Rd
aauucaagaugauauuua

SEQ ID NO: 2700480 - RNA, 21 nt, Haemophilus influenzae Rd
aauucaauagguuauaaguuu

SEQ ID NO: 2700481 - RNA, 22 nt, Haemophilus influenzae Rd
aauucaauagguuauaaguuuu

SEQ ID NO: 2700482 - RNA, 23 nt, Haemophilus influenzae Rd
aauucacagggcugaguccuuuu

SEQ ID NO: 2700483 - RNA, 11 nt, Haemophilus influenzae Rd
aauucaccaau

SEQ ID NO: 2700484 - RNA, 16 nt, Haemophilus influenzae Rd
aauucacgcagaauaa

SEQ ID NO: 2700485 - RNA, 15 nt, Haemophilus influenzae Rd
aauucacucaauuca

SEQ ID NO: 2700486 - RNA, 16 nt, Haemophilus influenzae Rd
aauucacucaauucaa

SEQ ID NO: 2700487 - RNA, 22 nt, Haemophilus influenzae Rd
aauucacugacaucaagcacau

SEQ ID NO: 2700488 - RNA, 16 nt, Haemophilus influenzae Rd
aauucagcaaaaagug

SEQ ID NO: 2700489 - RNA, 16 nt, Haemophilus influenzae Rd
aauucagcgagagaau

SEQ ID NO: 2700490 - RNA, 18 nt, Haemophilus influenzae Rd
aauucagcggcuuucuuc

SEQ ID NO: 2700491 - RNA, 18 nt, Haemophilus influenzae Rd
aauucaggcauuucauca

SEQ ID NO: 2700492 - RNA, 18 nt, Haemophilus influenzae Rd
aauucagggauuaagaaa

SEQ ID NO: 2700493 - RNA, 19 nt, Haemophilus influenzae Rd
aauucagggauuaagaaaa

SEQ ID NO: 2700494 - RNA, 20 nt, Haemophilus influenzae Rd
aauucagggauuaagaaaau

SEQ ID NO: 2700495 - RNA, 20 nt, Haemophilus influenzae Rd
aauucaggugggaaauaauu

SEQ ID NO: 2700496 - RNA, 18 nt, Haemophilus influenzae Rd
aauucaguccaugcguuu

SEQ ID NO: 2700497 - RNA, 21 nt, Haemophilus influenzae Rd
aauucaguguaauguuuuaau

SEQ ID NO: 2700498 - RNA, 16 nt, Haemophilus influenzae Rd
aauucaguucaauuua

SEQ ID NO: 2700499 - RNA, 13 nt, Haemophilus influenzae Rd
aauucauaaaaau

SEQ ID NO: 2700500 - RNA, 12 nt, Haemophilus influenzae Rd
aauucaucagaa

SEQ ID NO: 2700501 - RNA, 15 nt, Haemophilus influenzae Rd
aauucaucagaaagu

SEQ ID NO: 2700502 - RNA, 18 nt, Haemophilus influenzae Rd
aauucauucaacaaaaau

SEQ ID NO: 2700503 - RNA, 17 nt, Haemophilus influenzae Rd
aauucauugaguuuagu

SEQ ID NO: 2700504 - RNA, 21 nt, Haemophilus influenzae Rd
aauucauugaugcccacuuuu

SEQ ID NO: 2700505 - RNA, 12 nt, Haemophilus influenzae Rd
aauucauuuaaa

SEQ ID NO: 2700506 - RNA, 15 nt, Haemophilus influenzae Rd
aauucauuuaaaaua

SEQ ID NO: 2700507 - RNA, 22 nt, Haemophilus influenzae Rd
aauucauuuaaaauauauauua

SEQ ID NO: 2700508 - RNA, 23 nt, Haemophilus influenzae Rd
aauucauuuuuuauuuuuucuaa

SEQ ID NO: 2700509 - RNA, 22 nt, Haemophilus influenzae Rd
aauuccaagccauguugaugua

SEQ ID NO: 2700510 - RNA, 23 nt, Haemophilus influenzae Rd
aauuccauugcauccacuucauc

SEQ ID NO: 2700511 - RNA, 20 nt, Haemophilus influenzae Rd
aauuccccagcagaguuaau

SEQ ID NO: 2700512 - RNA, 15 nt, Haemophilus influenzae Rd
aauuccccuucaaau

SEQ ID NO: 2700513 - RNA, 15 nt, Haemophilus influenzae Rd
aauuccgcaauauuu

SEQ ID NO: 2700514 - RNA, 23 nt, Haemophilus influenzae Rd
aauuccuacacccauuacaccga

SEQ ID NO: 2700515 - RNA, 15 nt, Haemophilus influenzae Rd
aauuccuuauuuuac

SEQ ID NO: 2700516 - RNA, 16 nt, Haemophilus influenzae Rd
aauuccuuauuuuacu

SEQ ID NO: 2700517 - RNA, 24 nt, Haemophilus influenzae Rd
aauuccuucaucgucuucuucgcu

SEQ ID NO: 2700518 - RNA, 14 nt, Haemophilus influenzae Rd
aauuccuuuaacgc

SEQ ID NO: 2700519 - RNA, 13 nt, Haemophilus influenzae Rd
aauuccuuuuuaa

SEQ ID NO: 2700520 - RNA, 16 nt, Haemophilus influenzae Rd
aauuccuuuuucuacu

SEQ ID NO: 2700521 - RNA, 18 nt, Haemophilus influenzae Rd
aauucgacgauaaccauc

SEQ ID NO: 2700522 - RNA, 18 nt, Haemophilus influenzae Rd
aauucgagcgguaauuug

SEQ ID NO: 2700523 - RNA, 21 nt, Haemophilus influenzae Rd
aauucgcaaauccuacaacac

SEQ ID NO: 2700524 - RNA, 18 nt, Haemophilus influenzae Rd
aauucgcguuuauuuaac

SEQ ID NO: 2700525 - RNA, 21 nt, Haemophilus influenzae Rd
aauucgcguuuauuuaacaau

SEQ ID NO: 2700526 - RNA, 14 nt, Haemophilus influenzae Rd
aauucgcuuccagu

SEQ ID NO: 2700527 - RNA, 17 nt, Haemophilus influenzae Rd
aauucguacuuuugauu

SEQ ID NO: 2700528 - RNA, 18 nt, Haemophilus influenzae Rd
aauucgugcaaauuuuuu

SEQ ID NO: 2700529 - RNA, 17 nt, Haemophilus influenzae Rd
aauucgugccacaugau

SEQ ID NO: 2700530 - RNA, 18 nt, Haemophilus influenzae Rd
aauucguuaauaaaucca

SEQ ID NO: 2700531 - RNA, 13 nt, Haemophilus influenzae Rd
aauucuaaaacaa

SEQ ID NO: 2700532 - RNA, 14 nt, Haemophilus influenzae Rd
aauucuaaauucuc

SEQ ID NO: 2700533 - RNA, 19 nt, Haemophilus influenzae Rd
aauucuaagguuaugccaa

SEQ ID NO: 2700534 - RNA, 21 nt, Haemophilus influenzae Rd
aauucuaauucugcuuuucca

SEQ ID NO: 2700535 - RNA, 24 nt, Haemophilus influenzae Rd
aauucuacaccagcuuuaaccauu

SEQ ID NO: 2700536 - RNA, 18 nt, Haemophilus influenzae Rd
aauucuaguucuuccccu

SEQ ID NO: 2700537 - RNA, 22 nt, Haemophilus influenzae Rd
aauucuauaauccgcagaauuu

SEQ ID NO: 2700538 - RNA, 16 nt, Haemophilus influenzae Rd
aauucuauuaaaauau

SEQ ID NO: 2700539 - RNA, 17 nt, Haemophilus influenzae Rd
aauucuauuaaaauauu

SEQ ID NO: 2700540 - RNA, 19 nt, Haemophilus influenzae Rd
aauucuauuaaaauauuuc

SEQ ID NO: 2700541 - RNA, 14 nt, Haemophilus influenzae Rd
aauucucauacaaa

SEQ ID NO: 2700542 - RNA, 22 nt, Haemophilus influenzae Rd
aauucuccccgaugauuuuuac

SEQ ID NO: 2700543 - RNA, 18 nt, Haemophilus influenzae Rd
aauucucgccauaauaaa

SEQ ID NO: 2700544 - RNA, 18 nt, Haemophilus influenzae Rd
aauucucggcaaugguuc

SEQ ID NO: 2700545 - RNA, 20 nt, Haemophilus influenzae Rd
aauucucuuuccacuuuccg

SEQ ID NO: 2700546 - RNA, 22 nt, Haemophilus influenzae Rd
aauucugagcaaauuacccaaa

SEQ ID NO: 2700547 - RNA, 21 nt, Haemophilus influenzae Rd
aauucugcacgacgugcuuca

SEQ ID NO: 2700548 - RNA, 15 nt, Haemophilus influenzae Rd
aauucugcuaaaucu

SEQ ID NO: 2700549 - RNA, 17 nt, Haemophilus influenzae Rd
aauucugcuuaguucca

SEQ ID NO: 2700550 - RNA, 16 nt, Haemophilus influenzae Rd
aauucuguuuagucuu

SEQ ID NO: 2700551 - RNA, 14 nt, Haemophilus influenzae Rd
aauucuguuuuugg

SEQ ID NO: 2700552 - RNA, 21 nt, Haemophilus influenzae Rd
aauucuuaaaugggaaacuga

SEQ ID NO: 2700553 - RNA, 9 nt, Haemophilus influenzae Rd
aauucuucc

SEQ ID NO: 2700554 - RNA, 22 nt, Haemophilus influenzae Rd
aauucuucccagcguaaaaaug

SEQ ID NO: 2700555 - RNA, 15 nt, Haemophilus influenzae Rd
aauucuucuaauuca

SEQ ID NO: 2700556 - RNA, 20 nt, Haemophilus influenzae Rd
aauucuucuauuuuaucaag

SEQ ID NO: 2700557 - RNA, 16 nt, Haemophilus influenzae Rd
aauucuucuggcauau

SEQ ID NO: 2700558 - RNA, 14 nt, Haemophilus influenzae Rd
aauucuugacguaa

SEQ ID NO: 2700559 - RNA, 14 nt, Haemophilus influenzae Rd
aauucuugccauaa

SEQ ID NO: 2700560 - RNA, 14 nt, Haemophilus influenzae Rd
aauucuuuuaaaug

SEQ ID NO: 2700561 - RNA, 19 nt, Haemophilus influenzae Rd
aauucuuuucuuagauaaa

SEQ ID NO: 2700562 - RNA, 22 nt, Haemophilus influenzae Rd
aauucuuuucuucuuugacuaa

SEQ ID NO: 2700563 - RNA, 17 nt, Haemophilus influenzae Rd
aauucuuuugccauaua

SEQ ID NO: 2700564 - RNA, 14 nt, Haemophilus influenzae Rd
aauucuuuuucacu

SEQ ID NO: 2700565 - RNA, 11 nt, Haemophilus influenzae Rd
aauugaaaaaa

SEQ ID NO: 2700566 - RNA, 12 nt, Haemophilus influenzae Rd
aauugaaauuua

SEQ ID NO: 2700567 - RNA, 14 nt, Haemophilus influenzae Rd
aauugaaauuuauc

SEQ ID NO: 2700568 - RNA, 15 nt, Haemophilus influenzae Rd
aauugaaauuuaucu

SEQ ID NO: 2700569 - RNA, 14 nt, Haemophilus influenzae Rd
aauugaauuaaaag

SEQ ID NO: 2700570 - RNA, 19 nt, Haemophilus influenzae Rd
aauugaccgcacuuguaau

SEQ ID NO: 2700571 - RNA, 18 nt, Haemophilus influenzae Rd
aauugacggcuucagaaa

SEQ ID NO: 2700572 - RNA, 19 nt, Haemophilus influenzae Rd
aauugacggcuucagaaaa

SEQ ID NO: 2700573 - RNA, 20 nt, Haemophilus influenzae Rd
aauugacggugcauuugcau

SEQ ID NO: 2700574 - RNA, 21 nt, Haemophilus influenzae Rd
aauugacguaaaaguuuuccg

SEQ ID NO: 2700575 - RNA, 15 nt, Haemophilus influenzae Rd
aauugacguucuugc

SEQ ID NO: 2700576 - RNA, 20 nt, Haemophilus influenzae Rd
aauugacuugcacaauuacu

SEQ ID NO: 2700577 - RNA, 17 nt, Haemophilus influenzae Rd
aauugagaucuuugcca

SEQ ID NO: 2700578 - RNA, 22 nt, Haemophilus influenzae Rd
aauugagcguccacuucuuccg

SEQ ID NO: 2700579 - RNA, 18 nt, Haemophilus influenzae Rd
aauugaggauuugccucu

SEQ ID NO: 2700580 - RNA, 12 nt, Haemophilus influenzae Rd
aauugagugaau

SEQ ID NO: 2700581 - RNA, 17 nt, Haemophilus influenzae Rd
aauugagugaauuucuu

SEQ ID NO: 2700582 - RNA, 19 nt, Haemophilus influenzae Rd
aauugagugaauuucuugc

SEQ ID NO: 2700583 - RNA, 19 nt, Haemophilus influenzae Rd
aauugaguguggugaacag

SEQ ID NO: 2700584 - RNA, 22 nt, Haemophilus influenzae Rd
aauugaguguggugaacagcuu

SEQ ID NO: 2700585 - RNA, 21 nt, Haemophilus influenzae Rd
aauugauaccaagauaauaaa

SEQ ID NO: 2700586 - RNA, 15 nt, Haemophilus influenzae Rd
aauugauauaaaugg

SEQ ID NO: 2700587 - RNA, 15 nt, Haemophilus influenzae Rd
aauugaucuaaauua

SEQ ID NO: 2700588 - RNA, 16 nt, Haemophilus influenzae Rd
aauugaucuaaauuau

SEQ ID NO: 2700589 - RNA, 20 nt, Haemophilus influenzae Rd
aauugauggcgugaaauauu

SEQ ID NO: 2700590 - RNA, 16 nt, Haemophilus influenzae Rd
aauugauguaaaagau

SEQ ID NO: 2700591 - RNA, 13 nt, Haemophilus influenzae Rd
aauugauuaaaaa

SEQ ID NO: 2700592 - RNA, 15 nt, Haemophilus influenzae Rd
aauugauuaaaaaag

SEQ ID NO: 2700593 - RNA, 18 nt, Haemophilus influenzae Rd
aauugauucgauaaauua

SEQ ID NO: 2700594 - RNA, 18 nt, Haemophilus influenzae Rd
aauugauuuaaaaaucug

SEQ ID NO: 2700595 - RNA, 15 nt, Haemophilus influenzae Rd
aauugauuuuaaaga

SEQ ID NO: 2700596 - RNA, 13 nt, Haemophilus influenzae Rd
aauugcaaaaaac

SEQ ID NO: 2700597 - RNA, 14 nt, Haemophilus influenzae Rd
aauugcauuaaaag

SEQ ID NO: 2700598 - RNA, 12 nt, Haemophilus influenzae Rd
aauugcauuuuc

SEQ ID NO: 2700599 - RNA, 15 nt, Haemophilus influenzae Rd
aauugcauuuucuuc

SEQ ID NO: 2700600 - RNA, 14 nt, Haemophilus influenzae Rd
aauugccaaaaaag

SEQ ID NO: 2700601 - RNA, 16 nt, Haemophilus influenzae Rd
aauugcccaauaaaag

SEQ ID NO: 2700602 - RNA, 17 nt, Haemophilus influenzae Rd
aauugccccuucaccuu

SEQ ID NO: 2700603 - RNA, 18 nt, Haemophilus influenzae Rd
aauugccgacacuaaaaa

SEQ ID NO: 2700604 - RNA, 19 nt, Haemophilus influenzae Rd
aauugccgacacuaaaaag

SEQ ID NO: 2700605 - RNA, 21 nt, Haemophilus influenzae Rd
aauugcgguggaagucugcua

SEQ ID NO: 2700606 - RNA, 22 nt, Haemophilus influenzae Rd
aauugcguguuuauauaccauu

SEQ ID NO: 2700607 - RNA, 15 nt, Haemophilus influenzae Rd
aauugcucuaauuca

SEQ ID NO: 2700608 - RNA, 18 nt, Haemophilus influenzae Rd
aauuggaaaaguaagaaa

SEQ ID NO: 2700609 - RNA, 13 nt, Haemophilus influenzae Rd
aauuggaaauaau

SEQ ID NO: 2700610 - RNA, 14 nt, Haemophilus influenzae Rd
aauuggaaauaaua

SEQ ID NO: 2700611 - RNA, 19 nt, Haemophilus influenzae Rd
aauuggacaagaaauaaua

SEQ ID NO: 2700612 - RNA, 22 nt, Haemophilus influenzae Rd
aauuggcgcaggcaaaccaagc

SEQ ID NO: 2700613 - RNA, 21 nt, Haemophilus influenzae Rd
aauuggcgcgccgauauggcg

SEQ ID NO: 2700614 - RNA, 16 nt, Haemophilus influenzae Rd
aauugguguuuaaaug

SEQ ID NO: 2700615 - RNA, 20 nt, Haemophilus influenzae Rd
aauugguuaauguaaacaaa

SEQ ID NO: 2700616 - RNA, 16 nt, Haemophilus influenzae Rd
aauugguucuaaauau

SEQ ID NO: 2700617 - RNA, 19 nt, Haemophilus influenzae Rd
aauugguucuaaauauuuu

SEQ ID NO: 2700618 - RNA, 17 nt, Haemophilus influenzae Rd
aauugguuuugugcuug

SEQ ID NO: 2700619 - RNA, 24 nt, Haemophilus influenzae Rd
aauuguaacuauaugauauauaaa

SEQ ID NO: 2700620 - RNA, 15 nt, Haemophilus influenzae Rd
aauuguaauuuugug

SEQ ID NO: 2700621 - RNA, 19 nt, Haemophilus influenzae Rd
aauugucaaaauugaugaa

SEQ ID NO: 2700622 - RNA, 20 nt, Haemophilus influenzae Rd
aauugucguugaacucacaa

SEQ ID NO: 2700623 - RNA, 22 nt, Haemophilus influenzae Rd
aauugucguugaacucacaauu

SEQ ID NO: 2700624 - RNA, 20 nt, Haemophilus influenzae Rd
aauugugccgcuuguugauu

SEQ ID NO: 2700625 - RNA, 18 nt, Haemophilus influenzae Rd
aauugugcuaaauuuuuu

SEQ ID NO: 2700626 - RNA, 20 nt, Haemophilus influenzae Rd
aauuguguguuuuaaaccac

SEQ ID NO: 2700627 - RNA, 17 nt, Haemophilus influenzae Rd
aauuguucuucuguuaa

SEQ ID NO: 2700628 - RNA, 13 nt, Haemophilus influenzae Rd
aauuguugauucc

SEQ ID NO: 2700629 - RNA, 19 nt, Haemophilus influenzae Rd
aauuguugccgccaaucca

SEQ ID NO: 2700630 - RNA, 20 nt, Haemophilus influenzae Rd
aauuguugguuacuaaaugu

SEQ ID NO: 2700631 - RNA, 22 nt, Haemophilus influenzae Rd
aauuguugguuacuaaauguga

SEQ ID NO: 2700632 - RNA, 15 nt, Haemophilus influenzae Rd
aauuguuuaaugaaa

SEQ ID NO: 2700633 - RNA, 19 nt, Haemophilus influenzae Rd
aauuguuuguauaagccac

SEQ ID NO: 2700634 - RNA, 16 nt, Haemophilus influenzae Rd
aauuguuuuucccaca

SEQ ID NO: 2700635 - RNA, 12 nt, Haemophilus influenzae Rd
aauuuaaaaaag

SEQ ID NO: 2700636 - RNA, 16 nt, Haemophilus influenzae Rd
aauuuaaaaaguagua

SEQ ID NO: 2700637 - RNA, 18 nt, Haemophilus influenzae Rd
aauuuaaauaaagcauua

SEQ ID NO: 2700638 - RNA, 13 nt, Haemophilus influenzae Rd
aauuuaaauaaua

SEQ ID NO: 2700639 - RNA, 20 nt, Haemophilus influenzae Rd
aauuuaaauaauaaauccaa

SEQ ID NO: 2700640 - RNA, 23 nt, Haemophilus influenzae Rd
aauuuaaauaauaaauccaaaua

SEQ ID NO: 2700641 - RNA, 12 nt, Haemophilus influenzae Rd
aauuuaaauaua

SEQ ID NO: 2700642 - RNA, 14 nt, Haemophilus influenzae Rd
aauuuaaauauaau

SEQ ID NO: 2700643 - RNA, 23 nt, Haemophilus influenzae Rd
aauuuaacauaacuuuccauaua

SEQ ID NO: 2700644 - RNA, 12 nt, Haemophilus influenzae Rd
aauuuaagaaaa

SEQ ID NO: 2700645 - RNA, 13 nt, Haemophilus influenzae Rd
aauuuaagaaaaa

SEQ ID NO: 2700646 - RNA, 18 nt, Haemophilus influenzae Rd
aauuuaagaaaaaauaua

SEQ ID NO: 2700647 - RNA, 14 nt, Haemophilus influenzae Rd
aauuuaagcccugc

SEQ ID NO: 2700648 - RNA, 19 nt, Haemophilus influenzae Rd
aauuuaaggcuuuuucugc

SEQ ID NO: 2700649 - RNA, 18 nt, Haemophilus influenzae Rd
aauuuaauaagauuuuua

SEQ ID NO: 2700650 - RNA, 18 nt, Haemophilus influenzae Rd
aauuuacacauugccaua

SEQ ID NO: 2700651 - RNA, 14 nt, Haemophilus influenzae Rd
aauuuaccgcacuu

SEQ ID NO: 2700652 - RNA, 16 nt, Haemophilus influenzae Rd
aauuuaccgcacuuua

SEQ ID NO: 2700653 - RNA, 16 nt, Haemophilus influenzae Rd
aauuuacucacaacaa

SEQ ID NO: 2700654 - RNA, 17 nt, Haemophilus influenzae Rd
aauuuacucacaacaaa

SEQ ID NO: 2700655 - RNA, 20 nt, Haemophilus influenzae Rd
aauuuagaaaaagaaaaccu

SEQ ID NO: 2700656 - RNA, 15 nt, Haemophilus influenzae Rd
aauuuagauaacaau

SEQ ID NO: 2700657 - RNA, 15 nt, Haemophilus influenzae Rd
aauuuagcccgaaaa

SEQ ID NO: 2700658 - RNA, 20 nt, Haemophilus influenzae Rd
aauuuagcguauuuuguucu

SEQ ID NO: 2700659 - RNA, 13 nt, Haemophilus influenzae Rd
aauuuagcuaaac

SEQ ID NO: 2700660 - RNA, 21 nt, Haemophilus influenzae Rd
aauuuaggauuuggcacuaaa

SEQ ID NO: 2700661 - RNA, 17 nt, Haemophilus influenzae Rd
aauuuagucauacagaa

SEQ ID NO: 2700662 - RNA, 21 nt, Haemophilus influenzae Rd
aauuuagucauacagaaacca

SEQ ID NO: 2700663 - RNA, 14 nt, Haemophilus influenzae Rd
aauuuaguccuucu

SEQ ID NO: 2700664 - RNA, 15 nt, Haemophilus influenzae Rd
aauuuaguccuuuag

SEQ ID NO: 2700665 - RNA, 13 nt, Haemophilus influenzae Rd
aauuuauacaaaa

SEQ ID NO: 2700666 - RNA, 18 nt, Haemophilus influenzae Rd
aauuuauacuaaauuagu

SEQ ID NO: 2700667 - RNA, 16 nt, Haemophilus influenzae Rd
aauuuauauaugauaa

SEQ ID NO: 2700668 - RNA, 20 nt, Haemophilus influenzae Rd
aauuuauauaugauaaaaau

SEQ ID NO: 2700669 - RNA, 21 nt, Haemophilus influenzae Rd
aauuuauauaugauaaaaaua

SEQ ID NO: 2700670 - RNA, 22 nt, Haemophilus influenzae Rd
aauuuauauaugauaaaaauaa

SEQ ID NO: 2700671 - RNA, 14 nt, Haemophilus influenzae Rd
aauuuaucaucaau

SEQ ID NO: 2700672 - RNA, 19 nt, Haemophilus influenzae Rd
aauuuaucauuaaaacaaa

SEQ ID NO: 2700673 - RNA, 15 nt, Haemophilus influenzae Rd
aauuuauccaauacu

SEQ ID NO: 2700674 - RNA, 18 nt, Haemophilus influenzae Rd
aauuuaucgcacuguuuc

SEQ ID NO: 2700675 - RNA, 18 nt, Haemophilus influenzae Rd
aauuuaucugcuuuaauu

SEQ ID NO: 2700676 - RNA, 15 nt, Haemophilus influenzae Rd
aauuuaugcuguuuu

SEQ ID NO: 2700677 - RNA, 19 nt, Haemophilus influenzae Rd
aauuuaugcuguuuuauag

SEQ ID NO: 2700678 - RNA, 18 nt, Haemophilus influenzae Rd
aauuuauuacaaacaaaa

SEQ ID NO: 2700679 - RNA, 13 nt, Haemophilus influenzae Rd
aauuuauuauaaa

SEQ ID NO: 2700680 - RNA, 19 nt, Haemophilus influenzae Rd
aauuuauuauaaaaauauu

SEQ ID NO: 2700681 - RNA, 13 nt, Haemophilus influenzae Rd
aauuuauuauaua

SEQ ID NO: 2700682 - RNA, 14 nt, Haemophilus influenzae Rd
aauuuauuauuaca

SEQ ID NO: 2700683 - RNA, 13 nt, Haemophilus influenzae Rd
aauuuauucaaaa

SEQ ID NO: 2700684 - RNA, 22 nt, Haemophilus influenzae Rd
aauuuauucgggcuuaaaaaag

SEQ ID NO: 2700685 - RNA, 12 nt, Haemophilus influenzae Rd
aauuucaaaauc

SEQ ID NO: 2700686 - RNA, 15 nt, Haemophilus influenzae Rd
aauuucaaaaucaca

SEQ ID NO: 2700687 - RNA, 20 nt, Haemophilus influenzae Rd
aauuucaaagaggccucuac

SEQ ID NO: 2700688 - RNA, 16 nt, Haemophilus influenzae Rd
aauuucaauuaaauca

SEQ ID NO: 2700689 - RNA, 18 nt, Haemophilus influenzae Rd
aauuucaauuaaaucaaa

SEQ ID NO: 2700690 - RNA, 18 nt, Haemophilus influenzae Rd
aauuucacauuaugauau

SEQ ID NO: 2700691 - RNA, 22 nt, Haemophilus influenzae Rd
aauuucaccgcauucuucuuuu

SEQ ID NO: 2700692 - RNA, 23 nt, Haemophilus influenzae Rd
aauuucaccgcauucuucuuuua

SEQ ID NO: 2700693 - RNA, 22 nt, Haemophilus influenzae Rd
aauuucacguaguuaaaccaaa

SEQ ID NO: 2700694 - RNA, 15 nt, Haemophilus influenzae Rd
aauuucacugaaagu

SEQ ID NO: 2700695 - RNA, 16 nt, Haemophilus influenzae Rd
aauuucagaauuagua

SEQ ID NO: 2700696 - RNA, 22 nt, Haemophilus influenzae Rd
aauuucagaauuaguaaagaaa

SEQ ID NO: 2700697 - RNA, 16 nt, Haemophilus influenzae Rd
aauuucagcacccaca

SEQ ID NO: 2700698 - RNA, 23 nt, Haemophilus influenzae Rd
aauuucagcaucagaaauaccga

SEQ ID NO: 2700699 - RNA, 15 nt, Haemophilus influenzae Rd
aauuucagcuuaaau

SEQ ID NO: 2700700 - RNA, 19 nt, Haemophilus influenzae Rd
aauuucagcuuaaauacua

SEQ ID NO: 2700701 - RNA, 14 nt, Haemophilus influenzae Rd
aauuucauaaaaau

SEQ ID NO: 2700702 - RNA, 23 nt, Haemophilus influenzae Rd
aauuucauaguuuucugauuuaa

SEQ ID NO: 2700703 - RNA, 19 nt, Haemophilus influenzae Rd
aauuucaucgcgcaaaaua

SEQ ID NO: 2700704 - RNA, 18 nt, Haemophilus influenzae Rd
aauuucaucuaagguuuu

SEQ ID NO: 2700705 - RNA, 13 nt, Haemophilus influenzae Rd
aauuucaucuguu

SEQ ID NO: 2700706 - RNA, 14 nt, Haemophilus influenzae Rd
aauuucauuuuaac

SEQ ID NO: 2700707 - RNA, 20 nt, Haemophilus influenzae Rd
aauuuccauaugaccauuaa

SEQ ID NO: 2700708 - RNA, 18 nt, Haemophilus influenzae Rd
aauuuccgcuuccugcug

SEQ ID NO: 2700709 - RNA, 21 nt, Haemophilus influenzae Rd
aauuuccgugagcaaccacua

SEQ ID NO: 2700710 - RNA, 14 nt, Haemophilus influenzae Rd
aauuuccuauacua

SEQ ID NO: 2700711 - RNA, 21 nt, Haemophilus influenzae Rd
aauuuccugagaauuuucaac

SEQ ID NO: 2700712 - RNA, 20 nt, Haemophilus influenzae Rd
aauuuccuguauaauuuuuc

SEQ ID NO: 2700713 - RNA, 17 nt, Haemophilus influenzae Rd
aauuucgacauauucua

SEQ ID NO: 2700714 - RNA, 19 nt, Haemophilus influenzae Rd
aauuucgccauuuuuuccu

SEQ ID NO: 2700715 - RNA, 22 nt, Haemophilus influenzae Rd
aauuucgccauuuuuuccuaug

SEQ ID NO: 2700716 - RNA, 15 nt, Haemophilus influenzae Rd
aauuucgucaaaaau

SEQ ID NO: 2700717 - RNA, 13 nt, Haemophilus influenzae Rd
aauuucucagcuu

SEQ ID NO: 2700718 - RNA, 19 nt, Haemophilus influenzae Rd
aauuucucugcgcacuuuu

SEQ ID NO: 2700719 - RNA, 20 nt, Haemophilus influenzae Rd
aauuucugaacacaagccca

SEQ ID NO: 2700720 - RNA, 15 nt, Haemophilus influenzae Rd
aauuucuucaacuaa

SEQ ID NO: 2700721 - RNA, 19 nt, Haemophilus influenzae Rd
aauuucuucaacuaacugg

SEQ ID NO: 2700722 - RNA, 19 nt, Haemophilus influenzae Rd
aauuucuuguuuaaauuca

SEQ ID NO: 2700723 - RNA, 23 nt, Haemophilus influenzae Rd
aauuucuuguuuaaauucaggcu

SEQ ID NO: 2700724 - RNA, 23 nt, Haemophilus influenzae Rd
aauuucuuuaauugauuaaaaaa

SEQ ID NO: 2700725 - RNA, 11 nt, Haemophilus influenzae Rd
aauuucuuuuu

SEQ ID NO: 2700726 - RNA, 15 nt, Haemophilus influenzae Rd
aauuugaaaagaauu

SEQ ID NO: 2700727 - RNA, 15 nt, Haemophilus influenzae Rd
aauuugaaaauuuau

SEQ ID NO: 2700728 - RNA, 17 nt, Haemophilus influenzae Rd
aauuugaacaaacgcca

SEQ ID NO: 2700729 - RNA, 14 nt, Haemophilus influenzae Rd
aauuugaauguaaa

SEQ ID NO: 2700730 - RNA, 22 nt, Haemophilus influenzae Rd
aauuugacauuccuauucuaaa

SEQ ID NO: 2700731 - RNA, 23 nt, Haemophilus influenzae Rd
aauuugacgauaauauuuuugcc

SEQ ID NO: 2700732 - RNA, 20 nt, Haemophilus influenzae Rd
aauuugagucucaaauuuuu

SEQ ID NO: 2700733 - RNA, 21 nt, Haemophilus influenzae Rd
aauuugagucucaaauuuuuc

SEQ ID NO: 2700734 - RNA, 22 nt, Haemophilus influenzae Rd
aauuugagucucaaauuuuuca

SEQ ID NO: 2700735 - RNA, 14 nt, Haemophilus influenzae Rd
aauuugaucuuaga

SEQ ID NO: 2700736 - RNA, 14 nt, Haemophilus influenzae Rd
aauuugcaucauuu

SEQ ID NO: 2700737 - RNA, 14 nt, Haemophilus influenzae Rd
aauuugccaucacu

SEQ ID NO: 2700738 - RNA, 17 nt, Haemophilus influenzae Rd
aauuugcucaaaguucg

SEQ ID NO: 2700739 - RNA, 22 nt, Haemophilus influenzae Rd
aauuugcuguggugaagugcgg

SEQ ID NO: 2700740 - RNA, 17 nt, Haemophilus influenzae Rd
aauuuggcucacaagac

SEQ ID NO: 2700741 - RNA, 19 nt, Haemophilus influenzae Rd
aauuuggucuguuucuucu

SEQ ID NO: 2700742 - RNA, 20 nt, Haemophilus influenzae Rd
aauuuggucuguuucuucua

SEQ ID NO: 2700743 - RNA, 19 nt, Haemophilus influenzae Rd
aauuugguuccccuuucug

SEQ ID NO: 2700744 - RNA, 16 nt, Haemophilus influenzae Rd
aauuugguuuugcucu

SEQ ID NO: 2700745 - RNA, 14 nt, Haemophilus influenzae Rd
aauuuguaagauuu

SEQ ID NO: 2700746 - RNA, 16 nt, Haemophilus influenzae Rd
aauuuguacaucccau

SEQ ID NO: 2700747 - RNA, 14 nt, Haemophilus influenzae Rd
aauuuguccuuuau

SEQ ID NO: 2700748 - RNA, 22 nt, Haemophilus influenzae Rd
aauuuguccuuuaucaagcaca

SEQ ID NO: 2700749 - RNA, 13 nt, Haemophilus influenzae Rd
aauuugugcauaa

SEQ ID NO: 2700750 - RNA, 22 nt, Haemophilus influenzae Rd
aauuugugcggauuaagauggc

SEQ ID NO: 2700751 - RNA, 16 nt, Haemophilus influenzae Rd
aauuuguggugcauaa

SEQ ID NO: 2700752 - RNA, 18 nt, Haemophilus influenzae Rd
aauuugugugguggaaag

SEQ ID NO: 2700753 - RNA, 19 nt, Haemophilus influenzae Rd
aauuuguuagaucaaauuu

SEQ ID NO: 2700754 - RNA, 11 nt, Haemophilus influenzae Rd
aauuuguuguu

SEQ ID NO: 2700755 - RNA, 21 nt, Haemophilus influenzae Rd
  misc_feature (6)..(8): n is a, c, g or u
aauuunnngcaaaaaguacuu

SEQ ID NO: 2700756 - RNA, 14 nt, Haemophilus influenzae Rd
aauuuuaaaaccac

SEQ ID NO: 2700757 - RNA, 18 nt, Haemophilus influenzae Rd
aauuuuaaacagcaaaag

SEQ ID NO: 2700758 - RNA, 12 nt, Haemophilus influenzae Rd
aauuuuaaauaa

SEQ ID NO: 2700759 - RNA, 11 nt, Haemophilus influenzae Rd
aauuuuaaauu

SEQ ID NO: 2700760 - RNA, 21 nt, Haemophilus influenzae Rd
aauuuuaaauuuucugcguuu

SEQ ID NO: 2700761 - RNA, 19 nt, Haemophilus influenzae Rd
aauuuuaacgccugcugca

SEQ ID NO: 2700762 - RNA, 18 nt, Haemophilus influenzae Rd
aauuuuacagguguaguu

SEQ ID NO: 2700763 - RNA, 21 nt, Haemophilus influenzae Rd
aauuuuaccuaaaagcggcgc

SEQ ID NO: 2700764 - RNA, 16 nt, Haemophilus influenzae Rd
aauuuuacguuucauu

SEQ ID NO: 2700765 - RNA, 18 nt, Haemophilus influenzae Rd
aauuuuacguuucauuuu

SEQ ID NO: 2700766 - RNA, 13 nt, Haemophilus influenzae Rd
aauuuuacuucuu

SEQ ID NO: 2700767 - RNA, 18 nt, Haemophilus influenzae Rd
aauuuuaggugcuuuuaa

SEQ ID NO: 2700768 - RNA, 21 nt, Haemophilus influenzae Rd
aauuuuaguaauagacuuaau

SEQ ID NO: 2700769 - RNA, 21 nt, Haemophilus influenzae Rd
aauuuuaguuuguuucucaag

SEQ ID NO: 2700770 - RNA, 17 nt, Haemophilus influenzae Rd
aauuuuauauucauuga

SEQ ID NO: 2700771 - RNA, 18 nt, Haemophilus influenzae Rd
aauuuuaucuaugaaaaa

SEQ ID NO: 2700772 - RNA, 14 nt, Haemophilus influenzae Rd
aauuuuauuauguu

SEQ ID NO: 2700773 - RNA, 15 nt, Haemophilus influenzae Rd
aauuuuauuauguuu

SEQ ID NO: 2700774 - RNA, 23 nt, Haemophilus influenzae Rd
aauuuuauuauguuuuguagauu

SEQ ID NO: 2700775 - RNA, 17 nt, Haemophilus influenzae Rd
aauuuuauuccaccaca

SEQ ID NO: 2700776 - RNA, 18 nt, Haemophilus influenzae Rd
aauuuuauuccaccacag

SEQ ID NO: 2700777 - RNA, 20 nt, Haemophilus influenzae Rd
aauuuucaaacacaacauaa

SEQ ID NO: 2700778 - RNA, 23 nt, Haemophilus influenzae Rd
aauuuucaaagcguuuuaaaauc

SEQ ID NO: 2700779 - RNA, 13 nt, Haemophilus influenzae Rd
aauuuucaauagc

SEQ ID NO: 2700780 - RNA, 17 nt, Haemophilus influenzae Rd
aauuuucacauaauaaa

SEQ ID NO: 2700781 - RNA, 13 nt, Haemophilus influenzae Rd
aauuuucaucaau

SEQ ID NO: 2700782 - RNA, 12 nt, Haemophilus influenzae Rd
aauuuucccauu

SEQ ID NO: 2700783 - RNA, 15 nt, Haemophilus influenzae Rd
aauuuucccauuuaa

SEQ ID NO: 2700784 - RNA, 19 nt, Haemophilus influenzae Rd
aauuuuccuguuugagcaa

SEQ ID NO: 2700785 - RNA, 22 nt, Haemophilus influenzae Rd
aauuuuccuucuauaucagaaa

SEQ ID NO: 2700786 - RNA, 23 nt, Haemophilus influenzae Rd
aauuuuccuucuauaucagaaaa

SEQ ID NO: 2700787 - RNA, 16 nt, Haemophilus influenzae Rd
aauuuucggcaagaaa

SEQ ID NO: 2700788 - RNA, 18 nt, Haemophilus influenzae Rd
aauuuucggcaagaaauu

SEQ ID NO: 2700789 - RNA, 20 nt, Haemophilus influenzae Rd
aauuuucggcaagaaauuca

SEQ ID NO: 2700790 - RNA, 21 nt, Haemophilus influenzae Rd
aauuuucggcaagaaauucac

SEQ ID NO: 2700791 - RNA, 22 nt, Haemophilus influenzae Rd
aauuuucuguugggauagauuu

SEQ ID NO: 2700792 - RNA, 21 nt, Haemophilus influenzae Rd
aauuuucuuuucaaacaacaa

SEQ ID NO: 2700793 - RNA, 22 nt, Haemophilus influenzae Rd
aauuuucuuuucaaacaacaag

SEQ ID NO: 2700794 - RNA, 15 nt, Haemophilus influenzae Rd
aauuuugaugugauu

SEQ ID NO: 2700795 - RNA, 17 nt, Haemophilus influenzae Rd
aauuuugcaagccaaua

SEQ ID NO: 2700796 - RNA, 17 nt, Haemophilus influenzae Rd
aauuuugccaucaauaa

SEQ ID NO: 2700797 - RNA, 19 nt, Haemophilus influenzae Rd
aauuuuguaagcauuaaaa

SEQ ID NO: 2700798 - RNA, 23 nt, Haemophilus influenzae Rd
aauuuuguaagcauuaaaaauuu

SEQ ID NO: 2700799 - RNA, 18 nt, Haemophilus influenzae Rd
aauuuuguccgaaaaaac

SEQ ID NO: 2700800 - RNA, 19 nt, Haemophilus influenzae Rd
aauuuuguccgaaaaaacu

SEQ ID NO: 2700801 - RNA, 22 nt, Haemophilus influenzae Rd
aauuuuguuagcggauaaaaua

SEQ ID NO: 2700802 - RNA, 16 nt, Haemophilus influenzae Rd
aauuuuuaaaguuauu

SEQ ID NO: 2700803 - RNA, 21 nt, Haemophilus influenzae Rd
aauuuuuaacgcgcuacaaua

SEQ ID NO: 2700804 - RNA, 16 nt, Haemophilus influenzae Rd
aauuuuuaauuuucuc

SEQ ID NO: 2700805 - RNA, 18 nt, Haemophilus influenzae Rd
aauuuuuaccgcacuuuu

SEQ ID NO: 2700806 - RNA, 14 nt, Haemophilus influenzae Rd
aauuuuuagaagag

SEQ ID NO: 2700807 - RNA, 17 nt, Haemophilus influenzae Rd
aauuuuuagaagagauu

SEQ ID NO: 2700808 - RNA, 18 nt, Haemophilus influenzae Rd
aauuuuuauaauuuugau

SEQ ID NO: 2700809 - RNA, 21 nt, Haemophilus influenzae Rd
aauuuuuaucuuuaaagaaua

SEQ ID NO: 2700810 - RNA, 13 nt, Haemophilus influenzae Rd
aauuuuucauucu

SEQ ID NO: 2700811 - RNA, 15 nt, Haemophilus influenzae Rd
aauuuuucauucugu

SEQ ID NO: 2700812 - RNA, 21 nt, Haemophilus influenzae Rd
aauuuuuccgaauauccacuu

SEQ ID NO: 2700813 - RNA, 21 nt, Haemophilus influenzae Rd
aauuuuucgcaagauagcaaa

SEQ ID NO: 2700814 - RNA, 22 nt, Haemophilus influenzae Rd
aauuuuucgcaagauagcaaaa

SEQ ID NO: 2700815 - RNA, 19 nt, Haemophilus influenzae Rd
aauuuuucuacuuuugugc

SEQ ID NO: 2700816 - RNA, 11 nt, Haemophilus influenzae Rd
aauuuuucuca

SEQ ID NO: 2700817 - RNA, 17 nt, Haemophilus influenzae Rd
aauuuuucuuuucuucu

SEQ ID NO: 2700818 - RNA, 17 nt, Haemophilus influenzae Rd
aauuuuugcaaaaagua

SEQ ID NO: 2700819 - RNA, 20 nt, Haemophilus influenzae Rd
aauuuuugcaaaaaguacuu

SEQ ID NO: 2700820 - RNA, 13 nt, Haemophilus influenzae Rd
aauuuuugugauu

SEQ ID NO: 2700821 - RNA, 20 nt, Haemophilus influenzae Rd
aauuuuuuaauuaguuugau

SEQ ID NO: 2700822 - RNA, 16 nt, Haemophilus influenzae Rd
aauuuuuuacgauauu

SEQ ID NO: 2700823 - RNA, 21 nt, Haemophilus influenzae Rd
aauuuuuuacguaauguacca

SEQ ID NO: 2700824 - RNA, 17 nt, Haemophilus influenzae Rd
aauuuuuuauaaaauuu

SEQ ID NO: 2700825 - RNA, 16 nt, Haemophilus influenzae Rd
aauuuuuuauucaaaa

SEQ ID NO: 2700826 - RNA, 18 nt, Haemophilus influenzae Rd
aauuuuuuauucaaaauu

SEQ ID NO: 2700827 - RNA, 16 nt, Haemophilus influenzae Rd
aauuuuuucaaaaguu

SEQ ID NO: 2700828 - RNA, 22 nt, Haemophilus influenzae Rd
aauuuuuucagauaaucaaaaa

SEQ ID NO: 2700829 - RNA, 17 nt, Haemophilus influenzae Rd
aauuuuuucgguuuuuc

SEQ ID NO: 2700830 - RNA, 21 nt, Haemophilus influenzae Rd
aauuuuuucuccacaaaccaa

SEQ ID NO: 2700831 - RNA, 16 nt, Haemophilus influenzae Rd
aauuuuuucugaauaa

SEQ ID NO: 2700832 - RNA, 19 nt, Haemophilus influenzae Rd
aauuuuuucuguuuuucca

SEQ ID NO: 2700833 - RNA, 17 nt, Haemophilus influenzae Rd
aauuuuuuguucauuuu

SEQ ID NO: 2700834 - RNA, 20 nt, Haemophilus influenzae Rd
aauuuuuuguucauuuuaaa

SEQ ID NO: 2700835 - RNA, 23 nt, Haemophilus influenzae Rd
aauuuuuuguugauuagcuaaua

SEQ ID NO: 2700836 - RNA, 21 nt, Haemophilus influenzae Rd
aauuuuuuuaguuuuguauaa

SEQ ID NO: 2700837 - RNA, 16 nt, Haemophilus influenzae Rd
aauuuuuuucaagcaa

SEQ ID NO: 2700838 - RNA, 14 nt, Haemophilus influenzae Rd
aauuuuuuuucuaa

SEQ ID NO: 2700839 - RNA, 18 nt, Haemophilus influenzae Rd
acaaaaaacggacuauca

SEQ ID NO: 2700840 - RNA, 17 nt, Haemophilus influenzae Rd
acaaaaaaguacuugca

SEQ ID NO: 2700841 - RNA, 18 nt, Haemophilus influenzae Rd
acaaaaaggcuaaguucu

SEQ ID NO: 2700842 - RNA, 18 nt, Haemophilus influenzae Rd
acaaaaauacguuguuuu

SEQ ID NO: 2700843 - RNA, 14 nt, Haemophilus influenzae Rd
acaaaaaugcaccc

SEQ ID NO: 2700844 - RNA, 19 nt, Haemophilus influenzae Rd
acaaaacagacugaaauuc

SEQ ID NO: 2700845 - RNA, 13 nt, Haemophilus influenzae Rd
acaaaacauaaua

SEQ ID NO: 2700846 - RNA, 15 nt, Haemophilus influenzae Rd
acaaaaccaaucaua

SEQ ID NO: 2700847 - RNA, 17 nt, Haemophilus influenzae Rd
acaaaacuaaaaaaauu

SEQ ID NO: 2700848 - RNA, 13 nt, Haemophilus influenzae Rd
acaaaacuuauca

SEQ ID NO: 2700849 - RNA, 16 nt, Haemophilus influenzae Rd
acaaaagaaauuuuaa

SEQ ID NO: 2700850 - RNA, 17 nt, Haemophilus influenzae Rd
acaaaaggcaagcuagg

SEQ ID NO: 2700851 - RNA, 22 nt, Haemophilus influenzae Rd
acaaaaggcuuuuuacguucau

SEQ ID NO: 2700852 - RNA, 19 nt, Haemophilus influenzae Rd
acaaaagugcgguuuauuu

SEQ ID NO: 2700853 - RNA, 21 nt, Haemophilus influenzae Rd
acaaaagugcgguuuauuuuu

SEQ ID NO: 2700854 - RNA, 14 nt, Haemophilus influenzae Rd
acaaaauaaaugau

SEQ ID NO: 2700855 - RNA, 12 nt, Haemophilus influenzae Rd
acaaaauauuag

SEQ ID NO: 2700856 - RNA, 23 nt, Haemophilus influenzae Rd
acaaaauauuaguuagcuaaaaa

SEQ ID NO: 2700857 - RNA, 20 nt, Haemophilus influenzae Rd
acaaaaucgccgauugguuu

SEQ ID NO: 2700858 - RNA, 18 nt, Haemophilus influenzae Rd
acaaaaucgcuuuuuguu

SEQ ID NO: 2700859 - RNA, 18 nt, Haemophilus influenzae Rd
acaaaaucugauacgaau

SEQ ID NO: 2700860 - RNA, 23 nt, Haemophilus influenzae Rd
acaaaaucugauacgaauguuug

SEQ ID NO: 2700861 - RNA, 22 nt, Haemophilus influenzae Rd
acaaaaucugcuccgcuacuuu

SEQ ID NO: 2700862 - RNA, 21 nt, Haemophilus influenzae Rd
acaaaauggcaaacaaaauaa

SEQ ID NO: 2700863 - RNA, 24 nt, Haemophilus influenzae Rd
acaaaauggcuguuguuuuggcug

SEQ ID NO: 2700864 - RNA, 18 nt, Haemophilus influenzae Rd
acaaaaugucgcuuucuu

SEQ ID NO: 2700865 - RNA, 16 nt, Haemophilus influenzae Rd
acaaaauuaaugccaa

SEQ ID NO: 2700866 - RNA, 23 nt, Haemophilus influenzae Rd
acaaaauuaaugccaaugcaauu

SEQ ID NO: 2700867 - RNA, 16 nt, Haemophilus influenzae Rd
acaaaauuggcguaac

SEQ ID NO: 2700868 - RNA, 23 nt, Haemophilus influenzae Rd
acaaaauuuuaaauaaaauauuu

SEQ ID NO: 2700869 - RNA, 11 nt, Haemophilus influenzae Rd
acaaaauuuug

SEQ ID NO: 2700870 - RNA, 14 nt, Haemophilus influenzae Rd
acaaacaaauuuuu

SEQ ID NO: 2700871 - RNA, 21 nt, Haemophilus influenzae Rd
acaaacaacguaaaaguaaau

SEQ ID NO: 2700872 - RNA, 21 nt, Haemophilus influenzae Rd
acaaacaaucuuaacugcaag

SEQ ID NO: 2700873 - RNA, 14 nt, Haemophilus influenzae Rd
acaaacauaccuaa

SEQ ID NO: 2700874 - RNA, 15 nt, Haemophilus influenzae Rd
acaaacuaauuucau

SEQ ID NO: 2700875 - RNA, 22 nt, Haemophilus influenzae Rd
acaaacuccguccaaucuaauu

SEQ ID NO: 2700876 - RNA, 20 nt, Haemophilus influenzae Rd
acaaacugguuaaaauccaa

SEQ ID NO: 2700877 - RNA, 13 nt, Haemophilus influenzae Rd
acaaagaaaaacu

SEQ ID NO: 2700878 - RNA, 20 nt, Haemophilus influenzae Rd
acaaagaaucuuaaauucau

SEQ ID NO: 2700879 - RNA, 11 nt, Haemophilus influenzae Rd
acaaagcaaau

SEQ ID NO: 2700880 - RNA, 22 nt, Haemophilus influenzae Rd
acaaagggcugauauuuaaaau

SEQ ID NO: 2700881 - RNA, 13 nt, Haemophilus influenzae Rd
acaaaggguaaau

SEQ ID NO: 2700882 - RNA, 14 nt, Haemophilus influenzae Rd
acaaagucaauaca

SEQ ID NO: 2700883 - RNA, 13 nt, Haemophilus influenzae Rd
acaaagucaauuu

SEQ ID NO: 2700884 - RNA, 21 nt, Haemophilus influenzae Rd
acaaagucgcuucauccaaua

SEQ ID NO: 2700885 - RNA, 23 nt, Haemophilus influenzae Rd
acaaagucgguuuuuaauucagu

SEQ ID NO: 2700886 - RNA, 17 nt, Haemophilus influenzae Rd
acaaagucuucaucuuu

SEQ ID NO: 2700887 - RNA, 17 nt, Haemophilus influenzae Rd
acaaaguugauaaucau

SEQ ID NO: 2700888 - RNA, 14 nt, Haemophilus influenzae Rd
acaaauaaaaagug

SEQ ID NO: 2700889 - RNA, 17 nt, Haemophilus influenzae Rd
acaaauaaacaaacuuu

SEQ ID NO: 2700890 - RNA, 13 nt, Haemophilus influenzae Rd
acaaauaaaucau

SEQ ID NO: 2700891 - RNA, 20 nt, Haemophilus influenzae Rd
acaaauaaccuaucccaaaa

SEQ ID NO: 2700892 - RNA, 13 nt, Haemophilus influenzae Rd
acaaauaagccaa

SEQ ID NO: 2700893 - RNA, 14 nt, Haemophilus influenzae Rd
acaaauaauuauua

SEQ ID NO: 2700894 - RNA, 17 nt, Haemophilus influenzae Rd
acaaauaggauaaaaau

SEQ ID NO: 2700895 - RNA, 14 nt, Haemophilus influenzae Rd
acaaauauauuucu

SEQ ID NO: 2700896 - RNA, 15 nt, Haemophilus influenzae Rd
acaaauauauuucua

SEQ ID NO: 2700897 - RNA, 19 nt, Haemophilus influenzae Rd
acaaauauauuucuaauaa

SEQ ID NO: 2700898 - RNA, 22 nt, Haemophilus influenzae Rd
acaaauccauaaggaaauugca

SEQ ID NO: 2700899 - RNA, 17 nt, Haemophilus influenzae Rd
acaaaucguaauuaaaa

SEQ ID NO: 2700900 - RNA, 18 nt, Haemophilus influenzae Rd
acaaaucguaauuaaaau

SEQ ID NO: 2700901 - RNA, 23 nt, Haemophilus influenzae Rd
acaaaucguaauuaaaaucacau

SEQ ID NO: 2700902 - RNA, 20 nt, Haemophilus influenzae Rd
acaaaucugccugauuuuuu

SEQ ID NO: 2700903 - RNA, 15 nt, Haemophilus influenzae Rd
acaaaugaucauuuu

SEQ ID NO: 2700904 - RNA, 17 nt, Haemophilus influenzae Rd
acaaauuaauaagaaaa

SEQ ID NO: 2700905 - RNA, 18 nt, Haemophilus influenzae Rd
acaaauuaauaagaaaau

SEQ ID NO: 2700906 - RNA, 21 nt, Haemophilus influenzae Rd
acaaauuaauaagaaaaucaa

SEQ ID NO: 2700907 - RNA, 19 nt, Haemophilus influenzae Rd
acaaauuagcgauuaaagu

SEQ ID NO: 2700908 - RNA, 12 nt, Haemophilus influenzae Rd
acaaauucagcu

SEQ ID NO: 2700909 - RNA, 15 nt, Haemophilus influenzae Rd
acaaauuuaaaugau

SEQ ID NO: 2700910 - RNA, 14 nt, Haemophilus influenzae Rd
acaaauuuaauauu

SEQ ID NO: 2700911 - RNA, 17 nt, Haemophilus influenzae Rd
acaaauuuaauauuucu

SEQ ID NO: 2700912 - RNA, 17 nt, Haemophilus influenzae Rd
acaaauuuagauaacaa

SEQ ID NO: 2700913 - RNA, 22 nt, Haemophilus influenzae Rd
acaaauuuagauaacaaugaaa

SEQ ID NO: 2700914 - RNA, 16 nt, Haemophilus influenzae Rd
acaaauuuccauauga

SEQ ID NO: 2700915 - RNA, 20 nt, Haemophilus influenzae Rd
acaaauuuguugaucugcaa

SEQ ID NO: 2700916 - RNA, 19 nt, Haemophilus influenzae Rd
acaaauuuguugcauuucu

SEQ ID NO: 2700917 - RNA, 22 nt, Haemophilus influenzae Rd
acaaauuuguugcauuucuaaa

SEQ ID NO: 2700918 - RNA, 18 nt, Haemophilus influenzae Rd
acaaauuuuauauaucca

SEQ ID NO: 2700919 - RNA, 20 nt, Haemophilus influenzae Rd
acaaauuuuauauauccaaa

SEQ ID NO: 2700920 - RNA, 23 nt, Haemophilus influenzae Rd
acaacaaaagugcgguaaauuuu

SEQ ID NO: 2700921 - RNA, 14 nt, Haemophilus influenzae Rd
acaacaaaccagcc

SEQ ID NO: 2700922 - RNA, 15 nt, Haemophilus influenzae Rd
acaacaaaccagccu

SEQ ID NO: 2700923 - RNA, 16 nt, Haemophilus influenzae Rd
acaacaaagucuucau

SEQ ID NO: 2700924 - RNA, 19 nt, Haemophilus influenzae Rd
acaacaaauugugucacau

SEQ ID NO: 2700925 - RNA, 14 nt, Haemophilus influenzae Rd
acaacaacgcccuc

SEQ ID NO: 2700926 - RNA, 18 nt, Haemophilus influenzae Rd
acaacacuugcuguuuuu

SEQ ID NO: 2700927 - RNA, 16 nt, Haemophilus influenzae Rd
acaacagcgaaauauu

SEQ ID NO: 2700928 - RNA, 18 nt, Haemophilus influenzae Rd
acaacagcuaccaauuca

SEQ ID NO: 2700929 - RNA, 21 nt, Haemophilus influenzae Rd
acaacagugaauugacgaaau

SEQ ID NO: 2700930 - RNA, 14 nt, Haemophilus influenzae Rd
acaacauaauuaaa

SEQ ID NO: 2700931 - RNA, 23 nt, Haemophilus influenzae Rd
acaacauagcugaaaaauaaaaa

SEQ ID NO: 2700932 - RNA, 18 nt, Haemophilus influenzae Rd
acaacaucagauggaaua

SEQ ID NO: 2700933 - RNA, 18 nt, Haemophilus influenzae Rd
acaacaucuuguuuuaau

SEQ ID NO: 2700934 - RNA, 17 nt, Haemophilus influenzae Rd
acaacauuuugacuuuc

SEQ ID NO: 2700935 - RNA, 15 nt, Haemophilus influenzae Rd
acaaccaccaauuaa

SEQ ID NO: 2700936 - RNA, 17 nt, Haemophilus influenzae Rd
acaaccaccaauuaauu

SEQ ID NO: 2700937 - RNA, 21 nt, Haemophilus influenzae Rd
acaaccagcgcaccacacaau

SEQ ID NO: 2700938 - RNA, 22 nt, Haemophilus influenzae Rd
acaaccagcgcaccacacaaua

SEQ ID NO: 2700939 - RNA, 23 nt, Haemophilus influenzae Rd
acaaccauauuaaucgcaauaac

SEQ ID NO: 2700940 - RNA, 21 nt, Haemophilus influenzae Rd
acaacgagcgagaccacuuua

SEQ ID NO: 2700941 - RNA, 22 nt, Haemophilus influenzae Rd
acaacgcccucgccuugcaaau

SEQ ID NO: 2700942 - RNA, 16 nt, Haemophilus influenzae Rd
acaacgguugaaauug

SEQ ID NO: 2700943 - RNA, 17 nt, Haemophilus influenzae Rd
acaacguaaaaguaaau

SEQ ID NO: 2700944 - RNA, 23 nt, Haemophilus influenzae Rd
acaacguacguugguaaagccaa

SEQ ID NO: 2700945 - RNA, 13 nt, Haemophilus influenzae Rd
acaacgugaagua

SEQ ID NO: 2700946 - RNA, 14 nt, Haemophilus influenzae Rd
acaacucacaauaa

SEQ ID NO: 2700947 - RNA, 15 nt, Haemophilus influenzae Rd
acaacucacaauaau

SEQ ID NO: 2700948 - RNA, 21 nt, Haemophilus influenzae Rd
acaacugagcccacaacuaca

SEQ ID NO: 2700949 - RNA, 19 nt, Haemophilus influenzae Rd
acaacuggaauuuguaaga

SEQ ID NO: 2700950 - RNA, 15 nt, Haemophilus influenzae Rd
acaacuucaucaaug

SEQ ID NO: 2700951 - RNA, 18 nt, Haemophilus influenzae Rd
acaacuucggaagaaaaa

SEQ ID NO: 2700952 - RNA, 16 nt, Haemophilus influenzae Rd
acaacuuuuuauuuuc

SEQ ID NO: 2700953 - RNA, 21 nt, Haemophilus influenzae Rd
acaacuuuuuauuuucugcag

SEQ ID NO: 2700954 - RNA, 15 nt, Haemophilus influenzae Rd
acaagaaauuuuguu

SEQ ID NO: 2700955 - RNA, 21 nt, Haemophilus influenzae Rd
acaagaaauuuuguuuuguuc

SEQ ID NO: 2700956 - RNA, 17 nt, Haemophilus influenzae Rd
acaagaccaauauaauc

SEQ ID NO: 2700957 - RNA, 22 nt, Haemophilus influenzae Rd
acaagacucucgccuuauuacc

SEQ ID NO: 2700958 - RNA, 14 nt, Haemophilus influenzae Rd
acaagcaacaauau

SEQ ID NO: 2700959 - RNA, 16 nt, Haemophilus influenzae Rd
acaagcacaagauuug

SEQ ID NO: 2700960 - RNA, 16 nt, Haemophilus influenzae Rd
acaagcaccacuucca

SEQ ID NO: 2700961 - RNA, 23 nt, Haemophilus influenzae Rd
acaagcccacauuuggaaauguu

SEQ ID NO: 2700962 - RNA, 17 nt, Haemophilus influenzae Rd
acaagcucuagaaaauc

SEQ ID NO: 2700963 - RNA, 20 nt, Haemophilus influenzae Rd
acaagcuuguccaugaaaaa

SEQ ID NO: 2700964 - RNA, 21 nt, Haemophilus influenzae Rd
acaaggagauuuccaucuaaa

SEQ ID NO: 2700965 - RNA, 19 nt, Haemophilus influenzae Rd
acaaggcaaauaaaauaga

SEQ ID NO: 2700966 - RNA, 22 nt, Haemophilus influenzae Rd
acaaggcucaucauuaugaaaa

SEQ ID NO: 2700967 - RNA, 15 nt, Haemophilus influenzae Rd
acaaguauuuuccuu

SEQ ID NO: 2700968 - RNA, 19 nt, Haemophilus influenzae Rd
acaagugguggaauaaaag

SEQ ID NO: 2700969 - RNA, 16 nt, Haemophilus influenzae Rd
acaaguuuaauacaau

SEQ ID NO: 2700970 - RNA, 16 nt, Haemophilus influenzae Rd
acaaguuugauccaca

SEQ ID NO: 2700971 - RNA, 17 nt, Haemophilus influenzae Rd
acaaguuuuaccuucag

SEQ ID NO: 2700972 - RNA, 21 nt, Haemophilus influenzae Rd
acaaguuuuaccuucaguuuu

SEQ ID NO: 2700973 - RNA, 12 nt, Haemophilus influenzae Rd
acaauaaaacuu

SEQ ID NO: 2700974 - RNA, 16 nt, Haemophilus influenzae Rd
acaauaaaacuuuauu

SEQ ID NO: 2700975 - RNA, 13 nt, Haemophilus influenzae Rd
acaauaaaucaac

SEQ ID NO: 2700976 - RNA, 21 nt, Haemophilus influenzae Rd
acaauaacugcgccaauauaa

SEQ ID NO: 2700977 - RNA, 13 nt, Haemophilus influenzae Rd
acaauaauaagca

SEQ ID NO: 2700978 - RNA, 21 nt, Haemophilus influenzae Rd
acaauaauaggcgaaucaaaa

SEQ ID NO: 2700979 - RNA, 21 nt, Haemophilus influenzae Rd
acaauaauucagcgagagaau

SEQ ID NO: 2700980 - RNA, 13 nt, Haemophilus influenzae Rd
acaauaauuugcc

SEQ ID NO: 2700981 - RNA, 19 nt, Haemophilus influenzae Rd
acaauaauuugccaaaucc

SEQ ID NO: 2700982 - RNA, 14 nt, Haemophilus influenzae Rd
acaauaauuuucaa

SEQ ID NO: 2700983 - RNA, 14 nt, Haemophilus influenzae Rd
acaauacaaccgaa

SEQ ID NO: 2700984 - RNA, 21 nt, Haemophilus influenzae Rd
acaauacgauucguuucagua

SEQ ID NO: 2700985 - RNA, 16 nt, Haemophilus influenzae Rd
acaauacguugaguau

SEQ ID NO: 2700986 - RNA, 16 nt, Haemophilus influenzae Rd
acaauacucuuaacaa

SEQ ID NO: 2700987 - RNA, 15 nt, Haemophilus influenzae Rd
acaauacuuaucacu

SEQ ID NO: 2700988 - RNA, 19 nt, Haemophilus influenzae Rd
acaauacuuaucacugcgc

SEQ ID NO: 2700989 - RNA, 15 nt, Haemophilus influenzae Rd
acaauauaauuauca

SEQ ID NO: 2700990 - RNA, 19 nt, Haemophilus influenzae Rd
acaauaugugcuuggcaca

SEQ ID NO: 2700991 - RNA, 15 nt, Haemophilus influenzae Rd
acaauauugaaauaa

SEQ ID NO: 2700992 - RNA, 20 nt, Haemophilus influenzae Rd
acaauauugaaauaagauuu

SEQ ID NO: 2700993 - RNA, 12 nt, Haemophilus influenzae Rd
acaauauuuaau

SEQ ID NO: 2700994 - RNA, 22 nt, Haemophilus influenzae Rd
acaauauuugguugaacuucua

SEQ ID NO: 2700995 - RNA, 19 nt, Haemophilus influenzae Rd
acaaucacugaaaaaugga

SEQ ID NO: 2700996 - RNA, 21 nt, Haemophilus influenzae Rd
acaaucacuguaucuuuuugu

SEQ ID NO: 2700997 - RNA, 16 nt, Haemophilus influenzae Rd
acaaucauacacacca

SEQ ID NO: 2700998 - RNA, 20 nt, Haemophilus influenzae Rd
acaaucauacacaccaucaa

SEQ ID NO: 2700999 - RNA, 18 nt, Haemophilus influenzae Rd
acaaucauagaaaucccu

SEQ ID NO: 2701000 - RNA, 18 nt, Haemophilus influenzae Rd
acaauccuaacuuuucuu

SEQ ID NO: 2701001 - RNA, 19 nt, Haemophilus influenzae Rd
acaauccuaacuuuucuuc

SEQ ID NO: 2701002 - RNA, 18 nt, Haemophilus influenzae Rd
acaaucgcaucgucuuua

SEQ ID NO: 2701003 - RNA, 21 nt, Haemophilus influenzae Rd
acaaucgcuagcgcaaucaac

SEQ ID NO: 2701004 - RNA, 21 nt, Haemophilus influenzae Rd
acaaucgcuucauucucuucu

SEQ ID NO: 2701005 - RNA, 17 nt, Haemophilus influenzae Rd
acaaucgguuaaaagua

SEQ ID NO: 2701006 - RNA, 12 nt, Haemophilus influenzae Rd
acaaucuuguug

SEQ ID NO: 2701007 - RNA, 20 nt, Haemophilus influenzae Rd
acaaugagacuuaaccaaau

SEQ ID NO: 2701008 - RNA, 21 nt, Haemophilus influenzae Rd
acaaugagacuuaaccaaaua

SEQ ID NO: 2701009 - RNA, 12 nt, Haemophilus influenzae Rd
acaaugauuaau

SEQ ID NO: 2701010 - RNA, 18 nt, Haemophilus influenzae Rd
acaaugauuaauaucacu

SEQ ID NO: 2701011 - RNA, 22 nt, Haemophilus influenzae Rd
acaaugcccucaggaacaucac

SEQ ID NO: 2701012 - RNA, 18 nt, Haemophilus influenzae Rd
acaaugcggagaaaagca

SEQ ID NO: 2701013 - RNA, 17 nt, Haemophilus influenzae Rd
acaaugcuauaaaaccu

SEQ ID NO: 2701014 - RNA, 18 nt, Haemophilus influenzae Rd
acaaugcuauaaaaccuu

SEQ ID NO: 2701015 - RNA, 19 nt, Haemophilus influenzae Rd
acaaugcuaucaggcuuaa

SEQ ID NO: 2701016 - RNA, 19 nt, Haemophilus influenzae Rd
acaauguaguuucuucuuu

SEQ ID NO: 2701017 - RNA, 17 nt, Haemophilus influenzae Rd
acaaugucagaaaagau

SEQ ID NO: 2701018 - RNA, 18 nt, Haemophilus influenzae Rd
acaauguucguagaauga

SEQ ID NO: 2701019 - RNA, 17 nt, Haemophilus influenzae Rd
acaauuacuucuuacaa

SEQ ID NO: 2701020 - RNA, 18 nt, Haemophilus influenzae Rd
acaauuccccuuccuuga

SEQ ID NO: 2701021 - RNA, 14 nt, Haemophilus influenzae Rd
acaauucucaucag

SEQ ID NO: 2701022 - RNA, 15 nt, Haemophilus influenzae Rd
acaauugauguaaaa

SEQ ID NO: 2701023 - RNA, 17 nt, Haemophilus influenzae Rd
acaauugcagcccaaau

SEQ ID NO: 2701024 - RNA, 21 nt, Haemophilus influenzae Rd
acaauuucuaacaauguaguu

SEQ ID NO: 2701025 - RNA, 14 nt, Haemophilus influenzae Rd
acaauuuguccuuu

SEQ ID NO: 2701026 - RNA, 23 nt, Haemophilus influenzae Rd
acaauuuguccuuuaucaagcac

SEQ ID NO: 2701027 - RNA, 12 nt, Haemophilus influenzae Rd
acaauuuuccug

SEQ ID NO: 2701028 - RNA, 22 nt, Haemophilus influenzae Rd
acaauuuucuuuucaaacaaca

SEQ ID NO: 2701029 - RNA, 15 nt, Haemophilus influenzae Rd
acaauuuuuggauuu

SEQ ID NO: 2701030 - RNA, 17 nt, Haemophilus influenzae Rd
acaauuuuuuucaagca

SEQ ID NO: 2701031 - RNA, 21 nt, Haemophilus influenzae Rd
acaauuuuuuucaagcaacaa

SEQ ID NO: 2701032 - RNA, 17 nt, Haemophilus influenzae Rd
acacaacauagcugaaa

SEQ ID NO: 2701033 - RNA, 21 nt, Haemophilus influenzae Rd
acacaagaaaguuuaugacga

SEQ ID NO: 2701034 - RNA, 22 nt, Haemophilus influenzae Rd
acacaagggauuuaaaaucccu

SEQ ID NO: 2701035 - RNA, 15 nt, Haemophilus influenzae Rd
acacaauaauauagg

SEQ ID NO: 2701036 - RNA, 21 nt, Haemophilus influenzae Rd
acacaauaauauaggcgaaca

SEQ ID NO: 2701037 - RNA, 11 nt, Haemophilus influenzae Rd
acacacaccau

SEQ ID NO: 2701038 - RNA, 15 nt, Haemophilus influenzae Rd
acacaccuauuuuuu

SEQ ID NO: 2701039 - RNA, 16 nt, Haemophilus influenzae Rd
acacaccuauuuuuuc

SEQ ID NO: 2701040 - RNA, 15 nt, Haemophilus influenzae Rd
acacaccuuuuaagu

SEQ ID NO: 2701041 - RNA, 22 nt, Haemophilus influenzae Rd
acacaguuauacacaaguuaca

SEQ ID NO: 2701042 - RNA, 13 nt, Haemophilus influenzae Rd
acacaguuauuuu

SEQ ID NO: 2701043 - RNA, 15 nt, Haemophilus influenzae Rd
acacaguuauuuuuu

SEQ ID NO: 2701044 - RNA, 16 nt, Haemophilus influenzae Rd
acacaucagaaaauca

SEQ ID NO: 2701045 - RNA, 16 nt, Haemophilus influenzae Rd
acacaucgcuugcauu

SEQ ID NO: 2701046 - RNA, 15 nt, Haemophilus influenzae Rd
acacauggccaauuu

SEQ ID NO: 2701047 - RNA, 21 nt, Haemophilus influenzae Rd
acacauuucuucuaguuuucc

SEQ ID NO: 2701048 - RNA, 12 nt, Haemophilus influenzae Rd
acaccaaaaaug

SEQ ID NO: 2701049 - RNA, 14 nt, Haemophilus influenzae Rd
acaccaaaauaacc

SEQ ID NO: 2701050 - RNA, 18 nt, Haemophilus influenzae Rd
acaccaacggcauuuccg

SEQ ID NO: 2701051 - RNA, 15 nt, Haemophilus influenzae Rd
acaccaauaauuaaa

SEQ ID NO: 2701052 - RNA, 21 nt, Haemophilus influenzae Rd
acaccaauaauuaaacagcca

SEQ ID NO: 2701053 - RNA, 20 nt, Haemophilus influenzae Rd
acaccaauauugccgaccgu

SEQ ID NO: 2701054 - RNA, 20 nt, Haemophilus influenzae Rd
acaccaccugaugcuuuaac

SEQ ID NO: 2701055 - RNA, 17 nt, Haemophilus influenzae Rd
acaccagcuuuaaccau

SEQ ID NO: 2701056 - RNA, 17 nt, Haemophilus influenzae Rd
acaccagucaauaaacu

SEQ ID NO: 2701057 - RNA, 14 nt, Haemophilus influenzae Rd
acacccaaauuaaa

SEQ ID NO: 2701058 - RNA, 16 nt, Haemophilus influenzae Rd
acacccaaauuaaaaa

SEQ ID NO: 2701059 - RNA, 22 nt, Haemophilus influenzae Rd
acacccaugaaucgaacacugu

SEQ ID NO: 2701060 - RNA, 19 nt, Haemophilus influenzae Rd
acacccuuuucaaacaaca

SEQ ID NO: 2701061 - RNA, 14 nt, Haemophilus influenzae Rd
acaccgagaugcau

SEQ ID NO: 2701062 - RNA, 14 nt, Haemophilus influenzae Rd
acaccguccaaggu

SEQ ID NO: 2701063 - RNA, 22 nt, Haemophilus influenzae Rd
acaccgucuugccauaguacua

SEQ ID NO: 2701064 - RNA, 17 nt, Haemophilus influenzae Rd
acaccuauuuuuuccug

SEQ ID NO: 2701065 - RNA, 13 nt, Haemophilus influenzae Rd
acaccugaagcau

SEQ ID NO: 2701066 - RNA, 15 nt, Haemophilus influenzae Rd
acaccuuggcuuucu

SEQ ID NO: 2701067 - RNA, 14 nt, Haemophilus influenzae Rd
acaccuuuuuccuu

SEQ ID NO: 2701068 - RNA, 18 nt, Haemophilus influenzae Rd
acacgagcaauggcaauu

SEQ ID NO: 2701069 - RNA, 14 nt, Haemophilus influenzae Rd
acacgauaaacugu

SEQ ID NO: 2701070 - RNA, 12 nt, Haemophilus influenzae Rd
acacgcgcugcu

SEQ ID NO: 2701071 - RNA, 15 nt, Haemophilus influenzae Rd
acacgcucaacgccu

SEQ ID NO: 2701072 - RNA, 24 nt, Haemophilus influenzae Rd
acacgguaguaaauaacacaucag

SEQ ID NO: 2701073 - RNA, 20 nt, Haemophilus influenzae Rd
acacgguauaaucagguacu

SEQ ID NO: 2701074 - RNA, 22 nt, Haemophilus influenzae Rd
acacgugcuuuaaguugcucac

SEQ ID NO: 2701075 - RNA, 13 nt, Haemophilus influenzae Rd
acacguucauuac

SEQ ID NO: 2701076 - RNA, 22 nt, Haemophilus influenzae Rd
acacuaaccaagcguuaaucca

SEQ ID NO: 2701077 - RNA, 15 nt, Haemophilus influenzae Rd
acacuauuaauuacu

SEQ ID NO: 2701078 - RNA, 15 nt, Haemophilus influenzae Rd
acacucucagaauua

SEQ ID NO: 2701079 - RNA, 20 nt, Haemophilus influenzae Rd
acacugauuguggugagaug

SEQ ID NO: 2701080 - RNA, 17 nt, Haemophilus influenzae Rd
acacugcccuucucugc

SEQ ID NO: 2701081 - RNA, 17 nt, Haemophilus influenzae Rd
acacugcgcagauuaau

SEQ ID NO: 2701082 - RNA, 14 nt, Haemophilus influenzae Rd
acacuguaaauaaa

SEQ ID NO: 2701083 - RNA, 20 nt, Haemophilus influenzae Rd
acacuucaucacuaaauucu

SEQ ID NO: 2701084 - RNA, 21 nt, Haemophilus influenzae Rd
acacuugcaccaccaauuaag

SEQ ID NO: 2701085 - RNA, 16 nt, Haemophilus influenzae Rd
acacuugcuguuuuuc

SEQ ID NO: 2701086 - RNA, 18 nt, Haemophilus influenzae Rd
acacuugguucgcuucau

SEQ ID NO: 2701087 - RNA, 15 nt, Haemophilus influenzae Rd
acacuuuaaauuuuc

SEQ ID NO: 2701088 - RNA, 17 nt, Haemophilus influenzae Rd
acacuuuaaauuuuccu

SEQ ID NO: 2701089 - RNA, 18 nt, Haemophilus influenzae Rd
acacuuuaaauuuuccug

SEQ ID NO: 2701090 - RNA, 20 nt, Haemophilus influenzae Rd
acacuuuaauaguaaacuuu

SEQ ID NO: 2701091 - RNA, 13 nt, Haemophilus influenzae Rd
acacuuuuucuau

SEQ ID NO: 2701092 - RNA, 15 nt, Haemophilus influenzae Rd
acagaaacaaauccu

SEQ ID NO: 2701093 - RNA, 19 nt, Haemophilus influenzae Rd
acagaaacagaaauaacac

SEQ ID NO: 2701094 - RNA, 22 nt, Haemophilus influenzae Rd
acagaaagaaugucaucuaauu

SEQ ID NO: 2701095 - RNA, 20 nt, Haemophilus influenzae Rd
acagaacccgcuaaaguucu

SEQ ID NO: 2701096 - RNA, 16 nt, Haemophilus influenzae Rd
acagaaccuaaugcag

SEQ ID NO: 2701097 - RNA, 19 nt, Haemophilus influenzae Rd
acagaagacgauuuuagag

SEQ ID NO: 2701098 - RNA, 23 nt, Haemophilus influenzae Rd
acagaagacgauuuuagagguga

SEQ ID NO: 2701099 - RNA, 21 nt, Haemophilus influenzae Rd
acagaaguugaaaauaagcau

SEQ ID NO: 2701100 - RNA, 19 nt, Haemophilus influenzae Rd
acagaauaacuagcaaucu

SEQ ID NO: 2701101 - RNA, 17 nt, Haemophilus influenzae Rd
acagacaguagcauucc

SEQ ID NO: 2701102 - RNA, 15 nt, Haemophilus influenzae Rd
acagaccaaaauucu

SEQ ID NO: 2701103 - RNA, 17 nt, Haemophilus influenzae Rd
acagacgcugcccaaau

SEQ ID NO: 2701104 - RNA, 16 nt, Haemophilus influenzae Rd
acagacuaaauucagu

SEQ ID NO: 2701105 - RNA, 17 nt, Haemophilus influenzae Rd
acagacuaaauucagua

SEQ ID NO: 2701106 - RNA, 13 nt, Haemophilus influenzae Rd
acagacugaaauu

SEQ ID NO: 2701107 - RNA, 18 nt, Haemophilus influenzae Rd
acagagcgucaaaauuau

SEQ ID NO: 2701108 - RNA, 21 nt, Haemophilus influenzae Rd
acagagcgucaaaauuaugcu

SEQ ID NO: 2701109 - RNA, 21 nt, Haemophilus influenzae Rd
acagaggcauuauguaauaua

SEQ ID NO: 2701110 - RNA, 22 nt, Haemophilus influenzae Rd
acagaggcauuauguaauauaa

SEQ ID NO: 2701111 - RNA, 16 nt, Haemophilus influenzae Rd
acagaggggauaaaau

SEQ ID NO: 2701112 - RNA, 17 nt, Haemophilus influenzae Rd
acagaggggauaaaaua

SEQ ID NO: 2701113 - RNA, 22 nt, Haemophilus influenzae Rd
acagagugcgaucaccauaauc

SEQ ID NO: 2701114 - RNA, 14 nt, Haemophilus influenzae Rd
acagauacagaagg

SEQ ID NO: 2701115 - RNA, 15 nt, Haemophilus influenzae Rd
acagauacagaagga

SEQ ID NO: 2701116 - RNA, 15 nt, Haemophilus influenzae Rd
acagauuuaauacca

SEQ ID NO: 2701117 - RNA, 17 nt, Haemophilus influenzae Rd
acagauuuaauaccaua

SEQ ID NO: 2701118 - RNA, 14 nt, Haemophilus influenzae Rd
acagauuucaauua

SEQ ID NO: 2701119 - RNA, 21 nt, Haemophilus influenzae Rd
acagauuuuuacuucaucaaa

SEQ ID NO: 2701120 - RNA, 23 nt, Haemophilus influenzae Rd
acagauuuuuacuucaucaaaac

SEQ ID NO: 2701121 - RNA, 17 nt, Haemophilus influenzae Rd
acagauuuuuuauuaau

SEQ ID NO: 2701122 - RNA, 15 nt, Haemophilus influenzae Rd
acagcaaaagaaaua

SEQ ID NO: 2701123 - RNA, 14 nt, Haemophilus influenzae Rd
acagcaaaagcaau

SEQ ID NO: 2701124 - RNA, 16 nt, Haemophilus influenzae Rd
acagcaaacuuaaaua

SEQ ID NO: 2701125 - RNA, 18 nt, Haemophilus influenzae Rd
acagcaaacuuaaauaca

SEQ ID NO: 2701126 - RNA, 16 nt, Haemophilus influenzae Rd
acagcaagaacagcca

SEQ ID NO: 2701127 - RNA, 16 nt, Haemophilus influenzae Rd
acagcaauaaauaaua

SEQ ID NO: 2701128 - RNA, 19 nt, Haemophilus influenzae Rd
acagcaauuugaauuaaua

SEQ ID NO: 2701129 - RNA, 18 nt, Haemophilus influenzae Rd
acagcacacuaauaagaa

SEQ ID NO: 2701130 - RNA, 16 nt, Haemophilus influenzae Rd
acagcccaauuauugg

SEQ ID NO: 2701131 - RNA, 18 nt, Haemophilus influenzae Rd
acagccugcgagcaguuu

SEQ ID NO: 2701132 - RNA, 13 nt, Haemophilus influenzae Rd
acagcgcgagcac

SEQ ID NO: 2701133 - RNA, 15 nt, Haemophilus influenzae Rd
acagcuauuaaaaaa

SEQ ID NO: 2701134 - RNA, 21 nt, Haemophilus influenzae Rd
acagcucuguaaaacauuuca

SEQ ID NO: 2701135 - RNA, 21 nt, Haemophilus influenzae Rd
acagcugauaaguucauaaaa

SEQ ID NO: 2701136 - RNA, 16 nt, Haemophilus influenzae Rd
acagcugcauaaagcu

SEQ ID NO: 2701137 - RNA, 17 nt, Haemophilus influenzae Rd
acaggaugcaccaauac

SEQ ID NO: 2701138 - RNA, 18 nt, Haemophilus influenzae Rd
acaggcuugaguuucgcc

SEQ ID NO: 2701139 - RNA, 18 nt, Haemophilus influenzae Rd
acagggcgaccuguugca

SEQ ID NO: 2701140 - RNA, 15 nt, Haemophilus influenzae Rd
acagggcugauaaau

SEQ ID NO: 2701141 - RNA, 18 nt, Haemophilus influenzae Rd
acagggcuuuauuuuuga

SEQ ID NO: 2701142 - RNA, 21 nt, Haemophilus influenzae Rd
acaggguguuuauaagugcca

SEQ ID NO: 2701143 - RNA, 15 nt, Haemophilus influenzae Rd
acagguaauuucucu

SEQ ID NO: 2701144 - RNA, 22 nt, Haemophilus influenzae Rd
acagguacuuggauugcaugaa

SEQ ID NO: 2701145 - RNA, 18 nt, Haemophilus influenzae Rd
acagguguaguuagcaca

SEQ ID NO: 2701146 - RNA, 22 nt, Haemophilus influenzae Rd
acagguguguuuuucaaaaaau

SEQ ID NO: 2701147 - RNA, 14 nt, Haemophilus influenzae Rd
acaguaaaaauaga

SEQ ID NO: 2701148 - RNA, 13 nt, Haemophilus influenzae Rd
acaguaaagauua

SEQ ID NO: 2701149 - RNA, 13 nt, Haemophilus influenzae Rd
acaguaaauuuaa

SEQ ID NO: 2701150 - RNA, 16 nt, Haemophilus influenzae Rd
acaguaaauuuuucca

SEQ ID NO: 2701151 - RNA, 17 nt, Haemophilus influenzae Rd
acaguagaaaucacaau

SEQ ID NO: 2701152 - RNA, 21 nt, Haemophilus influenzae Rd
acaguauauccugcacauccu

SEQ ID NO: 2701153 - RNA, 16 nt, Haemophilus influenzae Rd
acaguauuuagcggaa

SEQ ID NO: 2701154 - RNA, 13 nt, Haemophilus influenzae Rd
acagucaaauugu

SEQ ID NO: 2701155 - RNA, 19 nt, Haemophilus influenzae Rd
acagucugcgccuaaaaua

SEQ ID NO: 2701156 - RNA, 22 nt, Haemophilus influenzae Rd
acagucuuuuaacacauaagca

SEQ ID NO: 2701157 - RNA, 19 nt, Haemophilus influenzae Rd
acagugacaaauuuugcau

SEQ ID NO: 2701158 - RNA, 17 nt, Haemophilus influenzae Rd
acagugaccgucaucgc

SEQ ID NO: 2701159 - RNA, 17 nt, Haemophilus influenzae Rd
acagugacuaaaacaac

SEQ ID NO: 2701160 - RNA, 21 nt, Haemophilus influenzae Rd
acagugacuaaaacaacagua

SEQ ID NO: 2701161 - RNA, 17 nt, Haemophilus influenzae Rd
acaguggguuauguagu

SEQ ID NO: 2701162 - RNA, 18 nt, Haemophilus influenzae Rd
acaguuagaacaacaaua

SEQ ID NO: 2701163 - RNA, 15 nt, Haemophilus influenzae Rd
acaguuauuuuuuau

SEQ ID NO: 2701164 - RNA, 18 nt, Haemophilus influenzae Rd
acaguucaauaaaaauau

SEQ ID NO: 2701165 - RNA, 19 nt, Haemophilus influenzae Rd
acaguuggggcuaaaaaua

SEQ ID NO: 2701166 - RNA, 16 nt, Haemophilus influenzae Rd
acaguugugaaaaaac

SEQ ID NO: 2701167 - RNA, 16 nt, Haemophilus influenzae Rd
acaguuuaucucuuuc

SEQ ID NO: 2701168 - RNA, 18 nt, Haemophilus influenzae Rd
acaguuuccgcaaaugcu

SEQ ID NO: 2701169 - RNA, 16 nt, Haemophilus influenzae Rd
acaguuuuauuuucca

SEQ ID NO: 2701170 - RNA, 17 nt, Haemophilus influenzae Rd
acauaaacggcugccgc

SEQ ID NO: 2701171 - RNA, 21 nt, Haemophilus influenzae Rd
acauaaagaauaauuuucaaa

SEQ ID NO: 2701172 - RNA, 22 nt, Haemophilus influenzae Rd
acauaaagaauaauuuucaaac

SEQ ID NO: 2701173 - RNA, 23 nt, Haemophilus influenzae Rd
acauaaagacgcuguuucuuuuc

SEQ ID NO: 2701174 - RNA, 15 nt, Haemophilus influenzae Rd
acauaaagauuaaaa

SEQ ID NO: 2701175 - RNA, 16 nt, Haemophilus influenzae Rd
acauaagcugcaucaa

SEQ ID NO: 2701176 - RNA, 16 nt, Haemophilus influenzae Rd
acauaaguaaaauagu

SEQ ID NO: 2701177 - RNA, 19 nt, Haemophilus influenzae Rd
acauaaguacauucaacca

SEQ ID NO: 2701178 - RNA, 20 nt, Haemophilus influenzae Rd
acauaaguuaccgcuucuuc

SEQ ID NO: 2701179 - RNA, 22 nt, Haemophilus influenzae Rd
acauaaguuaccgcuucuuccu

SEQ ID NO: 2701180 - RNA, 15 nt, Haemophilus influenzae Rd
acauaauaaaauuua

SEQ ID NO: 2701181 - RNA, 13 nt, Haemophilus influenzae Rd
acauaauaaacau

SEQ ID NO: 2701182 - RNA, 14 nt, Haemophilus influenzae Rd
acauaauaaacaua

SEQ ID NO: 2701183 - RNA, 13 nt, Haemophilus influenzae Rd
acauaauaagaaa

SEQ ID NO: 2701184 - RNA, 15 nt, Haemophilus influenzae Rd
acauaauaagaaagu

SEQ ID NO: 2701185 - RNA, 20 nt, Haemophilus influenzae Rd
acauaauaagaaaguaauug

SEQ ID NO: 2701186 - RNA, 18 nt, Haemophilus influenzae Rd
acauaauacuggcacuaa

SEQ ID NO: 2701187 - RNA, 20 nt, Haemophilus influenzae Rd
acauaauacuugaacgauuu

SEQ ID NO: 2701188 - RNA, 16 nt, Haemophilus influenzae Rd
acauaauauuuucccc

SEQ ID NO: 2701189 - RNA, 19 nt, Haemophilus influenzae Rd
acauaaucaggcugugcau

SEQ ID NO: 2701190 - RNA, 13 nt, Haemophilus influenzae Rd
acauaauuucaca

SEQ ID NO: 2701191 - RNA, 15 nt, Haemophilus influenzae Rd
acauaauuucacaau

SEQ ID NO: 2701192 - RNA, 16 nt, Haemophilus influenzae Rd
acauacaucuaauuuu

SEQ ID NO: 2701193 - RNA, 18 nt, Haemophilus influenzae Rd
acauacaucuaauuuuag

SEQ ID NO: 2701194 - RNA, 18 nt, Haemophilus influenzae Rd
acauaccuagauugcuuu

SEQ ID NO: 2701195 - RNA, 14 nt, Haemophilus influenzae Rd
acauacuuuguuga

SEQ ID NO: 2701196 - RNA, 18 nt, Haemophilus influenzae Rd
acauagaaaguuuaacuu

SEQ ID NO: 2701197 - RNA, 22 nt, Haemophilus influenzae Rd
acauagauuuaagcuuauuuca

SEQ ID NO: 2701198 - RNA, 18 nt, Haemophilus influenzae Rd
acauagccuuuuucuuuc

SEQ ID NO: 2701199 - RNA, 23 nt, Haemophilus influenzae Rd
acauagcuugaauugcuccuccu

SEQ ID NO: 2701200 - RNA, 21 nt, Haemophilus influenzae Rd
acauagugucagcaucggaua

SEQ ID NO: 2701201 - RNA, 11 nt, Haemophilus influenzae Rd
acauauaaaga

SEQ ID NO: 2701202 - RNA, 15 nt, Haemophilus influenzae Rd
acauauaacccauag

SEQ ID NO: 2701203 - RNA, 19 nt, Haemophilus influenzae Rd
acauauagugaaaaaauaa

SEQ ID NO: 2701204 - RNA, 22 nt, Haemophilus influenzae Rd
acauauccucaacaucaaaacc

SEQ ID NO: 2701205 - RNA, 19 nt, Haemophilus influenzae Rd
acauaugacagauagcaua

SEQ ID NO: 2701206 - RNA, 13 nt, Haemophilus influenzae Rd
acauaugauuauu

SEQ ID NO: 2701207 - RNA, 20 nt, Haemophilus influenzae Rd
acauauggauagaugaaaug

SEQ ID NO: 2701208 - RNA, 21 nt, Haemophilus influenzae Rd
acauauucuaccgcauuuuua

SEQ ID NO: 2701209 - RNA, 17 nt, Haemophilus influenzae Rd
acauauuguuucuucuc

SEQ ID NO: 2701210 - RNA, 18 nt, Haemophilus influenzae Rd
acauauuguuucuucucu

SEQ ID NO: 2701211 - RNA, 12 nt, Haemophilus influenzae Rd
acauauuucacc

SEQ ID NO: 2701212 - RNA, 18 nt, Haemophilus influenzae Rd
acauauuuucuaaaaaac

SEQ ID NO: 2701213 - RNA, 15 nt, Haemophilus influenzae Rd
acauauuuuuagauu

SEQ ID NO: 2701214 - RNA, 15 nt, Haemophilus influenzae Rd
acaucaacaaauguc

SEQ ID NO: 2701215 - RNA, 16 nt, Haemophilus influenzae Rd
acaucaacaaauguca

SEQ ID NO: 2701216 - RNA, 17 nt, Haemophilus influenzae Rd
acaucaacgguuuucau

SEQ ID NO: 2701217 - RNA, 17 nt, Haemophilus influenzae Rd
acaucaacuaauuuauu

SEQ ID NO: 2701218 - RNA, 15 nt, Haemophilus influenzae Rd
acaucaaucaaauuc

SEQ ID NO: 2701219 - RNA, 23 nt, Haemophilus influenzae Rd
acaucaccuguaaacaaauauuc

SEQ ID NO: 2701220 - RNA, 19 nt, Haemophilus influenzae Rd
acaucacgaggauuuuugc

SEQ ID NO: 2701221 - RNA, 24 nt, Haemophilus influenzae Rd
acaucacgaggauuuuugccguuu

SEQ ID NO: 2701222 - RNA, 15 nt, Haemophilus influenzae Rd
acaucagaaaaucaa

SEQ ID NO: 2701223 - RNA, 15 nt, Haemophilus influenzae Rd
acaucagcaaucauu

SEQ ID NO: 2701224 - RNA, 11 nt, Haemophilus influenzae Rd
acaucaucacc

SEQ ID NO: 2701225 - RNA, 20 nt, Haemophilus influenzae Rd
acaucaucggacgaaucaca

SEQ ID NO: 2701226 - RNA, 18 nt, Haemophilus influenzae Rd
acaucaucuggcauaucu

SEQ ID NO: 2701227 - RNA, 16 nt, Haemophilus influenzae Rd
acaucauuauugccuu

SEQ ID NO: 2701228 - RNA, 17 nt, Haemophilus influenzae Rd
acaucauuauugccuuu

SEQ ID NO: 2701229 - RNA, 13 nt, Haemophilus influenzae Rd
acaucauuugcaa

SEQ ID NO: 2701230 - RNA, 11 nt, Haemophilus influenzae Rd
acaucauuuuc

SEQ ID NO: 2701231 - RNA, 17 nt, Haemophilus influenzae Rd
acauccacaaaauuccg

SEQ ID NO: 2701232 - RNA, 20 nt, Haemophilus influenzae Rd
acauccacuuuuucugccaa

SEQ ID NO: 2701233 - RNA, 18 nt, Haemophilus influenzae Rd
acauccgaauaaaugcau

SEQ ID NO: 2701234 - RNA, 14 nt, Haemophilus influenzae Rd
acaucgcagugauc

SEQ ID NO: 2701235 - RNA, 15 nt, Haemophilus influenzae Rd
acaucgcuucaucau

SEQ ID NO: 2701236 - RNA, 18 nt, Haemophilus influenzae Rd
acaucgcuucaucaucgc

SEQ ID NO: 2701237 - RNA, 21 nt, Haemophilus influenzae Rd
acaucgcuugcauuucuucag

SEQ ID NO: 2701238 - RNA, 23 nt, Haemophilus influenzae Rd
acaucgcuugcauuucuucaguc

SEQ ID NO: 2701239 - RNA, 22 nt, Haemophilus influenzae Rd
acaucuaauuuuaguuguuugu

SEQ ID NO: 2701240 - RNA, 12 nt, Haemophilus influenzae Rd
acaucuuaaauu

SEQ ID NO: 2701241 - RNA, 15 nt, Haemophilus influenzae Rd
acaucuuaaauuaua

SEQ ID NO: 2701242 - RNA, 17 nt, Haemophilus influenzae Rd
acaucuuaaauuauaga

SEQ ID NO: 2701243 - RNA, 18 nt, Haemophilus influenzae Rd
acaucuugcauaaaccaa

SEQ ID NO: 2701244 - RNA, 15 nt, Haemophilus influenzae Rd
acaucuugcguuaaa

SEQ ID NO: 2701245 - RNA, 15 nt, Haemophilus influenzae Rd
acaugacaguuugua

SEQ ID NO: 2701246 - RNA, 15 nt, Haemophilus influenzae Rd
acaugcccuuucuca

SEQ ID NO: 2701247 - RNA, 22 nt, Haemophilus influenzae Rd
acaugcguuuucgcaauaucau

SEQ ID NO: 2701248 - RNA, 14 nt, Haemophilus influenzae Rd
acauggaacguuuu

SEQ ID NO: 2701249 - RNA, 19 nt, Haemophilus influenzae Rd
acauggccaauuucaucgc

SEQ ID NO: 2701250 - RNA, 17 nt, Haemophilus influenzae Rd
acaugguuaaaauauuc

SEQ ID NO: 2701251 - RNA, 17 nt, Haemophilus influenzae Rd
acauguugcaaguauua

SEQ ID NO: 2701252 - RNA, 16 nt, Haemophilus influenzae Rd
acauguugggcuaaaa

SEQ ID NO: 2701253 - RNA, 13 nt, Haemophilus influenzae Rd
acauuaaagcaau

SEQ ID NO: 2701254 - RNA, 20 nt, Haemophilus influenzae Rd
acauuaaagcaauugcuaaa

SEQ ID NO: 2701255 - RNA, 11 nt, Haemophilus influenzae Rd
acauuaacaau

SEQ ID NO: 2701256 - RNA, 23 nt, Haemophilus influenzae Rd
acauuaagugcguguauauauuu

SEQ ID NO: 2701257 - RNA, 23 nt, Haemophilus influenzae Rd
acauuaaucaccauaucaauuuc

SEQ ID NO: 2701258 - RNA, 14 nt, Haemophilus influenzae Rd
acauuaaucgauca

SEQ ID NO: 2701259 - RNA, 21 nt, Haemophilus influenzae Rd
acauuaaucgaucuauauucg

SEQ ID NO: 2701260 - RNA, 13 nt, Haemophilus influenzae Rd
acauuaauguaau

SEQ ID NO: 2701261 - RNA, 16 nt, Haemophilus influenzae Rd
acauuaauguaaucaa

SEQ ID NO: 2701262 - RNA, 14 nt, Haemophilus influenzae Rd
acauuacauaaauu

SEQ ID NO: 2701263 - RNA, 21 nt, Haemophilus influenzae Rd
acauuaccuucuguuuucaau

SEQ ID NO: 2701264 - RNA, 15 nt, Haemophilus influenzae Rd
acauuagagacaaac

SEQ ID NO: 2701265 - RNA, 16 nt, Haemophilus influenzae Rd
acauuaguaucuucca

SEQ ID NO: 2701266 - RNA, 16 nt, Haemophilus influenzae Rd
acauuaugauauuuca

SEQ ID NO: 2701267 - RNA, 21 nt, Haemophilus influenzae Rd
acauuaugauauuucaauuua

SEQ ID NO: 2701268 - RNA, 20 nt, Haemophilus influenzae Rd
acauuauuaaccguuuuuau

SEQ ID NO: 2701269 - RNA, 18 nt, Haemophilus influenzae Rd
acauuauugccaauuauc

SEQ ID NO: 2701270 - RNA, 12 nt, Haemophilus influenzae Rd
acauuauuuuua

SEQ ID NO: 2701271 - RNA, 17 nt, Haemophilus influenzae Rd
acauuauuuuuacaaau

SEQ ID NO: 2701272 - RNA, 13 nt, Haemophilus influenzae Rd
acauucaaaucca

SEQ ID NO: 2701273 - RNA, 16 nt, Haemophilus influenzae Rd
acauucaagccuucua

SEQ ID NO: 2701274 - RNA, 23 nt, Haemophilus influenzae Rd
acauucaagccuucuaaaauaag

SEQ ID NO: 2701275 - RNA, 15 nt, Haemophilus influenzae Rd
acauucaucaaaaca

SEQ ID NO: 2701276 - RNA, 21 nt, Haemophilus influenzae Rd
acauucaucuuagcuuuuuuc

SEQ ID NO: 2701277 - RNA, 16 nt, Haemophilus influenzae Rd
acauucuauagaauua

SEQ ID NO: 2701278 - RNA, 14 nt, Haemophilus influenzae Rd
acauucuuuuaaau

SEQ ID NO: 2701279 - RNA, 17 nt, Haemophilus influenzae Rd
acauucuuuuaaauaca

SEQ ID NO: 2701280 - RNA, 11 nt, Haemophilus influenzae Rd
acauugccaaa

SEQ ID NO: 2701281 - RNA, 12 nt, Haemophilus influenzae Rd
acauugccaaag

SEQ ID NO: 2701282 - RNA, 21 nt, Haemophilus influenzae Rd
acauugcguuuuacaccaaca

SEQ ID NO: 2701283 - RNA, 20 nt, Haemophilus influenzae Rd
acauugcuauggcaaugaau

SEQ ID NO: 2701284 - RNA, 20 nt, Haemophilus influenzae Rd
acauugcucgugauuaucua

SEQ ID NO: 2701285 - RNA, 20 nt, Haemophilus influenzae Rd
acauugcuuaacauuaauaa

SEQ ID NO: 2701286 - RNA, 19 nt, Haemophilus influenzae Rd
acauugugacauuggauua

SEQ ID NO: 2701287 - RNA, 13 nt, Haemophilus influenzae Rd
acauuuaaccaaa

SEQ ID NO: 2701288 - RNA, 14 nt, Haemophilus influenzae Rd
acauuuaaccaaaa

SEQ ID NO: 2701289 - RNA, 21 nt, Haemophilus influenzae Rd
acauuuaauggcugaaugcuu

SEQ ID NO: 2701290 - RNA, 20 nt, Haemophilus influenzae Rd
acauuuauuuuucuuaugaa

SEQ ID NO: 2701291 - RNA, 12 nt, Haemophilus influenzae Rd
acauuucaucgc

SEQ ID NO: 2701292 - RNA, 20 nt, Haemophilus influenzae Rd
acauuuccuuuacauuuaaa

SEQ ID NO: 2701293 - RNA, 21 nt, Haemophilus influenzae Rd
acauuuccuuuacauuuaaac

SEQ ID NO: 2701294 - RNA, 15 nt, Haemophilus influenzae Rd
acauuucuaaaauaa

SEQ ID NO: 2701295 - RNA, 16 nt, Haemophilus influenzae Rd
acauuucuaaaauaau

SEQ ID NO: 2701296 - RNA, 13 nt, Haemophilus influenzae Rd
acauuugacgaau

SEQ ID NO: 2701297 - RNA, 22 nt, Haemophilus influenzae Rd
acauuugacgaauggcacgcgc

SEQ ID NO: 2701298 - RNA, 16 nt, Haemophilus influenzae Rd
acauuugagaugaaaa

SEQ ID NO: 2701299 - RNA, 16 nt, Haemophilus influenzae Rd
acauuuggcaaaauaa

SEQ ID NO: 2701300 - RNA, 17 nt, Haemophilus influenzae Rd
acauuuggcaaaauaau

SEQ ID NO: 2701301 - RNA, 19 nt, Haemophilus influenzae Rd
acauuuuacuacguaaaga

SEQ ID NO: 2701302 - RNA, 22 nt, Haemophilus influenzae Rd
acauuuuacuacguaaagagag

SEQ ID NO: 2701303 - RNA, 17 nt, Haemophilus influenzae Rd
acauuuucaaauugucc

SEQ ID NO: 2701304 - RNA, 17 nt, Haemophilus influenzae Rd
acauuuuguaucuaaau

SEQ ID NO: 2701305 - RNA, 13 nt, Haemophilus influenzae Rd
acauuuuguuucu

SEQ ID NO: 2701306 - RNA, 18 nt, Haemophilus influenzae Rd
acauuuuucauuuucgca

SEQ ID NO: 2701307 - RNA, 13 nt, Haemophilus influenzae Rd
acauuuuucccug

SEQ ID NO: 2701308 - RNA, 13 nt, Haemophilus influenzae Rd
acauuuuuucaac

SEQ ID NO: 2701309 - RNA, 15 nt, Haemophilus influenzae Rd
acauuuuuuguaauu

SEQ ID NO: 2701310 - RNA, 13 nt, Haemophilus influenzae Rd
acauuuuuuuuau

SEQ ID NO: 2701311 - RNA, 12 nt, Haemophilus influenzae Rd
accaaaaauccu

SEQ ID NO: 2701312 - RNA, 17 nt, Haemophilus influenzae Rd
accaaaacgcaaugcaa

SEQ ID NO: 2701313 - RNA, 17 nt, Haemophilus influenzae Rd
accaaaagauccuucca

SEQ ID NO: 2701314 - RNA, 19 nt, Haemophilus influenzae Rd
accaaaaucguaauuuuaa

SEQ ID NO: 2701315 - RNA, 13 nt, Haemophilus influenzae Rd
accaaaauguaau

SEQ ID NO: 2701316 - RNA, 20 nt, Haemophilus influenzae Rd
accaaaauuuguuaagugau

SEQ ID NO: 2701317 - RNA, 19 nt, Haemophilus influenzae Rd
accaaacgagaaaauuucu

SEQ ID NO: 2701318 - RNA, 18 nt, Haemophilus influenzae Rd
accaaacugccaaacaaa

SEQ ID NO: 2701319 - RNA, 20 nt, Haemophilus influenzae Rd
accaaagcguccaagcaagc

SEQ ID NO: 2701320 - RNA, 23 nt, Haemophilus influenzae Rd
accaaaguuuccuucgccauuuu

SEQ ID NO: 2701321 - RNA, 23 nt, Haemophilus influenzae Rd
accaaauaaugaccauuggcuuu

SEQ ID NO: 2701322 - RNA, 16 nt, Haemophilus influenzae Rd
accaaauaauguuaaa

SEQ ID NO: 2701323 - RNA, 17 nt, Haemophilus influenzae Rd
accaaauacaauuuuuu

SEQ ID NO: 2701324 - RNA, 12 nt, Haemophilus influenzae Rd
accaaauaccac

SEQ ID NO: 2701325 - RNA, 20 nt, Haemophilus influenzae Rd
accaaauaccacacccuuuu

SEQ ID NO: 2701326 - RNA, 20 nt, Haemophilus influenzae Rd
accaaauagaugaaauuuau

SEQ ID NO: 2701327 - RNA, 16 nt, Haemophilus influenzae Rd
accaaauaucgcaauc

SEQ ID NO: 2701328 - RNA, 19 nt, Haemophilus influenzae Rd
accaaauaugguaauuagc

SEQ ID NO: 2701329 - RNA, 16 nt, Haemophilus influenzae Rd
accaaauauucuucua

SEQ ID NO: 2701330 - RNA, 14 nt, Haemophilus influenzae Rd
accaaaucacaaua

SEQ ID NO: 2701331 - RNA, 14 nt, Haemophilus influenzae Rd
accaaauccuuuug

SEQ ID NO: 2701332 - RNA, 16 nt, Haemophilus influenzae Rd
accaaaucuaacauuu

SEQ ID NO: 2701333 - RNA, 18 nt, Haemophilus influenzae Rd
accaaaugguggcuuuug

SEQ ID NO: 2701334 - RNA, 13 nt, Haemophilus influenzae Rd
accaaauuaaaaa

SEQ ID NO: 2701335 - RNA, 14 nt, Haemophilus influenzae Rd
accaaauuaaaaau

SEQ ID NO: 2701336 - RNA, 15 nt, Haemophilus influenzae Rd
accaaauuaaaaaua

SEQ ID NO: 2701337 - RNA, 16 nt, Haemophilus influenzae Rd
accaaauuaaaaauau

SEQ ID NO: 2701338 - RNA, 20 nt, Haemophilus influenzae Rd
accaaauugauucauuugau

SEQ ID NO: 2701339 - RNA, 21 nt, Haemophilus influenzae Rd
accaaauuuuccgcauaaaua

SEQ ID NO: 2701340 - RNA, 16 nt, Haemophilus influenzae Rd
accaacaaauucuaau

SEQ ID NO: 2701341 - RNA, 13 nt, Haemophilus influenzae Rd
accaacaacgaua

SEQ ID NO: 2701342 - RNA, 14 nt, Haemophilus influenzae Rd
accaacaccauucc

SEQ ID NO: 2701343 - RNA, 15 nt, Haemophilus influenzae Rd
accaacaccauucca

SEQ ID NO: 2701344 - RNA, 15 nt, Haemophilus influenzae Rd
accaacaguuaagcu

SEQ ID NO: 2701345 - RNA, 14 nt, Haemophilus influenzae Rd
accaacgaaaauag

SEQ ID NO: 2701346 - RNA, 19 nt, Haemophilus influenzae Rd
accaacggauuaaaagucc

SEQ ID NO: 2701347 - RNA, 15 nt, Haemophilus influenzae Rd
accaacggcauuucc

SEQ ID NO: 2701348 - RNA, 22 nt, Haemophilus influenzae Rd
aaaaaaagaccgcacuuuuaaa

SEQ ID NO: 2701349 - RNA, 12 nt, Haemophilus influenzae Rd
aaaaaaagcaau

SEQ ID NO: 2701350 - RNA, 13 nt, Haemophilus influenzae Rd
aaaaaaagcaaua

SEQ ID NO: 2701351 - RNA, 13 nt, Haemophilus influenzae Rd
aaaaaaauaaaaa

SEQ ID NO: 2701352 - RNA, 18 nt, Haemophilus influenzae Rd
aaaaaaaugaaauauuuu

SEQ ID NO: 2701353 - RNA, 12 nt, Haemophilus influenzae Rd
aaaaaacaccua

SEQ ID NO: 2701354 - RNA, 22 nt, Haemophilus influenzae Rd
aaaaaagaccgcacuuuaaaag

SEQ ID NO: 2701355 - RNA, 22 nt, Haemophilus influenzae Rd
aaaaaagaccgcacuuuuaaag

SEQ ID NO: 2701356 - RNA, 12 nt, Haemophilus influenzae Rd
aaaaaagccuug

SEQ ID NO: 2701357 - RNA, 14 nt, Haemophilus influenzae Rd
aaaaaagccuugaa

SEQ ID NO: 2701358 - RNA, 14 nt, Haemophilus influenzae Rd
aaaaaagcgaauuu

SEQ ID NO: 2701359 - RNA, 15 nt, Haemophilus influenzae Rd
aaaaaucauuaaaua

SEQ ID NO: 2701360 - RNA, 18 nt, Haemophilus influenzae Rd
aaaaauccuaaauaaaga

SEQ ID NO: 2701361 - RNA, 23 nt, Haemophilus influenzae Rd
aaaaauccugaagauuuuggugc

SEQ ID NO: 2701362 - RNA, 23 nt, Haemophilus influenzae Rd
aaaaauccuuguuugccaucuaa

SEQ ID NO: 2701363 - RNA, 16 nt, Haemophilus influenzae Rd
aaaaaucgaagaaaua

SEQ ID NO: 2701364 - RNA, 23 nt, Haemophilus influenzae Rd
aaaaaucguacaucgaaaacaua

SEQ ID NO: 2701365 - RNA, 18 nt, Haemophilus influenzae Rd
aaaaaucgucaaaaucau

SEQ ID NO: 2701366 - RNA, 18 nt, Haemophilus influenzae Rd
aaaaaucuccaacuucau

SEQ ID NO: 2701367 - RNA, 10 nt, Haemophilus influenzae Rd
aaaaaucucu

SEQ ID NO: 2701368 - RNA, 21 nt, Haemophilus influenzae Rd
aaaaaucugugauauauauca

SEQ ID NO: 2701369 - RNA, 15 nt, Haemophilus influenzae Rd
aaaaaucuuccaaua

SEQ ID NO: 2701370 - RNA, 17 nt, Haemophilus influenzae Rd
aaaaaucuuuaccaaaa

SEQ ID NO: 2701371 - RNA, 18 nt, Haemophilus influenzae Rd
aaaaaucuuuaccaaaaa

SEQ ID NO: 2701372 - RNA, 21 nt, Haemophilus influenzae Rd
aaaaaucuuuaccaaaaaauu

SEQ ID NO: 2701373 - RNA, 12 nt, Haemophilus influenzae Rd
aaaaaucuuuau

SEQ ID NO: 2701374 - RNA, 16 nt, Haemophilus influenzae Rd
aaaaaucuuugaauug

SEQ ID NO: 2701375 - RNA, 17 nt, Haemophilus influenzae Rd
aaaaaugaauaaaauuu

SEQ ID NO: 2701376 - RNA, 21 nt, Haemophilus influenzae Rd
aaaaaugagauuauuucuacu

SEQ ID NO: 2701377 - RNA, 21 nt, Haemophilus influenzae Rd
aaaaaugauuaaguuaaaagu

SEQ ID NO: 2701378 - RNA, 16 nt, Haemophilus influenzae Rd
aaaaaugccacuaagg

SEQ ID NO: 2701379 - RNA, 19 nt, Haemophilus influenzae Rd
aaaaaugcguucagaauuu

SEQ ID NO: 2701380 - RNA, 21 nt, Haemophilus influenzae Rd
aaaaaugcguucagaauuuga

SEQ ID NO: 2701381 - RNA, 18 nt, Haemophilus influenzae Rd
aaaaaugcuggaucggcu

SEQ ID NO: 2701382 - RNA, 19 nt, Haemophilus influenzae Rd
aaaaauggaaaaagcaaaa

SEQ ID NO: 2701383 - RNA, 15 nt, Haemophilus influenzae Rd
aaaaauggaauaaaa

SEQ ID NO: 2701384 - RNA, 17 nt, Haemophilus influenzae Rd
aaaaauggacagaauaa

SEQ ID NO: 2701385 - RNA, 23 nt, Haemophilus influenzae Rd
aaaaauguagagauaauaaauau

SEQ ID NO: 2701386 - RNA, 19 nt, Haemophilus influenzae Rd
aaaaauguucauuuuuaug

SEQ ID NO: 2701387 - RNA, 21 nt, Haemophilus influenzae Rd
aaaaauuaaccgcacuuuaaa

SEQ ID NO: 2701388 - RNA, 18 nt, Haemophilus influenzae Rd
aaaaauuaaggaaagccc

SEQ ID NO: 2701389 - RNA, 13 nt, Haemophilus influenzae Rd
aaaaauuaauacu

SEQ ID NO: 2701390 - RNA, 22 nt, Haemophilus influenzae Rd
aaaaauuaauacugaaaugauu

SEQ ID NO: 2701391 - RNA, 14 nt, Haemophilus influenzae Rd
aaaaauuacuuaau

SEQ ID NO: 2701392 - RNA, 20 nt, Haemophilus influenzae Rd
aaaaauuagguaacuaaagc

SEQ ID NO: 2701393 - RNA, 14 nt, Haemophilus influenzae Rd
aaaaauuaucaaaa

SEQ ID NO: 2701394 - RNA, 22 nt, Haemophilus influenzae Rd
aaaaauuaucaaaagaaaagau

SEQ ID NO: 2701395 - RNA, 14 nt, Haemophilus influenzae Rd
aaaaauuauugcau

SEQ ID NO: 2701396 - RNA, 20 nt, Haemophilus influenzae Rd
aaaaauuauugcauuuuuaa

SEQ ID NO: 2701397 - RNA, 22 nt, Haemophilus influenzae Rd
aaaaauuauugcauuuuuaacc

SEQ ID NO: 2701398 - RNA, 16 nt, Haemophilus influenzae Rd
aaaaauucaaugaaau

SEQ ID NO: 2701399 - RNA, 24 nt, Haemophilus influenzae Rd
aaaaauuccaguucuccuucucca

SEQ ID NO: 2701400 - RNA, 10 nt, Haemophilus influenzae Rd
aaaaauuccc

SEQ ID NO: 2701401 - RNA, 20 nt, Haemophilus influenzae Rd
aaaaauucuuuuuucuuccu

SEQ ID NO: 2701402 - RNA, 17 nt, Haemophilus influenzae Rd
aaaaauugaucuaaauu

SEQ ID NO: 2701403 - RNA, 21 nt, Haemophilus influenzae Rd
aaaaauugaucuaaauuaucg

SEQ ID NO: 2701404 - RNA, 18 nt, Haemophilus influenzae Rd
aaaaauuggaaaauaaaa

SEQ ID NO: 2701405 - RNA, 19 nt, Haemophilus influenzae Rd
aaaaauuggaaaauaaaau

SEQ ID NO: 2701406 - RNA, 21 nt, Haemophilus influenzae Rd
aaaaauuuaaaagcaccuaaa

SEQ ID NO: 2701407 - RNA, 16 nt, Haemophilus influenzae Rd
aaaaauuuaaauauaa

SEQ ID NO: 2701408 - RNA, 17 nt, Haemophilus influenzae Rd
aaaaauuuaaauauaau

SEQ ID NO: 2701409 - RNA, 21 nt, Haemophilus influenzae Rd
aaaaauuuaaauauaauuuag

SEQ ID NO: 2701410 - RNA, 21 nt, Haemophilus influenzae Rd
aaaaauuuaggguauuuauua

SEQ ID NO: 2701411 - RNA, 19 nt, Haemophilus influenzae Rd
aaaaauuucuuuuuuauca

SEQ ID NO: 2701412 - RNA, 13 nt, Haemophilus influenzae Rd
aaaaauuugaaug

SEQ ID NO: 2701413 - RNA, 17 nt, Haemophilus influenzae Rd
aaaaauuuuacauauaa

SEQ ID NO: 2701414 - RNA, 21 nt, Haemophilus influenzae Rd
aaaaauuuuacauauaaaagu

SEQ ID NO: 2701415 - RNA, 13 nt, Haemophilus influenzae Rd
aaaacaaaaaagu

SEQ ID NO: 2701416 - RNA, 21 nt, Haemophilus influenzae Rd
aaaacaaaagaaauuuuaacc

SEQ ID NO: 2701417 - RNA, 11 nt, Haemophilus influenzae Rd
aaaacaaaagg

SEQ ID NO: 2701418 - RNA, 18 nt, Haemophilus influenzae Rd
aaaacaaacgaugaagaa

SEQ ID NO: 2701419 - RNA, 19 nt, Haemophilus influenzae Rd
aaaacaaauguaaaacagu

SEQ ID NO: 2701420 - RNA, 13 nt, Haemophilus influenzae Rd
aaaacaauaaaaa

SEQ ID NO: 2701421 - RNA, 15 nt, Haemophilus influenzae Rd
aaaacaauaaaaaaa

SEQ ID NO: 2701422 - RNA, 16 nt, Haemophilus influenzae Rd
aaaacaccgucuaaau

SEQ ID NO: 2701423 - RNA, 12 nt, Haemophilus influenzae Rd
aaaacaccuaaa

SEQ ID NO: 2701424 - RNA, 18 nt, Haemophilus influenzae Rd
aaaacaccuccagcaaaa

SEQ ID NO: 2701425 - RNA, 15 nt, Haemophilus influenzae Rd
aaaacacgaaaaaaa

SEQ ID NO: 2701426 - RNA, 17 nt, Haemophilus influenzae Rd
aaaacacucucagaauu

SEQ ID NO: 2701427 - RNA, 19 nt, Haemophilus influenzae Rd
aaaacacucucagaauuaa

SEQ ID NO: 2701428 - RNA, 14 nt, Haemophilus influenzae Rd
aaaacagacugaaa

SEQ ID NO: 2701429 - RNA, 17 nt, Haemophilus influenzae Rd
aaaacagagaaaaaaau

SEQ ID NO: 2701430 - RNA, 20 nt, Haemophilus influenzae Rd
aaaacagaucgugauauuuc

SEQ ID NO: 2701431 - RNA, 13 nt, Haemophilus influenzae Rd
aaaacaguaauga

SEQ ID NO: 2701432 - RNA, 22 nt, Haemophilus influenzae Rd
aaaacaguuaucgccaauaaua

SEQ ID NO: 2701433 - RNA, 21 nt, Haemophilus influenzae Rd
aaaacauaauaaaauuuauua

SEQ ID NO: 2701434 - RNA, 21 nt, Haemophilus influenzae Rd
aaaacauaauccgcaucuaaa

SEQ ID NO: 2701435 - RNA, 15 nt, Haemophilus influenzae Rd
aaaacauaauugagu

SEQ ID NO: 2701436 - RNA, 18 nt, Haemophilus influenzae Rd
aaaacauaguaaauuuua

SEQ ID NO: 2701437 - RNA, 22 nt, Haemophilus influenzae Rd
aaaacauuucaucgcaucuaaa

SEQ ID NO: 2701438 - RNA, 13 nt, Haemophilus influenzae Rd
aaaaccaauaauc

SEQ ID NO: 2701439 - RNA, 14 nt, Haemophilus influenzae Rd
aaaaccaauuuuuu

SEQ ID NO: 2701440 - RNA, 12 nt, Haemophilus influenzae Rd
aaaaccacaaga

SEQ ID NO: 2701441 - RNA, 13 nt, Haemophilus influenzae Rd
aaaaccaccagaa

SEQ ID NO: 2701442 - RNA, 16 nt, Haemophilus influenzae Rd
aaaaccagauaaaaac

SEQ ID NO: 2701443 - RNA, 22 nt, Haemophilus influenzae Rd
aaaacccgaaccgauuuuaaau

SEQ ID NO: 2701444 - RNA, 18 nt, Haemophilus influenzae Rd
aaaacccguaauuaaaaa

SEQ ID NO: 2701445 - RNA, 20 nt, Haemophilus influenzae Rd
aaaaccgcagcuaauccaaa

SEQ ID NO: 2701446 - RNA, 23 nt, Haemophilus influenzae Rd
aaaaccgcagcuaauccaaauca

SEQ ID NO: 2701447 - RNA, 19 nt, Haemophilus influenzae Rd
aaaaccgucacaaauugac

SEQ ID NO: 2701448 - RNA, 19 nt, Haemophilus influenzae Rd
aaaaccuaacauaaugccu

SEQ ID NO: 2701449 - RNA, 16 nt, Haemophilus influenzae Rd
aaaacgaacaauuucu

SEQ ID NO: 2701450 - RNA, 18 nt, Haemophilus influenzae Rd
aaaacgaugaaguuuuca

SEQ ID NO: 2701451 - RNA, 19 nt, Haemophilus influenzae Rd
aaaacgcaaugcaaaagua

SEQ ID NO: 2701452 - RNA, 20 nt, Haemophilus influenzae Rd
aaaacgcacuucaaaugaag

SEQ ID NO: 2701453 - RNA, 20 nt, Haemophilus influenzae Rd
aaaacgcgaugaaauuauca

SEQ ID NO: 2701454 - RNA, 20 nt, Haemophilus influenzae Rd
aaaacggcgugaguugcaua

SEQ ID NO: 2701455 - RNA, 23 nt, Haemophilus influenzae Rd
aaaacggugggcugaagcccacc

SEQ ID NO: 2701456 - RNA, 21 nt, Haemophilus influenzae Rd
aaaacguucuaagaauuuuuu

SEQ ID NO: 2701457 - RNA, 18 nt, Haemophilus influenzae Rd
aaaacuaaaaacaaauau

SEQ ID NO: 2701458 - RNA, 14 nt, Haemophilus influenzae Rd
aaaacuacuuguuc

SEQ ID NO: 2701459 - RNA, 20 nt, Haemophilus influenzae Rd
aaaacuacuuuccaauucca

SEQ ID NO: 2701460 - RNA, 13 nt, Haemophilus influenzae Rd
aaaacuauaaaaa

SEQ ID NO: 2701461 - RNA, 15 nt, Haemophilus influenzae Rd
aaaacuauaaaaauu

SEQ ID NO: 2701462 - RNA, 12 nt, Haemophilus influenzae Rd
aaaacuaucaaa

SEQ ID NO: 2701463 - RNA, 19 nt, Haemophilus influenzae Rd
aaaacuaucuuacuugccu

SEQ ID NO: 2701464 - RNA, 21 nt, Haemophilus influenzae Rd
aaaauaaccuuaaaucaaaca

SEQ ID NO: 2701465 - RNA, 14 nt, Haemophilus influenzae Rd
aaaauaacuucauc

SEQ ID NO: 2701466 - RNA, 13 nt, Haemophilus influenzae Rd
aaaauaagcauaa

SEQ ID NO: 2701467 - RNA, 21 nt, Haemophilus influenzae Rd
aaaauaaggucagcaaauuau

SEQ ID NO: 2701468 - RNA, 13 nt, Haemophilus influenzae Rd
aaaauaauauaag

SEQ ID NO: 2701469 - RNA, 20 nt, Haemophilus influenzae Rd
aaaauaaucacuugauaaaa

SEQ ID NO: 2701470 - RNA, 13 nt, Haemophilus influenzae Rd
aaaauaaucuggc

SEQ ID NO: 2701471 - RNA, 15 nt, Haemophilus influenzae Rd
aaaauaaucuggcaa

SEQ ID NO: 2701472 - RNA, 12 nt, Haemophilus influenzae Rd
aaaauaauucca

SEQ ID NO: 2701473 - RNA, 13 nt, Haemophilus influenzae Rd
aaaauaauuuagu

SEQ ID NO: 2701474 - RNA, 16 nt, Haemophilus influenzae Rd
aaaauaauuuaguuau

SEQ ID NO: 2701475 - RNA, 22 nt, Haemophilus influenzae Rd
aaaauaauuuaguuauaugccu

SEQ ID NO: 2701476 - RNA, 14 nt, Haemophilus influenzae Rd
aaaauaauuuuacu

SEQ ID NO: 2701477 - RNA, 20 nt, Haemophilus influenzae Rd
aaaauaauuuucauugaaaa

SEQ ID NO: 2701478 - RNA, 16 nt, Haemophilus influenzae Rd
aaaauacaaauacauu

SEQ ID NO: 2701479 - RNA, 14 nt, Haemophilus influenzae Rd
aaaauacauugcua

SEQ ID NO: 2701480 - RNA, 14 nt, Haemophilus influenzae Rd
aaaauacccauaaa

SEQ ID NO: 2701481 - RNA, 16 nt, Haemophilus influenzae Rd
aaaauacccauaaaau

SEQ ID NO: 2701482 - RNA, 15 nt, Haemophilus influenzae Rd
aaaauacggugaaau

SEQ ID NO: 2701483 - RNA, 20 nt, Haemophilus influenzae Rd
aaaauacguacauugucuga

SEQ ID NO: 2701484 - RNA, 13 nt, Haemophilus influenzae Rd
aaaauacguuguu

SEQ ID NO: 2701485 - RNA, 15 nt, Haemophilus influenzae Rd
aaaauacugcacaau

SEQ ID NO: 2701486 - RNA, 18 nt, Haemophilus influenzae Rd
aaaauagaagccaaauca

SEQ ID NO: 2701487 - RNA, 16 nt, Haemophilus influenzae Rd
aaaauagaaugaaaaa

SEQ ID NO: 2701488 - RNA, 18 nt, Haemophilus influenzae Rd
aaaauagaaugaaaaaca

SEQ ID NO: 2701489 - RNA, 19 nt, Haemophilus influenzae Rd
aaaauagaaugaaaaacau

SEQ ID NO: 2701490 - RNA, 21 nt, Haemophilus influenzae Rd
aaaauagacaauauugaaaua

SEQ ID NO: 2701491 - RNA, 22 nt, Haemophilus influenzae Rd
aaaauagccuaaauauuuauac

SEQ ID NO: 2701492 - RNA, 21 nt, Haemophilus influenzae Rd
aaaauagccucagguauuucu

SEQ ID NO: 2701493 - RNA, 22 nt, Haemophilus influenzae Rd
aaaauagcugugcaaaaucuaa

SEQ ID NO: 2701494 - RNA, 17 nt, Haemophilus influenzae Rd
aaaauaggcugaaaaaa

SEQ ID NO: 2701495 - RNA, 17 nt, Haemophilus influenzae Rd
aaaauaguaaaaauugu

SEQ ID NO: 2701496 - RNA, 13 nt, Haemophilus influenzae Rd
aaaauaguugaaa

SEQ ID NO: 2701497 - RNA, 14 nt, Haemophilus influenzae Rd
aaaauaguugaaau

SEQ ID NO: 2701498 - RNA, 16 nt, Haemophilus influenzae Rd
aaaauaguugaaauuu

SEQ ID NO: 2701499 - RNA, 16 nt, Haemophilus influenzae Rd
aaaauauaaaaaaaga

SEQ ID NO: 2701500 - RNA, 23 nt, Haemophilus influenzae Rd
aaaauauaaccgcacuucaaaaa

SEQ ID NO: 2701501 - RNA, 14 nt, Haemophilus influenzae Rd
aaaauauacagcac

SEQ ID NO: 2701502 - RNA, 13 nt, Haemophilus influenzae Rd
aaaauauauaauc

SEQ ID NO: 2701503 - RNA, 21 nt, Haemophilus influenzae Rd
aaaauauaugggaaacaauau

SEQ ID NO: 2701504 - RNA, 13 nt, Haemophilus influenzae Rd
aaaauauauuaau

SEQ ID NO: 2701505 - RNA, 13 nt, Haemophilus influenzae Rd
aaaauaucacuuu

SEQ ID NO: 2701506 - RNA, 14 nt, Haemophilus influenzae Rd
aaaauauccacaua

SEQ ID NO: 2701507 - RNA, 19 nt, Haemophilus influenzae Rd
aaaauauccacauaaccaa

SEQ ID NO: 2701508 - RNA, 20 nt, Haemophilus influenzae Rd
aaaauaucccuuauuuuagu

SEQ ID NO: 2701509 - RNA, 22 nt, Haemophilus influenzae Rd
aaaauauccguuacauauuuca

SEQ ID NO: 2701510 - RNA, 17 nt, Haemophilus influenzae Rd
aaaauaucguaaaaaau

SEQ ID NO: 2701511 - RNA, 18 nt, Haemophilus influenzae Rd
aaaauaucugcaaaacuu

SEQ ID NO: 2701512 - RNA, 22 nt, Haemophilus influenzae Rd
aaaauauuaaagaguuauaaac

SEQ ID NO: 2701513 - RNA, 18 nt, Haemophilus influenzae Rd
aaaauauucuucauaaaa

SEQ ID NO: 2701514 - RNA, 21 nt, Haemophilus influenzae Rd
aaaauauucuucauaaaaaaa

SEQ ID NO: 2701515 - RNA, 22 nt, Haemophilus influenzae Rd
aaaauauucuucauaaaaaaag

SEQ ID NO: 2701516 - RNA, 13 nt, Haemophilus influenzae Rd
aaaauauugccug

SEQ ID NO: 2701517 - RNA, 13 nt, Haemophilus influenzae Rd
aaaauauuuaacu

SEQ ID NO: 2701518 - RNA, 20 nt, Haemophilus influenzae Rd
aaaauauuuacgacuaaaau

SEQ ID NO: 2701519 - RNA, 19 nt, Haemophilus influenzae Rd
aaaauauuuuaauaaagau

SEQ ID NO: 2701520 - RNA, 20 nt, Haemophilus influenzae Rd
aaaauauuuuccccuuucca

SEQ ID NO: 2701521 - RNA, 22 nt, Haemophilus influenzae Rd
aaaaucaaaauagcuuuuuaau

SEQ ID NO: 2701522 - RNA, 15 nt, Haemophilus influenzae Rd
aaaaucaaguuaaaa

SEQ ID NO: 2701523 - RNA, 17 nt, Haemophilus influenzae Rd
aaaaucaaguuaaaaaa

SEQ ID NO: 2701524 - RNA, 22 nt, Haemophilus influenzae Rd
aaaaucaaucaggcuuucauuu

SEQ ID NO: 2701525 - RNA, 13 nt, Haemophilus influenzae Rd
aaaaucacauaaa

SEQ ID NO: 2701526 - RNA, 18 nt, Haemophilus influenzae Rd
aaaaucacauaaaaaaug

SEQ ID NO: 2701527 - RNA, 22 nt, Haemophilus influenzae Rd
aaaaucaccgcacuuuuuguuu

SEQ ID NO: 2701528 - RNA, 16 nt, Haemophilus influenzae Rd
aaaaucacgcucuuuu

SEQ ID NO: 2701529 - RNA, 12 nt, Haemophilus influenzae Rd
aaaaucacuuuu

SEQ ID NO: 2701530 - RNA, 17 nt, Haemophilus influenzae Rd
aaaaucagauacauuug

SEQ ID NO: 2701531 - RNA, 23 nt, Haemophilus influenzae Rd
aaaaucaguuauugauaaaaaua

SEQ ID NO: 2701532 - RNA, 19 nt, Haemophilus influenzae Rd
aaaaucauaguguuuuuaa

SEQ ID NO: 2701533 - RNA, 20 nt, Haemophilus influenzae Rd
aaaaucaucauauucacuuu

SEQ ID NO: 2701534 - RNA, 17 nt, Haemophilus influenzae Rd
aaaaucaucguauuaaa

SEQ ID NO: 2701535 - RNA, 18 nt, Haemophilus influenzae Rd
aaaaucauuaaaaucugu

SEQ ID NO: 2701536 - RNA, 18 nt, Haemophilus influenzae Rd
aaaaucauuaaauaacuc

SEQ ID NO: 2701537 - RNA, 16 nt, Haemophilus influenzae Rd
aaaaucauuauccaac

SEQ ID NO: 2701538 - RNA, 15 nt, Haemophilus influenzae Rd
aaaauccaaguuugu

SEQ ID NO: 2701539 - RNA, 16 nt, Haemophilus influenzae Rd
aaaauccaaguuuguu

SEQ ID NO: 2701540 - RNA, 12 nt, Haemophilus influenzae Rd
aaaauccacacu

SEQ ID NO: 2701541 - RNA, 17 nt, Haemophilus influenzae Rd
aaaauccacacuuuaaa

SEQ ID NO: 2701542 - RNA, 18 nt, Haemophilus influenzae Rd
aaaauccacacuuuaaaa

SEQ ID NO: 2701543 - RNA, 20 nt, Haemophilus influenzae Rd
aaaauccacacuuuaaaagu

SEQ ID NO: 2701544 - RNA, 22 nt, Haemophilus influenzae Rd
aaaauccacacuuuaaaaguuu

SEQ ID NO: 2701545 - RNA, 16 nt, Haemophilus influenzae Rd
aaaauccauaauuuca

SEQ ID NO: 2701546 - RNA, 14 nt, Haemophilus influenzae Rd
aaaauccauuuaac

SEQ ID NO: 2701547 - RNA, 20 nt, Haemophilus influenzae Rd
aaaauccccguuaaauuuau

SEQ ID NO: 2701548 - RNA, 14 nt, Haemophilus influenzae Rd
aaaauccuaaauaa

SEQ ID NO: 2701549 - RNA, 17 nt, Haemophilus influenzae Rd
aaaaucgcaauauuaaa

SEQ ID NO: 2701550 - RNA, 22 nt, Haemophilus influenzae Rd
aaaaucguaauuuuaaaaccac

SEQ ID NO: 2701551 - RNA, 21 nt, Haemophilus influenzae Rd
aaaaucguacaucgaaaacau

SEQ ID NO: 2701552 - RNA, 23 nt, Haemophilus influenzae Rd
aaaaucuaaagguuccucagaga

SEQ ID NO: 2701553 - RNA, 18 nt, Haemophilus influenzae Rd
aaaaucuacucguuuacu

SEQ ID NO: 2701554 - RNA, 14 nt, Haemophilus influenzae Rd
aaaaucuccaacuu

SEQ ID NO: 2701555 - RNA, 11 nt, Haemophilus influenzae Rd
aaaaucucuau

SEQ ID NO: 2701556 - RNA, 17 nt, Haemophilus influenzae Rd
aaaaucucuauugcuuu

SEQ ID NO: 2701557 - RNA, 20 nt, Haemophilus influenzae Rd
aaaaucucucaaaaaucaac

SEQ ID NO: 2701558 - RNA, 18 nt, Haemophilus influenzae Rd
aaaaucucuggagaaaau

SEQ ID NO: 2701559 - RNA, 19 nt, Haemophilus influenzae Rd
aaaaucucuggagaaaauu

SEQ ID NO: 2701560 - RNA, 23 nt, Haemophilus influenzae Rd
aaaaucugcacucuaauaaguga

SEQ ID NO: 2701561 - RNA, 12 nt, Haemophilus influenzae Rd
aaaaucugcuag

SEQ ID NO: 2701562 - RNA, 21 nt, Haemophilus influenzae Rd
aaaaucugcuccgcuacuuuu

SEQ ID NO: 2701563 - RNA, 16 nt, Haemophilus influenzae Rd
aaaaucugugcaaagu

SEQ ID NO: 2701564 - RNA, 13 nt, Haemophilus influenzae Rd
aaaaucuuauuuc

SEQ ID NO: 2701565 - RNA, 15 nt, Haemophilus influenzae Rd
aaaaucuuccaauac

SEQ ID NO: 2701566 - RNA, 23 nt, Haemophilus influenzae Rd
aaaaucuuccaauacaaucagcu

SEQ ID NO: 2701567 - RNA, 12 nt, Haemophilus influenzae Rd
aaaaucuugcac

SEQ ID NO: 2701568 - RNA, 23 nt, Haemophilus influenzae Rd
aaaaucuuuaccaaaaaauucgu

SEQ ID NO: 2701569 - RNA, 14 nt, Haemophilus influenzae Rd
aaacaaaauaaaug

SEQ ID NO: 2701570 - RNA, 22 nt, Haemophilus influenzae Rd
aaacaaaccuaaaccuuauuuu

SEQ ID NO: 2701571 - RNA, 13 nt, Haemophilus influenzae Rd
aaacaaacgauga

SEQ ID NO: 2701572 - RNA, 16 nt, Haemophilus influenzae Rd
aaacaaauauauuucu

SEQ ID NO: 2701573 - RNA, 13 nt, Haemophilus influenzae Rd
aaacaaauuuuua

SEQ ID NO: 2701574 - RNA, 18 nt, Haemophilus influenzae Rd
aaacaacaguagaaauca

SEQ ID NO: 2701575 - RNA, 19 nt, Haemophilus influenzae Rd
aaacaaccagcgcaccaca

SEQ ID NO: 2701576 - RNA, 13 nt, Haemophilus influenzae Rd
aaacaacguaaaa

SEQ ID NO: 2701577 - RNA, 15 nt, Haemophilus influenzae Rd
aaacaagacaaaaua

SEQ ID NO: 2701578 - RNA, 17 nt, Haemophilus influenzae Rd
aaacaagauucugaaag

SEQ ID NO: 2701579 - RNA, 18 nt, Haemophilus influenzae Rd
aaacaagcucuagaaaau

SEQ ID NO: 2701580 - RNA, 22 nt, Haemophilus influenzae Rd
aaacaaggaaucgaaauuaaaa

SEQ ID NO: 2701581 - RNA, 12 nt, Haemophilus influenzae Rd
aaacaaggcuaa

SEQ ID NO: 2701582 - RNA, 15 nt, Haemophilus influenzae Rd
aaacaaguauaaaaa

SEQ ID NO: 2701583 - RNA, 17 nt, Haemophilus influenzae Rd
aaacaaguauaaaaaau

SEQ ID NO: 2701584 - RNA, 20 nt, Haemophilus influenzae Rd
aaacaagugcuaucuuaaau

SEQ ID NO: 2701585 - RNA, 13 nt, Haemophilus influenzae Rd
aaacaaguucuua

SEQ ID NO: 2701586 - RNA, 23 nt, Haemophilus influenzae Rd
aaacaauauauucggaaaaaauu

SEQ ID NO: 2701587 - RNA, 16 nt, Haemophilus influenzae Rd
aaacaauggcugaaaa

SEQ ID NO: 2701588 - RNA, 20 nt, Haemophilus influenzae Rd
aaacaauucuauauuauuua

SEQ ID NO: 2701589 - RNA, 15 nt, Haemophilus influenzae Rd
aaacacaaaauaagg

SEQ ID NO: 2701590 - RNA, 18 nt, Haemophilus influenzae Rd
aaacacaguuauuuuuua

SEQ ID NO: 2701591 - RNA, 14 nt, Haemophilus influenzae Rd
aaacaccaaauauu

SEQ ID NO: 2701592 - RNA, 19 nt, Haemophilus influenzae Rd
aaacaccaaauauucuucu

SEQ ID NO: 2701593 - RNA, 17 nt, Haemophilus influenzae Rd
aaacacuccaacaccag

SEQ ID NO: 2701594 - RNA, 18 nt, Haemophilus influenzae Rd
aaacacugcgcagauuaa

SEQ ID NO: 2701595 - RNA, 17 nt, Haemophilus influenzae Rd
aaacacuugguucgcuu

SEQ ID NO: 2701596 - RNA, 15 nt, Haemophilus influenzae Rd
aaacagaaguugaaa

SEQ ID NO: 2701597 - RNA, 13 nt, Haemophilus influenzae Rd
aaacagacugaaa

SEQ ID NO: 2701598 - RNA, 17 nt, Haemophilus influenzae Rd
aaacagacugaaauucu

SEQ ID NO: 2701599 - RNA, 16 nt, Haemophilus influenzae Rd
aaacagagaaaaaaau

SEQ ID NO: 2701600 - RNA, 13 nt, Haemophilus influenzae Rd
aaacagcacacua

SEQ ID NO: 2701601 - RNA, 22 nt, Haemophilus influenzae Rd
aaacagccauggcuuuuuccug

SEQ ID NO: 2701602 - RNA, 23 nt, Haemophilus influenzae Rd
aaacagguguguuuuucaaaaaa

SEQ ID NO: 2701603 - RNA, 13 nt, Haemophilus influenzae Rd
aaacaguauuuuc

SEQ ID NO: 2701604 - RNA, 22 nt, Haemophilus influenzae Rd
aaacagucugcgccuaaaauau

SEQ ID NO: 2701605 - RNA, 23 nt, Haemophilus influenzae Rd
aaacagucugcgccuaaaauauu

SEQ ID NO: 2701606 - RNA, 20 nt, Haemophilus influenzae Rd
aaacagugagcuuauugcca

SEQ ID NO: 2701607 - RNA, 15 nt, Haemophilus influenzae Rd
aaacaguucaauaaa

SEQ ID NO: 2701608 - RNA, 17 nt, Haemophilus influenzae Rd
aaacaguucaauaaaaa

SEQ ID NO: 2701609 - RNA, 13 nt, Haemophilus influenzae Rd
aaacauaagaaau

SEQ ID NO: 2701610 - RNA, 17 nt, Haemophilus influenzae Rd
aaacauaauauuuuccc

SEQ ID NO: 2701611 - RNA, 21 nt, Haemophilus influenzae Rd
aaacauacaucuaauuuuagu

SEQ ID NO: 2701612 - RNA, 16 nt, Haemophilus influenzae Rd
aaacauaguaaauuuu

SEQ ID NO: 2701613 - RNA, 13 nt, Haemophilus influenzae Rd
aaacauauuccaa

SEQ ID NO: 2701614 - RNA, 19 nt, Haemophilus influenzae Rd
aaacauauugaugauuaac

SEQ ID NO: 2701615 - RNA, 21 nt, Haemophilus influenzae Rd
aaacaucacgccaucgccauu

SEQ ID NO: 2701616 - RNA, 23 nt, Haemophilus influenzae Rd
aaacaucaucacccccacggcaa

SEQ ID NO: 2701617 - RNA, 21 nt, Haemophilus influenzae Rd
aaacaucgcagaaauagauuc

SEQ ID NO: 2701618 - RNA, 18 nt, Haemophilus influenzae Rd
aaacaucgcuucaucauc

SEQ ID NO: 2701619 - RNA, 19 nt, Haemophilus influenzae Rd
aaacauugcucgugauuau

SEQ ID NO: 2701620 - RNA, 20 nt, Haemophilus influenzae Rd
aaacauugcucgugauuauc

SEQ ID NO: 2701621 - RNA, 22 nt, Haemophilus influenzae Rd
aaacauuguuuuguucaucuaa

SEQ ID NO: 2701622 - RNA, 13 nt, Haemophilus influenzae Rd
aaacauuugaccu

SEQ ID NO: 2701623 - RNA, 14 nt, Haemophilus influenzae Rd
aaacauuuguaccu

SEQ ID NO: 2701624 - RNA, 16 nt, Haemophilus influenzae Rd
aaacauuuuguaucua

SEQ ID NO: 2701625 - RNA, 18 nt, Haemophilus influenzae Rd
aaacauuuuguaucuaaa

SEQ ID NO: 2701626 - RNA, 12 nt, Haemophilus influenzae Rd
aaacauuuuuau

SEQ ID NO: 2701627 - RNA, 17 nt, Haemophilus influenzae Rd
aaacauuuuuauuuuua

SEQ ID NO: 2701628 - RNA, 18 nt, Haemophilus influenzae Rd
aaacauuuuuauuuuuac

SEQ ID NO: 2701629 - RNA, 16 nt, Haemophilus influenzae Rd
aaacauuuuucauuuu

SEQ ID NO: 2701630 - RNA, 17 nt, Haemophilus influenzae Rd
aaacauuuuucauuuuc

SEQ ID NO: 2701631 - RNA, 12 nt, Haemophilus influenzae Rd
aaacauuuuucc

SEQ ID NO: 2701632 - RNA, 17 nt, Haemophilus influenzae Rd
aaaccaaaacauaagaa

SEQ ID NO: 2701633 - RNA, 14 nt, Haemophilus influenzae Rd
aaaccaaaagauuc

SEQ ID NO: 2701634 - RNA, 18 nt, Haemophilus influenzae Rd
aaaccaaacgagaaaauu

SEQ ID NO: 2701635 - RNA, 13 nt, Haemophilus influenzae Rd
aaaccaaauaaug

SEQ ID NO: 2701636 - RNA, 14 nt, Haemophilus influenzae Rd
aaaccaaauaauga

SEQ ID NO: 2701637 - RNA, 13 nt, Haemophilus influenzae Rd
aaaccaaaucaca

SEQ ID NO: 2701638 - RNA, 13 nt, Haemophilus influenzae Rd
aaaccaaauugau

SEQ ID NO: 2701639 - RNA, 14 nt, Haemophilus influenzae Rd
aaaccaaauuuuga

SEQ ID NO: 2701640 - RNA, 13 nt, Haemophilus influenzae Rd
aaaccaacauaca

SEQ ID NO: 2701641 - RNA, 11 nt, Haemophilus influenzae Rd
aaaccaaccac

SEQ ID NO: 2701642 - RNA, 17 nt, Haemophilus influenzae Rd
aaaccaaccacagcgac

SEQ ID NO: 2701643 - RNA, 18 nt, Haemophilus influenzae Rd
aaaccaacucuugucauu

SEQ ID NO: 2701644 - RNA, 22 nt, Haemophilus influenzae Rd
aaaccaagagccuccacaagca

SEQ ID NO: 2701645 - RNA, 23 nt, Haemophilus influenzae Rd
aaaccaagagggcuuguuuuuuc

SEQ ID NO: 2701646 - RNA, 17 nt, Haemophilus influenzae Rd
aaaccaauaauccuuuu

SEQ ID NO: 2701647 - RNA, 18 nt, Haemophilus influenzae Rd
aaaccaaucauuggauaa

SEQ ID NO: 2701648 - RNA, 17 nt, Haemophilus influenzae Rd
aaaccaauuucguuuuc

SEQ ID NO: 2701649 - RNA, 23 nt, Haemophilus influenzae Rd
aaaccaccguucuauauuuugaa

SEQ ID NO: 2701650 - RNA, 19 nt, Haemophilus influenzae Rd
aaaccagaaauagaguuaa

SEQ ID NO: 2701651 - RNA, 20 nt, Haemophilus influenzae Rd
aaaccagauaaaaacugugc

SEQ ID NO: 2701652 - RNA, 12 nt, Haemophilus influenzae Rd
aaaccagauaag

SEQ ID NO: 2701653 - RNA, 18 nt, Haemophilus influenzae Rd
aaaccaguuaaauccuca

SEQ ID NO: 2701654 - RNA, 20 nt, Haemophilus influenzae Rd
aaaccaucauaggcuuuaac

SEQ ID NO: 2701655 - RNA, 17 nt, Haemophilus influenzae Rd
aaaccauccgaaauuaa

SEQ ID NO: 2701656 - RNA, 16 nt, Haemophilus influenzae Rd
aaaccauuuuaaucau

SEQ ID NO: 2701657 - RNA, 21 nt, Haemophilus influenzae Rd
aaacccacuucacaacuuuuu

SEQ ID NO: 2701658 - RNA, 14 nt, Haemophilus influenzae Rd
aaacccaucauaaa

SEQ ID NO: 2701659 - RNA, 20 nt, Haemophilus influenzae Rd
aaacccgaaccgauuuuaaa

SEQ ID NO: 2701660 - RNA, 18 nt, Haemophilus influenzae Rd
aaacccucccauuagcuu

SEQ ID NO: 2701661 - RNA, 15 nt, Haemophilus influenzae Rd
aaacccuguuuuaag

SEQ ID NO: 2701662 - RNA, 22 nt, Haemophilus influenzae Rd
aaaccgcagcuaauccaaauca

SEQ ID NO: 2701663 - RNA, 20 nt, Haemophilus influenzae Rd
aaaccgcauccauucucaaa

SEQ ID NO: 2701664 - RNA, 21 nt, Haemophilus influenzae Rd
aaaccgcugucauauucauuu

SEQ ID NO: 2701665 - RNA, 23 nt, Haemophilus influenzae Rd
aaaccgcugucauauucauuuuc

SEQ ID NO: 2701666 - RNA, 21 nt, Haemophilus influenzae Rd
aaaccguggcauaauuugguu

SEQ ID NO: 2701667 - RNA, 24 nt, Haemophilus influenzae Rd
aaaccguuagguuuaaaagauacu

SEQ ID NO: 2701668 - RNA, 18 nt, Haemophilus influenzae Rd
aaaccuaaaauugauuuc

SEQ ID NO: 2701669 - RNA, 14 nt, Haemophilus influenzae Rd
aaaccuaaauccca

SEQ ID NO: 2701670 - RNA, 22 nt, Haemophilus influenzae Rd
aaaccuaacguagauagcacga

SEQ ID NO: 2701671 - RNA, 20 nt, Haemophilus influenzae Rd
aaaccuacacccacugauuu

SEQ ID NO: 2701672 - RNA, 23 nt, Haemophilus influenzae Rd
aaaccuacacccacugauuuuuc

SEQ ID NO: 2701673 - RNA, 23 nt, Haemophilus influenzae Rd
aaaccugaguaaauaaacggaac

SEQ ID NO: 2701674 - RNA, 16 nt, Haemophilus influenzae Rd
aaagaaacugucuacu

SEQ ID NO: 2701675 - RNA, 13 nt, Haemophilus influenzae Rd
aaagaaagcaaug

SEQ ID NO: 2701676 - RNA, 16 nt, Haemophilus influenzae Rd
aaagaaagcaauguag

SEQ ID NO: 2701677 - RNA, 20 nt, Haemophilus influenzae Rd
aaagaaaguauuaaauauaa

SEQ ID NO: 2701678 - RNA, 15 nt, Haemophilus influenzae Rd
aaagaaauauuuuua

SEQ ID NO: 2701679 - RNA, 12 nt, Haemophilus influenzae Rd
aaagaaauuuaa

SEQ ID NO: 2701680 - RNA, 11 nt, Haemophilus influenzae Rd
aaagaaauuuu

SEQ ID NO: 2701681 - RNA, 12 nt, Haemophilus influenzae Rd
aaagaaauuuua

SEQ ID NO: 2701682 - RNA, 16 nt, Haemophilus influenzae Rd
aaagaaauuuuaauca

SEQ ID NO: 2701683 - RNA, 18 nt, Haemophilus influenzae Rd
aaagaaauuuuauccauc

SEQ ID NO: 2701684 - RNA, 13 nt, Haemophilus influenzae Rd
aaagaagaaaaag

SEQ ID NO: 2701685 - RNA, 17 nt, Haemophilus influenzae Rd
aaagaagcguucaaaaa

SEQ ID NO: 2701686 - RNA, 17 nt, Haemophilus influenzae Rd
aaagaagcucacuuuau

SEQ ID NO: 2701687 - RNA, 14 nt, Haemophilus influenzae Rd
aaagaagcuuucca

SEQ ID NO: 2701688 - RNA, 24 nt, Haemophilus influenzae Rd
aaagaagggaugauugacgaaaaa

SEQ ID NO: 2701689 - RNA, 15 nt, Haemophilus influenzae Rd
aaagaaguuuuccau

SEQ ID NO: 2701690 - RNA, 12 nt, Haemophilus influenzae Rd
aaagaauaauaa

SEQ ID NO: 2701691 - RNA, 23 nt, Haemophilus influenzae Rd
aaagaauaauuuucaaacacaac

SEQ ID NO: 2701692 - RNA, 20 nt, Haemophilus influenzae Rd
aaagaauacaccccaaaauc

SEQ ID NO: 2701693 - RNA, 14 nt, Haemophilus influenzae Rd
aaagaauauaaaua

SEQ ID NO: 2701694 - RNA, 23 nt, Haemophilus influenzae Rd
aaagaauauaaauaaaacaagga

SEQ ID NO: 2701695 - RNA, 13 nt, Haemophilus influenzae Rd
aaagaauaucaau

SEQ ID NO: 2701696 - RNA, 23 nt, Haemophilus influenzae Rd
aaagaauaucgccuuaucccaua

SEQ ID NO: 2701697 - RNA, 12 nt, Haemophilus influenzae Rd
aaagaauauuua

SEQ ID NO: 2701698 - RNA, 15 nt, Haemophilus influenzae Rd
aaagaauauuuuaau

SEQ ID NO: 2701699 - RNA, 18 nt, Haemophilus influenzae Rd
aaagaaugucaucuaauu

SEQ ID NO: 2701700 - RNA, 12 nt, Haemophilus influenzae Rd
aaagaauguuug

SEQ ID NO: 2701701 - RNA, 13 nt, Haemophilus influenzae Rd
aaagaauuaaaau

SEQ ID NO: 2701702 - RNA, 18 nt, Haemophilus influenzae Rd
aaagaauuucaucgcauu

SEQ ID NO: 2701703 - RNA, 13 nt, Haemophilus influenzae Rd
aaagaauuucuuu

SEQ ID NO: 2701704 - RNA, 16 nt, Haemophilus influenzae Rd
aaagaauuugccugcc

SEQ ID NO: 2701705 - RNA, 12 nt, Haemophilus influenzae Rd
aaagaauuuuuu

SEQ ID NO: 2701706 - RNA, 13 nt, Haemophilus influenzae Rd
aaagacaauaauu

SEQ ID NO: 2701707 - RNA, 17 nt, Haemophilus influenzae Rd
aaagacagcuauuaaaa

SEQ ID NO: 2701708 - RNA, 18 nt, Haemophilus influenzae Rd
aaagacagcuauuaaaaa

SEQ ID NO: 2701709 - RNA, 20 nt, Haemophilus influenzae Rd
aaagaccaugccuguucuaa

SEQ ID NO: 2701710 - RNA, 22 nt, Haemophilus influenzae Rd
aaagacccaccgcaaaagccaa

SEQ ID NO: 2701711 - RNA, 18 nt, Haemophilus influenzae Rd
aaagacgauauuuuccuu

SEQ ID NO: 2701712 - RNA, 20 nt, Haemophilus influenzae Rd
aaagacgcuguuucuuuuca

SEQ ID NO: 2701713 - RNA, 14 nt, Haemophilus influenzae Rd
aaagacuaaaacca

SEQ ID NO: 2701714 - RNA, 19 nt, Haemophilus influenzae Rd
aaagacuaaaaccacauca

SEQ ID NO: 2701715 - RNA, 19 nt, Haemophilus influenzae Rd
aaagacuaaacucaaugaa

SEQ ID NO: 2701716 - RNA, 16 nt, Haemophilus influenzae Rd
aaagacugcuacuuuu

SEQ ID NO: 2701717 - RNA, 21 nt, Haemophilus influenzae Rd
aaagacugcuacuuuugacgc

SEQ ID NO: 2701718 - RNA, 21 nt, Haemophilus influenzae Rd
aaagagacucuguuccacagg

SEQ ID NO: 2701719 - RNA, 16 nt, Haemophilus influenzae Rd
aaagagagcuucucuu

SEQ ID NO: 2701720 - RNA, 23 nt, Haemophilus influenzae Rd
aaagagaucacuguaaauaauag

SEQ ID NO: 2701721 - RNA, 14 nt, Haemophilus influenzae Rd
aaagagcaaauuua

SEQ ID NO: 2701722 - RNA, 18 nt, Haemophilus influenzae Rd
aaagagcaaauuuaaaua

SEQ ID NO: 2701723 - RNA, 19 nt, Haemophilus influenzae Rd
aaagagcgguuaaaaauag

SEQ ID NO: 2701724 - RNA, 17 nt, Haemophilus influenzae Rd
aaagaggagguagaaaa

SEQ ID NO: 2701725 - RNA, 20 nt, Haemophilus influenzae Rd
aaagaggagguagaaaaucg

SEQ ID NO: 2701726 - RNA, 17 nt, Haemophilus influenzae Rd
aaagaguaccacuuuca

SEQ ID NO: 2701727 - RNA, 12 nt, Haemophilus influenzae Rd
aaagauaaaaca

SEQ ID NO: 2701728 - RNA, 12 nt, Haemophilus influenzae Rd
aaagauaaauua

SEQ ID NO: 2701729 - RNA, 16 nt, Haemophilus influenzae Rd
aaagauaacuaagaug

SEQ ID NO: 2701730 - RNA, 22 nt, Haemophilus influenzae Rd
aaagauacacucacuuuuccuu

SEQ ID NO: 2701731 - RNA, 17 nt, Haemophilus influenzae Rd
aaagauaguaauguucu

SEQ ID NO: 2701732 - RNA, 18 nt, Haemophilus influenzae Rd
aaagauaguaauguucua

SEQ ID NO: 2701733 - RNA, 15 nt, Haemophilus influenzae Rd
aaagauauaaacuga

SEQ ID NO: 2701734 - RNA, 16 nt, Haemophilus influenzae Rd
aaagauauaaacugau

SEQ ID NO: 2701735 - RNA, 23 nt, Haemophilus influenzae Rd
aaagaucaauggguuuaaaaagu

SEQ ID NO: 2701736 - RNA, 21 nt, Haemophilus influenzae Rd
aaagaucaggaucaaaaauau

SEQ ID NO: 2701737 - RNA, 14 nt, Haemophilus influenzae Rd
aaagaucauucaca

SEQ ID NO: 2701738 - RNA, 13 nt, Haemophilus influenzae Rd
aaagaucauuuuu

SEQ ID NO: 2701739 - RNA, 13 nt, Haemophilus influenzae Rd
aaagauccaaaga

SEQ ID NO: 2701740 - RNA, 22 nt, Haemophilus influenzae Rd
aaagauccaaagacuaaaacca

SEQ ID NO: 2701741 - RNA, 18 nt, Haemophilus influenzae Rd
aaagauguuccuacagaa

SEQ ID NO: 2701742 - RNA, 12 nt, Haemophilus influenzae Rd
aaagauuaaaau

SEQ ID NO: 2701743 - RNA, 14 nt, Haemophilus influenzae Rd
aaagauuauuuaau

SEQ ID NO: 2701744 - RNA, 22 nt, Haemophilus influenzae Rd
aaagauucgcuuuuuuuuuugc

SEQ ID NO: 2701745 - RNA, 23 nt, Haemophilus influenzae Rd
aaagauuguuuuuucauauuuua

SEQ ID NO: 2701746 - RNA, 16 nt, Haemophilus influenzae Rd
aaagauuuauguugaa

SEQ ID NO: 2701747 - RNA, 13 nt, Haemophilus influenzae Rd
aaagcaaaaccau

SEQ ID NO: 2701748 - RNA, 16 nt, Haemophilus influenzae Rd
aaagcaaaaucaaagu

SEQ ID NO: 2701749 - RNA, 19 nt, Haemophilus influenzae Rd
aaagcaaaugaggaaaaua

SEQ ID NO: 2701750 - RNA, 23 nt, Haemophilus influenzae Rd
aaagcaaauggcaucaauauuau

SEQ ID NO: 2701751 - RNA, 15 nt, Haemophilus influenzae Rd
aaagcaagaucuaaa

SEQ ID NO: 2701752 - RNA, 15 nt, Haemophilus influenzae Rd
aaagcaauauuuaga

SEQ ID NO: 2701753 - RNA, 14 nt, Haemophilus influenzae Rd
aaagcaaucccaag

SEQ ID NO: 2701754 - RNA, 20 nt, Haemophilus influenzae Rd
aaagcaauguaguuggcaua

SEQ ID NO: 2701755 - RNA, 23 nt, Haemophilus influenzae Rd
aaagcaauugccgacacuaaaaa

SEQ ID NO: 2701756 - RNA, 19 nt, Haemophilus influenzae Rd
aaagcaccuaaaauuuuua

SEQ ID NO: 2701757 - RNA, 22 nt, Haemophilus influenzae Rd
aaagcacuaugguguuacuuaa

SEQ ID NO: 2701758 - RNA, 14 nt, Haemophilus influenzae Rd
aaagcauaauauuc

SEQ ID NO: 2701759 - RNA, 16 nt, Haemophilus influenzae Rd
aaagcaugaauaaaaa

SEQ ID NO: 2701760 - RNA, 18 nt, Haemophilus influenzae Rd
aaagcauggauuuuucuu

SEQ ID NO: 2701761 - RNA, 14 nt, Haemophilus influenzae Rd
aaagcauuaaguuu

SEQ ID NO: 2701762 - RNA, 14 nt, Haemophilus influenzae Rd
aaagccaaugccaa

SEQ ID NO: 2701763 - RNA, 20 nt, Haemophilus influenzae Rd
aaagccaaugccaaaaccau

SEQ ID NO: 2701764 - RNA, 15 nt, Haemophilus influenzae Rd
aaagccauuuugcuc

SEQ ID NO: 2701765 - RNA, 19 nt, Haemophilus influenzae Rd
aaagccauuuugcucaaaa

SEQ ID NO: 2701766 - RNA, 17 nt, Haemophilus influenzae Rd
aaagccugcuacauuug

SEQ ID NO: 2701767 - RNA, 21 nt, Haemophilus influenzae Rd
aaagccuguugauguuuuaac

SEQ ID NO: 2701768 - RNA, 19 nt, Haemophilus influenzae Rd
aaagccuuauuguacucaa

SEQ ID NO: 2701769 - RNA, 19 nt, Haemophilus influenzae Rd
aaagccuugauuaucaagg

SEQ ID NO: 2701770 - RNA, 22 nt, Haemophilus influenzae Rd
aaagccuugauucuacugaaau

SEQ ID NO: 2701771 - RNA, 20 nt, Haemophilus influenzae Rd
aaagcgaaaucgcacucaca

SEQ ID NO: 2701772 - RNA, 15 nt, Haemophilus influenzae Rd
aaagcgaauuucuuu

SEQ ID NO: 2701773 - RNA, 17 nt, Haemophilus influenzae Rd
aaagcgaauuucuuuua

SEQ ID NO: 2701774 - RNA, 15 nt, Haemophilus influenzae Rd
aaagcgacauuuugu

SEQ ID NO: 2701775 - RNA, 15 nt, Haemophilus influenzae Rd
aaagcgagaauaguu

SEQ ID NO: 2701776 - RNA, 22 nt, Haemophilus influenzae Rd
aaagcgaguaagggcaaaaaau

SEQ ID NO: 2701777 - RNA, 16 nt, Haemophilus influenzae Rd
aaagcgugagccaaug

SEQ ID NO: 2701778 - RNA, 19 nt, Haemophilus influenzae Rd
aaagcgugagccaaugccu

SEQ ID NO: 2701779 - RNA, 14 nt, Haemophilus influenzae Rd
aaagcgugauuuuu

SEQ ID NO: 2701780 - RNA, 18 nt, Haemophilus influenzae Rd
aaaguuguuucauaagau

SEQ ID NO: 2701781 - RNA, 20 nt, Haemophilus influenzae Rd
aaaguuguuuugcuuuugca

SEQ ID NO: 2701782 - RNA, 14 nt, Haemophilus influenzae Rd
aaaguuuaacuuuc

SEQ ID NO: 2701783 - RNA, 12 nt, Haemophilus influenzae Rd
aaaguuugauaa

SEQ ID NO: 2701784 - RNA, 21 nt, Haemophilus influenzae Rd
aaaguuugcaacauauggaua

SEQ ID NO: 2701785 - RNA, 16 nt, Haemophilus influenzae Rd
aaaguuuuaaaccaag

SEQ ID NO: 2701786 - RNA, 19 nt, Haemophilus influenzae Rd
aaaguuuuccgacaacacu

SEQ ID NO: 2701787 - RNA, 10 nt, Haemophilus influenzae Rd
aaaguuuuuu

SEQ ID NO: 2701788 - RNA, 15 nt, Haemophilus influenzae Rd
aaaguuuuuucaaua

SEQ ID NO: 2701789 - RNA, 15 nt, Haemophilus influenzae Rd
aaauaaaaaauaaau

SEQ ID NO: 2701790 - RNA, 14 nt, Haemophilus influenzae Rd
aaauaaaaaauauu

SEQ ID NO: 2701791 - RNA, 15 nt, Haemophilus influenzae Rd
aaauaaaaaauccac

SEQ ID NO: 2701792 - RNA, 22 nt, Haemophilus influenzae Rd
aaauaaaaaauccacacuuuaa

SEQ ID NO: 2701793 - RNA, 22 nt, Haemophilus influenzae Rd
aaauaaaaacauugccaaagca

SEQ ID NO: 2701794 - RNA, 15 nt, Haemophilus influenzae Rd
aaauaaaaagugggu

SEQ ID NO: 2701795 - RNA, 12 nt, Haemophilus influenzae Rd
aaauaaaaccau

SEQ ID NO: 2701796 - RNA, 11 nt, Haemophilus influenzae Rd
aaauaaaauau

SEQ ID NO: 2701797 - RNA, 14 nt, Haemophilus influenzae Rd
aaauaaaauauuug

SEQ ID NO: 2701798 - RNA, 17 nt, Haemophilus influenzae Rd
aaauaaaauauuuuuua

SEQ ID NO: 2701799 - RNA, 13 nt, Haemophilus influenzae Rd
aaauaaaaugccg

SEQ ID NO: 2701800 - RNA, 20 nt, Haemophilus influenzae Rd
aaauaaaauucgcacacuuu

SEQ ID NO: 2701801 - RNA, 18 nt, Haemophilus influenzae Rd
aaauaaacaaacuuucau

SEQ ID NO: 2701802 - RNA, 20 nt, Haemophilus influenzae Rd
aaauaaacauuuuucauuuu

SEQ ID NO: 2701803 - RNA, 21 nt, Haemophilus influenzae Rd
aaauaaacgcaucaacuuuau

SEQ ID NO: 2701804 - RNA, 23 nt, Haemophilus influenzae Rd
aaauaaacgcaucaacuuuauca

SEQ ID NO: 2701805 - RNA, 17 nt, Haemophilus influenzae Rd
aaauaaacuacuucuaa

SEQ ID NO: 2701806 - RNA, 15 nt, Haemophilus influenzae Rd
aaauaaacucauuga

SEQ ID NO: 2701807 - RNA, 12 nt, Haemophilus influenzae Rd
aaauaaagaaga

SEQ ID NO: 2701808 - RNA, 21 nt, Haemophilus influenzae Rd
aaauaaagaagaaaaucuuua

SEQ ID NO: 2701809 - RNA, 14 nt, Haemophilus influenzae Rd
aaauaaagauuauu

SEQ ID NO: 2701810 - RNA, 13 nt, Haemophilus influenzae Rd
aaauaaagcauua

SEQ ID NO: 2701811 - RNA, 13 nt, Haemophilus influenzae Rd
aaauaaagcccug

SEQ ID NO: 2701812 - RNA, 14 nt, Haemophilus influenzae Rd
aaauaaauaaaaua

SEQ ID NO: 2701813 - RNA, 13 nt, Haemophilus influenzae Rd
aaauaaauaauag

SEQ ID NO: 2701814 - RNA, 18 nt, Haemophilus influenzae Rd
aaauaaaucacacaguua

SEQ ID NO: 2701815 - RNA, 23 nt, Haemophilus influenzae Rd
aaauaaauccuguuuauuuuuua

SEQ ID NO: 2701816 - RNA, 20 nt, Haemophilus influenzae Rd
aaauaaaugaugacagcuga

SEQ ID NO: 2701817 - RNA, 13 nt, Haemophilus influenzae Rd
aaauaaauuuauu

SEQ ID NO: 2701818 - RNA, 14 nt, Haemophilus influenzae Rd
aaauaaauuuggua

SEQ ID NO: 2701819 - RNA, 21 nt, Haemophilus influenzae Rd
aaauaaauuugguacauguug

SEQ ID NO: 2701820 - RNA, 17 nt, Haemophilus influenzae Rd
aaauaaauuuucaaauu

SEQ ID NO: 2701821 - RNA, 21 nt, Haemophilus influenzae Rd
aaauaaauuuucaaauugaaa

SEQ ID NO: 2701822 - RNA, 14 nt, Haemophilus influenzae Rd
aaauaacaauccua

SEQ ID NO: 2701823 - RNA, 15 nt, Haemophilus influenzae Rd
aaauaacacagaaac

SEQ ID NO: 2701824 - RNA, 16 nt, Haemophilus influenzae Rd
aaauaacacagaaacc

SEQ ID NO: 2701825 - RNA, 20 nt, Haemophilus influenzae Rd
aaauaacacagaaaccaaua

SEQ ID NO: 2701826 - RNA, 16 nt, Haemophilus influenzae Rd
aaauaacaucgcuaaa

SEQ ID NO: 2701827 - RNA, 22 nt, Haemophilus influenzae Rd
aaauaacaugguuaaaauauuc

SEQ ID NO: 2701828 - RNA, 14 nt, Haemophilus influenzae Rd
aaauaaccaauaua

SEQ ID NO: 2701829 - RNA, 21 nt, Haemophilus influenzae Rd
aaauaaccacuccaaauaaua

SEQ ID NO: 2701830 - RNA, 18 nt, Haemophilus influenzae Rd
aaauaacccuuacuuuau

SEQ ID NO: 2701831 - RNA, 18 nt, Haemophilus influenzae Rd
aaauaaccgcacuguaau

SEQ ID NO: 2701832 - RNA, 18 nt, Haemophilus influenzae Rd
aaauaaccgcacuucaau

SEQ ID NO: 2701833 - RNA, 18 nt, Haemophilus influenzae Rd
aaauaaccgcacuuuaau

SEQ ID NO: 2701834 - RNA, 18 nt, Haemophilus influenzae Rd
aaauaaccgcacuuuagu

SEQ ID NO: 2701835 - RNA, 19 nt, Haemophilus influenzae Rd
aaauaaccuaaaauauuua

SEQ ID NO: 2701836 - RNA, 14 nt, Haemophilus influenzae Rd
aaauaaccuagaac

SEQ ID NO: 2701837 - RNA, 18 nt, Haemophilus influenzae Rd
aaauaaccuagaacaaaa

SEQ ID NO: 2701838 - RNA, 19 nt, Haemophilus influenzae Rd
aaauaacgcaucaccacaa

SEQ ID NO: 2701839 - RNA, 16 nt, Haemophilus influenzae Rd
aaauaacguaaccauu

SEQ ID NO: 2701840 - RNA, 16 nt, Haemophilus influenzae Rd
aaauaacgucauuaau

SEQ ID NO: 2701841 - RNA, 20 nt, Haemophilus influenzae Rd
aaauaacgucauuaauuuuu

SEQ ID NO: 2701842 - RNA, 21 nt, Haemophilus influenzae Rd
aaauaacguuuuaaguuuuca

SEQ ID NO: 2701843 - RNA, 16 nt, Haemophilus influenzae Rd
aaauaacuucauccau

SEQ ID NO: 2701844 - RNA, 20 nt, Haemophilus influenzae Rd
aaauaagaggcauaacccac

SEQ ID NO: 2701845 - RNA, 17 nt, Haemophilus influenzae Rd
aaauaagcuaauuuuuc

SEQ ID NO: 2701846 - RNA, 19 nt, Haemophilus influenzae Rd
aaauaaggaucuuguaaag

SEQ ID NO: 2701847 - RNA, 16 nt, Haemophilus influenzae Rd
aaauaaguucaucaac

SEQ ID NO: 2701848 - RNA, 14 nt, Haemophilus influenzae Rd
aaauaauaaaucca

SEQ ID NO: 2701849 - RNA, 17 nt, Haemophilus influenzae Rd
aaauaauaaauccaaau

SEQ ID NO: 2701850 - RNA, 19 nt, Haemophilus influenzae Rd
aaauaauaauuagcuaaau

SEQ ID NO: 2701851 - RNA, 15 nt, Haemophilus influenzae Rd
aaauaauauucaaaa

SEQ ID NO: 2701852 - RNA, 14 nt, Haemophilus influenzae Rd
aaauaaucacuuga

SEQ ID NO: 2701853 - RNA, 17 nt, Haemophilus influenzae Rd
aaauaaucacuugauaa

SEQ ID NO: 2701854 - RNA, 20 nt, Haemophilus influenzae Rd
aaauaauccagauaacaaac

SEQ ID NO: 2701855 - RNA, 14 nt, Haemophilus influenzae Rd
aaauaaucucuucu

SEQ ID NO: 2701856 - RNA, 20 nt, Haemophilus influenzae Rd
aaauaaugagguauaaaaug

SEQ ID NO: 2701857 - RNA, 12 nt, Haemophilus influenzae Rd
aaauaaugcaaa

SEQ ID NO: 2701858 - RNA, 17 nt, Haemophilus influenzae Rd
aaauaaugcaaaaacaa

SEQ ID NO: 2701859 - RNA, 20 nt, Haemophilus influenzae Rd
aaauaaugcaaaaacaagug

SEQ ID NO: 2701860 - RNA, 16 nt, Haemophilus influenzae Rd
aaauaaugccucaucu

SEQ ID NO: 2701861 - RNA, 20 nt, Haemophilus influenzae Rd
aaauaaugccucaucuuuug

SEQ ID NO: 2701862 - RNA, 12 nt, Haemophilus influenzae Rd
aaauaauguuuu

SEQ ID NO: 2701863 - RNA, 12 nt, Haemophilus influenzae Rd
aaauaauuaaaa

SEQ ID NO: 2701864 - RNA, 19 nt, Haemophilus influenzae Rd
aaauaauuaaaaauaaaua

SEQ ID NO: 2701865 - RNA, 21 nt, Haemophilus influenzae Rd
aaauaauuaaggauuucuuau

SEQ ID NO: 2701866 - RNA, 17 nt, Haemophilus influenzae Rd
aaauaauucaagaugau

SEQ ID NO: 2701867 - RNA, 13 nt, Haemophilus influenzae Rd
aaauaauuuccuu

SEQ ID NO: 2701868 - RNA, 21 nt, Haemophilus influenzae Rd
aaauaauuuccuuuuuuauuu

SEQ ID NO: 2701869 - RNA, 20 nt, Haemophilus influenzae Rd
aaauaauuuuaggacuugug

SEQ ID NO: 2701870 - RNA, 19 nt, Haemophilus influenzae Rd
aaauaauuuucauugaaaa

SEQ ID NO: 2701871 - RNA, 15 nt, Haemophilus influenzae Rd
aaauacacaaaucac

SEQ ID NO: 2701872 - RNA, 13 nt, Haemophilus influenzae Rd
aaauacacuucua

SEQ ID NO: 2701873 - RNA, 22 nt, Haemophilus influenzae Rd
aaauacagugacaaauuuugca

SEQ ID NO: 2701874 - RNA, 19 nt, Haemophilus influenzae Rd
aaauacaucuucacaaaac

SEQ ID NO: 2701875 - RNA, 15 nt, Haemophilus influenzae Rd
aaauacauuauuaaa

SEQ ID NO: 2701876 - RNA, 16 nt, Haemophilus influenzae Rd
aaauacauuauuaaaa

SEQ ID NO: 2701877 - RNA, 18 nt, Haemophilus influenzae Rd
aaauacauuauuaaaagc

SEQ ID NO: 2701878 - RNA, 12 nt, Haemophilus influenzae Rd
aaauacauuuuu

SEQ ID NO: 2701879 - RNA, 13 nt, Haemophilus influenzae Rd
aaauacauuuuua

SEQ ID NO: 2701880 - RNA, 16 nt, Haemophilus influenzae Rd
aaauacauuuuuauag

SEQ ID NO: 2701881 - RNA, 12 nt, Haemophilus influenzae Rd
aaauaccaugga

SEQ ID NO: 2701882 - RNA, 16 nt, Haemophilus influenzae Rd
aaauaccccaauuaag

SEQ ID NO: 2701883 - RNA, 19 nt, Haemophilus influenzae Rd
aaauaccgcaccuuuccag

SEQ ID NO: 2701884 - RNA, 13 nt, Haemophilus influenzae Rd
aaauaccuucuug

SEQ ID NO: 2701885 - RNA, 23 nt, Haemophilus influenzae Rd
aaauaccuucuugauuauuuaau

SEQ ID NO: 2701886 - RNA, 18 nt, Haemophilus influenzae Rd
aaaucaccgcacuuuuau

SEQ ID NO: 2701887 - RNA, 19 nt, Haemophilus influenzae Rd
aaaucaccgcacuuuuugu

SEQ ID NO: 2701888 - RNA, 19 nt, Haemophilus influenzae Rd
aaaucaccuucaaguaauu

SEQ ID NO: 2701889 - RNA, 17 nt, Haemophilus influenzae Rd
aaaucacggaggaaugg

SEQ ID NO: 2701890 - RNA, 18 nt, Haemophilus influenzae Rd
aaaucacuuaauuucuua

SEQ ID NO: 2701891 - RNA, 13 nt, Haemophilus influenzae Rd
aaaucacuuucau

SEQ ID NO: 2701892 - RNA, 16 nt, Haemophilus influenzae Rd
aaaucagcaaauuguu

SEQ ID NO: 2701893 - RNA, 19 nt, Haemophilus influenzae Rd
aaaucagcccuuauuuuuu

SEQ ID NO: 2701894 - RNA, 18 nt, Haemophilus influenzae Rd
aaaucagcgcauuuuuua

SEQ ID NO: 2701895 - RNA, 23 nt, Haemophilus influenzae Rd
aaaucaguuauugauaaaaauau

SEQ ID NO: 2701896 - RNA, 23 nt, Haemophilus influenzae Rd
aaaucauaagcaauaauuucauu

SEQ ID NO: 2701897 - RNA, 19 nt, Haemophilus influenzae Rd
aaaucauaggcuucuuguu

SEQ ID NO: 2701898 - RNA, 15 nt, Haemophilus influenzae Rd
aaaucaucacaggaa

SEQ ID NO: 2701899 - RNA, 20 nt, Haemophilus influenzae Rd
aaaucaucggguaaauuuag

SEQ ID NO: 2701900 - RNA, 23 nt, Haemophilus influenzae Rd
aaaucaucguauuaaaagugcgg

SEQ ID NO: 2701901 - RNA, 21 nt, Haemophilus influenzae Rd
aaaucaucuaccacgauaaau

SEQ ID NO: 2701902 - RNA, 14 nt, Haemophilus influenzae Rd
aaaucaucuagcau

SEQ ID NO: 2701903 - RNA, 21 nt, Haemophilus influenzae Rd
aaaucauuauccaacauuaau

SEQ ID NO: 2701904 - RNA, 18 nt, Haemophilus influenzae Rd
aaaucauuuguaaguugu

SEQ ID NO: 2701905 - RNA, 14 nt, Haemophilus influenzae Rd
aaaucauuuuuugc

SEQ ID NO: 2701906 - RNA, 17 nt, Haemophilus influenzae Rd
aaaucauuuuuugcaaa

SEQ ID NO: 2701907 - RNA, 22 nt, Haemophilus influenzae Rd
aaauccaaccccauuugccaaa

SEQ ID NO: 2701908 - RNA, 22 nt, Haemophilus influenzae Rd
aaauccaaccgauaaggaaaau

SEQ ID NO: 2701909 - RNA, 17 nt, Haemophilus influenzae Rd
aaauccacacuuuaaua

SEQ ID NO: 2701910 - RNA, 20 nt, Haemophilus influenzae Rd
aaauccagacgcauucuuuc

SEQ ID NO: 2701911 - RNA, 19 nt, Haemophilus influenzae Rd
aaauccaucaauucuuccc

SEQ ID NO: 2701912 - RNA, 21 nt, Haemophilus influenzae Rd
aaauccaucaauucuucccaa

SEQ ID NO: 2701913 - RNA, 12 nt, Haemophilus influenzae Rd
aaaucccaaucu

SEQ ID NO: 2701914 - RNA, 16 nt, Haemophilus influenzae Rd
aaauccccccauuaca

SEQ ID NO: 2701915 - RNA, 14 nt, Haemophilus influenzae Rd
aaaucccuugacca

SEQ ID NO: 2701916 - RNA, 22 nt, Haemophilus influenzae Rd
aaauccgcacgcgugaugaaac

SEQ ID NO: 2701917 - RNA, 16 nt, Haemophilus influenzae Rd
aaauccguaaaauacg

SEQ ID NO: 2701918 - RNA, 11 nt, Haemophilus influenzae Rd
aaauccuaaau

SEQ ID NO: 2701919 - RNA, 14 nt, Haemophilus influenzae Rd
aaauccuacaacac

SEQ ID NO: 2701920 - RNA, 15 nt, Haemophilus influenzae Rd
aaauccucaucugaa

SEQ ID NO: 2701921 - RNA, 19 nt, Haemophilus influenzae Rd
aaauccugaagauuuuggu

SEQ ID NO: 2701922 - RNA, 20 nt, Haemophilus influenzae Rd
aaauccuguucagcuuuacu

SEQ ID NO: 2701923 - RNA, 21 nt, Haemophilus influenzae Rd
aaauccuguucagcuuuacuc

SEQ ID NO: 2701924 - RNA, 14 nt, Haemophilus influenzae Rd
aaauccuguuuauu

SEQ ID NO: 2701925 - RNA, 22 nt, Haemophilus influenzae Rd
aaauccuuaauuggggauaaau

SEQ ID NO: 2701926 - RNA, 17 nt, Haemophilus influenzae Rd
aaauccuucaggauaaa

SEQ ID NO: 2701927 - RNA, 15 nt, Haemophilus influenzae Rd
aaaucgaagaaauau

SEQ ID NO: 2701928 - RNA, 16 nt, Haemophilus influenzae Rd
aaaucgacauaacauu

SEQ ID NO: 2701929 - RNA, 22 nt, Haemophilus influenzae Rd
aaaucgaucacuuaauaaaaau

SEQ ID NO: 2701930 - RNA, 18 nt, Haemophilus influenzae Rd
aaaucgcaauauuaaaca

SEQ ID NO: 2701931 - RNA, 15 nt, Haemophilus influenzae Rd
aaaucgcaauuuuuu

SEQ ID NO: 2701932 - RNA, 20 nt, Haemophilus influenzae Rd
aaaucgcacucacaauacca

SEQ ID NO: 2701933 - RNA, 21 nt, Haemophilus influenzae Rd
aaaucgcacucacaauaccaa

SEQ ID NO: 2701934 - RNA, 23 nt, Haemophilus influenzae Rd
aaaucgcacucacaauaccaagu

SEQ ID NO: 2701935 - RNA, 17 nt, Haemophilus influenzae Rd
aaaucgccugacauuuu

SEQ ID NO: 2701936 - RNA, 19 nt, Haemophilus influenzae Rd
aaaucgcugggauuuuguc

SEQ ID NO: 2701937 - RNA, 23 nt, Haemophilus influenzae Rd
aaaucgcuugccagucauuuuuu

SEQ ID NO: 2701938 - RNA, 20 nt, Haemophilus influenzae Rd
aaaucggugcaacaauauca

SEQ ID NO: 2701939 - RNA, 15 nt, Haemophilus influenzae Rd
aaaucggugcgguaa

SEQ ID NO: 2701940 - RNA, 16 nt, Haemophilus influenzae Rd
aaaucguaauuaaaau

SEQ ID NO: 2701941 - RNA, 16 nt, Haemophilus influenzae Rd
aaaucguaauuuuaaa

SEQ ID NO: 2701942 - RNA, 22 nt, Haemophilus influenzae Rd
aaaucguacaucgaaaacauaa

SEQ ID NO: 2701943 - RNA, 16 nt, Haemophilus influenzae Rd
aaaucgucaaaaucau

SEQ ID NO: 2701944 - RNA, 14 nt, Haemophilus influenzae Rd
aaaucguuugauau

SEQ ID NO: 2701945 - RNA, 15 nt, Haemophilus influenzae Rd
aaaucguuugauaua

SEQ ID NO: 2701946 - RNA, 14 nt, Haemophilus influenzae Rd
aaaucuaaaaauau

SEQ ID NO: 2701947 - RNA, 13 nt, Haemophilus influenzae Rd
aaaucuaaugccu

SEQ ID NO: 2701948 - RNA, 17 nt, Haemophilus influenzae Rd
aaaucuaauuuugccau

SEQ ID NO: 2701949 - RNA, 15 nt, Haemophilus influenzae Rd
aaaucuacauuuuua

SEQ ID NO: 2701950 - RNA, 15 nt, Haemophilus influenzae Rd
aaaucuacuaaaaua

SEQ ID NO: 2701951 - RNA, 16 nt, Haemophilus influenzae Rd
aaaucuacuaaaauaa

SEQ ID NO: 2701952 - RNA, 17 nt, Haemophilus influenzae Rd
aaaucuacuaaaauaag

SEQ ID NO: 2701953 - RNA, 11 nt, Haemophilus influenzae Rd
aaaucuacuuu

SEQ ID NO: 2701954 - RNA, 13 nt, Haemophilus influenzae Rd
aaaucuacuuuau

SEQ ID NO: 2701955 - RNA, 14 nt, Haemophilus influenzae Rd
aaaucuacuuuauu

SEQ ID NO: 2701956 - RNA, 23 nt, Haemophilus influenzae Rd
aaaucuagagauuguaugaaaaa

SEQ ID NO: 2701957 - RNA, 16 nt, Haemophilus influenzae Rd
aaaucuauagauaaca

SEQ ID NO: 2701958 - RNA, 17 nt, Haemophilus influenzae Rd
aaaucuauagauaacac

SEQ ID NO: 2701959 - RNA, 18 nt, Haemophilus influenzae Rd
aaaucuauuccuuucuuu

SEQ ID NO: 2701960 - RNA, 15 nt, Haemophilus influenzae Rd
aaaucucaaaaucag

SEQ ID NO: 2701961 - RNA, 20 nt, Haemophilus influenzae Rd
aaaucuccaacuucauguuc

SEQ ID NO: 2701962 - RNA, 18 nt, Haemophilus influenzae Rd
aaaucucuaccacaguca

SEQ ID NO: 2701963 - RNA, 17 nt, Haemophilus influenzae Rd
aaaucucuggagaaaau

SEQ ID NO: 2701964 - RNA, 11 nt, Haemophilus influenzae Rd
aaaucucuugc

SEQ ID NO: 2701965 - RNA, 15 nt, Haemophilus influenzae Rd
aaaucucuugcucac

SEQ ID NO: 2701966 - RNA, 17 nt, Haemophilus influenzae Rd
aaaucugauucagaaaa

SEQ ID NO: 2701967 - RNA, 22 nt, Haemophilus influenzae Rd
aaaucugccaaugcuucuugcu

SEQ ID NO: 2701968 - RNA, 19 nt, Haemophilus influenzae Rd
aaaucugguggagaaaugu

SEQ ID NO: 2701969 - RNA, 21 nt, Haemophilus influenzae Rd
aaaucugugauauauaucaca

SEQ ID NO: 2701970 - RNA, 20 nt, Haemophilus influenzae Rd
aaaucugugcaaaguuacca

SEQ ID NO: 2701971 - RNA, 16 nt, Haemophilus influenzae Rd
aaaucuguuucauuug

SEQ ID NO: 2701972 - RNA, 20 nt, Haemophilus influenzae Rd
aaaucuuauuucaauauugu

SEQ ID NO: 2701973 - RNA, 12 nt, Haemophilus influenzae Rd
aaaucuucgcuc

SEQ ID NO: 2701974 - RNA, 15 nt, Haemophilus influenzae Rd
aaaucuucuaucuac

SEQ ID NO: 2701975 - RNA, 21 nt, Haemophilus influenzae Rd
aaaucuucuugaaaccuccca

SEQ ID NO: 2701976 - RNA, 20 nt, Haemophilus influenzae Rd
aaaucuucuuuaccaacuaa

SEQ ID NO: 2701977 - RNA, 15 nt, Haemophilus influenzae Rd
aaaucuugacauaau

SEQ ID NO: 2701978 - RNA, 16 nt, Haemophilus influenzae Rd
aaaucuugacauaauu

SEQ ID NO: 2701979 - RNA, 19 nt, Haemophilus influenzae Rd
aaaucuugguuuaaauuuu

SEQ ID NO: 2701980 - RNA, 20 nt, Haemophilus influenzae Rd
aaaucuugguuuaaauuuua

SEQ ID NO: 2701981 - RNA, 15 nt, Haemophilus influenzae Rd
aaaucuuuaccaaaa

SEQ ID NO: 2701982 - RNA, 12 nt, Haemophilus influenzae Rd
aaaucuuuaccu

SEQ ID NO: 2701983 - RNA, 23 nt, Haemophilus influenzae Rd
aaaucuuuggauugguguuuaaa

SEQ ID NO: 2701984 - RNA, 19 nt, Haemophilus influenzae Rd
aaaucuuuugaaagauuuu

SEQ ID NO: 2701985 - RNA, 15 nt, Haemophilus influenzae Rd
aaaugaaaacuaugc

SEQ ID NO: 2701986 - RNA, 18 nt, Haemophilus influenzae Rd
aaaugaaaacuaugcucu

SEQ ID NO: 2701987 - RNA, 24 nt, Haemophilus influenzae Rd
aaaugaaaacuaugcucuacuaaa

SEQ ID NO: 2701988 - RNA, 14 nt, Haemophilus influenzae Rd
aaaugaaauauuuu

SEQ ID NO: 2701989 - RNA, 16 nt, Haemophilus influenzae Rd
aaaugaaauauuuuua

SEQ ID NO: 2701990 - RNA, 13 nt, Haemophilus influenzae Rd
aaaugaaaugcaa

SEQ ID NO: 2701991 - RNA, 14 nt, Haemophilus influenzae Rd
aaauuaauuuaaca

SEQ ID NO: 2701992 - RNA, 13 nt, Haemophilus influenzae Rd
aaauuacauaaaa

SEQ ID NO: 2701993 - RNA, 14 nt, Haemophilus influenzae Rd
aaauuacauuuuuu

SEQ ID NO: 2701994 - RNA, 17 nt, Haemophilus influenzae Rd
aaauuaccacguucauu

SEQ ID NO: 2701995 - RNA, 19 nt, Haemophilus influenzae Rd
aaauuaccacguucauuuc

SEQ ID NO: 2701996 - RNA, 22 nt, Haemophilus influenzae Rd
aaauuaccacguucauuucgua

SEQ ID NO: 2701997 - RNA, 22 nt, Haemophilus influenzae Rd
aaauuacccaaaugaugaaaca

SEQ ID NO: 2701998 - RNA, 23 nt, Haemophilus influenzae Rd
aaauuacccaaaugaugaaacaa

SEQ ID NO: 2701999 - RNA, 15 nt, Haemophilus influenzae Rd
aaauuaccccaauuc

SEQ ID NO: 2702000 - RNA, 19 nt, Haemophilus influenzae Rd
aaauuaccuuguuuugcaa

SEQ ID NO: 2702001 - RNA, 19 nt, Haemophilus influenzae Rd
aaauuacgaccuuuacuuu

SEQ ID NO: 2702002 - RNA, 16 nt, Haemophilus influenzae Rd
aaauuacucaucugaa

SEQ ID NO: 2702003 - RNA, 22 nt, Haemophilus influenzae Rd
aaauuacucaucugaauuuaaa

SEQ ID NO: 2702004 - RNA, 22 nt, Haemophilus influenzae Rd
aaauuacuuggggcuaauuuuu

SEQ ID NO: 2702005 - RNA, 15 nt, Haemophilus influenzae Rd
aaauuagaauuuagu

SEQ ID NO: 2702006 - RNA, 15 nt, Haemophilus influenzae Rd
aaauuagacaaaaau

SEQ ID NO: 2702007 - RNA, 15 nt, Haemophilus influenzae Rd
aaauuagacuuucuu

SEQ ID NO: 2702008 - RNA, 19 nt, Haemophilus influenzae Rd
aaauuagccccaaauuacu

SEQ ID NO: 2702009 - RNA, 20 nt, Haemophilus influenzae Rd
aaauuagccccaaguaauuu

SEQ ID NO: 2702010 - RNA, 15 nt, Haemophilus influenzae Rd
aaauuagcgauuaaa

SEQ ID NO: 2702011 - RNA, 17 nt, Haemophilus influenzae Rd
aaauuagcguaaacauu

SEQ ID NO: 2702012 - RNA, 18 nt, Haemophilus influenzae Rd
aaauuagcguaaacauuu

SEQ ID NO: 2702013 - RNA, 23 nt, Haemophilus influenzae Rd
aaauuaguaguuagaauuuuaac

SEQ ID NO: 2702014 - RNA, 23 nt, Haemophilus influenzae Rd
aaauuaguuuuucgcugcagcug

SEQ ID NO: 2702015 - RNA, 15 nt, Haemophilus influenzae Rd
aaauuauaauauuua

SEQ ID NO: 2702016 - RNA, 16 nt, Haemophilus influenzae Rd
aaauuauagauaaaua

SEQ ID NO: 2702017 - RNA, 17 nt, Haemophilus influenzae Rd
aaauuauagauaaauau

SEQ ID NO: 2702018 - RNA, 15 nt, Haemophilus influenzae Rd
aaauuauauuuuccu

SEQ ID NO: 2702019 - RNA, 15 nt, Haemophilus influenzae Rd
aaauuauauuuuuaa

SEQ ID NO: 2702020 - RNA, 17 nt, Haemophilus influenzae Rd
aaauuaucaaaagaaaa

SEQ ID NO: 2702021 - RNA, 16 nt, Haemophilus influenzae Rd
aaauuaucaaagaauu

SEQ ID NO: 2702022 - RNA, 18 nt, Haemophilus influenzae Rd
aaauuaucaaagaauuuu

SEQ ID NO: 2702023 - RNA, 22 nt, Haemophilus influenzae Rd
aaauuaucaucauuuuuauuua

SEQ ID NO: 2702024 - RNA, 20 nt, Haemophilus influenzae Rd
aaauuaucguuuacuuaaaa

SEQ ID NO: 2702025 - RNA, 19 nt, Haemophilus influenzae Rd
aaauuaugcccaauuaccu

SEQ ID NO: 2702026 - RNA, 16 nt, Haemophilus influenzae Rd
aaauuauguacgguaa

SEQ ID NO: 2702027 - RNA, 21 nt, Haemophilus influenzae Rd
aaauuauguuaaauugcaaaa

SEQ ID NO: 2702028 - RNA, 19 nt, Haemophilus influenzae Rd
aaauuauguuuuaucuuua

SEQ ID NO: 2702029 - RNA, 22 nt, Haemophilus influenzae Rd
aaauuauucuucaucuucuuuu

SEQ ID NO: 2702030 - RNA, 17 nt, Haemophilus influenzae Rd
aaauuauugcauuuuua

SEQ ID NO: 2702031 - RNA, 14 nt, Haemophilus influenzae Rd
aaauuauuuauuua

SEQ ID NO: 2702032 - RNA, 16 nt, Haemophilus influenzae Rd
aaauuauuuauuuaau

SEQ ID NO: 2702033 - RNA, 12 nt, Haemophilus influenzae Rd
aaauucaaagau

SEQ ID NO: 2702034 - RNA, 18 nt, Haemophilus influenzae Rd
aaauucaaagauuauuua

SEQ ID NO: 2702035 - RNA, 18 nt, Haemophilus influenzae Rd
aaauucaaauacuuuacc

SEQ ID NO: 2702036 - RNA, 14 nt, Haemophilus influenzae Rd
aaauucaauagguu

SEQ ID NO: 2702037 - RNA, 15 nt, Haemophilus influenzae Rd
aaauucaauuuuccc

SEQ ID NO: 2702038 - RNA, 21 nt, Haemophilus influenzae Rd
aaauucaccgcacuuuucuuu

SEQ ID NO: 2702039 - RNA, 23 nt, Haemophilus influenzae Rd
aaauucaccgcacuuuuuacuuu

SEQ ID NO: 2702040 - RNA, 21 nt, Haemophilus influenzae Rd
aaauucacucaauucaaagaa

SEQ ID NO: 2702041 - RNA, 13 nt, Haemophilus influenzae Rd
aaauucacugaca

SEQ ID NO: 2702042 - RNA, 15 nt, Haemophilus influenzae Rd
aaauucacuguguuu

SEQ ID NO: 2702043 - RNA, 21 nt, Haemophilus influenzae Rd
aaauucaggcucuaacauacc

SEQ ID NO: 2702044 - RNA, 20 nt, Haemophilus influenzae Rd
aaauucaguaagaaaccaac

SEQ ID NO: 2702045 - RNA, 21 nt, Haemophilus influenzae Rd
aaauucaguaagaaaccaacu

SEQ ID NO: 2702046 - RNA, 22 nt, Haemophilus influenzae Rd
aaauucaguaagaaaccaacuu

SEQ ID NO: 2702047 - RNA, 19 nt, Haemophilus influenzae Rd
aaauucagugauuaagugc

SEQ ID NO: 2702048 - RNA, 20 nt, Haemophilus influenzae Rd
aaauucaguuaagaaaauaa

SEQ ID NO: 2702049 - RNA, 18 nt, Haemophilus influenzae Rd
aaauucauccaaagaaau

SEQ ID NO: 2702050 - RNA, 21 nt, Haemophilus influenzae Rd
aaauucaucguaauuaaacaa

SEQ ID NO: 2702051 - RNA, 22 nt, Haemophilus influenzae Rd
aaauucaucguaauuaaacaaa

SEQ ID NO: 2702052 - RNA, 13 nt, Haemophilus influenzae Rd
aaauucauuauua

SEQ ID NO: 2702053 - RNA, 15 nt, Haemophilus influenzae Rd
aaauucauucuugcu

SEQ ID NO: 2702054 - RNA, 15 nt, Haemophilus influenzae Rd
aaauucauugacuuc

SEQ ID NO: 2702055 - RNA, 14 nt, Haemophilus influenzae Rd
aaauucauuuuuua

SEQ ID NO: 2702056 - RNA, 17 nt, Haemophilus influenzae Rd
aaauuccaguucuccuu

SEQ ID NO: 2702057 - RNA, 17 nt, Haemophilus influenzae Rd
aaauuccauucacuuuc

SEQ ID NO: 2702058 - RNA, 17 nt, Haemophilus influenzae Rd
aaauuccgcaauauuua

SEQ ID NO: 2702059 - RNA, 19 nt, Haemophilus influenzae Rd
aaauuccuuccaacaauuu

SEQ ID NO: 2702060 - RNA, 23 nt, Haemophilus influenzae Rd
aaauucgacgauaaccaucuguu

SEQ ID NO: 2702061 - RNA, 20 nt, Haemophilus influenzae Rd
aaauucgauugcauuuuuua

SEQ ID NO: 2702062 - RNA, 18 nt, Haemophilus influenzae Rd
aaauucguacaaaugaaa

SEQ ID NO: 2702063 - RNA, 21 nt, Haemophilus influenzae Rd
aaauucguacuuuugauuuau

SEQ ID NO: 2702064 - RNA, 12 nt, Haemophilus influenzae Rd
aaauucuaaaac

SEQ ID NO: 2702065 - RNA, 23 nt, Haemophilus influenzae Rd
aaauucuacgccauuuucuaccg

SEQ ID NO: 2702066 - RNA, 20 nt, Haemophilus influenzae Rd
aaauucuacgucaaagccau

SEQ ID NO: 2702067 - RNA, 16 nt, Haemophilus influenzae Rd
aaauucuauuaaaaua

SEQ ID NO: 2702068 - RNA, 17 nt, Haemophilus influenzae Rd
aaauucuauuaaaauau

SEQ ID NO: 2702069 - RNA, 16 nt, Haemophilus influenzae Rd
aaauucucaagaauau

SEQ ID NO: 2702070 - RNA, 20 nt, Haemophilus influenzae Rd
aaauucucgccauaauaaaa

SEQ ID NO: 2702071 - RNA, 20 nt, Haemophilus influenzae Rd
aaauucucggcaaugguuca

SEQ ID NO: 2702072 - RNA, 18 nt, Haemophilus influenzae Rd
aaauucucuguuucuuua

SEQ ID NO: 2702073 - RNA, 22 nt, Haemophilus influenzae Rd
aaauucugagaucgaaauuagg

SEQ ID NO: 2702074 - RNA, 11 nt, Haemophilus influenzae Rd
aaauucugcuu

SEQ ID NO: 2702075 - RNA, 20 nt, Haemophilus influenzae Rd
aaauucuuugccuugaugcu

SEQ ID NO: 2702076 - RNA, 13 nt, Haemophilus influenzae Rd
aaauucuuuuauu

SEQ ID NO: 2702077 - RNA, 17 nt, Haemophilus influenzae Rd
aaauucuuuuauuuuaa

SEQ ID NO: 2702078 - RNA, 18 nt, Haemophilus influenzae Rd
aaauucuuuuuucuuccu

SEQ ID NO: 2702079 - RNA, 21 nt, Haemophilus influenzae Rd
aaauucuuuuuucuuccuaug

SEQ ID NO: 2702080 - RNA, 24 nt, Haemophilus influenzae Rd
aaauugaagccgaugaaagcuauu

SEQ ID NO: 2702081 - RNA, 17 nt, Haemophilus influenzae Rd
aaauugacaauguuuua

SEQ ID NO: 2702082 - RNA, 20 nt, Haemophilus influenzae Rd
aaauugacggcuucagaaaa

SEQ ID NO: 2702083 - RNA, 23 nt, Haemophilus influenzae Rd
aaauugacuugcacaauuacuuc

SEQ ID NO: 2702084 - RNA, 14 nt, Haemophilus influenzae Rd
aaauugagauaacg

SEQ ID NO: 2702085 - RNA, 17 nt, Haemophilus influenzae Rd
aaauugagaucaaaaau

SEQ ID NO: 2702086 - RNA, 15 nt, Haemophilus influenzae Rd
aaauugauaccaaga

SEQ ID NO: 2702087 - RNA, 15 nt, Haemophilus influenzae Rd
aaauugaugaaaauu

SEQ ID NO: 2702088 - RNA, 15 nt, Haemophilus influenzae Rd
aaauugauucauuug

SEQ ID NO: 2702089 - RNA, 24 nt, Haemophilus influenzae Rd
aaauugcaaaaaugcaaaguaacu

SEQ ID NO: 2702090 - RNA, 17 nt, Haemophilus influenzae Rd
aaauugcaccuucuuuu

SEQ ID NO: 2702091 - RNA, 22 nt, Haemophilus influenzae Rd
aaauugccauauaagcaaagaa

SEQ ID NO: 2702092 - RNA, 19 nt, Haemophilus influenzae Rd
aaauugccccuucaccuuu

SEQ ID NO: 2702093 - RNA, 20 nt, Haemophilus influenzae Rd
aaauugccccuucaccuuuu

SEQ ID NO: 2702094 - RNA, 21 nt, Haemophilus influenzae Rd
aaauugcccguagcacuggca

SEQ ID NO: 2702095 - RNA, 17 nt, Haemophilus influenzae Rd
aacaaagucaauacaca

SEQ ID NO: 2702096 - RNA, 15 nt, Haemophilus influenzae Rd
aacaaagucaauuuu

SEQ ID NO: 2702097 - RNA, 12 nt, Haemophilus influenzae Rd
aacaaagugcgg

SEQ ID NO: 2702098 - RNA, 17 nt, Haemophilus influenzae Rd
aacaaauaaaucauagg

SEQ ID NO: 2702099 - RNA, 17 nt, Haemophilus influenzae Rd
aacaaauaggauaaaaa

SEQ ID NO: 2702100 - RNA, 19 nt, Haemophilus influenzae Rd
aacaaauauuccacaucac

SEQ ID NO: 2702101 - RNA, 21 nt, Haemophilus influenzae Rd
aacaaauauuccacaucacuu

SEQ ID NO: 2702102 - RNA, 17 nt, Haemophilus influenzae Rd
aacaaaugauuagaagu

SEQ ID NO: 2702103 - RNA, 17 nt, Haemophilus influenzae Rd
aacaaaugucgaaauuu

SEQ ID NO: 2702104 - RNA, 18 nt, Haemophilus influenzae Rd
aacaaaugucgaaauuuu

SEQ ID NO: 2702105 - RNA, 14 nt, Haemophilus influenzae Rd
aacaaauuacagaa

SEQ ID NO: 2702106 - RNA, 11 nt, Haemophilus influenzae Rd
aacaaauuuca

SEQ ID NO: 2702107 - RNA, 17 nt, Haemophilus influenzae Rd
aacaaauuucacguagu

SEQ ID NO: 2702108 - RNA, 23 nt, Haemophilus influenzae Rd
aacaacaacgcaucuuuauaaca

SEQ ID NO: 2702109 - RNA, 19 nt, Haemophilus influenzae Rd
aacaacaucuuguuuuaau

SEQ ID NO: 2702110 - RNA, 12 nt, Haemophilus influenzae Rd
aacaaccacauu

SEQ ID NO: 2702111 - RNA, 14 nt, Haemophilus influenzae Rd
aacaaccacauuca

SEQ ID NO: 2702112 - RNA, 15 nt, Haemophilus influenzae Rd
aacaaccacauucaa

SEQ ID NO: 2702113 - RNA, 19 nt, Haemophilus influenzae Rd
aacaaccagcgcaccacac

SEQ ID NO: 2702114 - RNA, 22 nt, Haemophilus influenzae Rd
aacaacgcaucuuuauaacaua

SEQ ID NO: 2702115 - RNA, 10 nt, Haemophilus influenzae Rd
aacaacugcu

SEQ ID NO: 2702116 - RNA, 13 nt, Haemophilus influenzae Rd
aacaacuuuucua

SEQ ID NO: 2702117 - RNA, 14 nt, Haemophilus influenzae Rd
aacaagaaauuuug

SEQ ID NO: 2702118 - RNA, 14 nt, Haemophilus influenzae Rd
aacaagaaccgccg

SEQ ID NO: 2702119 - RNA, 20 nt, Haemophilus influenzae Rd
aacaagcacccauuugccaa

SEQ ID NO: 2702120 - RNA, 12 nt, Haemophilus influenzae Rd
aacaagcauuuu

SEQ ID NO: 2702121 - RNA, 15 nt, Haemophilus influenzae Rd
aacaagccccacagg

SEQ ID NO: 2702122 - RNA, 16 nt, Haemophilus influenzae Rd
aacaagcgcaaguucu

SEQ ID NO: 2702123 - RNA, 20 nt, Haemophilus influenzae Rd
aacaagcgcaaguucuucau

SEQ ID NO: 2702124 - RNA, 21 nt, Haemophilus influenzae Rd
aacaagcgcaaguucuucauu

SEQ ID NO: 2702125 - RNA, 16 nt, Haemophilus influenzae Rd
aacaagcuuauguaaa

SEQ ID NO: 2702126 - RNA, 21 nt, Haemophilus influenzae Rd
aacaaggaaucgaaauuaaaa

SEQ ID NO: 2702127 - RNA, 22 nt, Haemophilus influenzae Rd
aacaaggaaucgaaauuaaaau

SEQ ID NO: 2702128 - RNA, 15 nt, Haemophilus influenzae Rd
aacaaguaaaucaac

SEQ ID NO: 2702129 - RNA, 21 nt, Haemophilus influenzae Rd
aacaagugguggaauaaaagu

SEQ ID NO: 2702130 - RNA, 17 nt, Haemophilus influenzae Rd
aacaaguuucuaaaauc

SEQ ID NO: 2702131 - RNA, 19 nt, Haemophilus influenzae Rd
aacaauaacugccacauca

SEQ ID NO: 2702132 - RNA, 11 nt, Haemophilus influenzae Rd
aacaauaaugu

SEQ ID NO: 2702133 - RNA, 14 nt, Haemophilus influenzae Rd
aacaauaaugugag

SEQ ID NO: 2702134 - RNA, 22 nt, Haemophilus influenzae Rd
aacaauaaugugagaauaacca

SEQ ID NO: 2702135 - RNA, 18 nt, Haemophilus influenzae Rd
aacaauacucuuaacaaa

SEQ ID NO: 2702136 - RNA, 21 nt, Haemophilus influenzae Rd
aacaauacucuuaacaaaaca

SEQ ID NO: 2702137 - RNA, 12 nt, Haemophilus influenzae Rd
aacaauaucauu

SEQ ID NO: 2702138 - RNA, 22 nt, Haemophilus influenzae Rd
aacaauauuaggaauagcaaga

SEQ ID NO: 2702139 - RNA, 20 nt, Haemophilus influenzae Rd
aacaauauuucacuauucag

SEQ ID NO: 2702140 - RNA, 17 nt, Haemophilus influenzae Rd
aacaaucacugaaaaau

SEQ ID NO: 2702141 - RNA, 19 nt, Haemophilus influenzae Rd
aacaaucacuguaucuuuu

SEQ ID NO: 2702142 - RNA, 18 nt, Haemophilus influenzae Rd
aacaaucccaggcuuaau

SEQ ID NO: 2702143 - RNA, 15 nt, Haemophilus influenzae Rd
aacaaugcggagaaa

SEQ ID NO: 2702144 - RNA, 19 nt, Haemophilus influenzae Rd
aacaaugcggagaaaagca

SEQ ID NO: 2702145 - RNA, 13 nt, Haemophilus influenzae Rd
aacaauguagaaa

SEQ ID NO: 2702146 - RNA, 21 nt, Haemophilus influenzae Rd
aacaauguaguuucuucuuuc

SEQ ID NO: 2702147 - RNA, 14 nt, Haemophilus influenzae Rd
aacaauuacugcaa

SEQ ID NO: 2702148 - RNA, 13 nt, Haemophilus influenzae Rd
aacaauuccccuu

SEQ ID NO: 2702149 - RNA, 12 nt, Haemophilus influenzae Rd
aacaauuuuugc

SEQ ID NO: 2702150 - RNA, 22 nt, Haemophilus influenzae Rd
aacaauuuuugcauuuucaggg

SEQ ID NO: 2702151 - RNA, 22 nt, Haemophilus influenzae Rd
aacacaaacugguuaaaaucca

SEQ ID NO: 2702152 - RNA, 21 nt, Haemophilus influenzae Rd
aacacaacauagcugaaaaau

SEQ ID NO: 2702153 - RNA, 22 nt, Haemophilus influenzae Rd
aacacaacauagcugaaaaaua

SEQ ID NO: 2702154 - RNA, 22 nt, Haemophilus influenzae Rd
aacacaaucgguaacaguuuug

SEQ ID NO: 2702155 - RNA, 14 nt, Haemophilus influenzae Rd
aacacaauuaauaa

SEQ ID NO: 2702156 - RNA, 13 nt, Haemophilus influenzae Rd
aacacaccaacaa

SEQ ID NO: 2702157 - RNA, 14 nt, Haemophilus influenzae Rd
aacacaccaacaac

SEQ ID NO: 2702158 - RNA, 18 nt, Haemophilus influenzae Rd
aacacaccuauuuuuucc

SEQ ID NO: 2702159 - RNA, 18 nt, Haemophilus influenzae Rd
aacacagacuaaauucag

SEQ ID NO: 2702160 - RNA, 23 nt, Haemophilus influenzae Rd
aacacagagcacacaagguugua

SEQ ID NO: 2702161 - RNA, 15 nt, Haemophilus influenzae Rd
aacacagauuuuuac

SEQ ID NO: 2702162 - RNA, 15 nt, Haemophilus influenzae Rd
aacacagcagcuaaa

SEQ ID NO: 2702163 - RNA, 17 nt, Haemophilus influenzae Rd
aacacaguuauuuuuua

SEQ ID NO: 2702164 - RNA, 12 nt, Haemophilus influenzae Rd
aacacaucgcuu

SEQ ID NO: 2702165 - RNA, 17 nt, Haemophilus influenzae Rd
aacaccaaacagagugc

SEQ ID NO: 2702166 - RNA, 15 nt, Haemophilus influenzae Rd
aacaccauugagcau

SEQ ID NO: 2702167 - RNA, 23 nt, Haemophilus influenzae Rd
aacaccauugagcauuuuuuauu

SEQ ID NO: 2702168 - RNA, 18 nt, Haemophilus influenzae Rd
aacacccaaucuggauug

SEQ ID NO: 2702169 - RNA, 22 nt, Haemophilus influenzae Rd
aacaccgagaugcauuuuuuaa

SEQ ID NO: 2702170 - RNA, 17 nt, Haemophilus influenzae Rd
aacaccuaauaucaagu

SEQ ID NO: 2702171 - RNA, 18 nt, Haemophilus influenzae Rd
aacaccuccagcaaaagc

SEQ ID NO: 2702172 - RNA, 20 nt, Haemophilus influenzae Rd
aacaccuuucggugcuuacu

SEQ ID NO: 2702173 - RNA, 14 nt, Haemophilus influenzae Rd
aacacgaaaccaac

SEQ ID NO: 2702174 - RNA, 20 nt, Haemophilus influenzae Rd
aacacgaaaccaacgaaaau

SEQ ID NO: 2702175 - RNA, 22 nt, Haemophilus influenzae Rd
aacacgaaaccaacgaaaauag

SEQ ID NO: 2702176 - RNA, 20 nt, Haemophilus influenzae Rd
aacacgccaccauuuguaau

SEQ ID NO: 2702177 - RNA, 15 nt, Haemophilus influenzae Rd
aacacgccuaacaua

SEQ ID NO: 2702178 - RNA, 21 nt, Haemophilus influenzae Rd
aacacguccgcaaccagcaga

SEQ ID NO: 2702179 - RNA, 15 nt, Haemophilus influenzae Rd
aacacuccaacacca

SEQ ID NO: 2702180 - RNA, 17 nt, Haemophilus influenzae Rd
aacacucuaucuaaaau

SEQ ID NO: 2702181 - RNA, 19 nt, Haemophilus influenzae Rd
aacacucuaucuaaaauau

SEQ ID NO: 2702182 - RNA, 12 nt, Haemophilus influenzae Rd
aacacugccaau

SEQ ID NO: 2702183 - RNA, 14 nt, Haemophilus influenzae Rd
aacacuguaaauaa

SEQ ID NO: 2702184 - RNA, 22 nt, Haemophilus influenzae Rd
aacacuuaaauaguuaauugau

SEQ ID NO: 2702185 - RNA, 16 nt, Haemophilus influenzae Rd
aacacuugcagcccaa

SEQ ID NO: 2702186 - RNA, 20 nt, Haemophilus influenzae Rd
aacacuugguucgcuucauu

SEQ ID NO: 2702187 - RNA, 22 nt, Haemophilus influenzae Rd
aacacuugguucgcuucauuau

SEQ ID NO: 2702188 - RNA, 15 nt, Haemophilus influenzae Rd
aacacuuuuucacga

SEQ ID NO: 2702189 - RNA, 14 nt, Haemophilus influenzae Rd
aacacuuuuucuau

SEQ ID NO: 2702190 - RNA, 19 nt, Haemophilus influenzae Rd
aacacuuuuucuauuuuuu

SEQ ID NO: 2702191 - RNA, 20 nt, Haemophilus influenzae Rd
aacacuuuuucuauuuuuuc

SEQ ID NO: 2702192 - RNA, 18 nt, Haemophilus influenzae Rd
aacagaaaucauuucaau

SEQ ID NO: 2702193 - RNA, 17 nt, Haemophilus influenzae Rd
aacagagaaaaaaauag

SEQ ID NO: 2702194 - RNA, 18 nt, Haemophilus influenzae Rd
aacagagaaaaaaauagu

SEQ ID NO: 2702195 - RNA, 15 nt, Haemophilus influenzae Rd
aacagaucgugauau

SEQ ID NO: 2702196 - RNA, 21 nt, Haemophilus influenzae Rd
aacagaucgugauauuucacu

SEQ ID NO: 2702197 - RNA, 13 nt, Haemophilus influenzae Rd
aacagccaaacaa

SEQ ID NO: 2702198 - RNA, 18 nt, Haemophilus influenzae Rd
aacagccauggcuuuuuc

SEQ ID NO: 2702199 - RNA, 23 nt, Haemophilus influenzae Rd
aacagccauggcuuuuuccugau

SEQ ID NO: 2702200 - RNA, 21 nt, Haemophilus influenzae Rd
aaccauaucguaaccaucaga

SEQ ID NO: 2702201 - RNA, 14 nt, Haemophilus influenzae Rd
aaccauaucugaaa

SEQ ID NO: 2702202 - RNA, 23 nt, Haemophilus influenzae Rd
aaccauauuaaucgcaauaacac

SEQ ID NO: 2702203 - RNA, 18 nt, Haemophilus influenzae Rd
aaccaucccagucaaaaa

SEQ ID NO: 2702204 - RNA, 19 nt, Haemophilus influenzae Rd
aaccaucccuuuuuacauu

SEQ ID NO: 2702205 - RNA, 19 nt, Haemophilus influenzae Rd
aaccaucucgaauucguuu

SEQ ID NO: 2702206 - RNA, 15 nt, Haemophilus influenzae Rd
aaccaucuucaacga

SEQ ID NO: 2702207 - RNA, 17 nt, Haemophilus influenzae Rd
aaccaucuuuaauucca

SEQ ID NO: 2702208 - RNA, 20 nt, Haemophilus influenzae Rd
aaccaucuuuaauuccaacu

SEQ ID NO: 2702209 - RNA, 15 nt, Haemophilus influenzae Rd
aaccauugaugaaau

SEQ ID NO: 2702210 - RNA, 22 nt, Haemophilus influenzae Rd
aaccauuguuuaauucgugcca

SEQ ID NO: 2702211 - RNA, 18 nt, Haemophilus influenzae Rd
aacccaggaguaaccaca

SEQ ID NO: 2702212 - RNA, 14 nt, Haemophilus influenzae Rd
aacccaguuuuaaa

SEQ ID NO: 2702213 - RNA, 20 nt, Haemophilus influenzae Rd
aacccaucauaaauaugggu

SEQ ID NO: 2702214 - RNA, 14 nt, Haemophilus influenzae Rd
aacccauuacuaaa

SEQ ID NO: 2702215 - RNA, 16 nt, Haemophilus influenzae Rd
aacccauuuauuuaaa

SEQ ID NO: 2702216 - RNA, 18 nt, Haemophilus influenzae Rd
aaccccguuuuuuagaaa

SEQ ID NO: 2702217 - RNA, 22 nt, Haemophilus influenzae Rd
aaccccugaauuuuguaccaac

SEQ ID NO: 2702218 - RNA, 15 nt, Haemophilus influenzae Rd
aacccguaauuaaaa

SEQ ID NO: 2702219 - RNA, 22 nt, Haemophilus influenzae Rd
aaccgaauauaugguucauuau

SEQ ID NO: 2702220 - RNA, 21 nt, Haemophilus influenzae Rd
aaccgacuuugucaauauaaa

SEQ ID NO: 2702221 - RNA, 17 nt, Haemophilus influenzae Rd
aaccgauuuuaaauucu

SEQ ID NO: 2702222 - RNA, 20 nt, Haemophilus influenzae Rd
aaccgcacuuaauaaauauu

SEQ ID NO: 2702223 - RNA, 15 nt, Haemophilus influenzae Rd
aaccgcacuuuaaau

SEQ ID NO: 2702224 - RNA, 18 nt, Haemophilus influenzae Rd
aaccgcacuuuaaauauu

SEQ ID NO: 2702225 - RNA, 15 nt, Haemophilus influenzae Rd
aaccgcacuuuuaau

SEQ ID NO: 2702226 - RNA, 16 nt, Haemophilus influenzae Rd
aaccgcacuuuuauau

SEQ ID NO: 2702227 - RNA, 16 nt, Haemophilus influenzae Rd
aaccgcacuuuuuaau

SEQ ID NO: 2702228 - RNA, 23 nt, Haemophilus influenzae Rd
aaccgcacuuuuuaauaaaaugu

SEQ ID NO: 2702229 - RNA, 15 nt, Haemophilus influenzae Rd
aaccgcacuuuuuau

SEQ ID NO: 2702230 - RNA, 15 nt, Haemophilus influenzae Rd
aaccgcaucaaaauu

SEQ ID NO: 2702231 - RNA, 13 nt, Haemophilus influenzae Rd
aaccgcauuacuu

SEQ ID NO: 2702232 - RNA, 14 nt, Haemophilus influenzae Rd
aaccgccuuugaua

SEQ ID NO: 2702233 - RNA, 12 nt, Haemophilus influenzae Rd
aaccgcuuuuau

SEQ ID NO: 2702234 - RNA, 14 nt, Haemophilus influenzae Rd
aaccgcuuuuaugc

SEQ ID NO: 2702235 - RNA, 18 nt, Haemophilus influenzae Rd
aaccguggcauaauuugg

SEQ ID NO: 2702236 - RNA, 14 nt, Haemophilus influenzae Rd
aaccuaaacgauca

SEQ ID NO: 2702237 - RNA, 16 nt, Haemophilus influenzae Rd
aaccuaaacgcugacg

SEQ ID NO: 2702238 - RNA, 18 nt, Haemophilus influenzae Rd
aaccuaacguagauagca

SEQ ID NO: 2702239 - RNA, 23 nt, Haemophilus influenzae Rd
aaccuaauuguucagcaauuucu

SEQ ID NO: 2702240 - RNA, 19 nt, Haemophilus influenzae Rd
aaccuacauuaaucaccau

SEQ ID NO: 2702241 - RNA, 17 nt, Haemophilus influenzae Rd
aaccuaccggaaaccag

SEQ ID NO: 2702242 - RNA, 13 nt, Haemophilus influenzae Rd
aaccuaugauuau

SEQ ID NO: 2702243 - RNA, 19 nt, Haemophilus influenzae Rd
aaccuaugauuauagauuu

SEQ ID NO: 2702244 - RNA, 15 nt, Haemophilus influenzae Rd
aaccuauuagaauuu

SEQ ID NO: 2702245 - RNA, 16 nt, Haemophilus influenzae Rd
aaccucagaagaaauu

SEQ ID NO: 2702246 - RNA, 18 nt, Haemophilus influenzae Rd
aaccucccaaaaacuaaa

SEQ ID NO: 2702247 - RNA, 23 nt, Haemophilus influenzae Rd
aaccucccaaaaacuaaauauuc

SEQ ID NO: 2702248 - RNA, 20 nt, Haemophilus influenzae Rd
aaccucgccuuguaauugau

SEQ ID NO: 2702249 - RNA, 15 nt, Haemophilus influenzae Rd
aaccugaguaaauaa

SEQ ID NO: 2702250 - RNA, 20 nt, Haemophilus influenzae Rd
aaccugauaaguagaaaaau

SEQ ID NO: 2702251 - RNA, 21 nt, Haemophilus influenzae Rd
aaccugauaaguagaaaaauu

SEQ ID NO: 2702252 - RNA, 21 nt, Haemophilus influenzae Rd
aaccuguacguuaucugacac

SEQ ID NO: 2702253 - RNA, 17 nt, Haemophilus influenzae Rd
aaccugucgcaaugaag

SEQ ID NO: 2702254 - RNA, 12 nt, Haemophilus influenzae Rd
aaccuguuggau

SEQ ID NO: 2702255 - RNA, 21 nt, Haemophilus influenzae Rd
aaccuguugguuguucaguau

SEQ ID NO: 2702256 - RNA, 12 nt, Haemophilus influenzae Rd
aaccuuaaauca

SEQ ID NO: 2702257 - RNA, 20 nt, Haemophilus influenzae Rd
aaccuuaacgaguugauuaa

SEQ ID NO: 2702258 - RNA, 16 nt, Haemophilus influenzae Rd
aaccuuauuuuaaaua

SEQ ID NO: 2702259 - RNA, 17 nt, Haemophilus influenzae Rd
aaccuugcugauaaauu

SEQ ID NO: 2702260 - RNA, 22 nt, Haemophilus influenzae Rd
aaccuuggucggaauguaaaau

SEQ ID NO: 2702261 - RNA, 15 nt, Haemophilus influenzae Rd
aaccuuguaaagcac

SEQ ID NO: 2702262 - RNA, 15 nt, Haemophilus influenzae Rd
aaccuuguccgccac

SEQ ID NO: 2702263 - RNA, 20 nt, Haemophilus influenzae Rd
aaccuuguuccaggaaaauu

SEQ ID NO: 2702264 - RNA, 19 nt, Haemophilus influenzae Rd
aaccuuuagacaacaacuu

SEQ ID NO: 2702265 - RNA, 22 nt, Haemophilus influenzae Rd
aaccuuucauauaaauaagaau

SEQ ID NO: 2702266 - RNA, 19 nt, Haemophilus influenzae Rd
aaccuuucuguaaauaugc

SEQ ID NO: 2702267 - RNA, 13 nt, Haemophilus influenzae Rd
aaccuuuuucuaa

SEQ ID NO: 2702268 - RNA, 17 nt, Haemophilus influenzae Rd
aaccuuuuucuuccauu

SEQ ID NO: 2702269 - RNA, 22 nt, Haemophilus influenzae Rd
aaccuuuuucuuccauuucaau

SEQ ID NO: 2702270 - RNA, 16 nt, Haemophilus influenzae Rd
aacgaaaaaaauaaaa

SEQ ID NO: 2702271 - RNA, 19 nt, Haemophilus influenzae Rd
aacgaaaaaaauaaaaaau

SEQ ID NO: 2702272 - RNA, 13 nt, Haemophilus influenzae Rd
aacgaacaauuuc

SEQ ID NO: 2702273 - RNA, 14 nt, Haemophilus influenzae Rd
aacgaacaauuucu

SEQ ID NO: 2702274 - RNA, 12 nt, Haemophilus influenzae Rd
aacgaagaaaca

SEQ ID NO: 2702275 - RNA, 18 nt, Haemophilus influenzae Rd
aacgaccuugcaaauuuu

SEQ ID NO: 2702276 - RNA, 19 nt, Haemophilus influenzae Rd
aacgacgcacuguugugaa

SEQ ID NO: 2702277 - RNA, 16 nt, Haemophilus influenzae Rd
aacgacgccaaauaug

SEQ ID NO: 2702278 - RNA, 20 nt, Haemophilus influenzae Rd
aacgacgccacuguugugaa

SEQ ID NO: 2702279 - RNA, 18 nt, Haemophilus influenzae Rd
aacgacgguauaaaccuu

SEQ ID NO: 2702280 - RNA, 22 nt, Haemophilus influenzae Rd
aacgacgguauaaaccuugcau

SEQ ID NO: 2702281 - RNA, 18 nt, Haemophilus influenzae Rd
aacgagguuggcaauaaa

SEQ ID NO: 2702282 - RNA, 20 nt, Haemophilus influenzae Rd
aacgaugaagaaaauuucug

SEQ ID NO: 2702283 - RNA, 19 nt, Haemophilus influenzae Rd
aacgauuucgugcaauaac

SEQ ID NO: 2702284 - RNA, 20 nt, Haemophilus influenzae Rd
aacgauuucgugcaauaaca

SEQ ID NO: 2702285 - RNA, 17 nt, Haemophilus influenzae Rd
aacgcaaacuacaacuu

SEQ ID NO: 2702286 - RNA, 20 nt, Haemophilus influenzae Rd
aacgcaagcugugcaagcau

SEQ ID NO: 2702287 - RNA, 21 nt, Haemophilus influenzae Rd
aacgcaagcugugcaagcauu

SEQ ID NO: 2702288 - RNA, 18 nt, Haemophilus influenzae Rd
aacgcacguaacaaaugc

SEQ ID NO: 2702289 - RNA, 22 nt, Haemophilus influenzae Rd
aacgcacuugauuugcuuggaa

SEQ ID NO: 2702290 - RNA, 15 nt, Haemophilus influenzae Rd
aacgcauaauuugcu

SEQ ID NO: 2702291 - RNA, 19 nt, Haemophilus influenzae Rd
aacgcauauuuuguucuac

SEQ ID NO: 2702292 - RNA, 13 nt, Haemophilus influenzae Rd
aacgcaucuauug

SEQ ID NO: 2702293 - RNA, 14 nt, Haemophilus influenzae Rd
aacgcaucuauugu

SEQ ID NO: 2702294 - RNA, 19 nt, Haemophilus influenzae Rd
aacgcaucuuuauaacaua

SEQ ID NO: 2702295 - RNA, 17 nt, Haemophilus influenzae Rd
aacgcauucaaaucuaa

SEQ ID NO: 2702296 - RNA, 21 nt, Haemophilus influenzae Rd
aacgcauucuccguaaaaauc

SEQ ID NO: 2702297 - RNA, 21 nt, Haemophilus influenzae Rd
aacgcauuguuacaaauuccu

SEQ ID NO: 2702298 - RNA, 18 nt, Haemophilus influenzae Rd
aacgccacgcuuugucag

SEQ ID NO: 2702299 - RNA, 22 nt, Haemophilus influenzae Rd
aacgccacgcuuugucaguggu

SEQ ID NO: 2702300 - RNA, 20 nt, Haemophilus influenzae Rd
aacgccagaaguuguuuuuc

SEQ ID NO: 2702301 - RNA, 20 nt, Haemophilus influenzae Rd
aacgccaucaaccauaacaa

SEQ ID NO: 2702302 - RNA, 13 nt, Haemophilus influenzae Rd
aacgcccuucuuu

SEQ ID NO: 2702303 - RNA, 18 nt, Haemophilus influenzae Rd
aacgcccuucuuugauau

SEQ ID NO: 2702304 - RNA, 20 nt, Haemophilus influenzae Rd
aacgcccuucuuugauauaa

SEQ ID NO: 2702305 - RNA, 14 nt, Haemophilus influenzae Rd
aacucacauaaagu

SEQ ID NO: 2702306 - RNA, 16 nt, Haemophilus influenzae Rd
aacucacauugccauu

SEQ ID NO: 2702307 - RNA, 18 nt, Haemophilus influenzae Rd
aacucacuaaauuaggaa

SEQ ID NO: 2702308 - RNA, 21 nt, Haemophilus influenzae Rd
aacucauccaaucaucagaau

SEQ ID NO: 2702309 - RNA, 22 nt, Haemophilus influenzae Rd
aacucauccaaucaucagaaua

SEQ ID NO: 2702310 - RNA, 12 nt, Haemophilus influenzae Rd
aacucauuacac

SEQ ID NO: 2702311 - RNA, 17 nt, Haemophilus influenzae Rd
aacucauuacacaaaau

SEQ ID NO: 2702312 - RNA, 19 nt, Haemophilus influenzae Rd
aacucauuacacaaaauau

SEQ ID NO: 2702313 - RNA, 22 nt, Haemophilus influenzae Rd
aacuccguccaaucuaauucuu

SEQ ID NO: 2702314 - RNA, 17 nt, Haemophilus influenzae Rd
aacucgaacaugaaguu

SEQ ID NO: 2702315 - RNA, 13 nt, Haemophilus influenzae Rd
aacucgaauagaa

SEQ ID NO: 2702316 - RNA, 23 nt, Haemophilus influenzae Rd
aacucggcuuuuucaauacuuuu

SEQ ID NO: 2702317 - RNA, 15 nt, Haemophilus influenzae Rd
aacucuaagcuuaau

SEQ ID NO: 2702318 - RNA, 21 nt, Haemophilus influenzae Rd
aacucuaagcuuaauauguuc

SEQ ID NO: 2702319 - RNA, 17 nt, Haemophilus influenzae Rd
aacucugguucaaaaug

SEQ ID NO: 2702320 - RNA, 23 nt, Haemophilus influenzae Rd
aacucuuggcuaacuucuuccac

SEQ ID NO: 2702321 - RNA, 23 nt, Haemophilus influenzae Rd
aacucuugugccaaauucauucu

SEQ ID NO: 2702322 - RNA, 16 nt, Haemophilus influenzae Rd
aacucuuucaccauua

SEQ ID NO: 2702323 - RNA, 12 nt, Haemophilus influenzae Rd
aacugaaaauua

SEQ ID NO: 2702324 - RNA, 17 nt, Haemophilus influenzae Rd
aacugaaaauucaucau

SEQ ID NO: 2702325 - RNA, 18 nt, Haemophilus influenzae Rd
aacugaaaauucaucauu

SEQ ID NO: 2702326 - RNA, 13 nt, Haemophilus influenzae Rd
aacugaagcaauc

SEQ ID NO: 2702327 - RNA, 22 nt, Haemophilus influenzae Rd
aacugaauucucaauugcagau

SEQ ID NO: 2702328 - RNA, 15 nt, Haemophilus influenzae Rd
aacugaguuuucacg

SEQ ID NO: 2702329 - RNA, 15 nt, Haemophilus influenzae Rd
aacugaugauggcca

SEQ ID NO: 2702330 - RNA, 21 nt, Haemophilus influenzae Rd
aacugauuagggugcagauuu

SEQ ID NO: 2702331 - RNA, 23 nt, Haemophilus influenzae Rd
aacugauuuuguuuucuuuuuuu

SEQ ID NO: 2702332 - RNA, 15 nt, Haemophilus influenzae Rd
aacugcaacaauuuc

SEQ ID NO: 2702333 - RNA, 14 nt, Haemophilus influenzae Rd
aacugccaaacaaa

SEQ ID NO: 2702334 - RNA, 21 nt, Haemophilus influenzae Rd
aacugccacuaauaagccgcc

SEQ ID NO: 2702335 - RNA, 16 nt, Haemophilus influenzae Rd
aacugccgccuucuuc

SEQ ID NO: 2702336 - RNA, 12 nt, Haemophilus influenzae Rd
aacugcuuuaau

SEQ ID NO: 2702337 - RNA, 15 nt, Haemophilus influenzae Rd
aacugcuuucuucca

SEQ ID NO: 2702338 - RNA, 22 nt, Haemophilus influenzae Rd
aacuggguuuuuuuauuuuuau

SEQ ID NO: 2702339 - RNA, 17 nt, Haemophilus influenzae Rd
aacugugcggucuguug

SEQ ID NO: 2702340 - RNA, 19 nt, Haemophilus influenzae Rd
aacuguucuucugggauug

SEQ ID NO: 2702341 - RNA, 21 nt, Haemophilus influenzae Rd
aacuguuuuggcauuuucaau

SEQ ID NO: 2702342 - RNA, 22 nt, Haemophilus influenzae Rd
aacuuaaacaagcucuagaaaa

SEQ ID NO: 2702343 - RNA, 15 nt, Haemophilus influenzae Rd
aacuuaaauuuuuau

SEQ ID NO: 2702344 - RNA, 22 nt, Haemophilus influenzae Rd
aacuuaccuaaaaauuuaaaua

SEQ ID NO: 2702345 - RNA, 21 nt, Haemophilus influenzae Rd
aacuuacuacguguucaucau

SEQ ID NO: 2702346 - RNA, 23 nt, Haemophilus influenzae Rd
aacuuacuacguguucaucaucg

SEQ ID NO: 2702347 - RNA, 13 nt, Haemophilus influenzae Rd
aacuuagaaaaua

SEQ ID NO: 2702348 - RNA, 15 nt, Haemophilus influenzae Rd
aacuuagaaaauauc

SEQ ID NO: 2702349 - RNA, 17 nt, Haemophilus influenzae Rd
aacuuagcccuuaaacu

SEQ ID NO: 2702350 - RNA, 15 nt, Haemophilus influenzae Rd
aacuuagucucuuua

SEQ ID NO: 2702351 - RNA, 17 nt, Haemophilus influenzae Rd
aacuuagucucuuuauu

SEQ ID NO: 2702352 - RNA, 16 nt, Haemophilus influenzae Rd
aacuuauaaagauauu

SEQ ID NO: 2702353 - RNA, 16 nt, Haemophilus influenzae Rd
aacuuaucauuaaucu

SEQ ID NO: 2702354 - RNA, 20 nt, Haemophilus influenzae Rd
aacuuaucauuaaucuuaua

SEQ ID NO: 2702355 - RNA, 16 nt, Haemophilus influenzae Rd
aacuuaucuaaaaaga

SEQ ID NO: 2702356 - RNA, 19 nt, Haemophilus influenzae Rd
aacuuaucuaaaaagauuu

SEQ ID NO: 2702357 - RNA, 15 nt, Haemophilus influenzae Rd
aacuuaugaauaaua

SEQ ID NO: 2702358 - RNA, 16 nt, Haemophilus influenzae Rd
aacuuaugaauaauaa

SEQ ID NO: 2702359 - RNA, 17 nt, Haemophilus influenzae Rd
aacuuauuuggaacagu

SEQ ID NO: 2702360 - RNA, 16 nt, Haemophilus influenzae Rd
aacuucaaccacuuca

SEQ ID NO: 2702361 - RNA, 22 nt, Haemophilus influenzae Rd
aacuucacuuuucgcaauuuua

SEQ ID NO: 2702362 - RNA, 18 nt, Haemophilus influenzae Rd
aacuucauccauuuucga

SEQ ID NO: 2702363 - RNA, 19 nt, Haemophilus influenzae Rd
aacuucggaagaaaaagac

SEQ ID NO: 2702364 - RNA, 13 nt, Haemophilus influenzae Rd
aacuucuaaaaaa

SEQ ID NO: 2702365 - RNA, 19 nt, Haemophilus influenzae Rd
aacuucuauguuugcauca

SEQ ID NO: 2702366 - RNA, 14 nt, Haemophilus influenzae Rd
aacuucugcugcac

SEQ ID NO: 2702367 - RNA, 14 nt, Haemophilus influenzae Rd
aacuugaauaccug

SEQ ID NO: 2702368 - RNA, 22 nt, Haemophilus influenzae Rd
aacuugacguuguucuucuguu

SEQ ID NO: 2702369 - RNA, 22 nt, Haemophilus influenzae Rd
aacuugauauaaguucuaaaua

SEQ ID NO: 2702370 - RNA, 20 nt, Haemophilus influenzae Rd
aacuugauugauaaauugac

SEQ ID NO: 2702371 - RNA, 15 nt, Haemophilus influenzae Rd
aacuugcaaaccaac

SEQ ID NO: 2702372 - RNA, 15 nt, Haemophilus influenzae Rd
aacuugccagcagaa

SEQ ID NO: 2702373 - RNA, 12 nt, Haemophilus influenzae Rd
aacuugcucugg

SEQ ID NO: 2702374 - RNA, 13 nt, Haemophilus influenzae Rd
aacuuggaaugca

SEQ ID NO: 2702375 - RNA, 21 nt, Haemophilus influenzae Rd
aacuugguguaauuugaugcu

SEQ ID NO: 2702376 - RNA, 22 nt, Haemophilus influenzae Rd
aacuuuacggauaauuucccua

SEQ ID NO: 2702377 - RNA, 11 nt, Haemophilus influenzae Rd
aacuuucaaaa

SEQ ID NO: 2702378 - RNA, 13 nt, Haemophilus influenzae Rd
aacuuucaaaaua

SEQ ID NO: 2702379 - RNA, 21 nt, Haemophilus influenzae Rd
aacuuucacaacuaccacagg

SEQ ID NO: 2702380 - RNA, 23 nt, Haemophilus influenzae Rd
aacuuuccaccccagaauuaaga

SEQ ID NO: 2702381 - RNA, 15 nt, Haemophilus influenzae Rd
aacuuuccuacuaua

SEQ ID NO: 2702382 - RNA, 19 nt, Haemophilus influenzae Rd
aacuuucgcguaauaacaa

SEQ ID NO: 2702383 - RNA, 14 nt, Haemophilus influenzae Rd
aacuuugugccauu

SEQ ID NO: 2702384 - RNA, 18 nt, Haemophilus influenzae Rd
aacuuuguucauuuuuac

SEQ ID NO: 2702385 - RNA, 20 nt, Haemophilus influenzae Rd
aacuuuuaaaacacgcccuu

SEQ ID NO: 2702386 - RNA, 12 nt, Haemophilus influenzae Rd
aacuuuucuaaa

SEQ ID NO: 2702387 - RNA, 17 nt, Haemophilus influenzae Rd
aacuuuugcaaaauugc

SEQ ID NO: 2702388 - RNA, 23 nt, Haemophilus influenzae Rd
aacuuuuuuauaaucuuuaaauu

SEQ ID NO: 2702389 - RNA, 22 nt, Haemophilus influenzae Rd
aagaaaaacgccucaucuuuuu

SEQ ID NO: 2702390 - RNA, 14 nt, Haemophilus influenzae Rd
aagaaaaaggcagu

SEQ ID NO: 2702391 - RNA, 12 nt, Haemophilus influenzae Rd
aagaaaaccaaa

SEQ ID NO: 2702392 - RNA, 17 nt, Haemophilus influenzae Rd
aagaaaaccaaaacaua

SEQ ID NO: 2702393 - RNA, 19 nt, Haemophilus influenzae Rd
aagaaaaccaaaacauaag

SEQ ID NO: 2702394 - RNA, 21 nt, Haemophilus influenzae Rd
aagaaaaguuuuauauuuuuu

SEQ ID NO: 2702395 - RNA, 21 nt, Haemophilus influenzae Rd
aagaaaauaauauaagugauu

SEQ ID NO: 2702396 - RNA, 15 nt, Haemophilus influenzae Rd
aagaaaauacaauau

SEQ ID NO: 2702397 - RNA, 13 nt, Haemophilus influenzae Rd
aagaaaauacaua

SEQ ID NO: 2702398 - RNA, 16 nt, Haemophilus influenzae Rd
aagaaaauacauaauu

SEQ ID NO: 2702399 - RNA, 19 nt, Haemophilus influenzae Rd
aagaaaauagaaagaauau

SEQ ID NO: 2702400 - RNA, 23 nt, Haemophilus influenzae Rd
aagaaaauagaaagaauauuuaa

SEQ ID NO: 2702401 - RNA, 20 nt, Haemophilus influenzae Rd
aagaaaauauuuaacuaauu

SEQ ID NO: 2702402 - RNA, 18 nt, Haemophilus influenzae Rd
aagaaacgccuacaucuu

SEQ ID NO: 2702403 - RNA, 16 nt, Haemophilus influenzae Rd
aagaaacguaaacaaa

SEQ ID NO: 2702404 - RNA, 21 nt, Haemophilus influenzae Rd
aagaaacguaaacaaaauacc

SEQ ID NO: 2702405 - RNA, 15 nt, Haemophilus influenzae Rd
aagaaacguuuugga

SEQ ID NO: 2702406 - RNA, 17 nt, Haemophilus influenzae Rd
aagaaagaaauauaaua

SEQ ID NO: 2702407 - RNA, 21 nt, Haemophilus influenzae Rd
aagaaagaaauauaauaaaua

SEQ ID NO: 2702408 - RNA, 15 nt, Haemophilus influenzae Rd
aagaaagcaugaaua

SEQ ID NO: 2702409 - RNA, 18 nt, Haemophilus influenzae Rd
aagaaagcaugaauaaaa

SEQ ID NO: 2702410 - RNA, 19 nt, Haemophilus influenzae Rd
aagaugaagcuaagaaaau

SEQ ID NO: 2702411 - RNA, 21 nt, Haemophilus influenzae Rd
aagaugaagcuaagaaaaucc

SEQ ID NO: 2702412 - RNA, 17 nt, Haemophilus influenzae Rd
aagaugacgaaaugaaa

SEQ ID NO: 2702413 - RNA, 18 nt, Haemophilus influenzae Rd
aagaugacgaaaugaaau

SEQ ID NO: 2702414 - RNA, 17 nt, Haemophilus influenzae Rd
aagaugaggcguuuuuc

SEQ ID NO: 2702415 - RNA, 23 nt, Haemophilus influenzae Rd
aagaugaggcguuuuucuuaaau

SEQ ID NO: 2702416 - RNA, 14 nt, Haemophilus influenzae Rd
aagaugauaaauuc

SEQ ID NO: 2702417 - RNA, 16 nt, Haemophilus influenzae Rd
aagaugauauuuaaua

SEQ ID NO: 2702418 - RNA, 19 nt, Haemophilus influenzae Rd
aagaugugauauuaaacag

SEQ ID NO: 2702419 - RNA, 21 nt, Haemophilus influenzae Rd
aagauguuguaaaaucucuau

SEQ ID NO: 2702420 - RNA, 14 nt, Haemophilus influenzae Rd
aagauuaaucuuuu

SEQ ID NO: 2702421 - RNA, 18 nt, Haemophilus influenzae Rd
aagauuaaugauaaguuu

SEQ ID NO: 2702422 - RNA, 15 nt, Haemophilus influenzae Rd
aagauuaauuuuccu

SEQ ID NO: 2702423 - RNA, 21 nt, Haemophilus influenzae Rd
aagauuagagccaucacguuc

SEQ ID NO: 2702424 - RNA, 22 nt, Haemophilus influenzae Rd
aagauugaccucguggcaaaag

SEQ ID NO: 2702425 - RNA, 13 nt, Haemophilus influenzae Rd
aagauuguccuuu

SEQ ID NO: 2702426 - RNA, 21 nt, Haemophilus influenzae Rd
aagauuguuuuuucauauuuu

SEQ ID NO: 2702427 - RNA, 14 nt, Haemophilus influenzae Rd
aagauuuaaaacaa

SEQ ID NO: 2702428 - RNA, 16 nt, Haemophilus influenzae Rd
aagauuuaaaacaaga

SEQ ID NO: 2702429 - RNA, 17 nt, Haemophilus influenzae Rd
aagauuuacagaacaaa

SEQ ID NO: 2702430 - RNA, 18 nt, Haemophilus influenzae Rd
aagauuuacagaacaaaa

SEQ ID NO: 2702431 - RNA, 17 nt, Haemophilus influenzae Rd
aagauuuauauuccauu

SEQ ID NO: 2702432 - RNA, 15 nt, Haemophilus influenzae Rd
aagauuuauguugaa

SEQ ID NO: 2702433 - RNA, 20 nt, Haemophilus influenzae Rd
aagauuuauguugaauuuuc

SEQ ID NO: 2702434 - RNA, 22 nt, Haemophilus influenzae Rd
aagauuuauguugaauuuucac

SEQ ID NO: 2702435 - RNA, 17 nt, Haemophilus influenzae Rd
aagauuuauuccugcuu

SEQ ID NO: 2702436 - RNA, 16 nt, Haemophilus influenzae Rd
aagauuugauuuuuau

SEQ ID NO: 2702437 - RNA, 13 nt, Haemophilus influenzae Rd
aagauuugccaaa

SEQ ID NO: 2702438 - RNA, 22 nt, Haemophilus influenzae Rd
aagauuugccaaaaucacgcca

SEQ ID NO: 2702439 - RNA, 14 nt, Haemophilus influenzae Rd
aagauuugcugcug

SEQ ID NO: 2702440 - RNA, 18 nt, Haemophilus influenzae Rd
aagauuuuaaaauuuauu

SEQ ID NO: 2702441 - RNA, 14 nt, Haemophilus influenzae Rd
aagauuuuaugaaa

SEQ ID NO: 2702442 - RNA, 12 nt, Haemophilus influenzae Rd
aagauuuucucg

SEQ ID NO: 2702443 - RNA, 22 nt, Haemophilus influenzae Rd
aagauuuucucgugugaaauua

SEQ ID NO: 2702444 - RNA, 21 nt, Haemophilus influenzae Rd
aagauuuuuaaccgcacuuuu

SEQ ID NO: 2702445 - RNA, 20 nt, Haemophilus influenzae Rd
aagauuuuucuugcuauucu

SEQ ID NO: 2702446 - RNA, 21 nt, Haemophilus influenzae Rd
aagauuuuucuugcuauucuu

SEQ ID NO: 2702447 - RNA, 20 nt, Haemophilus influenzae Rd
aagauuuuugauaaaaaaga

SEQ ID NO: 2702448 - RNA, 19 nt, Haemophilus influenzae Rd
aagauuuuuugaaucucau

SEQ ID NO: 2702449 - RNA, 12 nt, Haemophilus influenzae Rd
aagcaaaaccau

SEQ ID NO: 2702450 - RNA, 16 nt, Haemophilus influenzae Rd
aagcaaacagcaauaa

SEQ ID NO: 2702451 - RNA, 21 nt, Haemophilus influenzae Rd
aagcaaacagcaauaaauaau

SEQ ID NO: 2702452 - RNA, 22 nt, Haemophilus influenzae Rd
aagcaaacagcaauaaauaaua

SEQ ID NO: 2702453 - RNA, 16 nt, Haemophilus influenzae Rd
aagcaaauagcgagua

SEQ ID NO: 2702454 - RNA, 18 nt, Haemophilus influenzae Rd
aagcaaauggcaucaaua

SEQ ID NO: 2702455 - RNA, 12 nt, Haemophilus influenzae Rd
aagcaacaauau

SEQ ID NO: 2702456 - RNA, 11 nt, Haemophilus influenzae Rd
aagcaacacag

SEQ ID NO: 2702457 - RNA, 12 nt, Haemophilus influenzae Rd
aagcaacacaga

SEQ ID NO: 2702458 - RNA, 20 nt, Haemophilus influenzae Rd
aagcaaguaauuuaaaaagu

SEQ ID NO: 2702459 - RNA, 20 nt, Haemophilus influenzae Rd
aagcaaguuugcgaucauca

SEQ ID NO: 2702460 - RNA, 15 nt, Haemophilus influenzae Rd
aagcaauaaacaaag

SEQ ID NO: 2702461 - RNA, 19 nt, Haemophilus influenzae Rd
aagcaauagaacgcacaca

SEQ ID NO: 2702462 - RNA, 22 nt, Haemophilus influenzae Rd
aagcaauagaacgcacacaaca

SEQ ID NO: 2702463 - RNA, 19 nt, Haemophilus influenzae Rd
aagcaauagauucuaaggu

SEQ ID NO: 2702464 - RNA, 18 nt, Haemophilus influenzae Rd
aagcaaucaaaaaugaaa

SEQ ID NO: 2702465 - RNA, 16 nt, Haemophilus influenzae Rd
aagcaauccuaagaau

SEQ ID NO: 2702466 - RNA, 18 nt, Haemophilus influenzae Rd
aagcaaugcuuuaaucau

SEQ ID NO: 2702467 - RNA, 14 nt, Haemophilus influenzae Rd
aagcaauugaauaa

SEQ ID NO: 2702468 - RNA, 14 nt, Haemophilus influenzae Rd
aagcaauuucacga

SEQ ID NO: 2702469 - RNA, 17 nt, Haemophilus influenzae Rd
aagcaauuucacgauuu

SEQ ID NO: 2702470 - RNA, 14 nt, Haemophilus influenzae Rd
aagcaauuuucugc

SEQ ID NO: 2702471 - RNA, 13 nt, Haemophilus influenzae Rd
aagcacaaggggu

SEQ ID NO: 2702472 - RNA, 19 nt, Haemophilus influenzae Rd
aagcacaggcguaauuaag

SEQ ID NO: 2702473 - RNA, 15 nt, Haemophilus influenzae Rd
aagcacauuaaucau

SEQ ID NO: 2702474 - RNA, 16 nt, Haemophilus influenzae Rd
aagcaccaaagcaaaa

SEQ ID NO: 2702475 - RNA, 16 nt, Haemophilus influenzae Rd
aagcaccagucaaggu

SEQ ID NO: 2702476 - RNA, 18 nt, Haemophilus influenzae Rd
aagcacccauuugccaag

SEQ ID NO: 2702477 - RNA, 17 nt, Haemophilus influenzae Rd
aagcaccuaaaaauuuu

SEQ ID NO: 2702478 - RNA, 16 nt, Haemophilus influenzae Rd
aagcacgauuuucaau

SEQ ID NO: 2702479 - RNA, 17 nt, Haemophilus influenzae Rd
aagcacguuucaucagc

SEQ ID NO: 2702480 - RNA, 14 nt, Haemophilus influenzae Rd
aagcacugaaauau

SEQ ID NO: 2702481 - RNA, 21 nt, Haemophilus influenzae Rd
aagcacugaggcuaauaauaa

SEQ ID NO: 2702482 - RNA, 19 nt, Haemophilus influenzae Rd
aagcacuuuauuuaauuca

SEQ ID NO: 2702483 - RNA, 20 nt, Haemophilus influenzae Rd
aagcacuuuauuuaauucac

SEQ ID NO: 2702484 - RNA, 14 nt, Haemophilus influenzae Rd
aagcacuuuuccuu

SEQ ID NO: 2702485 - RNA, 21 nt, Haemophilus influenzae Rd
aagcagcuggcgguuugaaau

SEQ ID NO: 2702486 - RNA, 16 nt, Haemophilus influenzae Rd
aagcaguuaaacagcu

SEQ ID NO: 2702487 - RNA, 14 nt, Haemophilus influenzae Rd
aagcauauuugcaa

SEQ ID NO: 2702488 - RNA, 18 nt, Haemophilus influenzae Rd
aagcaucaaaccaaaauc

SEQ ID NO: 2702489 - RNA, 21 nt, Haemophilus influenzae Rd
aagcauccaucgacauacaaa

SEQ ID NO: 2702490 - RNA, 16 nt, Haemophilus influenzae Rd
aagcaugaauaaaaau

SEQ ID NO: 2702491 - RNA, 18 nt, Haemophilus influenzae Rd
aagcauguggcucuguua

SEQ ID NO: 2702492 - RNA, 13 nt, Haemophilus influenzae Rd
aagcauuaaaaau

SEQ ID NO: 2702493 - RNA, 21 nt, Haemophilus influenzae Rd
aagcauuaaauaccgcuugaa

SEQ ID NO: 2702494 - RNA, 23 nt, Haemophilus influenzae Rd
aagcauuacggcaggaaugaaag

SEQ ID NO: 2702495 - RNA, 23 nt, Haemophilus influenzae Rd
aagcauugcuggugcaauuugau

SEQ ID NO: 2702496 - RNA, 18 nt, Haemophilus influenzae Rd
aagcauuuuaucacaagu

SEQ ID NO: 2702497 - RNA, 12 nt, Haemophilus influenzae Rd
aagcauuuugaa

SEQ ID NO: 2702498 - RNA, 18 nt, Haemophilus influenzae Rd
aagccaaaaccuagaaau

SEQ ID NO: 2702499 - RNA, 22 nt, Haemophilus influenzae Rd
aagccaaggcgauuaaucgaag

SEQ ID NO: 2702500 - RNA, 18 nt, Haemophilus influenzae Rd
aagccaauagauuacgua

SEQ ID NO: 2702501 - RNA, 19 nt, Haemophilus influenzae Rd
aagccaaucauugcuaaac

SEQ ID NO: 2702502 - RNA, 15 nt, Haemophilus influenzae Rd
aagccaaugccaaaa

SEQ ID NO: 2702503 - RNA, 22 nt, Haemophilus influenzae Rd
aagccaaugcggcuauggcagc

SEQ ID NO: 2702504 - RNA, 18 nt, Haemophilus influenzae Rd
aagccacugugcauuaaa

SEQ ID NO: 2702505 - RNA, 23 nt, Haemophilus influenzae Rd
aagccacuugcuguuaagaccaa

SEQ ID NO: 2702506 - RNA, 19 nt, Haemophilus influenzae Rd
aagccauacgcgaugcauu

SEQ ID NO: 2702507 - RNA, 20 nt, Haemophilus influenzae Rd
aagccauauucuuucgccaa

SEQ ID NO: 2702508 - RNA, 19 nt, Haemophilus influenzae Rd
aagccauuaacauuuaaca

SEQ ID NO: 2702509 - RNA, 12 nt, Haemophilus influenzae Rd
aagccauuuucu

SEQ ID NO: 2702510 - RNA, 16 nt, Haemophilus influenzae Rd
aagcccugcguuauau

SEQ ID NO: 2702511 - RNA, 17 nt, Haemophilus influenzae Rd
aagccgaagaagauaau

SEQ ID NO: 2702512 - RNA, 22 nt, Haemophilus influenzae Rd
aagccuacgcuaccuaauacgu

SEQ ID NO: 2702513 - RNA, 23 nt, Haemophilus influenzae Rd
aagccucugcagggaaaaauuuu

SEQ ID NO: 2702514 - RNA, 17 nt, Haemophilus influenzae Rd
aagccugcaaagccuuc

SEQ ID NO: 2702515 - RNA, 14 nt, Haemophilus influenzae Rd
aagguuaaauucac

SEQ ID NO: 2702516 - RNA, 18 nt, Haemophilus influenzae Rd
aagguucgauaguauuuu

SEQ ID NO: 2702517 - RNA, 21 nt, Haemophilus influenzae Rd
aagguuuaguggguaaaccaa

SEQ ID NO: 2702518 - RNA, 22 nt, Haemophilus influenzae Rd
aagguuuaguggguaaaccaaa

SEQ ID NO: 2702519 - RNA, 18 nt, Haemophilus influenzae Rd
aagguuuccauaauguuc

SEQ ID NO: 2702520 - RNA, 21 nt, Haemophilus influenzae Rd
aagguuucgauauuaauacuu

SEQ ID NO: 2702521 - RNA, 22 nt, Haemophilus influenzae Rd
aagguuuggacaccuuuuuccu

SEQ ID NO: 2702522 - RNA, 17 nt, Haemophilus influenzae Rd
aagguuuuaauuuuguc

SEQ ID NO: 2702523 - RNA, 16 nt, Haemophilus influenzae Rd
aagguuuuauuuugaa

SEQ ID NO: 2702524 - RNA, 23 nt, Haemophilus influenzae Rd
aagguuuuauuuugaacaauguc

SEQ ID NO: 2702525 - RNA, 12 nt, Haemophilus influenzae Rd
aaguaaaaaaau

SEQ ID NO: 2702526 - RNA, 12 nt, Haemophilus influenzae Rd
aaguaaaaccau

SEQ ID NO: 2702527 - RNA, 18 nt, Haemophilus influenzae Rd
aaguaaaaggacuaaauu

SEQ ID NO: 2702528 - RNA, 14 nt, Haemophilus influenzae Rd
aaguaaaaguaaaa

SEQ ID NO: 2702529 - RNA, 13 nt, Haemophilus influenzae Rd
aaguaaaauaguc

SEQ ID NO: 2702530 - RNA, 15 nt, Haemophilus influenzae Rd
aaguaaacaauuuuc

SEQ ID NO: 2702531 - RNA, 13 nt, Haemophilus influenzae Rd
aaguaaacccuuu

SEQ ID NO: 2702532 - RNA, 22 nt, Haemophilus influenzae Rd
aaguaaacccuuuagcauaaaa

SEQ ID NO: 2702533 - RNA, 23 nt, Haemophilus influenzae Rd
aaguaaauaauccagauaacaaa

SEQ ID NO: 2702534 - RNA, 16 nt, Haemophilus influenzae Rd
aaguaaauaguuauaa

SEQ ID NO: 2702535 - RNA, 13 nt, Haemophilus influenzae Rd
aaguaaauauuuc

SEQ ID NO: 2702536 - RNA, 13 nt, Haemophilus influenzae Rd
aaguaaauauuuu

SEQ ID NO: 2702537 - RNA, 12 nt, Haemophilus influenzae Rd
aaguaaauucag

SEQ ID NO: 2702538 - RNA, 14 nt, Haemophilus influenzae Rd
aaguaaauuuuaaa

SEQ ID NO: 2702539 - RNA, 15 nt, Haemophilus influenzae Rd
aaguaacaauguaga

SEQ ID NO: 2702540 - RNA, 22 nt, Haemophilus influenzae Rd
aaguaagaauuaggaucguuga

SEQ ID NO: 2702541 - RNA, 15 nt, Haemophilus influenzae Rd
aaguaagcaauuuuc

SEQ ID NO: 2702542 - RNA, 21 nt, Haemophilus influenzae Rd
aaguaaggugcagauuuuuua

SEQ ID NO: 2702543 - RNA, 23 nt, Haemophilus influenzae Rd
aaguaauacaccaauaauuaaac

SEQ ID NO: 2702544 - RNA, 17 nt, Haemophilus influenzae Rd
aaguaauauuucuuguu

SEQ ID NO: 2702545 - RNA, 21 nt, Haemophilus influenzae Rd
aaguaaucgccccaaaagcug

SEQ ID NO: 2702546 - RNA, 12 nt, Haemophilus influenzae Rd
aaguaaugcgau

SEQ ID NO: 2702547 - RNA, 12 nt, Haemophilus influenzae Rd
aaguaauuuaaa

SEQ ID NO: 2702548 - RNA, 13 nt, Haemophilus influenzae Rd
aaguaauuuaaaa

SEQ ID NO: 2702549 - RNA, 14 nt, Haemophilus influenzae Rd
aaguaauuuaaaaa

SEQ ID NO: 2702550 - RNA, 22 nt, Haemophilus influenzae Rd
aaguaauuuaucgccauagaaa

SEQ ID NO: 2702551 - RNA, 24 nt, Haemophilus influenzae Rd
aaguaauuuaucgccauagaaaau

SEQ ID NO: 2702552 - RNA, 21 nt, Haemophilus influenzae Rd
aaguacaacugagcccacaac

SEQ ID NO: 2702553 - RNA, 19 nt, Haemophilus influenzae Rd
aaguacauucaaccacugu

SEQ ID NO: 2702554 - RNA, 18 nt, Haemophilus influenzae Rd
aaguaccaaaaucguaau

SEQ ID NO: 2702555 - RNA, 22 nt, Haemophilus influenzae Rd
aaguacgacaucuuaaauuaua

SEQ ID NO: 2702556 - RNA, 13 nt, Haemophilus influenzae Rd
aaguagaaauugc

SEQ ID NO: 2702557 - RNA, 13 nt, Haemophilus influenzae Rd
aaguagaaccagg

SEQ ID NO: 2702558 - RNA, 14 nt, Haemophilus influenzae Rd
aaguagcacuuucc

SEQ ID NO: 2702559 - RNA, 17 nt, Haemophilus influenzae Rd
aaguagcacuuuccauc

SEQ ID NO: 2702560 - RNA, 13 nt, Haemophilus influenzae Rd
aaguaguaaaguu

SEQ ID NO: 2702561 - RNA, 15 nt, Haemophilus influenzae Rd
aaguagucagcgcag

SEQ ID NO: 2702562 - RNA, 20 nt, Haemophilus influenzae Rd
aaguaguguuuuauuuauag

SEQ ID NO: 2702563 - RNA, 13 nt, Haemophilus influenzae Rd
aaguauaaagagu

SEQ ID NO: 2702564 - RNA, 21 nt, Haemophilus influenzae Rd
aaguauaagccgcaccaauaa

SEQ ID NO: 2702565 - RNA, 19 nt, Haemophilus influenzae Rd
aaguauaaguuauuuuuac

SEQ ID NO: 2702566 - RNA, 21 nt, Haemophilus influenzae Rd
aaguauaauauagaugaagug

SEQ ID NO: 2702567 - RNA, 14 nt, Haemophilus influenzae Rd
aaguaucuaccaug

SEQ ID NO: 2702568 - RNA, 17 nt, Haemophilus influenzae Rd
aaguaugccauaaaaua

SEQ ID NO: 2702569 - RNA, 21 nt, Haemophilus influenzae Rd
aaguauucagugccuaaauuu

SEQ ID NO: 2702570 - RNA, 12 nt, Haemophilus influenzae Rd
aaguauuuuccu

SEQ ID NO: 2702571 - RNA, 13 nt, Haemophilus influenzae Rd
aaguauuuuccuu

SEQ ID NO: 2702572 - RNA, 12 nt, Haemophilus influenzae Rd
aaguauuuugug

SEQ ID NO: 2702573 - RNA, 21 nt, Haemophilus influenzae Rd
aaguauuuuguggaauaucaa

SEQ ID NO: 2702574 - RNA, 14 nt, Haemophilus influenzae Rd
aaguauuuuucuaa

SEQ ID NO: 2702575 - RNA, 15 nt, Haemophilus influenzae Rd
aaguauuuuucuaaa

SEQ ID NO: 2702576 - RNA, 21 nt, Haemophilus influenzae Rd
aagucaaaaauugauaccaag

SEQ ID NO: 2702577 - RNA, 17 nt, Haemophilus influenzae Rd
aagucagcauaaacaaa

SEQ ID NO: 2702578 - RNA, 19 nt, Haemophilus influenzae Rd
aagucagcauaaacaaaau

SEQ ID NO: 2702579 - RNA, 20 nt, Haemophilus influenzae Rd
aagucagcauaaacaaaaua

SEQ ID NO: 2702580 - RNA, 15 nt, Haemophilus influenzae Rd
aagucaguaaaccaa

SEQ ID NO: 2702581 - RNA, 22 nt, Haemophilus influenzae Rd
aagucaguaaaccaagugaaau

SEQ ID NO: 2702582 - RNA, 19 nt, Haemophilus influenzae Rd
aagucaucgaguuuuaucu

SEQ ID NO: 2702583 - RNA, 16 nt, Haemophilus influenzae Rd
aagucgauucaaauaa

SEQ ID NO: 2702584 - RNA, 17 nt, Haemophilus influenzae Rd
aagucgauucaaauaac

SEQ ID NO: 2702585 - RNA, 16 nt, Haemophilus influenzae Rd
aagucgcaucaacaac

SEQ ID NO: 2702586 - RNA, 15 nt, Haemophilus influenzae Rd
aagucgcuaauuuuu

SEQ ID NO: 2702587 - RNA, 16 nt, Haemophilus influenzae Rd
aagucgcuaauuuuuu

SEQ ID NO: 2702588 - RNA, 14 nt, Haemophilus influenzae Rd
aagucgcuuaaguc

SEQ ID NO: 2702589 - RNA, 18 nt, Haemophilus influenzae Rd
aagucgguuuuuaauuca

SEQ ID NO: 2702590 - RNA, 17 nt, Haemophilus influenzae Rd
aagucgugaucugcauc

SEQ ID NO: 2702591 - RNA, 18 nt, Haemophilus influenzae Rd
aagucguuauuuucuaga

SEQ ID NO: 2702592 - RNA, 20 nt, Haemophilus influenzae Rd
aagucguuucaucgagaaau

SEQ ID NO: 2702593 - RNA, 22 nt, Haemophilus influenzae Rd
aagucguuucaucgagaaauac

SEQ ID NO: 2702594 - RNA, 17 nt, Haemophilus influenzae Rd
aagucuauaaaagaagg

SEQ ID NO: 2702595 - RNA, 13 nt, Haemophilus influenzae Rd
aagucucuaugau

SEQ ID NO: 2702596 - RNA, 22 nt, Haemophilus influenzae Rd
aagucugcugaaauacaaagca

SEQ ID NO: 2702597 - RNA, 18 nt, Haemophilus influenzae Rd
aagucuuaaugacauuaa

SEQ ID NO: 2702598 - RNA, 23 nt, Haemophilus influenzae Rd
aagucuuuuuuuguugguugagu

SEQ ID NO: 2702599 - RNA, 14 nt, Haemophilus influenzae Rd
aagugaaauauuuc

SEQ ID NO: 2702600 - RNA, 11 nt, Haemophilus influenzae Rd
aagugaaauua

SEQ ID NO: 2702601 - RNA, 17 nt, Haemophilus influenzae Rd
aagugaaccaauauagc

SEQ ID NO: 2702602 - RNA, 19 nt, Haemophilus influenzae Rd
aagugaauaauguuuucau

SEQ ID NO: 2702603 - RNA, 19 nt, Haemophilus influenzae Rd
aagugagaaaguuaaucaa

SEQ ID NO: 2702604 - RNA, 13 nt, Haemophilus influenzae Rd
aagugagaaauau

SEQ ID NO: 2702605 - RNA, 20 nt, Haemophilus influenzae Rd
aagugagcuaagcauuucag

SEQ ID NO: 2702606 - RNA, 22 nt, Haemophilus influenzae Rd
aagugcaagccccugaagccaa

SEQ ID NO: 2702607 - RNA, 21 nt, Haemophilus influenzae Rd
aagugcagaucgcuauuuaau

SEQ ID NO: 2702608 - RNA, 20 nt, Haemophilus influenzae Rd
aagugcaucaaccgauaaau

SEQ ID NO: 2702609 - RNA, 13 nt, Haemophilus influenzae Rd
aagugcggaaaau

SEQ ID NO: 2702610 - RNA, 14 nt, Haemophilus influenzae Rd
aagugcggagaaaa

SEQ ID NO: 2702611 - RNA, 16 nt, Haemophilus influenzae Rd
aagugcggagaaaauu

SEQ ID NO: 2702612 - RNA, 20 nt, Haemophilus influenzae Rd
aagugcggaugaaauuuuuc

SEQ ID NO: 2702613 - RNA, 21 nt, Haemophilus influenzae Rd
aagugcggcaaaaaauggcuu

SEQ ID NO: 2702614 - RNA, 18 nt, Haemophilus influenzae Rd
aagugcggcuucauuuug

SEQ ID NO: 2702615 - RNA, 15 nt, Haemophilus influenzae Rd
aagugcgguaaaaaa

SEQ ID NO: 2702616 - RNA, 15 nt, Haemophilus influenzae Rd
aagugcgguaaaaau

SEQ ID NO: 2702617 - RNA, 23 nt, Haemophilus influenzae Rd
aagugcgguaaaaauuaaccgca

SEQ ID NO: 2702618 - RNA, 19 nt, Haemophilus influenzae Rd
aagugcgguaaaaauuuac

SEQ ID NO: 2702619 - RNA, 19 nt, Haemophilus influenzae Rd
aagugcgguaaaauuuuuc

SEQ ID NO: 2702620 - RNA, 12 nt, Haemophilus influenzae Rd
aauaaaaaaacc

SEQ ID NO: 2702621 - RNA, 15 nt, Haemophilus influenzae Rd
aauaaaaaauaaauu

SEQ ID NO: 2702622 - RNA, 18 nt, Haemophilus influenzae Rd
aauaaaaacauugccaaa

SEQ ID NO: 2702623 - RNA, 21 nt, Haemophilus influenzae Rd
aauaaaaacauugccaaagca

SEQ ID NO: 2702624 - RNA, 13 nt, Haemophilus influenzae Rd
aauaaaaaguggg

SEQ ID NO: 2702625 - RNA, 13 nt, Haemophilus influenzae Rd
aauaaaaauaaug

SEQ ID NO: 2702626 - RNA, 12 nt, Haemophilus influenzae Rd
aauaaaaauccu

SEQ ID NO: 2702627 - RNA, 12 nt, Haemophilus influenzae Rd
aauaaaaauggu

SEQ ID NO: 2702628 - RNA, 14 nt, Haemophilus influenzae Rd
aauaaaaauuaaaa

SEQ ID NO: 2702629 - RNA, 16 nt, Haemophilus influenzae Rd
aauaaaacaaauguaa

SEQ ID NO: 2702630 - RNA, 22 nt, Haemophilus influenzae Rd
aauaaaaccauccgaaauuaau

SEQ ID NO: 2702631 - RNA, 23 nt, Haemophilus influenzae Rd
aauaaaaccauccgaaauuaauu

SEQ ID NO: 2702632 - RNA, 19 nt, Haemophilus influenzae Rd
aauaaaaccgcucaacuua

SEQ ID NO: 2702633 - RNA, 15 nt, Haemophilus influenzae Rd
aauaaaagcaauaau

SEQ ID NO: 2702634 - RNA, 13 nt, Haemophilus influenzae Rd
aauaaaagucagu

SEQ ID NO: 2702635 - RNA, 12 nt, Haemophilus influenzae Rd
aauaaaauaaca

SEQ ID NO: 2702636 - RNA, 22 nt, Haemophilus influenzae Rd
aauaaaauagacaauauugaaa

SEQ ID NO: 2702637 - RNA, 22 nt, Haemophilus influenzae Rd
aauaaaauauaugggaaacaau

SEQ ID NO: 2702638 - RNA, 23 nt, Haemophilus influenzae Rd
aauaaaauauaugggaaacaaua

SEQ ID NO: 2702639 - RNA, 18 nt, Haemophilus influenzae Rd
aauaaaauguaagaguga

SEQ ID NO: 2702640 - RNA, 14 nt, Haemophilus influenzae Rd
aauaaaauuacaaa

SEQ ID NO: 2702641 - RNA, 14 nt, Haemophilus influenzae Rd
aauaaaauugcuuu

SEQ ID NO: 2702642 - RNA, 13 nt, Haemophilus influenzae Rd
aauaaaauuuuua

SEQ ID NO: 2702643 - RNA, 14 nt, Haemophilus influenzae Rd
aauaaaauuuuuaa

SEQ ID NO: 2702644 - RNA, 15 nt, Haemophilus influenzae Rd
aauaaaauuuuuaaa

SEQ ID NO: 2702645 - RNA, 14 nt, Haemophilus influenzae Rd
aauaaacaaagaau

SEQ ID NO: 2702646 - RNA, 16 nt, Haemophilus influenzae Rd
aauaaacagaaauauu

SEQ ID NO: 2702647 - RNA, 20 nt, Haemophilus influenzae Rd
aauaaacagaaauauugucu

SEQ ID NO: 2702648 - RNA, 13 nt, Haemophilus influenzae Rd
aauaaacauuuuu

SEQ ID NO: 2702649 - RNA, 21 nt, Haemophilus influenzae Rd
aauaaaccaauaagauagaaa

SEQ ID NO: 2702650 - RNA, 16 nt, Haemophilus influenzae Rd
aauaaaccgcaucaaa

SEQ ID NO: 2702651 - RNA, 17 nt, Haemophilus influenzae Rd
aauaaaccgcaucaaaa

SEQ ID NO: 2702652 - RNA, 20 nt, Haemophilus influenzae Rd
aauaaaccgcaucaaaauua

SEQ ID NO: 2702653 - RNA, 21 nt, Haemophilus influenzae Rd
aauaaaccguuagguuuaaaa

SEQ ID NO: 2702654 - RNA, 23 nt, Haemophilus influenzae Rd
aauaaacgagauaagcauuuuau

SEQ ID NO: 2702655 - RNA, 17 nt, Haemophilus influenzae Rd
aauaaacgucauaguau

SEQ ID NO: 2702656 - RNA, 20 nt, Haemophilus influenzae Rd
aauaaacucauugaacuguu

SEQ ID NO: 2702657 - RNA, 11 nt, Haemophilus influenzae Rd
aauaaagaaac

SEQ ID NO: 2702658 - RNA, 12 nt, Haemophilus influenzae Rd
aauaaagaaacg

SEQ ID NO: 2702659 - RNA, 20 nt, Haemophilus influenzae Rd
aauaaagagcggucaauuuu

SEQ ID NO: 2702660 - RNA, 15 nt, Haemophilus influenzae Rd
aauaaagcugaccgc

SEQ ID NO: 2702661 - RNA, 13 nt, Haemophilus influenzae Rd
aauaaagcuugaa

SEQ ID NO: 2702662 - RNA, 15 nt, Haemophilus influenzae Rd
aauaaaggauuaaau

SEQ ID NO: 2702663 - RNA, 17 nt, Haemophilus influenzae Rd
aauaaaggauuaaauaa

SEQ ID NO: 2702664 - RNA, 18 nt, Haemophilus influenzae Rd
aauaaagggcgguuaaaa

SEQ ID NO: 2702665 - RNA, 20 nt, Haemophilus influenzae Rd
aauaaagggcgguuaaaaau

SEQ ID NO: 2702666 - RNA, 11 nt, Haemophilus influenzae Rd
aauaaaguaaa

SEQ ID NO: 2702667 - RNA, 12 nt, Haemophilus influenzae Rd
aauaaaguaaaa

SEQ ID NO: 2702668 - RNA, 15 nt, Haemophilus influenzae Rd
aauaaaguaaaauau

SEQ ID NO: 2702669 - RNA, 20 nt, Haemophilus influenzae Rd
aauaaagugcggucaauuuu

SEQ ID NO: 2702670 - RNA, 10 nt, Haemophilus influenzae Rd
aauaaaguug

SEQ ID NO: 2702671 - RNA, 20 nt, Haemophilus influenzae Rd
aauaaaguugagaauuuuuu

SEQ ID NO: 2702672 - RNA, 13 nt, Haemophilus influenzae Rd
aauaaauaaaaua

SEQ ID NO: 2702673 - RNA, 14 nt, Haemophilus influenzae Rd
aauaaauaaaauau

SEQ ID NO: 2702674 - RNA, 11 nt, Haemophilus influenzae Rd
aauaaauaaca

SEQ ID NO: 2702675 - RNA, 12 nt, Haemophilus influenzae Rd
aauaaauaacau

SEQ ID NO: 2702676 - RNA, 15 nt, Haemophilus influenzae Rd
aauaaauaaggcaca

SEQ ID NO: 2702677 - RNA, 14 nt, Haemophilus influenzae Rd
aauaaauagaaauu

SEQ ID NO: 2702678 - RNA, 16 nt, Haemophilus influenzae Rd
aauaaauagauacaag

SEQ ID NO: 2702679 - RNA, 19 nt, Haemophilus influenzae Rd
aauaaauagauacaagaaa

SEQ ID NO: 2702680 - RNA, 23 nt, Haemophilus influenzae Rd
aauaaauagauacaagaaagaaa

SEQ ID NO: 2702681 - RNA, 15 nt, Haemophilus influenzae Rd
aauaaauauguugaa

SEQ ID NO: 2702682 - RNA, 16 nt, Haemophilus influenzae Rd
aauaaauauuauuaaa

SEQ ID NO: 2702683 - RNA, 16 nt, Haemophilus influenzae Rd
aauaaaucaaaagaau

SEQ ID NO: 2702684 - RNA, 11 nt, Haemophilus influenzae Rd
aauaaaucaag

SEQ ID NO: 2702685 - RNA, 12 nt, Haemophilus influenzae Rd
aauaaaucacac

SEQ ID NO: 2702686 - RNA, 20 nt, Haemophilus influenzae Rd
aauaaaucacacaguuauac

SEQ ID NO: 2702687 - RNA, 22 nt, Haemophilus influenzae Rd
aauaaaucccaauagguuugua

SEQ ID NO: 2702688 - RNA, 21 nt, Haemophilus influenzae Rd
aauaaauccuucaggauaaaa

SEQ ID NO: 2702689 - RNA, 23 nt, Haemophilus influenzae Rd
aauaaauccuucaggauaaaaca

SEQ ID NO: 2702690 - RNA, 15 nt, Haemophilus influenzae Rd
aauaaauccuugcga

SEQ ID NO: 2702691 - RNA, 23 nt, Haemophilus influenzae Rd
aauaaaugauguaggcaaaaaca

SEQ ID NO: 2702692 - RNA, 20 nt, Haemophilus influenzae Rd
aauaaaugcaucauuaauac

SEQ ID NO: 2702693 - RNA, 18 nt, Haemophilus influenzae Rd
aauaaaugcgucgcagcc

SEQ ID NO: 2702694 - RNA, 14 nt, Haemophilus influenzae Rd
aauaaaugcuaaaa

SEQ ID NO: 2702695 - RNA, 18 nt, Haemophilus influenzae Rd
aauaaauucguacaaaug

SEQ ID NO: 2702696 - RNA, 19 nt, Haemophilus influenzae Rd
aauaaauugaauaucuaaa

SEQ ID NO: 2702697 - RNA, 20 nt, Haemophilus influenzae Rd
aauaaauuuaaauuauuaaa

SEQ ID NO: 2702698 - RNA, 21 nt, Haemophilus influenzae Rd
aauaaauuuauuuaauaauau

SEQ ID NO: 2702699 - RNA, 23 nt, Haemophilus influenzae Rd
aauaaauuuauuuaauaauauca

SEQ ID NO: 2702700 - RNA, 12 nt, Haemophilus influenzae Rd
aauaaauuuuau

SEQ ID NO: 2702701 - RNA, 20 nt, Haemophilus influenzae Rd
aauaaauuuuauuauguuuu

SEQ ID NO: 2702702 - RNA, 20 nt, Haemophilus influenzae Rd
aauaaauuuugcccucuuuu

SEQ ID NO: 2702703 - RNA, 12 nt, Haemophilus influenzae Rd
aauaaauuuuuu

SEQ ID NO: 2702704 - RNA, 21 nt, Haemophilus influenzae Rd
aauaacaaaagggcgauuaaa

SEQ ID NO: 2702705 - RNA, 24 nt, Haemophilus influenzae Rd
aauaacaagcacaagauuugccaa

SEQ ID NO: 2702706 - RNA, 11 nt, Haemophilus influenzae Rd
aauaacaaucc

SEQ ID NO: 2702707 - RNA, 12 nt, Haemophilus influenzae Rd
aauaacaauccu

SEQ ID NO: 2702708 - RNA, 18 nt, Haemophilus influenzae Rd
aauaacacagaaaccaau

SEQ ID NO: 2702709 - RNA, 23 nt, Haemophilus influenzae Rd
aauaacacucauuguaaagccca

SEQ ID NO: 2702710 - RNA, 15 nt, Haemophilus influenzae Rd
aauaacauuccguuu

SEQ ID NO: 2702711 - RNA, 16 nt, Haemophilus influenzae Rd
aauaacauuccguuuu

SEQ ID NO: 2702712 - RNA, 17 nt, Haemophilus influenzae Rd
aauaaccaauaacgaua

SEQ ID NO: 2702713 - RNA, 15 nt, Haemophilus influenzae Rd
aauaaccacgccuuc

SEQ ID NO: 2702714 - RNA, 22 nt, Haemophilus influenzae Rd
aauaaccacgccuucgaaugcu

SEQ ID NO: 2702715 - RNA, 20 nt, Haemophilus influenzae Rd
aauaaccacuccaaauaaua

SEQ ID NO: 2702716 - RNA, 17 nt, Haemophilus influenzae Rd
aauaaccguacauucuu

SEQ ID NO: 2702717 - RNA, 18 nt, Haemophilus influenzae Rd
aauaaccucgaaucacac

SEQ ID NO: 2702718 - RNA, 15 nt, Haemophilus influenzae Rd
aauaaccuuaaauca

SEQ ID NO: 2702719 - RNA, 18 nt, Haemophilus influenzae Rd
aauaaccuuaaaucaaac

SEQ ID NO: 2702720 - RNA, 19 nt, Haemophilus influenzae Rd
aauaaccuuaaaucaaaca

SEQ ID NO: 2702721 - RNA, 15 nt, Haemophilus influenzae Rd
aauaaccuugcugau

SEQ ID NO: 2702722 - RNA, 16 nt, Haemophilus influenzae Rd
aauaaccuugcugaua

SEQ ID NO: 2702723 - RNA, 18 nt, Haemophilus influenzae Rd
aauaaccuugcugauaaa

SEQ ID NO: 2702724 - RNA, 17 nt, Haemophilus influenzae Rd
aauaacgauaagauuug

SEQ ID NO: 2702725 - RNA, 22 nt, Haemophilus influenzae Rd
aauaacgauaagauuugcuuuu

SEQ ID NO: 2702726 - RNA, 19 nt, Haemophilus influenzae Rd
aauacaguuucugguuuau

SEQ ID NO: 2702727 - RNA, 22 nt, Haemophilus influenzae Rd
aauacauaaagaauaauuuuca

SEQ ID NO: 2702728 - RNA, 17 nt, Haemophilus influenzae Rd
aauacaucacgaacuuc

SEQ ID NO: 2702729 - RNA, 21 nt, Haemophilus influenzae Rd
aauacaucacgaacuucagcu

SEQ ID NO: 2702730 - RNA, 14 nt, Haemophilus influenzae Rd
aauacauuauuaaa

SEQ ID NO: 2702731 - RNA, 13 nt, Haemophilus influenzae Rd
aauacauuuuuau

SEQ ID NO: 2702732 - RNA, 18 nt, Haemophilus influenzae Rd
aauacauuuuugauugca

SEQ ID NO: 2702733 - RNA, 13 nt, Haemophilus influenzae Rd
aauaccaaaauug

SEQ ID NO: 2702734 - RNA, 17 nt, Haemophilus influenzae Rd
aauaccaauugaugcac

SEQ ID NO: 2702735 - RNA, 19 nt, Haemophilus influenzae Rd
aauaccaauugaugcacaa

SEQ ID NO: 2702736 - RNA, 21 nt, Haemophilus influenzae Rd
aauaccacuccccaaaaacca

SEQ ID NO: 2702737 - RNA, 15 nt, Haemophilus influenzae Rd
aauacccauaaaauu

SEQ ID NO: 2702738 - RNA, 16 nt, Haemophilus influenzae Rd
aauaccgcacuuuuau

SEQ ID NO: 2702739 - RNA, 14 nt, Haemophilus influenzae Rd
aauaccuucuugau

SEQ ID NO: 2702740 - RNA, 20 nt, Haemophilus influenzae Rd
aauaccuucuugauuauuua

SEQ ID NO: 2702741 - RNA, 17 nt, Haemophilus influenzae Rd
aauacgagcugauuuac

SEQ ID NO: 2702742 - RNA, 17 nt, Haemophilus influenzae Rd
aauacgauaauuaaagu

SEQ ID NO: 2702743 - RNA, 20 nt, Haemophilus influenzae Rd
aauacgauaauuaaagucag

SEQ ID NO: 2702744 - RNA, 14 nt, Haemophilus influenzae Rd
aauacgaucugcau

SEQ ID NO: 2702745 - RNA, 22 nt, Haemophilus influenzae Rd
aauacgaugauaagcccgaaca

SEQ ID NO: 2702746 - RNA, 23 nt, Haemophilus influenzae Rd
aauacgaugauaagcccgaacag

SEQ ID NO: 2702747 - RNA, 15 nt, Haemophilus influenzae Rd
aauacgauucguuuc

SEQ ID NO: 2702748 - RNA, 15 nt, Haemophilus influenzae Rd
aauacgccaagauaa

SEQ ID NO: 2702749 - RNA, 17 nt, Haemophilus influenzae Rd
aauacgcggcggaacag

SEQ ID NO: 2702750 - RNA, 17 nt, Haemophilus influenzae Rd
aauacgucaauugcuaa

SEQ ID NO: 2702751 - RNA, 23 nt, Haemophilus influenzae Rd
aauacguuguuguucuuuccauu

SEQ ID NO: 2702752 - RNA, 20 nt, Haemophilus influenzae Rd
aauacuagcucguaaagauc

SEQ ID NO: 2702753 - RNA, 20 nt, Haemophilus influenzae Rd
aauacucacaagucuguaau

SEQ ID NO: 2702754 - RNA, 15 nt, Haemophilus influenzae Rd
aauacucacagagcc

SEQ ID NO: 2702755 - RNA, 17 nt, Haemophilus influenzae Rd
aauacucacagagccuu

SEQ ID NO: 2702756 - RNA, 18 nt, Haemophilus influenzae Rd
aauacucacagagccuuu

SEQ ID NO: 2702757 - RNA, 15 nt, Haemophilus influenzae Rd
aauacucuuaacaaa

SEQ ID NO: 2702758 - RNA, 16 nt, Haemophilus influenzae Rd
aauacucuuaacaaaa

SEQ ID NO: 2702759 - RNA, 18 nt, Haemophilus influenzae Rd
aauacucuuaacaaaaca

SEQ ID NO: 2702760 - RNA, 19 nt, Haemophilus influenzae Rd
aauacugaaaugauuauaa

SEQ ID NO: 2702761 - RNA, 18 nt, Haemophilus influenzae Rd
aauacugagaucucuaug

SEQ ID NO: 2702762 - RNA, 13 nt, Haemophilus influenzae Rd
aauacugauaccg

SEQ ID NO: 2702763 - RNA, 11 nt, Haemophilus influenzae Rd
aauacugcacc

SEQ ID NO: 2702764 - RNA, 19 nt, Haemophilus influenzae Rd
aauacugcgacuuucccug

SEQ ID NO: 2702765 - RNA, 22 nt, Haemophilus influenzae Rd
aauacugcgacuuucccugcaa

SEQ ID NO: 2702766 - RNA, 12 nt, Haemophilus influenzae Rd
aauacugcugaa

SEQ ID NO: 2702767 - RNA, 20 nt, Haemophilus influenzae Rd
aauacugcugaauaaaccua

SEQ ID NO: 2702768 - RNA, 14 nt, Haemophilus influenzae Rd
aauacugucacaau

SEQ ID NO: 2702769 - RNA, 19 nt, Haemophilus influenzae Rd
aauacugucacaauauuug

SEQ ID NO: 2702770 - RNA, 22 nt, Haemophilus influenzae Rd
aauacugucacaauauuugguu

SEQ ID NO: 2702771 - RNA, 17 nt, Haemophilus influenzae Rd
aauacuguugagcaucu

SEQ ID NO: 2702772 - RNA, 19 nt, Haemophilus influenzae Rd
aauacuguuuuaugcuaaa

SEQ ID NO: 2702773 - RNA, 20 nt, Haemophilus influenzae Rd
aauacuguuuuaugcuaaag

SEQ ID NO: 2702774 - RNA, 11 nt, Haemophilus influenzae Rd
aauacuuagcg

SEQ ID NO: 2702775 - RNA, 23 nt, Haemophilus influenzae Rd
aauacuuagcgugcuaauuccaa

SEQ ID NO: 2702776 - RNA, 21 nt, Haemophilus influenzae Rd
aauacuuggugcaauaaaauc

SEQ ID NO: 2702777 - RNA, 15 nt, Haemophilus influenzae Rd
aauacuuuugcuuca

SEQ ID NO: 2702778 - RNA, 15 nt, Haemophilus influenzae Rd
aauagaaaaaugcca

SEQ ID NO: 2702779 - RNA, 16 nt, Haemophilus influenzae Rd
aauagaaaguggcuua

SEQ ID NO: 2702780 - RNA, 22 nt, Haemophilus influenzae Rd
aauagaaaguggcuuaauuuau

SEQ ID NO: 2702781 - RNA, 16 nt, Haemophilus influenzae Rd
aauagaaugaaaaaca

SEQ ID NO: 2702782 - RNA, 14 nt, Haemophilus influenzae Rd
aauagaauuggugc

SEQ ID NO: 2702783 - RNA, 21 nt, Haemophilus influenzae Rd
aauagaauuggugcgucuuuu

SEQ ID NO: 2702784 - RNA, 22 nt, Haemophilus influenzae Rd
aauagaauuggugcgucuuuua

SEQ ID NO: 2702785 - RNA, 18 nt, Haemophilus influenzae Rd
aauagacauagaaaguuu

SEQ ID NO: 2702786 - RNA, 18 nt, Haemophilus influenzae Rd
aauagacuuaauaauaua

SEQ ID NO: 2702787 - RNA, 15 nt, Haemophilus influenzae Rd
aauagagaauaauua

SEQ ID NO: 2702788 - RNA, 17 nt, Haemophilus influenzae Rd
aauagagcaaauauaaa

SEQ ID NO: 2702789 - RNA, 17 nt, Haemophilus influenzae Rd
aauagauaaaauaaaac

SEQ ID NO: 2702790 - RNA, 21 nt, Haemophilus influenzae Rd
aauagauacaagaaagaaaua

SEQ ID NO: 2702791 - RNA, 13 nt, Haemophilus influenzae Rd
aauagaugaaauu

SEQ ID NO: 2702792 - RNA, 22 nt, Haemophilus influenzae Rd
aauagaugaaauuuauuauaaa

SEQ ID NO: 2702793 - RNA, 17 nt, Haemophilus influenzae Rd
aauagauuuaauaucuu

SEQ ID NO: 2702794 - RNA, 16 nt, Haemophilus influenzae Rd
aauagcaaaaccgaua

SEQ ID NO: 2702795 - RNA, 22 nt, Haemophilus influenzae Rd
aauagcaauaucugcuaauacu

SEQ ID NO: 2702796 - RNA, 15 nt, Haemophilus influenzae Rd
aauagcacagccaag

SEQ ID NO: 2702797 - RNA, 22 nt, Haemophilus influenzae Rd
aauagccaaaacgaauagaaau

SEQ ID NO: 2702798 - RNA, 17 nt, Haemophilus influenzae Rd
aauagccuucaucacaa

SEQ ID NO: 2702799 - RNA, 15 nt, Haemophilus influenzae Rd
aauagcgugaaaagc

SEQ ID NO: 2702800 - RNA, 16 nt, Haemophilus influenzae Rd
aauagcuaacaaauuu

SEQ ID NO: 2702801 - RNA, 22 nt, Haemophilus influenzae Rd
aauagcuacgguuauuuuuuuc

SEQ ID NO: 2702802 - RNA, 21 nt, Haemophilus influenzae Rd
aauagcuuccgcuuuuuucgc

SEQ ID NO: 2702803 - RNA, 18 nt, Haemophilus influenzae Rd
aauaggaagcauuucuaa

SEQ ID NO: 2702804 - RNA, 20 nt, Haemophilus influenzae Rd
aauaggaguaaaaauauuau

SEQ ID NO: 2702805 - RNA, 16 nt, Haemophilus influenzae Rd
aauaggauaaauaaac

SEQ ID NO: 2702806 - RNA, 18 nt, Haemophilus influenzae Rd
aauaggcaaguucguuuu

SEQ ID NO: 2702807 - RNA, 22 nt, Haemophilus influenzae Rd
aauagguuauaaguuuuuugcc

SEQ ID NO: 2702808 - RNA, 14 nt, Haemophilus influenzae Rd
aauagguugcaaau

SEQ ID NO: 2702809 - RNA, 16 nt, Haemophilus influenzae Rd
  misc_feature (6)..(6): n is a, c, g or u
aauagnaaaaauuuag

SEQ ID NO: 2702810 - RNA, 13 nt, Haemophilus influenzae Rd
aauaguaaagaau

SEQ ID NO: 2702811 - RNA, 18 nt, Haemophilus influenzae Rd
aauaguaucagcuguugc

SEQ ID NO: 2702812 - RNA, 20 nt, Haemophilus influenzae Rd
aauaguaucagcuguugcaa

SEQ ID NO: 2702813 - RNA, 20 nt, Haemophilus influenzae Rd
aauaguggugccuucuucag

SEQ ID NO: 2702814 - RNA, 14 nt, Haemophilus influenzae Rd
aauaguuaaagaaa

SEQ ID NO: 2702815 - RNA, 16 nt, Haemophilus influenzae Rd
aauaguuaaagaaaau

SEQ ID NO: 2702816 - RNA, 20 nt, Haemophilus influenzae Rd
aauaguuaaagaaaauauuu

SEQ ID NO: 2702817 - RNA, 15 nt, Haemophilus influenzae Rd
aauaguuaaucgaaa

SEQ ID NO: 2702818 - RNA, 20 nt, Haemophilus influenzae Rd
aauaguuaaucgaaaauuua

SEQ ID NO: 2702819 - RNA, 16 nt, Haemophilus influenzae Rd
aauaguuaauugauuu

SEQ ID NO: 2702820 - RNA, 23 nt, Haemophilus influenzae Rd
aauaguuauggcgauauucuccu

SEQ ID NO: 2702821 - RNA, 17 nt, Haemophilus influenzae Rd
aauaguuaugguaacua

SEQ ID NO: 2702822 - RNA, 18 nt, Haemophilus influenzae Rd
aauaguuggguaaucaaa

SEQ ID NO: 2702823 - RNA, 14 nt, Haemophilus influenzae Rd
aauauaaaaaauaa

SEQ ID NO: 2702824 - RNA, 14 nt, Haemophilus influenzae Rd
aauauaaaauaaaa

SEQ ID NO: 2702825 - RNA, 15 nt, Haemophilus influenzae Rd
aauauaaagauaauu

SEQ ID NO: 2702826 - RNA, 15 nt, Haemophilus influenzae Rd
aauauaaauaaaaca

SEQ ID NO: 2702827 - RNA, 16 nt, Haemophilus influenzae Rd
aauauaaauaaaacaa

SEQ ID NO: 2702828 - RNA, 20 nt, Haemophilus influenzae Rd
aauauaaauaguuaaagccu

SEQ ID NO: 2702829 - RNA, 21 nt, Haemophilus influenzae Rd
aauauaaauggaaaccauuga

SEQ ID NO: 2702830 - RNA, 15 nt, Haemophilus influenzae Rd
aauauaacaccaaac

SEQ ID NO: 2702831 - RNA, 20 nt, Haemophilus influenzae Rd
aauauugguagcuaaaaaua

SEQ ID NO: 2702832 - RNA, 19 nt, Haemophilus influenzae Rd
aauauugucuauuugcuuu

SEQ ID NO: 2702833 - RNA, 22 nt, Haemophilus influenzae Rd
  misc_feature (7)..(7): n is a, c, g or u
  misc_feature (11)..(11): n is a, c, g or u
aauauunugancgguuaugcaa

SEQ ID NO: 2702834 - RNA, 15 nt, Haemophilus influenzae Rd
aauauuuaaaaagaa

SEQ ID NO: 2702835 - RNA, 15 nt, Haemophilus influenzae Rd
aauauuuaauauauu

SEQ ID NO: 2702836 - RNA, 20 nt, Haemophilus influenzae Rd
aauauuuagauuacuuuuag

SEQ ID NO: 2702837 - RNA, 20 nt, Haemophilus influenzae Rd
aauauuuaggcuauuuuaua

SEQ ID NO: 2702838 - RNA, 14 nt, Haemophilus influenzae Rd
aauauuuauaaugu

SEQ ID NO: 2702839 - RNA, 14 nt, Haemophilus influenzae Rd
aauauuuauacacu

SEQ ID NO: 2702840 - RNA, 22 nt, Haemophilus influenzae Rd
aauauuuauuucuauagauuua

SEQ ID NO: 2702841 - RNA, 19 nt, Haemophilus influenzae Rd
aauauuuauuugaaacaau

SEQ ID NO: 2702842 - RNA, 18 nt, Haemophilus influenzae Rd
aauauuucacuauucagc

SEQ ID NO: 2702843 - RNA, 21 nt, Haemophilus influenzae Rd
aauauuuccucuaaauaaaaa

SEQ ID NO: 2702844 - RNA, 20 nt, Haemophilus influenzae Rd
aauauuucuucauuuuaaau

SEQ ID NO: 2702845 - RNA, 13 nt, Haemophilus influenzae Rd
aauauuucuuuuu

SEQ ID NO: 2702846 - RNA, 18 nt, Haemophilus influenzae Rd
aauauuugacgaaauaaa

SEQ ID NO: 2702847 - RNA, 14 nt, Haemophilus influenzae Rd
aauauuugggaaau

SEQ ID NO: 2702848 - RNA, 18 nt, Haemophilus influenzae Rd
aauauuuuaauagaauuu

SEQ ID NO: 2702849 - RNA, 18 nt, Haemophilus influenzae Rd
aauauuuuaaugaaagua

SEQ ID NO: 2702850 - RNA, 23 nt, Haemophilus influenzae Rd
aauauuuuaaugaaaguaacaau

SEQ ID NO: 2702851 - RNA, 21 nt, Haemophilus influenzae Rd
aauauuuuagcaagugcgcca

SEQ ID NO: 2702852 - RNA, 22 nt, Haemophilus influenzae Rd
aauauuuucaaauaaguuugau

SEQ ID NO: 2702853 - RNA, 12 nt, Haemophilus influenzae Rd
aauauuuucccc

SEQ ID NO: 2702854 - RNA, 19 nt, Haemophilus influenzae Rd
aauauuuuccccuuguucu

SEQ ID NO: 2702855 - RNA, 18 nt, Haemophilus influenzae Rd
aauauuuuguugaagaaa

SEQ ID NO: 2702856 - RNA, 19 nt, Haemophilus influenzae Rd
aauauuuuguugaagaaag

SEQ ID NO: 2702857 - RNA, 11 nt, Haemophilus influenzae Rd
aauauuuuuca

SEQ ID NO: 2702858 - RNA, 15 nt, Haemophilus influenzae Rd
aaucaaaaagcuacu

SEQ ID NO: 2702859 - RNA, 23 nt, Haemophilus influenzae Rd
aaucaaaaaugcuuuugccgaaa

SEQ ID NO: 2702860 - RNA, 17 nt, Haemophilus influenzae Rd
aaucaaaaccaaucauu

SEQ ID NO: 2702861 - RNA, 15 nt, Haemophilus influenzae Rd
aaucaaaagaaauua

SEQ ID NO: 2702862 - RNA, 14 nt, Haemophilus influenzae Rd
aaucaaaauagcuu

SEQ ID NO: 2702863 - RNA, 13 nt, Haemophilus influenzae Rd
aaucaaaaucugc

SEQ ID NO: 2702864 - RNA, 11 nt, Haemophilus influenzae Rd
aaucaaacaac

SEQ ID NO: 2702865 - RNA, 13 nt, Haemophilus influenzae Rd
aaucaaagauauu

SEQ ID NO: 2702866 - RNA, 14 nt, Haemophilus influenzae Rd
aaucaaauaaaaua

SEQ ID NO: 2702867 - RNA, 14 nt, Haemophilus influenzae Rd
aaucaaauugauca

SEQ ID NO: 2702868 - RNA, 19 nt, Haemophilus influenzae Rd
aaucaaauugaucaagcca

SEQ ID NO: 2702869 - RNA, 13 nt, Haemophilus influenzae Rd
aaucaaauuuucc

SEQ ID NO: 2702870 - RNA, 15 nt, Haemophilus influenzae Rd
aaucaaauuuuccuu

SEQ ID NO: 2702871 - RNA, 17 nt, Haemophilus influenzae Rd
aaucaaauuuuccuucu

SEQ ID NO: 2702872 - RNA, 12 nt, Haemophilus influenzae Rd
aaucaacaaucc

SEQ ID NO: 2702873 - RNA, 13 nt, Haemophilus influenzae Rd
aaucaacacaccu

SEQ ID NO: 2702874 - RNA, 19 nt, Haemophilus influenzae Rd
aaucaaccauuuguuggcg

SEQ ID NO: 2702875 - RNA, 20 nt, Haemophilus influenzae Rd
aaucaacgcuguacaaagca

SEQ ID NO: 2702876 - RNA, 21 nt, Haemophilus influenzae Rd
aaucaacgcuguacaaagcac

SEQ ID NO: 2702877 - RNA, 14 nt, Haemophilus influenzae Rd
aaucaagaauucca

SEQ ID NO: 2702878 - RNA, 22 nt, Haemophilus influenzae Rd
aaucaagaugacgaaaugaaau

SEQ ID NO: 2702879 - RNA, 19 nt, Haemophilus influenzae Rd
aaucaagcauaaaucuuua

SEQ ID NO: 2702880 - RNA, 17 nt, Haemophilus influenzae Rd
aaucaagcuaagauuga

SEQ ID NO: 2702881 - RNA, 18 nt, Haemophilus influenzae Rd
aaucaaggacuaggcucu

SEQ ID NO: 2702882 - RNA, 23 nt, Haemophilus influenzae Rd
aaucaaggacuaggcucuguaau

SEQ ID NO: 2702883 - RNA, 17 nt, Haemophilus influenzae Rd
aaucaaggcuuuguaau

SEQ ID NO: 2702884 - RNA, 21 nt, Haemophilus influenzae Rd
aaucaaguuaaaaaaugauua

SEQ ID NO: 2702885 - RNA, 15 nt, Haemophilus influenzae Rd
aaucaauuaaagaaa

SEQ ID NO: 2702886 - RNA, 15 nt, Haemophilus influenzae Rd
aaucaauuaacuauu

SEQ ID NO: 2702887 - RNA, 22 nt, Haemophilus influenzae Rd
aaucaauucaucuugauccaua

SEQ ID NO: 2702888 - RNA, 14 nt, Haemophilus influenzae Rd
aaucaauuugauca

SEQ ID NO: 2702889 - RNA, 15 nt, Haemophilus influenzae Rd
aaucaauuugaucau

SEQ ID NO: 2702890 - RNA, 11 nt, Haemophilus influenzae Rd
aaucaauuuuu

SEQ ID NO: 2702891 - RNA, 15 nt, Haemophilus influenzae Rd
aaucaauuuuuucuc

SEQ ID NO: 2702892 - RNA, 15 nt, Haemophilus influenzae Rd
aaucacaaagcuuag

SEQ ID NO: 2702893 - RNA, 14 nt, Haemophilus influenzae Rd
aaucacaaauauua

SEQ ID NO: 2702894 - RNA, 16 nt, Haemophilus influenzae Rd
aaucacaaauccauaa

SEQ ID NO: 2702895 - RNA, 16 nt, Haemophilus influenzae Rd
aaucacaacacaaucg

SEQ ID NO: 2702896 - RNA, 16 nt, Haemophilus influenzae Rd
aaucacaacauauaaa

SEQ ID NO: 2702897 - RNA, 18 nt, Haemophilus influenzae Rd
aaucacaaugagacuuaa

SEQ ID NO: 2702898 - RNA, 11 nt, Haemophilus influenzae Rd
aaucacagcac

SEQ ID NO: 2702899 - RNA, 19 nt, Haemophilus influenzae Rd
aaucacagccgcauuuuua

SEQ ID NO: 2702900 - RNA, 20 nt, Haemophilus influenzae Rd
aaucacagccgcauuuuuac

SEQ ID NO: 2702901 - RNA, 14 nt, Haemophilus influenzae Rd
aaucacaguuuuau

SEQ ID NO: 2702902 - RNA, 15 nt, Haemophilus influenzae Rd
aaucacauaaaaaau

SEQ ID NO: 2702903 - RNA, 16 nt, Haemophilus influenzae Rd
aaucacauagauuuaa

SEQ ID NO: 2702904 - RNA, 21 nt, Haemophilus influenzae Rd
aaucaccuucaaguaauucga

SEQ ID NO: 2702905 - RNA, 17 nt, Haemophilus influenzae Rd
aaucacgaucugcaaca

SEQ ID NO: 2702906 - RNA, 22 nt, Haemophilus influenzae Rd
aaucacgaucugcaacaucacc

SEQ ID NO: 2702907 - RNA, 19 nt, Haemophilus influenzae Rd
aaucacgccagauaaaauu

SEQ ID NO: 2702908 - RNA, 17 nt, Haemophilus influenzae Rd
aaucacgcucaaucucu

SEQ ID NO: 2702909 - RNA, 15 nt, Haemophilus influenzae Rd
aaucacuaaauuuca

SEQ ID NO: 2702910 - RNA, 14 nt, Haemophilus influenzae Rd
aaucacugaaaaau

SEQ ID NO: 2702911 - RNA, 20 nt, Haemophilus influenzae Rd
aaucacugaauaaugugcaa

SEQ ID NO: 2702912 - RNA, 13 nt, Haemophilus influenzae Rd
aaucacugaauuu

SEQ ID NO: 2702913 - RNA, 18 nt, Haemophilus influenzae Rd
aaucacuucucugacuaa

SEQ ID NO: 2702914 - RNA, 12 nt, Haemophilus influenzae Rd
aaucacuugaag

SEQ ID NO: 2702915 - RNA, 17 nt, Haemophilus influenzae Rd
aaucacuugauaaaaau

SEQ ID NO: 2702916 - RNA, 23 nt, Haemophilus influenzae Rd
aaucacuugugcgauuaacaaua

SEQ ID NO: 2702917 - RNA, 22 nt, Haemophilus influenzae Rd
aaucagaauagccgcaaucaca

SEQ ID NO: 2702918 - RNA, 16 nt, Haemophilus influenzae Rd
aaucagaguuaaaagu

SEQ ID NO: 2702919 - RNA, 14 nt, Haemophilus influenzae Rd
aaucagcaaaacuu

SEQ ID NO: 2702920 - RNA, 17 nt, Haemophilus influenzae Rd
aaucagcauauugaaau

SEQ ID NO: 2702921 - RNA, 20 nt, Haemophilus influenzae Rd
aaucagcccaagcuuuuucu

SEQ ID NO: 2702922 - RNA, 16 nt, Haemophilus influenzae Rd
aaucagcgaguuugau

SEQ ID NO: 2702923 - RNA, 17 nt, Haemophilus influenzae Rd
aaucaggcuuucauuuu

SEQ ID NO: 2702924 - RNA, 19 nt, Haemophilus influenzae Rd
aaucaggcuuucauuuucc

SEQ ID NO: 2702925 - RNA, 15 nt, Haemophilus influenzae Rd
aaucagugucuuaac

SEQ ID NO: 2702926 - RNA, 22 nt, Haemophilus influenzae Rd
aaucaguugaucgcaauguuca

SEQ ID NO: 2702927 - RNA, 13 nt, Haemophilus influenzae Rd
aaucauaaaaaaa

SEQ ID NO: 2702928 - RNA, 13 nt, Haemophilus influenzae Rd
aaucauaaaaaca

SEQ ID NO: 2702929 - RNA, 13 nt, Haemophilus influenzae Rd
aaucauaaaaaug

SEQ ID NO: 2702930 - RNA, 21 nt, Haemophilus influenzae Rd
aaucauaaucgccaaaaucau

SEQ ID NO: 2702931 - RNA, 14 nt, Haemophilus influenzae Rd
aaucauacacacca

SEQ ID NO: 2702932 - RNA, 18 nt, Haemophilus influenzae Rd
aaucauaccaauugcaac

SEQ ID NO: 2702933 - RNA, 16 nt, Haemophilus influenzae Rd
aaucauagaaaucccu

SEQ ID NO: 2702934 - RNA, 17 nt, Haemophilus influenzae Rd
aaucauagaaaucccuu

SEQ ID NO: 2702935 - RNA, 22 nt, Haemophilus influenzae Rd
aaucauagaaaucccuugacca

SEQ ID NO: 2702936 - RNA, 20 nt, Haemophilus influenzae Rd
aaucauaggcuucuuguuua

SEQ ID NO: 2702937 - RNA, 14 nt, Haemophilus influenzae Rd
aaucuaaaaaaccu

SEQ ID NO: 2702938 - RNA, 12 nt, Haemophilus influenzae Rd
aaucuaaaccag

SEQ ID NO: 2702939 - RNA, 13 nt, Haemophilus influenzae Rd
aaucuaaacuugu

SEQ ID NO: 2702940 - RNA, 17 nt, Haemophilus influenzae Rd
aaucuaaacuuguuaaa

SEQ ID NO: 2702941 - RNA, 13 nt, Haemophilus influenzae Rd
aaucuaaagcgau

SEQ ID NO: 2702942 - RNA, 20 nt, Haemophilus influenzae Rd
aaucuaaagcgaucaucauu

SEQ ID NO: 2702943 - RNA, 17 nt, Haemophilus influenzae Rd
aaucuaagcgaccugaa

SEQ ID NO: 2702944 - RNA, 19 nt, Haemophilus influenzae Rd
aaucuaauucuuccgcauc

SEQ ID NO: 2702945 - RNA, 13 nt, Haemophilus influenzae Rd
aaucuaauuugcu

SEQ ID NO: 2702946 - RNA, 17 nt, Haemophilus influenzae Rd
aaucuaauuuugccauc

SEQ ID NO: 2702947 - RNA, 20 nt, Haemophilus influenzae Rd
aaucuacagggcuuaguccu

SEQ ID NO: 2702948 - RNA, 14 nt, Haemophilus influenzae Rd
aaucuacucguuua

SEQ ID NO: 2702949 - RNA, 21 nt, Haemophilus influenzae Rd
aaucuagagauuguaugaaaa

SEQ ID NO: 2702950 - RNA, 23 nt, Haemophilus influenzae Rd
aaucuagagauuguaugaaaaau

SEQ ID NO: 2702951 - RNA, 12 nt, Haemophilus influenzae Rd
aaucuaucccaa

SEQ ID NO: 2702952 - RNA, 13 nt, Haemophilus influenzae Rd
aaucuaucccaac

SEQ ID NO: 2702953 - RNA, 23 nt, Haemophilus influenzae Rd
aaucuaucccaacagaaaauuug

SEQ ID NO: 2702954 - RNA, 17 nt, Haemophilus influenzae Rd
aaucuauuccuuucuuu

SEQ ID NO: 2702955 - RNA, 21 nt, Haemophilus influenzae Rd
aaucuauuucuuugaguaaaa

SEQ ID NO: 2702956 - RNA, 23 nt, Haemophilus influenzae Rd
aaucuauuucuuugaguaaaaaa

SEQ ID NO: 2702957 - RNA, 17 nt, Haemophilus influenzae Rd
aaucucaaaaucagcaa

SEQ ID NO: 2702958 - RNA, 21 nt, Haemophilus influenzae Rd
aaucucacguacuuuuaacac

SEQ ID NO: 2702959 - RNA, 17 nt, Haemophilus influenzae Rd
aaucucgcauugauucu

SEQ ID NO: 2702960 - RNA, 17 nt, Haemophilus influenzae Rd
aaucucuaccacaguca

SEQ ID NO: 2702961 - RNA, 13 nt, Haemophilus influenzae Rd
aaucucucaaaaa

SEQ ID NO: 2702962 - RNA, 14 nt, Haemophilus influenzae Rd
aaucucuggagaaa

SEQ ID NO: 2702963 - RNA, 19 nt, Haemophilus influenzae Rd
aaucucuggagaaaauugc

SEQ ID NO: 2702964 - RNA, 22 nt, Haemophilus influenzae Rd
aaucucuuuacuguucaaauaa

SEQ ID NO: 2702965 - RNA, 15 nt, Haemophilus influenzae Rd
aaucucuuucaauuu

SEQ ID NO: 2702966 - RNA, 12 nt, Haemophilus influenzae Rd
aaucugaaagug

SEQ ID NO: 2702967 - RNA, 15 nt, Haemophilus influenzae Rd
aaucugaaagugcgg

SEQ ID NO: 2702968 - RNA, 15 nt, Haemophilus influenzae Rd
aaucugaauuuccau

SEQ ID NO: 2702969 - RNA, 16 nt, Haemophilus influenzae Rd
aaucugaguauguugu

SEQ ID NO: 2702970 - RNA, 19 nt, Haemophilus influenzae Rd
aaucugauacgaauguuug

SEQ ID NO: 2702971 - RNA, 18 nt, Haemophilus influenzae Rd
aaucugcaacugaauucu

SEQ ID NO: 2702972 - RNA, 20 nt, Haemophilus influenzae Rd
aaucugcauucuaaaaguuu

SEQ ID NO: 2702973 - RNA, 14 nt, Haemophilus influenzae Rd
aaucugcuguugca

SEQ ID NO: 2702974 - RNA, 18 nt, Haemophilus influenzae Rd
aaucugcuguugcagcug

SEQ ID NO: 2702975 - RNA, 20 nt, Haemophilus influenzae Rd
aaucugcuguugcagcugga

SEQ ID NO: 2702976 - RNA, 22 nt, Haemophilus influenzae Rd
aaucuggugcuuguuuuaaaau

SEQ ID NO: 2702977 - RNA, 19 nt, Haemophilus influenzae Rd
aaucuguggcguauuuaga

SEQ ID NO: 2702978 - RNA, 14 nt, Haemophilus influenzae Rd
aaucuuaaauucau

SEQ ID NO: 2702979 - RNA, 17 nt, Haemophilus influenzae Rd
aaucuuaacugcaaguc

SEQ ID NO: 2702980 - RNA, 20 nt, Haemophilus influenzae Rd
aaucuuaacugcaaguccgc

SEQ ID NO: 2702981 - RNA, 15 nt, Haemophilus influenzae Rd
aaucuuacgaagaau

SEQ ID NO: 2702982 - RNA, 16 nt, Haemophilus influenzae Rd
aaucuuacgaagaauc

SEQ ID NO: 2702983 - RNA, 18 nt, Haemophilus influenzae Rd
aaucuuacgaagaaucca

SEQ ID NO: 2702984 - RNA, 13 nt, Haemophilus influenzae Rd
aaucuuauacaac

SEQ ID NO: 2702985 - RNA, 17 nt, Haemophilus influenzae Rd
aaucuuauacaacaaaa

SEQ ID NO: 2702986 - RNA, 16 nt, Haemophilus influenzae Rd
aaucuuaucaaacacu

SEQ ID NO: 2702987 - RNA, 23 nt, Haemophilus influenzae Rd
aaucuuaugaaacagcuaaaaau

SEQ ID NO: 2702988 - RNA, 18 nt, Haemophilus influenzae Rd
aaucuuauuaauaaaaau

SEQ ID NO: 2702989 - RNA, 14 nt, Haemophilus influenzae Rd
aaucuucacaaaua

SEQ ID NO: 2702990 - RNA, 12 nt, Haemophilus influenzae Rd
aaucuucauacu

SEQ ID NO: 2702991 - RNA, 12 nt, Haemophilus influenzae Rd
aaucuucccauu

SEQ ID NO: 2702992 - RNA, 17 nt, Haemophilus influenzae Rd
aaucuucuaauuugcca

SEQ ID NO: 2702993 - RNA, 12 nt, Haemophilus influenzae Rd
aaucuucuuccc

SEQ ID NO: 2702994 - RNA, 13 nt, Haemophilus influenzae Rd
aaucuucuuccca

SEQ ID NO: 2702995 - RNA, 15 nt, Haemophilus influenzae Rd
aaucuucuucuuuuu

SEQ ID NO: 2702996 - RNA, 21 nt, Haemophilus influenzae Rd
aaucuugaacagcuuugcugu

SEQ ID NO: 2702997 - RNA, 20 nt, Haemophilus influenzae Rd
aaucuugcacggcaguaucu

SEQ ID NO: 2702998 - RNA, 20 nt, Haemophilus influenzae Rd
aaucuugcgcacauucuaua

SEQ ID NO: 2702999 - RNA, 18 nt, Haemophilus influenzae Rd
aaucuuggcucauuuuaa

SEQ ID NO: 2703000 - RNA, 19 nt, Haemophilus influenzae Rd
aaucuuggcucauuuuaaa

SEQ ID NO: 2703001 - RNA, 17 nt, Haemophilus influenzae Rd
aaucuuggugccaaucc

SEQ ID NO: 2703002 - RNA, 21 nt, Haemophilus influenzae Rd
aaucuugguuuaaauuuuaaa

SEQ ID NO: 2703003 - RNA, 14 nt, Haemophilus influenzae Rd
aaucuuguuuuaau

SEQ ID NO: 2703004 - RNA, 17 nt, Haemophilus influenzae Rd
aaucuuuaaaauguaaa

SEQ ID NO: 2703005 - RNA, 13 nt, Haemophilus influenzae Rd
aaucuuuaccaaa

SEQ ID NO: 2703006 - RNA, 17 nt, Haemophilus influenzae Rd
aaucuuuaccaaaaaau

SEQ ID NO: 2703007 - RNA, 14 nt, Haemophilus influenzae Rd
aaucuuuacgaauu

SEQ ID NO: 2703008 - RNA, 22 nt, Haemophilus influenzae Rd
aaucuuucgauucgccuugcuu

SEQ ID NO: 2703009 - RNA, 15 nt, Haemophilus influenzae Rd
aaucuuugaauuggu

SEQ ID NO: 2703010 - RNA, 17 nt, Haemophilus influenzae Rd
aaucuuuuacaccgucc

SEQ ID NO: 2703011 - RNA, 12 nt, Haemophilus influenzae Rd
aaucuuuuauuc

SEQ ID NO: 2703012 - RNA, 22 nt, Haemophilus influenzae Rd
aaucuuuuuucuugcuaaaaag

SEQ ID NO: 2703013 - RNA, 23 nt, Haemophilus influenzae Rd
aaucuuuuuucuugcuaaaaaga

SEQ ID NO: 2703014 - RNA, 22 nt, Haemophilus influenzae Rd
aaugaaaauaaccgcacuuuag

SEQ ID NO: 2703015 - RNA, 23 nt, Haemophilus influenzae Rd
aaugaaacuucaccagugaauuu

SEQ ID NO: 2703016 - RNA, 18 nt, Haemophilus influenzae Rd
aaugaaagggaaauaaca

SEQ ID NO: 2703017 - RNA, 15 nt, Haemophilus influenzae Rd
aaugaaauauuccaa

SEQ ID NO: 2703018 - RNA, 12 nt, Haemophilus influenzae Rd
aaugaaauucag

SEQ ID NO: 2703019 - RNA, 17 nt, Haemophilus influenzae Rd
aaugaaauucagugauu

SEQ ID NO: 2703020 - RNA, 19 nt, Haemophilus influenzae Rd
aaugaaauuucuugcucua

SEQ ID NO: 2703021 - RNA, 14 nt, Haemophilus influenzae Rd
aaugaacaaaaaau

SEQ ID NO: 2703022 - RNA, 21 nt, Haemophilus influenzae Rd
aaugaacaaaaaauuaaccgc

SEQ ID NO: 2703023 - RNA, 20 nt, Haemophilus influenzae Rd
aaugaacgaacuaaaauggu

SEQ ID NO: 2703024 - RNA, 20 nt, Haemophilus influenzae Rd
aaugaacgccgcaacuaaua

SEQ ID NO: 2703025 - RNA, 12 nt, Haemophilus influenzae Rd
aaugaacuuucu

SEQ ID NO: 2703026 - RNA, 18 nt, Haemophilus influenzae Rd
aaugaacuuucuacgaca

SEQ ID NO: 2703027 - RNA, 20 nt, Haemophilus influenzae Rd
aaugaacuuucuacgacauu

SEQ ID NO: 2703028 - RNA, 19 nt, Haemophilus influenzae Rd
aaugaaguaauaaucuucu

SEQ ID NO: 2703029 - RNA, 21 nt, Haemophilus influenzae Rd
aaugaagugaaagauaaauua

SEQ ID NO: 2703030 - RNA, 14 nt, Haemophilus influenzae Rd
aaugaauaaaacuu

SEQ ID NO: 2703031 - RNA, 20 nt, Haemophilus influenzae Rd
aaugaauaaaauuuuuaaag

SEQ ID NO: 2703032 - RNA, 18 nt, Haemophilus influenzae Rd
aaugaauaauuuuuauaa

SEQ ID NO: 2703033 - RNA, 15 nt, Haemophilus influenzae Rd
aaugaauauaaaauu

SEQ ID NO: 2703034 - RNA, 19 nt, Haemophilus influenzae Rd
aaugaauauacucaugagu

SEQ ID NO: 2703035 - RNA, 13 nt, Haemophilus influenzae Rd
aaugaauuaaaag

SEQ ID NO: 2703036 - RNA, 15 nt, Haemophilus influenzae Rd
aaugacagaaacaaa

SEQ ID NO: 2703037 - RNA, 15 nt, Haemophilus influenzae Rd
aaugacagaaucuaa

SEQ ID NO: 2703038 - RNA, 12 nt, Haemophilus influenzae Rd
aaugacaucaau

SEQ ID NO: 2703039 - RNA, 21 nt, Haemophilus influenzae Rd
aaugacauuaaagcaauugcu

SEQ ID NO: 2703040 - RNA, 22 nt, Haemophilus influenzae Rd
aaugacauuaaagcaauugcua

SEQ ID NO: 2703041 - RNA, 23 nt, Haemophilus influenzae Rd
aaugacauuaaagcaauugcuaa

SEQ ID NO: 2703042 - RNA, 22 nt, Haemophilus influenzae Rd
aaugaccgcacuuuuuugauau

SEQ ID NO: 2703043 - RNA, 14 nt, Haemophilus influenzae Rd
aauggcuuuccaau

SEQ ID NO: 2703044 - RNA, 21 nt, Haemophilus influenzae Rd
aauggcuuuucucaaaacauc

SEQ ID NO: 2703045 - RNA, 15 nt, Haemophilus influenzae Rd
aaugggacaaagcag

SEQ ID NO: 2703046 - RNA, 15 nt, Haemophilus influenzae Rd
aauggggcuuuuuuu

SEQ ID NO: 2703047 - RNA, 20 nt, Haemophilus influenzae Rd
aauggucuucaucgccuguu

SEQ ID NO: 2703048 - RNA, 19 nt, Haemophilus influenzae Rd
aauggugcuuuuuacaaca

SEQ ID NO: 2703049 - RNA, 22 nt, Haemophilus influenzae Rd
aaugguguuuuaugaauaacuu

SEQ ID NO: 2703050 - RNA, 23 nt, Haemophilus influenzae Rd
aaugguugcauuugcucaauacc

SEQ ID NO: 2703051 - RNA, 15 nt, Haemophilus influenzae Rd
aaugguuggaagaaa

SEQ ID NO: 2703052 - RNA, 23 nt, Haemophilus influenzae Rd
aaugguuuaaauaaccaauauuu

SEQ ID NO: 2703053 - RNA, 22 nt, Haemophilus influenzae Rd
aaugguuucgagcgugaagaua

SEQ ID NO: 2703054 - RNA, 22 nt, Haemophilus influenzae Rd
aauguaaaaauaaccuauaaua

SEQ ID NO: 2703055 - RNA, 20 nt, Haemophilus influenzae Rd
aauguaaaaauuggaaaaua

SEQ ID NO: 2703056 - RNA, 21 nt, Haemophilus influenzae Rd
aauguaaaaauuggaaaauaa

SEQ ID NO: 2703057 - RNA, 14 nt, Haemophilus influenzae Rd
aauguaaacaaaaa

SEQ ID NO: 2703058 - RNA, 15 nt, Haemophilus influenzae Rd
aauguaaacaaaaau

SEQ ID NO: 2703059 - RNA, 14 nt, Haemophilus influenzae Rd
aauguaaauuggca

SEQ ID NO: 2703060 - RNA, 13 nt, Haemophilus influenzae Rd
aauguaauaaaaa

SEQ ID NO: 2703061 - RNA, 16 nt, Haemophilus influenzae Rd
aauguaauaaaaaaua

SEQ ID NO: 2703062 - RNA, 22 nt, Haemophilus influenzae Rd
aauguaccacgguugauaccaa

SEQ ID NO: 2703063 - RNA, 17 nt, Haemophilus influenzae Rd
aauguagagauaauaaa

SEQ ID NO: 2703064 - RNA, 23 nt, Haemophilus influenzae Rd
aauguauaaagcauaauauuccu

SEQ ID NO: 2703065 - RNA, 14 nt, Haemophilus influenzae Rd
aauguaucugauuu

SEQ ID NO: 2703066 - RNA, 21 nt, Haemophilus influenzae Rd
aauguaucugauuuuuuaaga

SEQ ID NO: 2703067 - RNA, 15 nt, Haemophilus influenzae Rd
aaugucgaaauuuuu

SEQ ID NO: 2703068 - RNA, 18 nt, Haemophilus influenzae Rd
aaugucuuaaagauaaaa

SEQ ID NO: 2703069 - RNA, 20 nt, Haemophilus influenzae Rd
aaugugagccaauggaaaua

SEQ ID NO: 2703070 - RNA, 12 nt, Haemophilus influenzae Rd
aaugugauuucc

SEQ ID NO: 2703071 - RNA, 18 nt, Haemophilus influenzae Rd
aaugugcaaucagcaaca

SEQ ID NO: 2703072 - RNA, 20 nt, Haemophilus influenzae Rd
aaugugcgguagauuuucau

SEQ ID NO: 2703073 - RNA, 13 nt, Haemophilus influenzae Rd
aauguggugcugu

SEQ ID NO: 2703074 - RNA, 13 nt, Haemophilus influenzae Rd
aauguguugauuu

SEQ ID NO: 2703075 - RNA, 20 nt, Haemophilus influenzae Rd
aauguguuucgauacuuucu

SEQ ID NO: 2703076 - RNA, 21 nt, Haemophilus influenzae Rd
aauguguuucgauacuuucuu

SEQ ID NO: 2703077 - RNA, 15 nt, Haemophilus influenzae Rd
aauguuaauggcuua

SEQ ID NO: 2703078 - RNA, 20 nt, Haemophilus influenzae Rd
aauguuauugccuaauaaaa

SEQ ID NO: 2703079 - RNA, 23 nt, Haemophilus influenzae Rd
aauguuauugccuaauaaaaaau

SEQ ID NO: 2703080 - RNA, 17 nt, Haemophilus influenzae Rd
aauguucacguguuaaa

SEQ ID NO: 2703081 - RNA, 23 nt, Haemophilus influenzae Rd
aauguucacugcggcaaaaucuu

SEQ ID NO: 2703082 - RNA, 13 nt, Haemophilus influenzae Rd
aauguucauuuuu

SEQ ID NO: 2703083 - RNA, 17 nt, Haemophilus influenzae Rd
aauguucauuuuuauga

SEQ ID NO: 2703084 - RNA, 19 nt, Haemophilus influenzae Rd
aauguucauuuuuaugauu

SEQ ID NO: 2703085 - RNA, 20 nt, Haemophilus influenzae Rd
aauguucccuauaaauaaac

SEQ ID NO: 2703086 - RNA, 12 nt, Haemophilus influenzae Rd
aauguucgauuu

SEQ ID NO: 2703087 - RNA, 16 nt, Haemophilus influenzae Rd
aauguucgauuuuacu

SEQ ID NO: 2703088 - RNA, 13 nt, Haemophilus influenzae Rd
aauguucuacgua

SEQ ID NO: 2703089 - RNA, 18 nt, Haemophilus influenzae Rd
aauguugcugauugcaca

SEQ ID NO: 2703090 - RNA, 20 nt, Haemophilus influenzae Rd
aauguuggauuuucaauacg

SEQ ID NO: 2703091 - RNA, 15 nt, Haemophilus influenzae Rd
aauguuuaaaguaag

SEQ ID NO: 2703092 - RNA, 18 nt, Haemophilus influenzae Rd
aauguuuaaaguaagaau

SEQ ID NO: 2703093 - RNA, 19 nt, Haemophilus influenzae Rd
aauguuuaaaguaagaauu

SEQ ID NO: 2703094 - RNA, 21 nt, Haemophilus influenzae Rd
aauguuuacgcuaauuuaaga

SEQ ID NO: 2703095 - RNA, 16 nt, Haemophilus influenzae Rd
aauguuugaaggcaaa

SEQ ID NO: 2703096 - RNA, 17 nt, Haemophilus influenzae Rd
aauguuugguauaaaua

SEQ ID NO: 2703097 - RNA, 23 nt, Haemophilus influenzae Rd
aauguuugugcguuuuuuaauuc

SEQ ID NO: 2703098 - RNA, 21 nt, Haemophilus influenzae Rd
aauguuuucgaucauuugacg

SEQ ID NO: 2703099 - RNA, 23 nt, Haemophilus influenzae Rd
aauguuuucgaucauuugacgau

SEQ ID NO: 2703100 - RNA, 12 nt, Haemophilus influenzae Rd
aauguuuucgcc

SEQ ID NO: 2703101 - RNA, 20 nt, Haemophilus influenzae Rd
aauguuuucuugaccuucaa

SEQ ID NO: 2703102 - RNA, 19 nt, Haemophilus influenzae Rd
aauuaaaaaaauaguuaau

SEQ ID NO: 2703103 - RNA, 11 nt, Haemophilus influenzae Rd
aauuaaaaaug

SEQ ID NO: 2703104 - RNA, 18 nt, Haemophilus influenzae Rd
aauuaaaacuugggugau

SEQ ID NO: 2703105 - RNA, 20 nt, Haemophilus influenzae Rd
aauuaaaagugcgguuaaaa

SEQ ID NO: 2703106 - RNA, 16 nt, Haemophilus influenzae Rd
aauuaaaauauuuuua

SEQ ID NO: 2703107 - RNA, 19 nt, Haemophilus influenzae Rd
aauuaaaaucacauaaaaa

SEQ ID NO: 2703108 - RNA, 17 nt, Haemophilus influenzae Rd
aauuaaacaaaaucuua

SEQ ID NO: 2703109 - RNA, 12 nt, Haemophilus influenzae Rd
aauuaaacauuu

SEQ ID NO: 2703110 - RNA, 14 nt, Haemophilus influenzae Rd
aauuaaacauuucc

SEQ ID NO: 2703111 - RNA, 15 nt, Haemophilus influenzae Rd
aauuaaacuuucaau

SEQ ID NO: 2703112 - RNA, 21 nt, Haemophilus influenzae Rd
aauuaaagaaaaaccuugugg

SEQ ID NO: 2703113 - RNA, 13 nt, Haemophilus influenzae Rd
aauuaaagaaauu

SEQ ID NO: 2703114 - RNA, 22 nt, Haemophilus influenzae Rd
aauuaaagaaauuucauauuuc

SEQ ID NO: 2703115 - RNA, 18 nt, Haemophilus influenzae Rd
aauuaaagacguuugauu

SEQ ID NO: 2703116 - RNA, 19 nt, Haemophilus influenzae Rd
aauuaaagauaguaauguu

SEQ ID NO: 2703117 - RNA, 15 nt, Haemophilus influenzae Rd
aauuaaagccacaua

SEQ ID NO: 2703118 - RNA, 13 nt, Haemophilus influenzae Rd
aauuaaagugcag

SEQ ID NO: 2703119 - RNA, 13 nt, Haemophilus influenzae Rd
aauuaaauacaaa

SEQ ID NO: 2703120 - RNA, 16 nt, Haemophilus influenzae Rd
aauuaaauccaucaau

SEQ ID NO: 2703121 - RNA, 13 nt, Haemophilus influenzae Rd
aauuaaauuacca

SEQ ID NO: 2703122 - RNA, 15 nt, Haemophilus influenzae Rd
aauuaaauucauuua

SEQ ID NO: 2703123 - RNA, 18 nt, Haemophilus influenzae Rd
aauuaaauucauuuaaaa

SEQ ID NO: 2703124 - RNA, 20 nt, Haemophilus influenzae Rd
aauuaaauucauuuaaaaua

SEQ ID NO: 2703125 - RNA, 17 nt, Haemophilus influenzae Rd
aauuaaauuguaacuau

SEQ ID NO: 2703126 - RNA, 18 nt, Haemophilus influenzae Rd
aauuaaauuguaacuaua

SEQ ID NO: 2703127 - RNA, 11 nt, Haemophilus influenzae Rd
aauuaacaaua

SEQ ID NO: 2703128 - RNA, 20 nt, Haemophilus influenzae Rd
aauuaaccccagaaaugcuu

SEQ ID NO: 2703129 - RNA, 14 nt, Haemophilus influenzae Rd
aauuaaccgcacuu

SEQ ID NO: 2703130 - RNA, 16 nt, Haemophilus influenzae Rd
aauuaacgcucaaaaa

SEQ ID NO: 2703131 - RNA, 18 nt, Haemophilus influenzae Rd
aauuaacgcucaaaaauu

SEQ ID NO: 2703132 - RNA, 18 nt, Haemophilus influenzae Rd
aauuaacgugcauuuuua

SEQ ID NO: 2703133 - RNA, 13 nt, Haemophilus influenzae Rd
aauuaacuuaucu

SEQ ID NO: 2703134 - RNA, 13 nt, Haemophilus influenzae Rd
aauuaagaaaaua

SEQ ID NO: 2703135 - RNA, 21 nt, Haemophilus influenzae Rd
aauuaagaaauuuucuuuucu

SEQ ID NO: 2703136 - RNA, 20 nt, Haemophilus influenzae Rd
aauuaagacgggaaacaaua

SEQ ID NO: 2703137 - RNA, 17 nt, Haemophilus influenzae Rd
aauuaaggacuaaacuu

SEQ ID NO: 2703138 - RNA, 16 nt, Haemophilus influenzae Rd
aauuaaggauuuauuu

SEQ ID NO: 2703139 - RNA, 23 nt, Haemophilus influenzae Rd
aauuaaggauuucuuaugaaaaa

SEQ ID NO: 2703140 - RNA, 16 nt, Haemophilus influenzae Rd
aauuaaguuugagcaa

SEQ ID NO: 2703141 - RNA, 14 nt, Haemophilus influenzae Rd
aauuaauaaaaaau

SEQ ID NO: 2703142 - RNA, 16 nt, Haemophilus influenzae Rd
aauuaauaagaaaauc

SEQ ID NO: 2703143 - RNA, 16 nt, Haemophilus influenzae Rd
aauuaauacgccaaga

SEQ ID NO: 2703144 - RNA, 22 nt, Haemophilus influenzae Rd
aauuaauacgucaauugcuaaa

SEQ ID NO: 2703145 - RNA, 18 nt, Haemophilus influenzae Rd
aauuaauacugaaaugau

SEQ ID NO: 2703146 - RNA, 20 nt, Haemophilus influenzae Rd
aauuaauccaucauuuuucg

SEQ ID NO: 2703147 - RNA, 14 nt, Haemophilus influenzae Rd
aauuaaucugcauu

SEQ ID NO: 2703148 - RNA, 14 nt, Haemophilus influenzae Rd
aauucacugcaacg

SEQ ID NO: 2703149 - RNA, 13 nt, Haemophilus influenzae Rd
aauucagcaagaa

SEQ ID NO: 2703150 - RNA, 18 nt, Haemophilus influenzae Rd
aauucagcgagagaauau

SEQ ID NO: 2703151 - RNA, 21 nt, Haemophilus influenzae Rd
aauucagcgagagaauauuua

SEQ ID NO: 2703152 - RNA, 17 nt, Haemophilus influenzae Rd
aauucagcggcuuucuu

SEQ ID NO: 2703153 - RNA, 19 nt, Haemophilus influenzae Rd
aauucagcggcuuucuuca

SEQ ID NO: 2703154 - RNA, 18 nt, Haemophilus influenzae Rd
aauucaggcucuaacaua

SEQ ID NO: 2703155 - RNA, 17 nt, Haemophilus influenzae Rd
aauucaguaagaaacca

SEQ ID NO: 2703156 - RNA, 18 nt, Haemophilus influenzae Rd
aauucaguaagaaaccaa

SEQ ID NO: 2703157 - RNA, 14 nt, Haemophilus influenzae Rd
aauucagucuuaau

SEQ ID NO: 2703158 - RNA, 19 nt, Haemophilus influenzae Rd
aauucaguguaauguuuua

SEQ ID NO: 2703159 - RNA, 16 nt, Haemophilus influenzae Rd
aauucaguuaagaaaa

SEQ ID NO: 2703160 - RNA, 17 nt, Haemophilus influenzae Rd
aauucaguuaagaaaau

SEQ ID NO: 2703161 - RNA, 18 nt, Haemophilus influenzae Rd
aauucaguuaagaaaaua

SEQ ID NO: 2703162 - RNA, 12 nt, Haemophilus influenzae Rd
aauucaguucaa

SEQ ID NO: 2703163 - RNA, 14 nt, Haemophilus influenzae Rd
aauucauaaaaaug

SEQ ID NO: 2703164 - RNA, 17 nt, Haemophilus influenzae Rd
aauucaucaaaauuuaa

SEQ ID NO: 2703165 - RNA, 18 nt, Haemophilus influenzae Rd
aauucaucaagcucaaaa

SEQ ID NO: 2703166 - RNA, 15 nt, Haemophilus influenzae Rd
aauucaucacaucag

SEQ ID NO: 2703167 - RNA, 14 nt, Haemophilus influenzae Rd
aauucaucuucugc

SEQ ID NO: 2703168 - RNA, 16 nt, Haemophilus influenzae Rd
aauucaucuucugcug

SEQ ID NO: 2703169 - RNA, 13 nt, Haemophilus influenzae Rd
aauucaucuucuu

SEQ ID NO: 2703170 - RNA, 16 nt, Haemophilus influenzae Rd
aauucaucuugaucca

SEQ ID NO: 2703171 - RNA, 22 nt, Haemophilus influenzae Rd
aauucauuauuuggugcaacga

SEQ ID NO: 2703172 - RNA, 13 nt, Haemophilus influenzae Rd
aauucauucuugc

SEQ ID NO: 2703173 - RNA, 19 nt, Haemophilus influenzae Rd
aauucauugacuucuguau

SEQ ID NO: 2703174 - RNA, 17 nt, Haemophilus influenzae Rd
aauucauuuaaaauaua

SEQ ID NO: 2703175 - RNA, 13 nt, Haemophilus influenzae Rd
aauuccauauuac

SEQ ID NO: 2703176 - RNA, 22 nt, Haemophilus influenzae Rd
aauuccauauuguuucaauuua

SEQ ID NO: 2703177 - RNA, 12 nt, Haemophilus influenzae Rd
aauuccauugca

SEQ ID NO: 2703178 - RNA, 21 nt, Haemophilus influenzae Rd
aauucccuagccuuuucuagc

SEQ ID NO: 2703179 - RNA, 21 nt, Haemophilus influenzae Rd
aauuccgacuaaaaccaagaa

SEQ ID NO: 2703180 - RNA, 15 nt, Haemophilus influenzae Rd
aauuccuaaaauaca

SEQ ID NO: 2703181 - RNA, 17 nt, Haemophilus influenzae Rd
aauuccuaaaauacaaa

SEQ ID NO: 2703182 - RNA, 14 nt, Haemophilus influenzae Rd
aauuccuucaucgu

SEQ ID NO: 2703183 - RNA, 21 nt, Haemophilus influenzae Rd
aauuccuucaucgucuucuuc

SEQ ID NO: 2703184 - RNA, 14 nt, Haemophilus influenzae Rd
aauuccuuccaaca

SEQ ID NO: 2703185 - RNA, 21 nt, Haemophilus influenzae Rd
aauuccuuuuucuacuucuuc

SEQ ID NO: 2703186 - RNA, 23 nt, Haemophilus influenzae Rd
aauuccuuuuucuacuucuuccg

SEQ ID NO: 2703187 - RNA, 15 nt, Haemophilus influenzae Rd
aauucgcugauuuau

SEQ ID NO: 2703188 - RNA, 17 nt, Haemophilus influenzae Rd
aauucgcuuuucuuuug

SEQ ID NO: 2703189 - RNA, 16 nt, Haemophilus influenzae Rd
aauucgcuuuuuuagu

SEQ ID NO: 2703190 - RNA, 16 nt, Haemophilus influenzae Rd
aauucguacaaaugaa

SEQ ID NO: 2703191 - RNA, 16 nt, Haemophilus influenzae Rd
aauucgugcaaauuuu

SEQ ID NO: 2703192 - RNA, 17 nt, Haemophilus influenzae Rd
aauucgugcaaauuuuu

SEQ ID NO: 2703193 - RNA, 16 nt, Haemophilus influenzae Rd
aauucguuguaauuga

SEQ ID NO: 2703194 - RNA, 17 nt, Haemophilus influenzae Rd
aauucguuucuugguuu

SEQ ID NO: 2703195 - RNA, 18 nt, Haemophilus influenzae Rd
aauucguuucuugguuua

SEQ ID NO: 2703196 - RNA, 19 nt, Haemophilus influenzae Rd
aauucguuuuucaaacuga

SEQ ID NO: 2703197 - RNA, 12 nt, Haemophilus influenzae Rd
aauucuaaaaaa

SEQ ID NO: 2703198 - RNA, 16 nt, Haemophilus influenzae Rd
aauucuaguucuuccc

SEQ ID NO: 2703199 - RNA, 17 nt, Haemophilus influenzae Rd
aauucuaguucuucccc

SEQ ID NO: 2703200 - RNA, 20 nt, Haemophilus influenzae Rd
aauucuaguucuuccccuca

SEQ ID NO: 2703201 - RNA, 19 nt, Haemophilus influenzae Rd
aauucuauauuauuuaagc

SEQ ID NO: 2703202 - RNA, 13 nt, Haemophilus influenzae Rd
aauucuauuaaaa

SEQ ID NO: 2703203 - RNA, 21 nt, Haemophilus influenzae Rd
aauucuauuaaaauauuuccg

SEQ ID NO: 2703204 - RNA, 19 nt, Haemophilus influenzae Rd
aauucucaagaauauauuu

SEQ ID NO: 2703205 - RNA, 16 nt, Haemophilus influenzae Rd
aauucucaauugcaga

SEQ ID NO: 2703206 - RNA, 20 nt, Haemophilus influenzae Rd
aauucucgguuguuucaucc

SEQ ID NO: 2703207 - RNA, 20 nt, Haemophilus influenzae Rd
aauucucuguuucuuuaaau

SEQ ID NO: 2703208 - RNA, 14 nt, Haemophilus influenzae Rd
aauucucuucaacu

SEQ ID NO: 2703209 - RNA, 20 nt, Haemophilus influenzae Rd
aauucugagaucgaaauuag

SEQ ID NO: 2703210 - RNA, 16 nt, Haemophilus influenzae Rd
aauucugcuaaaucug

SEQ ID NO: 2703211 - RNA, 16 nt, Haemophilus influenzae Rd
aauucugcuuaguucc

SEQ ID NO: 2703212 - RNA, 17 nt, Haemophilus influenzae Rd
aauucuggugcauuuau

SEQ ID NO: 2703213 - RNA, 22 nt, Haemophilus influenzae Rd
aauucuucaauaacaacuggaa

SEQ ID NO: 2703214 - RNA, 11 nt, Haemophilus influenzae Rd
aauucuuccaa

SEQ ID NO: 2703215 - RNA, 16 nt, Haemophilus influenzae Rd
aauucuuccaaaaguu

SEQ ID NO: 2703216 - RNA, 11 nt, Haemophilus influenzae Rd
aauucuuccca

SEQ ID NO: 2703217 - RNA, 21 nt, Haemophilus influenzae Rd
aauucuucccagcguaaaaau

SEQ ID NO: 2703218 - RNA, 15 nt, Haemophilus influenzae Rd
aauucuucgaaaaua

SEQ ID NO: 2703219 - RNA, 21 nt, Haemophilus influenzae Rd
aauucuucuauuuuaucaaga

SEQ ID NO: 2703220 - RNA, 17 nt, Haemophilus influenzae Rd
aauucuugaaugucuua

SEQ ID NO: 2703221 - RNA, 19 nt, Haemophilus influenzae Rd
aauucuugaaugucuuaaa

SEQ ID NO: 2703222 - RNA, 21 nt, Haemophilus influenzae Rd
aauucuugacguaauucucgc

SEQ ID NO: 2703223 - RNA, 21 nt, Haemophilus influenzae Rd
aauucuugucuuuuaaguuag

SEQ ID NO: 2703224 - RNA, 19 nt, Haemophilus influenzae Rd
aauucuugugcaaaauaac

SEQ ID NO: 2703225 - RNA, 14 nt, Haemophilus influenzae Rd
aauucuuguuuaau

SEQ ID NO: 2703226 - RNA, 19 nt, Haemophilus influenzae Rd
aauucuuguuuaauauuuu

SEQ ID NO: 2703227 - RNA, 19 nt, Haemophilus influenzae Rd
aauucuuuaaucguuacca

SEQ ID NO: 2703228 - RNA, 20 nt, Haemophilus influenzae Rd
aauucuuucacgucaccuac

SEQ ID NO: 2703229 - RNA, 13 nt, Haemophilus influenzae Rd
aauucuuuuaaau

SEQ ID NO: 2703230 - RNA, 11 nt, Haemophilus influenzae Rd
aauucuuuucu

SEQ ID NO: 2703231 - RNA, 22 nt, Haemophilus influenzae Rd
aauucuuuugcuaguaagauuu

SEQ ID NO: 2703232 - RNA, 21 nt, Haemophilus influenzae Rd
aauucuuuuucacuauuaccg

SEQ ID NO: 2703233 - RNA, 12 nt, Haemophilus influenzae Rd
aauugaaaaaau

SEQ ID NO: 2703234 - RNA, 18 nt, Haemophilus influenzae Rd
aauugaaaagaaaguauu

SEQ ID NO: 2703235 - RNA, 15 nt, Haemophilus influenzae Rd
aauugaacugaauua

SEQ ID NO: 2703236 - RNA, 16 nt, Haemophilus influenzae Rd
aauugaagaguuugau

SEQ ID NO: 2703237 - RNA, 19 nt, Haemophilus influenzae Rd
aauugaagaguuugaucau

SEQ ID NO: 2703238 - RNA, 20 nt, Haemophilus influenzae Rd
aauugaagaguuugaucaug

SEQ ID NO: 2703239 - RNA, 18 nt, Haemophilus influenzae Rd
aauugaauaucuaaauga

SEQ ID NO: 2703240 - RNA, 16 nt, Haemophilus influenzae Rd
aauugacaauuaauau

SEQ ID NO: 2703241 - RNA, 17 nt, Haemophilus influenzae Rd
aauugacaauuaauaua

SEQ ID NO: 2703242 - RNA, 18 nt, Haemophilus influenzae Rd
aauugacaauuaauauaa

SEQ ID NO: 2703243 - RNA, 19 nt, Haemophilus influenzae Rd
aauugacgggcuaggcuuu

SEQ ID NO: 2703244 - RNA, 18 nt, Haemophilus influenzae Rd
aauugauaccaagauaau

SEQ ID NO: 2703245 - RNA, 16 nt, Haemophilus influenzae Rd
aauugaucaaaauuau

SEQ ID NO: 2703246 - RNA, 23 nt, Haemophilus influenzae Rd
aauugaucaagccacugauuaua

SEQ ID NO: 2703247 - RNA, 18 nt, Haemophilus influenzae Rd
aauugaucgaaugauuca

SEQ ID NO: 2703248 - RNA, 13 nt, Haemophilus influenzae Rd
aauugaucuaaau

SEQ ID NO: 2703249 - RNA, 16 nt, Haemophilus influenzae Rd
aauugaucugcuggug

SEQ ID NO: 2703250 - RNA, 12 nt, Haemophilus influenzae Rd
aauugaugcaca

SEQ ID NO: 2703251 - RNA, 14 nt, Haemophilus influenzae Rd
aauugaugcuaaau

SEQ ID NO: 2703252 - RNA, 16 nt, Haemophilus influenzae Rd
aauugauggaauuuau

SEQ ID NO: 2703253 - RNA, 18 nt, Haemophilus influenzae Rd
aauugauggcgugaaaua

SEQ ID NO: 2703254 - RNA, 22 nt, Haemophilus influenzae Rd
aauuucaucgcgcaaaauaaua

SEQ ID NO: 2703255 - RNA, 19 nt, Haemophilus influenzae Rd
aauuucaucgcguuuuuuc

SEQ ID NO: 2703256 - RNA, 16 nt, Haemophilus influenzae Rd
aauuucaucuuuuaaa

SEQ ID NO: 2703257 - RNA, 19 nt, Haemophilus influenzae Rd
aauuucauucaacaauuca

SEQ ID NO: 2703258 - RNA, 17 nt, Haemophilus influenzae Rd
aauuucauuguuaaaua

SEQ ID NO: 2703259 - RNA, 14 nt, Haemophilus influenzae Rd
aauuucccuaaaau

SEQ ID NO: 2703260 - RNA, 18 nt, Haemophilus influenzae Rd
aauuucgacauauucuac

SEQ ID NO: 2703261 - RNA, 20 nt, Haemophilus influenzae Rd
aauuucgacauauucuaccg

SEQ ID NO: 2703262 - RNA, 19 nt, Haemophilus influenzae Rd
aauuucgcauaauauaaau

SEQ ID NO: 2703263 - RNA, 13 nt, Haemophilus influenzae Rd
aauuucgccagaa

SEQ ID NO: 2703264 - RNA, 20 nt, Haemophilus influenzae Rd
aauuucgccagaacuuuuua

SEQ ID NO: 2703265 - RNA, 20 nt, Haemophilus influenzae Rd
aauuucgccgccuuugauuu

SEQ ID NO: 2703266 - RNA, 22 nt, Haemophilus influenzae Rd
aauuucgcucaauaauuuucac

SEQ ID NO: 2703267 - RNA, 16 nt, Haemophilus influenzae Rd
aauuucgucaaaaaug

SEQ ID NO: 2703268 - RNA, 15 nt, Haemophilus influenzae Rd
aauuucuaauuuuug

SEQ ID NO: 2703269 - RNA, 14 nt, Haemophilus influenzae Rd
aauuucucaccaaa

SEQ ID NO: 2703270 - RNA, 18 nt, Haemophilus influenzae Rd
aauuucucuacuaauuca

SEQ ID NO: 2703271 - RNA, 14 nt, Haemophilus influenzae Rd
aauuucugaacaca

SEQ ID NO: 2703272 - RNA, 22 nt, Haemophilus influenzae Rd
aauuucugcugccauaauggaa

SEQ ID NO: 2703273 - RNA, 20 nt, Haemophilus influenzae Rd
aauuucuuaauuaagauaau

SEQ ID NO: 2703274 - RNA, 22 nt, Haemophilus influenzae Rd
aauuucuucauacgaccuucaa

SEQ ID NO: 2703275 - RNA, 15 nt, Haemophilus influenzae Rd
aauuucuuguuuaaa

SEQ ID NO: 2703276 - RNA, 21 nt, Haemophilus influenzae Rd
aauuucuuucgcuuuugcuac

SEQ ID NO: 2703277 - RNA, 11 nt, Haemophilus influenzae Rd
aauuucuuuug

SEQ ID NO: 2703278 - RNA, 17 nt, Haemophilus influenzae Rd
aauuucuuuugcaagaa

SEQ ID NO: 2703279 - RNA, 20 nt, Haemophilus influenzae Rd
aauuugacauuccuauucua

SEQ ID NO: 2703280 - RNA, 23 nt, Haemophilus influenzae Rd
aauuugaccuugaaguuugauuc

SEQ ID NO: 2703281 - RNA, 17 nt, Haemophilus influenzae Rd
aauuugacgcgcacaua

SEQ ID NO: 2703282 - RNA, 23 nt, Haemophilus influenzae Rd
aauuugagcggugaauucuuuuc

SEQ ID NO: 2703283 - RNA, 22 nt, Haemophilus influenzae Rd
aauuugagguauuguccuucau

SEQ ID NO: 2703284 - RNA, 18 nt, Haemophilus influenzae Rd
aauuugagucucaaauuu

SEQ ID NO: 2703285 - RNA, 19 nt, Haemophilus influenzae Rd
aauuugaucauauuagaau

SEQ ID NO: 2703286 - RNA, 19 nt, Haemophilus influenzae Rd
aauuugaucuaauuugcca

SEQ ID NO: 2703287 - RNA, 21 nt, Haemophilus influenzae Rd
aauuugaucuaauuugccaag

SEQ ID NO: 2703288 - RNA, 16 nt, Haemophilus influenzae Rd
aauuugcaucauuucu

SEQ ID NO: 2703289 - RNA, 21 nt, Haemophilus influenzae Rd
aauuugccccaauauuuuuca

SEQ ID NO: 2703290 - RNA, 19 nt, Haemophilus influenzae Rd
aauuugcgucuuaaauuag

SEQ ID NO: 2703291 - RNA, 17 nt, Haemophilus influenzae Rd
aauuugcucaauaauuu

SEQ ID NO: 2703292 - RNA, 22 nt, Haemophilus influenzae Rd
aauuugcucaauaauuucaaua

SEQ ID NO: 2703293 - RNA, 18 nt, Haemophilus influenzae Rd
aauuugcuguggugaagu

SEQ ID NO: 2703294 - RNA, 23 nt, Haemophilus influenzae Rd
aauuugcuguggugaagugcggu

SEQ ID NO: 2703295 - RNA, 20 nt, Haemophilus influenzae Rd
aauuuggcaaaaguaagcaa

SEQ ID NO: 2703296 - RNA, 16 nt, Haemophilus influenzae Rd
aauuuggguaguuuau

SEQ ID NO: 2703297 - RNA, 23 nt, Haemophilus influenzae Rd
aauuugggugguuuuuguuuaau

SEQ ID NO: 2703298 - RNA, 22 nt, Haemophilus influenzae Rd
aauuuggucuguuucuucuacu

SEQ ID NO: 2703299 - RNA, 16 nt, Haemophilus influenzae Rd
aauuuggugcucuggg

SEQ ID NO: 2703300 - RNA, 23 nt, Haemophilus influenzae Rd
aauuugguuuugcucuuuuucca

SEQ ID NO: 2703301 - RNA, 13 nt, Haemophilus influenzae Rd
aauuuguccuuua

SEQ ID NO: 2703302 - RNA, 22 nt, Haemophilus influenzae Rd
aauuugucgauaaaagaagcua

SEQ ID NO: 2703303 - RNA, 18 nt, Haemophilus influenzae Rd
aauuuguggaaauugcca

SEQ ID NO: 2703304 - RNA, 21 nt, Haemophilus influenzae Rd
aauuuguggaaauugccaaaa

SEQ ID NO: 2703305 - RNA, 22 nt, Haemophilus influenzae Rd
aauuuguuagaucaaauuugau

SEQ ID NO: 2703306 - RNA, 15 nt, Haemophilus influenzae Rd
aauuuuaaaauaguu

SEQ ID NO: 2703307 - RNA, 13 nt, Haemophilus influenzae Rd
aauuuuaaaauuu

SEQ ID NO: 2703308 - RNA, 21 nt, Haemophilus influenzae Rd
aauuuuaaaccgucauuuaua

SEQ ID NO: 2703309 - RNA, 23 nt, Haemophilus influenzae Rd
aauuuuaaaccgucauuuauaaa

SEQ ID NO: 2703310 - RNA, 10 nt, Haemophilus influenzae Rd
aauuuuaacg

SEQ ID NO: 2703311 - RNA, 17 nt, Haemophilus influenzae Rd
aauuuuaaucgcacuua

SEQ ID NO: 2703312 - RNA, 13 nt, Haemophilus influenzae Rd
aauuuuacaguuu

SEQ ID NO: 2703313 - RNA, 23 nt, Haemophilus influenzae Rd
aauuuuacaguuucaacaaagcg

SEQ ID NO: 2703314 - RNA, 17 nt, Haemophilus influenzae Rd
aauuuuaccaagaaaua

SEQ ID NO: 2703315 - RNA, 22 nt, Haemophilus influenzae Rd
aauuuuacguaguacaucauuu

SEQ ID NO: 2703316 - RNA, 18 nt, Haemophilus influenzae Rd
aauuuuacguuuuaaauu

SEQ ID NO: 2703317 - RNA, 10 nt, Haemophilus influenzae Rd
aauuuuauag

SEQ ID NO: 2703318 - RNA, 17 nt, Haemophilus influenzae Rd
aauuuuaucuaugaaaa

SEQ ID NO: 2703319 - RNA, 13 nt, Haemophilus influenzae Rd
aauuuuaugccgu

SEQ ID NO: 2703320 - RNA, 18 nt, Haemophilus influenzae Rd
aauuuuccaaauuccauc

SEQ ID NO: 2703321 - RNA, 18 nt, Haemophilus influenzae Rd
aauuuuccaauucuaguu

SEQ ID NO: 2703322 - RNA, 21 nt, Haemophilus influenzae Rd
aauuuuccaauucuaguucuu

SEQ ID NO: 2703323 - RNA, 22 nt, Haemophilus influenzae Rd
aauuuuccgcauaaauaauaaa

SEQ ID NO: 2703324 - RNA, 16 nt, Haemophilus influenzae Rd
aauuuuccuaacaaua

SEQ ID NO: 2703325 - RNA, 18 nt, Haemophilus influenzae Rd
aauuuucgacuugugcaa

SEQ ID NO: 2703326 - RNA, 22 nt, Haemophilus influenzae Rd
aauuuucugugagucuugcuuu

SEQ ID NO: 2703327 - RNA, 17 nt, Haemophilus influenzae Rd
aauuuugaagucuuaau

SEQ ID NO: 2703328 - RNA, 12 nt, Haemophilus influenzae Rd
aauuuugaugaa

SEQ ID NO: 2703329 - RNA, 17 nt, Haemophilus influenzae Rd
aauuuugaugaaaguug

SEQ ID NO: 2703330 - RNA, 22 nt, Haemophilus influenzae Rd
aauuuugcguguguuaucacaa

SEQ ID NO: 2703331 - RNA, 21 nt, Haemophilus influenzae Rd
aauuuugcuuuaaaucaaaua

SEQ ID NO: 2703332 - RNA, 20 nt, Haemophilus influenzae Rd
aauuuuggaucauuagcaac

SEQ ID NO: 2703333 - RNA, 18 nt, Haemophilus influenzae Rd
aauuuuggcgaaccuuuc

SEQ ID NO: 2703334 - RNA, 19 nt, Haemophilus influenzae Rd
aauuuuggcuuaauuacua

SEQ ID NO: 2703335 - RNA, 13 nt, Haemophilus influenzae Rd
aauuuugguuaaa

SEQ ID NO: 2703336 - RNA, 13 nt, Haemophilus influenzae Rd
aauuuuuaaaaua

SEQ ID NO: 2703337 - RNA, 19 nt, Haemophilus influenzae Rd
aauuuuuaaccgcacuuuu

SEQ ID NO: 2703338 - RNA, 20 nt, Haemophilus influenzae Rd
aauuuuuaauucuuuuucac

SEQ ID NO: 2703339 - RNA, 15 nt, Haemophilus influenzae Rd
aauuuuuagugauuu

SEQ ID NO: 2703340 - RNA, 19 nt, Haemophilus influenzae Rd
aauuuuuauaauuuugaug

SEQ ID NO: 2703341 - RNA, 20 nt, Haemophilus influenzae Rd
aauuuuuaucuuuaaagaau

SEQ ID NO: 2703342 - RNA, 15 nt, Haemophilus influenzae Rd
aauuuuuauuuuuac

SEQ ID NO: 2703343 - RNA, 12 nt, Haemophilus influenzae Rd
aauuuuucaccu

SEQ ID NO: 2703344 - RNA, 21 nt, Haemophilus influenzae Rd
aauuuuucaccugugauaagu

SEQ ID NO: 2703345 - RNA, 11 nt, Haemophilus influenzae Rd
aauuuuucacu

SEQ ID NO: 2703346 - RNA, 22 nt, Haemophilus influenzae Rd
aauuuuucacuguauuggaaaa

SEQ ID NO: 2703347 - RNA, 21 nt, Haemophilus influenzae Rd
aauuuuuccacauuaaacuga

SEQ ID NO: 2703348 - RNA, 13 nt, Haemophilus influenzae Rd
aauuuuuccgcug

SEQ ID NO: 2703349 - RNA, 23 nt, Haemophilus influenzae Rd
aauuuuucgcaagauagcaaaau

SEQ ID NO: 2703350 - RNA, 21 nt, Haemophilus influenzae Rd
aauuuuucggauuaagugcgg

SEQ ID NO: 2703351 - RNA, 21 nt, Haemophilus influenzae Rd
aauuuuucgucaaucaucccu

SEQ ID NO: 2703352 - RNA, 11 nt, Haemophilus influenzae Rd
aauuuuucuac

SEQ ID NO: 2703353 - RNA, 15 nt, Haemophilus influenzae Rd
aauuuuucuuuucuu

SEQ ID NO: 2703354 - RNA, 19 nt, Haemophilus influenzae Rd
aauuuuugacggcuugcuu

SEQ ID NO: 2703355 - RNA, 16 nt, Haemophilus influenzae Rd
aauuuuugcauuuuca

SEQ ID NO: 2703356 - RNA, 13 nt, Haemophilus influenzae Rd
aauuuuuggauuu

SEQ ID NO: 2703357 - RNA, 13 nt, Haemophilus influenzae Rd
aauuuuuuaaccg

SEQ ID NO: 2703358 - RNA, 15 nt, Haemophilus influenzae Rd
acaaccagcgcacca

SEQ ID NO: 2703359 - RNA, 20 nt, Haemophilus influenzae Rd
acaaccaucuucaacgauaa

SEQ ID NO: 2703360 - RNA, 21 nt, Haemophilus influenzae Rd
acaaccaucuucaacgauaac

SEQ ID NO: 2703361 - RNA, 21 nt, Haemophilus influenzae Rd
acaacccuauucgcugauaaa

SEQ ID NO: 2703362 - RNA, 21 nt, Haemophilus influenzae Rd
acaaccuguuugggauaagca

SEQ ID NO: 2703363 - RNA, 21 nt, Haemophilus influenzae Rd
acaacgauuacaucuaaugcc

SEQ ID NO: 2703364 - RNA, 15 nt, Haemophilus influenzae Rd
acaacgcgacuaaau

SEQ ID NO: 2703365 - RNA, 20 nt, Haemophilus influenzae Rd
acaacgcgacuaaaucuuau

SEQ ID NO: 2703366 - RNA, 14 nt, Haemophilus influenzae Rd
acaacggaagauuu

SEQ ID NO: 2703367 - RNA, 21 nt, Haemophilus influenzae Rd
acaacggaagauuuacccaac

SEQ ID NO: 2703368 - RNA, 14 nt, Haemophilus influenzae Rd
acaacguaaaagua

SEQ ID NO: 2703369 - RNA, 15 nt, Haemophilus influenzae Rd
acaacguaaaaguaa

SEQ ID NO: 2703370 - RNA, 16 nt, Haemophilus influenzae Rd
acaacgugaaguaaau

SEQ ID NO: 2703371 - RNA, 21 nt, Haemophilus influenzae Rd
acaacuaaauaaggcguaaaa

SEQ ID NO: 2703372 - RNA, 13 nt, Haemophilus influenzae Rd
acaacuaacauuu

SEQ ID NO: 2703373 - RNA, 12 nt, Haemophilus influenzae Rd
acaacuaauccc

SEQ ID NO: 2703374 - RNA, 13 nt, Haemophilus influenzae Rd
acaacuaauccca

SEQ ID NO: 2703375 - RNA, 14 nt, Haemophilus influenzae Rd
acaacuaccacagg

SEQ ID NO: 2703376 - RNA, 13 nt, Haemophilus influenzae Rd
acaacucacaaua

SEQ ID NO: 2703377 - RNA, 16 nt, Haemophilus influenzae Rd
acaacugcaaaugaaa

SEQ ID NO: 2703378 - RNA, 17 nt, Haemophilus influenzae Rd
acaacugcaaaugaaac

SEQ ID NO: 2703379 - RNA, 22 nt, Haemophilus influenzae Rd
acaacugcuaggacauagccuu

SEQ ID NO: 2703380 - RNA, 11 nt, Haemophilus influenzae Rd
acaacuggaau

SEQ ID NO: 2703381 - RNA, 20 nt, Haemophilus influenzae Rd
acaacuggacgcucuacauu

SEQ ID NO: 2703382 - RNA, 19 nt, Haemophilus influenzae Rd
acaacuucggaagaaaaag

SEQ ID NO: 2703383 - RNA, 23 nt, Haemophilus influenzae Rd
acaacuuuuuauuuucugcaguu

SEQ ID NO: 2703384 - RNA, 17 nt, Haemophilus influenzae Rd
acaacuuuuucaucuuu

SEQ ID NO: 2703385 - RNA, 24 nt, Haemophilus influenzae Rd
acaagaaaccaaaauagcugugca

SEQ ID NO: 2703386 - RNA, 14 nt, Haemophilus influenzae Rd
acaagaaauaauaa

SEQ ID NO: 2703387 - RNA, 17 nt, Haemophilus influenzae Rd
acaagaaauaauaaaau

SEQ ID NO: 2703388 - RNA, 18 nt, Haemophilus influenzae Rd
acaagaaauaauaaaaua

SEQ ID NO: 2703389 - RNA, 12 nt, Haemophilus influenzae Rd
acaagaaauuuu

SEQ ID NO: 2703390 - RNA, 22 nt, Haemophilus influenzae Rd
acaagaaucaucgcgaugacua

SEQ ID NO: 2703391 - RNA, 14 nt, Haemophilus influenzae Rd
acaagacaaaauaa

SEQ ID NO: 2703392 - RNA, 16 nt, Haemophilus influenzae Rd
acaagaugacugcaau

SEQ ID NO: 2703393 - RNA, 21 nt, Haemophilus influenzae Rd
acaagaugacugcaauuauca

SEQ ID NO: 2703394 - RNA, 16 nt, Haemophilus influenzae Rd
acaagaugucaaaugu

SEQ ID NO: 2703395 - RNA, 19 nt, Haemophilus influenzae Rd
acaagaugucaaaugugac

SEQ ID NO: 2703396 - RNA, 12 nt, Haemophilus influenzae Rd
acaagcaacaau

SEQ ID NO: 2703397 - RNA, 17 nt, Haemophilus influenzae Rd
acaagcaaguuugcgau

SEQ ID NO: 2703398 - RNA, 23 nt, Haemophilus influenzae Rd
acaagcaaguuugcgaucaucac

SEQ ID NO: 2703399 - RNA, 13 nt, Haemophilus influenzae Rd
acaagccacauca

SEQ ID NO: 2703400 - RNA, 16 nt, Haemophilus influenzae Rd
acaagccauauuuuag

SEQ ID NO: 2703401 - RNA, 14 nt, Haemophilus influenzae Rd
acaagccccacagg

SEQ ID NO: 2703402 - RNA, 16 nt, Haemophilus influenzae Rd
acaagcucuagaaaau

SEQ ID NO: 2703403 - RNA, 22 nt, Haemophilus influenzae Rd
acaagcuuguccaugaaaaacu

SEQ ID NO: 2703404 - RNA, 20 nt, Haemophilus influenzae Rd
acaaggcucaucauuaugaa

SEQ ID NO: 2703405 - RNA, 16 nt, Haemophilus influenzae Rd
acaagggauuuaaaau

SEQ ID NO: 2703406 - RNA, 19 nt, Haemophilus influenzae Rd
acaaggguaucuaaauuug

SEQ ID NO: 2703407 - RNA, 20 nt, Haemophilus influenzae Rd
acaaguaagucgugaucugc

SEQ ID NO: 2703408 - RNA, 21 nt, Haemophilus influenzae Rd
acaaguacgauugcaauaauc

SEQ ID NO: 2703409 - RNA, 15 nt, Haemophilus influenzae Rd
acaaguauaaaaaau

SEQ ID NO: 2703410 - RNA, 11 nt, Haemophilus influenzae Rd
acaagucucua

SEQ ID NO: 2703411 - RNA, 19 nt, Haemophilus influenzae Rd
acaagucucuaugauuuuu

SEQ ID NO: 2703412 - RNA, 20 nt, Haemophilus influenzae Rd
acaagugcggguucuuuuuu

SEQ ID NO: 2703413 - RNA, 14 nt, Haemophilus influenzae Rd
acaaguuaaaacuu

SEQ ID NO: 2703414 - RNA, 15 nt, Haemophilus influenzae Rd
acaaguuuaauacaa

SEQ ID NO: 2703415 - RNA, 14 nt, Haemophilus influenzae Rd
acaaguuuagauua

SEQ ID NO: 2703416 - RNA, 20 nt, Haemophilus influenzae Rd
acaaguuucuaaaaucacuu

SEQ ID NO: 2703417 - RNA, 21 nt, Haemophilus influenzae Rd
acaauaaaacuuuauuuuauu

SEQ ID NO: 2703418 - RNA, 14 nt, Haemophilus influenzae Rd
acaauaaaauaaua

SEQ ID NO: 2703419 - RNA, 15 nt, Haemophilus influenzae Rd
acaauaacugccaca

SEQ ID NO: 2703420 - RNA, 19 nt, Haemophilus influenzae Rd
acaauaacugccacaucau

SEQ ID NO: 2703421 - RNA, 20 nt, Haemophilus influenzae Rd
acaauaacugcgccaauaua

SEQ ID NO: 2703422 - RNA, 22 nt, Haemophilus influenzae Rd
acaauaaugugagaauaaccac

SEQ ID NO: 2703423 - RNA, 16 nt, Haemophilus influenzae Rd
acaauaauuugccaaa

SEQ ID NO: 2703424 - RNA, 22 nt, Haemophilus influenzae Rd
acaauacguugaguauagucau

SEQ ID NO: 2703425 - RNA, 13 nt, Haemophilus influenzae Rd
acaauacuuauca

SEQ ID NO: 2703426 - RNA, 20 nt, Haemophilus influenzae Rd
acaauagcuuccgcuuuuuu

SEQ ID NO: 2703427 - RNA, 14 nt, Haemophilus influenzae Rd
acaauauaaccagc

SEQ ID NO: 2703428 - RNA, 15 nt, Haemophilus influenzae Rd
acaauauaaccagcc

SEQ ID NO: 2703429 - RNA, 20 nt, Haemophilus influenzae Rd
acaauauauucggaaaaaau

SEQ ID NO: 2703430 - RNA, 19 nt, Haemophilus influenzae Rd
acaauauguauaauuccua

SEQ ID NO: 2703431 - RNA, 15 nt, Haemophilus influenzae Rd
acaauauuuauuucu

SEQ ID NO: 2703432 - RNA, 13 nt, Haemophilus influenzae Rd
acaauauuucacu

SEQ ID NO: 2703433 - RNA, 13 nt, Haemophilus influenzae Rd
acaaucaaaaaau

SEQ ID NO: 2703434 - RNA, 18 nt, Haemophilus influenzae Rd
acaaucacgaucugcaac

SEQ ID NO: 2703435 - RNA, 18 nt, Haemophilus influenzae Rd
acaaucacugaaaaaugg

SEQ ID NO: 2703436 - RNA, 20 nt, Haemophilus influenzae Rd
acaaucagcgagcaguggua

SEQ ID NO: 2703437 - RNA, 18 nt, Haemophilus influenzae Rd
acaaucagcugcucuuua

SEQ ID NO: 2703438 - RNA, 16 nt, Haemophilus influenzae Rd
acaaucccaggcuuaa

SEQ ID NO: 2703439 - RNA, 17 nt, Haemophilus influenzae Rd
acaaucccaggcuuaau

SEQ ID NO: 2703440 - RNA, 17 nt, Haemophilus influenzae Rd
acaauccuauagcccaa

SEQ ID NO: 2703441 - RNA, 18 nt, Haemophilus influenzae Rd
acaauccuauagcccaac

SEQ ID NO: 2703442 - RNA, 21 nt, Haemophilus influenzae Rd
acaauccuauagcccaacgca

SEQ ID NO: 2703443 - RNA, 20 nt, Haemophilus influenzae Rd
acaaucgcuucauucucuuc

SEQ ID NO: 2703444 - RNA, 24 nt, Haemophilus influenzae Rd
acaaucgguuaaaaguaagcaauu

SEQ ID NO: 2703445 - RNA, 22 nt, Haemophilus influenzae Rd
acaaucuaaagcgaucaucauu

SEQ ID NO: 2703446 - RNA, 20 nt, Haemophilus influenzae Rd
acaaucugcuguugcagcug

SEQ ID NO: 2703447 - RNA, 22 nt, Haemophilus influenzae Rd
acaaucuguggcguauuuagaa

SEQ ID NO: 2703448 - RNA, 23 nt, Haemophilus influenzae Rd
acaaugaguguuauugaugaaga

SEQ ID NO: 2703449 - RNA, 21 nt, Haemophilus influenzae Rd
acaaugauuaaacgcaacauc

SEQ ID NO: 2703450 - RNA, 14 nt, Haemophilus influenzae Rd
acaaugcucacuuc

SEQ ID NO: 2703451 - RNA, 18 nt, Haemophilus influenzae Rd
acaaugcucacuucgcuu

SEQ ID NO: 2703452 - RNA, 20 nt, Haemophilus influenzae Rd
acaauguaguuucuucuuuc

SEQ ID NO: 2703453 - RNA, 13 nt, Haemophilus influenzae Rd
acaaugucagaaa

SEQ ID NO: 2703454 - RNA, 16 nt, Haemophilus influenzae Rd
acaauguuuaauccaa

SEQ ID NO: 2703455 - RNA, 13 nt, Haemophilus influenzae Rd
acaauuacugcaa

SEQ ID NO: 2703456 - RNA, 20 nt, Haemophilus influenzae Rd
acaauuacugcaaaugcagg

SEQ ID NO: 2703457 - RNA, 19 nt, Haemophilus influenzae Rd
acaauucacugcaacguua

SEQ ID NO: 2703458 - RNA, 12 nt, Haemophilus influenzae Rd
acaauuccccuu

SEQ ID NO: 2703459 - RNA, 22 nt, Haemophilus influenzae Rd
acaauuucaucagaaggaauau

SEQ ID NO: 2703460 - RNA, 19 nt, Haemophilus influenzae Rd
acaauuucauuaauuuuau

SEQ ID NO: 2703461 - RNA, 20 nt, Haemophilus influenzae Rd
acaauuucauuaauuuuauu

SEQ ID NO: 2703462 - RNA, 22 nt, Haemophilus influenzae Rd
acaauuugaccgcggaaaauau

SEQ ID NO: 2703463 - RNA, 13 nt, Haemophilus influenzae Rd
acagguacuuuua

SEQ ID NO: 2703464 - RNA, 20 nt, Haemophilus influenzae Rd
acagguguguuuuucaaaaa

SEQ ID NO: 2703465 - RNA, 13 nt, Haemophilus influenzae Rd
acagguuucucua

SEQ ID NO: 2703466 - RNA, 15 nt, Haemophilus influenzae Rd
acagguuucucuagc

SEQ ID NO: 2703467 - RNA, 15 nt, Haemophilus influenzae Rd
acagguuugacauuc

SEQ ID NO: 2703468 - RNA, 15 nt, Haemophilus influenzae Rd
acaguaaauuuuucc

SEQ ID NO: 2703469 - RNA, 17 nt, Haemophilus influenzae Rd
acaguaaauuuuuccac

SEQ ID NO: 2703470 - RNA, 21 nt, Haemophilus influenzae Rd
acaguaaugaaagaaacacca

SEQ ID NO: 2703471 - RNA, 16 nt, Haemophilus influenzae Rd
acaguaauuguugguu

SEQ ID NO: 2703472 - RNA, 18 nt, Haemophilus influenzae Rd
acaguaguacgaccugaa

SEQ ID NO: 2703473 - RNA, 14 nt, Haemophilus influenzae Rd
acaguauuuuccuu

SEQ ID NO: 2703474 - RNA, 23 nt, Haemophilus influenzae Rd
acaguccccauaucucugccauc

SEQ ID NO: 2703475 - RNA, 16 nt, Haemophilus influenzae Rd
acagugaaaccaaaga

SEQ ID NO: 2703476 - RNA, 14 nt, Haemophilus influenzae Rd
acagugacaaauuu

SEQ ID NO: 2703477 - RNA, 14 nt, Haemophilus influenzae Rd
acaguucaauaaaa

SEQ ID NO: 2703478 - RNA, 15 nt, Haemophilus influenzae Rd
acaguugaaaaccgc

SEQ ID NO: 2703479 - RNA, 14 nt, Haemophilus influenzae Rd
acaguuuaucucuu

SEQ ID NO: 2703480 - RNA, 19 nt, Haemophilus influenzae Rd
acaguuuuggcucuacuuu

SEQ ID NO: 2703481 - RNA, 14 nt, Haemophilus influenzae Rd
acauaaaaaacaca

SEQ ID NO: 2703482 - RNA, 17 nt, Haemophilus influenzae Rd
acauaaaaaacacagcu

SEQ ID NO: 2703483 - RNA, 22 nt, Haemophilus influenzae Rd
acauaaaagcggagauaguuua

SEQ ID NO: 2703484 - RNA, 23 nt, Haemophilus influenzae Rd
acauaaacggcugccgcaucaac

SEQ ID NO: 2703485 - RNA, 20 nt, Haemophilus influenzae Rd
acauaaauguggucaaagau

SEQ ID NO: 2703486 - RNA, 23 nt, Haemophilus influenzae Rd
acauaacaaaauggcuuuuuugc

SEQ ID NO: 2703487 - RNA, 18 nt, Haemophilus influenzae Rd
acauaacauuguuuuaau

SEQ ID NO: 2703488 - RNA, 13 nt, Haemophilus influenzae Rd
acauaaccaaagg

SEQ ID NO: 2703489 - RNA, 19 nt, Haemophilus influenzae Rd
acauaacccacuguuaaag

SEQ ID NO: 2703490 - RNA, 13 nt, Haemophilus influenzae Rd
acauaacuuucca

SEQ ID NO: 2703491 - RNA, 14 nt, Haemophilus influenzae Rd
acauaaguaaaaua

SEQ ID NO: 2703492 - RNA, 21 nt, Haemophilus influenzae Rd
acauaauuaaauuaaggacua

SEQ ID NO: 2703493 - RNA, 12 nt, Haemophilus influenzae Rd
acauacaucuaa

SEQ ID NO: 2703494 - RNA, 14 nt, Haemophilus influenzae Rd
acauaccuaaaaau

SEQ ID NO: 2703495 - RNA, 15 nt, Haemophilus influenzae Rd
acauagaaaguuuaa

SEQ ID NO: 2703496 - RNA, 20 nt, Haemophilus influenzae Rd
acauagauugaaaaguaaau

SEQ ID NO: 2703497 - RNA, 19 nt, Haemophilus influenzae Rd
acauagauuuaagcuuauu

SEQ ID NO: 2703498 - RNA, 22 nt, Haemophilus influenzae Rd
acauagccuuuuucuuucagga

SEQ ID NO: 2703499 - RNA, 21 nt, Haemophilus influenzae Rd
acauagcugaaaaauaaaaaa

SEQ ID NO: 2703500 - RNA, 18 nt, Haemophilus influenzae Rd
acauaggguguucaacuu

SEQ ID NO: 2703501 - RNA, 21 nt, Haemophilus influenzae Rd
acauagucgcuggaacuucua

SEQ ID NO: 2703502 - RNA, 10 nt, Haemophilus influenzae Rd
acauauaaag

SEQ ID NO: 2703503 - RNA, 15 nt, Haemophilus influenzae Rd
acauaucaauuugcc

SEQ ID NO: 2703504 - RNA, 17 nt, Haemophilus influenzae Rd
acauaugcgucgcaaaa

SEQ ID NO: 2703505 - RNA, 15 nt, Haemophilus influenzae Rd
acauauggagaaucu

SEQ ID NO: 2703506 - RNA, 14 nt, Haemophilus influenzae Rd
acauauucuaccgc

SEQ ID NO: 2703507 - RNA, 22 nt, Haemophilus influenzae Rd
acauauucuaccgcauuuuuaa

SEQ ID NO: 2703508 - RNA, 21 nt, Haemophilus influenzae Rd
acauauuguuucuucucuuua

SEQ ID NO: 2703509 - RNA, 18 nt, Haemophilus influenzae Rd
acaucaaaccugcuucau

SEQ ID NO: 2703510 - RNA, 23 nt, Haemophilus influenzae Rd
acaucaaauccuuguuuuucaaa

SEQ ID NO: 2703511 - RNA, 18 nt, Haemophilus influenzae Rd
acaucaacgguuuucauu

SEQ ID NO: 2703512 - RNA, 20 nt, Haemophilus influenzae Rd
acaucaacgguuuucauugc

SEQ ID NO: 2703513 - RNA, 14 nt, Haemophilus influenzae Rd
acaucaacuaauuu

SEQ ID NO: 2703514 - RNA, 15 nt, Haemophilus influenzae Rd
acaucaagcacauca

SEQ ID NO: 2703515 - RNA, 15 nt, Haemophilus influenzae Rd
acaucaauaagaauu

SEQ ID NO: 2703516 - RNA, 19 nt, Haemophilus influenzae Rd
acaucaauuugauaauuug

SEQ ID NO: 2703517 - RNA, 19 nt, Haemophilus influenzae Rd
acaucaccgauaauaugca

SEQ ID NO: 2703518 - RNA, 21 nt, Haemophilus influenzae Rd
acaucaccuguaaacaaauau

SEQ ID NO: 2703519 - RNA, 16 nt, Haemophilus influenzae Rd
acaucagcuucaauuu

SEQ ID NO: 2703520 - RNA, 17 nt, Haemophilus influenzae Rd
acaucagugauuuucac

SEQ ID NO: 2703521 - RNA, 13 nt, Haemophilus influenzae Rd
acaucaucaucgc

SEQ ID NO: 2703522 - RNA, 18 nt, Haemophilus influenzae Rd
acaucaucggacgaauca

SEQ ID NO: 2703523 - RNA, 23 nt, Haemophilus influenzae Rd
acaucaucuggcauaucugcugc

SEQ ID NO: 2703524 - RNA, 17 nt, Haemophilus influenzae Rd
acaucauuccgcccauu

SEQ ID NO: 2703525 - RNA, 20 nt, Haemophilus influenzae Rd
acaucauuccgcccauucca

SEQ ID NO: 2703526 - RNA, 13 nt, Haemophilus influenzae Rd
acaucauuuucaa

SEQ ID NO: 2703527 - RNA, 15 nt, Haemophilus influenzae Rd
acaucauuuucaagu

SEQ ID NO: 2703528 - RNA, 18 nt, Haemophilus influenzae Rd
acaucauuuucaaguaac

SEQ ID NO: 2703529 - RNA, 19 nt, Haemophilus influenzae Rd
acaucauuuucaaguaacu

SEQ ID NO: 2703530 - RNA, 17 nt, Haemophilus influenzae Rd
acauccauuccugcaag

SEQ ID NO: 2703531 - RNA, 17 nt, Haemophilus influenzae Rd
acaucgccaacuugaau

SEQ ID NO: 2703532 - RNA, 14 nt, Haemophilus influenzae Rd
acaucgcugugaaa

SEQ ID NO: 2703533 - RNA, 14 nt, Haemophilus influenzae Rd
acaucgcuucauca

SEQ ID NO: 2703534 - RNA, 15 nt, Haemophilus influenzae Rd
acaucuaaaauguca

SEQ ID NO: 2703535 - RNA, 16 nt, Haemophilus influenzae Rd
acaucuaaguauucau

SEQ ID NO: 2703536 - RNA, 19 nt, Haemophilus influenzae Rd
acaucuaaguauucaugau

SEQ ID NO: 2703537 - RNA, 18 nt, Haemophilus influenzae Rd
acaucuaaugccgcaaau

SEQ ID NO: 2703538 - RNA, 12 nt, Haemophilus influenzae Rd
acaucuaauuuu

SEQ ID NO: 2703539 - RNA, 12 nt, Haemophilus influenzae Rd
acaucuacaauu

SEQ ID NO: 2703540 - RNA, 14 nt, Haemophilus influenzae Rd
acaucuuaaauuau

SEQ ID NO: 2703541 - RNA, 19 nt, Haemophilus influenzae Rd
acaucuuaaauuauagaua

SEQ ID NO: 2703542 - RNA, 15 nt, Haemophilus influenzae Rd
acaucuucaaaaaca

SEQ ID NO: 2703543 - RNA, 11 nt, Haemophilus influenzae Rd
acaucuucaca

SEQ ID NO: 2703544 - RNA, 21 nt, Haemophilus influenzae Rd
acaucuugcauaaaccaacua

SEQ ID NO: 2703545 - RNA, 13 nt, Haemophilus influenzae Rd
acaucuugcguua

SEQ ID NO: 2703546 - RNA, 20 nt, Haemophilus influenzae Rd
acaugaacaagcacccauuu

SEQ ID NO: 2703547 - RNA, 14 nt, Haemophilus influenzae Rd
acaugaauuucuaa

SEQ ID NO: 2703548 - RNA, 17 nt, Haemophilus influenzae Rd
acaugaauuucuaauuu

SEQ ID NO: 2703549 - RNA, 18 nt, Haemophilus influenzae Rd
acaugaauuucuaauuuu

SEQ ID NO: 2703550 - RNA, 22 nt, Haemophilus influenzae Rd
acaugaauuucuaauuuuuguu

SEQ ID NO: 2703551 - RNA, 18 nt, Haemophilus influenzae Rd
acaugacaguuuguaauc

SEQ ID NO: 2703552 - RNA, 15 nt, Haemophilus influenzae Rd
acaugcaaaauauuc

SEQ ID NO: 2703553 - RNA, 16 nt, Haemophilus influenzae Rd
acauggccaauuucau

SEQ ID NO: 2703554 - RNA, 14 nt, Haemophilus influenzae Rd
acaugguuaaaaua

SEQ ID NO: 2703555 - RNA, 21 nt, Haemophilus influenzae Rd
acauuaacaaugcggagaaaa

SEQ ID NO: 2703556 - RNA, 18 nt, Haemophilus influenzae Rd
acauuaaggcuuugguau

SEQ ID NO: 2703557 - RNA, 22 nt, Haemophilus influenzae Rd
acauuaagugcaucaaccgaua

SEQ ID NO: 2703558 - RNA, 22 nt, Haemophilus influenzae Rd
acauuaagugcguguauauauu

SEQ ID NO: 2703559 - RNA, 15 nt, Haemophilus influenzae Rd
acauuaauaaaccaa

SEQ ID NO: 2703560 - RNA, 16 nt, Haemophilus influenzae Rd
acauuaauaaaccaac

SEQ ID NO: 2703561 - RNA, 21 nt, Haemophilus influenzae Rd
acauuaauaaaccaacauaca

SEQ ID NO: 2703562 - RNA, 20 nt, Haemophilus influenzae Rd
acauuaauaacguguaaauu

SEQ ID NO: 2703563 - RNA, 15 nt, Haemophilus influenzae Rd
acauuaaucauuuca

SEQ ID NO: 2703564 - RNA, 20 nt, Haemophilus influenzae Rd
acauuaauugacaauuaaua

SEQ ID NO: 2703565 - RNA, 12 nt, Haemophilus influenzae Rd
acauuaauuugu

SEQ ID NO: 2703566 - RNA, 14 nt, Haemophilus influenzae Rd
acauuaauuuuucc

SEQ ID NO: 2703567 - RNA, 18 nt, Haemophilus influenzae Rd
acauuaguaucuuccauu

SEQ ID NO: 2703568 - RNA, 19 nt, Haemophilus influenzae Rd
acauuagugaaugaugcca

SEQ ID NO: 2703569 - RNA, 21 nt, Haemophilus influenzae Rd
accaauugcaacuucgccuug

SEQ ID NO: 2703570 - RNA, 20 nt, Haemophilus influenzae Rd
accaauugguaaaauuucuu

SEQ ID NO: 2703571 - RNA, 16 nt, Haemophilus influenzae Rd
accaauuugugcgcau

SEQ ID NO: 2703572 - RNA, 15 nt, Haemophilus influenzae Rd
accacaaaauaaaug

SEQ ID NO: 2703573 - RNA, 21 nt, Haemophilus influenzae Rd
accacaaaauaaaugauuauc

SEQ ID NO: 2703574 - RNA, 15 nt, Haemophilus influenzae Rd
accacaagcugacca

SEQ ID NO: 2703575 - RNA, 22 nt, Haemophilus influenzae Rd
accacaagcugaccacuuucaa

SEQ ID NO: 2703576 - RNA, 16 nt, Haemophilus influenzae Rd
accacaauaaaauaau

SEQ ID NO: 2703577 - RNA, 23 nt, Haemophilus influenzae Rd
accacaauaaaauaauauauuau

SEQ ID NO: 2703578 - RNA, 15 nt, Haemophilus influenzae Rd
accacacaagcacca

SEQ ID NO: 2703579 - RNA, 13 nt, Haemophilus influenzae Rd
accacauaaaugu

SEQ ID NO: 2703580 - RNA, 13 nt, Haemophilus influenzae Rd
accacaucaaauu

SEQ ID NO: 2703581 - RNA, 21 nt, Haemophilus influenzae Rd
accacaugaauuucuaauuuu

SEQ ID NO: 2703582 - RNA, 16 nt, Haemophilus influenzae Rd
accaccaauguuggca

SEQ ID NO: 2703583 - RNA, 13 nt, Haemophilus influenzae Rd
accacccaaauau

SEQ ID NO: 2703584 - RNA, 16 nt, Haemophilus influenzae Rd
accaccccauuucuug

SEQ ID NO: 2703585 - RNA, 19 nt, Haemophilus influenzae Rd
accacccgauaaaugcaca

SEQ ID NO: 2703586 - RNA, 20 nt, Haemophilus influenzae Rd
accacccgauaaaugcacau

SEQ ID NO: 2703587 - RNA, 18 nt, Haemophilus influenzae Rd
accacccuucuuucaaau

SEQ ID NO: 2703588 - RNA, 20 nt, Haemophilus influenzae Rd
accacgaguauauugcauaa

SEQ ID NO: 2703589 - RNA, 18 nt, Haemophilus influenzae Rd
accacgcuggaauuuuca

SEQ ID NO: 2703590 - RNA, 14 nt, Haemophilus influenzae Rd
accacguaauucuu

SEQ ID NO: 2703591 - RNA, 14 nt, Haemophilus influenzae Rd
accacuaaaaacaa

SEQ ID NO: 2703592 - RNA, 16 nt, Haemophilus influenzae Rd
accacuaaaaacaagu

SEQ ID NO: 2703593 - RNA, 21 nt, Haemophilus influenzae Rd
accacucacuggcucaaguaa

SEQ ID NO: 2703594 - RNA, 22 nt, Haemophilus influenzae Rd
accacucacuggcucaaguaau

SEQ ID NO: 2703595 - RNA, 14 nt, Haemophilus influenzae Rd
accacuuaaaaaua

SEQ ID NO: 2703596 - RNA, 20 nt, Haemophilus influenzae Rd
accacuucauauaaauuagc

SEQ ID NO: 2703597 - RNA, 20 nt, Haemophilus influenzae Rd
accacuugagccugaaucga

SEQ ID NO: 2703598 - RNA, 18 nt, Haemophilus influenzae Rd
accacuugucauuaaaaa

SEQ ID NO: 2703599 - RNA, 14 nt, Haemophilus influenzae Rd
accacuuucaauuu

SEQ ID NO: 2703600 - RNA, 18 nt, Haemophilus influenzae Rd
accacuuucaauuugagu

SEQ ID NO: 2703601 - RNA, 18 nt, Haemophilus influenzae Rd
accagaaacauagauaac

SEQ ID NO: 2703602 - RNA, 17 nt, Haemophilus influenzae Rd
accagaaguagcaacac

SEQ ID NO: 2703603 - RNA, 18 nt, Haemophilus influenzae Rd
accagauucaucaaagua

SEQ ID NO: 2703604 - RNA, 18 nt, Haemophilus influenzae Rd
accagcacaguuuccgca

SEQ ID NO: 2703605 - RNA, 14 nt, Haemophilus influenzae Rd
accagcagaaaaua

SEQ ID NO: 2703606 - RNA, 22 nt, Haemophilus influenzae Rd
accagcagaaaauaacgcauca

SEQ ID NO: 2703607 - RNA, 18 nt, Haemophilus influenzae Rd
accagccgacuauuacaa

SEQ ID NO: 2703608 - RNA, 16 nt, Haemophilus influenzae Rd
accagugccaauauga

SEQ ID NO: 2703609 - RNA, 15 nt, Haemophilus influenzae Rd
accagugguauauac

SEQ ID NO: 2703610 - RNA, 14 nt, Haemophilus influenzae Rd
accaguuaaauccu

SEQ ID NO: 2703611 - RNA, 18 nt, Haemophilus influenzae Rd
accauaacaagaaucauc

SEQ ID NO: 2703612 - RNA, 21 nt, Haemophilus influenzae Rd
accauaacuuaugaauaauaa

SEQ ID NO: 2703613 - RNA, 21 nt, Haemophilus influenzae Rd
accauacaacgaguuaaguaa

SEQ ID NO: 2703614 - RNA, 13 nt, Haemophilus influenzae Rd
accauauccauug

SEQ ID NO: 2703615 - RNA, 19 nt, Haemophilus influenzae Rd
accauaucguaaccaucag

SEQ ID NO: 2703616 - RNA, 19 nt, Haemophilus influenzae Rd
accauaucuuccaaagcaa

SEQ ID NO: 2703617 - RNA, 18 nt, Haemophilus influenzae Rd
accaucauagauaaagua

SEQ ID NO: 2703618 - RNA, 14 nt, Haemophilus influenzae Rd
accauccaucaaau

SEQ ID NO: 2703619 - RNA, 18 nt, Haemophilus influenzae Rd
accauccaugacagaauu

SEQ ID NO: 2703620 - RNA, 17 nt, Haemophilus influenzae Rd
accaucccuuuuuacau

SEQ ID NO: 2703621 - RNA, 19 nt, Haemophilus influenzae Rd
accaucguuaaaccaaaua

SEQ ID NO: 2703622 - RNA, 14 nt, Haemophilus influenzae Rd
accaucuauauuug

SEQ ID NO: 2703623 - RNA, 14 nt, Haemophilus influenzae Rd
accaucuuuuuuug

SEQ ID NO: 2703624 - RNA, 18 nt, Haemophilus influenzae Rd
accaucuuuuuuugcaag

SEQ ID NO: 2703625 - RNA, 14 nt, Haemophilus influenzae Rd
accauuaagcgcaa

SEQ ID NO: 2703626 - RNA, 15 nt, Haemophilus influenzae Rd
accauuaauaaauuu

SEQ ID NO: 2703627 - RNA, 17 nt, Haemophilus influenzae Rd
accauuaauaaauuuuu

SEQ ID NO: 2703628 - RNA, 19 nt, Haemophilus influenzae Rd
accauuaauaaauuuuucg

SEQ ID NO: 2703629 - RNA, 16 nt, Haemophilus influenzae Rd
accauuacagcaagca

SEQ ID NO: 2703630 - RNA, 14 nt, Haemophilus influenzae Rd
accauuacauaaaa

SEQ ID NO: 2703631 - RNA, 18 nt, Haemophilus influenzae Rd
accauuacauaaaaccaa

SEQ ID NO: 2703632 - RNA, 15 nt, Haemophilus influenzae Rd
accauuacauccacu

SEQ ID NO: 2703633 - RNA, 15 nt, Haemophilus influenzae Rd
accauucccauucca

SEQ ID NO: 2703634 - RNA, 19 nt, Haemophilus influenzae Rd
accauucgccuaaugccuu

SEQ ID NO: 2703635 - RNA, 14 nt, Haemophilus influenzae Rd
accauucguuucaa

SEQ ID NO: 2703636 - RNA, 14 nt, Haemophilus influenzae Rd
accauugaauccaa

SEQ ID NO: 2703637 - RNA, 22 nt, Haemophilus influenzae Rd
accauugaauccaacguauuua

SEQ ID NO: 2703638 - RNA, 19 nt, Haemophilus influenzae Rd
accauugagcauuuuuuau

SEQ ID NO: 2703639 - RNA, 14 nt, Haemophilus influenzae Rd
accauugaugaaau

SEQ ID NO: 2703640 - RNA, 15 nt, Haemophilus influenzae Rd
accauugaugaaaug

SEQ ID NO: 2703641 - RNA, 12 nt, Haemophilus influenzae Rd
accauugcguuc

SEQ ID NO: 2703642 - RNA, 19 nt, Haemophilus influenzae Rd
accauugcguucacucacu

SEQ ID NO: 2703643 - RNA, 20 nt, Haemophilus influenzae Rd
accauugcguucacucacuu

SEQ ID NO: 2703644 - RNA, 16 nt, Haemophilus influenzae Rd
accauuggggcgacca

SEQ ID NO: 2703645 - RNA, 15 nt, Haemophilus influenzae Rd
accauuggugaaagg

SEQ ID NO: 2703646 - RNA, 13 nt, Haemophilus influenzae Rd
accauugugccaa

SEQ ID NO: 2703647 - RNA, 13 nt, Haemophilus influenzae Rd
accauuguuuaau

SEQ ID NO: 2703648 - RNA, 18 nt, Haemophilus influenzae Rd
accauuuaauaaaacaaa

SEQ ID NO: 2703649 - RNA, 21 nt, Haemophilus influenzae Rd
accauuuauaaugcaaccaaa

SEQ ID NO: 2703650 - RNA, 23 nt, Haemophilus influenzae Rd
accauuuauccaugacuaaucca

SEQ ID NO: 2703651 - RNA, 23 nt, Haemophilus influenzae Rd
accauuuauuccuuuauuuugca

SEQ ID NO: 2703652 - RNA, 13 nt, Haemophilus influenzae Rd
accauuuccuuug

SEQ ID NO: 2703653 - RNA, 11 nt, Haemophilus influenzae Rd
accauuugauu

SEQ ID NO: 2703654 - RNA, 13 nt, Haemophilus influenzae Rd
accauuugauuca

SEQ ID NO: 2703655 - RNA, 15 nt, Haemophilus influenzae Rd
accauuuuagaggcu

SEQ ID NO: 2703656 - RNA, 13 nt, Haemophilus influenzae Rd
accauuuugccca

SEQ ID NO: 2703657 - RNA, 17 nt, Haemophilus influenzae Rd
accauuuugcccaauuc

SEQ ID NO: 2703658 - RNA, 11 nt, Haemophilus influenzae Rd
accauuuuucc

SEQ ID NO: 2703659 - RNA, 15 nt, Haemophilus influenzae Rd
accauuuuuccagca

SEQ ID NO: 2703660 - RNA, 12 nt, Haemophilus influenzae Rd
accauuuuugcg

SEQ ID NO: 2703661 - RNA, 19 nt, Haemophilus influenzae Rd
acccaaauauuaugguuuu

SEQ ID NO: 2703662 - RNA, 13 nt, Haemophilus influenzae Rd
acccaaauuaaaa

SEQ ID NO: 2703663 - RNA, 15 nt, Haemophilus influenzae Rd
acccaacaaauuuaa

SEQ ID NO: 2703664 - RNA, 23 nt, Haemophilus influenzae Rd
acccaauuagaugauuuuaaaau

SEQ ID NO: 2703665 - RNA, 23 nt, Haemophilus influenzae Rd
acccaauuagaugauuuuaaagu

SEQ ID NO: 2703666 - RNA, 22 nt, Haemophilus influenzae Rd
acccacaacuuuuucaucuuua

SEQ ID NO: 2703667 - RNA, 13 nt, Haemophilus influenzae Rd
acccacacaaacu

SEQ ID NO: 2703668 - RNA, 11 nt, Haemophilus influenzae Rd
acccacacacc

SEQ ID NO: 2703669 - RNA, 16 nt, Haemophilus influenzae Rd
acccacauacuuauuc

SEQ ID NO: 2703670 - RNA, 13 nt, Haemophilus influenzae Rd
acccacaucauca

SEQ ID NO: 2703671 - RNA, 16 nt, Haemophilus influenzae Rd
acccacaucaucaagc

SEQ ID NO: 2703672 - RNA, 17 nt, Haemophilus influenzae Rd
acccacaucaucaagca

SEQ ID NO: 2703673 - RNA, 15 nt, Haemophilus influenzae Rd
acccaccacuuaaaa

SEQ ID NO: 2703674 - RNA, 23 nt, Haemophilus influenzae Rd
acccaccgcaaaagccaauaaga

SEQ ID NO: 2703675 - RNA, 22 nt, Haemophilus influenzae Rd
accuagucccgcuuuugccaua

SEQ ID NO: 2703676 - RNA, 17 nt, Haemophilus influenzae Rd
accuauuagaauuuaua

SEQ ID NO: 2703677 - RNA, 14 nt, Haemophilus influenzae Rd
accuauuuuuuccu

SEQ ID NO: 2703678 - RNA, 23 nt, Haemophilus influenzae Rd
accucgaauagcaauaucugcua

SEQ ID NO: 2703679 - RNA, 16 nt, Haemophilus influenzae Rd
accucgccauuuuuca

SEQ ID NO: 2703680 - RNA, 22 nt, Haemophilus influenzae Rd
accucgccauuuuucaaaauuu

SEQ ID NO: 2703681 - RNA, 17 nt, Haemophilus influenzae Rd
accucgccuuguaauug

SEQ ID NO: 2703682 - RNA, 22 nt, Haemophilus influenzae Rd
accucuaaaaugcaaacaagau

SEQ ID NO: 2703683 - RNA, 14 nt, Haemophilus influenzae Rd
accugaaaaaccuu

SEQ ID NO: 2703684 - RNA, 13 nt, Haemophilus influenzae Rd
accugaagaauac

SEQ ID NO: 2703685 - RNA, 16 nt, Haemophilus influenzae Rd
accugaguaaauaaac

SEQ ID NO: 2703686 - RNA, 16 nt, Haemophilus influenzae Rd
accugauaaguagaaa

SEQ ID NO: 2703687 - RNA, 17 nt, Haemophilus influenzae Rd
accugaugaaaucauua

SEQ ID NO: 2703688 - RNA, 19 nt, Haemophilus influenzae Rd
accugauucauugcauuuu

SEQ ID NO: 2703689 - RNA, 19 nt, Haemophilus influenzae Rd
accugcaaggauauuucca

SEQ ID NO: 2703690 - RNA, 13 nt, Haemophilus influenzae Rd
accugcagaaagg

SEQ ID NO: 2703691 - RNA, 18 nt, Haemophilus influenzae Rd
accugcagagaagaaaua

SEQ ID NO: 2703692 - RNA, 19 nt, Haemophilus influenzae Rd
accugcagagaagaaauac

SEQ ID NO: 2703693 - RNA, 20 nt, Haemophilus influenzae Rd
accugcagccauaauauuua

SEQ ID NO: 2703694 - RNA, 22 nt, Haemophilus influenzae Rd
accugcagccauaauauuuaaa

SEQ ID NO: 2703695 - RNA, 17 nt, Haemophilus influenzae Rd
accugcaucaauuuuac

SEQ ID NO: 2703696 - RNA, 15 nt, Haemophilus influenzae Rd
accugcauuuuggau

SEQ ID NO: 2703697 - RNA, 21 nt, Haemophilus influenzae Rd
accugcccuugagccaguuua

SEQ ID NO: 2703698 - RNA, 16 nt, Haemophilus influenzae Rd
accugcggauuucacu

SEQ ID NO: 2703699 - RNA, 19 nt, Haemophilus influenzae Rd
accugcuucuuuuaauaag

SEQ ID NO: 2703700 - RNA, 14 nt, Haemophilus influenzae Rd
accugguugcauaa

SEQ ID NO: 2703701 - RNA, 13 nt, Haemophilus influenzae Rd
accuguaauccuu

SEQ ID NO: 2703702 - RNA, 14 nt, Haemophilus influenzae Rd
accugugaaaacac

SEQ ID NO: 2703703 - RNA, 15 nt, Haemophilus influenzae Rd
accugugaaaacacg

SEQ ID NO: 2703704 - RNA, 15 nt, Haemophilus influenzae Rd
accuguuaaugaaac

SEQ ID NO: 2703705 - RNA, 19 nt, Haemophilus influenzae Rd
accuguuggaugaauugcc

SEQ ID NO: 2703706 - RNA, 21 nt, Haemophilus influenzae Rd
accuguuucguacauuguuuc

SEQ ID NO: 2703707 - RNA, 16 nt, Haemophilus influenzae Rd
accuuaacauuuucug

SEQ ID NO: 2703708 - RNA, 18 nt, Haemophilus influenzae Rd
accuuaauuagauuuauu

SEQ ID NO: 2703709 - RNA, 16 nt, Haemophilus influenzae Rd
accuuagcaccacuua

SEQ ID NO: 2703710 - RNA, 20 nt, Haemophilus influenzae Rd
accuuagccaaaucaucuag

SEQ ID NO: 2703711 - RNA, 12 nt, Haemophilus influenzae Rd
accuuauugcau

SEQ ID NO: 2703712 - RNA, 14 nt, Haemophilus influenzae Rd
accuuauuuuaaau

SEQ ID NO: 2703713 - RNA, 14 nt, Haemophilus influenzae Rd
accuucaaacauca

SEQ ID NO: 2703714 - RNA, 17 nt, Haemophilus influenzae Rd
accuucaaccauuuucu

SEQ ID NO: 2703715 - RNA, 14 nt, Haemophilus influenzae Rd
accuucaauugugc

SEQ ID NO: 2703716 - RNA, 17 nt, Haemophilus influenzae Rd
accuucacagauuucaa

SEQ ID NO: 2703717 - RNA, 21 nt, Haemophilus influenzae Rd
accuucacagauuucaauuaa

SEQ ID NO: 2703718 - RNA, 23 nt, Haemophilus influenzae Rd
accuucaccacuuggugcaacca

SEQ ID NO: 2703719 - RNA, 22 nt, Haemophilus influenzae Rd
accuucacuuggcgaaaaucau

SEQ ID NO: 2703720 - RNA, 13 nt, Haemophilus influenzae Rd
accuucagccacu

SEQ ID NO: 2703721 - RNA, 18 nt, Haemophilus influenzae Rd
accuucaguuuucauuuu

SEQ ID NO: 2703722 - RNA, 13 nt, Haemophilus influenzae Rd
accuuccacuuuu

SEQ ID NO: 2703723 - RNA, 16 nt, Haemophilus influenzae Rd
accuuccacuuuuggu

SEQ ID NO: 2703724 - RNA, 19 nt, Haemophilus influenzae Rd
accuucugcggaaaugaaa

SEQ ID NO: 2703725 - RNA, 19 nt, Haemophilus influenzae Rd
accuugauaaguaggcaaa

SEQ ID NO: 2703726 - RNA, 16 nt, Haemophilus influenzae Rd
accuugaucuacagaa

SEQ ID NO: 2703727 - RNA, 14 nt, Haemophilus influenzae Rd
accuugauugagau

SEQ ID NO: 2703728 - RNA, 21 nt, Haemophilus influenzae Rd
accuugauugagaugccauuu

SEQ ID NO: 2703729 - RNA, 14 nt, Haemophilus influenzae Rd
accuugcacuaauu

SEQ ID NO: 2703730 - RNA, 21 nt, Haemophilus influenzae Rd
accuugcauuucauuugagaa

SEQ ID NO: 2703731 - RNA, 13 nt, Haemophilus influenzae Rd
accuugcauuucu

SEQ ID NO: 2703732 - RNA, 18 nt, Haemophilus influenzae Rd
accuuggcuuucuacaua

SEQ ID NO: 2703733 - RNA, 21 nt, Haemophilus influenzae Rd
accuuguaaauacucaauggu

SEQ ID NO: 2703734 - RNA, 21 nt, Haemophilus influenzae Rd
accuugugcgacaaguuugau

SEQ ID NO: 2703735 - RNA, 17 nt, Haemophilus influenzae Rd
accuugugguucacgau

SEQ ID NO: 2703736 - RNA, 21 nt, Haemophilus influenzae Rd
accuuguuccaggaaaauuuu

SEQ ID NO: 2703737 - RNA, 23 nt, Haemophilus influenzae Rd
accuuuacuuauucguucuuuug

SEQ ID NO: 2703738 - RNA, 14 nt, Haemophilus influenzae Rd
accuuuauuugcac

SEQ ID NO: 2703739 - RNA, 16 nt, Haemophilus influenzae Rd
accuuucauauaaaua

SEQ ID NO: 2703740 - RNA, 18 nt, Haemophilus influenzae Rd
accuuuuaccaauugauu

SEQ ID NO: 2703741 - RNA, 13 nt, Haemophilus influenzae Rd
accuuuuagcaac

SEQ ID NO: 2703742 - RNA, 20 nt, Haemophilus influenzae Rd
accuuuuguauuacgugauu

SEQ ID NO: 2703743 - RNA, 20 nt, Haemophilus influenzae Rd
accuuuuucagcuaaugcuu

SEQ ID NO: 2703744 - RNA, 14 nt, Haemophilus influenzae Rd
accuuuuucuaccg

SEQ ID NO: 2703745 - RNA, 20 nt, Haemophilus influenzae Rd
accuuuuucuuccauuucaa

SEQ ID NO: 2703746 - RNA, 11 nt, Haemophilus influenzae Rd
accuuuuugcg

SEQ ID NO: 2703747 - RNA, 14 nt, Haemophilus influenzae Rd
acgaaaaaaaccga

SEQ ID NO: 2703748 - RNA, 18 nt, Haemophilus influenzae Rd
acgaaagcuucauugcua

SEQ ID NO: 2703749 - RNA, 12 nt, Haemophilus influenzae Rd
acgaaauaauug

SEQ ID NO: 2703750 - RNA, 11 nt, Haemophilus influenzae Rd
acgaaaucauc

SEQ ID NO: 2703751 - RNA, 23 nt, Haemophilus influenzae Rd
acgaaaucaucgaaaucuaauuu

SEQ ID NO: 2703752 - RNA, 14 nt, Haemophilus influenzae Rd
acgaaaugaaauua

SEQ ID NO: 2703753 - RNA, 22 nt, Haemophilus influenzae Rd
acgaacaagcgcgauaaagagu

SEQ ID NO: 2703754 - RNA, 19 nt, Haemophilus influenzae Rd
acgaacaauuucuuuaccu

SEQ ID NO: 2703755 - RNA, 15 nt, Haemophilus influenzae Rd
acgaacagccgcaau

SEQ ID NO: 2703756 - RNA, 16 nt, Haemophilus influenzae Rd
acgaaccgagcgguca

SEQ ID NO: 2703757 - RNA, 22 nt, Haemophilus influenzae Rd
acgaacguuucaucacuucaaa

SEQ ID NO: 2703758 - RNA, 15 nt, Haemophilus influenzae Rd
acgaaggauaaauug

SEQ ID NO: 2703759 - RNA, 21 nt, Haemophilus influenzae Rd
acgaaggggcauuaacagcac

SEQ ID NO: 2703760 - RNA, 16 nt, Haemophilus influenzae Rd
acgaaguguuaagcac

SEQ ID NO: 2703761 - RNA, 22 nt, Haemophilus influenzae Rd
acgaauaaacgccacucuuuga

SEQ ID NO: 2703762 - RNA, 19 nt, Haemophilus influenzae Rd
acgaauuaagcgaacaccu

SEQ ID NO: 2703763 - RNA, 17 nt, Haemophilus influenzae Rd
acgaauugacggugcau

SEQ ID NO: 2703764 - RNA, 19 nt, Haemophilus influenzae Rd
acgaauuucagcgaaacuu

SEQ ID NO: 2703765 - RNA, 15 nt, Haemophilus influenzae Rd
acgacaucaaucaaa

SEQ ID NO: 2703766 - RNA, 15 nt, Haemophilus influenzae Rd
acgacauuuuuaacu

SEQ ID NO: 2703767 - RNA, 17 nt, Haemophilus influenzae Rd
acgaccguuaauacuug

SEQ ID NO: 2703768 - RNA, 15 nt, Haemophilus influenzae Rd
acgaccuaagaaaag

SEQ ID NO: 2703769 - RNA, 16 nt, Haemophilus influenzae Rd
acgaccuugcaaauuu

SEQ ID NO: 2703770 - RNA, 22 nt, Haemophilus influenzae Rd
acgaccuuuacuuuuuaauaaa

SEQ ID NO: 2703771 - RNA, 15 nt, Haemophilus influenzae Rd
acgacgugcuucaaa

SEQ ID NO: 2703772 - RNA, 16 nt, Haemophilus influenzae Rd
acgacuaaaauuagau

SEQ ID NO: 2703773 - RNA, 21 nt, Haemophilus influenzae Rd
acgagaaagguguaauuccau

SEQ ID NO: 2703774 - RNA, 20 nt, Haemophilus influenzae Rd
acgagaacgagccucaucua

SEQ ID NO: 2703775 - RNA, 16 nt, Haemophilus influenzae Rd
acgagaagaaccacag

SEQ ID NO: 2703776 - RNA, 14 nt, Haemophilus influenzae Rd
acgagaaguuaaac

SEQ ID NO: 2703777 - RNA, 13 nt, Haemophilus influenzae Rd
acgagauaagcau

SEQ ID NO: 2703778 - RNA, 13 nt, Haemophilus influenzae Rd
acgagcaauaaua

SEQ ID NO: 2703779 - RNA, 17 nt, Haemophilus influenzae Rd
acgagcaggaaaaccac

SEQ ID NO: 2703780 - RNA, 19 nt, Haemophilus influenzae Rd
acgagcauauuuuccauca

SEQ ID NO: 2703781 - RNA, 18 nt, Haemophilus influenzae Rd
acggcuucagaaaauaaa

SEQ ID NO: 2703782 - RNA, 19 nt, Haemophilus influenzae Rd
acgggauuuuuucgcaaua

SEQ ID NO: 2703783 - RNA, 16 nt, Haemophilus influenzae Rd
acgggcucaucacaaa

SEQ ID NO: 2703784 - RNA, 16 nt, Haemophilus influenzae Rd
acggguuggaagaaug

SEQ ID NO: 2703785 - RNA, 13 nt, Haemophilus influenzae Rd
acgguaguaaaua

SEQ ID NO: 2703786 - RNA, 14 nt, Haemophilus influenzae Rd
acgguauuuucuua

SEQ ID NO: 2703787 - RNA, 21 nt, Haemophilus influenzae Rd
acgguauuuucuuauugaaga

SEQ ID NO: 2703788 - RNA, 23 nt, Haemophilus influenzae Rd
acggucgauaccuaaaccuuccc

SEQ ID NO: 2703789 - RNA, 15 nt, Haemophilus influenzae Rd
acggucgcaccaccu

SEQ ID NO: 2703790 - RNA, 16 nt, Haemophilus influenzae Rd
acggugaaauuucacc

SEQ ID NO: 2703791 - RNA, 16 nt, Haemophilus influenzae Rd
acggugaauuuaucau

SEQ ID NO: 2703792 - RNA, 15 nt, Haemophilus influenzae Rd
acggugcgaugggga

SEQ ID NO: 2703793 - RNA, 16 nt, Haemophilus influenzae Rd
acggugggcugaagcc

SEQ ID NO: 2703794 - RNA, 20 nt, Haemophilus influenzae Rd
acggugggcugaagcccacc

SEQ ID NO: 2703795 - RNA, 14 nt, Haemophilus influenzae Rd
acgguguuuucuuu

SEQ ID NO: 2703796 - RNA, 21 nt, Haemophilus influenzae Rd
acgguuauaccacauaaaugu

SEQ ID NO: 2703797 - RNA, 18 nt, Haemophilus influenzae Rd
acgguuauuuuuuucuaa

SEQ ID NO: 2703798 - RNA, 12 nt, Haemophilus influenzae Rd
acgguugaaauu

SEQ ID NO: 2703799 - RNA, 11 nt, Haemophilus influenzae Rd
acgguuuuaau

SEQ ID NO: 2703800 - RNA, 20 nt, Haemophilus influenzae Rd
acgguuuuccacuucuucuu

SEQ ID NO: 2703801 - RNA, 21 nt, Haemophilus influenzae Rd
acguaaaaguaaauaagccau

SEQ ID NO: 2703802 - RNA, 20 nt, Haemophilus influenzae Rd
acguaaaaguuuuccgacaa

SEQ ID NO: 2703803 - RNA, 16 nt, Haemophilus influenzae Rd
acguaaacgguuugga

SEQ ID NO: 2703804 - RNA, 22 nt, Haemophilus influenzae Rd
acguaaaggcgcuuccauagca

SEQ ID NO: 2703805 - RNA, 20 nt, Haemophilus influenzae Rd
acguaacuaaaaaaguuuaa

SEQ ID NO: 2703806 - RNA, 15 nt, Haemophilus influenzae Rd
acguaagcaccaaug

SEQ ID NO: 2703807 - RNA, 13 nt, Haemophilus influenzae Rd
acguaagguaaug

SEQ ID NO: 2703808 - RNA, 21 nt, Haemophilus influenzae Rd
acguaauaaguuuucaucaau

SEQ ID NO: 2703809 - RNA, 19 nt, Haemophilus influenzae Rd
acguaaucauccacuaauu

SEQ ID NO: 2703810 - RNA, 19 nt, Haemophilus influenzae Rd
acguaauucgcaaauccua

SEQ ID NO: 2703811 - RNA, 19 nt, Haemophilus influenzae Rd
acguaauuuaauuuaucau

SEQ ID NO: 2703812 - RNA, 12 nt, Haemophilus influenzae Rd
acguacuuuuaa

SEQ ID NO: 2703813 - RNA, 15 nt, Haemophilus influenzae Rd
acguagaaaacaaua

SEQ ID NO: 2703814 - RNA, 17 nt, Haemophilus influenzae Rd
acguaguaaauuuucca

SEQ ID NO: 2703815 - RNA, 14 nt, Haemophilus influenzae Rd
acguaguacaucau

SEQ ID NO: 2703816 - RNA, 17 nt, Haemophilus influenzae Rd
acguauguauuuucaac

SEQ ID NO: 2703817 - RNA, 13 nt, Haemophilus influenzae Rd
acguauugaacua

SEQ ID NO: 2703818 - RNA, 14 nt, Haemophilus influenzae Rd
acguauuuuuuaau

SEQ ID NO: 2703819 - RNA, 20 nt, Haemophilus influenzae Rd
acgucaauagcggauucugc

SEQ ID NO: 2703820 - RNA, 13 nt, Haemophilus influenzae Rd
acguccaugaacu

SEQ ID NO: 2703821 - RNA, 23 nt, Haemophilus influenzae Rd
acgucgaaucugaguauguuguu

SEQ ID NO: 2703822 - RNA, 15 nt, Haemophilus influenzae Rd
acgucgucuuugaaa

SEQ ID NO: 2703823 - RNA, 21 nt, Haemophilus influenzae Rd
acgucugugauaccgauaaaa

SEQ ID NO: 2703824 - RNA, 14 nt, Haemophilus influenzae Rd
acgugcaaauaaau

SEQ ID NO: 2703825 - RNA, 20 nt, Haemophilus influenzae Rd
acgugcaauuaauucuuuug

SEQ ID NO: 2703826 - RNA, 14 nt, Haemophilus influenzae Rd
acgugcgauaaaau

SEQ ID NO: 2703827 - RNA, 23 nt, Haemophilus influenzae Rd
acgugcuguuuaguguguccccc

SEQ ID NO: 2703828 - RNA, 22 nt, Haemophilus influenzae Rd
acguggauuuguuugccuucau

SEQ ID NO: 2703829 - RNA, 16 nt, Haemophilus influenzae Rd
acguuaaaugaacguu

SEQ ID NO: 2703830 - RNA, 17 nt, Haemophilus influenzae Rd
acguuacucaucauaua

SEQ ID NO: 2703831 - RNA, 16 nt, Haemophilus influenzae Rd
acguuauaaacaacaa

SEQ ID NO: 2703832 - RNA, 19 nt, Haemophilus influenzae Rd
acguuaucgacuuuuucac

SEQ ID NO: 2703833 - RNA, 21 nt, Haemophilus influenzae Rd
acguucaaaaauauuauguuc

SEQ ID NO: 2703834 - RNA, 14 nt, Haemophilus influenzae Rd
acguucaacaauca

SEQ ID NO: 2703835 - RNA, 22 nt, Haemophilus influenzae Rd
acguucaacaaucacuucgucu

SEQ ID NO: 2703836 - RNA, 15 nt, Haemophilus influenzae Rd
acguucuugcucagc

SEQ ID NO: 2703837 - RNA, 17 nt, Haemophilus influenzae Rd
acguucuuggaaaucuu

SEQ ID NO: 2703838 - RNA, 20 nt, Haemophilus influenzae Rd
acguugaguauagucauuca

SEQ ID NO: 2703839 - RNA, 17 nt, Haemophilus influenzae Rd
acguugcaccuuuaaau

SEQ ID NO: 2703840 - RNA, 18 nt, Haemophilus influenzae Rd
acguugcucuuucaaguu

SEQ ID NO: 2703841 - RNA, 19 nt, Haemophilus influenzae Rd
acguugcucuuucaaguuu

SEQ ID NO: 2703842 - RNA, 18 nt, Haemophilus influenzae Rd
acguugucacauuuuguc

SEQ ID NO: 2703843 - RNA, 20 nt, Haemophilus influenzae Rd
acguuguucuucuguuaaac

SEQ ID NO: 2703844 - RNA, 17 nt, Haemophilus influenzae Rd
acguuuauggcuuucaa

SEQ ID NO: 2703845 - RNA, 16 nt, Haemophilus influenzae Rd
acguuuauuuauucca

SEQ ID NO: 2703846 - RNA, 19 nt, Haemophilus influenzae Rd
acguuuauuuauuccauca

SEQ ID NO: 2703847 - RNA, 19 nt, Haemophilus influenzae Rd
acguuucaucacuucaaaa

SEQ ID NO: 2703848 - RNA, 15 nt, Haemophilus influenzae Rd
acguuucuaauacca

SEQ ID NO: 2703849 - RNA, 23 nt, Haemophilus influenzae Rd
acguuugguuaccgcugcaggua

SEQ ID NO: 2703850 - RNA, 19 nt, Haemophilus influenzae Rd
acguuuuaaauuaauuaag

SEQ ID NO: 2703851 - RNA, 14 nt, Haemophilus influenzae Rd
acguuuucaacagu

SEQ ID NO: 2703852 - RNA, 16 nt, Haemophilus influenzae Rd
acguuuucaacugcuu

SEQ ID NO: 2703853 - RNA, 13 nt, Haemophilus influenzae Rd
acguuuugcacca

SEQ ID NO: 2703854 - RNA, 14 nt, Haemophilus influenzae Rd
acguuuugcaccac

SEQ ID NO: 2703855 - RNA, 20 nt, Haemophilus influenzae Rd
acguuuuugucguucuuuuu

SEQ ID NO: 2703856 - RNA, 13 nt, Haemophilus influenzae Rd
acuaaaaaacuaa

SEQ ID NO: 2703857 - RNA, 18 nt, Haemophilus influenzae Rd
acuaaaaaagcgaauuuc

SEQ ID NO: 2703858 - RNA, 20 nt, Haemophilus influenzae Rd
acuaaaaaauuaaauuguaa

SEQ ID NO: 2703859 - RNA, 12 nt, Haemophilus influenzae Rd
acuaaaaacaag

SEQ ID NO: 2703860 - RNA, 22 nt, Haemophilus influenzae Rd
acuaaaaaucccauuuagguua

SEQ ID NO: 2703861 - RNA, 18 nt, Haemophilus influenzae Rd
acuaaaacacguuugcca

SEQ ID NO: 2703862 - RNA, 17 nt, Haemophilus influenzae Rd
acuaaaaccacaucauu

SEQ ID NO: 2703863 - RNA, 15 nt, Haemophilus influenzae Rd
acuaaaauaauuuuu

SEQ ID NO: 2703864 - RNA, 16 nt, Haemophilus influenzae Rd
acuaaaauaauuuuuu

SEQ ID NO: 2703865 - RNA, 23 nt, Haemophilus influenzae Rd
acuaaaauaauuuuuugaauaug

SEQ ID NO: 2703866 - RNA, 19 nt, Haemophilus influenzae Rd
acuaaaauggugcuuuuua

SEQ ID NO: 2703867 - RNA, 14 nt, Haemophilus influenzae Rd
acuaaacaaauaaa

SEQ ID NO: 2703868 - RNA, 15 nt, Haemophilus influenzae Rd
acuaaacaaauaaaa

SEQ ID NO: 2703869 - RNA, 23 nt, Haemophilus influenzae Rd
acuaaacagaauuuacgaaaacu

SEQ ID NO: 2703870 - RNA, 15 nt, Haemophilus influenzae Rd
acuaaaccauuuaau

SEQ ID NO: 2703871 - RNA, 18 nt, Haemophilus influenzae Rd
acuaaacguaacuaaaaa

SEQ ID NO: 2703872 - RNA, 18 nt, Haemophilus influenzae Rd
acuaaacuguaaucuaaa

SEQ ID NO: 2703873 - RNA, 22 nt, Haemophilus influenzae Rd
acuaaagacggcgcguucuucu

SEQ ID NO: 2703874 - RNA, 14 nt, Haemophilus influenzae Rd
acuaaaguaaauuu

SEQ ID NO: 2703875 - RNA, 14 nt, Haemophilus influenzae Rd
acuaaauaaaucac

SEQ ID NO: 2703876 - RNA, 19 nt, Haemophilus influenzae Rd
acuaaauaaaucacacagu

SEQ ID NO: 2703877 - RNA, 22 nt, Haemophilus influenzae Rd
acuaaauaaggcguaaaacuau

SEQ ID NO: 2703878 - RNA, 14 nt, Haemophilus influenzae Rd
acuaaauauucaau

SEQ ID NO: 2703879 - RNA, 16 nt, Haemophilus influenzae Rd
acuaaauauucaaucc

SEQ ID NO: 2703880 - RNA, 15 nt, Haemophilus influenzae Rd
acuaaaucaaaaaua

SEQ ID NO: 2703881 - RNA, 22 nt, Haemophilus influenzae Rd
acuaaaucaugaauaauuuugu

SEQ ID NO: 2703882 - RNA, 15 nt, Haemophilus influenzae Rd
acuaaaucuugcuuu

SEQ ID NO: 2703883 - RNA, 17 nt, Haemophilus influenzae Rd
acuaaaugaaguucacu

SEQ ID NO: 2703884 - RNA, 21 nt, Haemophilus influenzae Rd
acuaaaugugacauuguaaag

SEQ ID NO: 2703885 - RNA, 19 nt, Haemophilus influenzae Rd
acuaaauuauuugauuuuu

SEQ ID NO: 2703886 - RNA, 21 nt, Haemophilus influenzae Rd
acuccaacaccagucaauaaa

SEQ ID NO: 2703887 - RNA, 22 nt, Haemophilus influenzae Rd
acuccaacaccagucaauaaac

SEQ ID NO: 2703888 - RNA, 15 nt, Haemophilus influenzae Rd
acuccuauuaguauu

SEQ ID NO: 2703889 - RNA, 12 nt, Haemophilus influenzae Rd
acucgaaggaaa

SEQ ID NO: 2703890 - RNA, 13 nt, Haemophilus influenzae Rd
acucgaauuauuu

SEQ ID NO: 2703891 - RNA, 20 nt, Haemophilus influenzae Rd
acucgcgcaccgucauuuuc

SEQ ID NO: 2703892 - RNA, 12 nt, Haemophilus influenzae Rd
acucggaaugcc

SEQ ID NO: 2703893 - RNA, 17 nt, Haemophilus influenzae Rd
acucggagcauuuuggu

SEQ ID NO: 2703894 - RNA, 19 nt, Haemophilus influenzae Rd
acucgguuuauuuucagcc

SEQ ID NO: 2703895 - RNA, 16 nt, Haemophilus influenzae Rd
acucguagaguuuuuu

SEQ ID NO: 2703896 - RNA, 20 nt, Haemophilus influenzae Rd
acucguauaagcgaauuaca

SEQ ID NO: 2703897 - RNA, 23 nt, Haemophilus influenzae Rd
acucguccaaauucauuuuuuau

SEQ ID NO: 2703898 - RNA, 16 nt, Haemophilus influenzae Rd
acucguccaucaaaaa

SEQ ID NO: 2703899 - RNA, 15 nt, Haemophilus influenzae Rd
acucguggaauuuca

SEQ ID NO: 2703900 - RNA, 15 nt, Haemophilus influenzae Rd
acucguuuacuauuu

SEQ ID NO: 2703901 - RNA, 19 nt, Haemophilus influenzae Rd
acucguuuuuuauuuugug

SEQ ID NO: 2703902 - RNA, 23 nt, Haemophilus influenzae Rd
acucuaagcuuaauauguucuuu

SEQ ID NO: 2703903 - RNA, 18 nt, Haemophilus influenzae Rd
acucuaccaucuaaaguu

SEQ ID NO: 2703904 - RNA, 14 nt, Haemophilus influenzae Rd
acucuaucuaaaau

SEQ ID NO: 2703905 - RNA, 15 nt, Haemophilus influenzae Rd
acucuaucuaaaaua

SEQ ID NO: 2703906 - RNA, 22 nt, Haemophilus influenzae Rd
acucuaucuaaauggcaaaauu

SEQ ID NO: 2703907 - RNA, 12 nt, Haemophilus influenzae Rd
acucucagaauu

SEQ ID NO: 2703908 - RNA, 16 nt, Haemophilus influenzae Rd
acucuccccuuguucu

SEQ ID NO: 2703909 - RNA, 21 nt, Haemophilus influenzae Rd
acucugacaguuuaucucuuu

SEQ ID NO: 2703910 - RNA, 12 nt, Haemophilus influenzae Rd
acucuuaacaaa

SEQ ID NO: 2703911 - RNA, 17 nt, Haemophilus influenzae Rd
acucuuaacaaaacaga

SEQ ID NO: 2703912 - RNA, 14 nt, Haemophilus influenzae Rd
acucuuaauuuuug

SEQ ID NO: 2703913 - RNA, 16 nt, Haemophilus influenzae Rd
acucuuaauuuuugau

SEQ ID NO: 2703914 - RNA, 19 nt, Haemophilus influenzae Rd
acucuuaauuuuugauuua

SEQ ID NO: 2703915 - RNA, 20 nt, Haemophilus influenzae Rd
acucuuccauuuuuauuccu

SEQ ID NO: 2703916 - RNA, 15 nt, Haemophilus influenzae Rd
acucuugauaaccuu

SEQ ID NO: 2703917 - RNA, 22 nt, Haemophilus influenzae Rd
acucuuggcuaacuucuuccac

SEQ ID NO: 2703918 - RNA, 23 nt, Haemophilus influenzae Rd
acucuuggcuaacuucuuccacu

SEQ ID NO: 2703919 - RNA, 14 nt, Haemophilus influenzae Rd
acucuuugaaguuc

SEQ ID NO: 2703920 - RNA, 20 nt, Haemophilus influenzae Rd
acucuuuuuuagauaaaaag

SEQ ID NO: 2703921 - RNA, 16 nt, Haemophilus influenzae Rd
acugaaaauucaucau

SEQ ID NO: 2703922 - RNA, 16 nt, Haemophilus influenzae Rd
acugaaaugauuauaa

SEQ ID NO: 2703923 - RNA, 18 nt, Haemophilus influenzae Rd
acugaagcuucuucaccu

SEQ ID NO: 2703924 - RNA, 22 nt, Haemophilus influenzae Rd
acugaaguauaagccgcaccaa

SEQ ID NO: 2703925 - RNA, 13 nt, Haemophilus influenzae Rd
acugaauaaaaaa

SEQ ID NO: 2703926 - RNA, 14 nt, Haemophilus influenzae Rd
acugaauaaaaaaa

SEQ ID NO: 2703927 - RNA, 15 nt, Haemophilus influenzae Rd
acugaauaaaaaaaa

SEQ ID NO: 2703928 - RNA, 21 nt, Haemophilus influenzae Rd
acugaauaauuuccaacacau

SEQ ID NO: 2703929 - RNA, 19 nt, Haemophilus influenzae Rd
acugaauuucauucaaaaa

SEQ ID NO: 2703930 - RNA, 13 nt, Haemophilus influenzae Rd
acugacagaagac

SEQ ID NO: 2703931 - RNA, 19 nt, Haemophilus influenzae Rd
acugacaucaagcacauca

SEQ ID NO: 2703932 - RNA, 21 nt, Haemophilus influenzae Rd
acugacaucaagcacaucaua

SEQ ID NO: 2703933 - RNA, 12 nt, Haemophilus influenzae Rd
acugacuuucua

SEQ ID NO: 2703934 - RNA, 19 nt, Haemophilus influenzae Rd
acugacuuucuaacuuuua

SEQ ID NO: 2703935 - RNA, 17 nt, Haemophilus influenzae Rd
acugagcccacaacuac

SEQ ID NO: 2703936 - RNA, 20 nt, Haemophilus influenzae Rd
acugauauagcuagaaagca

SEQ ID NO: 2703937 - RNA, 23 nt, Haemophilus influenzae Rd
acugauauagcuagaaagcaaug

SEQ ID NO: 2703938 - RNA, 15 nt, Haemophilus influenzae Rd
acugaucauaaucca

SEQ ID NO: 2703939 - RNA, 12 nt, Haemophilus influenzae Rd
acugauuauauu

SEQ ID NO: 2703940 - RNA, 16 nt, Haemophilus influenzae Rd
acugauuauauuguug

SEQ ID NO: 2703941 - RNA, 20 nt, Haemophilus influenzae Rd
acugauuauauuguugcaca

SEQ ID NO: 2703942 - RNA, 21 nt, Haemophilus influenzae Rd
acugauuauauuguugcacau

SEQ ID NO: 2703943 - RNA, 19 nt, Haemophilus influenzae Rd
acugauuuccuguaaaaaa

SEQ ID NO: 2703944 - RNA, 15 nt, Haemophilus influenzae Rd
acugauuuuaagaaa

SEQ ID NO: 2703945 - RNA, 22 nt, Haemophilus influenzae Rd
acugauuuuuuuauaauuaaau

SEQ ID NO: 2703946 - RNA, 16 nt, Haemophilus influenzae Rd
acugcaacaauuucau

SEQ ID NO: 2703947 - RNA, 20 nt, Haemophilus influenzae Rd
acugcaacguuacucaucau

SEQ ID NO: 2703948 - RNA, 22 nt, Haemophilus influenzae Rd
acugcaaguccgccuugagaug

SEQ ID NO: 2703949 - RNA, 22 nt, Haemophilus influenzae Rd
acugcaccguauucuuuacaaa

SEQ ID NO: 2703950 - RNA, 20 nt, Haemophilus influenzae Rd
acugcauauccaaagcaauu

SEQ ID NO: 2703951 - RNA, 14 nt, Haemophilus influenzae Rd
acugcaucaauuug

SEQ ID NO: 2703952 - RNA, 17 nt, Haemophilus influenzae Rd
acugccaaacaaauugc

SEQ ID NO: 2703953 - RNA, 18 nt, Haemophilus influenzae Rd
acugccaaugcagcuuca

SEQ ID NO: 2703954 - RNA, 22 nt, Haemophilus influenzae Rd
acugcgaccacguuugccuuuu

SEQ ID NO: 2703955 - RNA, 23 nt, Haemophilus influenzae Rd
acugcucacgccgugauaacaac

SEQ ID NO: 2703956 - RNA, 16 nt, Haemophilus influenzae Rd
acugcugaauaaaccu

SEQ ID NO: 2703957 - RNA, 21 nt, Haemophilus influenzae Rd
acugcuucauaaauguaagau

SEQ ID NO: 2703958 - RNA, 22 nt, Haemophilus influenzae Rd
acugcuuuauuuucuuuugugc

SEQ ID NO: 2703959 - RNA, 14 nt, Haemophilus influenzae Rd
acugcuuucaaaag

SEQ ID NO: 2703960 - RNA, 17 nt, Haemophilus influenzae Rd
acugcuuucuagaugau

SEQ ID NO: 2703961 - RNA, 22 nt, Haemophilus influenzae Rd
acugcuuucuagaugaugaaau

SEQ ID NO: 2703962 - RNA, 14 nt, Haemophilus influenzae Rd
acugcuuuuuucca

SEQ ID NO: 2703963 - RNA, 17 nt, Haemophilus influenzae Rd
acuggaaauucuucaau

SEQ ID NO: 2703964 - RNA, 14 nt, Haemophilus influenzae Rd
acuggaauaaagca

SEQ ID NO: 2703965 - RNA, 17 nt, Haemophilus influenzae Rd
acuggaccuaaucccau

SEQ ID NO: 2703966 - RNA, 19 nt, Haemophilus influenzae Rd
acuggacuccaaggcaauu

SEQ ID NO: 2703967 - RNA, 16 nt, Haemophilus influenzae Rd
acuggaugaaaucauu

SEQ ID NO: 2703968 - RNA, 15 nt, Haemophilus influenzae Rd
acuggcauuuucuuc

SEQ ID NO: 2703969 - RNA, 15 nt, Haemophilus influenzae Rd
acuggcguagcugca

SEQ ID NO: 2703970 - RNA, 18 nt, Haemophilus influenzae Rd
acuggcucuucuuucggu

SEQ ID NO: 2703971 - RNA, 16 nt, Haemophilus influenzae Rd
acuggcugagagaaga

SEQ ID NO: 2703972 - RNA, 17 nt, Haemophilus influenzae Rd
acuggcuguguaaaaca

SEQ ID NO: 2703973 - RNA, 20 nt, Haemophilus influenzae Rd
acuggcuguguaaaacauug

SEQ ID NO: 2703974 - RNA, 20 nt, Haemophilus influenzae Rd
acuggguuucggauaauaau

SEQ ID NO: 2703975 - RNA, 18 nt, Haemophilus influenzae Rd
acuguauauuguuugcuu

SEQ ID NO: 2703976 - RNA, 14 nt, Haemophilus influenzae Rd
acuguaucuacuuu

SEQ ID NO: 2703977 - RNA, 13 nt, Haemophilus influenzae Rd
acugucuacuggc

SEQ ID NO: 2703978 - RNA, 14 nt, Haemophilus influenzae Rd
acugugcauuaaau

SEQ ID NO: 2703979 - RNA, 17 nt, Haemophilus influenzae Rd
acugugcauuaaaucaa

SEQ ID NO: 2703980 - RNA, 18 nt, Haemophilus influenzae Rd
acugugcauuaaaucaaa

SEQ ID NO: 2703981 - RNA, 23 nt, Haemophilus influenzae Rd
acugugcauuaaaucaaauuuag

SEQ ID NO: 2703982 - RNA, 17 nt, Haemophilus influenzae Rd
acugugcggucuguugc

SEQ ID NO: 2703983 - RNA, 20 nt, Haemophilus influenzae Rd
acuguggauaauucaucaaa

SEQ ID NO: 2703984 - RNA, 12 nt, Haemophilus influenzae Rd
acuguuauuaag

SEQ ID NO: 2703985 - RNA, 22 nt, Haemophilus influenzae Rd
acuguuccgccacaaguagauu

SEQ ID NO: 2703986 - RNA, 12 nt, Haemophilus influenzae Rd
acuguuugaacg

SEQ ID NO: 2703987 - RNA, 18 nt, Haemophilus influenzae Rd
acuguuugauaacuuuaa

SEQ ID NO: 2703988 - RNA, 14 nt, Haemophilus influenzae Rd
acuguuuuggcauu

SEQ ID NO: 2703989 - RNA, 19 nt, Haemophilus influenzae Rd
acuguuuuggcauuuucaa

SEQ ID NO: 2703990 - RNA, 13 nt, Haemophilus influenzae Rd
acuuaaaaauaaa

SEQ ID NO: 2703991 - RNA, 20 nt, Haemophilus influenzae Rd
acuugcuauuuucuaauuuu

SEQ ID NO: 2703992 - RNA, 19 nt, Haemophilus influenzae Rd
acuugcuccgccuacacga

SEQ ID NO: 2703993 - RNA, 16 nt, Haemophilus influenzae Rd
acuugcuguuuuuccg

SEQ ID NO: 2703994 - RNA, 14 nt, Haemophilus influenzae Rd
acuugcuucaagau

SEQ ID NO: 2703995 - RNA, 18 nt, Haemophilus influenzae Rd
acuuggaauaucaucuag

SEQ ID NO: 2703996 - RNA, 19 nt, Haemophilus influenzae Rd
acuuggaauaucaucuaga

SEQ ID NO: 2703997 - RNA, 20 nt, Haemophilus influenzae Rd
acuuggacauuguuguuuaa

SEQ ID NO: 2703998 - RNA, 21 nt, Haemophilus influenzae Rd
acuuggauugcaugaaaugua

SEQ ID NO: 2703999 - RNA, 19 nt, Haemophilus influenzae Rd
acuuggcguucauaucuuu

SEQ ID NO: 2704000 - RNA, 18 nt, Haemophilus influenzae Rd
acuuggggcuaauuuuua

SEQ ID NO: 2704001 - RNA, 20 nt, Haemophilus influenzae Rd
acuuggggcuaauuuuuaaa

SEQ ID NO: 2704002 - RNA, 17 nt, Haemophilus influenzae Rd
acuuggugaucaccgaa

SEQ ID NO: 2704003 - RNA, 21 nt, Haemophilus influenzae Rd
acuuggugcaauaaaaucauu

SEQ ID NO: 2704004 - RNA, 14 nt, Haemophilus influenzae Rd
acuugguggauugu

SEQ ID NO: 2704005 - RNA, 19 nt, Haemophilus influenzae Rd
acuugugcaagaaauugau

SEQ ID NO: 2704006 - RNA, 19 nt, Haemophilus influenzae Rd
acuuguuaaauaaacacaa

SEQ ID NO: 2704007 - RNA, 14 nt, Haemophilus influenzae Rd
acuuguucaaaaau

SEQ ID NO: 2704008 - RNA, 17 nt, Haemophilus influenzae Rd
acuuguuccgcaguuaa

SEQ ID NO: 2704009 - RNA, 14 nt, Haemophilus influenzae Rd
acuuguuggauauc

SEQ ID NO: 2704010 - RNA, 18 nt, Haemophilus influenzae Rd
acuuguuguuguacgauu

SEQ ID NO: 2704011 - RNA, 13 nt, Haemophilus influenzae Rd
acuuguuuuaaaa

SEQ ID NO: 2704012 - RNA, 17 nt, Haemophilus influenzae Rd
acuuguuuuaaaacuau

SEQ ID NO: 2704013 - RNA, 19 nt, Haemophilus influenzae Rd
acuuguuuuaaaacuauuu

SEQ ID NO: 2704014 - RNA, 20 nt, Haemophilus influenzae Rd
acuuguuuuaaaacuauuuu

SEQ ID NO: 2704015 - RNA, 15 nt, Haemophilus influenzae Rd
acuuguuuuccaaac

SEQ ID NO: 2704016 - RNA, 18 nt, Haemophilus influenzae Rd
acuuguuuuccaaacauu

SEQ ID NO: 2704017 - RNA, 19 nt, Haemophilus influenzae Rd
acuuguuuuccaaacauuu

SEQ ID NO: 2704018 - RNA, 22 nt, Haemophilus influenzae Rd
acuuguuuuuucaaucauuucu

SEQ ID NO: 2704019 - RNA, 19 nt, Haemophilus influenzae Rd
acuuuaaacuguugccaua

SEQ ID NO: 2704020 - RNA, 14 nt, Haemophilus influenzae Rd
acuuuaaagaaaua

SEQ ID NO: 2704021 - RNA, 16 nt, Haemophilus influenzae Rd
acuuuaaagaaauaaa

SEQ ID NO: 2704022 - RNA, 21 nt, Haemophilus influenzae Rd
acuuuaaagaauauucuuuuc

SEQ ID NO: 2704023 - RNA, 12 nt, Haemophilus influenzae Rd
acuuuaaauauu

SEQ ID NO: 2704024 - RNA, 15 nt, Haemophilus influenzae Rd
acuuuaaauauuuaa

SEQ ID NO: 2704025 - RNA, 16 nt, Haemophilus influenzae Rd
acuuuaacccauuacu

SEQ ID NO: 2704026 - RNA, 23 nt, Haemophilus influenzae Rd
acuuuaauucgcugauuuauuca

SEQ ID NO: 2704027 - RNA, 14 nt, Haemophilus influenzae Rd
acuuuaccauuaca

SEQ ID NO: 2704028 - RNA, 16 nt, Haemophilus influenzae Rd
acuuuaccauuacaua

SEQ ID NO: 2704029 - RNA, 23 nt, Haemophilus influenzae Rd
acuuuaccgaucgcuuucauuuc

SEQ ID NO: 2704030 - RNA, 21 nt, Haemophilus influenzae Rd
acuuuacgccccuacuuuaaa

SEQ ID NO: 2704031 - RNA, 21 nt, Haemophilus influenzae Rd
acuuuacggauaauuucccua

SEQ ID NO: 2704032 - RNA, 15 nt, Haemophilus influenzae Rd
acuuuacguaaagua

SEQ ID NO: 2704033 - RNA, 16 nt, Haemophilus influenzae Rd
acuuuagaacauugau

SEQ ID NO: 2704034 - RNA, 15 nt, Haemophilus influenzae Rd
acuuuagagauuuua

SEQ ID NO: 2704035 - RNA, 15 nt, Haemophilus influenzae Rd
acuuuauaaaugauu

SEQ ID NO: 2704036 - RNA, 17 nt, Haemophilus influenzae Rd
acuuuauaacuugcuug

SEQ ID NO: 2704037 - RNA, 16 nt, Haemophilus influenzae Rd
acuuuauauugacaaa

SEQ ID NO: 2704038 - RNA, 21 nt, Haemophilus influenzae Rd
acuuuauccccuacagugacc

SEQ ID NO: 2704039 - RNA, 22 nt, Haemophilus influenzae Rd
acuuuauguccauaacugucaa

SEQ ID NO: 2704040 - RNA, 15 nt, Haemophilus influenzae Rd
acuuuauuacuuuua

SEQ ID NO: 2704041 - RNA, 19 nt, Haemophilus influenzae Rd
acuuuauuagaaauauauu

SEQ ID NO: 2704042 - RNA, 14 nt, Haemophilus influenzae Rd
acuuuauuuaauuc

SEQ ID NO: 2704043 - RNA, 14 nt, Haemophilus influenzae Rd
acuuuauuugauug

SEQ ID NO: 2704044 - RNA, 21 nt, Haemophilus influenzae Rd
acuuucaacacgguggcauuu

SEQ ID NO: 2704045 - RNA, 19 nt, Haemophilus influenzae Rd
acuuucaacuguucuucug

SEQ ID NO: 2704046 - RNA, 14 nt, Haemophilus influenzae Rd
acuuucaauuuuuc

SEQ ID NO: 2704047 - RNA, 19 nt, Haemophilus influenzae Rd
acuuucaauuuuuccaccg

SEQ ID NO: 2704048 - RNA, 16 nt, Haemophilus influenzae Rd
acuuucacaacuacca

SEQ ID NO: 2704049 - RNA, 21 nt, Haemophilus influenzae Rd
acuuucacacccaugaaucga

SEQ ID NO: 2704050 - RNA, 15 nt, Haemophilus influenzae Rd
acuuucauaaagaua

SEQ ID NO: 2704051 - RNA, 21 nt, Haemophilus influenzae Rd
acuuuccauacccuugcuucu

SEQ ID NO: 2704052 - RNA, 23 nt, Haemophilus influenzae Rd
acuuuccaucauugcucgacaaa

SEQ ID NO: 2704053 - RNA, 16 nt, Haemophilus influenzae Rd
acuuuccguuuacuac

SEQ ID NO: 2704054 - RNA, 16 nt, Haemophilus influenzae Rd
acuuuccuucuaacau

SEQ ID NO: 2704055 - RNA, 23 nt, Haemophilus influenzae Rd
acuuucgccgaguaaauucacca

SEQ ID NO: 2704056 - RNA, 22 nt, Haemophilus influenzae Rd
acuuucgccuucauaaguccaa

SEQ ID NO: 2704057 - RNA, 17 nt, Haemophilus influenzae Rd
acuuucuaacuuuuaau

SEQ ID NO: 2704058 - RNA, 18 nt, Haemophilus influenzae Rd
acuuucuaacuuuuaauu

SEQ ID NO: 2704059 - RNA, 19 nt, Haemophilus influenzae Rd
acuuucuaacuuuuaauuc

SEQ ID NO: 2704060 - RNA, 21 nt, Haemophilus influenzae Rd
acuuucuacgacauuuuuaac

SEQ ID NO: 2704061 - RNA, 23 nt, Haemophilus influenzae Rd
acuuucuauuaaaaaaucaucaa

SEQ ID NO: 2704062 - RNA, 20 nt, Haemophilus influenzae Rd
acuuucuuguauugccacuu

SEQ ID NO: 2704063 - RNA, 19 nt, Haemophilus influenzae Rd
acuuucuuuucaauuugaa

SEQ ID NO: 2704064 - RNA, 21 nt, Haemophilus influenzae Rd
acuuucuuuuuguuuaaaagc

SEQ ID NO: 2704065 - RNA, 17 nt, Haemophilus influenzae Rd
acuuuggaauauucuuu

SEQ ID NO: 2704066 - RNA, 21 nt, Haemophilus influenzae Rd
acuuuggauuggauuuugaaa

SEQ ID NO: 2704067 - RNA, 15 nt, Haemophilus influenzae Rd
acuuugguuuguuaa

SEQ ID NO: 2704068 - RNA, 22 nt, Haemophilus influenzae Rd
acuuugguuuguuaaaugaaaa

SEQ ID NO: 2704069 - RNA, 23 nt, Haemophilus influenzae Rd
acuuuguuuuugcuuucagauuc

SEQ ID NO: 2704070 - RNA, 14 nt, Haemophilus influenzae Rd
acuuuuaacacuuu

SEQ ID NO: 2704071 - RNA, 14 nt, Haemophilus influenzae Rd
acuuuuaauuaaua

SEQ ID NO: 2704072 - RNA, 15 nt, Haemophilus influenzae Rd
acuuuuaauucuugu

SEQ ID NO: 2704073 - RNA, 20 nt, Haemophilus influenzae Rd
acuuuuacgacuaauuuuuu

SEQ ID NO: 2704074 - RNA, 19 nt, Haemophilus influenzae Rd
acuuuuacgcguuuuucug

SEQ ID NO: 2704075 - RNA, 20 nt, Haemophilus influenzae Rd
acuuuuacgcuuggaaaugu

SEQ ID NO: 2704076 - RNA, 23 nt, Haemophilus influenzae Rd
acuuuuacgcuuggaaauguuua

SEQ ID NO: 2704077 - RNA, 18 nt, Haemophilus influenzae Rd
acuuuuagcuccuaaauu

SEQ ID NO: 2704078 - RNA, 22 nt, Haemophilus influenzae Rd
acuuuuauaaagaucaaugggu

SEQ ID NO: 2704079 - RNA, 20 nt, Haemophilus influenzae Rd
acuuuuauccacaugauaua

SEQ ID NO: 2704080 - RNA, 15 nt, Haemophilus influenzae Rd
acuuuuaucuauaaa

SEQ ID NO: 2704081 - RNA, 17 nt, Haemophilus influenzae Rd
acuuuuauuauuuaaau

SEQ ID NO: 2704082 - RNA, 20 nt, Haemophilus influenzae Rd
acuuuucaacacuuuauuac

SEQ ID NO: 2704083 - RNA, 23 nt, Haemophilus influenzae Rd
acuuuucccaaugcaccaaaaau

SEQ ID NO: 2704084 - RNA, 15 nt, Haemophilus influenzae Rd
acuuuucgauagaac

SEQ ID NO: 2704085 - RNA, 18 nt, Haemophilus influenzae Rd
acuuuucgcaauuuuaac

SEQ ID NO: 2704086 - RNA, 17 nt, Haemophilus influenzae Rd
acuuuucuucaauuacc

SEQ ID NO: 2704087 - RNA, 23 nt, Haemophilus influenzae Rd
acuuuugacgcagcaucugccac

SEQ ID NO: 2704088 - RNA, 22 nt, Haemophilus influenzae Rd
acuuuugagucaauuugaccga

SEQ ID NO: 2704089 - RNA, 23 nt, Haemophilus influenzae Rd
acuuuugagugcuguacacacac

SEQ ID NO: 2704090 - RNA, 22 nt, Haemophilus influenzae Rd
acuuuugaucugcacuccaaaa

SEQ ID NO: 2704091 - RNA, 18 nt, Haemophilus influenzae Rd
acuuuugcaaaauugcuu

SEQ ID NO: 2704092 - RNA, 18 nt, Haemophilus influenzae Rd
acuuuuggauaaaguauu

SEQ ID NO: 2704093 - RNA, 19 nt, Haemophilus influenzae Rd
acuuuugguggauuauaaa

SEQ ID NO: 2704094 - RNA, 18 nt, Haemophilus influenzae Rd
acuuuuuaauaaaucaag

SEQ ID NO: 2704095 - RNA, 15 nt, Haemophilus influenzae Rd
agaaaugaccuucac

SEQ ID NO: 2704096 - RNA, 14 nt, Haemophilus influenzae Rd
agaaauggcgacca

SEQ ID NO: 2704097 - RNA, 18 nt, Haemophilus influenzae Rd
agaaaugucguaagaacg

SEQ ID NO: 2704098 - RNA, 22 nt, Haemophilus influenzae Rd
agaaauguuguccaucaaucau

SEQ ID NO: 2704099 - RNA, 21 nt, Haemophilus influenzae Rd
agaaauugauauaaauggguu

SEQ ID NO: 2704100 - RNA, 14 nt, Haemophilus influenzae Rd
agaaauuuuaauca

SEQ ID NO: 2704101 - RNA, 18 nt, Haemophilus influenzae Rd
agaacaaaaggcuuuuua

SEQ ID NO: 2704102 - RNA, 20 nt, Haemophilus influenzae Rd
agaacaaaugucgaaauuuu

SEQ ID NO: 2704103 - RNA, 14 nt, Haemophilus influenzae Rd
agaacaauacucuu

SEQ ID NO: 2704104 - RNA, 23 nt, Haemophilus influenzae Rd
agaacaauacucuuaacaaaaca

SEQ ID NO: 2704105 - RNA, 14 nt, Haemophilus influenzae Rd
agaacaauauuuau

SEQ ID NO: 2704106 - RNA, 15 nt, Haemophilus influenzae Rd
agaacaauauuuaua

SEQ ID NO: 2704107 - RNA, 20 nt, Haemophilus influenzae Rd
agaacaauauuuauaaugug

SEQ ID NO: 2704108 - RNA, 23 nt, Haemophilus influenzae Rd
agaacaccgagaugcauuuuuua

SEQ ID NO: 2704109 - RNA, 16 nt, Haemophilus influenzae Rd
agaacagguugcugau

SEQ ID NO: 2704110 - RNA, 22 nt, Haemophilus influenzae Rd
agaacagguugcugauaaagau

SEQ ID NO: 2704111 - RNA, 13 nt, Haemophilus influenzae Rd
agaacauugauaa

SEQ ID NO: 2704112 - RNA, 17 nt, Haemophilus influenzae Rd
agaacauugauaagauu

SEQ ID NO: 2704113 - RNA, 14 nt, Haemophilus influenzae Rd
agaacauugugaca

SEQ ID NO: 2704114 - RNA, 22 nt, Haemophilus influenzae Rd
agaaccauuuauaaugcaacca

SEQ ID NO: 2704115 - RNA, 17 nt, Haemophilus influenzae Rd
agaacccgcuaaaguuc

SEQ ID NO: 2704116 - RNA, 22 nt, Haemophilus influenzae Rd
agaaccuaucucauccacuaaa

SEQ ID NO: 2704117 - RNA, 18 nt, Haemophilus influenzae Rd
agaacgacgccaaauaug

SEQ ID NO: 2704118 - RNA, 15 nt, Haemophilus influenzae Rd
agaacguaaauuaug

SEQ ID NO: 2704119 - RNA, 16 nt, Haemophilus influenzae Rd
agaacguuuuuuacuu

SEQ ID NO: 2704120 - RNA, 19 nt, Haemophilus influenzae Rd
agaacuauuauuccaaaua

SEQ ID NO: 2704121 - RNA, 22 nt, Haemophilus influenzae Rd
agaacuauuauuccaaauaucu

SEQ ID NO: 2704122 - RNA, 23 nt, Haemophilus influenzae Rd
agaacuauuauuccaaauaucuu

SEQ ID NO: 2704123 - RNA, 23 nt, Haemophilus influenzae Rd
agaacuuagcccuuaaacuaaau

SEQ ID NO: 2704124 - RNA, 19 nt, Haemophilus influenzae Rd
agaacuucaaauuguacuu

SEQ ID NO: 2704125 - RNA, 12 nt, Haemophilus influenzae Rd
agaacuugauaa

SEQ ID NO: 2704126 - RNA, 23 nt, Haemophilus influenzae Rd
agaacuuuccaccccagaauuaa

SEQ ID NO: 2704127 - RNA, 13 nt, Haemophilus influenzae Rd
agaacuuuuaaaa

SEQ ID NO: 2704128 - RNA, 23 nt, Haemophilus influenzae Rd
agaacuuuugaauuagguuuugu

SEQ ID NO: 2704129 - RNA, 22 nt, Haemophilus influenzae Rd
agaagaaucuucuaauuugcca

SEQ ID NO: 2704130 - RNA, 15 nt, Haemophilus influenzae Rd
agaagacgauuuuag

SEQ ID NO: 2704131 - RNA, 19 nt, Haemophilus influenzae Rd
agaagauaaucgcaaagaa

SEQ ID NO: 2704132 - RNA, 22 nt, Haemophilus influenzae Rd
agaagauuuaaaacaagaaccg

SEQ ID NO: 2704133 - RNA, 21 nt, Haemophilus influenzae Rd
agaagauuuauauaccuuaac

SEQ ID NO: 2704134 - RNA, 15 nt, Haemophilus influenzae Rd
agaagcugaauaaaa

SEQ ID NO: 2704135 - RNA, 18 nt, Haemophilus influenzae Rd
agaagcugaauaaaagag

SEQ ID NO: 2704136 - RNA, 21 nt, Haemophilus influenzae Rd
agaaggcuaguucuuccuugg

SEQ ID NO: 2704137 - RNA, 14 nt, Haemophilus influenzae Rd
agaaguaaaaagaa

SEQ ID NO: 2704138 - RNA, 11 nt, Haemophilus influenzae Rd
agaaguaaauu

SEQ ID NO: 2704139 - RNA, 19 nt, Haemophilus influenzae Rd
agaagucacauauuguuuc

SEQ ID NO: 2704140 - RNA, 14 nt, Haemophilus influenzae Rd
agaagucagcaaua

SEQ ID NO: 2704141 - RNA, 15 nt, Haemophilus influenzae Rd
agaagugaaauuacu

SEQ ID NO: 2704142 - RNA, 15 nt, Haemophilus influenzae Rd
agaagugagaaauau

SEQ ID NO: 2704143 - RNA, 21 nt, Haemophilus influenzae Rd
agaagugcggggacaauugca

SEQ ID NO: 2704144 - RNA, 21 nt, Haemophilus influenzae Rd
agaagugcguucauauuugaa

SEQ ID NO: 2704145 - RNA, 16 nt, Haemophilus influenzae Rd
agaaguuguuuuucuu

SEQ ID NO: 2704146 - RNA, 17 nt, Haemophilus influenzae Rd
agaaguuuaagaaaagu

SEQ ID NO: 2704147 - RNA, 12 nt, Haemophilus influenzae Rd
agaauaaaaugu

SEQ ID NO: 2704148 - RNA, 12 nt, Haemophilus influenzae Rd
agaauaaagaaa

SEQ ID NO: 2704149 - RNA, 13 nt, Haemophilus influenzae Rd
agaauaaaucacc

SEQ ID NO: 2704150 - RNA, 12 nt, Haemophilus influenzae Rd
agaauaaauuaa

SEQ ID NO: 2704151 - RNA, 14 nt, Haemophilus influenzae Rd
agaauaaauuaaaa

SEQ ID NO: 2704152 - RNA, 15 nt, Haemophilus influenzae Rd
agaauaacaacaaaa

SEQ ID NO: 2704153 - RNA, 16 nt, Haemophilus influenzae Rd
agaauaacaacaaaag

SEQ ID NO: 2704154 - RNA, 23 nt, Haemophilus influenzae Rd
agaauaaccacauauagugaaaa

SEQ ID NO: 2704155 - RNA, 21 nt, Haemophilus influenzae Rd
agaauaacccuuguaacguau

SEQ ID NO: 2704156 - RNA, 20 nt, Haemophilus influenzae Rd
agaauacaccccaaaauccc

SEQ ID NO: 2704157 - RNA, 16 nt, Haemophilus influenzae Rd
agaauacuuaauagcu

SEQ ID NO: 2704158 - RNA, 19 nt, Haemophilus influenzae Rd
agaauagccgcaaucacaa

SEQ ID NO: 2704159 - RNA, 22 nt, Haemophilus influenzae Rd
agaauagccgcaaucacaaaau

SEQ ID NO: 2704160 - RNA, 14 nt, Haemophilus influenzae Rd
agaauagucacacc

SEQ ID NO: 2704161 - RNA, 16 nt, Haemophilus influenzae Rd
agaauauaaauaaaac

SEQ ID NO: 2704162 - RNA, 17 nt, Haemophilus influenzae Rd
agaauauaaauaaaaca

SEQ ID NO: 2704163 - RNA, 14 nt, Haemophilus influenzae Rd
agaauauauuuuau

SEQ ID NO: 2704164 - RNA, 16 nt, Haemophilus influenzae Rd
agaauauauuuuauca

SEQ ID NO: 2704165 - RNA, 20 nt, Haemophilus influenzae Rd
agaauauauuuuaucaacua

SEQ ID NO: 2704166 - RNA, 14 nt, Haemophilus influenzae Rd
agaauauucuuuuc

SEQ ID NO: 2704167 - RNA, 22 nt, Haemophilus influenzae Rd
agaauauugguagcuaaaaaua

SEQ ID NO: 2704168 - RNA, 12 nt, Haemophilus influenzae Rd
agaauauuucac

SEQ ID NO: 2704169 - RNA, 22 nt, Haemophilus influenzae Rd
agaauauuuugcauguuauucu

SEQ ID NO: 2704170 - RNA, 18 nt, Haemophilus influenzae Rd
agaaucagaguuaaaagu

SEQ ID NO: 2704171 - RNA, 22 nt, Haemophilus influenzae Rd
agaauccacauuuuuuguaauu

SEQ ID NO: 2704172 - RNA, 20 nt, Haemophilus influenzae Rd
agaaucgcccacgaaaagca

SEQ ID NO: 2704173 - RNA, 14 nt, Haemophilus influenzae Rd
agaaucuaaagaaa

SEQ ID NO: 2704174 - RNA, 20 nt, Haemophilus influenzae Rd
agaaugaaguagaaauugcc

SEQ ID NO: 2704175 - RNA, 21 nt, Haemophilus influenzae Rd
agaaugacuggcuugugaaau

SEQ ID NO: 2704176 - RNA, 13 nt, Haemophilus influenzae Rd
agaaugaucauuu

SEQ ID NO: 2704177 - RNA, 14 nt, Haemophilus influenzae Rd
agaaugcaaacauu

SEQ ID NO: 2704178 - RNA, 15 nt, Haemophilus influenzae Rd
agaaugcaaacauuu

SEQ ID NO: 2704179 - RNA, 13 nt, Haemophilus influenzae Rd
agaaugcaacaag

SEQ ID NO: 2704180 - RNA, 17 nt, Haemophilus influenzae Rd
agaauguagcugaaacu

SEQ ID NO: 2704181 - RNA, 20 nt, Haemophilus influenzae Rd
agaaugucagguuuaucuac

SEQ ID NO: 2704182 - RNA, 22 nt, Haemophilus influenzae Rd
agaaugucagguuuaucuacca

SEQ ID NO: 2704183 - RNA, 20 nt, Haemophilus influenzae Rd
agaauuaagaucuaaaccua

SEQ ID NO: 2704184 - RNA, 21 nt, Haemophilus influenzae Rd
agaauuaccgcacuuuaaacu

SEQ ID NO: 2704185 - RNA, 19 nt, Haemophilus influenzae Rd
agaauuacguuguuguucu

SEQ ID NO: 2704186 - RNA, 17 nt, Haemophilus influenzae Rd
agaauuaguaaagaaau

SEQ ID NO: 2704187 - RNA, 15 nt, Haemophilus influenzae Rd
agaauuauuuaaacu

SEQ ID NO: 2704188 - RNA, 18 nt, Haemophilus influenzae Rd
agaauugaucaaaauuau

SEQ ID NO: 2704189 - RNA, 19 nt, Haemophilus influenzae Rd
agaauuuacgaaaacuuuc

SEQ ID NO: 2704190 - RNA, 19 nt, Haemophilus influenzae Rd
agaauuucgucaaaaaugu

SEQ ID NO: 2704191 - RNA, 13 nt, Haemophilus influenzae Rd
agaauuuucaacc

SEQ ID NO: 2704192 - RNA, 17 nt, Haemophilus influenzae Rd
agaauuuucaaccgcac

SEQ ID NO: 2704193 - RNA, 20 nt, Haemophilus influenzae Rd
agaauuuucaucaauuuuga

SEQ ID NO: 2704194 - RNA, 13 nt, Haemophilus influenzae Rd
agaauuuugguua

SEQ ID NO: 2704195 - RNA, 16 nt, Haemophilus influenzae Rd
agaauuuuuauuuuua

SEQ ID NO: 2704196 - RNA, 13 nt, Haemophilus influenzae Rd
agaauuuuuucuu

SEQ ID NO: 2704197 - RNA, 15 nt, Haemophilus influenzae Rd
agacaaaacuuauca

SEQ ID NO: 2704198 - RNA, 17 nt, Haemophilus influenzae Rd
agacaaaacuuaucauu

SEQ ID NO: 2704199 - RNA, 13 nt, Haemophilus influenzae Rd
agacaaauuaaau

SEQ ID NO: 2704200 - RNA, 15 nt, Haemophilus influenzae Rd
agauagcacuuguuu

SEQ ID NO: 2704201 - RNA, 18 nt, Haemophilus influenzae Rd
agauaguuuucgcaauca

SEQ ID NO: 2704202 - RNA, 22 nt, Haemophilus influenzae Rd
agauaguuuucgcaaucagcau

SEQ ID NO: 2704203 - RNA, 10 nt, Haemophilus influenzae Rd
agauauaaaa

SEQ ID NO: 2704204 - RNA, 15 nt, Haemophilus influenzae Rd
agauauaaaaaucug

SEQ ID NO: 2704205 - RNA, 14 nt, Haemophilus influenzae Rd
agauauaaggcaca

SEQ ID NO: 2704206 - RNA, 18 nt, Haemophilus influenzae Rd
agauauuauuauuaaauc

SEQ ID NO: 2704207 - RNA, 13 nt, Haemophilus influenzae Rd
agauauuucuagg

SEQ ID NO: 2704208 - RNA, 21 nt, Haemophilus influenzae Rd
agaucaauggguuuaaaaagu

SEQ ID NO: 2704209 - RNA, 22 nt, Haemophilus influenzae Rd
agaucacaguugugaaaaaacg

SEQ ID NO: 2704210 - RNA, 13 nt, Haemophilus influenzae Rd
agaucagaaaacg

SEQ ID NO: 2704211 - RNA, 23 nt, Haemophilus influenzae Rd
agaucagauuuuuuucagaaaug

SEQ ID NO: 2704212 - RNA, 20 nt, Haemophilus influenzae Rd
agaucagccccuuaauuauu

SEQ ID NO: 2704213 - RNA, 18 nt, Haemophilus influenzae Rd
agaucaggaucaaaaaua

SEQ ID NO: 2704214 - RNA, 19 nt, Haemophilus influenzae Rd
agaucaggaucaaaaauau

SEQ ID NO: 2704215 - RNA, 18 nt, Haemophilus influenzae Rd
agaucauaaaaaaaugua

SEQ ID NO: 2704216 - RNA, 15 nt, Haemophilus influenzae Rd
agaucauuuuuuuaa

SEQ ID NO: 2704217 - RNA, 17 nt, Haemophilus influenzae Rd
agauccaaagacuaaaa

SEQ ID NO: 2704218 - RNA, 22 nt, Haemophilus influenzae Rd
agauccaaagacuaaaaccaca

SEQ ID NO: 2704219 - RNA, 17 nt, Haemophilus influenzae Rd
agauccgcgagauacua

SEQ ID NO: 2704220 - RNA, 23 nt, Haemophilus influenzae Rd
agaucgacuccacuuugcucuaa

SEQ ID NO: 2704221 - RNA, 18 nt, Haemophilus influenzae Rd
agaucgauaucaucaaga

SEQ ID NO: 2704222 - RNA, 18 nt, Haemophilus influenzae Rd
agaugaagcuaagaaaau

SEQ ID NO: 2704223 - RNA, 16 nt, Haemophilus influenzae Rd
agaugaagugaacuuc

SEQ ID NO: 2704224 - RNA, 15 nt, Haemophilus influenzae Rd
agaugacgaaaugaa

SEQ ID NO: 2704225 - RNA, 22 nt, Haemophilus influenzae Rd
agaugacugcaauuaucaagcu

SEQ ID NO: 2704226 - RNA, 16 nt, Haemophilus influenzae Rd
agaugacuggcaaaaa

SEQ ID NO: 2704227 - RNA, 17 nt, Haemophilus influenzae Rd
agaugacuggcaaaaau

SEQ ID NO: 2704228 - RNA, 19 nt, Haemophilus influenzae Rd
agaugacuuguuucauaaa

SEQ ID NO: 2704229 - RNA, 13 nt, Haemophilus influenzae Rd
agaugaugaaauu

SEQ ID NO: 2704230 - RNA, 15 nt, Haemophilus influenzae Rd
agaugaugaaauuuu

SEQ ID NO: 2704231 - RNA, 17 nt, Haemophilus influenzae Rd
agaugaugaaauuuuuc

SEQ ID NO: 2704232 - RNA, 14 nt, Haemophilus influenzae Rd
agaugauuuuaaaa

SEQ ID NO: 2704233 - RNA, 19 nt, Haemophilus influenzae Rd
agaugauuuuaaaauaaau

SEQ ID NO: 2704234 - RNA, 22 nt, Haemophilus influenzae Rd
agaugcacgagcaggaaaacca

SEQ ID NO: 2704235 - RNA, 18 nt, Haemophilus influenzae Rd
agaugcauuuuuuaaucu

SEQ ID NO: 2704236 - RNA, 15 nt, Haemophilus influenzae Rd
agaugccaauuuuuc

SEQ ID NO: 2704237 - RNA, 16 nt, Haemophilus influenzae Rd
agaugccauuucgcuu

SEQ ID NO: 2704238 - RNA, 22 nt, Haemophilus influenzae Rd
agaugccauuucgcuugaguga

SEQ ID NO: 2704239 - RNA, 16 nt, Haemophilus influenzae Rd
agaugucaaaugugac

SEQ ID NO: 2704240 - RNA, 17 nt, Haemophilus influenzae Rd
agaugugauauuaaaca

SEQ ID NO: 2704241 - RNA, 17 nt, Haemophilus influenzae Rd
agauguuccuacagaac

SEQ ID NO: 2704242 - RNA, 15 nt, Haemophilus influenzae Rd
agauuaaaacagauc

SEQ ID NO: 2704243 - RNA, 20 nt, Haemophilus influenzae Rd
agauuaaauauuuucauuua

SEQ ID NO: 2704244 - RNA, 18 nt, Haemophilus influenzae Rd
agauuaaucuuuuuucuu

SEQ ID NO: 2704245 - RNA, 23 nt, Haemophilus influenzae Rd
agauuacacauuaacagaauuug

SEQ ID NO: 2704246 - RNA, 20 nt, Haemophilus influenzae Rd
agauuacccacuaaguauua

SEQ ID NO: 2704247 - RNA, 15 nt, Haemophilus influenzae Rd
agauuacgcuuuacu

SEQ ID NO: 2704248 - RNA, 22 nt, Haemophilus influenzae Rd
agauuacguagaaaacaauaaa

SEQ ID NO: 2704249 - RNA, 13 nt, Haemophilus influenzae Rd
agauuacuuucau

SEQ ID NO: 2704250 - RNA, 21 nt, Haemophilus influenzae Rd
agauuacuuuuagauaaauuu

SEQ ID NO: 2704251 - RNA, 20 nt, Haemophilus influenzae Rd
agauuagugugauuuuagaa

SEQ ID NO: 2704252 - RNA, 14 nt, Haemophilus influenzae Rd
agauuaucauuaaa

SEQ ID NO: 2704253 - RNA, 20 nt, Haemophilus influenzae Rd
agauuaucugaggauuaaag

SEQ ID NO: 2704254 - RNA, 19 nt, Haemophilus influenzae Rd
agauuauggcugacuagau

SEQ ID NO: 2704255 - RNA, 16 nt, Haemophilus influenzae Rd
agauuauguucauuuu

SEQ ID NO: 2704256 - RNA, 19 nt, Haemophilus influenzae Rd
agauuauguucauuuucuu

SEQ ID NO: 2704257 - RNA, 15 nt, Haemophilus influenzae Rd
agauuauuucuacuu

SEQ ID NO: 2704258 - RNA, 16 nt, Haemophilus influenzae Rd
agauuauuucuacuug

SEQ ID NO: 2704259 - RNA, 14 nt, Haemophilus influenzae Rd
agauucaacaauaa

SEQ ID NO: 2704260 - RNA, 23 nt, Haemophilus influenzae Rd
agauucaucuucagcauuuaaaa

SEQ ID NO: 2704261 - RNA, 23 nt, Haemophilus influenzae Rd
agauucgcuuuuuuuuuugcuca

SEQ ID NO: 2704262 - RNA, 16 nt, Haemophilus influenzae Rd
agauucggcuaaaaca

SEQ ID NO: 2704263 - RNA, 18 nt, Haemophilus influenzae Rd
agauugcugacaaauuug

SEQ ID NO: 2704264 - RNA, 19 nt, Haemophilus influenzae Rd
agauugcugacaaauuugu

SEQ ID NO: 2704265 - RNA, 20 nt, Haemophilus influenzae Rd
agauugcugacaaauuuguu

SEQ ID NO: 2704266 - RNA, 12 nt, Haemophilus influenzae Rd
agauuggaugga

SEQ ID NO: 2704267 - RNA, 14 nt, Haemophilus influenzae Rd
agauuguaugaaaa

SEQ ID NO: 2704268 - RNA, 12 nt, Haemophilus influenzae Rd
agauuuaaaaca

SEQ ID NO: 2704269 - RNA, 18 nt, Haemophilus influenzae Rd
agauuuaauucugcccuu

SEQ ID NO: 2704270 - RNA, 15 nt, Haemophilus influenzae Rd
agauuuacagaacaa

SEQ ID NO: 2704271 - RNA, 15 nt, Haemophilus influenzae Rd
agauuuacccaacaa

SEQ ID NO: 2704272 - RNA, 16 nt, Haemophilus influenzae Rd
agauuuauuucugaag

SEQ ID NO: 2704273 - RNA, 22 nt, Haemophilus influenzae Rd
agauuuauuuugguauuuuugu

SEQ ID NO: 2704274 - RNA, 20 nt, Haemophilus influenzae Rd
agauuuccaucuaaaaguug

SEQ ID NO: 2704275 - RNA, 20 nt, Haemophilus influenzae Rd
agauuuccuccccacacuuu

SEQ ID NO: 2704276 - RNA, 14 nt, Haemophilus influenzae Rd
agauuucuucgccu

SEQ ID NO: 2704277 - RNA, 22 nt, Haemophilus influenzae Rd
agauuugaaccuucacagauuu

SEQ ID NO: 2704278 - RNA, 15 nt, Haemophilus influenzae Rd
agauuuuauuucgcu

SEQ ID NO: 2704279 - RNA, 19 nt, Haemophilus influenzae Rd
agauuuucucgugugaaau

SEQ ID NO: 2704280 - RNA, 13 nt, Haemophilus influenzae Rd
agauuuucuuauu

SEQ ID NO: 2704281 - RNA, 16 nt, Haemophilus influenzae Rd
agauuuucuuauuaua

SEQ ID NO: 2704282 - RNA, 18 nt, Haemophilus influenzae Rd
agauuuucuuauuauaca

SEQ ID NO: 2704283 - RNA, 17 nt, Haemophilus influenzae Rd
agauuuugcagauagau

SEQ ID NO: 2704284 - RNA, 13 nt, Haemophilus influenzae Rd
agauuuuuaaauc

SEQ ID NO: 2704285 - RNA, 23 nt, Haemophilus influenzae Rd
agauuuuucuugcuauucuuuag

SEQ ID NO: 2704286 - RNA, 15 nt, Haemophilus influenzae Rd
agauuuuugauaaaa

SEQ ID NO: 2704287 - RNA, 17 nt, Haemophilus influenzae Rd
agauuuuuuaggacuaa

SEQ ID NO: 2704288 - RNA, 22 nt, Haemophilus influenzae Rd
agauuuuuuauuaauaaacugc

SEQ ID NO: 2704289 - RNA, 20 nt, Haemophilus influenzae Rd
agauuuuuuauuuauuaaga

SEQ ID NO: 2704290 - RNA, 23 nt, Haemophilus influenzae Rd
agauuuuuuuuauaucuucucuu

SEQ ID NO: 2704291 - RNA, 23 nt, Haemophilus influenzae Rd
agcaaaaaaccuuggaauauccc

SEQ ID NO: 2704292 - RNA, 23 nt, Haemophilus influenzae Rd
agcaaaaaagugcgguaaaaauu

SEQ ID NO: 2704293 - RNA, 15 nt, Haemophilus influenzae Rd
agcaaaaccauccaa

SEQ ID NO: 2704294 - RNA, 14 nt, Haemophilus influenzae Rd
agcaaaacugaaag

SEQ ID NO: 2704295 - RNA, 13 nt, Haemophilus influenzae Rd
agcaaaagaaaua

SEQ ID NO: 2704296 - RNA, 20 nt, Haemophilus influenzae Rd
agcaaaagcaagaucuaaaa

SEQ ID NO: 2704297 - RNA, 12 nt, Haemophilus influenzae Rd
agcaaaagcaau

SEQ ID NO: 2704298 - RNA, 14 nt, Haemophilus influenzae Rd
agcaaaaucauauu

SEQ ID NO: 2704299 - RNA, 20 nt, Haemophilus influenzae Rd
agcaaacagcaauaaauaau

SEQ ID NO: 2704300 - RNA, 21 nt, Haemophilus influenzae Rd
agcaaacagcaauaaauaaua

SEQ ID NO: 2704301 - RNA, 17 nt, Haemophilus influenzae Rd
agcaaacuuaaauacau

SEQ ID NO: 2704302 - RNA, 21 nt, Haemophilus influenzae Rd
agcaaauagcgaguauaagca

SEQ ID NO: 2704303 - RNA, 22 nt, Haemophilus influenzae Rd
agcaaauagcgaguauaagcaa

SEQ ID NO: 2704304 - RNA, 11 nt, Haemophilus influenzae Rd
agcaaaucaaa

SEQ ID NO: 2704305 - RNA, 13 nt, Haemophilus influenzae Rd
agccaaauacaau

SEQ ID NO: 2704306 - RNA, 18 nt, Haemophilus influenzae Rd
agccaaauacaaucgcau

SEQ ID NO: 2704307 - RNA, 12 nt, Haemophilus influenzae Rd
agccaaaucauc

SEQ ID NO: 2704308 - RNA, 14 nt, Haemophilus influenzae Rd
agccaaauuuaaaa

SEQ ID NO: 2704309 - RNA, 19 nt, Haemophilus influenzae Rd
agccaaauuuaaaaaagcc

SEQ ID NO: 2704310 - RNA, 23 nt, Haemophilus influenzae Rd
agccaaauuuuucuuuucuucua

SEQ ID NO: 2704311 - RNA, 20 nt, Haemophilus influenzae Rd
agccaacucgaacaugaagu

SEQ ID NO: 2704312 - RNA, 13 nt, Haemophilus influenzae Rd
agccaagugcagc

SEQ ID NO: 2704313 - RNA, 15 nt, Haemophilus influenzae Rd
agccaaguuguaaaa

SEQ ID NO: 2704314 - RNA, 23 nt, Haemophilus influenzae Rd
agccaauaauuucuuguuuaaau

SEQ ID NO: 2704315 - RNA, 12 nt, Haemophilus influenzae Rd
agccaauaugga

SEQ ID NO: 2704316 - RNA, 14 nt, Haemophilus influenzae Rd
agccaaugaacgaa

SEQ ID NO: 2704317 - RNA, 14 nt, Haemophilus influenzae Rd
agccaaugcggcua

SEQ ID NO: 2704318 - RNA, 13 nt, Haemophilus influenzae Rd
agccaauuuucuc

SEQ ID NO: 2704319 - RNA, 15 nt, Haemophilus influenzae Rd
agccaauuuuucaaa

SEQ ID NO: 2704320 - RNA, 17 nt, Haemophilus influenzae Rd
agccacauaauaagaaa

SEQ ID NO: 2704321 - RNA, 14 nt, Haemophilus influenzae Rd
agccaccaaauggu

SEQ ID NO: 2704322 - RNA, 16 nt, Haemophilus influenzae Rd
agccaccgauagucac

SEQ ID NO: 2704323 - RNA, 22 nt, Haemophilus influenzae Rd
agccaccgauagucaccaucac

SEQ ID NO: 2704324 - RNA, 21 nt, Haemophilus influenzae Rd
agccacuugcuguuaagacca

SEQ ID NO: 2704325 - RNA, 15 nt, Haemophilus influenzae Rd
agccacuugugcauc

SEQ ID NO: 2704326 - RNA, 21 nt, Haemophilus influenzae Rd
agccagcagcuaauaggcuua

SEQ ID NO: 2704327 - RNA, 21 nt, Haemophilus influenzae Rd
agccaguuggguuaaauauaa

SEQ ID NO: 2704328 - RNA, 17 nt, Haemophilus influenzae Rd
agccauaaauaaaucaa

SEQ ID NO: 2704329 - RNA, 18 nt, Haemophilus influenzae Rd
agccauaaauaaaucaau

SEQ ID NO: 2704330 - RNA, 14 nt, Haemophilus influenzae Rd
agccauaaaugcua

SEQ ID NO: 2704331 - RNA, 14 nt, Haemophilus influenzae Rd
agccauaauauuua

SEQ ID NO: 2704332 - RNA, 18 nt, Haemophilus influenzae Rd
agccauauccguaucauu

SEQ ID NO: 2704333 - RNA, 17 nt, Haemophilus influenzae Rd
agccauccccaaaacag

SEQ ID NO: 2704334 - RNA, 22 nt, Haemophilus influenzae Rd
agccauccccaaaacaguaaug

SEQ ID NO: 2704335 - RNA, 22 nt, Haemophilus influenzae Rd
agccaucgcugaaauuaauaag

SEQ ID NO: 2704336 - RNA, 17 nt, Haemophilus influenzae Rd
agccauggcuuuuuccu

SEQ ID NO: 2704337 - RNA, 19 nt, Haemophilus influenzae Rd
agccauguugauguaaaaa

SEQ ID NO: 2704338 - RNA, 13 nt, Haemophilus influenzae Rd
agccauuucuaaa

SEQ ID NO: 2704339 - RNA, 17 nt, Haemophilus influenzae Rd
agccauuuucgcaucaa

SEQ ID NO: 2704340 - RNA, 18 nt, Haemophilus influenzae Rd
agccauuuucugcaucca

SEQ ID NO: 2704341 - RNA, 17 nt, Haemophilus influenzae Rd
agccauuuuuaaacgaa

SEQ ID NO: 2704342 - RNA, 16 nt, Haemophilus influenzae Rd
agcccaaguaauacac

SEQ ID NO: 2704343 - RNA, 14 nt, Haemophilus influenzae Rd
agcccaccaauuaa

SEQ ID NO: 2704344 - RNA, 19 nt, Haemophilus influenzae Rd
agcccauuccauauuggaa

SEQ ID NO: 2704345 - RNA, 19 nt, Haemophilus influenzae Rd
agccccucagauaaugaua

SEQ ID NO: 2704346 - RNA, 14 nt, Haemophilus influenzae Rd
agcccgaauucuga

SEQ ID NO: 2704347 - RNA, 20 nt, Haemophilus influenzae Rd
agcccgaauucugagcaaau

SEQ ID NO: 2704348 - RNA, 23 nt, Haemophilus influenzae Rd
agcccguuguguuucaacaaaaa

SEQ ID NO: 2704349 - RNA, 18 nt, Haemophilus influenzae Rd
agcccuuaauacugcuga

SEQ ID NO: 2704350 - RNA, 13 nt, Haemophilus influenzae Rd
agccgaagaagau

SEQ ID NO: 2704351 - RNA, 14 nt, Haemophilus influenzae Rd
agccgaagaagaua

SEQ ID NO: 2704352 - RNA, 17 nt, Haemophilus influenzae Rd
agccgcaguaaugcaga

SEQ ID NO: 2704353 - RNA, 14 nt, Haemophilus influenzae Rd
agccgccuuuuuca

SEQ ID NO: 2704354 - RNA, 13 nt, Haemophilus influenzae Rd
agccgcucuuuuu

SEQ ID NO: 2704355 - RNA, 20 nt, Haemophilus influenzae Rd
agccguaaguuaaaccaaca

SEQ ID NO: 2704356 - RNA, 19 nt, Haemophilus influenzae Rd
agccuaaaccaaauauggu

SEQ ID NO: 2704357 - RNA, 22 nt, Haemophilus influenzae Rd
agccuaagauuuuaucuaacuc

SEQ ID NO: 2704358 - RNA, 13 nt, Haemophilus influenzae Rd
agccuaagccaaa

SEQ ID NO: 2704359 - RNA, 23 nt, Haemophilus influenzae Rd
agccuacaacuaaucccacuugu

SEQ ID NO: 2704360 - RNA, 18 nt, Haemophilus influenzae Rd
agccuagugcuaaaauaa

SEQ ID NO: 2704361 - RNA, 14 nt, Haemophilus influenzae Rd
agccuauaauuaaa

SEQ ID NO: 2704362 - RNA, 15 nt, Haemophilus influenzae Rd
agccuauaauuaaag

SEQ ID NO: 2704363 - RNA, 19 nt, Haemophilus influenzae Rd
agccuauuuuuagaaaauc

SEQ ID NO: 2704364 - RNA, 20 nt, Haemophilus influenzae Rd
agccugaauggcgaauuuca

SEQ ID NO: 2704365 - RNA, 17 nt, Haemophilus influenzae Rd
agccugcaaagccuuca

SEQ ID NO: 2704366 - RNA, 20 nt, Haemophilus influenzae Rd
agccugcaaagccuucaccu

SEQ ID NO: 2704367 - RNA, 16 nt, Haemophilus influenzae Rd
agccugcuacauuugc

SEQ ID NO: 2704368 - RNA, 17 nt, Haemophilus influenzae Rd
agccugggcuugcauuc

SEQ ID NO: 2704369 - RNA, 21 nt, Haemophilus influenzae Rd
agccuguuaugcuuuauucuu

SEQ ID NO: 2704370 - RNA, 14 nt, Haemophilus influenzae Rd
agccuguugauguu

SEQ ID NO: 2704371 - RNA, 18 nt, Haemophilus influenzae Rd
agccuguugauguuuuaa

SEQ ID NO: 2704372 - RNA, 14 nt, Haemophilus influenzae Rd
agccuuauuuuguc

SEQ ID NO: 2704373 - RNA, 17 nt, Haemophilus influenzae Rd
agccuucaaaauuuggc

SEQ ID NO: 2704374 - RNA, 16 nt, Haemophilus influenzae Rd
agccuucaucacaaau

SEQ ID NO: 2704375 - RNA, 19 nt, Haemophilus influenzae Rd
agccuucuaaaauaagaau

SEQ ID NO: 2704376 - RNA, 12 nt, Haemophilus influenzae Rd
agccuucugcca

SEQ ID NO: 2704377 - RNA, 20 nt, Haemophilus influenzae Rd
agccuugauucuacugaaau

SEQ ID NO: 2704378 - RNA, 15 nt, Haemophilus influenzae Rd
agccuugauuucagu

SEQ ID NO: 2704379 - RNA, 16 nt, Haemophilus influenzae Rd
agccuugauuucagua

SEQ ID NO: 2704380 - RNA, 20 nt, Haemophilus influenzae Rd
agccuuguucugcagcaaga

SEQ ID NO: 2704381 - RNA, 21 nt, Haemophilus influenzae Rd
agccuuuaaggugcagauuaa

SEQ ID NO: 2704382 - RNA, 20 nt, Haemophilus influenzae Rd
agccuuuaugacuauuuuuu

SEQ ID NO: 2704383 - RNA, 22 nt, Haemophilus influenzae Rd
agccuuuuaaaaugaacaaaaa

SEQ ID NO: 2704384 - RNA, 12 nt, Haemophilus influenzae Rd
agccuuuucuac

SEQ ID NO: 2704385 - RNA, 17 nt, Haemophilus influenzae Rd
agccuuuuucuaauggu

SEQ ID NO: 2704386 - RNA, 13 nt, Haemophilus influenzae Rd
agcgaaaauuuug

SEQ ID NO: 2704387 - RNA, 21 nt, Haemophilus influenzae Rd
agcgaaaucgcacucacaaua

SEQ ID NO: 2704388 - RNA, 13 nt, Haemophilus influenzae Rd
agcgaaguuaaac

SEQ ID NO: 2704389 - RNA, 15 nt, Haemophilus influenzae Rd
agcgaauuacaucau

SEQ ID NO: 2704390 - RNA, 18 nt, Haemophilus influenzae Rd
agcgaauuuaagaaaaaa

SEQ ID NO: 2704391 - RNA, 19 nt, Haemophilus influenzae Rd
agcgaauuuaagaaaaaau

SEQ ID NO: 2704392 - RNA, 23 nt, Haemophilus influenzae Rd
agcgaccugaacggucauccaau

SEQ ID NO: 2704393 - RNA, 13 nt, Haemophilus influenzae Rd
agcgauaaauauu

SEQ ID NO: 2704394 - RNA, 18 nt, Haemophilus influenzae Rd
agcgauagaaauaaagau

SEQ ID NO: 2704395 - RNA, 20 nt, Haemophilus influenzae Rd
agcgauccguaaucgugccu

SEQ ID NO: 2704396 - RNA, 18 nt, Haemophilus influenzae Rd
agcgauccuaaaaaaccc

SEQ ID NO: 2704397 - RNA, 22 nt, Haemophilus influenzae Rd
agcgaucugcacgauagcaaug

SEQ ID NO: 2704398 - RNA, 16 nt, Haemophilus influenzae Rd
agcgcauauuaucucg

SEQ ID NO: 2704399 - RNA, 22 nt, Haemophilus influenzae Rd
agcgcauuauggaauggcauaa

SEQ ID NO: 2704400 - RNA, 16 nt, Haemophilus influenzae Rd
agcgcuguuacuucuu

SEQ ID NO: 2704401 - RNA, 19 nt, Haemophilus influenzae Rd
agcgcuguuacuucuuuca

SEQ ID NO: 2704402 - RNA, 13 nt, Haemophilus influenzae Rd
agcggaauuuuug

SEQ ID NO: 2704403 - RNA, 20 nt, Haemophilus influenzae Rd
agcggcauuugcaucauuua

SEQ ID NO: 2704404 - RNA, 17 nt, Haemophilus influenzae Rd
agcggcugacauuacau

SEQ ID NO: 2704405 - RNA, 15 nt, Haemophilus influenzae Rd
agcggugaauucuuu

SEQ ID NO: 2704406 - RNA, 13 nt, Haemophilus influenzae Rd
agcguaaaaaugc

SEQ ID NO: 2704407 - RNA, 15 nt, Haemophilus influenzae Rd
agcguaaaaaugcug

SEQ ID NO: 2704408 - RNA, 15 nt, Haemophilus influenzae Rd
agcguaaugcacuuu

SEQ ID NO: 2704409 - RNA, 21 nt, Haemophilus influenzae Rd
agcguaccgccaguaucaauc

SEQ ID NO: 2704410 - RNA, 19 nt, Haemophilus influenzae Rd
agcgugaauauaagaaauc

SEQ ID NO: 2704411 - RNA, 23 nt, Haemophilus influenzae Rd
agcgugaauauaagaaaucucuu

SEQ ID NO: 2704412 - RNA, 19 nt, Haemophilus influenzae Rd
agcguuauuguaguaagug

SEQ ID NO: 2704413 - RNA, 19 nt, Haemophilus influenzae Rd
agcguucauuuugaucuuc

SEQ ID NO: 2704414 - RNA, 23 nt, Haemophilus influenzae Rd
agcguucauuuugaucuuccgcg

SEQ ID NO: 2704415 - RNA, 16 nt, Haemophilus influenzae Rd
agcguuuacgugcgau

SEQ ID NO: 2704416 - RNA, 14 nt, Haemophilus influenzae Rd
agcguuugcugccu

SEQ ID NO: 2704417 - RNA, 15 nt, Haemophilus influenzae Rd
agcuaaaaauaauua

SEQ ID NO: 2704418 - RNA, 15 nt, Haemophilus influenzae Rd
agcuaaacauccgaa

SEQ ID NO: 2704419 - RNA, 15 nt, Haemophilus influenzae Rd
agcuaaauacuugcu

SEQ ID NO: 2704420 - RNA, 10 nt, Haemophilus influenzae Rd
agcuaaaucc

SEQ ID NO: 2704421 - RNA, 16 nt, Haemophilus influenzae Rd
agcuaagcauuucagu

SEQ ID NO: 2704422 - RNA, 15 nt, Haemophilus influenzae Rd
agcuaaguacaaaag

SEQ ID NO: 2704423 - RNA, 21 nt, Haemophilus influenzae Rd
agcuaauccaaaucaagcuaa

SEQ ID NO: 2704424 - RNA, 15 nt, Haemophilus influenzae Rd
agcuaaucgguacuu

SEQ ID NO: 2704425 - RNA, 20 nt, Haemophilus influenzae Rd
agcuaaugcuuuaauuuguu

SEQ ID NO: 2704426 - RNA, 17 nt, Haemophilus influenzae Rd
agcuaaugguuggaaga

SEQ ID NO: 2704427 - RNA, 15 nt, Haemophilus influenzae Rd
agcuaauugguaaaa

SEQ ID NO: 2704428 - RNA, 16 nt, Haemophilus influenzae Rd
agcuaauugguaaaau

SEQ ID NO: 2704429 - RNA, 21 nt, Haemophilus influenzae Rd
agcuaccaauauucuuuaaaa

SEQ ID NO: 2704430 - RNA, 22 nt, Haemophilus influenzae Rd
agcuaccaauauucuuuaaaac

SEQ ID NO: 2704431 - RNA, 20 nt, Haemophilus influenzae Rd
agcuaccaauucaaaaacca

SEQ ID NO: 2704432 - RNA, 22 nt, Haemophilus influenzae Rd
agcuacuggugaaauuaauuua

SEQ ID NO: 2704433 - RNA, 19 nt, Haemophilus influenzae Rd
agcuagguacguuuuguuu

SEQ ID NO: 2704434 - RNA, 19 nt, Haemophilus influenzae Rd
agcuaguuuaguuuaaucu

SEQ ID NO: 2704435 - RNA, 16 nt, Haemophilus influenzae Rd
agcuauaaguaacuuu

SEQ ID NO: 2704436 - RNA, 22 nt, Haemophilus influenzae Rd
agcuaucgucaaauuuaaauag

SEQ ID NO: 2704437 - RNA, 16 nt, Haemophilus influenzae Rd
agcuauuaaaaaaagc

SEQ ID NO: 2704438 - RNA, 20 nt, Haemophilus influenzae Rd
agcuauuacucuuaauuuuu

SEQ ID NO: 2704439 - RNA, 20 nt, Haemophilus influenzae Rd
agcuauucccgcauuuauca

SEQ ID NO: 2704440 - RNA, 23 nt, Haemophilus influenzae Rd
agcuauuucggcaguacucgaaa

SEQ ID NO: 2704441 - RNA, 19 nt, Haemophilus influenzae Rd
agcuauuuuucaauaagca

SEQ ID NO: 2704442 - RNA, 14 nt, Haemophilus influenzae Rd
agcucaaaaugcuc

SEQ ID NO: 2704443 - RNA, 13 nt, Haemophilus influenzae Rd
agcucaauuauuu

SEQ ID NO: 2704444 - RNA, 17 nt, Haemophilus influenzae Rd
agcucagucgguagagc

SEQ ID NO: 2704445 - RNA, 23 nt, Haemophilus influenzae Rd
agcucccagugcugaaauauagc

SEQ ID NO: 2704446 - RNA, 17 nt, Haemophilus influenzae Rd
agcuccuacauuaaaag

SEQ ID NO: 2704447 - RNA, 18 nt, Haemophilus influenzae Rd
agcuccuacauuaaaaga

SEQ ID NO: 2704448 - RNA, 16 nt, Haemophilus influenzae Rd
agcucgcuauuuugag

SEQ ID NO: 2704449 - RNA, 15 nt, Haemophilus influenzae Rd
agcucggaauguuuu

SEQ ID NO: 2704450 - RNA, 15 nt, Haemophilus influenzae Rd
agcucgguaaaaauc

SEQ ID NO: 2704451 - RNA, 18 nt, Haemophilus influenzae Rd
agcucgguaaaaaucauu

SEQ ID NO: 2704452 - RNA, 18 nt, Haemophilus influenzae Rd
agcucguaaagaucauuc

SEQ ID NO: 2704453 - RNA, 15 nt, Haemophilus influenzae Rd
agcucguauaauauu

SEQ ID NO: 2704454 - RNA, 21 nt, Haemophilus influenzae Rd
agcucguugccauaaaaaauu

SEQ ID NO: 2704455 - RNA, 20 nt, Haemophilus influenzae Rd
agcucuagaaaaucguauuc

SEQ ID NO: 2704456 - RNA, 15 nt, Haemophilus influenzae Rd
agcugaaaaauaaaa

SEQ ID NO: 2704457 - RNA, 15 nt, Haemophilus influenzae Rd
agcugaaauuuagug

SEQ ID NO: 2704458 - RNA, 23 nt, Haemophilus influenzae Rd
agcugauaaguucauaaaagggg

SEQ ID NO: 2704459 - RNA, 13 nt, Haemophilus influenzae Rd
agcugauauaaaa

SEQ ID NO: 2704460 - RNA, 17 nt, Haemophilus influenzae Rd
agcugauucuucauaaa

SEQ ID NO: 2704461 - RNA, 19 nt, Haemophilus influenzae Rd
agcugauucuucauaaaua

SEQ ID NO: 2704462 - RNA, 22 nt, Haemophilus influenzae Rd
agcugcacaagcaccacuucca

SEQ ID NO: 2704463 - RNA, 22 nt, Haemophilus influenzae Rd
agcugcacuauauacauuaaca

SEQ ID NO: 2704464 - RNA, 17 nt, Haemophilus influenzae Rd
agcugcauaaagcucag

SEQ ID NO: 2704465 - RNA, 21 nt, Haemophilus influenzae Rd
agcugcauuucaauuucacug

SEQ ID NO: 2704466 - RNA, 15 nt, Haemophilus influenzae Rd
agcugccgaauagau

SEQ ID NO: 2704467 - RNA, 16 nt, Haemophilus influenzae Rd
agcugccgaauagauu

SEQ ID NO: 2704468 - RNA, 14 nt, Haemophilus influenzae Rd
agcugcgaauugca

SEQ ID NO: 2704469 - RNA, 19 nt, Haemophilus influenzae Rd
agcugcugcuuuaacaauu

SEQ ID NO: 2704470 - RNA, 20 nt, Haemophilus influenzae Rd
agcugcugcuuuaacaauua

SEQ ID NO: 2704471 - RNA, 21 nt, Haemophilus influenzae Rd
agcugcuuguaaccaauaaag

SEQ ID NO: 2704472 - RNA, 22 nt, Haemophilus influenzae Rd
agcuggaguucguuauaagccu

SEQ ID NO: 2704473 - RNA, 19 nt, Haemophilus influenzae Rd
agcuggcgguuugaaauuu

SEQ ID NO: 2704474 - RNA, 20 nt, Haemophilus influenzae Rd
agcuggcgguuugaaauuua

SEQ ID NO: 2704475 - RNA, 17 nt, Haemophilus influenzae Rd
agcuggcucuucuuguu

SEQ ID NO: 2704476 - RNA, 22 nt, Haemophilus influenzae Rd
agcuggcuuucuuuuucaaguu

SEQ ID NO: 2704477 - RNA, 23 nt, Haemophilus influenzae Rd
agcuggcuuucuuuuucaaguuc

SEQ ID NO: 2704478 - RNA, 22 nt, Haemophilus influenzae Rd
agcugggcuguucggacuuaca

SEQ ID NO: 2704479 - RNA, 15 nt, Haemophilus influenzae Rd
agcugucuaauuuuu

SEQ ID NO: 2704480 - RNA, 18 nt, Haemophilus influenzae Rd
agcugucucauuuugcuc

SEQ ID NO: 2704481 - RNA, 19 nt, Haemophilus influenzae Rd
agcugugcaaaacuaguca

SEQ ID NO: 2704482 - RNA, 14 nt, Haemophilus influenzae Rd
agcugugguaaaua

SEQ ID NO: 2704483 - RNA, 16 nt, Haemophilus influenzae Rd
agcuguguaagcuggc

SEQ ID NO: 2704484 - RNA, 13 nt, Haemophilus influenzae Rd
agcuguuguugug

SEQ ID NO: 2704485 - RNA, 23 nt, Haemophilus influenzae Rd
agcuguuguuguggaucguaaau

SEQ ID NO: 2704486 - RNA, 14 nt, Haemophilus influenzae Rd
agcuuaacaacaaa

SEQ ID NO: 2704487 - RNA, 16 nt, Haemophilus influenzae Rd
agcuuaagccuuuauc

SEQ ID NO: 2704488 - RNA, 16 nt, Haemophilus influenzae Rd
agcuuauccuauaaaa

SEQ ID NO: 2704489 - RNA, 19 nt, Haemophilus influenzae Rd
agcuuauuuuuauuaucaa

SEQ ID NO: 2704490 - RNA, 15 nt, Haemophilus influenzae Rd
agcuucaaaaucacc

SEQ ID NO: 2704491 - RNA, 24 nt, Haemophilus influenzae Rd
agcuucagcuugaguugucacaac

SEQ ID NO: 2704492 - RNA, 17 nt, Haemophilus influenzae Rd
agcuucaucuucaucaa

SEQ ID NO: 2704493 - RNA, 22 nt, Haemophilus influenzae Rd
agcuuccgcuuuuuucgcacca

SEQ ID NO: 2704494 - RNA, 15 nt, Haemophilus influenzae Rd
agcuucuaauuuuug

SEQ ID NO: 2704495 - RNA, 17 nt, Haemophilus influenzae Rd
agcuucuaauuuuugca

SEQ ID NO: 2704496 - RNA, 19 nt, Haemophilus influenzae Rd
agcuucuccuacaucgccu

SEQ ID NO: 2704497 - RNA, 12 nt, Haemophilus influenzae Rd
agcuucugccag

SEQ ID NO: 2704498 - RNA, 16 nt, Haemophilus influenzae Rd
agcuucugccagcaug

SEQ ID NO: 2704499 - RNA, 22 nt, Haemophilus influenzae Rd
agcuucuucaucgcucaucgua

SEQ ID NO: 2704500 - RNA, 14 nt, Haemophilus influenzae Rd
agcuucuucuuccu

SEQ ID NO: 2704501 - RNA, 16 nt, Haemophilus influenzae Rd
agcuucuuuuaucgac

SEQ ID NO: 2704502 - RNA, 14 nt, Haemophilus influenzae Rd
agcuugaauugcuc

SEQ ID NO: 2704503 - RNA, 14 nt, Haemophilus influenzae Rd
agcuugauuuucag

SEQ ID NO: 2704504 - RNA, 17 nt, Haemophilus influenzae Rd
agcuugcguaauguuua

SEQ ID NO: 2704505 - RNA, 18 nt, Haemophilus influenzae Rd
agcuugcuccgcuaaaaa

SEQ ID NO: 2704506 - RNA, 21 nt, Haemophilus influenzae Rd
agcuugugcucgauuuuuaaa

SEQ ID NO: 2704507 - RNA, 18 nt, Haemophilus influenzae Rd
agcuuguuggaaaaaugc

SEQ ID NO: 2704508 - RNA, 20 nt, Haemophilus influenzae Rd
agcuuguuggaaaaaugcug

SEQ ID NO: 2704509 - RNA, 21 nt, Haemophilus influenzae Rd
agcuuguuggaaaaaugcugg

SEQ ID NO: 2704510 - RNA, 17 nt, Haemophilus influenzae Rd
agcuuguuuaaucacau

SEQ ID NO: 2704511 - RNA, 14 nt, Haemophilus influenzae Rd
agcuuuagcaauca

SEQ ID NO: 2704512 - RNA, 15 nt, Haemophilus influenzae Rd
agcuuuagcaaucaa

SEQ ID NO: 2704513 - RNA, 16 nt, Haemophilus influenzae Rd
agcuuuccaaacaagg

SEQ ID NO: 2704514 - RNA, 22 nt, Haemophilus influenzae Rd
agcuuuuugcacgguguuuucu

SEQ ID NO: 2704515 - RNA, 13 nt, Haemophilus influenzae Rd
agcuuuuuuuaau

SEQ ID NO: 2704516 - RNA, 12 nt, Haemophilus influenzae Rd
agggcacuuugc

SEQ ID NO: 2704517 - RNA, 22 nt, Haemophilus influenzae Rd
agggcagauuuaauucugcccu

SEQ ID NO: 2704518 - RNA, 13 nt, Haemophilus influenzae Rd
agggcgguuaaaa

SEQ ID NO: 2704519 - RNA, 21 nt, Haemophilus influenzae Rd
agggcugcgcccauuggaaua

SEQ ID NO: 2704520 - RNA, 19 nt, Haemophilus influenzae Rd
agggcugcuacaauuucau

SEQ ID NO: 2704521 - RNA, 19 nt, Haemophilus influenzae Rd
agggcuuguuuuuucguuu

SEQ ID NO: 2704522 - RNA, 20 nt, Haemophilus influenzae Rd
agggcuuuguuguuuauaac

SEQ ID NO: 2704523 - RNA, 22 nt, Haemophilus influenzae Rd
agggcuuuuucugcuggcucua

SEQ ID NO: 2704524 - RNA, 13 nt, Haemophilus influenzae Rd
aggggauaaaaua

SEQ ID NO: 2704525 - RNA, 18 nt, Haemophilus influenzae Rd
aggggauaaaauaaacau

SEQ ID NO: 2704526 - RNA, 13 nt, Haemophilus influenzae Rd
aggguauacuuua

SEQ ID NO: 2704527 - RNA, 17 nt, Haemophilus influenzae Rd
aggguauuuauuauucu

SEQ ID NO: 2704528 - RNA, 15 nt, Haemophilus influenzae Rd
aggguuccugcauca

SEQ ID NO: 2704529 - RNA, 16 nt, Haemophilus influenzae Rd
aggguuccugcaucag

SEQ ID NO: 2704530 - RNA, 13 nt, Haemophilus influenzae Rd
aggguuuucauca

SEQ ID NO: 2704531 - RNA, 15 nt, Haemophilus influenzae Rd
agguaaaacuuucua

SEQ ID NO: 2704532 - RNA, 21 nt, Haemophilus influenzae Rd
agguaauaauagguuguccac

SEQ ID NO: 2704533 - RNA, 12 nt, Haemophilus influenzae Rd
agguaauugcca

SEQ ID NO: 2704534 - RNA, 16 nt, Haemophilus influenzae Rd
agguacacggccguaa

SEQ ID NO: 2704535 - RNA, 23 nt, Haemophilus influenzae Rd
agguacuuggauugcaugaaaug

SEQ ID NO: 2704536 - RNA, 14 nt, Haemophilus influenzae Rd
agguagauugauac

SEQ ID NO: 2704537 - RNA, 17 nt, Haemophilus influenzae Rd
agguauaaauaauuuuc

SEQ ID NO: 2704538 - RNA, 16 nt, Haemophilus influenzae Rd
aggucgagggucaaaa

SEQ ID NO: 2704539 - RNA, 19 nt, Haemophilus influenzae Rd
aggucgagggucaaaagaa

SEQ ID NO: 2704540 - RNA, 15 nt, Haemophilus influenzae Rd
aggugcagauuaaau

SEQ ID NO: 2704541 - RNA, 16 nt, Haemophilus influenzae Rd
aggugcagauuaaaua

SEQ ID NO: 2704542 - RNA, 23 nt, Haemophilus influenzae Rd
aggugcauuaggguuacguacaa

SEQ ID NO: 2704543 - RNA, 19 nt, Haemophilus influenzae Rd
aggugcuuuuaaauuuuua

SEQ ID NO: 2704544 - RNA, 12 nt, Haemophilus influenzae Rd
aggugcuuuuug

SEQ ID NO: 2704545 - RNA, 20 nt, Haemophilus influenzae Rd
agguggaacaaagguuaaac

SEQ ID NO: 2704546 - RNA, 21 nt, Haemophilus influenzae Rd
agguggaacucuuucaccauu

SEQ ID NO: 2704547 - RNA, 15 nt, Haemophilus influenzae Rd
aggugggcuuuagcc

SEQ ID NO: 2704548 - RNA, 18 nt, Haemophilus influenzae Rd
aggugggcuuuagcccac

SEQ ID NO: 2704549 - RNA, 19 nt, Haemophilus influenzae Rd
aggugggcuuuagcccacc

SEQ ID NO: 2704550 - RNA, 20 nt, Haemophilus influenzae Rd
aggugggcuuuagcccacca

SEQ ID NO: 2704551 - RNA, 15 nt, Haemophilus influenzae Rd
aggugguuucaagag

SEQ ID NO: 2704552 - RNA, 13 nt, Haemophilus influenzae Rd
aggugucacagca

SEQ ID NO: 2704553 - RNA, 14 nt, Haemophilus influenzae Rd
aggugucacagcaa

SEQ ID NO: 2704554 - RNA, 18 nt, Haemophilus influenzae Rd
agguuaaaccuaaauccc

SEQ ID NO: 2704555 - RNA, 16 nt, Haemophilus influenzae Rd
agguuacucauucuaa

SEQ ID NO: 2704556 - RNA, 22 nt, Haemophilus influenzae Rd
agguuauaaguuuuuugccaaa

SEQ ID NO: 2704557 - RNA, 22 nt, Haemophilus influenzae Rd
agguuauauaacauaccuagau

SEQ ID NO: 2704558 - RNA, 20 nt, Haemophilus influenzae Rd
agguuccccuaaaaaauaag

SEQ ID NO: 2704559 - RNA, 20 nt, Haemophilus influenzae Rd
agguucgucaucuucauuaa

SEQ ID NO: 2704560 - RNA, 18 nt, Haemophilus influenzae Rd
agguugaagaacguaaau

SEQ ID NO: 2704561 - RNA, 13 nt, Haemophilus influenzae Rd
agguugaauuuuu

SEQ ID NO: 2704562 - RNA, 15 nt, Haemophilus influenzae Rd
agguugaauuuuugu

SEQ ID NO: 2704563 - RNA, 16 nt, Haemophilus influenzae Rd
agguugcugauaaaga

SEQ ID NO: 2704564 - RNA, 14 nt, Haemophilus influenzae Rd
agguuguaagccca

SEQ ID NO: 2704565 - RNA, 18 nt, Haemophilus influenzae Rd
agguuuaauaaucgaaaa

SEQ ID NO: 2704566 - RNA, 18 nt, Haemophilus influenzae Rd
agguuuauaacaaagaag

SEQ ID NO: 2704567 - RNA, 22 nt, Haemophilus influenzae Rd
agguuuaucuaccacaucaaau

SEQ ID NO: 2704568 - RNA, 20 nt, Haemophilus influenzae Rd
agguuuccuuauaauaugaa

SEQ ID NO: 2704569 - RNA, 18 nt, Haemophilus influenzae Rd
agguuucgauauuaauac

SEQ ID NO: 2704570 - RNA, 11 nt, Haemophilus influenzae Rd
agguuucucua

SEQ ID NO: 2704571 - RNA, 15 nt, Haemophilus influenzae Rd
agguuucucuagccg

SEQ ID NO: 2704572 - RNA, 21 nt, Haemophilus influenzae Rd
agguuuggacaccuuuuuccu

SEQ ID NO: 2704573 - RNA, 19 nt, Haemophilus influenzae Rd
agguuuuacauauaaagau

SEQ ID NO: 2704574 - RNA, 16 nt, Haemophilus influenzae Rd
agguuuuauuacaaaa

SEQ ID NO: 2704575 - RNA, 19 nt, Haemophilus influenzae Rd
agguuuuauuuugaacaau

SEQ ID NO: 2704576 - RNA, 10 nt, Haemophilus influenzae Rd
agguuuugug

SEQ ID NO: 2704577 - RNA, 22 nt, Haemophilus influenzae Rd
agguuuugugaagauugaaaua

SEQ ID NO: 2704578 - RNA, 19 nt, Haemophilus influenzae Rd
agguuuuuuauuucucauu

SEQ ID NO: 2704579 - RNA, 12 nt, Haemophilus influenzae Rd
aguaaaaaaauc

SEQ ID NO: 2704580 - RNA, 23 nt, Haemophilus influenzae Rd
aguaaaaaaucuagagauuguau

SEQ ID NO: 2704581 - RNA, 13 nt, Haemophilus influenzae Rd
aguaaaaauaaaa

SEQ ID NO: 2704582 - RNA, 15 nt, Haemophilus influenzae Rd
aguaaaaauaaaaac

SEQ ID NO: 2704583 - RNA, 16 nt, Haemophilus influenzae Rd
aguaaaaauaaaaugc

SEQ ID NO: 2704584 - RNA, 13 nt, Haemophilus influenzae Rd
aguaaaaauuguu

SEQ ID NO: 2704585 - RNA, 23 nt, Haemophilus influenzae Rd
aguaaaacuaauuugcacacuua

SEQ ID NO: 2704586 - RNA, 12 nt, Haemophilus influenzae Rd
aguaaaauaaaa

SEQ ID NO: 2704587 - RNA, 13 nt, Haemophilus influenzae Rd
aguaaaauaaaaa

SEQ ID NO: 2704588 - RNA, 15 nt, Haemophilus influenzae Rd
aguaaaauaaaaaau

SEQ ID NO: 2704589 - RNA, 14 nt, Haemophilus influenzae Rd
aguaaaauaaaaag

SEQ ID NO: 2704590 - RNA, 17 nt, Haemophilus influenzae Rd
aguaaaauacgaauaaa

SEQ ID NO: 2704591 - RNA, 11 nt, Haemophilus influenzae Rd
aguaaacaagu

SEQ ID NO: 2704592 - RNA, 19 nt, Haemophilus influenzae Rd
aguaaacaaguauaaaaaa

SEQ ID NO: 2704593 - RNA, 15 nt, Haemophilus influenzae Rd
aguaaacaauucuau

SEQ ID NO: 2704594 - RNA, 21 nt, Haemophilus influenzae Rd
aguaaacacuuaaauaguuaa

SEQ ID NO: 2704595 - RNA, 15 nt, Haemophilus influenzae Rd
aguaaaccaaaucca

SEQ ID NO: 2704596 - RNA, 18 nt, Haemophilus influenzae Rd
aguaaaccaagugaaauu

SEQ ID NO: 2704597 - RNA, 18 nt, Haemophilus influenzae Rd
aguaaaccacaauacuua

SEQ ID NO: 2704598 - RNA, 21 nt, Haemophilus influenzae Rd
aguaaacgcguaaaccuacac

SEQ ID NO: 2704599 - RNA, 22 nt, Haemophilus influenzae Rd
aguaaacguucugauaaucugc

SEQ ID NO: 2704600 - RNA, 15 nt, Haemophilus influenzae Rd
aguaaacuuuuaaag

SEQ ID NO: 2704601 - RNA, 17 nt, Haemophilus influenzae Rd
aguaaagaaauaagcaa

SEQ ID NO: 2704602 - RNA, 21 nt, Haemophilus influenzae Rd
aguaaagcgugugcuugcauu

SEQ ID NO: 2704603 - RNA, 12 nt, Haemophilus influenzae Rd
aguaaaggcacu

SEQ ID NO: 2704604 - RNA, 13 nt, Haemophilus influenzae Rd
aguaaauaagcca

SEQ ID NO: 2704605 - RNA, 12 nt, Haemophilus influenzae Rd
aguaaauaauuc

SEQ ID NO: 2704606 - RNA, 19 nt, Haemophilus influenzae Rd
aguaaauauuuuuuaguuu

SEQ ID NO: 2704607 - RNA, 15 nt, Haemophilus influenzae Rd
aguaaauucaccaau

SEQ ID NO: 2704608 - RNA, 13 nt, Haemophilus influenzae Rd
aguaaauuuagag

SEQ ID NO: 2704609 - RNA, 14 nt, Haemophilus influenzae Rd
aguaaauuuuaaaa

SEQ ID NO: 2704610 - RNA, 21 nt, Haemophilus influenzae Rd
aguaaauuuuuccacauuaaa

SEQ ID NO: 2704611 - RNA, 18 nt, Haemophilus influenzae Rd
aguaacaauguagaaaug

SEQ ID NO: 2704612 - RNA, 12 nt, Haemophilus influenzae Rd
aguaacuacaac

SEQ ID NO: 2704613 - RNA, 17 nt, Haemophilus influenzae Rd
aguaacuacaacuucau

SEQ ID NO: 2704614 - RNA, 18 nt, Haemophilus influenzae Rd
aguaacuucugcugcacg

SEQ ID NO: 2704615 - RNA, 13 nt, Haemophilus influenzae Rd
aguaacuuucaca

SEQ ID NO: 2704616 - RNA, 16 nt, Haemophilus influenzae Rd
aguaacuuucuucaau

SEQ ID NO: 2704617 - RNA, 14 nt, Haemophilus influenzae Rd
aguaagaaaccaac

SEQ ID NO: 2704618 - RNA, 16 nt, Haemophilus influenzae Rd
aguaagcaaguacaac

SEQ ID NO: 2704619 - RNA, 19 nt, Haemophilus influenzae Rd
aguaagcaaguacaacuga

SEQ ID NO: 2704620 - RNA, 13 nt, Haemophilus influenzae Rd
aguaagcugauuc

SEQ ID NO: 2704621 - RNA, 18 nt, Haemophilus influenzae Rd
aguaaggcacugauuuuu

SEQ ID NO: 2704622 - RNA, 21 nt, Haemophilus influenzae Rd
agucuuagacucguuuuuuau

SEQ ID NO: 2704623 - RNA, 18 nt, Haemophilus influenzae Rd
agucuucaucuuuaaaca

SEQ ID NO: 2704624 - RNA, 16 nt, Haemophilus influenzae Rd
agucuuguaacuauaa

SEQ ID NO: 2704625 - RNA, 18 nt, Haemophilus influenzae Rd
agucuuguaacuauaacu

SEQ ID NO: 2704626 - RNA, 16 nt, Haemophilus influenzae Rd
agucuuucaauguugc

SEQ ID NO: 2704627 - RNA, 18 nt, Haemophilus influenzae Rd
agucuuuuuaauuuaaau

SEQ ID NO: 2704628 - RNA, 19 nt, Haemophilus influenzae Rd
agucuuuuuaauuuaaaua

SEQ ID NO: 2704629 - RNA, 16 nt, Haemophilus influenzae Rd
agugaaaaaauaacca

SEQ ID NO: 2704630 - RNA, 17 nt, Haemophilus influenzae Rd
agugaaaaaauaaccac

SEQ ID NO: 2704631 - RNA, 18 nt, Haemophilus influenzae Rd
agugaaaaaauaaccacu

SEQ ID NO: 2704632 - RNA, 19 nt, Haemophilus influenzae Rd
agugaaaccugcuugaaug

SEQ ID NO: 2704633 - RNA, 20 nt, Haemophilus influenzae Rd
agugaaacuggcauuuucuu

SEQ ID NO: 2704634 - RNA, 17 nt, Haemophilus influenzae Rd
agugaaauuacucaucu

SEQ ID NO: 2704635 - RNA, 16 nt, Haemophilus influenzae Rd
agugaaccaauauagc

SEQ ID NO: 2704636 - RNA, 18 nt, Haemophilus influenzae Rd
agugaacuucauuuaguu

SEQ ID NO: 2704637 - RNA, 14 nt, Haemophilus influenzae Rd
agugaaguuauagu

SEQ ID NO: 2704638 - RNA, 21 nt, Haemophilus influenzae Rd
agugaauaauguuuucauuaa

SEQ ID NO: 2704639 - RNA, 20 nt, Haemophilus influenzae Rd
agugaaucauuauauugugc

SEQ ID NO: 2704640 - RNA, 23 nt, Haemophilus influenzae Rd
agugaauuuauauuaauuuugau

SEQ ID NO: 2704641 - RNA, 10 nt, Haemophilus influenzae Rd
agugacaauc

SEQ ID NO: 2704642 - RNA, 22 nt, Haemophilus influenzae Rd
agugacguuuauuuuuauaugu

SEQ ID NO: 2704643 - RNA, 16 nt, Haemophilus influenzae Rd
agugagauaaauaaau

SEQ ID NO: 2704644 - RNA, 13 nt, Haemophilus influenzae Rd
agugagcauuucg

SEQ ID NO: 2704645 - RNA, 16 nt, Haemophilus influenzae Rd
agugaguauaaauuug

SEQ ID NO: 2704646 - RNA, 16 nt, Haemophilus influenzae Rd
agugaguauguugcuu

SEQ ID NO: 2704647 - RNA, 17 nt, Haemophilus influenzae Rd
agugaguauguugcuuu

SEQ ID NO: 2704648 - RNA, 16 nt, Haemophilus influenzae Rd
agugaguugauuuaaa

SEQ ID NO: 2704649 - RNA, 17 nt, Haemophilus influenzae Rd
agugaguugauuuuaaa

SEQ ID NO: 2704650 - RNA, 21 nt, Haemophilus influenzae Rd
agugaguugauuuuaaaauau

SEQ ID NO: 2704651 - RNA, 17 nt, Haemophilus influenzae Rd
agugauuaaagugacaa

SEQ ID NO: 2704652 - RNA, 20 nt, Haemophilus influenzae Rd
agugauuuuugcaacuucag

SEQ ID NO: 2704653 - RNA, 23 nt, Haemophilus influenzae Rd
agugauuuuugcaacuucagcag

SEQ ID NO: 2704654 - RNA, 14 nt, Haemophilus influenzae Rd
agugcaugauguuu

SEQ ID NO: 2704655 - RNA, 21 nt, Haemophilus influenzae Rd
agugcaugauguuuuucagca

SEQ ID NO: 2704656 - RNA, 14 nt, Haemophilus influenzae Rd
agugccaaucaaga

SEQ ID NO: 2704657 - RNA, 19 nt, Haemophilus influenzae Rd
agugcccgcuacaaauaag

SEQ ID NO: 2704658 - RNA, 19 nt, Haemophilus influenzae Rd
agugcgcauauacuucuuu

SEQ ID NO: 2704659 - RNA, 18 nt, Haemophilus influenzae Rd
agugcggaaaauuuuccg

SEQ ID NO: 2704660 - RNA, 14 nt, Haemophilus influenzae Rd
agugcggaugaaau

SEQ ID NO: 2704661 - RNA, 15 nt, Haemophilus influenzae Rd
agugcggcaaaaaau

SEQ ID NO: 2704662 - RNA, 19 nt, Haemophilus influenzae Rd
agugcggcuucauuuugag

SEQ ID NO: 2704663 - RNA, 13 nt, Haemophilus influenzae Rd
agugcgguaaaaa

SEQ ID NO: 2704664 - RNA, 14 nt, Haemophilus influenzae Rd
agugcgguaaaaau

SEQ ID NO: 2704665 - RNA, 21 nt, Haemophilus influenzae Rd
agugcgguaaaaauucaccgc

SEQ ID NO: 2704666 - RNA, 17 nt, Haemophilus influenzae Rd
agugcgguaaaaucacc

SEQ ID NO: 2704667 - RNA, 18 nt, Haemophilus influenzae Rd
agugcgguaaaauuuuuc

SEQ ID NO: 2704668 - RNA, 16 nt, Haemophilus influenzae Rd
agugcgguaaauuuuu

SEQ ID NO: 2704669 - RNA, 14 nt, Haemophilus influenzae Rd
agugcgguaagaaa

SEQ ID NO: 2704670 - RNA, 20 nt, Haemophilus influenzae Rd
agugcgguaagaaaaucaac

SEQ ID NO: 2704671 - RNA, 18 nt, Haemophilus influenzae Rd
agugcggucaauaaaaau

SEQ ID NO: 2704672 - RNA, 19 nt, Haemophilus influenzae Rd
agugcggucaauuuucaaa

SEQ ID NO: 2704673 - RNA, 16 nt, Haemophilus influenzae Rd
agugcggucaauuuuu

SEQ ID NO: 2704674 - RNA, 19 nt, Haemophilus influenzae Rd
agugcggucagcauaaaga

SEQ ID NO: 2704675 - RNA, 21 nt, Haemophilus influenzae Rd
agugcgguuaaaaaagaaaua

SEQ ID NO: 2704676 - RNA, 20 nt, Haemophilus influenzae Rd
agugcgguuaauuucugcga

SEQ ID NO: 2704677 - RNA, 17 nt, Haemophilus influenzae Rd
agugcgguuaguuuuuu

SEQ ID NO: 2704678 - RNA, 15 nt, Haemophilus influenzae Rd
agugcgguucuucuu

SEQ ID NO: 2704679 - RNA, 15 nt, Haemophilus influenzae Rd
agugcgguugaaauu

SEQ ID NO: 2704680 - RNA, 18 nt, Haemophilus influenzae Rd
agugcgguugaaauuuaa

SEQ ID NO: 2704681 - RNA, 15 nt, Haemophilus influenzae Rd
agugcgguugauuuu

SEQ ID NO: 2704682 - RNA, 21 nt, Haemophilus influenzae Rd
agugcgguugauuuuccugau

SEQ ID NO: 2704683 - RNA, 12 nt, Haemophilus influenzae Rd
agugcuaaaaua

SEQ ID NO: 2704684 - RNA, 15 nt, Haemophilus influenzae Rd
agugcuaaaauaaaa

SEQ ID NO: 2704685 - RNA, 21 nt, Haemophilus influenzae Rd
agugcuaaauggaauguagau

SEQ ID NO: 2704686 - RNA, 16 nt, Haemophilus influenzae Rd
agugcugguagcaaua

SEQ ID NO: 2704687 - RNA, 17 nt, Haemophilus influenzae Rd
agugcugguagcaauaa

SEQ ID NO: 2704688 - RNA, 15 nt, Haemophilus influenzae Rd
agugcuguacacaca

SEQ ID NO: 2704689 - RNA, 21 nt, Haemophilus influenzae Rd
agugcuguacacacaccaucc

SEQ ID NO: 2704690 - RNA, 15 nt, Haemophilus influenzae Rd
agugcuguauauuuu

SEQ ID NO: 2704691 - RNA, 23 nt, Haemophilus influenzae Rd
aguggaauaaugaaauauuccaa

SEQ ID NO: 2704692 - RNA, 20 nt, Haemophilus influenzae Rd
aguggacgagauaaaacuug

SEQ ID NO: 2704693 - RNA, 15 nt, Haemophilus influenzae Rd
aguggagcuggaugu

SEQ ID NO: 2704694 - RNA, 23 nt, Haemophilus influenzae Rd
aguggaguauagggaauaaaaaa

SEQ ID NO: 2704695 - RNA, 15 nt, Haemophilus influenzae Rd
aguggauauuuuuga

SEQ ID NO: 2704696 - RNA, 18 nt, Haemophilus influenzae Rd
aguggcaccgaauguggc

SEQ ID NO: 2704697 - RNA, 19 nt, Haemophilus influenzae Rd
aguggcauaaagaaacagg

SEQ ID NO: 2704698 - RNA, 23 nt, Haemophilus influenzae Rd
aguggcauaaagaaacaggacac

SEQ ID NO: 2704699 - RNA, 14 nt, Haemophilus influenzae Rd
aguggcgguaaaaa

SEQ ID NO: 2704700 - RNA, 15 nt, Haemophilus influenzae Rd
aguggcgguaaaaau

SEQ ID NO: 2704701 - RNA, 19 nt, Haemophilus influenzae Rd
aguggcuugcgccauuucc

SEQ ID NO: 2704702 - RNA, 22 nt, Haemophilus influenzae Rd
aguggcuuuaaagguuuaaacc

SEQ ID NO: 2704703 - RNA, 18 nt, Haemophilus influenzae Rd
agugggcuuuuuuauuuu

SEQ ID NO: 2704704 - RNA, 13 nt, Haemophilus influenzae Rd
agugguaaucauu

SEQ ID NO: 2704705 - RNA, 14 nt, Haemophilus influenzae Rd
agugguaucaaucg

SEQ ID NO: 2704706 - RNA, 16 nt, Haemophilus influenzae Rd
agugguuucagaauaa

SEQ ID NO: 2704707 - RNA, 21 nt, Haemophilus influenzae Rd
aguguaaucagcuguuuauca

SEQ ID NO: 2704708 - RNA, 15 nt, Haemophilus influenzae Rd
aguguagucacuauu

SEQ ID NO: 2704709 - RNA, 14 nt, Haemophilus influenzae Rd
aguguauaaauauu

SEQ ID NO: 2704710 - RNA, 18 nt, Haemophilus influenzae Rd
agugugauuuuagaaaaa

SEQ ID NO: 2704711 - RNA, 17 nt, Haemophilus influenzae Rd
agugugcgagaaagauu

SEQ ID NO: 2704712 - RNA, 15 nt, Haemophilus influenzae Rd
aguguggugaacagc

SEQ ID NO: 2704713 - RNA, 19 nt, Haemophilus influenzae Rd
aguguuacaacucuaaauu

SEQ ID NO: 2704714 - RNA, 16 nt, Haemophilus influenzae Rd
aguguugcagggaaag

SEQ ID NO: 2704715 - RNA, 18 nt, Haemophilus influenzae Rd
aguguuguuccaccuuga

SEQ ID NO: 2704716 - RNA, 18 nt, Haemophilus influenzae Rd
aguguuuacuauuaauuc

SEQ ID NO: 2704717 - RNA, 20 nt, Haemophilus influenzae Rd
aguuaaacagcuuuccugua

SEQ ID NO: 2704718 - RNA, 22 nt, Haemophilus influenzae Rd
aguuaaaccaaauuuugaugaa

SEQ ID NO: 2704719 - RNA, 19 nt, Haemophilus influenzae Rd
aguuaaacgcuccucugca

SEQ ID NO: 2704720 - RNA, 16 nt, Haemophilus influenzae Rd
aguuaaacguugaauc

SEQ ID NO: 2704721 - RNA, 12 nt, Haemophilus influenzae Rd
aguuaaauaauc

SEQ ID NO: 2704722 - RNA, 16 nt, Haemophilus influenzae Rd
aguuaaauauaaacua

SEQ ID NO: 2704723 - RNA, 19 nt, Haemophilus influenzae Rd
aguuaaauccucagcaauu

SEQ ID NO: 2704724 - RNA, 23 nt, Haemophilus influenzae Rd
aguuaaauccucagcaauuucuu

SEQ ID NO: 2704725 - RNA, 15 nt, Haemophilus influenzae Rd
aguuaagaaaauaau

SEQ ID NO: 2704726 - RNA, 15 nt, Haemophilus influenzae Rd
aguuaauggcaauuu

SEQ ID NO: 2704727 - RNA, 16 nt, Haemophilus influenzae Rd
aguuuuauaguuuuua

SEQ ID NO: 2704728 - RNA, 20 nt, Haemophilus influenzae Rd
aguuuuauccaugaugaaau

SEQ ID NO: 2704729 - RNA, 21 nt, Haemophilus influenzae Rd
aguuuuauuaucaacaguaaa

SEQ ID NO: 2704730 - RNA, 18 nt, Haemophilus influenzae Rd
aguuuuauuuuccaucau

SEQ ID NO: 2704731 - RNA, 16 nt, Haemophilus influenzae Rd
aguuuucaccaacaaa

SEQ ID NO: 2704732 - RNA, 24 nt, Haemophilus influenzae Rd
aguuuucacgcugacuuaaugcaa

SEQ ID NO: 2704733 - RNA, 22 nt, Haemophilus influenzae Rd
aguuuucauuuuuuggugcaua

SEQ ID NO: 2704734 - RNA, 19 nt, Haemophilus influenzae Rd
aguuuuccgacaacacuug

SEQ ID NO: 2704735 - RNA, 21 nt, Haemophilus influenzae Rd
aguuuuccuuuuucuaacauc

SEQ ID NO: 2704736 - RNA, 22 nt, Haemophilus influenzae Rd
aguuuuccuuuuucuaacaucu

SEQ ID NO: 2704737 - RNA, 18 nt, Haemophilus influenzae Rd
aguuuucgugauuuugaa

SEQ ID NO: 2704738 - RNA, 11 nt, Haemophilus influenzae Rd
aguuuucuagc

SEQ ID NO: 2704739 - RNA, 17 nt, Haemophilus influenzae Rd
aguuuugaaguuaucaa

SEQ ID NO: 2704740 - RNA, 17 nt, Haemophilus influenzae Rd
aguuuugcuuuuuuaau

SEQ ID NO: 2704741 - RNA, 12 nt, Haemophilus influenzae Rd
aguuuuggcuuu

SEQ ID NO: 2704742 - RNA, 17 nt, Haemophilus influenzae Rd
aguuuuuagcaguuugc

SEQ ID NO: 2704743 - RNA, 16 nt, Haemophilus influenzae Rd
aguuuuuaguuuuugc

SEQ ID NO: 2704744 - RNA, 19 nt, Haemophilus influenzae Rd
aguuuuucaaaaauuuuug

SEQ ID NO: 2704745 - RNA, 14 nt, Haemophilus influenzae Rd
aguuuuuuaaguuu

SEQ ID NO: 2704746 - RNA, 18 nt, Haemophilus influenzae Rd
aguuuuuuaccuugcaag

SEQ ID NO: 2704747 - RNA, 21 nt, Haemophilus influenzae Rd
aguuuuuuacguaauaaguuu

SEQ ID NO: 2704748 - RNA, 13 nt, Haemophilus influenzae Rd
aguuuuuugccaa

SEQ ID NO: 2704749 - RNA, 17 nt, Haemophilus influenzae Rd
aguuuuuugccaaaaaa

SEQ ID NO: 2704750 - RNA, 13 nt, Haemophilus influenzae Rd
aguuuuuuuauaa

SEQ ID NO: 2704751 - RNA, 11 nt, Haemophilus influenzae Rd
auaaaaaaaca

SEQ ID NO: 2704752 - RNA, 14 nt, Haemophilus influenzae Rd
auaaaaaagaaauu

SEQ ID NO: 2704753 - RNA, 16 nt, Haemophilus influenzae Rd
auaaaaaagaaauuuu

SEQ ID NO: 2704754 - RNA, 12 nt, Haemophilus influenzae Rd
auaaaaaauaaa

SEQ ID NO: 2704755 - RNA, 21 nt, Haemophilus influenzae Rd
auaaaaaaucggugcaacaau

SEQ ID NO: 2704756 - RNA, 13 nt, Haemophilus influenzae Rd
auaaaaacauugc

SEQ ID NO: 2704757 - RNA, 22 nt, Haemophilus influenzae Rd
auaaaaacgugcuuuuuuuguu

SEQ ID NO: 2704758 - RNA, 20 nt, Haemophilus influenzae Rd
auaaaaagauaacuuagaaa

SEQ ID NO: 2704759 - RNA, 19 nt, Haemophilus influenzae Rd
auaaaaaguggguagcuuu

SEQ ID NO: 2704760 - RNA, 22 nt, Haemophilus influenzae Rd
auaaaaaguggguagcuuucgc

SEQ ID NO: 2704761 - RNA, 15 nt, Haemophilus influenzae Rd
auaaaaauaauguuu

SEQ ID NO: 2704762 - RNA, 15 nt, Haemophilus influenzae Rd
auaaaaauauuuuaa

SEQ ID NO: 2704763 - RNA, 17 nt, Haemophilus influenzae Rd
auaaaaauauuuuaaua

SEQ ID NO: 2704764 - RNA, 14 nt, Haemophilus influenzae Rd
auaaaaaucaucgu

SEQ ID NO: 2704765 - RNA, 17 nt, Haemophilus influenzae Rd
auaaaaaugagauuauu

SEQ ID NO: 2704766 - RNA, 12 nt, Haemophilus influenzae Rd
auaaaaauuagg

SEQ ID NO: 2704767 - RNA, 14 nt, Haemophilus influenzae Rd
auaaaaauuaggua

SEQ ID NO: 2704768 - RNA, 14 nt, Haemophilus influenzae Rd
auaaaaauuauuuu

SEQ ID NO: 2704769 - RNA, 20 nt, Haemophilus influenzae Rd
auaaaacaaugcaaauacaa

SEQ ID NO: 2704770 - RNA, 20 nt, Haemophilus influenzae Rd
auaaaacacaguuauuuuuu

SEQ ID NO: 2704771 - RNA, 13 nt, Haemophilus influenzae Rd
auaaaacagagcg

SEQ ID NO: 2704772 - RNA, 15 nt, Haemophilus influenzae Rd
auaaaacaguauuuu

SEQ ID NO: 2704773 - RNA, 21 nt, Haemophilus influenzae Rd
auaaaaccauccgaaauuaau

SEQ ID NO: 2704774 - RNA, 22 nt, Haemophilus influenzae Rd
auaaaaccauccgaaauuaauu

SEQ ID NO: 2704775 - RNA, 23 nt, Haemophilus influenzae Rd
auaaaaccauccgaaauuaauuu

SEQ ID NO: 2704776 - RNA, 19 nt, Haemophilus influenzae Rd
auaaaaccccguucaauuu

SEQ ID NO: 2704777 - RNA, 14 nt, Haemophilus influenzae Rd
auaaaaccuaaaau

SEQ ID NO: 2704778 - RNA, 19 nt, Haemophilus influenzae Rd
auaaaaccuaaaauugauu

SEQ ID NO: 2704779 - RNA, 14 nt, Haemophilus influenzae Rd
auaaaaccucagaa

SEQ ID NO: 2704780 - RNA, 19 nt, Haemophilus influenzae Rd
auaaaaccucagaagaaau

SEQ ID NO: 2704781 - RNA, 14 nt, Haemophilus influenzae Rd
auaaaacgaacaau

SEQ ID NO: 2704782 - RNA, 20 nt, Haemophilus influenzae Rd
auaaaacuuuucuuauaauu

SEQ ID NO: 2704783 - RNA, 20 nt, Haemophilus influenzae Rd
auaaaagaaagggcaucaau

SEQ ID NO: 2704784 - RNA, 20 nt, Haemophilus influenzae Rd
auaaaagaagcuauuacucu

SEQ ID NO: 2704785 - RNA, 19 nt, Haemophilus influenzae Rd
auaaaaggcaaagcaaaau

SEQ ID NO: 2704786 - RNA, 19 nt, Haemophilus influenzae Rd
auaaaagucaguaaaccaa

SEQ ID NO: 2704787 - RNA, 18 nt, Haemophilus influenzae Rd
auaaaagugcgguaaaaa

SEQ ID NO: 2704788 - RNA, 20 nt, Haemophilus influenzae Rd
auaaaagugcgguauuuuuu

SEQ ID NO: 2704789 - RNA, 13 nt, Haemophilus influenzae Rd
auaaaauaaaauu

SEQ ID NO: 2704790 - RNA, 11 nt, Haemophilus influenzae Rd
auaaaauagcc

SEQ ID NO: 2704791 - RNA, 23 nt, Haemophilus influenzae Rd
auaaaauauaugggaaacaauau

SEQ ID NO: 2704792 - RNA, 21 nt, Haemophilus influenzae Rd
auaaaauauauuaauuauuuu

SEQ ID NO: 2704793 - RNA, 17 nt, Haemophilus influenzae Rd
auaaaauauuuggcuga

SEQ ID NO: 2704794 - RNA, 13 nt, Haemophilus influenzae Rd
auaaaaucaaaau

SEQ ID NO: 2704795 - RNA, 22 nt, Haemophilus influenzae Rd
auaaaauggcgguuuuuuaauu

SEQ ID NO: 2704796 - RNA, 21 nt, Haemophilus influenzae Rd
auaaaauguuuauauuuccau

SEQ ID NO: 2704797 - RNA, 19 nt, Haemophilus influenzae Rd
auaaaauuaaucauaaaaa

SEQ ID NO: 2704798 - RNA, 18 nt, Haemophilus influenzae Rd
auaaaauuuuuaaaguua

SEQ ID NO: 2704799 - RNA, 21 nt, Haemophilus influenzae Rd
auaaaauuuuuaaaguuauuu

SEQ ID NO: 2704800 - RNA, 17 nt, Haemophilus influenzae Rd
auaaaauuuuuaccaua

SEQ ID NO: 2704801 - RNA, 21 nt, Haemophilus influenzae Rd
auaaacaaagaaucuuaaauu

SEQ ID NO: 2704802 - RNA, 15 nt, Haemophilus influenzae Rd
auaaacaauuccccu

SEQ ID NO: 2704803 - RNA, 20 nt, Haemophilus influenzae Rd
auaaacaauuccccuuccuu

SEQ ID NO: 2704804 - RNA, 22 nt, Haemophilus influenzae Rd
auaaacaauuccccuuccuuga

SEQ ID NO: 2704805 - RNA, 13 nt, Haemophilus influenzae Rd
auaaacaauuuca

SEQ ID NO: 2704806 - RNA, 23 nt, Haemophilus influenzae Rd
auaaacagccauggcuuuuuccu

SEQ ID NO: 2704807 - RNA, 23 nt, Haemophilus influenzae Rd
auaaacaucagugauuuucacau

SEQ ID NO: 2704808 - RNA, 20 nt, Haemophilus influenzae Rd
auaaacauuaggaauaucuu

SEQ ID NO: 2704809 - RNA, 15 nt, Haemophilus influenzae Rd
auaaacauuaugaaa

SEQ ID NO: 2704810 - RNA, 20 nt, Haemophilus influenzae Rd
auaaacauuaugaaaaaaac

SEQ ID NO: 2704811 - RNA, 10 nt, Haemophilus influenzae Rd
auaaacauuu

SEQ ID NO: 2704812 - RNA, 22 nt, Haemophilus influenzae Rd
auaaacauuucuaucgcauuuu

SEQ ID NO: 2704813 - RNA, 15 nt, Haemophilus influenzae Rd
auaaaccgcaucaaa

SEQ ID NO: 2704814 - RNA, 15 nt, Haemophilus influenzae Rd
auaaaccgccaaaaa

SEQ ID NO: 2704815 - RNA, 20 nt, Haemophilus influenzae Rd
auaaaccgccaaaaauuaau

SEQ ID NO: 2704816 - RNA, 20 nt, Haemophilus influenzae Rd
auaaaccguuagguuuaaaa

SEQ ID NO: 2704817 - RNA, 21 nt, Haemophilus influenzae Rd
auaaaccguuagguuuaaaag

SEQ ID NO: 2704818 - RNA, 18 nt, Haemophilus influenzae Rd
auaaaccuaaagccaagg

SEQ ID NO: 2704819 - RNA, 21 nt, Haemophilus influenzae Rd
auaaaccuaaagccaaggcga

SEQ ID NO: 2704820 - RNA, 17 nt, Haemophilus influenzae Rd
auaaacgagaaccaaaa

SEQ ID NO: 2704821 - RNA, 23 nt, Haemophilus influenzae Rd
auaaacgaugggcaauggcaauc

SEQ ID NO: 2704822 - RNA, 14 nt, Haemophilus influenzae Rd
auaaacgcaccaca

SEQ ID NO: 2704823 - RNA, 16 nt, Haemophilus influenzae Rd
auaaacgccuuuuaaa

SEQ ID NO: 2704824 - RNA, 21 nt, Haemophilus influenzae Rd
auaaacgccuuuuaaacuauu

SEQ ID NO: 2704825 - RNA, 14 nt, Haemophilus influenzae Rd
auaaacgguauuuu

SEQ ID NO: 2704826 - RNA, 20 nt, Haemophilus influenzae Rd
auaaacgguauuuucucgau

SEQ ID NO: 2704827 - RNA, 17 nt, Haemophilus influenzae Rd
auaaacguugugaacuu

SEQ ID NO: 2704828 - RNA, 18 nt, Haemophilus influenzae Rd
auaaacguugugaacuuu

SEQ ID NO: 2704829 - RNA, 22 nt, Haemophilus influenzae Rd
auaaacuacuucuaaaggcuaa

SEQ ID NO: 2704830 - RNA, 14 nt, Haemophilus influenzae Rd
auaaacucuaagcu

SEQ ID NO: 2704831 - RNA, 16 nt, Haemophilus influenzae Rd
auaaacuuccuuuugc

SEQ ID NO: 2704832 - RNA, 22 nt, Haemophilus influenzae Rd
auaaauuuugguugauugacca

SEQ ID NO: 2704833 - RNA, 12 nt, Haemophilus influenzae Rd
auaaauuuugug

SEQ ID NO: 2704834 - RNA, 13 nt, Haemophilus influenzae Rd
auaaauuuuuagc

SEQ ID NO: 2704835 - RNA, 21 nt, Haemophilus influenzae Rd
auaaauuuuuagcugauuuuu

SEQ ID NO: 2704836 - RNA, 22 nt, Haemophilus influenzae Rd
auaaauuuuuagcugauuuuuu

SEQ ID NO: 2704837 - RNA, 14 nt, Haemophilus influenzae Rd
auaaauuuuuuaau

SEQ ID NO: 2704838 - RNA, 14 nt, Haemophilus influenzae Rd
auaacaaaaacaau

SEQ ID NO: 2704839 - RNA, 21 nt, Haemophilus influenzae Rd
auaacaaaaacaaucacugaa

SEQ ID NO: 2704840 - RNA, 15 nt, Haemophilus influenzae Rd
auaacaaaagggcga

SEQ ID NO: 2704841 - RNA, 19 nt, Haemophilus influenzae Rd
auaacaacaacgcaucuuu

SEQ ID NO: 2704842 - RNA, 15 nt, Haemophilus influenzae Rd
auaacaacuaaaaau

SEQ ID NO: 2704843 - RNA, 16 nt, Haemophilus influenzae Rd
auaacacagaaaccaa

SEQ ID NO: 2704844 - RNA, 17 nt, Haemophilus influenzae Rd
auaacacagaaaccaau

SEQ ID NO: 2704845 - RNA, 16 nt, Haemophilus influenzae Rd
auaacacccucaacca

SEQ ID NO: 2704846 - RNA, 20 nt, Haemophilus influenzae Rd
auaacacccucaaccacuuc

SEQ ID NO: 2704847 - RNA, 23 nt, Haemophilus influenzae Rd
auaacaccgcuaauaaaaauccu

SEQ ID NO: 2704848 - RNA, 14 nt, Haemophilus influenzae Rd
auaacacucauugu

SEQ ID NO: 2704849 - RNA, 15 nt, Haemophilus influenzae Rd
auaacagauggaucu

SEQ ID NO: 2704850 - RNA, 17 nt, Haemophilus influenzae Rd
auaacaugcaaaauauu

SEQ ID NO: 2704851 - RNA, 15 nt, Haemophilus influenzae Rd
auaacauuguuuuaa

SEQ ID NO: 2704852 - RNA, 16 nt, Haemophilus influenzae Rd
auaacauuguuuuaau

SEQ ID NO: 2704853 - RNA, 17 nt, Haemophilus influenzae Rd
auaacauuguuuuaaug

SEQ ID NO: 2704854 - RNA, 14 nt, Haemophilus influenzae Rd
auaaccaaaauauu

SEQ ID NO: 2704855 - RNA, 18 nt, Haemophilus influenzae Rd
auaaccaaauagaugaaa

SEQ ID NO: 2704856 - RNA, 19 nt, Haemophilus influenzae Rd
auaaccaagaaagcaugaa

SEQ ID NO: 2704857 - RNA, 23 nt, Haemophilus influenzae Rd
auaaccaauccacucuuuuaaua

SEQ ID NO: 2704858 - RNA, 18 nt, Haemophilus influenzae Rd
auaaccacuagccauugc

SEQ ID NO: 2704859 - RNA, 21 nt, Haemophilus influenzae Rd
auaaccagauucaucaaagua

SEQ ID NO: 2704860 - RNA, 18 nt, Haemophilus influenzae Rd
auaaccauucccauucca

SEQ ID NO: 2704861 - RNA, 22 nt, Haemophilus influenzae Rd
auaaccauucccauuccaguaa

SEQ ID NO: 2704862 - RNA, 18 nt, Haemophilus influenzae Rd
auaacccaccaaauuacu

SEQ ID NO: 2704863 - RNA, 21 nt, Haemophilus influenzae Rd
auaacccacuguuaaagugca

SEQ ID NO: 2704864 - RNA, 18 nt, Haemophilus influenzae Rd
auaacccgauuauucuua

SEQ ID NO: 2704865 - RNA, 17 nt, Haemophilus influenzae Rd
auaacccgccuuuguuu

SEQ ID NO: 2704866 - RNA, 15 nt, Haemophilus influenzae Rd
auaacccuaaaguga

SEQ ID NO: 2704867 - RNA, 16 nt, Haemophilus influenzae Rd
auaacccuuacuuuau

SEQ ID NO: 2704868 - RNA, 17 nt, Haemophilus influenzae Rd
auaacccuuacuuuaua

SEQ ID NO: 2704869 - RNA, 20 nt, Haemophilus influenzae Rd
auaaccgcacuucaaaaagu

SEQ ID NO: 2704870 - RNA, 19 nt, Haemophilus influenzae Rd
auaaccgcacuuuaaucuc

SEQ ID NO: 2704871 - RNA, 23 nt, Haemophilus influenzae Rd
auaaccgccauucagcacuaauu

SEQ ID NO: 2704872 - RNA, 22 nt, Haemophilus influenzae Rd
auaaccgccuaaaguuacacaa

SEQ ID NO: 2704873 - RNA, 15 nt, Haemophilus influenzae Rd
auaaccuagaacaaa

SEQ ID NO: 2704874 - RNA, 16 nt, Haemophilus influenzae Rd
auaaccucgaaucaca

SEQ ID NO: 2704875 - RNA, 19 nt, Haemophilus influenzae Rd
auaaccugcggauuucacu

SEQ ID NO: 2704876 - RNA, 20 nt, Haemophilus influenzae Rd
auaaccuuaaaucaaacaaa

SEQ ID NO: 2704877 - RNA, 19 nt, Haemophilus influenzae Rd
auaacgacgggaaacuguc

SEQ ID NO: 2704878 - RNA, 20 nt, Haemophilus influenzae Rd
auaacgagguuggcaauaaa

SEQ ID NO: 2704879 - RNA, 16 nt, Haemophilus influenzae Rd
auaacgauaacugaau

SEQ ID NO: 2704880 - RNA, 21 nt, Haemophilus influenzae Rd
auaacgcaucaccacaaaaua

SEQ ID NO: 2704881 - RNA, 24 nt, Haemophilus influenzae Rd
auaacgcccuacgccuaauucauc

SEQ ID NO: 2704882 - RNA, 21 nt, Haemophilus influenzae Rd
auaacgcuccccuugauuauu

SEQ ID NO: 2704883 - RNA, 18 nt, Haemophilus influenzae Rd
auaacgcuugaauaaauc

SEQ ID NO: 2704884 - RNA, 21 nt, Haemophilus influenzae Rd
auaacgcuugaauaaaucccc

SEQ ID NO: 2704885 - RNA, 18 nt, Haemophilus influenzae Rd
auaacggcacaccuaacu

SEQ ID NO: 2704886 - RNA, 12 nt, Haemophilus influenzae Rd
auaacguauuuu

SEQ ID NO: 2704887 - RNA, 20 nt, Haemophilus influenzae Rd
auaacguauuuucucaucau

SEQ ID NO: 2704888 - RNA, 22 nt, Haemophilus influenzae Rd
auaacgucgaauaacuuuauuu

SEQ ID NO: 2704889 - RNA, 13 nt, Haemophilus influenzae Rd
auaacguuaauuc

SEQ ID NO: 2704890 - RNA, 16 nt, Haemophilus influenzae Rd
auaacguuuaaaaauu

SEQ ID NO: 2704891 - RNA, 18 nt, Haemophilus influenzae Rd
auaacguuuaaaaauuaa

SEQ ID NO: 2704892 - RNA, 22 nt, Haemophilus influenzae Rd
auaacguuuacgauacauagaa

SEQ ID NO: 2704893 - RNA, 14 nt, Haemophilus influenzae Rd
auaacuaaaaauac

SEQ ID NO: 2704894 - RNA, 17 nt, Haemophilus influenzae Rd
auaacuaaaaauaccgc

SEQ ID NO: 2704895 - RNA, 14 nt, Haemophilus influenzae Rd
auaacuacaacaca

SEQ ID NO: 2704896 - RNA, 18 nt, Haemophilus influenzae Rd
auaacuaggcaucaaaau

SEQ ID NO: 2704897 - RNA, 15 nt, Haemophilus influenzae Rd
auaacuaugccuucu

SEQ ID NO: 2704898 - RNA, 22 nt, Haemophilus influenzae Rd
auaacucaacaccgcaaaaaua

SEQ ID NO: 2704899 - RNA, 19 nt, Haemophilus influenzae Rd
auaacuggaauggauaaac

SEQ ID NO: 2704900 - RNA, 13 nt, Haemophilus influenzae Rd
auaacuuagaaaa

SEQ ID NO: 2704901 - RNA, 17 nt, Haemophilus influenzae Rd
auaacuuaugaauaaua

SEQ ID NO: 2704902 - RNA, 14 nt, Haemophilus influenzae Rd
auaacuucaccaau

SEQ ID NO: 2704903 - RNA, 23 nt, Haemophilus influenzae Rd
auaacuugauguuuuugaaguaa

SEQ ID NO: 2704904 - RNA, 20 nt, Haemophilus influenzae Rd
auaacuugcuugugggaauu

SEQ ID NO: 2704905 - RNA, 13 nt, Haemophilus influenzae Rd
auaacuuucaguu

SEQ ID NO: 2704906 - RNA, 14 nt, Haemophilus influenzae Rd
auaacuuuuuggca

SEQ ID NO: 2704907 - RNA, 21 nt, Haemophilus influenzae Rd
auaacuuuuuggcauaguaau

SEQ ID NO: 2704908 - RNA, 13 nt, Haemophilus influenzae Rd
auaagaaaauuau

SEQ ID NO: 2704909 - RNA, 15 nt, Haemophilus influenzae Rd
auaagaaaauuaucu

SEQ ID NO: 2704910 - RNA, 17 nt, Haemophilus influenzae Rd
auaagaaaucucuuuca

SEQ ID NO: 2704911 - RNA, 18 nt, Haemophilus influenzae Rd
auaagaaauguuuggaua

SEQ ID NO: 2704912 - RNA, 18 nt, Haemophilus influenzae Rd
auaagaagcugcuuuuaa

SEQ ID NO: 2704913 - RNA, 21 nt, Haemophilus influenzae Rd
auaagagcuuacuucuacuuc

SEQ ID NO: 2704914 - RNA, 21 nt, Haemophilus influenzae Rd
auaagaguuuccuuauauuca

SEQ ID NO: 2704915 - RNA, 15 nt, Haemophilus influenzae Rd
auaagauaacaucac

SEQ ID NO: 2704916 - RNA, 23 nt, Haemophilus influenzae Rd
auaagaugaacgaguaaauuaau

SEQ ID NO: 2704917 - RNA, 22 nt, Haemophilus influenzae Rd
auaagauguuucacuaaaaaua

SEQ ID NO: 2704918 - RNA, 14 nt, Haemophilus influenzae Rd
auaagauuaaugau

SEQ ID NO: 2704919 - RNA, 22 nt, Haemophilus influenzae Rd
auaagauuaaugauaaguuuug

SEQ ID NO: 2704920 - RNA, 23 nt, Haemophilus influenzae Rd
auaagauuaaugauaaguuuugu

SEQ ID NO: 2704921 - RNA, 13 nt, Haemophilus influenzae Rd
auaagauuugcuc

SEQ ID NO: 2704922 - RNA, 13 nt, Haemophilus influenzae Rd
auaagauuugcuu

SEQ ID NO: 2704923 - RNA, 13 nt, Haemophilus influenzae Rd
auaagauuuuuaa

SEQ ID NO: 2704924 - RNA, 23 nt, Haemophilus influenzae Rd
auaagauuuuugauaaaaaagaa

SEQ ID NO: 2704925 - RNA, 19 nt, Haemophilus influenzae Rd
auaagcaaguaauuuaaaa

SEQ ID NO: 2704926 - RNA, 23 nt, Haemophilus influenzae Rd
auaagcaaguaauuuaaaaagua

SEQ ID NO: 2704927 - RNA, 14 nt, Haemophilus influenzae Rd
auaagcaauuucac

SEQ ID NO: 2704928 - RNA, 13 nt, Haemophilus influenzae Rd
auaagcacaaucg

SEQ ID NO: 2704929 - RNA, 19 nt, Haemophilus influenzae Rd
auaagcauuuuaucacaag

SEQ ID NO: 2704930 - RNA, 20 nt, Haemophilus influenzae Rd
auaagccacugugcauuaaa

SEQ ID NO: 2704931 - RNA, 21 nt, Haemophilus influenzae Rd
auaagccacugugcauuaaau

SEQ ID NO: 2704932 - RNA, 15 nt, Haemophilus influenzae Rd
auaagccauuaacau

SEQ ID NO: 2704933 - RNA, 14 nt, Haemophilus influenzae Rd
auaagcccaacuua

SEQ ID NO: 2704934 - RNA, 18 nt, Haemophilus influenzae Rd
auaagcccaacuuaaguu

SEQ ID NO: 2704935 - RNA, 14 nt, Haemophilus influenzae Rd
auaagccuuuucau

SEQ ID NO: 2704936 - RNA, 16 nt, Haemophilus influenzae Rd
auaagcuaauuuuuca

SEQ ID NO: 2704937 - RNA, 15 nt, Haemophilus influenzae Rd
auaaucuucuuccca

SEQ ID NO: 2704938 - RNA, 17 nt, Haemophilus influenzae Rd
auaaucuucuucccaac

SEQ ID NO: 2704939 - RNA, 13 nt, Haemophilus influenzae Rd
auaaucuuuaaaa

SEQ ID NO: 2704940 - RNA, 23 nt, Haemophilus influenzae Rd
auaaucuuuaaaauguaaaaaau

SEQ ID NO: 2704941 - RNA, 16 nt, Haemophilus influenzae Rd
auaaucuuuaaauuuu

SEQ ID NO: 2704942 - RNA, 12 nt, Haemophilus influenzae Rd
auaaugaaauau

SEQ ID NO: 2704943 - RNA, 21 nt, Haemophilus influenzae Rd
auaaugaacgccgcaacuaau

SEQ ID NO: 2704944 - RNA, 14 nt, Haemophilus influenzae Rd
auaaugaauaauuu

SEQ ID NO: 2704945 - RNA, 22 nt, Haemophilus influenzae Rd
auaaugaauaauuuuuauaauu

SEQ ID NO: 2704946 - RNA, 14 nt, Haemophilus influenzae Rd
auaaugaauauauu

SEQ ID NO: 2704947 - RNA, 14 nt, Haemophilus influenzae Rd
auaaugaccauugg

SEQ ID NO: 2704948 - RNA, 13 nt, Haemophilus influenzae Rd
auaaugauauuau

SEQ ID NO: 2704949 - RNA, 22 nt, Haemophilus influenzae Rd
auaaugaugaaugcuuuuauaa

SEQ ID NO: 2704950 - RNA, 12 nt, Haemophilus influenzae Rd
auaaugauguac

SEQ ID NO: 2704951 - RNA, 16 nt, Haemophilus influenzae Rd
auaaugcaaaaacaag

SEQ ID NO: 2704952 - RNA, 17 nt, Haemophilus influenzae Rd
auaaugcaaccaaacaa

SEQ ID NO: 2704953 - RNA, 19 nt, Haemophilus influenzae Rd
auaaugcaaccaaacaaaa

SEQ ID NO: 2704954 - RNA, 14 nt, Haemophilus influenzae Rd
auaaugcauagcca

SEQ ID NO: 2704955 - RNA, 17 nt, Haemophilus influenzae Rd
auaaugcauagccaagu

SEQ ID NO: 2704956 - RNA, 16 nt, Haemophilus influenzae Rd
auaauggcaauuuuau

SEQ ID NO: 2704957 - RNA, 17 nt, Haemophilus influenzae Rd
auaauggcaauuuuaua

SEQ ID NO: 2704958 - RNA, 22 nt, Haemophilus influenzae Rd
auaauggcaauuuuauauucau

SEQ ID NO: 2704959 - RNA, 18 nt, Haemophilus influenzae Rd
auaauggcgauaauuauu

SEQ ID NO: 2704960 - RNA, 20 nt, Haemophilus influenzae Rd
auaauggcgguaaaaaagua

SEQ ID NO: 2704961 - RNA, 15 nt, Haemophilus influenzae Rd
auaauggcuuuucuc

SEQ ID NO: 2704962 - RNA, 22 nt, Haemophilus influenzae Rd
auaaugggcuuuccaauaacca

SEQ ID NO: 2704963 - RNA, 21 nt, Haemophilus influenzae Rd
auaauguagagcucaauuauu

SEQ ID NO: 2704964 - RNA, 14 nt, Haemophilus influenzae Rd
auaaugucaucuag

SEQ ID NO: 2704965 - RNA, 23 nt, Haemophilus influenzae Rd
auaaugucccugcccuugauauu

SEQ ID NO: 2704966 - RNA, 18 nt, Haemophilus influenzae Rd
auaaugugagaauaacca

SEQ ID NO: 2704967 - RNA, 22 nt, Haemophilus influenzae Rd
auaauguguugauuucuacacu

SEQ ID NO: 2704968 - RNA, 16 nt, Haemophilus influenzae Rd
auaauguucuuuuaaa

SEQ ID NO: 2704969 - RNA, 21 nt, Haemophilus influenzae Rd
auaauguuuucauuaauuuca

SEQ ID NO: 2704970 - RNA, 17 nt, Haemophilus influenzae Rd
auaauuaaaaauaaaua

SEQ ID NO: 2704971 - RNA, 18 nt, Haemophilus influenzae Rd
auaauuaaacagcacacu

SEQ ID NO: 2704972 - RNA, 15 nt, Haemophilus influenzae Rd
auaauuaaacagcca

SEQ ID NO: 2704973 - RNA, 20 nt, Haemophilus influenzae Rd
auaauuaaacagccaaacaa

SEQ ID NO: 2704974 - RNA, 15 nt, Haemophilus influenzae Rd
auaauuaaacauuuc

SEQ ID NO: 2704975 - RNA, 12 nt, Haemophilus influenzae Rd
auaauuaaacuu

SEQ ID NO: 2704976 - RNA, 21 nt, Haemophilus influenzae Rd
auaauuaaacuuucaauuuuu

SEQ ID NO: 2704977 - RNA, 15 nt, Haemophilus influenzae Rd
auaauuaaaguuacu

SEQ ID NO: 2704978 - RNA, 13 nt, Haemophilus influenzae Rd
auaauuaaauuca

SEQ ID NO: 2704979 - RNA, 15 nt, Haemophilus influenzae Rd
auaauuaaauucauu

SEQ ID NO: 2704980 - RNA, 14 nt, Haemophilus influenzae Rd
auaauuaagaaaau

SEQ ID NO: 2704981 - RNA, 16 nt, Haemophilus influenzae Rd
auaauuaauaaaaaau

SEQ ID NO: 2704982 - RNA, 22 nt, Haemophilus influenzae Rd
auaauuaauaaaaaaucuguga

SEQ ID NO: 2704983 - RNA, 18 nt, Haemophilus influenzae Rd
auaauuaaugcuaaacca

SEQ ID NO: 2704984 - RNA, 21 nt, Haemophilus influenzae Rd
auaauuacagaaucauuuuca

SEQ ID NO: 2704985 - RNA, 19 nt, Haemophilus influenzae Rd
auaauuaccugugaaaaca

SEQ ID NO: 2704986 - RNA, 20 nt, Haemophilus influenzae Rd
auaauuagauaauacagaaa

SEQ ID NO: 2704987 - RNA, 16 nt, Haemophilus influenzae Rd
auaauuagaucauaaa

SEQ ID NO: 2704988 - RNA, 19 nt, Haemophilus influenzae Rd
auaauuaucaacaucaacu

SEQ ID NO: 2704989 - RNA, 22 nt, Haemophilus influenzae Rd
auaauuauggugaauaaaaccg

SEQ ID NO: 2704990 - RNA, 22 nt, Haemophilus influenzae Rd
auaauucaaaacggucagucac

SEQ ID NO: 2704991 - RNA, 15 nt, Haemophilus influenzae Rd
auaauucaagaugau

SEQ ID NO: 2704992 - RNA, 21 nt, Haemophilus influenzae Rd
auaauucaagaugauauuuaa

SEQ ID NO: 2704993 - RNA, 20 nt, Haemophilus influenzae Rd
auaauucagcaagaaacuca

SEQ ID NO: 2704994 - RNA, 23 nt, Haemophilus influenzae Rd
auaauucagcgagagaauauuua

SEQ ID NO: 2704995 - RNA, 13 nt, Haemophilus influenzae Rd
auaauucaucaaa

SEQ ID NO: 2704996 - RNA, 15 nt, Haemophilus influenzae Rd
auaauuccuaaaaua

SEQ ID NO: 2704997 - RNA, 19 nt, Haemophilus influenzae Rd
auaauuccuaaaauacaaa

SEQ ID NO: 2704998 - RNA, 15 nt, Haemophilus influenzae Rd
auaauuccuuuuucu

SEQ ID NO: 2704999 - RNA, 21 nt, Haemophilus influenzae Rd
auaauucuugggcaacaguca

SEQ ID NO: 2705000 - RNA, 19 nt, Haemophilus influenzae Rd
auaauuggaguggacauaa

SEQ ID NO: 2705001 - RNA, 17 nt, Haemophilus influenzae Rd
auaauuggcaauaaugu

SEQ ID NO: 2705002 - RNA, 18 nt, Haemophilus influenzae Rd
auaauugguaaucaaauu

SEQ ID NO: 2705003 - RNA, 14 nt, Haemophilus influenzae Rd
auaauuuaaauuua

SEQ ID NO: 2705004 - RNA, 15 nt, Haemophilus influenzae Rd
auaauuuaagcaaaa

SEQ ID NO: 2705005 - RNA, 23 nt, Haemophilus influenzae Rd
auaauuuacuguuuaaauaguga

SEQ ID NO: 2705006 - RNA, 14 nt, Haemophilus influenzae Rd
auaauuuauauuau

SEQ ID NO: 2705007 - RNA, 16 nt, Haemophilus influenzae Rd
auaauuuauauuaugc

SEQ ID NO: 2705008 - RNA, 23 nt, Haemophilus influenzae Rd
auaauuuauucaaaauaaaacca

SEQ ID NO: 2705009 - RNA, 24 nt, Haemophilus influenzae Rd
auaauuuauucaaaauaaaaccau

SEQ ID NO: 2705010 - RNA, 13 nt, Haemophilus influenzae Rd
auaauuucaucua

SEQ ID NO: 2705011 - RNA, 21 nt, Haemophilus influenzae Rd
auaauuuccaacacauuauca

SEQ ID NO: 2705012 - RNA, 23 nt, Haemophilus influenzae Rd
auaauuuccuauacuaauuuuag

SEQ ID NO: 2705013 - RNA, 17 nt, Haemophilus influenzae Rd
auaauuuccuuuuuuau

SEQ ID NO: 2705014 - RNA, 22 nt, Haemophilus influenzae Rd
auaauuucguagagagucuggu

SEQ ID NO: 2705015 - RNA, 15 nt, Haemophilus influenzae Rd
auaauuucuuuugca

SEQ ID NO: 2705016 - RNA, 13 nt, Haemophilus influenzae Rd
auaauuugguuag

SEQ ID NO: 2705017 - RNA, 21 nt, Haemophilus influenzae Rd
auaauuuuacguuucauuuuu

SEQ ID NO: 2705018 - RNA, 16 nt, Haemophilus influenzae Rd
auaauuuuagaacuua

SEQ ID NO: 2705019 - RNA, 17 nt, Haemophilus influenzae Rd
auaauuuucaaacacaa

SEQ ID NO: 2705020 - RNA, 14 nt, Haemophilus influenzae Rd
auaauuuuggauca

SEQ ID NO: 2705021 - RNA, 14 nt, Haemophilus influenzae Rd
auaauuuuuauaau

SEQ ID NO: 2705022 - RNA, 10 nt, Haemophilus influenzae Rd
auaauuuuuc

SEQ ID NO: 2705023 - RNA, 11 nt, Haemophilus influenzae Rd
auaauuuuuca

SEQ ID NO: 2705024 - RNA, 15 nt, Haemophilus influenzae Rd
auaauuuuucaccug

SEQ ID NO: 2705025 - RNA, 14 nt, Haemophilus influenzae Rd
auacaaaaaagcca

SEQ ID NO: 2705026 - RNA, 13 nt, Haemophilus influenzae Rd
auacaaaacuaaa

SEQ ID NO: 2705027 - RNA, 21 nt, Haemophilus influenzae Rd
auacaacgcucugcaccuuca

SEQ ID NO: 2705028 - RNA, 17 nt, Haemophilus influenzae Rd
auacaagaaagaaauau

SEQ ID NO: 2705029 - RNA, 23 nt, Haemophilus influenzae Rd
auacaagcggcugacauuacaua

SEQ ID NO: 2705030 - RNA, 19 nt, Haemophilus influenzae Rd
auacaagguacuugaacuu

SEQ ID NO: 2705031 - RNA, 13 nt, Haemophilus influenzae Rd
auacaaguauuuu

SEQ ID NO: 2705032 - RNA, 15 nt, Haemophilus influenzae Rd
auacaaguauuuucc

SEQ ID NO: 2705033 - RNA, 13 nt, Haemophilus influenzae Rd
auacaaguuuuac

SEQ ID NO: 2705034 - RNA, 18 nt, Haemophilus influenzae Rd
auacaauccaccaaaugc

SEQ ID NO: 2705035 - RNA, 20 nt, Haemophilus influenzae Rd
auacaaucucuagauuuuuu

SEQ ID NO: 2705036 - RNA, 21 nt, Haemophilus influenzae Rd
auacaaucucuagauuuuuua

SEQ ID NO: 2705037 - RNA, 15 nt, Haemophilus influenzae Rd
auacaaucuguccau

SEQ ID NO: 2705038 - RNA, 21 nt, Haemophilus influenzae Rd
auacaauucuuguuuaauauu

SEQ ID NO: 2705039 - RNA, 14 nt, Haemophilus influenzae Rd
auacaauuuucuuu

SEQ ID NO: 2705040 - RNA, 19 nt, Haemophilus influenzae Rd
auacaauuuucuuuucaaa

SEQ ID NO: 2705041 - RNA, 22 nt, Haemophilus influenzae Rd
auacaauuuuuuucaagcaaca

SEQ ID NO: 2705042 - RNA, 19 nt, Haemophilus influenzae Rd
auacuugcgauauugacca

SEQ ID NO: 2705043 - RNA, 14 nt, Haemophilus influenzae Rd
auacuugcuuaugc

SEQ ID NO: 2705044 - RNA, 17 nt, Haemophilus influenzae Rd
auacuuuauaacuugcu

SEQ ID NO: 2705045 - RNA, 12 nt, Haemophilus influenzae Rd
auacuuuuaauu

SEQ ID NO: 2705046 - RNA, 20 nt, Haemophilus influenzae Rd
auacuuuuaauuaaauacaa

SEQ ID NO: 2705047 - RNA, 21 nt, Haemophilus influenzae Rd
auacuuuuaauuaaauacaaa

SEQ ID NO: 2705048 - RNA, 14 nt, Haemophilus influenzae Rd
auacuuuuguaugu

SEQ ID NO: 2705049 - RNA, 18 nt, Haemophilus influenzae Rd
auagaaaaaugccacuaa

SEQ ID NO: 2705050 - RNA, 14 nt, Haemophilus influenzae Rd
auagaaaagacaau

SEQ ID NO: 2705051 - RNA, 20 nt, Haemophilus influenzae Rd
auagaaaccaauaauuucau

SEQ ID NO: 2705052 - RNA, 17 nt, Haemophilus influenzae Rd
auagaaagaauauuuaa

SEQ ID NO: 2705053 - RNA, 20 nt, Haemophilus influenzae Rd
auagaaagcauuguuugcua

SEQ ID NO: 2705054 - RNA, 17 nt, Haemophilus influenzae Rd
auagaaaguuuaacuuu

SEQ ID NO: 2705055 - RNA, 11 nt, Haemophilus influenzae Rd
auagaaauuca

SEQ ID NO: 2705056 - RNA, 17 nt, Haemophilus influenzae Rd
auagaacuguuauuugc

SEQ ID NO: 2705057 - RNA, 17 nt, Haemophilus influenzae Rd
auagaagauuuaaaaca

SEQ ID NO: 2705058 - RNA, 20 nt, Haemophilus influenzae Rd
auagaaggcuaguucuuccu

SEQ ID NO: 2705059 - RNA, 21 nt, Haemophilus influenzae Rd
auagaagugcgguugcuuuua

SEQ ID NO: 2705060 - RNA, 18 nt, Haemophilus influenzae Rd
auagaauaacgccaugaa

SEQ ID NO: 2705061 - RNA, 14 nt, Haemophilus influenzae Rd
auagaaugaaaaac

SEQ ID NO: 2705062 - RNA, 15 nt, Haemophilus influenzae Rd
auagaaugaaaaaca

SEQ ID NO: 2705063 - RNA, 21 nt, Haemophilus influenzae Rd
auagaaugaaaaacauucaau

SEQ ID NO: 2705064 - RNA, 19 nt, Haemophilus influenzae Rd
auagacaauauugaaauaa

SEQ ID NO: 2705065 - RNA, 15 nt, Haemophilus influenzae Rd
auagacaggcauauu

SEQ ID NO: 2705066 - RNA, 20 nt, Haemophilus influenzae Rd
auagaccgcuauuuuuaauu

SEQ ID NO: 2705067 - RNA, 14 nt, Haemophilus influenzae Rd
auagacuucaagug

SEQ ID NO: 2705068 - RNA, 12 nt, Haemophilus influenzae Rd
auagagaaauaa

SEQ ID NO: 2705069 - RNA, 19 nt, Haemophilus influenzae Rd
auagaggaaccauguaauc

SEQ ID NO: 2705070 - RNA, 14 nt, Haemophilus influenzae Rd
auagaguacgccca

SEQ ID NO: 2705071 - RNA, 16 nt, Haemophilus influenzae Rd
auagagucaauccagu

SEQ ID NO: 2705072 - RNA, 15 nt, Haemophilus influenzae Rd
auagauaaaauaaaa

SEQ ID NO: 2705073 - RNA, 21 nt, Haemophilus influenzae Rd
auagauaaaauguugaauaua

SEQ ID NO: 2705074 - RNA, 22 nt, Haemophilus influenzae Rd
auagauaaaauuaaucauaaaa

SEQ ID NO: 2705075 - RNA, 15 nt, Haemophilus influenzae Rd
auagauaaauauauc

SEQ ID NO: 2705076 - RNA, 20 nt, Haemophilus influenzae Rd
auagauaaauaucaaaauua

SEQ ID NO: 2705077 - RNA, 14 nt, Haemophilus influenzae Rd
auagauaaaucaaa

SEQ ID NO: 2705078 - RNA, 22 nt, Haemophilus influenzae Rd
auagauaagaaguuaucauuug

SEQ ID NO: 2705079 - RNA, 19 nt, Haemophilus influenzae Rd
auagauaugugaauaaaau

SEQ ID NO: 2705080 - RNA, 20 nt, Haemophilus influenzae Rd
auagauaugugaauaaaauc

SEQ ID NO: 2705081 - RNA, 15 nt, Haemophilus influenzae Rd
auagaugaaauuuau

SEQ ID NO: 2705082 - RNA, 15 nt, Haemophilus influenzae Rd
auagaugaauuagaa

SEQ ID NO: 2705083 - RNA, 16 nt, Haemophilus influenzae Rd
auagauuacguagaaa

SEQ ID NO: 2705084 - RNA, 17 nt, Haemophilus influenzae Rd
auagauuacguagaaaa

SEQ ID NO: 2705085 - RNA, 18 nt, Haemophilus influenzae Rd
auagauuacguagaaaac

SEQ ID NO: 2705086 - RNA, 20 nt, Haemophilus influenzae Rd
auagauuacguagaaaacaa

SEQ ID NO: 2705087 - RNA, 16 nt, Haemophilus influenzae Rd
auagauugaaaaguaa

SEQ ID NO: 2705088 - RNA, 19 nt, Haemophilus influenzae Rd
auagauuuaagcuuauuuc

SEQ ID NO: 2705089 - RNA, 13 nt, Haemophilus influenzae Rd
auagauuuaauau

SEQ ID NO: 2705090 - RNA, 15 nt, Haemophilus influenzae Rd
auagauuuaauaucu

SEQ ID NO: 2705091 - RNA, 19 nt, Haemophilus influenzae Rd
auagauuuauacuuaauuu

SEQ ID NO: 2705092 - RNA, 13 nt, Haemophilus influenzae Rd
auagauuugacuu

SEQ ID NO: 2705093 - RNA, 20 nt, Haemophilus influenzae Rd
auagcaacgcccuucuuuga

SEQ ID NO: 2705094 - RNA, 17 nt, Haemophilus influenzae Rd
auagcaagaacaauuaa

SEQ ID NO: 2705095 - RNA, 15 nt, Haemophilus influenzae Rd
auagcauaaguuaau

SEQ ID NO: 2705096 - RNA, 18 nt, Haemophilus influenzae Rd
auagcauuaaagucuaau

SEQ ID NO: 2705097 - RNA, 19 nt, Haemophilus influenzae Rd
auagcauuaaagucuaaua

SEQ ID NO: 2705098 - RNA, 19 nt, Haemophilus influenzae Rd
auagccaagugcuuuaccu

SEQ ID NO: 2705099 - RNA, 23 nt, Haemophilus influenzae Rd
auagccgcgaugauagaaccaau

SEQ ID NO: 2705100 - RNA, 16 nt, Haemophilus influenzae Rd
auagccguccauuuca

SEQ ID NO: 2705101 - RNA, 24 nt, Haemophilus influenzae Rd
auagccguucuuaucuacaaucaa

SEQ ID NO: 2705102 - RNA, 18 nt, Haemophilus influenzae Rd
auagccuaaauauuuaua

SEQ ID NO: 2705103 - RNA, 19 nt, Haemophilus influenzae Rd
auagccuauaauuaaaguu

SEQ ID NO: 2705104 - RNA, 23 nt, Haemophilus influenzae Rd
auagccucagguauuucuucaau

SEQ ID NO: 2705105 - RNA, 16 nt, Haemophilus influenzae Rd
auagccucuucuuuug

SEQ ID NO: 2705106 - RNA, 20 nt, Haemophilus influenzae Rd
auagccucuucuuuugauaa

SEQ ID NO: 2705107 - RNA, 16 nt, Haemophilus influenzae Rd
auagccuucaucacaa

SEQ ID NO: 2705108 - RNA, 22 nt, Haemophilus influenzae Rd
auagccuucgcuauuuuucgcu

SEQ ID NO: 2705109 - RNA, 15 nt, Haemophilus influenzae Rd
auagccuucugccau

SEQ ID NO: 2705110 - RNA, 15 nt, Haemophilus influenzae Rd
auagcgaucugcacu

SEQ ID NO: 2705111 - RNA, 13 nt, Haemophilus influenzae Rd
auagcggcaugaa

SEQ ID NO: 2705112 - RNA, 20 nt, Haemophilus influenzae Rd
auagcguuuuucguguuuag

SEQ ID NO: 2705113 - RNA, 16 nt, Haemophilus influenzae Rd
auagcuaacaaauuua

SEQ ID NO: 2705114 - RNA, 23 nt, Haemophilus influenzae Rd
auagcuaacaaauuuaauauuuc

SEQ ID NO: 2705115 - RNA, 14 nt, Haemophilus influenzae Rd
auagcuagaaagca

SEQ ID NO: 2705116 - RNA, 17 nt, Haemophilus influenzae Rd
auagcucaguugguaga

SEQ ID NO: 2705117 - RNA, 20 nt, Haemophilus influenzae Rd
auagcuguaagauaaacgca

SEQ ID NO: 2705118 - RNA, 13 nt, Haemophilus influenzae Rd
auagcuuccauuu

SEQ ID NO: 2705119 - RNA, 16 nt, Haemophilus influenzae Rd
auagcuucuaauuuuu

SEQ ID NO: 2705120 - RNA, 14 nt, Haemophilus influenzae Rd
auagcuucugccag

SEQ ID NO: 2705121 - RNA, 13 nt, Haemophilus influenzae Rd
auagcuuugcuuu

SEQ ID NO: 2705122 - RNA, 16 nt, Haemophilus influenzae Rd
auaggaaaggcauuuu

SEQ ID NO: 2705123 - RNA, 15 nt, Haemophilus influenzae Rd
auaggaguaaaaaua

SEQ ID NO: 2705124 - RNA, 16 nt, Haemophilus influenzae Rd
auaggaguaaaaauau

SEQ ID NO: 2705125 - RNA, 16 nt, Haemophilus influenzae Rd
auaggauaaauaaacu

SEQ ID NO: 2705126 - RNA, 22 nt, Haemophilus influenzae Rd
auaggauuaacguaagaaauaa

SEQ ID NO: 2705127 - RNA, 19 nt, Haemophilus influenzae Rd
auaggauugccuucauaua

SEQ ID NO: 2705128 - RNA, 16 nt, Haemophilus influenzae Rd
auaggcgcguaauaaa

SEQ ID NO: 2705129 - RNA, 23 nt, Haemophilus influenzae Rd
auaggcuucuuguuuacauucuu

SEQ ID NO: 2705130 - RNA, 14 nt, Haemophilus influenzae Rd
auaggguaauaaaa

SEQ ID NO: 2705131 - RNA, 14 nt, Haemophilus influenzae Rd
auagguaaacuuug

SEQ ID NO: 2705132 - RNA, 21 nt, Haemophilus influenzae Rd
auaggugcuuaacugaaaauu

SEQ ID NO: 2705133 - RNA, 16 nt, Haemophilus influenzae Rd
auaguaaaaaaucaag

SEQ ID NO: 2705134 - RNA, 15 nt, Haemophilus influenzae Rd
auaguaaaaauuguu

SEQ ID NO: 2705135 - RNA, 14 nt, Haemophilus influenzae Rd
auaguaaacuuuua

SEQ ID NO: 2705136 - RNA, 15 nt, Haemophilus influenzae Rd
auaguaaacuuuuaa

SEQ ID NO: 2705137 - RNA, 23 nt, Haemophilus influenzae Rd
auaguacuaccgcaucuuuuucu

SEQ ID NO: 2705138 - RNA, 21 nt, Haemophilus influenzae Rd
auaguagagucauuuacaggu

SEQ ID NO: 2705139 - RNA, 17 nt, Haemophilus influenzae Rd
auaguauggcucuaaau

SEQ ID NO: 2705140 - RNA, 20 nt, Haemophilus influenzae Rd
auaguauggcucuaaauuaa

SEQ ID NO: 2705141 - RNA, 21 nt, Haemophilus influenzae Rd
auaguauggcucuaaauuaau

SEQ ID NO: 2705142 - RNA, 13 nt, Haemophilus influenzae Rd
auagucaaauaac

SEQ ID NO: 2705143 - RNA, 23 nt, Haemophilus influenzae Rd
auagucauucaaugcagaaauac

SEQ ID NO: 2705144 - RNA, 22 nt, Haemophilus influenzae Rd
auagucuaacuuuuucaaugaa

SEQ ID NO: 2705145 - RNA, 21 nt, Haemophilus influenzae Rd
auaguggcaauaacuacaaca

SEQ ID NO: 2705146 - RNA, 18 nt, Haemophilus influenzae Rd
auaguuaaagaaaauauu

SEQ ID NO: 2705147 - RNA, 17 nt, Haemophilus influenzae Rd
auaucugcuuuuucuug

SEQ ID NO: 2705148 - RNA, 20 nt, Haemophilus influenzae Rd
auaucuggauguuguaaaau

SEQ ID NO: 2705149 - RNA, 17 nt, Haemophilus influenzae Rd
auaucuuauauuuuuga

SEQ ID NO: 2705150 - RNA, 15 nt, Haemophilus influenzae Rd
auaucuuccacaaca

SEQ ID NO: 2705151 - RNA, 13 nt, Haemophilus influenzae Rd
auaucuucucuug

SEQ ID NO: 2705152 - RNA, 14 nt, Haemophilus influenzae Rd
auaucuucuucuug

SEQ ID NO: 2705153 - RNA, 19 nt, Haemophilus influenzae Rd
auaucuucuucuugcaggg

SEQ ID NO: 2705154 - RNA, 22 nt, Haemophilus influenzae Rd
auaucuucuucuugcagggcuu

SEQ ID NO: 2705155 - RNA, 14 nt, Haemophilus influenzae Rd
auaucuuguugaua

SEQ ID NO: 2705156 - RNA, 13 nt, Haemophilus influenzae Rd
auaucuuuaaauu

SEQ ID NO: 2705157 - RNA, 12 nt, Haemophilus influenzae Rd
auaucuuuaccu

SEQ ID NO: 2705158 - RNA, 22 nt, Haemophilus influenzae Rd
auaucuuucucuugcguuuggu

SEQ ID NO: 2705159 - RNA, 16 nt, Haemophilus influenzae Rd
auaucuuugaauugaa

SEQ ID NO: 2705160 - RNA, 18 nt, Haemophilus influenzae Rd
auaucuuugacuaaauca

SEQ ID NO: 2705161 - RNA, 20 nt, Haemophilus influenzae Rd
auaucuuugacuaaaucaug

SEQ ID NO: 2705162 - RNA, 13 nt, Haemophilus influenzae Rd
auaugaaauuucu

SEQ ID NO: 2705163 - RNA, 22 nt, Haemophilus influenzae Rd
auaugacagauagcauaaguua

SEQ ID NO: 2705164 - RNA, 19 nt, Haemophilus influenzae Rd
auaugaccauuaaucacac

SEQ ID NO: 2705165 - RNA, 14 nt, Haemophilus influenzae Rd
auaugauaaaugca

SEQ ID NO: 2705166 - RNA, 17 nt, Haemophilus influenzae Rd
auaugaucuuuaauuaa

SEQ ID NO: 2705167 - RNA, 21 nt, Haemophilus influenzae Rd
auaugauuacgguuugcgccg

SEQ ID NO: 2705168 - RNA, 19 nt, Haemophilus influenzae Rd
auaugauuucuucaaagcu

SEQ ID NO: 2705169 - RNA, 19 nt, Haemophilus influenzae Rd
auaugcaucagauuuuucg

SEQ ID NO: 2705170 - RNA, 18 nt, Haemophilus influenzae Rd
auaugcauucaaauuuca

SEQ ID NO: 2705171 - RNA, 22 nt, Haemophilus influenzae Rd
auaugccaaauaaaauuacaaa

SEQ ID NO: 2705172 - RNA, 20 nt, Haemophilus influenzae Rd
auaugccaaggcucccgccc

SEQ ID NO: 2705173 - RNA, 16 nt, Haemophilus influenzae Rd
auaugccuuauauuuc

SEQ ID NO: 2705174 - RNA, 17 nt, Haemophilus influenzae Rd
auaugcgaucacugcac

SEQ ID NO: 2705175 - RNA, 18 nt, Haemophilus influenzae Rd
auaugcgaucacugcacc

SEQ ID NO: 2705176 - RNA, 16 nt, Haemophilus influenzae Rd
auaugcguugaugcaa

SEQ ID NO: 2705177 - RNA, 13 nt, Haemophilus influenzae Rd
auaugguaagaac

SEQ ID NO: 2705178 - RNA, 15 nt, Haemophilus influenzae Rd
auauguaaaauuuuu

SEQ ID NO: 2705179 - RNA, 14 nt, Haemophilus influenzae Rd
auauguucaacaag

SEQ ID NO: 2705180 - RNA, 22 nt, Haemophilus influenzae Rd
auauguucuaagguauaaauaa

SEQ ID NO: 2705181 - RNA, 23 nt, Haemophilus influenzae Rd
auauguugaauaguaaagaauau

SEQ ID NO: 2705182 - RNA, 15 nt, Haemophilus influenzae Rd
auauguugguaauuc

SEQ ID NO: 2705183 - RNA, 19 nt, Haemophilus influenzae Rd
auauuaagcaauugaauaa

SEQ ID NO: 2705184 - RNA, 13 nt, Haemophilus influenzae Rd
auauuaauuuuga

SEQ ID NO: 2705185 - RNA, 22 nt, Haemophilus influenzae Rd
auauuacauaccaaucacaaca

SEQ ID NO: 2705186 - RNA, 22 nt, Haemophilus influenzae Rd
auauuacccguaccuuuaaauu

SEQ ID NO: 2705187 - RNA, 19 nt, Haemophilus influenzae Rd
auauuacgcauaucacgau

SEQ ID NO: 2705188 - RNA, 22 nt, Haemophilus influenzae Rd
auauuacuaauucauuacauaa

SEQ ID NO: 2705189 - RNA, 14 nt, Haemophilus influenzae Rd
auauuacuuaacau

SEQ ID NO: 2705190 - RNA, 20 nt, Haemophilus influenzae Rd
auauuacuuaacaucaucau

SEQ ID NO: 2705191 - RNA, 14 nt, Haemophilus influenzae Rd
auauuagaaucaau

SEQ ID NO: 2705192 - RNA, 18 nt, Haemophilus influenzae Rd
auauuagaaucaauggcu

SEQ ID NO: 2705193 - RNA, 20 nt, Haemophilus influenzae Rd
auauuaguaauauauucuac

SEQ ID NO: 2705194 - RNA, 18 nt, Haemophilus influenzae Rd
auauuaguuagcuaaaaa

SEQ ID NO: 2705195 - RNA, 16 nt, Haemophilus influenzae Rd
auauuauacuuucaau

SEQ ID NO: 2705196 - RNA, 18 nt, Haemophilus influenzae Rd
auauuauacuuucaauua

SEQ ID NO: 2705197 - RNA, 22 nt, Haemophilus influenzae Rd
auauuaucuucaugauuuucca

SEQ ID NO: 2705198 - RNA, 21 nt, Haemophilus influenzae Rd
auauuaugugcuugggcaauu

SEQ ID NO: 2705199 - RNA, 18 nt, Haemophilus influenzae Rd
auauuauuaagucuauua

SEQ ID NO: 2705200 - RNA, 22 nt, Haemophilus influenzae Rd
auauuauucagcacuuucgcuu

SEQ ID NO: 2705201 - RNA, 13 nt, Haemophilus influenzae Rd
auauucaaaacau

SEQ ID NO: 2705202 - RNA, 12 nt, Haemophilus influenzae Rd
auauucaaauuu

SEQ ID NO: 2705203 - RNA, 19 nt, Haemophilus influenzae Rd
auauucaaauuucauccua

SEQ ID NO: 2705204 - RNA, 14 nt, Haemophilus influenzae Rd
auauucaauuacua

SEQ ID NO: 2705205 - RNA, 18 nt, Haemophilus influenzae Rd
auauucaauucuuuuugu

SEQ ID NO: 2705206 - RNA, 23 nt, Haemophilus influenzae Rd
auauucagacugaauuugacauu

SEQ ID NO: 2705207 - RNA, 20 nt, Haemophilus influenzae Rd
auauucauaaaaggcaaagc

SEQ ID NO: 2705208 - RNA, 13 nt, Haemophilus influenzae Rd
auauucaugaauc

SEQ ID NO: 2705209 - RNA, 19 nt, Haemophilus influenzae Rd
auauucauuuaaaacaaaa

SEQ ID NO: 2705210 - RNA, 14 nt, Haemophilus influenzae Rd
auauuccaaaaaau

SEQ ID NO: 2705211 - RNA, 15 nt, Haemophilus influenzae Rd
auauuccacaucacu

SEQ ID NO: 2705212 - RNA, 22 nt, Haemophilus influenzae Rd
auauuccauaguucacuaaaaa

SEQ ID NO: 2705213 - RNA, 22 nt, Haemophilus influenzae Rd
auauuccauuaacuaaaccauu

SEQ ID NO: 2705214 - RNA, 19 nt, Haemophilus influenzae Rd
auauuccuucggcauauaa

SEQ ID NO: 2705215 - RNA, 16 nt, Haemophilus influenzae Rd
auauucgcaccuucag

SEQ ID NO: 2705216 - RNA, 17 nt, Haemophilus influenzae Rd
auauucgccuucacaaa

SEQ ID NO: 2705217 - RNA, 18 nt, Haemophilus influenzae Rd
auauucgcuucuuuuaau

SEQ ID NO: 2705218 - RNA, 21 nt, Haemophilus influenzae Rd
auauucgcuucuuuuaauggg

SEQ ID NO: 2705219 - RNA, 14 nt, Haemophilus influenzae Rd
auauucgcuuucau

SEQ ID NO: 2705220 - RNA, 13 nt, Haemophilus influenzae Rd
auauucggaaaaa

SEQ ID NO: 2705221 - RNA, 18 nt, Haemophilus influenzae Rd
auauucguuaaauaaugc

SEQ ID NO: 2705222 - RNA, 21 nt, Haemophilus influenzae Rd
auauucuaccgcauuuuuaau

SEQ ID NO: 2705223 - RNA, 16 nt, Haemophilus influenzae Rd
auauucuauuuauaau

SEQ ID NO: 2705224 - RNA, 19 nt, Haemophilus influenzae Rd
auauucugcauaaaauaau

SEQ ID NO: 2705225 - RNA, 21 nt, Haemophilus influenzae Rd
auauucugcuaacucaucaac

SEQ ID NO: 2705226 - RNA, 17 nt, Haemophilus influenzae Rd
auauucuggcaauauuu

SEQ ID NO: 2705227 - RNA, 18 nt, Haemophilus influenzae Rd
auauucuggcaauauuuc

SEQ ID NO: 2705228 - RNA, 19 nt, Haemophilus influenzae Rd
auauucuggcaauauuuca

SEQ ID NO: 2705229 - RNA, 16 nt, Haemophilus influenzae Rd
auauucuguaucaauu

SEQ ID NO: 2705230 - RNA, 13 nt, Haemophilus influenzae Rd
auauucuguugaa

SEQ ID NO: 2705231 - RNA, 15 nt, Haemophilus influenzae Rd
auauucuucauaaaa

SEQ ID NO: 2705232 - RNA, 17 nt, Haemophilus influenzae Rd
auauucuucauaaaaaa

SEQ ID NO: 2705233 - RNA, 16 nt, Haemophilus influenzae Rd
auauucuucgcuuaau

SEQ ID NO: 2705234 - RNA, 20 nt, Haemophilus influenzae Rd
auauucuugcguaaccaaag

SEQ ID NO: 2705235 - RNA, 19 nt, Haemophilus influenzae Rd
auauucuuuaaaacauucc

SEQ ID NO: 2705236 - RNA, 16 nt, Haemophilus influenzae Rd
auauucuuuaaauauu

SEQ ID NO: 2705237 - RNA, 15 nt, Haemophilus influenzae Rd
auauucuuuuuaaau

SEQ ID NO: 2705238 - RNA, 22 nt, Haemophilus influenzae Rd
auauucuuuuuaaauauuuaaa

SEQ ID NO: 2705239 - RNA, 14 nt, Haemophilus influenzae Rd
auauugaaaaguac

SEQ ID NO: 2705240 - RNA, 15 nt, Haemophilus influenzae Rd
auauugaaauuggaa

SEQ ID NO: 2705241 - RNA, 23 nt, Haemophilus influenzae Rd
auauugaacgccuagauauuguu

SEQ ID NO: 2705242 - RNA, 16 nt, Haemophilus influenzae Rd
auauugaccauuucau

SEQ ID NO: 2705243 - RNA, 21 nt, Haemophilus influenzae Rd
auauugaccguuugaccauuc

SEQ ID NO: 2705244 - RNA, 23 nt, Haemophilus influenzae Rd
auauugaccguuugaccauucau

SEQ ID NO: 2705245 - RNA, 19 nt, Haemophilus influenzae Rd
auauugagggcuuuuuuau

SEQ ID NO: 2705246 - RNA, 16 nt, Haemophilus influenzae Rd
auauugauuauguaaa

SEQ ID NO: 2705247 - RNA, 16 nt, Haemophilus influenzae Rd
auauugcacaauagcu

SEQ ID NO: 2705248 - RNA, 23 nt, Haemophilus influenzae Rd
auauugccauaauaaucacaaca

SEQ ID NO: 2705249 - RNA, 18 nt, Haemophilus influenzae Rd
auauugcucucccuugcc

SEQ ID NO: 2705250 - RNA, 18 nt, Haemophilus influenzae Rd
auauuggaguuagaauaa

SEQ ID NO: 2705251 - RNA, 15 nt, Haemophilus influenzae Rd
auauugguagcuaaa

SEQ ID NO: 2705252 - RNA, 20 nt, Haemophilus influenzae Rd
aucagcaacauuauugccaa

SEQ ID NO: 2705253 - RNA, 18 nt, Haemophilus influenzae Rd
aucagcauauugaaauug

SEQ ID NO: 2705254 - RNA, 15 nt, Haemophilus influenzae Rd
aucagcccuuuguuu

SEQ ID NO: 2705255 - RNA, 21 nt, Haemophilus influenzae Rd
aucagccgcuuuuugaucucu

SEQ ID NO: 2705256 - RNA, 22 nt, Haemophilus influenzae Rd
aucagcgaauuaaagugcagau

SEQ ID NO: 2705257 - RNA, 23 nt, Haemophilus influenzae Rd
aucagcuaaacgcacuugauuug

SEQ ID NO: 2705258 - RNA, 21 nt, Haemophilus influenzae Rd
aucagcuacuucccaaauuuu

SEQ ID NO: 2705259 - RNA, 14 nt, Haemophilus influenzae Rd
aucagcuccuacau

SEQ ID NO: 2705260 - RNA, 17 nt, Haemophilus influenzae Rd
aucagcuccuacauuaa

SEQ ID NO: 2705261 - RNA, 18 nt, Haemophilus influenzae Rd
aucagcuccuacauuaaa

SEQ ID NO: 2705262 - RNA, 20 nt, Haemophilus influenzae Rd
aucagcuccuacauuaaaag

SEQ ID NO: 2705263 - RNA, 22 nt, Haemophilus influenzae Rd
aucagcuuuuguugcacccauu

SEQ ID NO: 2705264 - RNA, 18 nt, Haemophilus influenzae Rd
aucaggcgauccaucgcu

SEQ ID NO: 2705265 - RNA, 17 nt, Haemophilus influenzae Rd
aucaggguuauuugcaa

SEQ ID NO: 2705266 - RNA, 19 nt, Haemophilus influenzae Rd
aucagguaauuggugugca

SEQ ID NO: 2705267 - RNA, 15 nt, Haemophilus influenzae Rd
aucaguuaccauaca

SEQ ID NO: 2705268 - RNA, 19 nt, Haemophilus influenzae Rd
aucaguuaugcaaauacau

SEQ ID NO: 2705269 - RNA, 16 nt, Haemophilus influenzae Rd
aucauaaaaaaaugua

SEQ ID NO: 2705270 - RNA, 17 nt, Haemophilus influenzae Rd
aucauaaaaacaauacu

SEQ ID NO: 2705271 - RNA, 13 nt, Haemophilus influenzae Rd
aucauaaaaaugc

SEQ ID NO: 2705272 - RNA, 11 nt, Haemophilus influenzae Rd
aucauaaaauu

SEQ ID NO: 2705273 - RNA, 20 nt, Haemophilus influenzae Rd
aucauaacgggcauuuuucu

SEQ ID NO: 2705274 - RNA, 22 nt, Haemophilus influenzae Rd
aucauaacgggcauuuuucuuc

SEQ ID NO: 2705275 - RNA, 16 nt, Haemophilus influenzae Rd
aucauaaguaaaacca

SEQ ID NO: 2705276 - RNA, 17 nt, Haemophilus influenzae Rd
aucauaauccacuaaaa

SEQ ID NO: 2705277 - RNA, 18 nt, Haemophilus influenzae Rd
aucauaauccacuaaaaa

SEQ ID NO: 2705278 - RNA, 19 nt, Haemophilus influenzae Rd
aucauacauauccaacgca

SEQ ID NO: 2705279 - RNA, 19 nt, Haemophilus influenzae Rd
aucauaccaauugcaacuu

SEQ ID NO: 2705280 - RNA, 14 nt, Haemophilus influenzae Rd
aucauacuaaaaaa

SEQ ID NO: 2705281 - RNA, 21 nt, Haemophilus influenzae Rd
aucauacuaaaaaauuaaauu

SEQ ID NO: 2705282 - RNA, 21 nt, Haemophilus influenzae Rd
aucauacuaaauacauuuuua

SEQ ID NO: 2705283 - RNA, 22 nt, Haemophilus influenzae Rd
aucauacuauuacccacuucac

SEQ ID NO: 2705284 - RNA, 22 nt, Haemophilus influenzae Rd
aucauagaaccgucuuuaaaua

SEQ ID NO: 2705285 - RNA, 23 nt, Haemophilus influenzae Rd
aucauagcaacgcccuucuuuga

SEQ ID NO: 2705286 - RNA, 22 nt, Haemophilus influenzae Rd
aucauauacucguucguuauuu

SEQ ID NO: 2705287 - RNA, 17 nt, Haemophilus influenzae Rd
aucauauauucaacuaa

SEQ ID NO: 2705288 - RNA, 13 nt, Haemophilus influenzae Rd
aucauaucaucaa

SEQ ID NO: 2705289 - RNA, 15 nt, Haemophilus influenzae Rd
aucauaucuaacaua

SEQ ID NO: 2705290 - RNA, 14 nt, Haemophilus influenzae Rd
aucauauugauuua

SEQ ID NO: 2705291 - RNA, 17 nt, Haemophilus influenzae Rd
aucaucaaauugaugcu

SEQ ID NO: 2705292 - RNA, 24 nt, Haemophilus influenzae Rd
aucaucacucggagcauuuuggua

SEQ ID NO: 2705293 - RNA, 23 nt, Haemophilus influenzae Rd
aucaucagaaauauaaucaauuu

SEQ ID NO: 2705294 - RNA, 17 nt, Haemophilus influenzae Rd
aucaucagaauaauuaa

SEQ ID NO: 2705295 - RNA, 23 nt, Haemophilus influenzae Rd
aucaucagcuuaucaaucaagaa

SEQ ID NO: 2705296 - RNA, 13 nt, Haemophilus influenzae Rd
aucaucaucauuu

SEQ ID NO: 2705297 - RNA, 18 nt, Haemophilus influenzae Rd
aucaucauuaaacgaucu

SEQ ID NO: 2705298 - RNA, 20 nt, Haemophilus influenzae Rd
aucaucauuuauuaaaagua

SEQ ID NO: 2705299 - RNA, 18 nt, Haemophilus influenzae Rd
aucaucauuuuuugcuuc

SEQ ID NO: 2705300 - RNA, 15 nt, Haemophilus influenzae Rd
aucaucccuucuuuu

SEQ ID NO: 2705301 - RNA, 15 nt, Haemophilus influenzae Rd
aucaucgaaaucuaa

SEQ ID NO: 2705302 - RNA, 15 nt, Haemophilus influenzae Rd
aucaucgcccgcuuc

SEQ ID NO: 2705303 - RNA, 19 nt, Haemophilus influenzae Rd
aucaucggcaguacgaauu

SEQ ID NO: 2705304 - RNA, 15 nt, Haemophilus influenzae Rd
aucaucuagauuucu

SEQ ID NO: 2705305 - RNA, 21 nt, Haemophilus influenzae Rd
aucaucuagauuucuauccau

SEQ ID NO: 2705306 - RNA, 16 nt, Haemophilus influenzae Rd
aucaucuauaccaauu

SEQ ID NO: 2705307 - RNA, 20 nt, Haemophilus influenzae Rd
aucaucucuaaccuaaaaua

SEQ ID NO: 2705308 - RNA, 18 nt, Haemophilus influenzae Rd
aucaucugauacugccaa

SEQ ID NO: 2705309 - RNA, 16 nt, Haemophilus influenzae Rd
aucaucuguaaaccau

SEQ ID NO: 2705310 - RNA, 23 nt, Haemophilus influenzae Rd
aucaugagguuugccaucugaaa

SEQ ID NO: 2705311 - RNA, 19 nt, Haemophilus influenzae Rd
aucauggcucagauugaac

SEQ ID NO: 2705312 - RNA, 20 nt, Haemophilus influenzae Rd
aucauuaaauaacucaagca

SEQ ID NO: 2705313 - RNA, 21 nt, Haemophilus influenzae Rd
aucauuaaauauaaugaauua

SEQ ID NO: 2705314 - RNA, 15 nt, Haemophilus influenzae Rd
aucauuaaauuuagu

SEQ ID NO: 2705315 - RNA, 15 nt, Haemophilus influenzae Rd
aucauuaacuuacca

SEQ ID NO: 2705316 - RNA, 17 nt, Haemophilus influenzae Rd
aucauuaacuuaccacg

SEQ ID NO: 2705317 - RNA, 17 nt, Haemophilus influenzae Rd
aucauuaaucuuauaca

SEQ ID NO: 2705318 - RNA, 17 nt, Haemophilus influenzae Rd
aucauuacgacgugcaa

SEQ ID NO: 2705319 - RNA, 22 nt, Haemophilus influenzae Rd
aucauuacuuagauauauuauu

SEQ ID NO: 2705320 - RNA, 13 nt, Haemophilus influenzae Rd
aucauuacuuuaa

SEQ ID NO: 2705321 - RNA, 16 nt, Haemophilus influenzae Rd
aucauuaugaaaaaaa

SEQ ID NO: 2705322 - RNA, 18 nt, Haemophilus influenzae Rd
aucauucaauauaaaaaa

SEQ ID NO: 2705323 - RNA, 22 nt, Haemophilus influenzae Rd
aucauucugguaauuugcucaa

SEQ ID NO: 2705324 - RNA, 13 nt, Haemophilus influenzae Rd
aucauugaaaugu

SEQ ID NO: 2705325 - RNA, 22 nt, Haemophilus influenzae Rd
aucauugcaagugcaguuucag

SEQ ID NO: 2705326 - RNA, 21 nt, Haemophilus influenzae Rd
aucauugcuaagggcaacaau

SEQ ID NO: 2705327 - RNA, 22 nt, Haemophilus influenzae Rd
aucauuuaacggggauuuuuua

SEQ ID NO: 2705328 - RNA, 22 nt, Haemophilus influenzae Rd
aucauuucucgggcugaaauac

SEQ ID NO: 2705329 - RNA, 15 nt, Haemophilus influenzae Rd
aucauuucuuuaugu

SEQ ID NO: 2705330 - RNA, 16 nt, Haemophilus influenzae Rd
aucauuucuuuauguu

SEQ ID NO: 2705331 - RNA, 17 nt, Haemophilus influenzae Rd
aucauuucuuuauguuc

SEQ ID NO: 2705332 - RNA, 14 nt, Haemophilus influenzae Rd
aucauuugaauuaa

SEQ ID NO: 2705333 - RNA, 19 nt, Haemophilus influenzae Rd
aucauuuggaucuaaaaaa

SEQ ID NO: 2705334 - RNA, 20 nt, Haemophilus influenzae Rd
aucauuuucaaguaacuuuc

SEQ ID NO: 2705335 - RNA, 13 nt, Haemophilus influenzae Rd
aucauuuucacca

SEQ ID NO: 2705336 - RNA, 19 nt, Haemophilus influenzae Rd
aucauuuucaccaauuuau

SEQ ID NO: 2705337 - RNA, 15 nt, Haemophilus influenzae Rd
aucauuuucacuccg

SEQ ID NO: 2705338 - RNA, 13 nt, Haemophilus influenzae Rd
aucauuuuuaacc

SEQ ID NO: 2705339 - RNA, 19 nt, Haemophilus influenzae Rd
aucauuuuuauuuaauggg

SEQ ID NO: 2705340 - RNA, 21 nt, Haemophilus influenzae Rd
aucauuuuuuaacuugauuuu

SEQ ID NO: 2705341 - RNA, 13 nt, Haemophilus influenzae Rd
aucauuuuuugca

SEQ ID NO: 2705342 - RNA, 14 nt, Haemophilus influenzae Rd
auccaaaaauauaa

SEQ ID NO: 2705343 - RNA, 14 nt, Haemophilus influenzae Rd
auccaaaauuaaau

SEQ ID NO: 2705344 - RNA, 15 nt, Haemophilus influenzae Rd
auccaaaauuaaauu

SEQ ID NO: 2705345 - RNA, 22 nt, Haemophilus influenzae Rd
auccaaaauuaaauugaaaaaa

SEQ ID NO: 2705346 - RNA, 14 nt, Haemophilus influenzae Rd
auccaaaauuacuu

SEQ ID NO: 2705347 - RNA, 17 nt, Haemophilus influenzae Rd
auccaaaauuacuuuuc

SEQ ID NO: 2705348 - RNA, 22 nt, Haemophilus influenzae Rd
auccaaacuuucugcaauuaaa

SEQ ID NO: 2705349 - RNA, 14 nt, Haemophilus influenzae Rd
auccaaaucaaaaa

SEQ ID NO: 2705350 - RNA, 18 nt, Haemophilus influenzae Rd
auccaaauugagaucuuu

SEQ ID NO: 2705351 - RNA, 23 nt, Haemophilus influenzae Rd
auccaaauugagaucuuugccaa

SEQ ID NO: 2705352 - RNA, 21 nt, Haemophilus influenzae Rd
auccaaauuguccgccaucag

SEQ ID NO: 2705353 - RNA, 19 nt, Haemophilus influenzae Rd
auccaaccccauuugccaa

SEQ ID NO: 2705354 - RNA, 23 nt, Haemophilus influenzae Rd
auccaaccgauaaggaaaauacu

SEQ ID NO: 2705355 - RNA, 18 nt, Haemophilus influenzae Rd
auccaacgaagaaacaca

SEQ ID NO: 2705356 - RNA, 23 nt, Haemophilus influenzae Rd
auccuuuguugucguuauuauga

SEQ ID NO: 2705357 - RNA, 13 nt, Haemophilus influenzae Rd
aucgaaacauaaa

SEQ ID NO: 2705358 - RNA, 16 nt, Haemophilus influenzae Rd
aucgaaacgguuagua

SEQ ID NO: 2705359 - RNA, 14 nt, Haemophilus influenzae Rd
aucgaaauuaaaau

SEQ ID NO: 2705360 - RNA, 17 nt, Haemophilus influenzae Rd
aucgaaauuaaaauaau

SEQ ID NO: 2705361 - RNA, 12 nt, Haemophilus influenzae Rd
aucgaagaaaua

SEQ ID NO: 2705362 - RNA, 17 nt, Haemophilus influenzae Rd
aucgaauaauccuucuu

SEQ ID NO: 2705363 - RNA, 21 nt, Haemophilus influenzae Rd
aucgacauaacauuguuuuaa

SEQ ID NO: 2705364 - RNA, 17 nt, Haemophilus influenzae Rd
aucgacuuuuucaccau

SEQ ID NO: 2705365 - RNA, 18 nt, Haemophilus influenzae Rd
aucgagaaaauuaaaaau

SEQ ID NO: 2705366 - RNA, 16 nt, Haemophilus influenzae Rd
aucgaggccucuugcu

SEQ ID NO: 2705367 - RNA, 12 nt, Haemophilus influenzae Rd
aucgaucacuuc

SEQ ID NO: 2705368 - RNA, 16 nt, Haemophilus influenzae Rd
aucgauccucccuaau

SEQ ID NO: 2705369 - RNA, 22 nt, Haemophilus influenzae Rd
aucgauccucccuaaugauuaa

SEQ ID NO: 2705370 - RNA, 23 nt, Haemophilus influenzae Rd
aucgaugucuggcugaguaaaua

SEQ ID NO: 2705371 - RNA, 21 nt, Haemophilus influenzae Rd
aucgcaagggcugcgcccauu

SEQ ID NO: 2705372 - RNA, 15 nt, Haemophilus influenzae Rd
aucgcaauaacaccg

SEQ ID NO: 2705373 - RNA, 12 nt, Haemophilus influenzae Rd
aucgcaauauua

SEQ ID NO: 2705374 - RNA, 13 nt, Haemophilus influenzae Rd
aucgcaauauuaa

SEQ ID NO: 2705375 - RNA, 14 nt, Haemophilus influenzae Rd
aucgcaaucacgaa

SEQ ID NO: 2705376 - RNA, 12 nt, Haemophilus influenzae Rd
aucgcaggauaa

SEQ ID NO: 2705377 - RNA, 21 nt, Haemophilus influenzae Rd
aucgcaggauaagaugauaaa

SEQ ID NO: 2705378 - RNA, 16 nt, Haemophilus influenzae Rd
aucgcauaguuaucca

SEQ ID NO: 2705379 - RNA, 13 nt, Haemophilus influenzae Rd
aucgcauuaucaa

SEQ ID NO: 2705380 - RNA, 18 nt, Haemophilus influenzae Rd
aucgccacguagauacau

SEQ ID NO: 2705381 - RNA, 15 nt, Haemophilus influenzae Rd
aucgccacucacgau

SEQ ID NO: 2705382 - RNA, 18 nt, Haemophilus influenzae Rd
aucgccauuaaaauucac

SEQ ID NO: 2705383 - RNA, 15 nt, Haemophilus influenzae Rd
aucgccuaaaauugc

SEQ ID NO: 2705384 - RNA, 20 nt, Haemophilus influenzae Rd
aucgccuuaucccauaccgu

SEQ ID NO: 2705385 - RNA, 17 nt, Haemophilus influenzae Rd
aucgcugccuaauucca

SEQ ID NO: 2705386 - RNA, 18 nt, Haemophilus influenzae Rd
aucgcugccuaauuccau

SEQ ID NO: 2705387 - RNA, 22 nt, Haemophilus influenzae Rd
aucgcugcgaugguggauaaac

SEQ ID NO: 2705388 - RNA, 19 nt, Haemophilus influenzae Rd
aucgcuggcuaaauuuuug

SEQ ID NO: 2705389 - RNA, 20 nt, Haemophilus influenzae Rd
aucgcuggcuaaauuuuugg

SEQ ID NO: 2705390 - RNA, 20 nt, Haemophilus influenzae Rd
aucgcuuaggguaauuuuuu

SEQ ID NO: 2705391 - RNA, 21 nt, Haemophilus influenzae Rd
aucgcuucagaaguggaagga

SEQ ID NO: 2705392 - RNA, 13 nt, Haemophilus influenzae Rd
aucgcuucaucau

SEQ ID NO: 2705393 - RNA, 22 nt, Haemophilus influenzae Rd
aucgcuucauucucuucugggu

SEQ ID NO: 2705394 - RNA, 18 nt, Haemophilus influenzae Rd
aucgcuugcauuucuuca

SEQ ID NO: 2705395 - RNA, 22 nt, Haemophilus influenzae Rd
aucgcuugccagucauuuuuua

SEQ ID NO: 2705396 - RNA, 20 nt, Haemophilus influenzae Rd
aucgcuuguuguaaauuggu

SEQ ID NO: 2705397 - RNA, 20 nt, Haemophilus influenzae Rd
aucgcuuugagaaagaauau

SEQ ID NO: 2705398 - RNA, 16 nt, Haemophilus influenzae Rd
aucggacgaaucacaa

SEQ ID NO: 2705399 - RNA, 14 nt, Haemophilus influenzae Rd
aucggcagaauuac

SEQ ID NO: 2705400 - RNA, 15 nt, Haemophilus influenzae Rd
aucggcuuuaucauc

SEQ ID NO: 2705401 - RNA, 20 nt, Haemophilus influenzae Rd
aucgguauaggggauuuuau

SEQ ID NO: 2705402 - RNA, 19 nt, Haemophilus influenzae Rd
aucgguuaaaaguaagcaa

SEQ ID NO: 2705403 - RNA, 16 nt, Haemophilus influenzae Rd
aucgguuggauuuuaa

SEQ ID NO: 2705404 - RNA, 17 nt, Haemophilus influenzae Rd
aucgguuggauuuuaac

SEQ ID NO: 2705405 - RNA, 12 nt, Haemophilus influenzae Rd
aucguaauuaaa

SEQ ID NO: 2705406 - RNA, 14 nt, Haemophilus influenzae Rd
aucguaauuaaaau

SEQ ID NO: 2705407 - RNA, 18 nt, Haemophilus influenzae Rd
aucguaauuuuaaaacca

SEQ ID NO: 2705408 - RNA, 12 nt, Haemophilus influenzae Rd
aucguagaaauc

SEQ ID NO: 2705409 - RNA, 23 nt, Haemophilus influenzae Rd
aucguagguuuuuuuauaaacca

SEQ ID NO: 2705410 - RNA, 14 nt, Haemophilus influenzae Rd
aucguauaagcccc

SEQ ID NO: 2705411 - RNA, 15 nt, Haemophilus influenzae Rd
aucguaucaauuuua

SEQ ID NO: 2705412 - RNA, 16 nt, Haemophilus influenzae Rd
aucguaucaauuuuau

SEQ ID NO: 2705413 - RNA, 19 nt, Haemophilus influenzae Rd
aucguauucccaaauuuuu

SEQ ID NO: 2705414 - RNA, 20 nt, Haemophilus influenzae Rd
aucguauucccaaauuuuuu

SEQ ID NO: 2705415 - RNA, 15 nt, Haemophilus influenzae Rd
aucgucaaaaucauu

SEQ ID NO: 2705416 - RNA, 15 nt, Haemophilus influenzae Rd
aucgucuaucuaaga

SEQ ID NO: 2705417 - RNA, 21 nt, Haemophilus influenzae Rd
aucgucuuguuuucaauaguu

SEQ ID NO: 2705418 - RNA, 16 nt, Haemophilus influenzae Rd
aucgugacaauaacug

SEQ ID NO: 2705419 - RNA, 21 nt, Haemophilus influenzae Rd
aucgugaugauuuucauuccu

SEQ ID NO: 2705420 - RNA, 15 nt, Haemophilus influenzae Rd
aucguggucaccaag

SEQ ID NO: 2705421 - RNA, 23 nt, Haemophilus influenzae Rd
aucguguaaaaguuguuuugcuu

SEQ ID NO: 2705422 - RNA, 12 nt, Haemophilus influenzae Rd
aucguucauaaa

SEQ ID NO: 2705423 - RNA, 15 nt, Haemophilus influenzae Rd
aucguucgcacaaac

SEQ ID NO: 2705424 - RNA, 15 nt, Haemophilus influenzae Rd
aucguugcuaccacu

SEQ ID NO: 2705425 - RNA, 18 nt, Haemophilus influenzae Rd
aucguuuacaucacguaa

SEQ ID NO: 2705426 - RNA, 21 nt, Haemophilus influenzae Rd
aucguuugaacaaauucagcu

SEQ ID NO: 2705427 - RNA, 12 nt, Haemophilus influenzae Rd
aucguuuucucg

SEQ ID NO: 2705428 - RNA, 11 nt, Haemophilus influenzae Rd
aucuaaaaaag

SEQ ID NO: 2705429 - RNA, 15 nt, Haemophilus influenzae Rd
aucuaaaaaaucaau

SEQ ID NO: 2705430 - RNA, 19 nt, Haemophilus influenzae Rd
aucuaaaaacuuuuguucu

SEQ ID NO: 2705431 - RNA, 18 nt, Haemophilus influenzae Rd
aucuaaaccccguuuuuu

SEQ ID NO: 2705432 - RNA, 23 nt, Haemophilus influenzae Rd
aucuaaaccccguuuuuuagaaa

SEQ ID NO: 2705433 - RNA, 20 nt, Haemophilus influenzae Rd
aucuaaaccgauagcuuuug

SEQ ID NO: 2705434 - RNA, 15 nt, Haemophilus influenzae Rd
aucuaaacuuguuaa

SEQ ID NO: 2705435 - RNA, 14 nt, Haemophilus influenzae Rd
aucuaaacuuucau

SEQ ID NO: 2705436 - RNA, 17 nt, Haemophilus influenzae Rd
aucuaaagaaaauacaa

SEQ ID NO: 2705437 - RNA, 18 nt, Haemophilus influenzae Rd
aucuaaagcgaucaucau

SEQ ID NO: 2705438 - RNA, 20 nt, Haemophilus influenzae Rd
aucuaaaggaaucccauauu

SEQ ID NO: 2705439 - RNA, 17 nt, Haemophilus influenzae Rd
aucuaaaguuggcacuu

SEQ ID NO: 2705440 - RNA, 14 nt, Haemophilus influenzae Rd
aucuaaaucauuua

SEQ ID NO: 2705441 - RNA, 23 nt, Haemophilus influenzae Rd
aucuaaaucugguggagaaaugu

SEQ ID NO: 2705442 - RNA, 14 nt, Haemophilus influenzae Rd
aucuaaauggcaaa

SEQ ID NO: 2705443 - RNA, 14 nt, Haemophilus influenzae Rd
aucuaaauuaucgu

SEQ ID NO: 2705444 - RNA, 12 nt, Haemophilus influenzae Rd
aucuaaauuccu

SEQ ID NO: 2705445 - RNA, 13 nt, Haemophilus influenzae Rd
aucuaacaauaga

SEQ ID NO: 2705446 - RNA, 14 nt, Haemophilus influenzae Rd
aucuaacacaauaa

SEQ ID NO: 2705447 - RNA, 16 nt, Haemophilus influenzae Rd
aucuaacguuuauauu

SEQ ID NO: 2705448 - RNA, 17 nt, Haemophilus influenzae Rd
aucuaacguuuauauug

SEQ ID NO: 2705449 - RNA, 20 nt, Haemophilus influenzae Rd
aucuaacuaaaauaguugaa

SEQ ID NO: 2705450 - RNA, 14 nt, Haemophilus influenzae Rd
aucuaacucuuggc

SEQ ID NO: 2705451 - RNA, 17 nt, Haemophilus influenzae Rd
aucuaagauacccauuu

SEQ ID NO: 2705452 - RNA, 13 nt, Haemophilus influenzae Rd
aucuaagauuuua

SEQ ID NO: 2705453 - RNA, 14 nt, Haemophilus influenzae Rd
aucuaagauuuuag

SEQ ID NO: 2705454 - RNA, 20 nt, Haemophilus influenzae Rd
aucuaagauuuuaguauuuu

SEQ ID NO: 2705455 - RNA, 23 nt, Haemophilus influenzae Rd
aucuaagcgaccugaacggucau

SEQ ID NO: 2705456 - RNA, 19 nt, Haemophilus influenzae Rd
aucuaagguuuuauuuuca

SEQ ID NO: 2705457 - RNA, 14 nt, Haemophilus influenzae Rd
aucuaauaaaaagu

SEQ ID NO: 2705458 - RNA, 15 nt, Haemophilus influenzae Rd
aucuaaucauuaaca

SEQ ID NO: 2705459 - RNA, 19 nt, Haemophilus influenzae Rd
aucuaaugccgcaaauacu

SEQ ID NO: 2705460 - RNA, 15 nt, Haemophilus influenzae Rd
aucuaaugccuuucc

SEQ ID NO: 2705461 - RNA, 22 nt, Haemophilus influenzae Rd
aucuaaugccuuuccugcauca

SEQ ID NO: 2705462 - RNA, 17 nt, Haemophilus influenzae Rd
aucuucggauuuuucaa

SEQ ID NO: 2705463 - RNA, 15 nt, Haemophilus influenzae Rd
aucuucuaaaagagu

SEQ ID NO: 2705464 - RNA, 19 nt, Haemophilus influenzae Rd
aucuucuacggucgcacca

SEQ ID NO: 2705465 - RNA, 14 nt, Haemophilus influenzae Rd
aucuucuauucucu

SEQ ID NO: 2705466 - RNA, 17 nt, Haemophilus influenzae Rd
aucuucugaucaauuua

SEQ ID NO: 2705467 - RNA, 22 nt, Haemophilus influenzae Rd
aucuucugcagaaaaauguuca

SEQ ID NO: 2705468 - RNA, 15 nt, Haemophilus influenzae Rd
aucuucugcugauaa

SEQ ID NO: 2705469 - RNA, 13 nt, Haemophilus influenzae Rd
aucuucuucccaa

SEQ ID NO: 2705470 - RNA, 22 nt, Haemophilus influenzae Rd
aucuucuucuuggcaauauuua

SEQ ID NO: 2705471 - RNA, 19 nt, Haemophilus influenzae Rd
aucuucuucuuuuuucuca

SEQ ID NO: 2705472 - RNA, 12 nt, Haemophilus influenzae Rd
aucuucuuuacg

SEQ ID NO: 2705473 - RNA, 20 nt, Haemophilus influenzae Rd
aucuucuuuacgugugcgau

SEQ ID NO: 2705474 - RNA, 18 nt, Haemophilus influenzae Rd
aucuucuuugcgauuacu

SEQ ID NO: 2705475 - RNA, 14 nt, Haemophilus influenzae Rd
aucuucuuuugccc

SEQ ID NO: 2705476 - RNA, 21 nt, Haemophilus influenzae Rd
aucuugaccaucuaauugugc

SEQ ID NO: 2705477 - RNA, 22 nt, Haemophilus influenzae Rd
aucuugccaaugccaaauuucu

SEQ ID NO: 2705478 - RNA, 19 nt, Haemophilus influenzae Rd
aucuugcguuaaaucaaaa

SEQ ID NO: 2705479 - RNA, 14 nt, Haemophilus influenzae Rd
aucuuggcauuuuu

SEQ ID NO: 2705480 - RNA, 17 nt, Haemophilus influenzae Rd
aucuuggcucauuuuaa

SEQ ID NO: 2705481 - RNA, 12 nt, Haemophilus influenzae Rd
aucuugguuuaa

SEQ ID NO: 2705482 - RNA, 15 nt, Haemophilus influenzae Rd
aucuuguaauuuuuu

SEQ ID NO: 2705483 - RNA, 14 nt, Haemophilus influenzae Rd
aucuuuaaacaucg

SEQ ID NO: 2705484 - RNA, 12 nt, Haemophilus influenzae Rd
aucuuuaaagug

SEQ ID NO: 2705485 - RNA, 18 nt, Haemophilus influenzae Rd
aucuuuaaucguguucac

SEQ ID NO: 2705486 - RNA, 16 nt, Haemophilus influenzae Rd
aucuuuaauuaaaaua

SEQ ID NO: 2705487 - RNA, 22 nt, Haemophilus influenzae Rd
aucuuuaauuaaaauauuuuua

SEQ ID NO: 2705488 - RNA, 14 nt, Haemophilus influenzae Rd
aucuuuacaacugg

SEQ ID NO: 2705489 - RNA, 15 nt, Haemophilus influenzae Rd
aucuuuaccaaaaaa

SEQ ID NO: 2705490 - RNA, 16 nt, Haemophilus influenzae Rd
aucuuuaccaaaaaau

SEQ ID NO: 2705491 - RNA, 14 nt, Haemophilus influenzae Rd
aucuuuacccacac

SEQ ID NO: 2705492 - RNA, 17 nt, Haemophilus influenzae Rd
aucuuuacccauugcuc

SEQ ID NO: 2705493 - RNA, 23 nt, Haemophilus influenzae Rd
aucuuuagugagcaaacaaguuu

SEQ ID NO: 2705494 - RNA, 19 nt, Haemophilus influenzae Rd
aucuuuauuugucagauuu

SEQ ID NO: 2705495 - RNA, 22 nt, Haemophilus influenzae Rd
aucuuuauuugucagauuuacc

SEQ ID NO: 2705496 - RNA, 19 nt, Haemophilus influenzae Rd
aucuuucacugcauuuucu

SEQ ID NO: 2705497 - RNA, 18 nt, Haemophilus influenzae Rd
aucuuucgcuugcuguuu

SEQ ID NO: 2705498 - RNA, 13 nt, Haemophilus influenzae Rd
aucuuucuucgau

SEQ ID NO: 2705499 - RNA, 18 nt, Haemophilus influenzae Rd
aucuuugaauugguguuu

SEQ ID NO: 2705500 - RNA, 11 nt, Haemophilus influenzae Rd
aucuuugccaa

SEQ ID NO: 2705501 - RNA, 14 nt, Haemophilus influenzae Rd
aucuuuuauucugc

SEQ ID NO: 2705502 - RNA, 13 nt, Haemophilus influenzae Rd
aucuuuugccacg

SEQ ID NO: 2705503 - RNA, 15 nt, Haemophilus influenzae Rd
aucuuuuggguuaaa

SEQ ID NO: 2705504 - RNA, 18 nt, Haemophilus influenzae Rd
aucuuuuguuacuuucca

SEQ ID NO: 2705505 - RNA, 24 nt, Haemophilus influenzae Rd
aucuuuuucuguaauauaugaaaa

SEQ ID NO: 2705506 - RNA, 12 nt, Haemophilus influenzae Rd
aucuuuuucuuu

SEQ ID NO: 2705507 - RNA, 22 nt, Haemophilus influenzae Rd
aucuuuuuguuaauaaaagaau

SEQ ID NO: 2705508 - RNA, 22 nt, Haemophilus influenzae Rd
aucuuuuuucuugcuaaaaaga

SEQ ID NO: 2705509 - RNA, 19 nt, Haemophilus influenzae Rd
augaaaaacauucaaucuu

SEQ ID NO: 2705510 - RNA, 12 nt, Haemophilus influenzae Rd
augaaaaauaau

SEQ ID NO: 2705511 - RNA, 13 nt, Haemophilus influenzae Rd
augaaaaauaauc

SEQ ID NO: 2705512 - RNA, 15 nt, Haemophilus influenzae Rd
augaaaauuaucugc

SEQ ID NO: 2705513 - RNA, 19 nt, Haemophilus influenzae Rd
augaaacagcuaaaaauga

SEQ ID NO: 2705514 - RNA, 19 nt, Haemophilus influenzae Rd
augaaacgagauuuauuuu

SEQ ID NO: 2705515 - RNA, 16 nt, Haemophilus influenzae Rd
augaaagggaaauaac

SEQ ID NO: 2705516 - RNA, 20 nt, Haemophilus influenzae Rd
augaaaguaacaauguagaa

SEQ ID NO: 2705517 - RNA, 16 nt, Haemophilus influenzae Rd
augaaaguugaauauu

SEQ ID NO: 2705518 - RNA, 21 nt, Haemophilus influenzae Rd
augaaaguugaauauuuuguu

SEQ ID NO: 2705519 - RNA, 17 nt, Haemophilus influenzae Rd
augaaauauuuuuauuu

SEQ ID NO: 2705520 - RNA, 15 nt, Haemophilus influenzae Rd
augaaaucaaacaac

SEQ ID NO: 2705521 - RNA, 15 nt, Haemophilus influenzae Rd
augaaaucauuacac

SEQ ID NO: 2705522 - RNA, 17 nt, Haemophilus influenzae Rd
augaaaucauuacacag

SEQ ID NO: 2705523 - RNA, 23 nt, Haemophilus influenzae Rd
augaaaucauuuguaaguuguaa

SEQ ID NO: 2705524 - RNA, 22 nt, Haemophilus influenzae Rd
augaaaucgcaguuucuuuguu

SEQ ID NO: 2705525 - RNA, 19 nt, Haemophilus influenzae Rd
augaaaugcccguuacuuu

SEQ ID NO: 2705526 - RNA, 21 nt, Haemophilus influenzae Rd
augaaauuaaccccagaaaug

SEQ ID NO: 2705527 - RNA, 22 nt, Haemophilus influenzae Rd
augaaauuagguuauuuuuuca

SEQ ID NO: 2705528 - RNA, 13 nt, Haemophilus influenzae Rd
augaaauuaucau

SEQ ID NO: 2705529 - RNA, 14 nt, Haemophilus influenzae Rd
augaaauucaguga

SEQ ID NO: 2705530 - RNA, 12 nt, Haemophilus influenzae Rd
augaaauugcug

SEQ ID NO: 2705531 - RNA, 18 nt, Haemophilus influenzae Rd
augaaauuuauuauaaaa

SEQ ID NO: 2705532 - RNA, 21 nt, Haemophilus influenzae Rd
augaaauuucuuuaauugauu

SEQ ID NO: 2705533 - RNA, 17 nt, Haemophilus influenzae Rd
augaaauuugaauauaa

SEQ ID NO: 2705534 - RNA, 15 nt, Haemophilus influenzae Rd
augaaauuuguugau

SEQ ID NO: 2705535 - RNA, 13 nt, Haemophilus influenzae Rd
augaacaagcacc

SEQ ID NO: 2705536 - RNA, 17 nt, Haemophilus influenzae Rd
augaacaagcacccauu

SEQ ID NO: 2705537 - RNA, 14 nt, Haemophilus influenzae Rd
augaaccaaaucua

SEQ ID NO: 2705538 - RNA, 18 nt, Haemophilus influenzae Rd
augaacgaguaaauuaau

SEQ ID NO: 2705539 - RNA, 14 nt, Haemophilus influenzae Rd
augaacuguaauuu

SEQ ID NO: 2705540 - RNA, 22 nt, Haemophilus influenzae Rd
augaacuuaugugcaccuucaa

SEQ ID NO: 2705541 - RNA, 20 nt, Haemophilus influenzae Rd
augaacuuucuacgacauuu

SEQ ID NO: 2705542 - RNA, 15 nt, Haemophilus influenzae Rd
augaacuuuuuuaua

SEQ ID NO: 2705543 - RNA, 19 nt, Haemophilus influenzae Rd
augaagaaaauuucugcug

SEQ ID NO: 2705544 - RNA, 17 nt, Haemophilus influenzae Rd
augaagaacaaggggaa

SEQ ID NO: 2705545 - RNA, 15 nt, Haemophilus influenzae Rd
augaagugaaagaua

SEQ ID NO: 2705546 - RNA, 18 nt, Haemophilus influenzae Rd
augaaguucacuucaucu

SEQ ID NO: 2705547 - RNA, 22 nt, Haemophilus influenzae Rd
augaaguucacuucaucuauau

SEQ ID NO: 2705548 - RNA, 15 nt, Haemophilus influenzae Rd
augaauaaaaauggu

SEQ ID NO: 2705549 - RNA, 12 nt, Haemophilus influenzae Rd
augaauaaaauu

SEQ ID NO: 2705550 - RNA, 18 nt, Haemophilus influenzae Rd
augaauaaaauuuuuaaa

SEQ ID NO: 2705551 - RNA, 21 nt, Haemophilus influenzae Rd
augaauaacuuuaauuuucca

SEQ ID NO: 2705552 - RNA, 18 nt, Haemophilus influenzae Rd
augaauaagcgaaaaaca

SEQ ID NO: 2705553 - RNA, 16 nt, Haemophilus influenzae Rd
augaauaauucaaaac

SEQ ID NO: 2705554 - RNA, 14 nt, Haemophilus influenzae Rd
augaauauaaaauu

SEQ ID NO: 2705555 - RNA, 20 nt, Haemophilus influenzae Rd
augaaucguuuguucugaca

SEQ ID NO: 2705556 - RNA, 20 nt, Haemophilus influenzae Rd
augaaucguuuuuuccaguu

SEQ ID NO: 2705557 - RNA, 20 nt, Haemophilus influenzae Rd
augaauggguuaguaagugg

SEQ ID NO: 2705558 - RNA, 14 nt, Haemophilus influenzae Rd
augaauguuucaaa

SEQ ID NO: 2705559 - RNA, 18 nt, Haemophilus influenzae Rd
augaauuaguuucaacuu

SEQ ID NO: 2705560 - RNA, 23 nt, Haemophilus influenzae Rd
augaauuucgccuguuucacgau

SEQ ID NO: 2705561 - RNA, 20 nt, Haemophilus influenzae Rd
augaauuucuaauuuuuguu

SEQ ID NO: 2705562 - RNA, 22 nt, Haemophilus influenzae Rd
augacaaaagugcgguuaauuu

SEQ ID NO: 2705563 - RNA, 19 nt, Haemophilus influenzae Rd
augacaccuuuaaaaauua

SEQ ID NO: 2705564 - RNA, 20 nt, Haemophilus influenzae Rd
augacagucgauuacaaaaa

SEQ ID NO: 2705565 - RNA, 15 nt, Haemophilus influenzae Rd
augacauauaauauu

SEQ ID NO: 2705566 - RNA, 22 nt, Haemophilus influenzae Rd
augacauaucaauuugccauuu

SEQ ID NO: 2705567 - RNA, 15 nt, Haemophilus influenzae Rd
augccaagauaacca

SEQ ID NO: 2705568 - RNA, 11 nt, Haemophilus influenzae Rd
augccaagauu

SEQ ID NO: 2705569 - RNA, 13 nt, Haemophilus influenzae Rd
augccaagauuuc

SEQ ID NO: 2705570 - RNA, 16 nt, Haemophilus influenzae Rd
augccaaucacaauga

SEQ ID NO: 2705571 - RNA, 13 nt, Haemophilus influenzae Rd
augccaaucuaaa

SEQ ID NO: 2705572 - RNA, 14 nt, Haemophilus influenzae Rd
augccacaaauaaa

SEQ ID NO: 2705573 - RNA, 22 nt, Haemophilus influenzae Rd
augccaccgcgaucuguuuuaa

SEQ ID NO: 2705574 - RNA, 14 nt, Haemophilus influenzae Rd
augccauuaaacuu

SEQ ID NO: 2705575 - RNA, 16 nt, Haemophilus influenzae Rd
augccauuaaacuucu

SEQ ID NO: 2705576 - RNA, 13 nt, Haemophilus influenzae Rd
augcccaagugcg

SEQ ID NO: 2705577 - RNA, 17 nt, Haemophilus influenzae Rd
augcccacuuuuccuaa

SEQ ID NO: 2705578 - RNA, 13 nt, Haemophilus influenzae Rd
augcccagcaauu

SEQ ID NO: 2705579 - RNA, 17 nt, Haemophilus influenzae Rd
augccccuaauuauuua

SEQ ID NO: 2705580 - RNA, 17 nt, Haemophilus influenzae Rd
augccgaagccuuguaa

SEQ ID NO: 2705581 - RNA, 21 nt, Haemophilus influenzae Rd
augccgaagccuuguaaaauu

SEQ ID NO: 2705582 - RNA, 18 nt, Haemophilus influenzae Rd
augccgauaauagacaua

SEQ ID NO: 2705583 - RNA, 17 nt, Haemophilus influenzae Rd
augccgcaaucaagcaa

SEQ ID NO: 2705584 - RNA, 18 nt, Haemophilus influenzae Rd
augccgccuuuuaauaaa

SEQ ID NO: 2705585 - RNA, 14 nt, Haemophilus influenzae Rd
augccguauuuuuc

SEQ ID NO: 2705586 - RNA, 14 nt, Haemophilus influenzae Rd
augccuacuuuuua

SEQ ID NO: 2705587 - RNA, 17 nt, Haemophilus influenzae Rd
augccuacuuuuuauuu

SEQ ID NO: 2705588 - RNA, 21 nt, Haemophilus influenzae Rd
augccucaucuuuuggguuaa

SEQ ID NO: 2705589 - RNA, 14 nt, Haemophilus influenzae Rd
augccucuuuuuuc

SEQ ID NO: 2705590 - RNA, 20 nt, Haemophilus influenzae Rd
augccucuuuuuucauugca

SEQ ID NO: 2705591 - RNA, 14 nt, Haemophilus influenzae Rd
augccuuauauuuc

SEQ ID NO: 2705592 - RNA, 15 nt, Haemophilus influenzae Rd
augccuuauauuuca

SEQ ID NO: 2705593 - RNA, 13 nt, Haemophilus influenzae Rd
augccuuccgcuu

SEQ ID NO: 2705594 - RNA, 17 nt, Haemophilus influenzae Rd
augccuucuucacuacu

SEQ ID NO: 2705595 - RNA, 19 nt, Haemophilus influenzae Rd
augccuucuucacuacuug

SEQ ID NO: 2705596 - RNA, 14 nt, Haemophilus influenzae Rd
augcgaacagguuc

SEQ ID NO: 2705597 - RNA, 17 nt, Haemophilus influenzae Rd
augcgaucuuuuguuac

SEQ ID NO: 2705598 - RNA, 21 nt, Haemophilus influenzae Rd
augcgcccuuuaaauuacauu

SEQ ID NO: 2705599 - RNA, 16 nt, Haemophilus influenzae Rd
augcgcugauuuuuca

SEQ ID NO: 2705600 - RNA, 21 nt, Haemophilus influenzae Rd
augcggacuuuuucauuaucu

SEQ ID NO: 2705601 - RNA, 22 nt, Haemophilus influenzae Rd
augcggcaaugguuaauacaaa

SEQ ID NO: 2705602 - RNA, 17 nt, Haemophilus influenzae Rd
augcggugaaauuucac

SEQ ID NO: 2705603 - RNA, 24 nt, Haemophilus influenzae Rd
augcguagaaagaugggugguauc

SEQ ID NO: 2705604 - RNA, 15 nt, Haemophilus influenzae Rd
augcgugaacugcuu

SEQ ID NO: 2705605 - RNA, 22 nt, Haemophilus influenzae Rd
augcgugguuacgaaaaguuga

SEQ ID NO: 2705606 - RNA, 14 nt, Haemophilus influenzae Rd
augcguucagaauu

SEQ ID NO: 2705607 - RNA, 18 nt, Haemophilus influenzae Rd
augcguucgauaacaauu

SEQ ID NO: 2705608 - RNA, 24 nt, Haemophilus influenzae Rd
augcguucgauaacaauuuuugca

SEQ ID NO: 2705609 - RNA, 17 nt, Haemophilus influenzae Rd
augcguuuuauggcuug

SEQ ID NO: 2705610 - RNA, 15 nt, Haemophilus influenzae Rd
augcuaaacguucuu

SEQ ID NO: 2705611 - RNA, 16 nt, Haemophilus influenzae Rd
augcuaaauauauauc

SEQ ID NO: 2705612 - RNA, 13 nt, Haemophilus influenzae Rd
augcuaauuucaa

SEQ ID NO: 2705613 - RNA, 17 nt, Haemophilus influenzae Rd
augcucccaaauugugu

SEQ ID NO: 2705614 - RNA, 16 nt, Haemophilus influenzae Rd
augcucgcuuuuguau

SEQ ID NO: 2705615 - RNA, 14 nt, Haemophilus influenzae Rd
augcucucuuuuaa

SEQ ID NO: 2705616 - RNA, 14 nt, Haemophilus influenzae Rd
augcugagauuuug

SEQ ID NO: 2705617 - RNA, 12 nt, Haemophilus influenzae Rd
augcugaguaau

SEQ ID NO: 2705618 - RNA, 17 nt, Haemophilus influenzae Rd
augcugaguaccaaaag

SEQ ID NO: 2705619 - RNA, 23 nt, Haemophilus influenzae Rd
augcugauuugacagaauuacgu

SEQ ID NO: 2705620 - RNA, 14 nt, Haemophilus influenzae Rd
augcugcaaaagcu

SEQ ID NO: 2705621 - RNA, 16 nt, Haemophilus influenzae Rd
augcuguuuaaaucua

SEQ ID NO: 2705622 - RNA, 15 nt, Haemophilus influenzae Rd
augcuuacaaaauua

SEQ ID NO: 2705623 - RNA, 16 nt, Haemophilus influenzae Rd
augcuuauaaaacaga

SEQ ID NO: 2705624 - RNA, 20 nt, Haemophilus influenzae Rd
augcuucagcguugucauca

SEQ ID NO: 2705625 - RNA, 22 nt, Haemophilus influenzae Rd
augcuucagcguugucaucaga

SEQ ID NO: 2705626 - RNA, 16 nt, Haemophilus influenzae Rd
augcuucuaaucccau

SEQ ID NO: 2705627 - RNA, 15 nt, Haemophilus influenzae Rd
augcuuuaacaccaa

SEQ ID NO: 2705628 - RNA, 21 nt, Haemophilus influenzae Rd
augcuuuaaucauuuucacuc

SEQ ID NO: 2705629 - RNA, 20 nt, Haemophilus influenzae Rd
augcuuuauuuaaauuaaaa

SEQ ID NO: 2705630 - RNA, 21 nt, Haemophilus influenzae Rd
augcuuuauuuagaauuuuua

SEQ ID NO: 2705631 - RNA, 12 nt, Haemophilus influenzae Rd
augcuuucagau

SEQ ID NO: 2705632 - RNA, 16 nt, Haemophilus influenzae Rd
augcuuucagauaacg

SEQ ID NO: 2705633 - RNA, 17 nt, Haemophilus influenzae Rd
augcuuuugaugccaag

SEQ ID NO: 2705634 - RNA, 18 nt, Haemophilus influenzae Rd
augcuuuugaugccaaga

SEQ ID NO: 2705635 - RNA, 20 nt, Haemophilus influenzae Rd
augcuuuugccgaaaauggu

SEQ ID NO: 2705636 - RNA, 15 nt, Haemophilus influenzae Rd
auggaacaguugaaa

SEQ ID NO: 2705637 - RNA, 19 nt, Haemophilus influenzae Rd
auggaacguuuuuuacuug

SEQ ID NO: 2705638 - RNA, 16 nt, Haemophilus influenzae Rd
auggaauguagauaau

SEQ ID NO: 2705639 - RNA, 14 nt, Haemophilus influenzae Rd
auggacagaauaac

SEQ ID NO: 2705640 - RNA, 22 nt, Haemophilus influenzae Rd
auggacagaauaacuagcaauc

SEQ ID NO: 2705641 - RNA, 20 nt, Haemophilus influenzae Rd
auggagagaauagcuauuuu

SEQ ID NO: 2705642 - RNA, 21 nt, Haemophilus influenzae Rd
auggagagaauagcuauuuuu

SEQ ID NO: 2705643 - RNA, 19 nt, Haemophilus influenzae Rd
auggauaaaccguacaaac

SEQ ID NO: 2705644 - RNA, 14 nt, Haemophilus influenzae Rd
auggaugaauacaa

SEQ ID NO: 2705645 - RNA, 20 nt, Haemophilus influenzae Rd
auggauuauaaauagaauau

SEQ ID NO: 2705646 - RNA, 17 nt, Haemophilus influenzae Rd
auggauuuuucuucuag

SEQ ID NO: 2705647 - RNA, 19 nt, Haemophilus influenzae Rd
auggcaaaauuuaguccuu

SEQ ID NO: 2705648 - RNA, 15 nt, Haemophilus influenzae Rd
auggcaaacaaaaua

SEQ ID NO: 2705649 - RNA, 18 nt, Haemophilus influenzae Rd
auggcaaacaaaauaaau

SEQ ID NO: 2705650 - RNA, 13 nt, Haemophilus influenzae Rd
auggcaaucacaa

SEQ ID NO: 2705651 - RNA, 14 nt, Haemophilus influenzae Rd
auggcaaucacaaa

SEQ ID NO: 2705652 - RNA, 19 nt, Haemophilus influenzae Rd
auggcaaucacaaauccau

SEQ ID NO: 2705653 - RNA, 22 nt, Haemophilus influenzae Rd
auggcaauucgugaagugauuc

SEQ ID NO: 2705654 - RNA, 15 nt, Haemophilus influenzae Rd
auggcauuuauaaac

SEQ ID NO: 2705655 - RNA, 17 nt, Haemophilus influenzae Rd
auggccaauuucaucgc

SEQ ID NO: 2705656 - RNA, 12 nt, Haemophilus influenzae Rd
auggcgaccauu

SEQ ID NO: 2705657 - RNA, 18 nt, Haemophilus influenzae Rd
auggcgguaaaaaaguaa

SEQ ID NO: 2705658 - RNA, 18 nt, Haemophilus influenzae Rd
auggcgguauauucugua

SEQ ID NO: 2705659 - RNA, 19 nt, Haemophilus influenzae Rd
auggcgugaaauauugauc

SEQ ID NO: 2705660 - RNA, 13 nt, Haemophilus influenzae Rd
auggcuaaagaaa

SEQ ID NO: 2705661 - RNA, 19 nt, Haemophilus influenzae Rd
auggcuaucugcuuuucuu

SEQ ID NO: 2705662 - RNA, 14 nt, Haemophilus influenzae Rd
auggcuauuuaagc

SEQ ID NO: 2705663 - RNA, 19 nt, Haemophilus influenzae Rd
auggcuauuuaagccuuga

SEQ ID NO: 2705664 - RNA, 16 nt, Haemophilus influenzae Rd
auggcucgaaaguuac

SEQ ID NO: 2705665 - RNA, 17 nt, Haemophilus influenzae Rd
auggcucuaaauuaauu

SEQ ID NO: 2705666 - RNA, 19 nt, Haemophilus influenzae Rd
auggcucuaaauuaauuua

SEQ ID NO: 2705667 - RNA, 14 nt, Haemophilus influenzae Rd
auggcugaaaaauu

SEQ ID NO: 2705668 - RNA, 21 nt, Haemophilus influenzae Rd
auggcugaaaaauucaaagaa

SEQ ID NO: 2705669 - RNA, 23 nt, Haemophilus influenzae Rd
auggcugaucuugguagaaaauu

SEQ ID NO: 2705670 - RNA, 18 nt, Haemophilus influenzae Rd
auggcuuucaauuucacg

SEQ ID NO: 2705671 - RNA, 14 nt, Haemophilus influenzae Rd
auggcuuuuuccug

SEQ ID NO: 2705672 - RNA, 16 nt, Haemophilus influenzae Rd
augggauaaacauuuc

SEQ ID NO: 2705673 - RNA, 21 nt, Haemophilus influenzae Rd
auuaaaacuugacguuguucu

SEQ ID NO: 2705674 - RNA, 23 nt, Haemophilus influenzae Rd
auuaaaacuugggugauccauua

SEQ ID NO: 2705675 - RNA, 18 nt, Haemophilus influenzae Rd
auuaaaagaagcgaauau

SEQ ID NO: 2705676 - RNA, 17 nt, Haemophilus influenzae Rd
auuaaaagauacacuca

SEQ ID NO: 2705677 - RNA, 16 nt, Haemophilus influenzae Rd
auuaaaaggacuaaac

SEQ ID NO: 2705678 - RNA, 13 nt, Haemophilus influenzae Rd
auuaaaaguagaa

SEQ ID NO: 2705679 - RNA, 22 nt, Haemophilus influenzae Rd
auuaaaaguccgcugcucuacc

SEQ ID NO: 2705680 - RNA, 17 nt, Haemophilus influenzae Rd
auuaaaaucacauaaaa

SEQ ID NO: 2705681 - RNA, 21 nt, Haemophilus influenzae Rd
auuaaaaucacauaaaaaaug

SEQ ID NO: 2705682 - RNA, 14 nt, Haemophilus influenzae Rd
auuaaaaucugugc

SEQ ID NO: 2705683 - RNA, 18 nt, Haemophilus influenzae Rd
auuaaaauuccuuauuuu

SEQ ID NO: 2705684 - RNA, 16 nt, Haemophilus influenzae Rd
auuaaacaaaaaccau

SEQ ID NO: 2705685 - RNA, 14 nt, Haemophilus influenzae Rd
auuaaacagccaaa

SEQ ID NO: 2705686 - RNA, 14 nt, Haemophilus influenzae Rd
auuaaacgcaacau

SEQ ID NO: 2705687 - RNA, 22 nt, Haemophilus influenzae Rd
auuaaacggcucacauccauuc

SEQ ID NO: 2705688 - RNA, 19 nt, Haemophilus influenzae Rd
auuaaacgugauuuaccaa

SEQ ID NO: 2705689 - RNA, 10 nt, Haemophilus influenzae Rd
auuaaacuga

SEQ ID NO: 2705690 - RNA, 12 nt, Haemophilus influenzae Rd
auuaaacugaau

SEQ ID NO: 2705691 - RNA, 11 nt, Haemophilus influenzae Rd
auuaaacugau

SEQ ID NO: 2705692 - RNA, 15 nt, Haemophilus influenzae Rd
auuaaagaaaauaca

SEQ ID NO: 2705693 - RNA, 21 nt, Haemophilus influenzae Rd
auuaaagaguuauaaacccau

SEQ ID NO: 2705694 - RNA, 17 nt, Haemophilus influenzae Rd
auuaaagauaguaaugu

SEQ ID NO: 2705695 - RNA, 21 nt, Haemophilus influenzae Rd
auuaaagggcugcuacaauuu

SEQ ID NO: 2705696 - RNA, 19 nt, Haemophilus influenzae Rd
auuaaagucccaaaagcaa

SEQ ID NO: 2705697 - RNA, 18 nt, Haemophilus influenzae Rd
auuaaagucuaauaugau

SEQ ID NO: 2705698 - RNA, 11 nt, Haemophilus influenzae Rd
auuaaagugac

SEQ ID NO: 2705699 - RNA, 19 nt, Haemophilus influenzae Rd
auuaaagugcgguaaauuu

SEQ ID NO: 2705700 - RNA, 19 nt, Haemophilus influenzae Rd
auuaaaguuacuuugcauu

SEQ ID NO: 2705701 - RNA, 19 nt, Haemophilus influenzae Rd
auuaaauagcgaacaugcg

SEQ ID NO: 2705702 - RNA, 22 nt, Haemophilus influenzae Rd
auuaaauauaggguaaauaaaa

SEQ ID NO: 2705703 - RNA, 17 nt, Haemophilus influenzae Rd
auuaaaucaaaaauuaa

SEQ ID NO: 2705704 - RNA, 14 nt, Haemophilus influenzae Rd
auuaaauguauuuu

SEQ ID NO: 2705705 - RNA, 17 nt, Haemophilus influenzae Rd
auuaaauguauuuucca

SEQ ID NO: 2705706 - RNA, 23 nt, Haemophilus influenzae Rd
auuaaauuaccaugauccacaua

SEQ ID NO: 2705707 - RNA, 18 nt, Haemophilus influenzae Rd
auuaacaaauaauuauua

SEQ ID NO: 2705708 - RNA, 14 nt, Haemophilus influenzae Rd
auuaacagaauuug

SEQ ID NO: 2705709 - RNA, 18 nt, Haemophilus influenzae Rd
auuaacagcaaacuuaaa

SEQ ID NO: 2705710 - RNA, 22 nt, Haemophilus influenzae Rd
auuaacaucuuaguauuuuauu

SEQ ID NO: 2705711 - RNA, 13 nt, Haemophilus influenzae Rd
auuaaccaacaua

SEQ ID NO: 2705712 - RNA, 14 nt, Haemophilus influenzae Rd
auuaaccaacauaa

SEQ ID NO: 2705713 - RNA, 18 nt, Haemophilus influenzae Rd
auuaaccccagaaaugcu

SEQ ID NO: 2705714 - RNA, 17 nt, Haemophilus influenzae Rd
auuaaccgcacuuuaaa

SEQ ID NO: 2705715 - RNA, 18 nt, Haemophilus influenzae Rd
auuaaccgcacuuuaaau

SEQ ID NO: 2705716 - RNA, 16 nt, Haemophilus influenzae Rd
auuaaccguuuuuauu

SEQ ID NO: 2705717 - RNA, 21 nt, Haemophilus influenzae Rd
auuaacgcucaaaaauuucag

SEQ ID NO: 2705718 - RNA, 22 nt, Haemophilus influenzae Rd
auuaacgcucaaaaauuucaga

SEQ ID NO: 2705719 - RNA, 20 nt, Haemophilus influenzae Rd
auuaacgggcuuaaacuuuu

SEQ ID NO: 2705720 - RNA, 13 nt, Haemophilus influenzae Rd
auuaacguaagaa

SEQ ID NO: 2705721 - RNA, 14 nt, Haemophilus influenzae Rd
auuaacgugcauuu

SEQ ID NO: 2705722 - RNA, 14 nt, Haemophilus influenzae Rd
auuaacguuauaaa

SEQ ID NO: 2705723 - RNA, 13 nt, Haemophilus influenzae Rd
auuaacuaaacca

SEQ ID NO: 2705724 - RNA, 19 nt, Haemophilus influenzae Rd
auuaacuaaaccauuuaau

SEQ ID NO: 2705725 - RNA, 18 nt, Haemophilus influenzae Rd
auuaacuuaucuaaaaag

SEQ ID NO: 2705726 - RNA, 20 nt, Haemophilus influenzae Rd
auuaacuuaucuaaaaagau

SEQ ID NO: 2705727 - RNA, 15 nt, Haemophilus influenzae Rd
auuaagaaaauaaua

SEQ ID NO: 2705728 - RNA, 19 nt, Haemophilus influenzae Rd
auuaagaaagguugguuga

SEQ ID NO: 2705729 - RNA, 11 nt, Haemophilus influenzae Rd
auuaagaauac

SEQ ID NO: 2705730 - RNA, 23 nt, Haemophilus influenzae Rd
auuaagaauaccgaguucaagug

SEQ ID NO: 2705731 - RNA, 23 nt, Haemophilus influenzae Rd
auuaagauggcuauuuaagccuu

SEQ ID NO: 2705732 - RNA, 23 nt, Haemophilus influenzae Rd
auuaagcacaggcguaauuaagg

SEQ ID NO: 2705733 - RNA, 15 nt, Haemophilus influenzae Rd
auuaagccauuggaa

SEQ ID NO: 2705734 - RNA, 14 nt, Haemophilus influenzae Rd
auuaagccugcaaa

SEQ ID NO: 2705735 - RNA, 22 nt, Haemophilus influenzae Rd
auuaagcucaacugccacuaau

SEQ ID NO: 2705736 - RNA, 23 nt, Haemophilus influenzae Rd
auuaagggcgcagacugcauauc

SEQ ID NO: 2705737 - RNA, 16 nt, Haemophilus influenzae Rd
auuaaggggauucgau

SEQ ID NO: 2705738 - RNA, 17 nt, Haemophilus influenzae Rd
auuaagguaauauguaa

SEQ ID NO: 2705739 - RNA, 21 nt, Haemophilus influenzae Rd
auuaaggugcagauuaaauau

SEQ ID NO: 2705740 - RNA, 20 nt, Haemophilus influenzae Rd
auuaagguuagaauguagcu

SEQ ID NO: 2705741 - RNA, 15 nt, Haemophilus influenzae Rd
auuaagguuggaaua

SEQ ID NO: 2705742 - RNA, 16 nt, Haemophilus influenzae Rd
auuaagguuucuucua

SEQ ID NO: 2705743 - RNA, 13 nt, Haemophilus influenzae Rd
auuaaguaaauau

SEQ ID NO: 2705744 - RNA, 14 nt, Haemophilus influenzae Rd
auuaaguauaaauc

SEQ ID NO: 2705745 - RNA, 17 nt, Haemophilus influenzae Rd
auuaaguauaacuaauu

SEQ ID NO: 2705746 - RNA, 19 nt, Haemophilus influenzae Rd
auuaaguauagcuuuuugc

SEQ ID NO: 2705747 - RNA, 14 nt, Haemophilus influenzae Rd
auuaagugauguuc

SEQ ID NO: 2705748 - RNA, 21 nt, Haemophilus influenzae Rd
auuaagugcggugaaaaauca

SEQ ID NO: 2705749 - RNA, 14 nt, Haemophilus influenzae Rd
auuaaguuaaaagu

SEQ ID NO: 2705750 - RNA, 14 nt, Haemophilus influenzae Rd
auuaaguucaaauu

SEQ ID NO: 2705751 - RNA, 20 nt, Haemophilus influenzae Rd
auuaaguuugagcaaaucaa

SEQ ID NO: 2705752 - RNA, 21 nt, Haemophilus influenzae Rd
auuaaguuugagcaaaucaaa

SEQ ID NO: 2705753 - RNA, 13 nt, Haemophilus influenzae Rd
auuaaguuuucua

SEQ ID NO: 2705754 - RNA, 13 nt, Haemophilus influenzae Rd
auuaauaaaccaa

SEQ ID NO: 2705755 - RNA, 19 nt, Haemophilus influenzae Rd
auuaauaaaccaacauaca

SEQ ID NO: 2705756 - RNA, 18 nt, Haemophilus influenzae Rd
auuaauaaacugcgaucu

SEQ ID NO: 2705757 - RNA, 13 nt, Haemophilus influenzae Rd
auuaauaaauauu

SEQ ID NO: 2705758 - RNA, 14 nt, Haemophilus influenzae Rd
auuaauaaauauua

SEQ ID NO: 2705759 - RNA, 16 nt, Haemophilus influenzae Rd
auuaauaaauuuuucg

SEQ ID NO: 2705760 - RNA, 19 nt, Haemophilus influenzae Rd
auuaauaacgcaagcacca

SEQ ID NO: 2705761 - RNA, 21 nt, Haemophilus influenzae Rd
auuaauaacguguaaauugcu

SEQ ID NO: 2705762 - RNA, 16 nt, Haemophilus influenzae Rd
auuaauaacugaauaa

SEQ ID NO: 2705763 - RNA, 15 nt, Haemophilus influenzae Rd
auuaauaagaaagaa

SEQ ID NO: 2705764 - RNA, 15 nt, Haemophilus influenzae Rd
auuaauaagccauuu

SEQ ID NO: 2705765 - RNA, 22 nt, Haemophilus influenzae Rd
auuaauaccaauaauaauaucg

SEQ ID NO: 2705766 - RNA, 17 nt, Haemophilus influenzae Rd
auuaauacgucaauugc

SEQ ID NO: 2705767 - RNA, 20 nt, Haemophilus influenzae Rd
auuaauacgucaauugcuaa

SEQ ID NO: 2705768 - RNA, 14 nt, Haemophilus influenzae Rd
auuaauacugaaau

SEQ ID NO: 2705769 - RNA, 18 nt, Haemophilus influenzae Rd
auuaauaggaauaacaca

SEQ ID NO: 2705770 - RNA, 22 nt, Haemophilus influenzae Rd
auuaauauaaaggauuuuauca

SEQ ID NO: 2705771 - RNA, 15 nt, Haemophilus influenzae Rd
auuaaucaaaaauug

SEQ ID NO: 2705772 - RNA, 21 nt, Haemophilus influenzae Rd
auuaaucaauaagaaauccac

SEQ ID NO: 2705773 - RNA, 20 nt, Haemophilus influenzae Rd
auuaaucaccauaucaauuu

SEQ ID NO: 2705774 - RNA, 15 nt, Haemophilus influenzae Rd
auuaaucauaaaaau

SEQ ID NO: 2705775 - RNA, 14 nt, Haemophilus influenzae Rd
auuaaucauuucaa

SEQ ID NO: 2705776 - RNA, 15 nt, Haemophilus influenzae Rd
auuaauccaucauuu

SEQ ID NO: 2705777 - RNA, 17 nt, Haemophilus influenzae Rd
auuaauccaucauuuuu

SEQ ID NO: 2705778 - RNA, 13 nt, Haemophilus influenzae Rd
auuagaaucaaug

SEQ ID NO: 2705779 - RNA, 16 nt, Haemophilus influenzae Rd
auuagagccaucaauu

SEQ ID NO: 2705780 - RNA, 18 nt, Haemophilus influenzae Rd
auuagaucauaaaaaaau

SEQ ID NO: 2705781 - RNA, 16 nt, Haemophilus influenzae Rd
auuagaugauuuuaaa

SEQ ID NO: 2705782 - RNA, 22 nt, Haemophilus influenzae Rd
auuagaugauuuuaaaauaaau

SEQ ID NO: 2705783 - RNA, 17 nt, Haemophilus influenzae Rd
auuagaugauuuuaaag

SEQ ID NO: 2705784 - RNA, 13 nt, Haemophilus influenzae Rd
auuagauuuauuu

SEQ ID NO: 2705785 - RNA, 15 nt, Haemophilus influenzae Rd
auuagcaaagaauua

SEQ ID NO: 2705786 - RNA, 21 nt, Haemophilus influenzae Rd
auuagcagguuuuuuauuucu

SEQ ID NO: 2705787 - RNA, 14 nt, Haemophilus influenzae Rd
auuagcgauuaaag

SEQ ID NO: 2705788 - RNA, 16 nt, Haemophilus influenzae Rd
auuagcguaaacauuu

SEQ ID NO: 2705789 - RNA, 15 nt, Haemophilus influenzae Rd
auuagcuaaauacuu

SEQ ID NO: 2705790 - RNA, 20 nt, Haemophilus influenzae Rd
auuagcuaauauaauaaauu

SEQ ID NO: 2705791 - RNA, 19 nt, Haemophilus influenzae Rd
auuaggaauagcaagauaa

SEQ ID NO: 2705792 - RNA, 15 nt, Haemophilus influenzae Rd
auuaggaauaucuuu

SEQ ID NO: 2705793 - RNA, 12 nt, Haemophilus influenzae Rd
auuaggaauuug

SEQ ID NO: 2705794 - RNA, 19 nt, Haemophilus influenzae Rd
auuaggacaauauuuacuc

SEQ ID NO: 2705795 - RNA, 17 nt, Haemophilus influenzae Rd
auuaggguacauuugac

SEQ ID NO: 2705796 - RNA, 21 nt, Haemophilus influenzae Rd
auuaguaauauauucuacgua

SEQ ID NO: 2705797 - RNA, 20 nt, Haemophilus influenzae Rd
auuaguaucuuccauuaauu

SEQ ID NO: 2705798 - RNA, 13 nt, Haemophilus influenzae Rd
auuaguauuuaag

SEQ ID NO: 2705799 - RNA, 21 nt, Haemophilus influenzae Rd
auuagucuacaagaaaccaaa

SEQ ID NO: 2705800 - RNA, 14 nt, Haemophilus influenzae Rd
auuagugauaaaug

SEQ ID NO: 2705801 - RNA, 15 nt, Haemophilus influenzae Rd
auuagugugauuuua

SEQ ID NO: 2705802 - RNA, 19 nt, Haemophilus influenzae Rd
auuagugugauuuuagaaa

SEQ ID NO: 2705803 - RNA, 17 nt, Haemophilus influenzae Rd
auuaguuagcuaaaaaa

SEQ ID NO: 2705804 - RNA, 19 nt, Haemophilus influenzae Rd
auuaguugguacuaaagau

SEQ ID NO: 2705805 - RNA, 14 nt, Haemophilus influenzae Rd
auuaguuguuuuag

SEQ ID NO: 2705806 - RNA, 20 nt, Haemophilus influenzae Rd
auuaguuguuuuaguucuag

SEQ ID NO: 2705807 - RNA, 20 nt, Haemophilus influenzae Rd
auuaguuuuucgcugcagcu

SEQ ID NO: 2705808 - RNA, 18 nt, Haemophilus influenzae Rd
auuaguuuuuuauuucua

SEQ ID NO: 2705809 - RNA, 19 nt, Haemophilus influenzae Rd
auuaguuuuuuauuucuaa

SEQ ID NO: 2705810 - RNA, 12 nt, Haemophilus influenzae Rd
auuauaaaaaua

SEQ ID NO: 2705811 - RNA, 11 nt, Haemophilus influenzae Rd
auuauaaacca

SEQ ID NO: 2705812 - RNA, 21 nt, Haemophilus influenzae Rd
auuauacaucggcgcaccaau

SEQ ID NO: 2705813 - RNA, 14 nt, Haemophilus influenzae Rd
auuauagagaaaua

SEQ ID NO: 2705814 - RNA, 15 nt, Haemophilus influenzae Rd
auuauagagaaauaa

SEQ ID NO: 2705815 - RNA, 20 nt, Haemophilus influenzae Rd
auuauagagaaauaaucacu

SEQ ID NO: 2705816 - RNA, 15 nt, Haemophilus influenzae Rd
auuauagauaaauau

SEQ ID NO: 2705817 - RNA, 16 nt, Haemophilus influenzae Rd
auuauagauaaauauc

SEQ ID NO: 2705818 - RNA, 17 nt, Haemophilus influenzae Rd
auuauagauaaauauca

SEQ ID NO: 2705819 - RNA, 17 nt, Haemophilus influenzae Rd
auuauaggcuauaaaga

SEQ ID NO: 2705820 - RNA, 13 nt, Haemophilus influenzae Rd
auuauauaaaaaa

SEQ ID NO: 2705821 - RNA, 19 nt, Haemophilus influenzae Rd
auuauauuguugcacauua

SEQ ID NO: 2705822 - RNA, 16 nt, Haemophilus influenzae Rd
auuauauuuaauacuu

SEQ ID NO: 2705823 - RNA, 21 nt, Haemophilus influenzae Rd
auuauauuuuccuguuaauuc

SEQ ID NO: 2705824 - RNA, 19 nt, Haemophilus influenzae Rd
auuaucaaaaagaaauauu

SEQ ID NO: 2705825 - RNA, 20 nt, Haemophilus influenzae Rd
auuaucaaaagaaaagauga

SEQ ID NO: 2705826 - RNA, 20 nt, Haemophilus influenzae Rd
auuaucaaagaauuuuuuca

SEQ ID NO: 2705827 - RNA, 15 nt, Haemophilus influenzae Rd
auuaucaaaugccac

SEQ ID NO: 2705828 - RNA, 23 nt, Haemophilus influenzae Rd
auuaucaacaguaaauuuuucca

SEQ ID NO: 2705829 - RNA, 20 nt, Haemophilus influenzae Rd
auuaucaagcugauuuauca

SEQ ID NO: 2705830 - RNA, 16 nt, Haemophilus influenzae Rd
auuaucaauguuugug

SEQ ID NO: 2705831 - RNA, 21 nt, Haemophilus influenzae Rd
auuaucauaaacaauuucauu

SEQ ID NO: 2705832 - RNA, 14 nt, Haemophilus influenzae Rd
auuaucauuaaaua

SEQ ID NO: 2705833 - RNA, 16 nt, Haemophilus influenzae Rd
auuaucauuaaauaua

SEQ ID NO: 2705834 - RNA, 12 nt, Haemophilus influenzae Rd
auuauccaaacc

SEQ ID NO: 2705835 - RNA, 15 nt, Haemophilus influenzae Rd
auuauccacuaaaaa

SEQ ID NO: 2705836 - RNA, 16 nt, Haemophilus influenzae Rd
auuauccacuaaaaaa

SEQ ID NO: 2705837 - RNA, 18 nt, Haemophilus influenzae Rd
auuauccacuaaaaaacu

SEQ ID NO: 2705838 - RNA, 16 nt, Haemophilus influenzae Rd
auuauccguaaauuca

SEQ ID NO: 2705839 - RNA, 14 nt, Haemophilus influenzae Rd
auuauccuauagua

SEQ ID NO: 2705840 - RNA, 19 nt, Haemophilus influenzae Rd
auuaucgaauagauuuuua

SEQ ID NO: 2705841 - RNA, 18 nt, Haemophilus influenzae Rd
auuaucguagguuuuuuu

SEQ ID NO: 2705842 - RNA, 15 nt, Haemophilus influenzae Rd
auuaucgucuaucua

SEQ ID NO: 2705843 - RNA, 14 nt, Haemophilus influenzae Rd
auuaucgugauuuu

SEQ ID NO: 2705844 - RNA, 14 nt, Haemophilus influenzae Rd
auuaucguuuacuu

SEQ ID NO: 2705845 - RNA, 19 nt, Haemophilus influenzae Rd
auuaucguuuacuuaaaau

SEQ ID NO: 2705846 - RNA, 21 nt, Haemophilus influenzae Rd
auuaucguuuacuuaaaaucu

SEQ ID NO: 2705847 - RNA, 15 nt, Haemophilus influenzae Rd
auuaucuaaaucucu

SEQ ID NO: 2705848 - RNA, 16 nt, Haemophilus influenzae Rd
auuaucuaaaucucug

SEQ ID NO: 2705849 - RNA, 15 nt, Haemophilus influenzae Rd
auuaucuaaauuucg

SEQ ID NO: 2705850 - RNA, 15 nt, Haemophilus influenzae Rd
auuaucucgaauauc

SEQ ID NO: 2705851 - RNA, 22 nt, Haemophilus influenzae Rd
auuaucugaggauuaaagggcu

SEQ ID NO: 2705852 - RNA, 14 nt, Haemophilus influenzae Rd
auuaucugauguag

SEQ ID NO: 2705853 - RNA, 13 nt, Haemophilus influenzae Rd
auuaucugauguu

SEQ ID NO: 2705854 - RNA, 21 nt, Haemophilus influenzae Rd
auuaucuguaauugagcauaa

SEQ ID NO: 2705855 - RNA, 15 nt, Haemophilus influenzae Rd
auuaugaaaaaaacu

SEQ ID NO: 2705856 - RNA, 12 nt, Haemophilus influenzae Rd
auuaugaaauuu

SEQ ID NO: 2705857 - RNA, 13 nt, Haemophilus influenzae Rd
auuaugaaauuug

SEQ ID NO: 2705858 - RNA, 14 nt, Haemophilus influenzae Rd
auuaugcccaauua

SEQ ID NO: 2705859 - RNA, 23 nt, Haemophilus influenzae Rd
auuaugcuccauugcaauuucag

SEQ ID NO: 2705860 - RNA, 16 nt, Haemophilus influenzae Rd
auuaugcugauuugac

SEQ ID NO: 2705861 - RNA, 20 nt, Haemophilus influenzae Rd
auuauggaauggcauaagau

SEQ ID NO: 2705862 - RNA, 21 nt, Haemophilus influenzae Rd
auuauggguguuuaaauuuuu

SEQ ID NO: 2705863 - RNA, 16 nt, Haemophilus influenzae Rd
auuaugguuuugcugu

SEQ ID NO: 2705864 - RNA, 14 nt, Haemophilus influenzae Rd
auuauguauuacca

SEQ ID NO: 2705865 - RNA, 20 nt, Haemophilus influenzae Rd
auuaugugcaauuugacaaa

SEQ ID NO: 2705866 - RNA, 11 nt, Haemophilus influenzae Rd
auuauguucau

SEQ ID NO: 2705867 - RNA, 14 nt, Haemophilus influenzae Rd
auuauguuuuguag

SEQ ID NO: 2705868 - RNA, 18 nt, Haemophilus influenzae Rd
auuauuaaauaaacgcuc

SEQ ID NO: 2705869 - RNA, 16 nt, Haemophilus influenzae Rd
auuauuaaauccaaaa

SEQ ID NO: 2705870 - RNA, 21 nt, Haemophilus influenzae Rd
auuauuaaguaauacauuuuc

SEQ ID NO: 2705871 - RNA, 22 nt, Haemophilus influenzae Rd
auuauuaaguaauacauuuuca

SEQ ID NO: 2705872 - RNA, 20 nt, Haemophilus influenzae Rd
auuauuacaauuuaagaucu

SEQ ID NO: 2705873 - RNA, 12 nt, Haemophilus influenzae Rd
auuauuagcaua

SEQ ID NO: 2705874 - RNA, 19 nt, Haemophilus influenzae Rd
auuauugaagcacugaaau

SEQ ID NO: 2705875 - RNA, 17 nt, Haemophilus influenzae Rd
auuauugcauuuuuaac

SEQ ID NO: 2705876 - RNA, 16 nt, Haemophilus influenzae Rd
auuauugugauaauua

SEQ ID NO: 2705877 - RNA, 21 nt, Haemophilus influenzae Rd
auuauugugauaauuaagguc

SEQ ID NO: 2705878 - RNA, 20 nt, Haemophilus influenzae Rd
auuauuguuuucugaacuaa

SEQ ID NO: 2705879 - RNA, 13 nt, Haemophilus influenzae Rd
auuauuuaaacuu

SEQ ID NO: 2705880 - RNA, 12 nt, Haemophilus influenzae Rd
auuauuuaaaug

SEQ ID NO: 2705881 - RNA, 15 nt, Haemophilus influenzae Rd
auuauuuaauacgaa

SEQ ID NO: 2705882 - RNA, 15 nt, Haemophilus influenzae Rd
auuauuuaauuucaa

SEQ ID NO: 2705883 - RNA, 18 nt, Haemophilus influenzae Rd
auuauuuagauauaaaaa

SEQ ID NO: 2705884 - RNA, 15 nt, Haemophilus influenzae Rd
auuccauauuggaag

SEQ ID NO: 2705885 - RNA, 13 nt, Haemophilus influenzae Rd
auuccauuaacua

SEQ ID NO: 2705886 - RNA, 18 nt, Haemophilus influenzae Rd
auuccauucacuuucaca

SEQ ID NO: 2705887 - RNA, 22 nt, Haemophilus influenzae Rd
auuccauugcauccacuucauc

SEQ ID NO: 2705888 - RNA, 23 nt, Haemophilus influenzae Rd
auuccauuugaagaauuuguugu

SEQ ID NO: 2705889 - RNA, 14 nt, Haemophilus influenzae Rd
auuccauuuugcau

SEQ ID NO: 2705890 - RNA, 17 nt, Haemophilus influenzae Rd
auuccauuuugcauauu

SEQ ID NO: 2705891 - RNA, 15 nt, Haemophilus influenzae Rd
auucccaaauuuuuu

SEQ ID NO: 2705892 - RNA, 16 nt, Haemophilus influenzae Rd
auuccccuucaaauau

SEQ ID NO: 2705893 - RNA, 17 nt, Haemophilus influenzae Rd
auucccuagccuuuucu

SEQ ID NO: 2705894 - RNA, 17 nt, Haemophilus influenzae Rd
auuccgcaccugcaggu

SEQ ID NO: 2705895 - RNA, 23 nt, Haemophilus influenzae Rd
auuccguaguuauuuauuuaaga

SEQ ID NO: 2705896 - RNA, 18 nt, Haemophilus influenzae Rd
auuccgucagaauuucau

SEQ ID NO: 2705897 - RNA, 15 nt, Haemophilus influenzae Rd
auuccuauucuaaau

SEQ ID NO: 2705898 - RNA, 14 nt, Haemophilus influenzae Rd
auuccucugaaccu

SEQ ID NO: 2705899 - RNA, 15 nt, Haemophilus influenzae Rd
auuccugcuuuuuuc

SEQ ID NO: 2705900 - RNA, 15 nt, Haemophilus influenzae Rd
auuccuuacaacaaa

SEQ ID NO: 2705901 - RNA, 22 nt, Haemophilus influenzae Rd
auuccuucaaauucuacauggc

SEQ ID NO: 2705902 - RNA, 19 nt, Haemophilus influenzae Rd
auuccuuccaacaauuuca

SEQ ID NO: 2705903 - RNA, 20 nt, Haemophilus influenzae Rd
auuccuuccaacaauuucac

SEQ ID NO: 2705904 - RNA, 23 nt, Haemophilus influenzae Rd
auuccuucgccuucggcucccau

SEQ ID NO: 2705905 - RNA, 16 nt, Haemophilus influenzae Rd
auuccuuuauuuugca

SEQ ID NO: 2705906 - RNA, 19 nt, Haemophilus influenzae Rd
auuccuuuugaacuuuuaa

SEQ ID NO: 2705907 - RNA, 22 nt, Haemophilus influenzae Rd
auuccuuuugaacuuuuaacug

SEQ ID NO: 2705908 - RNA, 18 nt, Haemophilus influenzae Rd
auucgaaccuucgaccaa

SEQ ID NO: 2705909 - RNA, 17 nt, Haemophilus influenzae Rd
auucgaauauugaucau

SEQ ID NO: 2705910 - RNA, 13 nt, Haemophilus influenzae Rd
auucgacaauuuc

SEQ ID NO: 2705911 - RNA, 18 nt, Haemophilus influenzae Rd
auucgaucagcacgauaa

SEQ ID NO: 2705912 - RNA, 18 nt, Haemophilus influenzae Rd
auucgauugcauuuuuua

SEQ ID NO: 2705913 - RNA, 12 nt, Haemophilus influenzae Rd
auucgcaccuuc

SEQ ID NO: 2705914 - RNA, 17 nt, Haemophilus influenzae Rd
auucgccuugcuuuuaa

SEQ ID NO: 2705915 - RNA, 14 nt, Haemophilus influenzae Rd
auucgcugauuuau

SEQ ID NO: 2705916 - RNA, 14 nt, Haemophilus influenzae Rd
auucgcuucuuuua

SEQ ID NO: 2705917 - RNA, 17 nt, Haemophilus influenzae Rd
auucgcuuggaguucuu

SEQ ID NO: 2705918 - RNA, 17 nt, Haemophilus influenzae Rd
auucgcuuucauaaauu

SEQ ID NO: 2705919 - RNA, 23 nt, Haemophilus influenzae Rd
auucgcuuucauaaauucaucuu

SEQ ID NO: 2705920 - RNA, 14 nt, Haemophilus influenzae Rd
auucgcuuuucuuu

SEQ ID NO: 2705921 - RNA, 23 nt, Haemophilus influenzae Rd
auucggcuucaguauccgccaau

SEQ ID NO: 2705922 - RNA, 22 nt, Haemophilus influenzae Rd
auucgggcuucucaaaugaaau

SEQ ID NO: 2705923 - RNA, 15 nt, Haemophilus influenzae Rd
auucgguuuuucuua

SEQ ID NO: 2705924 - RNA, 19 nt, Haemophilus influenzae Rd
auucguacuuuugauuuau

SEQ ID NO: 2705925 - RNA, 15 nt, Haemophilus influenzae Rd
auucguauaaauauu

SEQ ID NO: 2705926 - RNA, 19 nt, Haemophilus influenzae Rd
auucguaucaacuuuugag

SEQ ID NO: 2705927 - RNA, 18 nt, Haemophilus influenzae Rd
auucguggcaauuuuucu

SEQ ID NO: 2705928 - RNA, 13 nt, Haemophilus influenzae Rd
auucguuaaauaa

SEQ ID NO: 2705929 - RNA, 21 nt, Haemophilus influenzae Rd
auucguuguaccaaucaaagu

SEQ ID NO: 2705930 - RNA, 12 nt, Haemophilus influenzae Rd
auucuaaaaaaa

SEQ ID NO: 2705931 - RNA, 15 nt, Haemophilus influenzae Rd
auucuaaaaaaauca

SEQ ID NO: 2705932 - RNA, 17 nt, Haemophilus influenzae Rd
auucuaaaaaaauccua

SEQ ID NO: 2705933 - RNA, 20 nt, Haemophilus influenzae Rd
auucuaaaaagaagcucacu

SEQ ID NO: 2705934 - RNA, 20 nt, Haemophilus influenzae Rd
auucuaaacggcguaucaua

SEQ ID NO: 2705935 - RNA, 12 nt, Haemophilus influenzae Rd
auucuaaauauu

SEQ ID NO: 2705936 - RNA, 14 nt, Haemophilus influenzae Rd
auucuaaauucuca

SEQ ID NO: 2705937 - RNA, 22 nt, Haemophilus influenzae Rd
auucuaaauucucaagaauaua

SEQ ID NO: 2705938 - RNA, 21 nt, Haemophilus influenzae Rd
auucuaauccugcgugaauga

SEQ ID NO: 2705939 - RNA, 10 nt, Haemophilus influenzae Rd
auucuaauga

SEQ ID NO: 2705940 - RNA, 13 nt, Haemophilus influenzae Rd
auucuaauuaacu

SEQ ID NO: 2705941 - RNA, 17 nt, Haemophilus influenzae Rd
auucuaauuccccuuca

SEQ ID NO: 2705942 - RNA, 18 nt, Haemophilus influenzae Rd
auucuacgaauugguucu

SEQ ID NO: 2705943 - RNA, 16 nt, Haemophilus influenzae Rd
auucuacguauugaac

SEQ ID NO: 2705944 - RNA, 21 nt, Haemophilus influenzae Rd
auucuacguauugaacuaaaa

SEQ ID NO: 2705945 - RNA, 19 nt, Haemophilus influenzae Rd
auucuacuuggugauuaug

SEQ ID NO: 2705946 - RNA, 13 nt, Haemophilus influenzae Rd
auucuauuuuaaa

SEQ ID NO: 2705947 - RNA, 15 nt, Haemophilus influenzae Rd
auucuauuuuaaaaa

SEQ ID NO: 2705948 - RNA, 15 nt, Haemophilus influenzae Rd
auucucacaucauca

SEQ ID NO: 2705949 - RNA, 18 nt, Haemophilus influenzae Rd
auucucacaucaucaagu

SEQ ID NO: 2705950 - RNA, 13 nt, Haemophilus influenzae Rd
auucucauuuuag

SEQ ID NO: 2705951 - RNA, 14 nt, Haemophilus influenzae Rd
auucuccaaauaua

SEQ ID NO: 2705952 - RNA, 22 nt, Haemophilus influenzae Rd
auucuccaaauauaaaauaaaa

SEQ ID NO: 2705953 - RNA, 16 nt, Haemophilus influenzae Rd
auucuccccgaugauu

SEQ ID NO: 2705954 - RNA, 15 nt, Haemophilus influenzae Rd
auucuccguaaaaau

SEQ ID NO: 2705955 - RNA, 17 nt, Haemophilus influenzae Rd
auucucgccauaauaaa

SEQ ID NO: 2705956 - RNA, 21 nt, Haemophilus influenzae Rd
auucucucgcugaauuauugu

SEQ ID NO: 2705957 - RNA, 15 nt, Haemophilus influenzae Rd
auucucucguaaaau

SEQ ID NO: 2705958 - RNA, 13 nt, Haemophilus influenzae Rd
auucucugcaucg

SEQ ID NO: 2705959 - RNA, 19 nt, Haemophilus influenzae Rd
auucucuguuucuuuaaau

SEQ ID NO: 2705960 - RNA, 14 nt, Haemophilus influenzae Rd
auucugaaaccacu

SEQ ID NO: 2705961 - RNA, 18 nt, Haemophilus influenzae Rd
auucugaaugaucgagua

SEQ ID NO: 2705962 - RNA, 23 nt, Haemophilus influenzae Rd
auucugaaugaucgaguaaaaau

SEQ ID NO: 2705963 - RNA, 16 nt, Haemophilus influenzae Rd
auucugaggauuuuau

SEQ ID NO: 2705964 - RNA, 22 nt, Haemophilus influenzae Rd
auucugaggauuuuauggcugc

SEQ ID NO: 2705965 - RNA, 17 nt, Haemophilus influenzae Rd
auucugcacgacgugcu

SEQ ID NO: 2705966 - RNA, 19 nt, Haemophilus influenzae Rd
auucugcacgacgugcuuc

SEQ ID NO: 2705967 - RNA, 20 nt, Haemophilus influenzae Rd
auucugcaguuuuuuguuuu

SEQ ID NO: 2705968 - RNA, 18 nt, Haemophilus influenzae Rd
auucugcauaaaauaauu

SEQ ID NO: 2705969 - RNA, 21 nt, Haemophilus influenzae Rd
auucugcuaaaucuguuucau

SEQ ID NO: 2705970 - RNA, 18 nt, Haemophilus influenzae Rd
auucugcucugcaccauc

SEQ ID NO: 2705971 - RNA, 15 nt, Haemophilus influenzae Rd
auucugcuuguucgc

SEQ ID NO: 2705972 - RNA, 16 nt, Haemophilus influenzae Rd
auucugcuuuuuuacu

SEQ ID NO: 2705973 - RNA, 15 nt, Haemophilus influenzae Rd
auucuggcaauauuu

SEQ ID NO: 2705974 - RNA, 17 nt, Haemophilus influenzae Rd
auucuggcaauauuuca

SEQ ID NO: 2705975 - RNA, 19 nt, Haemophilus influenzae Rd
auucugugcaauauuuccu

SEQ ID NO: 2705976 - RNA, 13 nt, Haemophilus influenzae Rd
auucuuaaaucau

SEQ ID NO: 2705977 - RNA, 16 nt, Haemophilus influenzae Rd
auucuuaaaugggaaa

SEQ ID NO: 2705978 - RNA, 23 nt, Haemophilus influenzae Rd
auucuuaccaaaaggucuuaaua

SEQ ID NO: 2705979 - RNA, 18 nt, Haemophilus influenzae Rd
auucuuagcuuuagcaau

SEQ ID NO: 2705980 - RNA, 22 nt, Haemophilus influenzae Rd
auucuuagcuuuagcaaucaau

SEQ ID NO: 2705981 - RNA, 13 nt, Haemophilus influenzae Rd
auucuucaauaac

SEQ ID NO: 2705982 - RNA, 23 nt, Haemophilus influenzae Rd
auucuucaauaacaacuggaauu

SEQ ID NO: 2705983 - RNA, 17 nt, Haemophilus influenzae Rd
auucuucagaacugcuu

SEQ ID NO: 2705984 - RNA, 16 nt, Haemophilus influenzae Rd
auucuucagauuuuau

SEQ ID NO: 2705985 - RNA, 15 nt, Haemophilus influenzae Rd
auucuucauaaaaaa

SEQ ID NO: 2705986 - RNA, 17 nt, Haemophilus influenzae Rd
auucuucauaaaaaaag

SEQ ID NO: 2705987 - RNA, 20 nt, Haemophilus influenzae Rd
auucuuccgcaauuucugcc

SEQ ID NO: 2705988 - RNA, 23 nt, Haemophilus influenzae Rd
auucuuccguugcauuuaacuua

SEQ ID NO: 2705989 - RNA, 17 nt, Haemophilus influenzae Rd
auugcauuuuuuauaaa

SEQ ID NO: 2705990 - RNA, 20 nt, Haemophilus influenzae Rd
auugcauuuuuuauaaaugg

SEQ ID NO: 2705991 - RNA, 19 nt, Haemophilus influenzae Rd
auugccaacuuagauuuuc

SEQ ID NO: 2705992 - RNA, 20 nt, Haemophilus influenzae Rd
auugccauauaccaauaauu

SEQ ID NO: 2705993 - RNA, 14 nt, Haemophilus influenzae Rd
auugccgaagccau

SEQ ID NO: 2705994 - RNA, 15 nt, Haemophilus influenzae Rd
auugccuaaauacau

SEQ ID NO: 2705995 - RNA, 21 nt, Haemophilus influenzae Rd
auugccuaaauacaucacuaa

SEQ ID NO: 2705996 - RNA, 13 nt, Haemophilus influenzae Rd
auugccuaauaaa

SEQ ID NO: 2705997 - RNA, 16 nt, Haemophilus influenzae Rd
auugccuaauaaaaaa

SEQ ID NO: 2705998 - RNA, 13 nt, Haemophilus influenzae Rd
auugccuuuuuuc

SEQ ID NO: 2705999 - RNA, 15 nt, Haemophilus influenzae Rd
auugcgguuucaguu

SEQ ID NO: 2706000 - RNA, 15 nt, Haemophilus influenzae Rd
auugcuaaauaaauu

SEQ ID NO: 2706001 - RNA, 13 nt, Haemophilus influenzae Rd
auugcuaaauuua

SEQ ID NO: 2706002 - RNA, 14 nt, Haemophilus influenzae Rd
auugcuagccaaua

SEQ ID NO: 2706003 - RNA, 15 nt, Haemophilus influenzae Rd
auugcuccacuucuu

SEQ ID NO: 2706004 - RNA, 17 nt, Haemophilus influenzae Rd
auugcucgacaaagauu

SEQ ID NO: 2706005 - RNA, 22 nt, Haemophilus influenzae Rd
auugcucgugauuaucuaaauu

SEQ ID NO: 2706006 - RNA, 19 nt, Haemophilus influenzae Rd
auugcucgugcaggauaaa

SEQ ID NO: 2706007 - RNA, 20 nt, Haemophilus influenzae Rd
auugcucgugcaggauaaag

SEQ ID NO: 2706008 - RNA, 14 nt, Haemophilus influenzae Rd
auugcucugacacu

SEQ ID NO: 2706009 - RNA, 15 nt, Haemophilus influenzae Rd
auugcucugcuuuau

SEQ ID NO: 2706010 - RNA, 17 nt, Haemophilus influenzae Rd
auugcugcuuuaauuuc

SEQ ID NO: 2706011 - RNA, 19 nt, Haemophilus influenzae Rd
auugcugggcaauauaaac

SEQ ID NO: 2706012 - RNA, 19 nt, Haemophilus influenzae Rd
auugcuggugcaauuugau

SEQ ID NO: 2706013 - RNA, 19 nt, Haemophilus influenzae Rd
auugcugugcgaccugaag

SEQ ID NO: 2706014 - RNA, 18 nt, Haemophilus influenzae Rd
auugcuugcauucacaaa

SEQ ID NO: 2706015 - RNA, 18 nt, Haemophilus influenzae Rd
auugcuuguuucauacaa

SEQ ID NO: 2706016 - RNA, 15 nt, Haemophilus influenzae Rd
auugcuuuaacugaa

SEQ ID NO: 2706017 - RNA, 14 nt, Haemophilus influenzae Rd
auuggaaaauaaaa

SEQ ID NO: 2706018 - RNA, 15 nt, Haemophilus influenzae Rd
auuggaaaauucaaa

SEQ ID NO: 2706019 - RNA, 14 nt, Haemophilus influenzae Rd
auuggaaguuuuuc

SEQ ID NO: 2706020 - RNA, 16 nt, Haemophilus influenzae Rd
auuggaaguuuuuccg

SEQ ID NO: 2706021 - RNA, 12 nt, Haemophilus influenzae Rd
auuggaauggua

SEQ ID NO: 2706022 - RNA, 14 nt, Haemophilus influenzae Rd
auuggacugcauau

SEQ ID NO: 2706023 - RNA, 14 nt, Haemophilus influenzae Rd
auuggauuaaucaa

SEQ ID NO: 2706024 - RNA, 22 nt, Haemophilus influenzae Rd
auuggauucacggauagggaua

SEQ ID NO: 2706025 - RNA, 16 nt, Haemophilus influenzae Rd
auuggauugaaucaau

SEQ ID NO: 2706026 - RNA, 18 nt, Haemophilus influenzae Rd
auuggauugaaucaauuu

SEQ ID NO: 2706027 - RNA, 21 nt, Haemophilus influenzae Rd
auuggcuauugaaaauuauug

SEQ ID NO: 2706028 - RNA, 17 nt, Haemophilus influenzae Rd
auuggcugaauuuaauu

SEQ ID NO: 2706029 - RNA, 13 nt, Haemophilus influenzae Rd
auuggggaacgga

SEQ ID NO: 2706030 - RNA, 19 nt, Haemophilus influenzae Rd
auuggggaaguaauauuuc

SEQ ID NO: 2706031 - RNA, 21 nt, Haemophilus influenzae Rd
auuggggaaguaauauuucuu

SEQ ID NO: 2706032 - RNA, 18 nt, Haemophilus influenzae Rd
auuggggcgaccauuaca

SEQ ID NO: 2706033 - RNA, 20 nt, Haemophilus influenzae Rd
auuggggcgaccauuacagc

SEQ ID NO: 2706034 - RNA, 12 nt, Haemophilus influenzae Rd
auuggguuauaa

SEQ ID NO: 2706035 - RNA, 20 nt, Haemophilus influenzae Rd
auuggguucgcaaauaacga

SEQ ID NO: 2706036 - RNA, 19 nt, Haemophilus influenzae Rd
auugguaaaauuucuucua

SEQ ID NO: 2706037 - RNA, 15 nt, Haemophilus influenzae Rd
auugguaacaacugc

SEQ ID NO: 2706038 - RNA, 22 nt, Haemophilus influenzae Rd
auugguaacaacugcuaggaca

SEQ ID NO: 2706039 - RNA, 23 nt, Haemophilus influenzae Rd
auugguaauugcccaauaaaagu

SEQ ID NO: 2706040 - RNA, 17 nt, Haemophilus influenzae Rd
auugguacgagaaaaau

SEQ ID NO: 2706041 - RNA, 19 nt, Haemophilus influenzae Rd
auugguacgccagucacuu

SEQ ID NO: 2706042 - RNA, 17 nt, Haemophilus influenzae Rd
auugguggguucaucua

SEQ ID NO: 2706043 - RNA, 22 nt, Haemophilus influenzae Rd
auugguuaauguaaacaaaaau

SEQ ID NO: 2706044 - RNA, 20 nt, Haemophilus influenzae Rd
auugguuggaaacgaauuua

SEQ ID NO: 2706045 - RNA, 20 nt, Haemophilus influenzae Rd
auugguuuugugcuugcuuu

SEQ ID NO: 2706046 - RNA, 21 nt, Haemophilus influenzae Rd
auuguaaaaccgcauccauuc

SEQ ID NO: 2706047 - RNA, 12 nt, Haemophilus influenzae Rd
auuguaaaaguc

SEQ ID NO: 2706048 - RNA, 17 nt, Haemophilus influenzae Rd
auuguaaaccaaauuuc

SEQ ID NO: 2706049 - RNA, 17 nt, Haemophilus influenzae Rd
auuguaacuauaugaua

SEQ ID NO: 2706050 - RNA, 23 nt, Haemophilus influenzae Rd
auuguaacuauaugauauauaaa

SEQ ID NO: 2706051 - RNA, 20 nt, Haemophilus influenzae Rd
auuguaaugucgugaaagaa

SEQ ID NO: 2706052 - RNA, 15 nt, Haemophilus influenzae Rd
auuguaccuucugcu

SEQ ID NO: 2706053 - RNA, 22 nt, Haemophilus influenzae Rd
auuguacuucuuacguuuaaau

SEQ ID NO: 2706054 - RNA, 15 nt, Haemophilus influenzae Rd
auuguacuuuuugac

SEQ ID NO: 2706055 - RNA, 23 nt, Haemophilus influenzae Rd
auuguagccuaguauuuuuguga

SEQ ID NO: 2706056 - RNA, 18 nt, Haemophilus influenzae Rd
auuguaguaauaaaaagc

SEQ ID NO: 2706057 - RNA, 17 nt, Haemophilus influenzae Rd
auuguaugaaaaaugcu

SEQ ID NO: 2706058 - RNA, 22 nt, Haemophilus influenzae Rd
auugucauaccccaaacuugga

SEQ ID NO: 2706059 - RNA, 13 nt, Haemophilus influenzae Rd
auugucauggcau

SEQ ID NO: 2706060 - RNA, 22 nt, Haemophilus influenzae Rd
auuguccacagcaaaagaaaua

SEQ ID NO: 2706061 - RNA, 20 nt, Haemophilus influenzae Rd
auuguccuucauugauggaa

SEQ ID NO: 2706062 - RNA, 14 nt, Haemophilus influenzae Rd
auugucgcuaacau

SEQ ID NO: 2706063 - RNA, 14 nt, Haemophilus influenzae Rd
auugucuauuuuau

SEQ ID NO: 2706064 - RNA, 18 nt, Haemophilus influenzae Rd
auugucugcuccaaauaa

SEQ ID NO: 2706065 - RNA, 19 nt, Haemophilus influenzae Rd
auugucugcuccaaauaau

SEQ ID NO: 2706066 - RNA, 15 nt, Haemophilus influenzae Rd
auugucuuuuacguu

SEQ ID NO: 2706067 - RNA, 21 nt, Haemophilus influenzae Rd
auugucuuuucuauaauuaaa

SEQ ID NO: 2706068 - RNA, 18 nt, Haemophilus influenzae Rd
auugugacauuggauuaa

SEQ ID NO: 2706069 - RNA, 15 nt, Haemophilus influenzae Rd
auugugauaauuaag

SEQ ID NO: 2706070 - RNA, 12 nt, Haemophilus influenzae Rd
auugugauguuc

SEQ ID NO: 2706071 - RNA, 15 nt, Haemophilus influenzae Rd
auugugauguucuaa

SEQ ID NO: 2706072 - RNA, 17 nt, Haemophilus influenzae Rd
auugugauguucuaaau

SEQ ID NO: 2706073 - RNA, 15 nt, Haemophilus influenzae Rd
auugugcauuguuac

SEQ ID NO: 2706074 - RNA, 22 nt, Haemophilus influenzae Rd
auugugccguauuuuuuacagu

SEQ ID NO: 2706075 - RNA, 16 nt, Haemophilus influenzae Rd
auugugcuaaauaauu

SEQ ID NO: 2706076 - RNA, 21 nt, Haemophilus influenzae Rd
auugugggcuuuaagcuuuuc

SEQ ID NO: 2706077 - RNA, 17 nt, Haemophilus influenzae Rd
auugugucacauaauca

SEQ ID NO: 2706078 - RNA, 21 nt, Haemophilus influenzae Rd
auugugucacauaaucaggcu

SEQ ID NO: 2706079 - RNA, 17 nt, Haemophilus influenzae Rd
auugugucacuagauuu

SEQ ID NO: 2706080 - RNA, 20 nt, Haemophilus influenzae Rd
auuguguugcccuagugcaa

SEQ ID NO: 2706081 - RNA, 20 nt, Haemophilus influenzae Rd
auuguguuggaacguuuaaa

SEQ ID NO: 2706082 - RNA, 18 nt, Haemophilus influenzae Rd
auuguuaaaacgccauuc

SEQ ID NO: 2706083 - RNA, 17 nt, Haemophilus influenzae Rd
auuguuaucuaaauaau

SEQ ID NO: 2706084 - RNA, 15 nt, Haemophilus influenzae Rd
auuguuaucuguaga

SEQ ID NO: 2706085 - RNA, 14 nt, Haemophilus influenzae Rd
auuguuauugugau

SEQ ID NO: 2706086 - RNA, 23 nt, Haemophilus influenzae Rd
auuguucacgauaacggcaaaau

SEQ ID NO: 2706087 - RNA, 23 nt, Haemophilus influenzae Rd
auuguucagcaauuucucuggcu

SEQ ID NO: 2706088 - RNA, 13 nt, Haemophilus influenzae Rd
auuguucuuguuc

SEQ ID NO: 2706089 - RNA, 19 nt, Haemophilus influenzae Rd
auuguuggcccaacagaaa

SEQ ID NO: 2706090 - RNA, 19 nt, Haemophilus influenzae Rd
auuguugguuacuaaaugu

SEQ ID NO: 2706091 - RNA, 16 nt, Haemophilus influenzae Rd
auuguuguaaaauagu

SEQ ID NO: 2706092 - RNA, 15 nt, Haemophilus influenzae Rd
auuguuucaauuuau

SEQ ID NO: 2706093 - RNA, 23 nt, Haemophilus influenzae Rd
auuguuucucaauaaauaucuaa

SEQ ID NO: 2706094 - RNA, 17 nt, Haemophilus influenzae Rd
auuuagcggaauuuuug

SEQ ID NO: 2706095 - RNA, 20 nt, Haemophilus influenzae Rd
auuuagcggcuuuuugcuuu

SEQ ID NO: 2706096 - RNA, 16 nt, Haemophilus influenzae Rd
auuuaggcuauuuuau

SEQ ID NO: 2706097 - RNA, 14 nt, Haemophilus influenzae Rd
auuuaguccuaaaa

SEQ ID NO: 2706098 - RNA, 22 nt, Haemophilus influenzae Rd
auuuaguccuuaaacaaaugua

SEQ ID NO: 2706099 - RNA, 19 nt, Haemophilus influenzae Rd
auuuaguccuuaauuuuau

SEQ ID NO: 2706100 - RNA, 21 nt, Haemophilus influenzae Rd
auuuaguccuuaauuuuauag

SEQ ID NO: 2706101 - RNA, 17 nt, Haemophilus influenzae Rd
auuuaguccuuuagaaa

SEQ ID NO: 2706102 - RNA, 16 nt, Haemophilus influenzae Rd
auuuagugaccacauu

SEQ ID NO: 2706103 - RNA, 16 nt, Haemophilus influenzae Rd
auuuaguugaagaaau

SEQ ID NO: 2706104 - RNA, 20 nt, Haemophilus influenzae Rd
auuuaguugaagaaaucgcu

SEQ ID NO: 2706105 - RNA, 20 nt, Haemophilus influenzae Rd
auuuaguuggguauucacuu

SEQ ID NO: 2706106 - RNA, 15 nt, Haemophilus influenzae Rd
auuuaguuuaacuuu

SEQ ID NO: 2706107 - RNA, 22 nt, Haemophilus influenzae Rd
auuuauaaugcaaccaaacaaa

SEQ ID NO: 2706108 - RNA, 19 nt, Haemophilus influenzae Rd
auuuauacaaaaaagccac

SEQ ID NO: 2706109 - RNA, 21 nt, Haemophilus influenzae Rd
auuuauacacuuuuaacuuaa

SEQ ID NO: 2706110 - RNA, 12 nt, Haemophilus influenzae Rd
auuuauaccaga

SEQ ID NO: 2706111 - RNA, 13 nt, Haemophilus influenzae Rd
auuuauacuuaau

SEQ ID NO: 2706112 - RNA, 18 nt, Haemophilus influenzae Rd
auuuauagcauuuaaaua

SEQ ID NO: 2706113 - RNA, 21 nt, Haemophilus influenzae Rd
auuuauagcuaagcaguuuau

SEQ ID NO: 2706114 - RNA, 14 nt, Haemophilus influenzae Rd
auuuauauaaagcu

SEQ ID NO: 2706115 - RNA, 24 nt, Haemophilus influenzae Rd
auuuauauaaagcucuaauugaaa

SEQ ID NO: 2706116 - RNA, 19 nt, Haemophilus influenzae Rd
auuuauauaauuuaacaua

SEQ ID NO: 2706117 - RNA, 18 nt, Haemophilus influenzae Rd
auuuauauaugauaaaaa

SEQ ID NO: 2706118 - RNA, 14 nt, Haemophilus influenzae Rd
auuuaucaaacaag

SEQ ID NO: 2706119 - RNA, 16 nt, Haemophilus influenzae Rd
auuuaucauaaugaua

SEQ ID NO: 2706120 - RNA, 11 nt, Haemophilus influenzae Rd
auuuaucauca

SEQ ID NO: 2706121 - RNA, 14 nt, Haemophilus influenzae Rd
auuuaucaucuagu

SEQ ID NO: 2706122 - RNA, 13 nt, Haemophilus influenzae Rd
auuuaucauuccc

SEQ ID NO: 2706123 - RNA, 19 nt, Haemophilus influenzae Rd
auuuauccaauacugucgu

SEQ ID NO: 2706124 - RNA, 16 nt, Haemophilus influenzae Rd
auuuauccaugacuaa

SEQ ID NO: 2706125 - RNA, 20 nt, Haemophilus influenzae Rd
auuuauccccaauuaaggau

SEQ ID NO: 2706126 - RNA, 20 nt, Haemophilus influenzae Rd
auuuauccguuuggagauaa

SEQ ID NO: 2706127 - RNA, 16 nt, Haemophilus influenzae Rd
auuuaucgcacuguuu

SEQ ID NO: 2706128 - RNA, 14 nt, Haemophilus influenzae Rd
auuuaucuaaaagu

SEQ ID NO: 2706129 - RNA, 14 nt, Haemophilus influenzae Rd
auuuaucuuccccc

SEQ ID NO: 2706130 - RNA, 15 nt, Haemophilus influenzae Rd
auuuaucuuccccca

SEQ ID NO: 2706131 - RNA, 16 nt, Haemophilus influenzae Rd
auuuaugaauguuuca

SEQ ID NO: 2706132 - RNA, 23 nt, Haemophilus influenzae Rd
auuuaugaauguuucaaacaccu

SEQ ID NO: 2706133 - RNA, 16 nt, Haemophilus influenzae Rd
auuuauggaaauaaau

SEQ ID NO: 2706134 - RNA, 14 nt, Haemophilus influenzae Rd
auuuauuaaaaaua

SEQ ID NO: 2706135 - RNA, 16 nt, Haemophilus influenzae Rd
auuuauuaaaaguaaa

SEQ ID NO: 2706136 - RNA, 14 nt, Haemophilus influenzae Rd
auuuauuaagauau

SEQ ID NO: 2706137 - RNA, 19 nt, Haemophilus influenzae Rd
auuuauuaagauauaaaag

SEQ ID NO: 2706138 - RNA, 14 nt, Haemophilus influenzae Rd
auuuauuauaaaaa

SEQ ID NO: 2706139 - RNA, 14 nt, Haemophilus influenzae Rd
auuuauuauucuug

SEQ ID NO: 2706140 - RNA, 16 nt, Haemophilus influenzae Rd
auuuauucaaaauaaa

SEQ ID NO: 2706141 - RNA, 16 nt, Haemophilus influenzae Rd
auuuauucagcuuuaa

SEQ ID NO: 2706142 - RNA, 14 nt, Haemophilus influenzae Rd
auuuauuccaucaa

SEQ ID NO: 2706143 - RNA, 19 nt, Haemophilus influenzae Rd
auuuauucccccauuaaaa

SEQ ID NO: 2706144 - RNA, 22 nt, Haemophilus influenzae Rd
auuuauucccccauuaaaagaa

SEQ ID NO: 2706145 - RNA, 23 nt, Haemophilus influenzae Rd
auuuauucccccauuaaaagaag

SEQ ID NO: 2706146 - RNA, 20 nt, Haemophilus influenzae Rd
auuuauuccugcuuuuuuca

SEQ ID NO: 2706147 - RNA, 21 nt, Haemophilus influenzae Rd
auuuauuccuucaaucgcauc

SEQ ID NO: 2706148 - RNA, 23 nt, Haemophilus influenzae Rd
auuuauuguagccuaguauuuuu

SEQ ID NO: 2706149 - RNA, 13 nt, Haemophilus influenzae Rd
auuuauuuaacaa

SEQ ID NO: 2706150 - RNA, 14 nt, Haemophilus influenzae Rd
auuuauuuaacaau

SEQ ID NO: 2706151 - RNA, 20 nt, Haemophilus influenzae Rd
auuuauuuaacaaugaaauu

SEQ ID NO: 2706152 - RNA, 21 nt, Haemophilus influenzae Rd
auuuauuuaacaaugaaauua

SEQ ID NO: 2706153 - RNA, 16 nt, Haemophilus influenzae Rd
auuuauuuacaucggu

SEQ ID NO: 2706154 - RNA, 15 nt, Haemophilus influenzae Rd
auuuauuucaauaua

SEQ ID NO: 2706155 - RNA, 16 nt, Haemophilus influenzae Rd
auuuauuucaucaauc

SEQ ID NO: 2706156 - RNA, 15 nt, Haemophilus influenzae Rd
auuuauuugcuaaaa

SEQ ID NO: 2706157 - RNA, 16 nt, Haemophilus influenzae Rd
auuuauuugcuaaaau

SEQ ID NO: 2706158 - RNA, 23 nt, Haemophilus influenzae Rd
auuuauuugcuaaaauuaccgcu

SEQ ID NO: 2706159 - RNA, 17 nt, Haemophilus influenzae Rd
auuuauuuuaaaaucau

SEQ ID NO: 2706160 - RNA, 17 nt, Haemophilus influenzae Rd
auuuauuuugguauuuu

SEQ ID NO: 2706161 - RNA, 18 nt, Haemophilus influenzae Rd
auuuauuuugguauuuuu

SEQ ID NO: 2706162 - RNA, 22 nt, Haemophilus influenzae Rd
auuucaaccgcacuuuuuuuca

SEQ ID NO: 2706163 - RNA, 17 nt, Haemophilus influenzae Rd
auuucaacgaauaauuu

SEQ ID NO: 2706164 - RNA, 17 nt, Haemophilus influenzae Rd
auuucaagcuuugcaac

SEQ ID NO: 2706165 - RNA, 16 nt, Haemophilus influenzae Rd
auuucaauaaauucac

SEQ ID NO: 2706166 - RNA, 18 nt, Haemophilus influenzae Rd
auuucaauaaauucacca

SEQ ID NO: 2706167 - RNA, 13 nt, Haemophilus influenzae Rd
auuucaauauaag

SEQ ID NO: 2706168 - RNA, 19 nt, Haemophilus influenzae Rd
auuucaauauaaucaauua

SEQ ID NO: 2706169 - RNA, 15 nt, Haemophilus influenzae Rd
auuucaauauugucu

SEQ ID NO: 2706170 - RNA, 15 nt, Haemophilus influenzae Rd
auuucaaucacugaa

SEQ ID NO: 2706171 - RNA, 13 nt, Haemophilus influenzae Rd
auuucaauugcca

SEQ ID NO: 2706172 - RNA, 14 nt, Haemophilus influenzae Rd
auuucacaauuuuu

SEQ ID NO: 2706173 - RNA, 20 nt, Haemophilus influenzae Rd
auuucacaccauuuuuaauu

SEQ ID NO: 2706174 - RNA, 22 nt, Haemophilus influenzae Rd
auuucaccgcagaaguaaaaua

SEQ ID NO: 2706175 - RNA, 15 nt, Haemophilus influenzae Rd
auuucaccguauuuu

SEQ ID NO: 2706176 - RNA, 22 nt, Haemophilus influenzae Rd
auuucacgcugacguuguucaa

SEQ ID NO: 2706177 - RNA, 16 nt, Haemophilus influenzae Rd
auuucacguaguuaaa

SEQ ID NO: 2706178 - RNA, 21 nt, Haemophilus influenzae Rd
auuucacguaguuaaaccaaa

SEQ ID NO: 2706179 - RNA, 15 nt, Haemophilus influenzae Rd
auuucacuaaauaaa

SEQ ID NO: 2706180 - RNA, 16 nt, Haemophilus influenzae Rd
auuucacuaaauaaau

SEQ ID NO: 2706181 - RNA, 15 nt, Haemophilus influenzae Rd
auuucacuaaauccu

SEQ ID NO: 2706182 - RNA, 23 nt, Haemophilus influenzae Rd
auuucacuauucagcaaccuaaa

SEQ ID NO: 2706183 - RNA, 21 nt, Haemophilus influenzae Rd
auuucacuucuaacuaaaaaa

SEQ ID NO: 2706184 - RNA, 14 nt, Haemophilus influenzae Rd
auuucagcaucaga

SEQ ID NO: 2706185 - RNA, 17 nt, Haemophilus influenzae Rd
auuucagcugcaauauc

SEQ ID NO: 2706186 - RNA, 17 nt, Haemophilus influenzae Rd
auuucagcuuaaauacu

SEQ ID NO: 2706187 - RNA, 23 nt, Haemophilus influenzae Rd
auuucaggaucgucuugaccugc

SEQ ID NO: 2706188 - RNA, 19 nt, Haemophilus influenzae Rd
auuucaguagaaucaaggc

SEQ ID NO: 2706189 - RNA, 20 nt, Haemophilus influenzae Rd
auuucaguagaaucaaggcu

SEQ ID NO: 2706190 - RNA, 13 nt, Haemophilus influenzae Rd
auuucaguaucaa

SEQ ID NO: 2706191 - RNA, 16 nt, Haemophilus influenzae Rd
auuucaguaucaauac

SEQ ID NO: 2706192 - RNA, 14 nt, Haemophilus influenzae Rd
auuucauaaaaauu

SEQ ID NO: 2706193 - RNA, 16 nt, Haemophilus influenzae Rd
auuucauaaaaauuag

SEQ ID NO: 2706194 - RNA, 18 nt, Haemophilus influenzae Rd
auuucauaaaaauuaggu

SEQ ID NO: 2706195 - RNA, 22 nt, Haemophilus influenzae Rd
auuucauaaacgguauuuucuc

SEQ ID NO: 2706196 - RNA, 22 nt, Haemophilus influenzae Rd
auuucauaucucacaauaauuu

SEQ ID NO: 2706197 - RNA, 19 nt, Haemophilus influenzae Rd
auuucaucaggcauugcgc

SEQ ID NO: 2706198 - RNA, 17 nt, Haemophilus influenzae Rd
auuucaucccaauuauu

SEQ ID NO: 2706199 - RNA, 15 nt, Haemophilus influenzae Rd
auuugauaaaaacac

SEQ ID NO: 2706200 - RNA, 17 nt, Haemophilus influenzae Rd
auuugaucguuaauauc

SEQ ID NO: 2706201 - RNA, 19 nt, Haemophilus influenzae Rd
auuugauuaucuagcacaa

SEQ ID NO: 2706202 - RNA, 13 nt, Haemophilus influenzae Rd
auuugauuucaga

SEQ ID NO: 2706203 - RNA, 21 nt, Haemophilus influenzae Rd
auuugauuucagaacaugacu

SEQ ID NO: 2706204 - RNA, 17 nt, Haemophilus influenzae Rd
auuugauuuuuauagug

SEQ ID NO: 2706205 - RNA, 22 nt, Haemophilus influenzae Rd
auuugcaaggcucgcgauuaau

SEQ ID NO: 2706206 - RNA, 21 nt, Haemophilus influenzae Rd
auuugcaccuuguaaccaagc

SEQ ID NO: 2706207 - RNA, 16 nt, Haemophilus influenzae Rd
auuugcauaaaaccag

SEQ ID NO: 2706208 - RNA, 22 nt, Haemophilus influenzae Rd
auuugcauaaaaccagcauuga

SEQ ID NO: 2706209 - RNA, 19 nt, Haemophilus influenzae Rd
auuugcauaguuuuccauu

SEQ ID NO: 2706210 - RNA, 15 nt, Haemophilus influenzae Rd
auuugcauauaaaaa

SEQ ID NO: 2706211 - RNA, 14 nt, Haemophilus influenzae Rd
auuugcauauguug

SEQ ID NO: 2706212 - RNA, 22 nt, Haemophilus influenzae Rd
auuugccaaaacgcaauuucca

SEQ ID NO: 2706213 - RNA, 16 nt, Haemophilus influenzae Rd
auuugccaaaaucacg

SEQ ID NO: 2706214 - RNA, 14 nt, Haemophilus influenzae Rd
auuugccaaguaca

SEQ ID NO: 2706215 - RNA, 16 nt, Haemophilus influenzae Rd
auuugccaucacucaa

SEQ ID NO: 2706216 - RNA, 13 nt, Haemophilus influenzae Rd
auuugcccauacc

SEQ ID NO: 2706217 - RNA, 17 nt, Haemophilus influenzae Rd
auuugccccaauauuuu

SEQ ID NO: 2706218 - RNA, 14 nt, Haemophilus influenzae Rd
auuugccucuucuu

SEQ ID NO: 2706219 - RNA, 16 nt, Haemophilus influenzae Rd
auuugcggacaguaua

SEQ ID NO: 2706220 - RNA, 21 nt, Haemophilus influenzae Rd
auuugcgggguuuuguuuuau

SEQ ID NO: 2706221 - RNA, 17 nt, Haemophilus influenzae Rd
auuugcuaagauugcaa

SEQ ID NO: 2706222 - RNA, 15 nt, Haemophilus influenzae Rd
auuugcuauccaacc

SEQ ID NO: 2706223 - RNA, 17 nt, Haemophilus influenzae Rd
auuugcuauccaaccua

SEQ ID NO: 2706224 - RNA, 16 nt, Haemophilus influenzae Rd
auuugcucaauaauuu

SEQ ID NO: 2706225 - RNA, 13 nt, Haemophilus influenzae Rd
auuugcucuaaau

SEQ ID NO: 2706226 - RNA, 13 nt, Haemophilus influenzae Rd
auuugcugcugcu

SEQ ID NO: 2706227 - RNA, 24 nt, Haemophilus influenzae Rd
auuugcuucgccuucagcaauuaa

SEQ ID NO: 2706228 - RNA, 14 nt, Haemophilus influenzae Rd
auuugcuuggaaua

SEQ ID NO: 2706229 - RNA, 17 nt, Haemophilus influenzae Rd
auuugcuuggaauaaau

SEQ ID NO: 2706230 - RNA, 18 nt, Haemophilus influenzae Rd
auuugcuuuaacccauuu

SEQ ID NO: 2706231 - RNA, 20 nt, Haemophilus influenzae Rd
auuugcuuuaacccauuuau

SEQ ID NO: 2706232 - RNA, 13 nt, Haemophilus influenzae Rd
auuuggaauacuc

SEQ ID NO: 2706233 - RNA, 16 nt, Haemophilus influenzae Rd
auuuggaucuaaaaaa

SEQ ID NO: 2706234 - RNA, 22 nt, Haemophilus influenzae Rd
auuuggaucuaaaaaaucaauc

SEQ ID NO: 2706235 - RNA, 15 nt, Haemophilus influenzae Rd
auuuggcauagaaaa

SEQ ID NO: 2706236 - RNA, 13 nt, Haemophilus influenzae Rd
auuuggcauuuug

SEQ ID NO: 2706237 - RNA, 16 nt, Haemophilus influenzae Rd
auuuggcucacaagac

SEQ ID NO: 2706238 - RNA, 23 nt, Haemophilus influenzae Rd
auuuggucgccgacuuuuacauc

SEQ ID NO: 2706239 - RNA, 19 nt, Haemophilus influenzae Rd
auuuggucuaacauuucau

SEQ ID NO: 2706240 - RNA, 16 nt, Haemophilus influenzae Rd
auuugguuagaucaga

SEQ ID NO: 2706241 - RNA, 18 nt, Haemophilus influenzae Rd
auuugguuaguuguuuca

SEQ ID NO: 2706242 - RNA, 14 nt, Haemophilus influenzae Rd
auuuguaccaccaa

SEQ ID NO: 2706243 - RNA, 15 nt, Haemophilus influenzae Rd
auuuguaccaccaaa

SEQ ID NO: 2706244 - RNA, 14 nt, Haemophilus influenzae Rd
auuuguaccauugu

SEQ ID NO: 2706245 - RNA, 12 nt, Haemophilus influenzae Rd
auuugugaugaa

SEQ ID NO: 2706246 - RNA, 17 nt, Haemophilus influenzae Rd
auuuguguggaaaaaug

SEQ ID NO: 2706247 - RNA, 16 nt, Haemophilus influenzae Rd
auuuguuacuaaaaua

SEQ ID NO: 2706248 - RNA, 18 nt, Haemophilus influenzae Rd
auuuguuacuaaaauaau

SEQ ID NO: 2706249 - RNA, 20 nt, Haemophilus influenzae Rd
auuuguuagaaauacauuau

SEQ ID NO: 2706250 - RNA, 23 nt, Haemophilus influenzae Rd
auuuguuagaaauacauuauuaa

SEQ ID NO: 2706251 - RNA, 20 nt, Haemophilus influenzae Rd
auuuguuagaucaaauuuga

SEQ ID NO: 2706252 - RNA, 14 nt, Haemophilus influenzae Rd
auuuguucuacuuu

SEQ ID NO: 2706253 - RNA, 22 nt, Haemophilus influenzae Rd
auuuguugaauuggaaguuuuu

SEQ ID NO: 2706254 - RNA, 21 nt, Haemophilus influenzae Rd
auuuguugaucugcaaauggu

SEQ ID NO: 2706255 - RNA, 18 nt, Haemophilus influenzae Rd
auuuguugccauuguuaa

SEQ ID NO: 2706256 - RNA, 22 nt, Haemophilus influenzae Rd
auuuguugguaaaucuaacaau

SEQ ID NO: 2706257 - RNA, 23 nt, Haemophilus influenzae Rd
auuuguugguaaaucuaacaauc

SEQ ID NO: 2706258 - RNA, 17 nt, Haemophilus influenzae Rd
auuuguuguucuccuug

SEQ ID NO: 2706259 - RNA, 11 nt, Haemophilus influenzae Rd
auuuguuuuau

SEQ ID NO: 2706260 - RNA, 18 nt, Haemophilus influenzae Rd
auuuguuuuccguauuuu

SEQ ID NO: 2706261 - RNA, 20 nt, Haemophilus influenzae Rd
auuuguuuuccguauuuuca

SEQ ID NO: 2706262 - RNA, 23 nt, Haemophilus influenzae Rd
auuuguuuuuaguuuuuuuauaa

SEQ ID NO: 2706263 - RNA, 14 nt, Haemophilus influenzae Rd
auuuguuuuuuagg

SEQ ID NO: 2706264 - RNA, 13 nt, Haemophilus influenzae Rd
auuuuaaaacaug

SEQ ID NO: 2706265 - RNA, 17 nt, Haemophilus influenzae Rd
auuuuaaaaccacaaua

SEQ ID NO: 2706266 - RNA, 14 nt, Haemophilus influenzae Rd
auuuuaaaaggcuu

SEQ ID NO: 2706267 - RNA, 14 nt, Haemophilus influenzae Rd
auuuuaaaauaaau

SEQ ID NO: 2706268 - RNA, 14 nt, Haemophilus influenzae Rd
auuuuaaaauauca

SEQ ID NO: 2706269 - RNA, 12 nt, Haemophilus influenzae Rd
auuuuaaaauuu

SEQ ID NO: 2706270 - RNA, 15 nt, Haemophilus influenzae Rd
auuuuaaacagcaaa

SEQ ID NO: 2706271 - RNA, 13 nt, Haemophilus influenzae Rd
auuuuaaagccau

SEQ ID NO: 2706272 - RNA, 14 nt, Haemophilus influenzae Rd
auuuuaaauaaaaa

SEQ ID NO: 2706273 - RNA, 15 nt, Haemophilus influenzae Rd
auuuuaaauaaaaaa

SEQ ID NO: 2706274 - RNA, 20 nt, Haemophilus influenzae Rd
auuuuaaauaaaaaauaaau

SEQ ID NO: 2706275 - RNA, 20 nt, Haemophilus influenzae Rd
auuuuaaauaaaauauuuaa

SEQ ID NO: 2706276 - RNA, 16 nt, Haemophilus influenzae Rd
auuuuaaauaauuaaa

SEQ ID NO: 2706277 - RNA, 14 nt, Haemophilus influenzae Rd
auuuuaaaucccaa

SEQ ID NO: 2706278 - RNA, 14 nt, Haemophilus influenzae Rd
auuuuaaauuauuu

SEQ ID NO: 2706279 - RNA, 17 nt, Haemophilus influenzae Rd
auuuuaacucagggaaa

SEQ ID NO: 2706280 - RNA, 15 nt, Haemophilus influenzae Rd
auuuuaauaaagaua

SEQ ID NO: 2706281 - RNA, 14 nt, Haemophilus influenzae Rd
auuuuaauaaggca

SEQ ID NO: 2706282 - RNA, 21 nt, Haemophilus influenzae Rd
auuuuaaugaaaguaacaaug

SEQ ID NO: 2706283 - RNA, 12 nt, Haemophilus influenzae Rd
auuuuaaugcug

SEQ ID NO: 2706284 - RNA, 22 nt, Haemophilus influenzae Rd
auuuuaauuaucuaaauuacau

SEQ ID NO: 2706285 - RNA, 17 nt, Haemophilus influenzae Rd
auuuuaccgcacuuuau

SEQ ID NO: 2706286 - RNA, 21 nt, Haemophilus influenzae Rd
auuuuaccgcacuuuuaaaau

SEQ ID NO: 2706287 - RNA, 21 nt, Haemophilus influenzae Rd
auuuuaccgcacuuuuuuucu

SEQ ID NO: 2706288 - RNA, 15 nt, Haemophilus influenzae Rd
auuuuacggauuuau

SEQ ID NO: 2706289 - RNA, 21 nt, Haemophilus influenzae Rd
auuuuacguaguacaucauuu

SEQ ID NO: 2706290 - RNA, 20 nt, Haemophilus influenzae Rd
auuuuacguauguauuuuca

SEQ ID NO: 2706291 - RNA, 20 nt, Haemophilus influenzae Rd
auuuuacguuucauuuuugc

SEQ ID NO: 2706292 - RNA, 21 nt, Haemophilus influenzae Rd
auuuuacguuucauuuuugca

SEQ ID NO: 2706293 - RNA, 17 nt, Haemophilus influenzae Rd
auuuuacguuuuaaauu

SEQ ID NO: 2706294 - RNA, 15 nt, Haemophilus influenzae Rd
auuuuacuaauuaaa

SEQ ID NO: 2706295 - RNA, 19 nt, Haemophilus influenzae Rd
auuuuacuugugcauuugg

SEQ ID NO: 2706296 - RNA, 22 nt, Haemophilus influenzae Rd
auuuuacuuguuuaugucuaaa

SEQ ID NO: 2706297 - RNA, 18 nt, Haemophilus influenzae Rd
auuuuacuuuagcaaugc

SEQ ID NO: 2706298 - RNA, 14 nt, Haemophilus influenzae Rd
auuuuagaaaaauc

SEQ ID NO: 2706299 - RNA, 20 nt, Haemophilus influenzae Rd
auuuuagaaaaaucgaagaa

SEQ ID NO: 2706300 - RNA, 22 nt, Haemophilus influenzae Rd
auuuuagaaaaaucgaagaaau

SEQ ID NO: 2706301 - RNA, 22 nt, Haemophilus influenzae Rd
auuuuagaauccaaaauuacuu

SEQ ID NO: 2706302 - RNA, 21 nt, Haemophilus influenzae Rd
auuuuagaggcuaugauuuua

SEQ ID NO: 2706303 - RNA, 23 nt, Haemophilus influenzae Rd
auuuuagauuggauggagagaau

SEQ ID NO: 2706304 - RNA, 20 nt, Haemophilus influenzae Rd
auuuuggaaugguugcaaag

SEQ ID NO: 2706305 - RNA, 22 nt, Haemophilus influenzae Rd
auuuuggaucauuagcaacuuc

SEQ ID NO: 2706306 - RNA, 22 nt, Haemophilus influenzae Rd
auuuuggcgaaccuuucauaua

SEQ ID NO: 2706307 - RNA, 18 nt, Haemophilus influenzae Rd
auuuuggcuuaauuacua

SEQ ID NO: 2706308 - RNA, 21 nt, Haemophilus influenzae Rd
auuuuggcuuaauuacuauau

SEQ ID NO: 2706309 - RNA, 16 nt, Haemophilus influenzae Rd
auuuugguauuuuugu

SEQ ID NO: 2706310 - RNA, 15 nt, Haemophilus influenzae Rd
auuuugguuaaacuc

SEQ ID NO: 2706311 - RNA, 16 nt, Haemophilus influenzae Rd
auuuugguuaaacucg

SEQ ID NO: 2706312 - RNA, 16 nt, Haemophilus influenzae Rd
auuuuguaagcauuaa

SEQ ID NO: 2706313 - RNA, 17 nt, Haemophilus influenzae Rd
auuuuguaauaaaaccu

SEQ ID NO: 2706314 - RNA, 20 nt, Haemophilus influenzae Rd
auuuuguauauugugacaaa

SEQ ID NO: 2706315 - RNA, 16 nt, Haemophilus influenzae Rd
auuuugucagauuuau

SEQ ID NO: 2706316 - RNA, 22 nt, Haemophilus influenzae Rd
auuuuguccgugccaaagcauu

SEQ ID NO: 2706317 - RNA, 16 nt, Haemophilus influenzae Rd
auuuugugaucuugau

SEQ ID NO: 2706318 - RNA, 23 nt, Haemophilus influenzae Rd
auuuuguggcaaucguucuaaaa

SEQ ID NO: 2706319 - RNA, 20 nt, Haemophilus influenzae Rd
auuuuguuaaaaguuagauu

SEQ ID NO: 2706320 - RNA, 22 nt, Haemophilus influenzae Rd
auuuuguuagcggauaaaauaa

SEQ ID NO: 2706321 - RNA, 17 nt, Haemophilus influenzae Rd
auuuuguuucuaaauua

SEQ ID NO: 2706322 - RNA, 11 nt, Haemophilus influenzae Rd
auuuuuaaaaa

SEQ ID NO: 2706323 - RNA, 23 nt, Haemophilus influenzae Rd
auuuuuaaaagcaccgcauugua

SEQ ID NO: 2706324 - RNA, 21 nt, Haemophilus influenzae Rd
auuuuuaaaauagaaugaaaa

SEQ ID NO: 2706325 - RNA, 18 nt, Haemophilus influenzae Rd
auuuuuaaacaauauauu

SEQ ID NO: 2706326 - RNA, 15 nt, Haemophilus influenzae Rd
auuuuuaaagaaauc

SEQ ID NO: 2706327 - RNA, 12 nt, Haemophilus influenzae Rd
auuuuuaaaguu

SEQ ID NO: 2706328 - RNA, 19 nt, Haemophilus influenzae Rd
auuuuuaaccgcacuuuua

SEQ ID NO: 2706329 - RNA, 23 nt, Haemophilus influenzae Rd
auuuuuaaccgcacuuuuuaaua

SEQ ID NO: 2706330 - RNA, 20 nt, Haemophilus influenzae Rd
auuuuuaauaaaguaaaaua

SEQ ID NO: 2706331 - RNA, 13 nt, Haemophilus influenzae Rd
auuuuuaaugaac

SEQ ID NO: 2706332 - RNA, 17 nt, Haemophilus influenzae Rd
auuuuuaaugcguuuua

SEQ ID NO: 2706333 - RNA, 14 nt, Haemophilus influenzae Rd
auuuuuaauuuacu

SEQ ID NO: 2706334 - RNA, 19 nt, Haemophilus influenzae Rd
auuuuuaauuuacuggaaa

SEQ ID NO: 2706335 - RNA, 13 nt, Haemophilus influenzae Rd
auuuuuaauuuau

SEQ ID NO: 2706336 - RNA, 16 nt, Haemophilus influenzae Rd
auuuuuaauuuucucg

SEQ ID NO: 2706337 - RNA, 17 nt, Haemophilus influenzae Rd
auuuuuaauuuugaagu

SEQ ID NO: 2706338 - RNA, 15 nt, Haemophilus influenzae Rd
auuuuuaccaauuug

SEQ ID NO: 2706339 - RNA, 18 nt, Haemophilus influenzae Rd
auuuuuaccauauccauu

SEQ ID NO: 2706340 - RNA, 14 nt, Haemophilus influenzae Rd
auuuuuaccccacc

SEQ ID NO: 2706341 - RNA, 17 nt, Haemophilus influenzae Rd
auuuuuacuauuaaugc

SEQ ID NO: 2706342 - RNA, 23 nt, Haemophilus influenzae Rd
auuuuuacucguccaaauucauu

SEQ ID NO: 2706343 - RNA, 11 nt, Haemophilus influenzae Rd
auuuuuagaaa

SEQ ID NO: 2706344 - RNA, 14 nt, Haemophilus influenzae Rd
auuuuuagaaaauc

SEQ ID NO: 2706345 - RNA, 19 nt, Haemophilus influenzae Rd
auuuuuagaagagauuauu

SEQ ID NO: 2706346 - RNA, 22 nt, Haemophilus influenzae Rd
auuuuuagaagagauuauuugc

SEQ ID NO: 2706347 - RNA, 21 nt, Haemophilus influenzae Rd
auuuuuagacggucaaauuca

SEQ ID NO: 2706348 - RNA, 14 nt, Haemophilus influenzae Rd
auuuuuagauuauu

SEQ ID NO: 2706349 - RNA, 19 nt, Haemophilus influenzae Rd
auuuuuaggugcuuuuugc

SEQ ID NO: 2706350 - RNA, 14 nt, Haemophilus influenzae Rd
auuuuuauauguuc

SEQ ID NO: 2706351 - RNA, 15 nt, Haemophilus influenzae Rd
auuuuuaucaauaac

SEQ ID NO: 2706352 - RNA, 22 nt, Haemophilus influenzae Rd
auuuuuaucaauaacugauuuu

SEQ ID NO: 2706353 - RNA, 18 nt, Haemophilus influenzae Rd
auuuuuaucauauauaaa

SEQ ID NO: 2706354 - RNA, 17 nt, Haemophilus influenzae Rd
auuuuuaugauuuugca

SEQ ID NO: 2706355 - RNA, 22 nt, Haemophilus influenzae Rd
auuuuuaugauuuugcauuaaa

SEQ ID NO: 2706356 - RNA, 21 nt, Haemophilus influenzae Rd
auuuuuauuaguaaaauaaua

SEQ ID NO: 2706357 - RNA, 12 nt, Haemophilus influenzae Rd
auuuuuauuauc

SEQ ID NO: 2706358 - RNA, 14 nt, Haemophilus influenzae Rd
auuuuuauuaucaa

SEQ ID NO: 2706359 - RNA, 20 nt, Haemophilus influenzae Rd
auuuuuauuccuuacaacaa

SEQ ID NO: 2706360 - RNA, 15 nt, Haemophilus influenzae Rd
auuuuuauuguguuu

SEQ ID NO: 2706361 - RNA, 17 nt, Haemophilus influenzae Rd
auuuuuauuuaaugggu

SEQ ID NO: 2706362 - RNA, 13 nt, Haemophilus influenzae Rd
auuuuuauuuucu

SEQ ID NO: 2706363 - RNA, 15 nt, Haemophilus influenzae Rd
auuuuuauuuuuacu

SEQ ID NO: 2706364 - RNA, 22 nt, Haemophilus influenzae Rd
auuuuucaauaagcaaguaauu

SEQ ID NO: 2706365 - RNA, 23 nt, Haemophilus influenzae Rd
auuuuucaauaagcaaguaauuu

SEQ ID NO: 2706366 - RNA, 22 nt, Haemophilus influenzae Rd
auuuuucaccgcacuuucuucu

SEQ ID NO: 2706367 - RNA, 23 nt, Haemophilus influenzae Rd
auuuuucaccgcacuuucuucuu

SEQ ID NO: 2706368 - RNA, 15 nt, Haemophilus influenzae Rd
auuuuucaguauuuu

SEQ ID NO: 2706369 - RNA, 19 nt, Haemophilus influenzae Rd
auuuuucaguauuuuuucg

SEQ ID NO: 2706370 - RNA, 17 nt, Haemophilus influenzae Rd
auuuuucauaaauauca

SEQ ID NO: 2706371 - RNA, 19 nt, Haemophilus influenzae Rd
auuuuucauaaauaucaac

SEQ ID NO: 2706372 - RNA, 20 nt, Haemophilus influenzae Rd
auuuuucaucuuuuuauaaa

SEQ ID NO: 2706373 - RNA, 12 nt, Haemophilus influenzae Rd
auuuuucauucu

SEQ ID NO: 2706374 - RNA, 21 nt, Haemophilus influenzae Rd
auuuuuccuuuucauaaaaau

SEQ ID NO: 2706375 - RNA, 23 nt, Haemophilus influenzae Rd
auuuuucgcaaaaucuugcugaa

SEQ ID NO: 2706376 - RNA, 20 nt, Haemophilus influenzae Rd
auuuuucgcuacgccuugga

SEQ ID NO: 2706377 - RNA, 15 nt, Haemophilus influenzae Rd
auuuuucggauuaag

SEQ ID NO: 2706378 - RNA, 17 nt, Haemophilus influenzae Rd
auuuuucuaaaaucaca

SEQ ID NO: 2706379 - RNA, 16 nt, Haemophilus influenzae Rd
auuuuucuuuucuucu

SEQ ID NO: 2706380 - RNA, 20 nt, Haemophilus influenzae Rd
auuuuucuuuuucaguuuuu

SEQ ID NO: 2706381 - RNA, 21 nt, Haemophilus influenzae Rd
auuuuucuuuuucaguuuuua

SEQ ID NO: 2706382 - RNA, 12 nt, Haemophilus influenzae Rd
auuuuugaauga

SEQ ID NO: 2706383 - RNA, 22 nt, Haemophilus influenzae Rd
auuuuugaaugaugaguagauu

SEQ ID NO: 2706384 - RNA, 19 nt, Haemophilus influenzae Rd
auuuuugagguguuuaugc

SEQ ID NO: 2706385 - RNA, 19 nt, Haemophilus influenzae Rd
auuuuugauccugaucuuu

SEQ ID NO: 2706386 - RNA, 17 nt, Haemophilus influenzae Rd
auuuuugauugcaccua

SEQ ID NO: 2706387 - RNA, 18 nt, Haemophilus influenzae Rd
auuuuugcacgaauuuca

SEQ ID NO: 2706388 - RNA, 19 nt, Haemophilus influenzae Rd
auuuuugcacgaauuucag

SEQ ID NO: 2706389 - RNA, 16 nt, Haemophilus influenzae Rd
auuuuugcgauuuuau

SEQ ID NO: 2706390 - RNA, 19 nt, Haemophilus influenzae Rd
auuuuuggauuuaacccag

SEQ ID NO: 2706391 - RNA, 15 nt, Haemophilus influenzae Rd
auuuuugguuucauu

SEQ ID NO: 2706392 - RNA, 19 nt, Haemophilus influenzae Rd
auuuuugucccaaaauauu

SEQ ID NO: 2706393 - RNA, 21 nt, Haemophilus influenzae Rd
auuuuugucccaaaauauuuu

SEQ ID NO: 2706394 - RNA, 15 nt, Haemophilus influenzae Rd
auuuuuuaacuugau

SEQ ID NO: 2706395 - RNA, 17 nt, Haemophilus influenzae Rd
auuuuuuacgauauuuu

SEQ ID NO: 2706396 - RNA, 13 nt, Haemophilus influenzae Rd
auuuuuuacucaa

SEQ ID NO: 2706397 - RNA, 22 nt, Haemophilus influenzae Rd
auuuuuuacugcuucauaaaug

SEQ ID NO: 2706398 - RNA, 14 nt, Haemophilus influenzae Rd
auuuuuuauaaaau

SEQ ID NO: 2706399 - RNA, 17 nt, Haemophilus influenzae Rd
auuuuuuauaaugucau

SEQ ID NO: 2706400 - RNA, 12 nt, Haemophilus influenzae Rd
auuuuuuaucaa

SEQ ID NO: 2706401 - RNA, 15 nt, Haemophilus influenzae Rd
auuuuuuaugguaaa

SEQ ID NO: 2706402 - RNA, 23 nt, Haemophilus influenzae Rd
auuuuuuauuacccuauucuaaa

SEQ ID NO: 2706403 - RNA, 16 nt, Haemophilus influenzae Rd
auuuuuuauuuuuucu

SEQ ID NO: 2706404 - RNA, 16 nt, Haemophilus influenzae Rd
auuuuuucaauuuaaa

SEQ ID NO: 2706405 - RNA, 14 nt, Haemophilus influenzae Rd
auuuuuucacaauc

SEQ ID NO: 2706406 - RNA, 22 nt, Haemophilus influenzae Rd
auuuuuucacaccgucuaaaaa

SEQ ID NO: 2706407 - RNA, 17 nt, Haemophilus influenzae Rd
auuuuuucaucauuucu

SEQ ID NO: 2706408 - RNA, 19 nt, Haemophilus influenzae Rd
auuuuuucgaucuaaucca

SEQ ID NO: 2706409 - RNA, 22 nt, Haemophilus influenzae Rd
caaaaucacgccagauaaaauu

SEQ ID NO: 2706410 - RNA, 17 nt, Haemophilus influenzae Rd
caaaaucagcaaauugu

SEQ ID NO: 2706411 - RNA, 21 nt, Haemophilus influenzae Rd
caaaaucaguuauugauaaaa

SEQ ID NO: 2706412 - RNA, 22 nt, Haemophilus influenzae Rd
caaaaucauauugauuuacauu

SEQ ID NO: 2706413 - RNA, 12 nt, Haemophilus influenzae Rd
caaaaucaucac

SEQ ID NO: 2706414 - RNA, 18 nt, Haemophilus influenzae Rd
caaaaucauuaaaaucug

SEQ ID NO: 2706415 - RNA, 22 nt, Haemophilus influenzae Rd
caaaaucauucguaucaacuuu

SEQ ID NO: 2706416 - RNA, 16 nt, Haemophilus influenzae Rd
caaaaucgcauauuga

SEQ ID NO: 2706417 - RNA, 23 nt, Haemophilus influenzae Rd
caaaaucguaauuuuaaaaccac

SEQ ID NO: 2706418 - RNA, 18 nt, Haemophilus influenzae Rd
caaaaucucuggagaaaa

SEQ ID NO: 2706419 - RNA, 14 nt, Haemophilus influenzae Rd
caaaaucuugcuga

SEQ ID NO: 2706420 - RNA, 13 nt, Haemophilus influenzae Rd
caaaaugaacagu

SEQ ID NO: 2706421 - RNA, 23 nt, Haemophilus influenzae Rd
caaaaugcgugcugugauugaug

SEQ ID NO: 2706422 - RNA, 21 nt, Haemophilus influenzae Rd
caaaaugcuugaauaaaugac

SEQ ID NO: 2706423 - RNA, 13 nt, Haemophilus influenzae Rd
caaaauggaauuc

SEQ ID NO: 2706424 - RNA, 15 nt, Haemophilus influenzae Rd
caaaauggcaaacaa

SEQ ID NO: 2706425 - RNA, 19 nt, Haemophilus influenzae Rd
caaaauggcaaacaaaaua

SEQ ID NO: 2706426 - RNA, 15 nt, Haemophilus influenzae Rd
caaaaugucgccauu

SEQ ID NO: 2706427 - RNA, 17 nt, Haemophilus influenzae Rd
caaaauguucacugcgg

SEQ ID NO: 2706428 - RNA, 22 nt, Haemophilus influenzae Rd
caaaauguuuacgcuaauuuaa

SEQ ID NO: 2706429 - RNA, 21 nt, Haemophilus influenzae Rd
caaaauuaaauugaaaaaauc

SEQ ID NO: 2706430 - RNA, 15 nt, Haemophilus influenzae Rd
caaaauuaaugccaa

SEQ ID NO: 2706431 - RNA, 17 nt, Haemophilus influenzae Rd
caaaauuagacuuucuu

SEQ ID NO: 2706432 - RNA, 19 nt, Haemophilus influenzae Rd
caaaauugaucgaaaaauc

SEQ ID NO: 2706433 - RNA, 22 nt, Haemophilus influenzae Rd
caaaauugaucgaaaaaucuuu

SEQ ID NO: 2706434 - RNA, 16 nt, Haemophilus influenzae Rd
caaaauugaugaaaau

SEQ ID NO: 2706435 - RNA, 18 nt, Haemophilus influenzae Rd
caaaauugaugaaaauuc

SEQ ID NO: 2706436 - RNA, 19 nt, Haemophilus influenzae Rd
caaaauugaugaaaauucu

SEQ ID NO: 2706437 - RNA, 17 nt, Haemophilus influenzae Rd
caaaauugcuuaaugga

SEQ ID NO: 2706438 - RNA, 15 nt, Haemophilus influenzae Rd
caaaauuguguguuu

SEQ ID NO: 2706439 - RNA, 22 nt, Haemophilus influenzae Rd
caaaauuuaaaaucgcaauuuu

SEQ ID NO: 2706440 - RNA, 17 nt, Haemophilus influenzae Rd
caaaauuucugaacaca

SEQ ID NO: 2706441 - RNA, 20 nt, Haemophilus influenzae Rd
caaaauuuuaaauaaaauau

SEQ ID NO: 2706442 - RNA, 23 nt, Haemophilus influenzae Rd
caaacaaaaagugcggugauuuu

SEQ ID NO: 2706443 - RNA, 13 nt, Haemophilus influenzae Rd
caaacaaaauaaa

SEQ ID NO: 2706444 - RNA, 14 nt, Haemophilus influenzae Rd
caaacaaaauuuua

SEQ ID NO: 2706445 - RNA, 16 nt, Haemophilus influenzae Rd
caaacaagcccacauu

SEQ ID NO: 2706446 - RNA, 12 nt, Haemophilus influenzae Rd
caaacacaaaau

SEQ ID NO: 2706447 - RNA, 14 nt, Haemophilus influenzae Rd
caaacagcaauaaa

SEQ ID NO: 2706448 - RNA, 17 nt, Haemophilus influenzae Rd
caaacagcaauaaauaa

SEQ ID NO: 2706449 - RNA, 18 nt, Haemophilus influenzae Rd
caaacagcaauaaauaau

SEQ ID NO: 2706450 - RNA, 21 nt, Haemophilus influenzae Rd
caaacaggcuuauuaaaaacu

SEQ ID NO: 2706451 - RNA, 22 nt, Haemophilus influenzae Rd
caaacagggcagugauguaaau

SEQ ID NO: 2706452 - RNA, 19 nt, Haemophilus influenzae Rd
caaacaguucaauaaaaau

SEQ ID NO: 2706453 - RNA, 20 nt, Haemophilus influenzae Rd
caaacaguucaauaaaaaua

SEQ ID NO: 2706454 - RNA, 14 nt, Haemophilus influenzae Rd
caaacauaccacuu

SEQ ID NO: 2706455 - RNA, 20 nt, Haemophilus influenzae Rd
caaacaucagcgcauaauua

SEQ ID NO: 2706456 - RNA, 13 nt, Haemophilus influenzae Rd
caaacaucaucac

SEQ ID NO: 2706457 - RNA, 14 nt, Haemophilus influenzae Rd
caaacaugcuccca

SEQ ID NO: 2706458 - RNA, 23 nt, Haemophilus influenzae Rd
caaacauuaaucgaucaauuugc

SEQ ID NO: 2706459 - RNA, 15 nt, Haemophilus influenzae Rd
caaacauuuuuauuu

SEQ ID NO: 2706460 - RNA, 20 nt, Haemophilus influenzae Rd
caaacauuuuuauuuuuacu

SEQ ID NO: 2706461 - RNA, 20 nt, Haemophilus influenzae Rd
caaaccaaaaucuaaaccag

SEQ ID NO: 2706462 - RNA, 18 nt, Haemophilus influenzae Rd
caaaccaaaucacaauaa

SEQ ID NO: 2706463 - RNA, 13 nt, Haemophilus influenzae Rd
caaaccaucucga

SEQ ID NO: 2706464 - RNA, 13 nt, Haemophilus influenzae Rd
caaaccauuuauc

SEQ ID NO: 2706465 - RNA, 17 nt, Haemophilus influenzae Rd
caaacgaaaaaaauaaa

SEQ ID NO: 2706466 - RNA, 18 nt, Haemophilus influenzae Rd
caaacgaaaaaaauaaaa

SEQ ID NO: 2706467 - RNA, 20 nt, Haemophilus influenzae Rd
caaacgacuuaauuuuauag

SEQ ID NO: 2706468 - RNA, 17 nt, Haemophilus influenzae Rd
caaacgaugaagaaaau

SEQ ID NO: 2706469 - RNA, 18 nt, Haemophilus influenzae Rd
caaacgccguucaaaauc

SEQ ID NO: 2706470 - RNA, 21 nt, Haemophilus influenzae Rd
caaacgcuccauuaccguaug

SEQ ID NO: 2706471 - RNA, 14 nt, Haemophilus influenzae Rd
caaacgcucuuuaa

SEQ ID NO: 2706472 - RNA, 13 nt, Haemophilus influenzae Rd
caaacggaaaauu

SEQ ID NO: 2706473 - RNA, 17 nt, Haemophilus influenzae Rd
caaacggaaaauuugau

SEQ ID NO: 2706474 - RNA, 20 nt, Haemophilus influenzae Rd
caaacggucgaguuuuucaa

SEQ ID NO: 2706475 - RNA, 14 nt, Haemophilus influenzae Rd
caaacuaaaugcuc

SEQ ID NO: 2706476 - RNA, 15 nt, Haemophilus influenzae Rd
caaacuaauuucauu

SEQ ID NO: 2706477 - RNA, 20 nt, Haemophilus influenzae Rd
caaacuauuaccuaaccaaa

SEQ ID NO: 2706478 - RNA, 16 nt, Haemophilus influenzae Rd
caaacucuaauuccac

SEQ ID NO: 2706479 - RNA, 14 nt, Haemophilus influenzae Rd
caaacugccaaaca

SEQ ID NO: 2706480 - RNA, 16 nt, Haemophilus influenzae Rd
caaacugccaaacaaa

SEQ ID NO: 2706481 - RNA, 15 nt, Haemophilus influenzae Rd
caaacuggaauaaag

SEQ ID NO: 2706482 - RNA, 17 nt, Haemophilus influenzae Rd
caaacugguuaaaaucc

SEQ ID NO: 2706483 - RNA, 18 nt, Haemophilus influenzae Rd
caaacugguuaaaaucca

SEQ ID NO: 2706484 - RNA, 15 nt, Haemophilus influenzae Rd
caaacuuaaauacau

SEQ ID NO: 2706485 - RNA, 13 nt, Haemophilus influenzae Rd
caaacuuggauca

SEQ ID NO: 2706486 - RNA, 23 nt, Haemophilus influenzae Rd
caaacuuuuagaaugcagauuaa

SEQ ID NO: 2706487 - RNA, 13 nt, Haemophilus influenzae Rd
caaagaaaaacua

SEQ ID NO: 2706488 - RNA, 16 nt, Haemophilus influenzae Rd
caaagaaucuuaaauu

SEQ ID NO: 2706489 - RNA, 22 nt, Haemophilus influenzae Rd
caaagaaucuuaaauucauaau

SEQ ID NO: 2706490 - RNA, 13 nt, Haemophilus influenzae Rd
caaagacuaauac

SEQ ID NO: 2706491 - RNA, 23 nt, Haemophilus influenzae Rd
caaagagaagcugaauaaaagag

SEQ ID NO: 2706492 - RNA, 15 nt, Haemophilus influenzae Rd
caaagauugcauuga

SEQ ID NO: 2706493 - RNA, 16 nt, Haemophilus influenzae Rd
caaagauuuuaaaauu

SEQ ID NO: 2706494 - RNA, 12 nt, Haemophilus influenzae Rd
caaagcaaaauu

SEQ ID NO: 2706495 - RNA, 13 nt, Haemophilus influenzae Rd
caaagcacuaauc

SEQ ID NO: 2706496 - RNA, 22 nt, Haemophilus influenzae Rd
caaagcacuaugguguuacuua

SEQ ID NO: 2706497 - RNA, 23 nt, Haemophilus influenzae Rd
caaagcacuaugguguuacuuaa

SEQ ID NO: 2706498 - RNA, 19 nt, Haemophilus influenzae Rd
caaagcauuaaguuuuuag

SEQ ID NO: 2706499 - RNA, 20 nt, Haemophilus influenzae Rd
caaagcauuuagagcaagca

SEQ ID NO: 2706500 - RNA, 14 nt, Haemophilus influenzae Rd
caaagccugcuaca

SEQ ID NO: 2706501 - RNA, 17 nt, Haemophilus influenzae Rd
caaagccuucaccuaau

SEQ ID NO: 2706502 - RNA, 17 nt, Haemophilus influenzae Rd
caaagcguucauuuuga

SEQ ID NO: 2706503 - RNA, 15 nt, Haemophilus influenzae Rd
caaagcguuuuaaaa

SEQ ID NO: 2706504 - RNA, 17 nt, Haemophilus influenzae Rd
caaagcguuuuaaaauc

SEQ ID NO: 2706505 - RNA, 20 nt, Haemophilus influenzae Rd
caaagcucaccugcccugaa

SEQ ID NO: 2706506 - RNA, 22 nt, Haemophilus influenzae Rd
caaagcuggcucuucuuguuca

SEQ ID NO: 2706507 - RNA, 15 nt, Haemophilus influenzae Rd
caaagcuguaaaauu

SEQ ID NO: 2706508 - RNA, 22 nt, Haemophilus influenzae Rd
caaaggcaggacguuuuaauag

SEQ ID NO: 2706509 - RNA, 21 nt, Haemophilus influenzae Rd
caaaggcucuaccuaaaauaa

SEQ ID NO: 2706510 - RNA, 20 nt, Haemophilus influenzae Rd
caaaggcuuucgcaaguugu

SEQ ID NO: 2706511 - RNA, 16 nt, Haemophilus influenzae Rd
caaagggcugauauuu

SEQ ID NO: 2706512 - RNA, 15 nt, Haemophilus influenzae Rd
caaaggguaaauaac

SEQ ID NO: 2706513 - RNA, 16 nt, Haemophilus influenzae Rd
caaagguaaaacuuuc

SEQ ID NO: 2706514 - RNA, 19 nt, Haemophilus influenzae Rd
caacaacaaagucuucauc

SEQ ID NO: 2706515 - RNA, 14 nt, Haemophilus influenzae Rd
caacaacgauagca

SEQ ID NO: 2706516 - RNA, 15 nt, Haemophilus influenzae Rd
caacaaguucuucua

SEQ ID NO: 2706517 - RNA, 18 nt, Haemophilus influenzae Rd
caacaauauuaggaauag

SEQ ID NO: 2706518 - RNA, 13 nt, Haemophilus influenzae Rd
caacaaucacugu

SEQ ID NO: 2706519 - RNA, 14 nt, Haemophilus influenzae Rd
caacaaugcuauaa

SEQ ID NO: 2706520 - RNA, 21 nt, Haemophilus influenzae Rd
caacaauuaaugucauccauc

SEQ ID NO: 2706521 - RNA, 19 nt, Haemophilus influenzae Rd
caacaauucauaaauaauu

SEQ ID NO: 2706522 - RNA, 20 nt, Haemophilus influenzae Rd
caacaauucauaaauaauug

SEQ ID NO: 2706523 - RNA, 17 nt, Haemophilus influenzae Rd
caacaccagucaauaaa

SEQ ID NO: 2706524 - RNA, 20 nt, Haemophilus influenzae Rd
caacaccgcaaaaauacuaa

SEQ ID NO: 2706525 - RNA, 18 nt, Haemophilus influenzae Rd
caacaccuaaaugagaaa

SEQ ID NO: 2706526 - RNA, 14 nt, Haemophilus influenzae Rd
caacacgccuaaca

SEQ ID NO: 2706527 - RNA, 13 nt, Haemophilus influenzae Rd
caacacuuuauua

SEQ ID NO: 2706528 - RNA, 17 nt, Haemophilus influenzae Rd
caacacuuuauuacuuu

SEQ ID NO: 2706529 - RNA, 18 nt, Haemophilus influenzae Rd
caacagauuuaauaccau

SEQ ID NO: 2706530 - RNA, 19 nt, Haemophilus influenzae Rd
caacagauuuaauaccaua

SEQ ID NO: 2706531 - RNA, 15 nt, Haemophilus influenzae Rd
caacagcugcacaag

SEQ ID NO: 2706532 - RNA, 21 nt, Haemophilus influenzae Rd
caacagcugcacaagcaccac

SEQ ID NO: 2706533 - RNA, 13 nt, Haemophilus influenzae Rd
caacagcuucucc

SEQ ID NO: 2706534 - RNA, 12 nt, Haemophilus influenzae Rd
caacaguaaauu

SEQ ID NO: 2706535 - RNA, 19 nt, Haemophilus influenzae Rd
caacauaguugaugaacca

SEQ ID NO: 2706536 - RNA, 11 nt, Haemophilus influenzae Rd
caacauauuuu

SEQ ID NO: 2706537 - RNA, 13 nt, Haemophilus influenzae Rd
caacaucaauaac

SEQ ID NO: 2706538 - RNA, 20 nt, Haemophilus influenzae Rd
caacaucagauggaauauuu

SEQ ID NO: 2706539 - RNA, 14 nt, Haemophilus influenzae Rd
caacaucauaaggu

SEQ ID NO: 2706540 - RNA, 23 nt, Haemophilus influenzae Rd
caacaucauaagguacaacagac

SEQ ID NO: 2706541 - RNA, 16 nt, Haemophilus influenzae Rd
caacaucgcagugauc

SEQ ID NO: 2706542 - RNA, 19 nt, Haemophilus influenzae Rd
caacauuucacuaaauaaa

SEQ ID NO: 2706543 - RNA, 14 nt, Haemophilus influenzae Rd
caacauuuuuugcu

SEQ ID NO: 2706544 - RNA, 17 nt, Haemophilus influenzae Rd
caaccaaaauacaauca

SEQ ID NO: 2706545 - RNA, 11 nt, Haemophilus influenzae Rd
caaccaaacaa

SEQ ID NO: 2706546 - RNA, 13 nt, Haemophilus influenzae Rd
caaccacccaaau

SEQ ID NO: 2706547 - RNA, 17 nt, Haemophilus influenzae Rd
caaccacccauacuuua

SEQ ID NO: 2706548 - RNA, 20 nt, Haemophilus influenzae Rd
caaccacccauacuuuaacu

SEQ ID NO: 2706549 - RNA, 23 nt, Haemophilus influenzae Rd
caaccacccauacuuuaacuucu

SEQ ID NO: 2706550 - RNA, 13 nt, Haemophilus influenzae Rd
caaccacuucaaa

SEQ ID NO: 2706551 - RNA, 14 nt, Haemophilus influenzae Rd
caaccacuucaaau

SEQ ID NO: 2706552 - RNA, 16 nt, Haemophilus influenzae Rd
caaccagcagaaaaua

SEQ ID NO: 2706553 - RNA, 17 nt, Haemophilus influenzae Rd
caaccagcagaaaauaa

SEQ ID NO: 2706554 - RNA, 19 nt, Haemophilus influenzae Rd
caaccauaacaagaaucau

SEQ ID NO: 2706555 - RNA, 13 nt, Haemophilus influenzae Rd
caacccauuuucc

SEQ ID NO: 2706556 - RNA, 13 nt, Haemophilus influenzae Rd
caaccgaauauau

SEQ ID NO: 2706557 - RNA, 19 nt, Haemophilus influenzae Rd
caaccgauaaggaaaauac

SEQ ID NO: 2706558 - RNA, 18 nt, Haemophilus influenzae Rd
caaccgcucuuuuuauuu

SEQ ID NO: 2706559 - RNA, 14 nt, Haemophilus influenzae Rd
caaccguggcaacc

SEQ ID NO: 2706560 - RNA, 14 nt, Haemophilus influenzae Rd
caaccguugcauug

SEQ ID NO: 2706561 - RNA, 18 nt, Haemophilus influenzae Rd
caaccuugagcaauauaa

SEQ ID NO: 2706562 - RNA, 14 nt, Haemophilus influenzae Rd
caacgaaaauagca

SEQ ID NO: 2706563 - RNA, 22 nt, Haemophilus influenzae Rd
caacgacgguauaaaccuugca

SEQ ID NO: 2706564 - RNA, 17 nt, Haemophilus influenzae Rd
caacgagcgagaccacu

SEQ ID NO: 2706565 - RNA, 19 nt, Haemophilus influenzae Rd
caacgcaucuuuauaacau

SEQ ID NO: 2706566 - RNA, 15 nt, Haemophilus influenzae Rd
caacgccuacgccgu

SEQ ID NO: 2706567 - RNA, 21 nt, Haemophilus influenzae Rd
caacgcguacuuuuuuaccuu

SEQ ID NO: 2706568 - RNA, 15 nt, Haemophilus influenzae Rd
caacggauuaaaagu

SEQ ID NO: 2706569 - RNA, 20 nt, Haemophilus influenzae Rd
caacgguaacugauuuugcu

SEQ ID NO: 2706570 - RNA, 15 nt, Haemophilus influenzae Rd
caacgguguggaaag

SEQ ID NO: 2706571 - RNA, 14 nt, Haemophilus influenzae Rd
caacguaaaaguaa

SEQ ID NO: 2706572 - RNA, 17 nt, Haemophilus influenzae Rd
caacuaaaaagacaaaa

SEQ ID NO: 2706573 - RNA, 14 nt, Haemophilus influenzae Rd
caacuaaaaauccc

SEQ ID NO: 2706574 - RNA, 21 nt, Haemophilus influenzae Rd
caacuaaaggcacaaaaaauu

SEQ ID NO: 2706575 - RNA, 14 nt, Haemophilus influenzae Rd
caacuaaaucaucu

SEQ ID NO: 2706576 - RNA, 20 nt, Haemophilus influenzae Rd
caacuaacacgcgcugcucu

SEQ ID NO: 2706577 - RNA, 16 nt, Haemophilus influenzae Rd
caacuaauaaaccaau

SEQ ID NO: 2706578 - RNA, 21 nt, Haemophilus influenzae Rd
caacuaauuuauuaaaaauaa

SEQ ID NO: 2706579 - RNA, 18 nt, Haemophilus influenzae Rd
caacuaugaagacuaaac

SEQ ID NO: 2706580 - RNA, 13 nt, Haemophilus influenzae Rd
caacuaugguaaa

SEQ ID NO: 2706581 - RNA, 14 nt, Haemophilus influenzae Rd
caacucacaauaau

SEQ ID NO: 2706582 - RNA, 22 nt, Haemophilus influenzae Rd
caacugaauucucaauugcaga

SEQ ID NO: 2706583 - RNA, 16 nt, Haemophilus influenzae Rd
caacugcaaaugaaac

SEQ ID NO: 2706584 - RNA, 17 nt, Haemophilus influenzae Rd
caacugcaacaauuuca

SEQ ID NO: 2706585 - RNA, 14 nt, Haemophilus influenzae Rd
caacugcuucuguu

SEQ ID NO: 2706586 - RNA, 19 nt, Haemophilus influenzae Rd
caacuggagccuugggaau

SEQ ID NO: 2706587 - RNA, 14 nt, Haemophilus influenzae Rd
caacuguuauauug

SEQ ID NO: 2706588 - RNA, 14 nt, Haemophilus influenzae Rd
caacuuaaacaagc

SEQ ID NO: 2706589 - RNA, 13 nt, Haemophilus influenzae Rd
caacuucaucaau

SEQ ID NO: 2706590 - RNA, 18 nt, Haemophilus influenzae Rd
caacuuccgcuaauacua

SEQ ID NO: 2706591 - RNA, 17 nt, Haemophilus influenzae Rd
caacuucggaagaaaaa

SEQ ID NO: 2706592 - RNA, 19 nt, Haemophilus influenzae Rd
caacuucggaagaaaaaga

SEQ ID NO: 2706593 - RNA, 21 nt, Haemophilus influenzae Rd
caacuucugcgccuaauccaa

SEQ ID NO: 2706594 - RNA, 16 nt, Haemophilus influenzae Rd
caacuugcaaccauaa

SEQ ID NO: 2706595 - RNA, 20 nt, Haemophilus influenzae Rd
caacuugccacaguagaugu

SEQ ID NO: 2706596 - RNA, 12 nt, Haemophilus influenzae Rd
caacuuggaaug

SEQ ID NO: 2706597 - RNA, 23 nt, Haemophilus influenzae Rd
caacuuguuguguuucagcuucg

SEQ ID NO: 2706598 - RNA, 15 nt, Haemophilus influenzae Rd
caacuuuuucaucuu

SEQ ID NO: 2706599 - RNA, 19 nt, Haemophilus influenzae Rd
caagaaaccaaaauagcug

SEQ ID NO: 2706600 - RNA, 12 nt, Haemophilus influenzae Rd
caagaaacucaa

SEQ ID NO: 2706601 - RNA, 15 nt, Haemophilus influenzae Rd
caagaaacucaaggu

SEQ ID NO: 2706602 - RNA, 14 nt, Haemophilus influenzae Rd
caagaaagaaauau

SEQ ID NO: 2706603 - RNA, 20 nt, Haemophilus influenzae Rd
caagaaagaaauauaauaaa

SEQ ID NO: 2706604 - RNA, 21 nt, Haemophilus influenzae Rd
caagaaagcguucaucaauuu

SEQ ID NO: 2706605 - RNA, 17 nt, Haemophilus influenzae Rd
caagaaaguuuuaagug

SEQ ID NO: 2706606 - RNA, 18 nt, Haemophilus influenzae Rd
caagaaauugauauaaau

SEQ ID NO: 2706607 - RNA, 21 nt, Haemophilus influenzae Rd
caagaaauuuuguuuuguuca

SEQ ID NO: 2706608 - RNA, 11 nt, Haemophilus influenzae Rd
caagaagauuu

SEQ ID NO: 2706609 - RNA, 12 nt, Haemophilus influenzae Rd
caagaagauuug

SEQ ID NO: 2706610 - RNA, 14 nt, Haemophilus influenzae Rd
caagaauaaaaugu

SEQ ID NO: 2706611 - RNA, 13 nt, Haemophilus influenzae Rd
caagaauauuuca

SEQ ID NO: 2706612 - RNA, 22 nt, Haemophilus influenzae Rd
caagaaugacuggcuugugaaa

SEQ ID NO: 2706613 - RNA, 13 nt, Haemophilus influenzae Rd
caagaauuccauu

SEQ ID NO: 2706614 - RNA, 17 nt, Haemophilus influenzae Rd
caagaauuuuaauaagg

SEQ ID NO: 2706615 - RNA, 16 nt, Haemophilus influenzae Rd
caagacguucuaauug

SEQ ID NO: 2706616 - RNA, 18 nt, Haemophilus influenzae Rd
caagagaggcaccugaau

SEQ ID NO: 2706617 - RNA, 18 nt, Haemophilus influenzae Rd
caagagccuccacaagca

SEQ ID NO: 2706618 - RNA, 21 nt, Haemophilus influenzae Rd
caagagccuccacaagcaaca

SEQ ID NO: 2706619 - RNA, 20 nt, Haemophilus influenzae Rd
caagagucuugccaacgcag

SEQ ID NO: 2706620 - RNA, 19 nt, Haemophilus influenzae Rd
caauaacaagcacaagauu

SEQ ID NO: 2706621 - RNA, 15 nt, Haemophilus influenzae Rd
caauaaccacgccuu

SEQ ID NO: 2706622 - RNA, 14 nt, Haemophilus influenzae Rd
caauaacuaaaaau

SEQ ID NO: 2706623 - RNA, 17 nt, Haemophilus influenzae Rd
caauaacucuauaaaau

SEQ ID NO: 2706624 - RNA, 17 nt, Haemophilus influenzae Rd
caauaacuggaauggau

SEQ ID NO: 2706625 - RNA, 19 nt, Haemophilus influenzae Rd
caauaagauagaaauguug

SEQ ID NO: 2706626 - RNA, 15 nt, Haemophilus influenzae Rd
caauaaggcuuuuuu

SEQ ID NO: 2706627 - RNA, 21 nt, Haemophilus influenzae Rd
caauaagugcgguaaaaaaau

SEQ ID NO: 2706628 - RNA, 22 nt, Haemophilus influenzae Rd
caauaauagccauauuaucugc

SEQ ID NO: 2706629 - RNA, 19 nt, Haemophilus influenzae Rd
caauaauaggcgaaucaaa

SEQ ID NO: 2706630 - RNA, 21 nt, Haemophilus influenzae Rd
caauaauaggcgaaucaaaau

SEQ ID NO: 2706631 - RNA, 13 nt, Haemophilus influenzae Rd
caauaauaucugc

SEQ ID NO: 2706632 - RNA, 14 nt, Haemophilus influenzae Rd
caauaauaucugcu

SEQ ID NO: 2706633 - RNA, 21 nt, Haemophilus influenzae Rd
caauaaucacaguaccuacau

SEQ ID NO: 2706634 - RNA, 16 nt, Haemophilus influenzae Rd
caauaauccuuuuuuu

SEQ ID NO: 2706635 - RNA, 19 nt, Haemophilus influenzae Rd
caauaaugauguaccaaaa

SEQ ID NO: 2706636 - RNA, 23 nt, Haemophilus influenzae Rd
caauaaugugagaauaaccacau

SEQ ID NO: 2706637 - RNA, 15 nt, Haemophilus influenzae Rd
caauaauguugcuga

SEQ ID NO: 2706638 - RNA, 19 nt, Haemophilus influenzae Rd
caauaauguugcugauugc

SEQ ID NO: 2706639 - RNA, 16 nt, Haemophilus influenzae Rd
caauaauuaaacagcc

SEQ ID NO: 2706640 - RNA, 21 nt, Haemophilus influenzae Rd
caauaauuaaugcuaaaccaa

SEQ ID NO: 2706641 - RNA, 22 nt, Haemophilus influenzae Rd
caauaauucauuagaaaguugu

SEQ ID NO: 2706642 - RNA, 21 nt, Haemophilus influenzae Rd
caauaauugaagcaauugaaa

SEQ ID NO: 2706643 - RNA, 18 nt, Haemophilus influenzae Rd
caauaauugaugcuaaau

SEQ ID NO: 2706644 - RNA, 22 nt, Haemophilus influenzae Rd
caauaauugaugcuaaauuaua

SEQ ID NO: 2706645 - RNA, 20 nt, Haemophilus influenzae Rd
caauaauuucuuguuuaaau

SEQ ID NO: 2706646 - RNA, 14 nt, Haemophilus influenzae Rd
caauaauuugccaa

SEQ ID NO: 2706647 - RNA, 12 nt, Haemophilus influenzae Rd
caauaauuuuac

SEQ ID NO: 2706648 - RNA, 16 nt, Haemophilus influenzae Rd
caauaauuuuuaauuc

SEQ ID NO: 2706649 - RNA, 20 nt, Haemophilus influenzae Rd
caauaauuuuuaauucuuuu

SEQ ID NO: 2706650 - RNA, 18 nt, Haemophilus influenzae Rd
caauacacauuucuucua

SEQ ID NO: 2706651 - RNA, 16 nt, Haemophilus influenzae Rd
caauacaucaguaaug

SEQ ID NO: 2706652 - RNA, 23 nt, Haemophilus influenzae Rd
caauaccaagugcugguagcaau

SEQ ID NO: 2706653 - RNA, 16 nt, Haemophilus influenzae Rd
caauaccaauuuccau

SEQ ID NO: 2706654 - RNA, 15 nt, Haemophilus influenzae Rd
caauaccacagcauu

SEQ ID NO: 2706655 - RNA, 13 nt, Haemophilus influenzae Rd
caauaccuaacgu

SEQ ID NO: 2706656 - RNA, 16 nt, Haemophilus influenzae Rd
caauaccuuugugaca

SEQ ID NO: 2706657 - RNA, 14 nt, Haemophilus influenzae Rd
caauacgauauuug

SEQ ID NO: 2706658 - RNA, 19 nt, Haemophilus influenzae Rd
caauacgccaacgcuuaau

SEQ ID NO: 2706659 - RNA, 15 nt, Haemophilus influenzae Rd
caauacgccuaaaac

SEQ ID NO: 2706660 - RNA, 16 nt, Haemophilus influenzae Rd
caauacguugaguaua

SEQ ID NO: 2706661 - RNA, 17 nt, Haemophilus influenzae Rd
caauacuccaacccaga

SEQ ID NO: 2706662 - RNA, 15 nt, Haemophilus influenzae Rd
caauacucuuaacaa

SEQ ID NO: 2706663 - RNA, 18 nt, Haemophilus influenzae Rd
caauacucuuaacaaaac

SEQ ID NO: 2706664 - RNA, 16 nt, Haemophilus influenzae Rd
caauacuguuuggcaa

SEQ ID NO: 2706665 - RNA, 23 nt, Haemophilus influenzae Rd
caauagaacgaaccccuugaauu

SEQ ID NO: 2706666 - RNA, 15 nt, Haemophilus influenzae Rd
caauagaauuggugc

SEQ ID NO: 2706667 - RNA, 18 nt, Haemophilus influenzae Rd
caauagccaauaauaaag

SEQ ID NO: 2706668 - RNA, 15 nt, Haemophilus influenzae Rd
caauagcgaccaaca

SEQ ID NO: 2706669 - RNA, 19 nt, Haemophilus influenzae Rd
caauagcgaccaacaguua

SEQ ID NO: 2706670 - RNA, 15 nt, Haemophilus influenzae Rd
caauagguugcaaau

SEQ ID NO: 2706671 - RNA, 17 nt, Haemophilus influenzae Rd
caauagucguuuaacca

SEQ ID NO: 2706672 - RNA, 14 nt, Haemophilus influenzae Rd
caauauaacucaac

SEQ ID NO: 2706673 - RNA, 15 nt, Haemophilus influenzae Rd
caauauaacucaaca

SEQ ID NO: 2706674 - RNA, 23 nt, Haemophilus influenzae Rd
caauauaacucaacaccgcaaaa

SEQ ID NO: 2706675 - RNA, 19 nt, Haemophilus influenzae Rd
caauauaaucaauuauuuc

SEQ ID NO: 2706676 - RNA, 14 nt, Haemophilus influenzae Rd
caauauaauuauca

SEQ ID NO: 2706677 - RNA, 16 nt, Haemophilus influenzae Rd
caauauagucaaauaa

SEQ ID NO: 2706678 - RNA, 15 nt, Haemophilus influenzae Rd
caauauauaaauccg

SEQ ID NO: 2706679 - RNA, 21 nt, Haemophilus influenzae Rd
caauauaucagacaaucugug

SEQ ID NO: 2706680 - RNA, 20 nt, Haemophilus influenzae Rd
caauauauucggaaaaaauu

SEQ ID NO: 2706681 - RNA, 19 nt, Haemophilus influenzae Rd
caauaucaaucgguuucac

SEQ ID NO: 2706682 - RNA, 23 nt, Haemophilus influenzae Rd
caauaucccaacuuuauguccau

SEQ ID NO: 2706683 - RNA, 16 nt, Haemophilus influenzae Rd
caauaucuaagaaaau

SEQ ID NO: 2706684 - RNA, 19 nt, Haemophilus influenzae Rd
caauaucuaagauuuuagu

SEQ ID NO: 2706685 - RNA, 22 nt, Haemophilus influenzae Rd
caauaucuauuggaauggcaaa

SEQ ID NO: 2706686 - RNA, 22 nt, Haemophilus influenzae Rd
caauaucugcacguaaaguugg

SEQ ID NO: 2706687 - RNA, 20 nt, Haemophilus influenzae Rd
caauauggaacaguugaaaa

SEQ ID NO: 2706688 - RNA, 21 nt, Haemophilus influenzae Rd
caauauguauaauuccuaaaa

SEQ ID NO: 2706689 - RNA, 16 nt, Haemophilus influenzae Rd
caauauuaucgugauu

SEQ ID NO: 2706690 - RNA, 21 nt, Haemophilus influenzae Rd
caauauuaugugcuugggcaa

SEQ ID NO: 2706691 - RNA, 11 nt, Haemophilus influenzae Rd
caauauuauuc

SEQ ID NO: 2706692 - RNA, 15 nt, Haemophilus influenzae Rd
caauauuauucagca

SEQ ID NO: 2706693 - RNA, 17 nt, Haemophilus influenzae Rd
caauauucuuuaaaaca

SEQ ID NO: 2706694 - RNA, 14 nt, Haemophilus influenzae Rd
caauauugaaaagu

SEQ ID NO: 2706695 - RNA, 16 nt, Haemophilus influenzae Rd
caauauugaccguuug

SEQ ID NO: 2706696 - RNA, 15 nt, Haemophilus influenzae Rd
caauauugucuauuu

SEQ ID NO: 2706697 - RNA, 18 nt, Haemophilus influenzae Rd
caauauugucuauuuuau

SEQ ID NO: 2706698 - RNA, 15 nt, Haemophilus influenzae Rd
caauauuuaaauaca

SEQ ID NO: 2706699 - RNA, 18 nt, Haemophilus influenzae Rd
caauauuuaauauauuuu

SEQ ID NO: 2706700 - RNA, 18 nt, Haemophilus influenzae Rd
caauauuuacucuuuuuu

SEQ ID NO: 2706701 - RNA, 15 nt, Haemophilus influenzae Rd
caauauuuauuucua

SEQ ID NO: 2706702 - RNA, 22 nt, Haemophilus influenzae Rd
caauauuuauuucuauagauuu

SEQ ID NO: 2706703 - RNA, 14 nt, Haemophilus influenzae Rd
caauauuucaauaa

SEQ ID NO: 2706704 - RNA, 12 nt, Haemophilus influenzae Rd
caaucaaaaaau

SEQ ID NO: 2706705 - RNA, 15 nt, Haemophilus influenzae Rd
caaucaaaaaugaaa

SEQ ID NO: 2706706 - RNA, 22 nt, Haemophilus influenzae Rd
caaucaaaaaugaaagggaaau

SEQ ID NO: 2706707 - RNA, 13 nt, Haemophilus influenzae Rd
caaucaaauaaag

SEQ ID NO: 2706708 - RNA, 22 nt, Haemophilus influenzae Rd
caaucaaauucucuguuucuuu

SEQ ID NO: 2706709 - RNA, 16 nt, Haemophilus influenzae Rd
caaucaacacaccuau

SEQ ID NO: 2706710 - RNA, 20 nt, Haemophilus influenzae Rd
caaucaacgcuguacaaagc

SEQ ID NO: 2706711 - RNA, 20 nt, Haemophilus influenzae Rd
caaucaagaauuccauugca

SEQ ID NO: 2706712 - RNA, 13 nt, Haemophilus influenzae Rd
caaucaagcaaau

SEQ ID NO: 2706713 - RNA, 15 nt, Haemophilus influenzae Rd
caaucaagcaaauag

SEQ ID NO: 2706714 - RNA, 20 nt, Haemophilus influenzae Rd
caaucaagcauaaaucuuua

SEQ ID NO: 2706715 - RNA, 14 nt, Haemophilus influenzae Rd
caaucaauucuuuc

SEQ ID NO: 2706716 - RNA, 15 nt, Haemophilus influenzae Rd
caaucaauucuuuca

SEQ ID NO: 2706717 - RNA, 12 nt, Haemophilus influenzae Rd
caaucacaauga

SEQ ID NO: 2706718 - RNA, 21 nt, Haemophilus influenzae Rd
caaucacuagccauaaauaaa

SEQ ID NO: 2706719 - RNA, 19 nt, Haemophilus influenzae Rd
caaucacuuuaucuaaagu

SEQ ID NO: 2706720 - RNA, 14 nt, Haemophilus influenzae Rd
caaucaguuuuacg

SEQ ID NO: 2706721 - RNA, 15 nt, Haemophilus influenzae Rd
caaucauaucaucaa

SEQ ID NO: 2706722 - RNA, 13 nt, Haemophilus influenzae Rd
caaucaucagaau

SEQ ID NO: 2706723 - RNA, 16 nt, Haemophilus influenzae Rd
caaucaucagaauaau

SEQ ID NO: 2706724 - RNA, 21 nt, Haemophilus influenzae Rd
caaucaucccuucuuuuauag

SEQ ID NO: 2706725 - RNA, 20 nt, Haemophilus influenzae Rd
caauucuuuuuguaauuuuu

SEQ ID NO: 2706726 - RNA, 22 nt, Haemophilus influenzae Rd
caauucuuuuuguaauuuuuga

SEQ ID NO: 2706727 - RNA, 13 nt, Haemophilus influenzae Rd
caauugauguaaa

SEQ ID NO: 2706728 - RNA, 14 nt, Haemophilus influenzae Rd
caauugauguaaaa

SEQ ID NO: 2706729 - RNA, 12 nt, Haemophilus influenzae Rd
caauugauuuuu

SEQ ID NO: 2706730 - RNA, 19 nt, Haemophilus influenzae Rd
caauugcagauuuuuuuau

SEQ ID NO: 2706731 - RNA, 21 nt, Haemophilus influenzae Rd
caauugcagcccaaauuguug

SEQ ID NO: 2706732 - RNA, 17 nt, Haemophilus influenzae Rd
caauugccgacacuaaa

SEQ ID NO: 2706733 - RNA, 21 nt, Haemophilus influenzae Rd
caauugcucgugcaggauaaa

SEQ ID NO: 2706734 - RNA, 17 nt, Haemophilus influenzae Rd
caauuguuguuggcaua

SEQ ID NO: 2706735 - RNA, 23 nt, Haemophilus influenzae Rd
caauuuaaaucaacucacuaucc

SEQ ID NO: 2706736 - RNA, 14 nt, Haemophilus influenzae Rd
caauuuaacauaau

SEQ ID NO: 2706737 - RNA, 14 nt, Haemophilus influenzae Rd
caauuuaagcccug

SEQ ID NO: 2706738 - RNA, 15 nt, Haemophilus influenzae Rd
caauuuaagcccugc

SEQ ID NO: 2706739 - RNA, 22 nt, Haemophilus influenzae Rd
caauuucaaaacaguuuucaaa

SEQ ID NO: 2706740 - RNA, 19 nt, Haemophilus influenzae Rd
caauuucaaauaaacauac

SEQ ID NO: 2706741 - RNA, 15 nt, Haemophilus influenzae Rd
caauuucaauugcca

SEQ ID NO: 2706742 - RNA, 14 nt, Haemophilus influenzae Rd
caauuucacgauuu

SEQ ID NO: 2706743 - RNA, 16 nt, Haemophilus influenzae Rd
caauuucaucacauca

SEQ ID NO: 2706744 - RNA, 17 nt, Haemophilus influenzae Rd
caauuuccauaaaagac

SEQ ID NO: 2706745 - RNA, 19 nt, Haemophilus influenzae Rd
caauuuccgcuuccugcug

SEQ ID NO: 2706746 - RNA, 12 nt, Haemophilus influenzae Rd
caauuucguuua

SEQ ID NO: 2706747 - RNA, 12 nt, Haemophilus influenzae Rd
caauuucucugg

SEQ ID NO: 2706748 - RNA, 15 nt, Haemophilus influenzae Rd
caauuucugcauaau

SEQ ID NO: 2706749 - RNA, 14 nt, Haemophilus influenzae Rd
caauuucuucagcu

SEQ ID NO: 2706750 - RNA, 15 nt, Haemophilus influenzae Rd
caauuucuuuaccuu

SEQ ID NO: 2706751 - RNA, 16 nt, Haemophilus influenzae Rd
caauuugaaaauuuau

SEQ ID NO: 2706752 - RNA, 21 nt, Haemophilus influenzae Rd
caauuugacgcgcacauacuu

SEQ ID NO: 2706753 - RNA, 17 nt, Haemophilus influenzae Rd
caauuugagucucaaau

SEQ ID NO: 2706754 - RNA, 21 nt, Haemophilus influenzae Rd
caauuugagucucaaauuuuu

SEQ ID NO: 2706755 - RNA, 15 nt, Haemophilus influenzae Rd
caauuugcggagaaa

SEQ ID NO: 2706756 - RNA, 19 nt, Haemophilus influenzae Rd
caauuugugcauaaacagc

SEQ ID NO: 2706757 - RNA, 11 nt, Haemophilus influenzae Rd
caauuuuaaaa

SEQ ID NO: 2706758 - RNA, 20 nt, Haemophilus influenzae Rd
caauuuuaacgccugcugca

SEQ ID NO: 2706759 - RNA, 20 nt, Haemophilus influenzae Rd
caauuuuaauugguuuugug

SEQ ID NO: 2706760 - RNA, 20 nt, Haemophilus influenzae Rd
caauuuuacguuuuaaauua

SEQ ID NO: 2706761 - RNA, 14 nt, Haemophilus influenzae Rd
caauuuucugcaga

SEQ ID NO: 2706762 - RNA, 21 nt, Haemophilus influenzae Rd
caauuuucugugagucuugcu

SEQ ID NO: 2706763 - RNA, 22 nt, Haemophilus influenzae Rd
caauuuucugugagucuugcuu

SEQ ID NO: 2706764 - RNA, 22 nt, Haemophilus influenzae Rd
caauuuucuuuucaaacaacaa

SEQ ID NO: 2706765 - RNA, 13 nt, Haemophilus influenzae Rd
caauuuuucaaaa

SEQ ID NO: 2706766 - RNA, 19 nt, Haemophilus influenzae Rd
caauuuuucggauuaagug

SEQ ID NO: 2706767 - RNA, 20 nt, Haemophilus influenzae Rd
caauuuuuuaucaaauaacg

SEQ ID NO: 2706768 - RNA, 22 nt, Haemophilus influenzae Rd
caauuuuuucugaauaaauuuu

SEQ ID NO: 2706769 - RNA, 18 nt, Haemophilus influenzae Rd
caauuuuuuucaagcaac

SEQ ID NO: 2706770 - RNA, 13 nt, Haemophilus influenzae Rd
cacaaaacugaag

SEQ ID NO: 2706771 - RNA, 22 nt, Haemophilus influenzae Rd
cacaaaauaagggcgauauuuc

SEQ ID NO: 2706772 - RNA, 13 nt, Haemophilus influenzae Rd
cacaaaauccauu

SEQ ID NO: 2706773 - RNA, 16 nt, Haemophilus influenzae Rd
cacaaaauggcaaaca

SEQ ID NO: 2706774 - RNA, 17 nt, Haemophilus influenzae Rd
cacaaaauggcaaacaa

SEQ ID NO: 2706775 - RNA, 14 nt, Haemophilus influenzae Rd
cacaaacacguucu

SEQ ID NO: 2706776 - RNA, 16 nt, Haemophilus influenzae Rd
cacaaacuaauuucau

SEQ ID NO: 2706777 - RNA, 21 nt, Haemophilus influenzae Rd
cacaaacuaauuucauuuugc

SEQ ID NO: 2706778 - RNA, 23 nt, Haemophilus influenzae Rd
cacaaacuccguccaaucuaauu

SEQ ID NO: 2706779 - RNA, 21 nt, Haemophilus influenzae Rd
cacaaacugguuaaaauccaa

SEQ ID NO: 2706780 - RNA, 15 nt, Haemophilus influenzae Rd
cacaaagaaaaacua

SEQ ID NO: 2706781 - RNA, 22 nt, Haemophilus influenzae Rd
cacaaagacagcuauuaaaaaa

SEQ ID NO: 2706782 - RNA, 12 nt, Haemophilus influenzae Rd
cacaaagcaaau

SEQ ID NO: 2706783 - RNA, 22 nt, Haemophilus influenzae Rd
cacaaagcuuaguccuuuacug

SEQ ID NO: 2706784 - RNA, 20 nt, Haemophilus influenzae Rd
cacaaaggugguuucaagag

SEQ ID NO: 2706785 - RNA, 18 nt, Haemophilus influenzae Rd
cacaaaguugauaaucau

SEQ ID NO: 2706786 - RNA, 19 nt, Haemophilus influenzae Rd
cacaaaucuaaaaauaugu

SEQ ID NO: 2706787 - RNA, 16 nt, Haemophilus influenzae Rd
cacaaaucuucuugaa

SEQ ID NO: 2706788 - RNA, 14 nt, Haemophilus influenzae Rd
cacaacaaagaugg

SEQ ID NO: 2706789 - RNA, 15 nt, Haemophilus influenzae Rd
cacaacaauuaaugu

SEQ ID NO: 2706790 - RNA, 12 nt, Haemophilus influenzae Rd
cacaacauaauu

SEQ ID NO: 2706791 - RNA, 23 nt, Haemophilus influenzae Rd
cacaacauagcugaaaaauaaaa

SEQ ID NO: 2706792 - RNA, 14 nt, Haemophilus influenzae Rd
cacaacauauaaau

SEQ ID NO: 2706793 - RNA, 16 nt, Haemophilus influenzae Rd
cacaacaucagaugga

SEQ ID NO: 2706794 - RNA, 22 nt, Haemophilus influenzae Rd
cacaacaugcccuuucucaaau

SEQ ID NO: 2706795 - RNA, 18 nt, Haemophilus influenzae Rd
cacaaccuuguuccagga

SEQ ID NO: 2706796 - RNA, 21 nt, Haemophilus influenzae Rd
cacaacgacgccacuguugug

SEQ ID NO: 2706797 - RNA, 14 nt, Haemophilus influenzae Rd
cacaacuaccacag

SEQ ID NO: 2706798 - RNA, 14 nt, Haemophilus influenzae Rd
cacaacugaagcuu

SEQ ID NO: 2706799 - RNA, 19 nt, Haemophilus influenzae Rd
cacaacuugaccauuaagc

SEQ ID NO: 2706800 - RNA, 16 nt, Haemophilus influenzae Rd
cacaagauuugccaaa

SEQ ID NO: 2706801 - RNA, 20 nt, Haemophilus influenzae Rd
cacaagauuugccaaaauca

SEQ ID NO: 2706802 - RNA, 13 nt, Haemophilus influenzae Rd
cacaagcaaguuu

SEQ ID NO: 2706803 - RNA, 21 nt, Haemophilus influenzae Rd
cacaagcuuguccaugaaaaa

SEQ ID NO: 2706804 - RNA, 17 nt, Haemophilus influenzae Rd
cacaaggcucaucauua

SEQ ID NO: 2706805 - RNA, 17 nt, Haemophilus influenzae Rd
cacaagggauuuaaaau

SEQ ID NO: 2706806 - RNA, 19 nt, Haemophilus influenzae Rd
cacaagguuguaagcccau

SEQ ID NO: 2706807 - RNA, 21 nt, Haemophilus influenzae Rd
cacaagugcggguucuuuuuu

SEQ ID NO: 2706808 - RNA, 14 nt, Haemophilus influenzae Rd
cacaauaaaauaau

SEQ ID NO: 2706809 - RNA, 22 nt, Haemophilus influenzae Rd
cacaauagcuuccgcuuuuuuc

SEQ ID NO: 2706810 - RNA, 20 nt, Haemophilus influenzae Rd
cacaauccuucaugguuugu

SEQ ID NO: 2706811 - RNA, 19 nt, Haemophilus influenzae Rd
cacaaucgcaucgucuuua

SEQ ID NO: 2706812 - RNA, 21 nt, Haemophilus influenzae Rd
cacaaucgcuagcgcaaucaa

SEQ ID NO: 2706813 - RNA, 22 nt, Haemophilus influenzae Rd
cacaaugauuaauaucacugca

SEQ ID NO: 2706814 - RNA, 23 nt, Haemophilus influenzae Rd
cacaauuacuucuuacaacaaau

SEQ ID NO: 2706815 - RNA, 23 nt, Haemophilus influenzae Rd
cacaauugauguaaaagauaaaa

SEQ ID NO: 2706816 - RNA, 15 nt, Haemophilus influenzae Rd
cacaauuuuuggauu

SEQ ID NO: 2706817 - RNA, 18 nt, Haemophilus influenzae Rd
cacacaccaacacgccau

SEQ ID NO: 2706818 - RNA, 19 nt, Haemophilus influenzae Rd
cacacaguuauacacaagu

SEQ ID NO: 2706819 - RNA, 17 nt, Haemophilus influenzae Rd
cacaccauuuuuaauua

SEQ ID NO: 2706820 - RNA, 20 nt, Haemophilus influenzae Rd
cacacccuuuucaaacaaca

SEQ ID NO: 2706821 - RNA, 22 nt, Haemophilus influenzae Rd
cacacccuuuucaaacaacaag

SEQ ID NO: 2706822 - RNA, 17 nt, Haemophilus influenzae Rd
cacaccuauuuuuuccu

SEQ ID NO: 2706823 - RNA, 21 nt, Haemophilus influenzae Rd
cacaccuauuuuuuccugccu

SEQ ID NO: 2706824 - RNA, 17 nt, Haemophilus influenzae Rd
cacacuauuaauuacuu

SEQ ID NO: 2706825 - RNA, 16 nt, Haemophilus influenzae Rd
cacacugcccuucucu

SEQ ID NO: 2706826 - RNA, 18 nt, Haemophilus influenzae Rd
cacacugcccuucucugc

SEQ ID NO: 2706827 - RNA, 19 nt, Haemophilus influenzae Rd
cacacugcccuucucugcc

SEQ ID NO: 2706828 - RNA, 20 nt, Haemophilus influenzae Rd
cacacugcccuucucugccg

SEQ ID NO: 2706829 - RNA, 19 nt, Haemophilus influenzae Rd
cacacuuuaauaguaaacu

SEQ ID NO: 2706830 - RNA, 18 nt, Haemophilus influenzae Rd
cacgacccaccacuuaaa

SEQ ID NO: 2706831 - RNA, 21 nt, Haemophilus influenzae Rd
cacgacccaccacuuaaaaau

SEQ ID NO: 2706832 - RNA, 18 nt, Haemophilus influenzae Rd
cacgaccuuucggacuuu

SEQ ID NO: 2706833 - RNA, 21 nt, Haemophilus influenzae Rd
cacgaccuuucggacuuugau

SEQ ID NO: 2706834 - RNA, 22 nt, Haemophilus influenzae Rd
cacgacgagcuuuccaaacaag

SEQ ID NO: 2706835 - RNA, 22 nt, Haemophilus influenzae Rd
cacgagaaaagucgcuacauuu

SEQ ID NO: 2706836 - RNA, 22 nt, Haemophilus influenzae Rd
cacgagacacacuaaucaaucc

SEQ ID NO: 2706837 - RNA, 16 nt, Haemophilus influenzae Rd
cacgagcaauggcaau

SEQ ID NO: 2706838 - RNA, 16 nt, Haemophilus influenzae Rd
cacgagcuaaaaaauc

SEQ ID NO: 2706839 - RNA, 23 nt, Haemophilus influenzae Rd
cacgauacggcaaauuaaaucac

SEQ ID NO: 2706840 - RNA, 20 nt, Haemophilus influenzae Rd
cacgauaguggaauaaugaa

SEQ ID NO: 2706841 - RNA, 18 nt, Haemophilus influenzae Rd
cacgauauugcacaauag

SEQ ID NO: 2706842 - RNA, 15 nt, Haemophilus influenzae Rd
cacgaucauaaauuu

SEQ ID NO: 2706843 - RNA, 21 nt, Haemophilus influenzae Rd
cacgaucgcccguauuuugca

SEQ ID NO: 2706844 - RNA, 19 nt, Haemophilus influenzae Rd
cacgaugaugcaggaaagg

SEQ ID NO: 2706845 - RNA, 21 nt, Haemophilus influenzae Rd
cacgaugaugcaggaaaggca

SEQ ID NO: 2706846 - RNA, 22 nt, Haemophilus influenzae Rd
cacgauucuuccaauuacuaau

SEQ ID NO: 2706847 - RNA, 16 nt, Haemophilus influenzae Rd
cacgauuucuaucacg

SEQ ID NO: 2706848 - RNA, 16 nt, Haemophilus influenzae Rd
cacgauuuucaauaca

SEQ ID NO: 2706849 - RNA, 13 nt, Haemophilus influenzae Rd
cacgauuuuucuc

SEQ ID NO: 2706850 - RNA, 21 nt, Haemophilus influenzae Rd
cacgauuuuuuuauaaaaaaa

SEQ ID NO: 2706851 - RNA, 19 nt, Haemophilus influenzae Rd
cacgcaagcgcguuuauca

SEQ ID NO: 2706852 - RNA, 20 nt, Haemophilus influenzae Rd
cacgccuaauaccaauacga

SEQ ID NO: 2706853 - RNA, 20 nt, Haemophilus influenzae Rd
cacgccuucgcgagauaaaa

SEQ ID NO: 2706854 - RNA, 23 nt, Haemophilus influenzae Rd
cacgccuuugucuuauucaaacu

SEQ ID NO: 2706855 - RNA, 18 nt, Haemophilus influenzae Rd
cacgcguuucuaaaauaa

SEQ ID NO: 2706856 - RNA, 23 nt, Haemophilus influenzae Rd
cacgcuaaggcaaaaaaaucaua

SEQ ID NO: 2706857 - RNA, 21 nt, Haemophilus influenzae Rd
cacgcucaaucucuuuacugu

SEQ ID NO: 2706858 - RNA, 22 nt, Haemophilus influenzae Rd
cacgcucgaggguuaagauuau

SEQ ID NO: 2706859 - RNA, 16 nt, Haemophilus influenzae Rd
cacgcuguaaacaaga

SEQ ID NO: 2706860 - RNA, 18 nt, Haemophilus influenzae Rd
cacgcuuugucagugguu

SEQ ID NO: 2706861 - RNA, 16 nt, Haemophilus influenzae Rd
cacggauuucggcuua

SEQ ID NO: 2706862 - RNA, 16 nt, Haemophilus influenzae Rd
cacggccguaaugaau

SEQ ID NO: 2706863 - RNA, 18 nt, Haemophilus influenzae Rd
cacggcgcguaaaucaga

SEQ ID NO: 2706864 - RNA, 22 nt, Haemophilus influenzae Rd
cacgguaguaaauaacacauca

SEQ ID NO: 2706865 - RNA, 18 nt, Haemophilus influenzae Rd
cacgguguuuuuuuucuu

SEQ ID NO: 2706866 - RNA, 15 nt, Haemophilus influenzae Rd
cacguaauacaaaau

SEQ ID NO: 2706867 - RNA, 14 nt, Haemophilus influenzae Rd
cacguaaugcaagu

SEQ ID NO: 2706868 - RNA, 23 nt, Haemophilus influenzae Rd
cacguacuuuuaacacuuuuuca

SEQ ID NO: 2706869 - RNA, 12 nt, Haemophilus influenzae Rd
cacguccgcaac

SEQ ID NO: 2706870 - RNA, 17 nt, Haemophilus influenzae Rd
cacguccgcaaccagca

SEQ ID NO: 2706871 - RNA, 20 nt, Haemophilus influenzae Rd
cacguuacgcgcagcaccaa

SEQ ID NO: 2706872 - RNA, 21 nt, Haemophilus influenzae Rd
cacguucagcuuuacucauau

SEQ ID NO: 2706873 - RNA, 15 nt, Haemophilus influenzae Rd
cacguucuaauguua

SEQ ID NO: 2706874 - RNA, 14 nt, Haemophilus influenzae Rd
cacuaaaaaacuaa

SEQ ID NO: 2706875 - RNA, 13 nt, Haemophilus influenzae Rd
cacuaaaaacaag

SEQ ID NO: 2706876 - RNA, 15 nt, Haemophilus influenzae Rd
cacuaaaaacgcauc

SEQ ID NO: 2706877 - RNA, 14 nt, Haemophilus influenzae Rd
cacuaaaaagccca

SEQ ID NO: 2706878 - RNA, 18 nt, Haemophilus influenzae Rd
cacuaaaccauuuuggaa

SEQ ID NO: 2706879 - RNA, 16 nt, Haemophilus influenzae Rd
cacuaaaccugcuucu

SEQ ID NO: 2706880 - RNA, 13 nt, Haemophilus influenzae Rd
cacuaaagcaaua

SEQ ID NO: 2706881 - RNA, 13 nt, Haemophilus influenzae Rd
cacuaacuuuccu

SEQ ID NO: 2706882 - RNA, 15 nt, Haemophilus influenzae Rd
cacuaauauaaagau

SEQ ID NO: 2706883 - RNA, 17 nt, Haemophilus influenzae Rd
cacuaauauaaagauaa

SEQ ID NO: 2706884 - RNA, 21 nt, Haemophilus influenzae Rd
cacuaaucuaaacuuguuaaa

SEQ ID NO: 2706885 - RNA, 20 nt, Haemophilus influenzae Rd
cacuaauugcauuaaaaguc

SEQ ID NO: 2706886 - RNA, 20 nt, Haemophilus influenzae Rd
cacuaauugugguaaagcua

SEQ ID NO: 2706887 - RNA, 12 nt, Haemophilus influenzae Rd
cacuaauuugcu

SEQ ID NO: 2706888 - RNA, 14 nt, Haemophilus influenzae Rd
cacuacacccucag

SEQ ID NO: 2706889 - RNA, 16 nt, Haemophilus influenzae Rd
cacuacuugaacuaau

SEQ ID NO: 2706890 - RNA, 13 nt, Haemophilus influenzae Rd
cacuaugauuuuu

SEQ ID NO: 2706891 - RNA, 22 nt, Haemophilus influenzae Rd
cacuauuaauguuauuaaauau

SEQ ID NO: 2706892 - RNA, 19 nt, Haemophilus influenzae Rd
cacuauuaccgcguaaaaa

SEQ ID NO: 2706893 - RNA, 20 nt, Haemophilus influenzae Rd
cacuauuaccgcguaaaaau

SEQ ID NO: 2706894 - RNA, 21 nt, Haemophilus influenzae Rd
cacuauuaccgcguaaaaauu

SEQ ID NO: 2706895 - RNA, 14 nt, Haemophilus influenzae Rd
cacuauuacuuuca

SEQ ID NO: 2706896 - RNA, 22 nt, Haemophilus influenzae Rd
cacucacuggcucaaguaaugc

SEQ ID NO: 2706897 - RNA, 13 nt, Haemophilus influenzae Rd
cacuccccaaaaa

SEQ ID NO: 2706898 - RNA, 15 nt, Haemophilus influenzae Rd
cacucgcaggaagcu

SEQ ID NO: 2706899 - RNA, 16 nt, Haemophilus influenzae Rd
cacucgcucuaacaau

SEQ ID NO: 2706900 - RNA, 13 nt, Haemophilus influenzae Rd
cacucggaaugcc

SEQ ID NO: 2706901 - RNA, 16 nt, Haemophilus influenzae Rd
cacucuaucuaaaaua

SEQ ID NO: 2706902 - RNA, 19 nt, Haemophilus influenzae Rd
cacucuaucuaaaauauaa

SEQ ID NO: 2706903 - RNA, 24 nt, Haemophilus influenzae Rd
cacucuaucuaaaauauaacauuu

SEQ ID NO: 2706904 - RNA, 15 nt, Haemophilus influenzae Rd
cacucucuugggugg

SEQ ID NO: 2706905 - RNA, 18 nt, Haemophilus influenzae Rd
cacucuuucaaaaaucaa

SEQ ID NO: 2706906 - RNA, 20 nt, Haemophilus influenzae Rd
cacucuuucaaaaaucaaau

SEQ ID NO: 2706907 - RNA, 14 nt, Haemophilus influenzae Rd
cacugaauacacuu

SEQ ID NO: 2706908 - RNA, 22 nt, Haemophilus influenzae Rd
cacugaauuucauucaaaaaua

SEQ ID NO: 2706909 - RNA, 15 nt, Haemophilus influenzae Rd
cacugacaucaagca

SEQ ID NO: 2706910 - RNA, 18 nt, Haemophilus influenzae Rd
cacugaggcuaauaauaa

SEQ ID NO: 2706911 - RNA, 20 nt, Haemophilus influenzae Rd
cacugaggcuaauaauaaaa

SEQ ID NO: 2706912 - RNA, 21 nt, Haemophilus influenzae Rd
cacugauauagcuagaaagca

SEQ ID NO: 2706913 - RNA, 14 nt, Haemophilus influenzae Rd
cacugauuauauug

SEQ ID NO: 2706914 - RNA, 11 nt, Haemophilus influenzae Rd
cacugcaauga

SEQ ID NO: 2706915 - RNA, 22 nt, Haemophilus influenzae Rd
cacugcauuuucuuuuucaaga

SEQ ID NO: 2706916 - RNA, 16 nt, Haemophilus influenzae Rd
cacugccacugcgccc

SEQ ID NO: 2706917 - RNA, 19 nt, Haemophilus influenzae Rd
cacugcccaaccaaaccug

SEQ ID NO: 2706918 - RNA, 20 nt, Haemophilus influenzae Rd
cacugcuaauuccacuucag

SEQ ID NO: 2706919 - RNA, 15 nt, Haemophilus influenzae Rd
cacuggcucaaguaa

SEQ ID NO: 2706920 - RNA, 13 nt, Haemophilus influenzae Rd
cacuguaaauaaa

SEQ ID NO: 2706921 - RNA, 14 nt, Haemophilus influenzae Rd
cacuguaaauaaac

SEQ ID NO: 2706922 - RNA, 13 nt, Haemophilus influenzae Rd
cacuguaaauaau

SEQ ID NO: 2706923 - RNA, 14 nt, Haemophilus influenzae Rd
cacuguuauauaaa

SEQ ID NO: 2706924 - RNA, 15 nt, Haemophilus influenzae Rd
cacuuaaaaauaaag

SEQ ID NO: 2706925 - RNA, 14 nt, Haemophilus influenzae Rd
cacuuaaauaguua

SEQ ID NO: 2706926 - RNA, 19 nt, Haemophilus influenzae Rd
cacuuaacgaaccaucagc

SEQ ID NO: 2706927 - RNA, 13 nt, Haemophilus influenzae Rd
cacuuaauaaaaa

SEQ ID NO: 2706928 - RNA, 17 nt, Haemophilus influenzae Rd
cacuuaauguuaauaau

SEQ ID NO: 2706929 - RNA, 18 nt, Haemophilus influenzae Rd
cacuucacaacuuuuuaa

SEQ ID NO: 2706930 - RNA, 22 nt, Haemophilus influenzae Rd
cacuucacacaccaacacgcca

SEQ ID NO: 2706931 - RNA, 22 nt, Haemophilus influenzae Rd
cacuucagaaccugucgcaaug

SEQ ID NO: 2706932 - RNA, 15 nt, Haemophilus influenzae Rd
cacuucagaauucau

SEQ ID NO: 2706933 - RNA, 23 nt, Haemophilus influenzae Rd
cacuucaggguuuucaucauuac

SEQ ID NO: 2706934 - RNA, 11 nt, Haemophilus influenzae Rd
cacuucauaaa

SEQ ID NO: 2706935 - RNA, 17 nt, Haemophilus influenzae Rd
cagaggggauaaaauaa

SEQ ID NO: 2706936 - RNA, 18 nt, Haemophilus influenzae Rd
cagaggggauaaaauaaa

SEQ ID NO: 2706937 - RNA, 19 nt, Haemophilus influenzae Rd
cagagugcgaucaccauaa

SEQ ID NO: 2706938 - RNA, 13 nt, Haemophilus influenzae Rd
cagauaaaaacug

SEQ ID NO: 2706939 - RNA, 15 nt, Haemophilus influenzae Rd
cagauaaaaacugug

SEQ ID NO: 2706940 - RNA, 15 nt, Haemophilus influenzae Rd
cagauaaucaaaaau

SEQ ID NO: 2706941 - RNA, 17 nt, Haemophilus influenzae Rd
cagauaaucuacaaaac

SEQ ID NO: 2706942 - RNA, 19 nt, Haemophilus influenzae Rd
cagauacauuuaaugauga

SEQ ID NO: 2706943 - RNA, 21 nt, Haemophilus influenzae Rd
cagaugccauuaaaacgaaag

SEQ ID NO: 2706944 - RNA, 19 nt, Haemophilus influenzae Rd
cagauuaaaaauucaauga

SEQ ID NO: 2706945 - RNA, 22 nt, Haemophilus influenzae Rd
cagauuaaaaauucaaugaaau

SEQ ID NO: 2706946 - RNA, 15 nt, Haemophilus influenzae Rd
cagauuaauuauauu

SEQ ID NO: 2706947 - RNA, 18 nt, Haemophilus influenzae Rd
cagauuauguucauuuuc

SEQ ID NO: 2706948 - RNA, 21 nt, Haemophilus influenzae Rd
cagauuuugguuguuuaaaga

SEQ ID NO: 2706949 - RNA, 19 nt, Haemophilus influenzae Rd
cagauuuuuacuucaucaa

SEQ ID NO: 2706950 - RNA, 11 nt, Haemophilus influenzae Rd
cagauuuuuau

SEQ ID NO: 2706951 - RNA, 22 nt, Haemophilus influenzae Rd
cagauuuuuuauuaauuauaaa

SEQ ID NO: 2706952 - RNA, 21 nt, Haemophilus influenzae Rd
cagauuuuuuauuuauuaaga

SEQ ID NO: 2706953 - RNA, 15 nt, Haemophilus influenzae Rd
cagcaaaacuuuuuc

SEQ ID NO: 2706954 - RNA, 11 nt, Haemophilus influenzae Rd
cagcaaaagca

SEQ ID NO: 2706955 - RNA, 21 nt, Haemophilus influenzae Rd
cagcaaaagcaagaucuaaaa

SEQ ID NO: 2706956 - RNA, 22 nt, Haemophilus influenzae Rd
cagcaaaagugcuuaaaugcaa

SEQ ID NO: 2706957 - RNA, 15 nt, Haemophilus influenzae Rd
cagcaaauuaucuga

SEQ ID NO: 2706958 - RNA, 13 nt, Haemophilus influenzae Rd
cagcaaauuguuu

SEQ ID NO: 2706959 - RNA, 22 nt, Haemophilus influenzae Rd
cagcaaauuguuugaaaucaaa

SEQ ID NO: 2706960 - RNA, 12 nt, Haemophilus influenzae Rd
cagcaaccuaaa

SEQ ID NO: 2706961 - RNA, 15 nt, Haemophilus influenzae Rd
cagcaaccuaaauug

SEQ ID NO: 2706962 - RNA, 16 nt, Haemophilus influenzae Rd
cagcaaccuaaauugu

SEQ ID NO: 2706963 - RNA, 20 nt, Haemophilus influenzae Rd
cagcaacgcuugugcauugc

SEQ ID NO: 2706964 - RNA, 22 nt, Haemophilus influenzae Rd
cagcaagaaagcguucaucaau

SEQ ID NO: 2706965 - RNA, 14 nt, Haemophilus influenzae Rd
cagcaagaucaaua

SEQ ID NO: 2706966 - RNA, 21 nt, Haemophilus influenzae Rd
cagcaagcaucgcuggauaaa

SEQ ID NO: 2706967 - RNA, 15 nt, Haemophilus influenzae Rd
cagcaaguucauaua

SEQ ID NO: 2706968 - RNA, 14 nt, Haemophilus influenzae Rd
cagcaauaagcaac

SEQ ID NO: 2706969 - RNA, 15 nt, Haemophilus influenzae Rd
cagcaauaagcaacg

SEQ ID NO: 2706970 - RNA, 21 nt, Haemophilus influenzae Rd
cagcaaucguucgcacaaacu

SEQ ID NO: 2706971 - RNA, 14 nt, Haemophilus influenzae Rd
cagcaauuaaaaag

SEQ ID NO: 2706972 - RNA, 17 nt, Haemophilus influenzae Rd
cagcaauuaaaaaguca

SEQ ID NO: 2706973 - RNA, 16 nt, Haemophilus influenzae Rd
cagcaauuuauuguag

SEQ ID NO: 2706974 - RNA, 14 nt, Haemophilus influenzae Rd
cagcaauuucucug

SEQ ID NO: 2706975 - RNA, 14 nt, Haemophilus influenzae Rd
cagcaauuucuuca

SEQ ID NO: 2706976 - RNA, 23 nt, Haemophilus influenzae Rd
cagcacacuaauaagaauacaaa

SEQ ID NO: 2706977 - RNA, 18 nt, Haemophilus influenzae Rd
cagcacuugcaucuaaaa

SEQ ID NO: 2706978 - RNA, 21 nt, Haemophilus influenzae Rd
cagcacuuucgcuuaaaaauc

SEQ ID NO: 2706979 - RNA, 11 nt, Haemophilus influenzae Rd
cagcagauaca

SEQ ID NO: 2706980 - RNA, 21 nt, Haemophilus influenzae Rd
cagcagcuaauaggcuuaauu

SEQ ID NO: 2706981 - RNA, 19 nt, Haemophilus influenzae Rd
cagcagcuucuucuuccug

SEQ ID NO: 2706982 - RNA, 13 nt, Haemophilus influenzae Rd
cagcauaaagaga

SEQ ID NO: 2706983 - RNA, 14 nt, Haemophilus influenzae Rd
cagcauaaagagaa

SEQ ID NO: 2706984 - RNA, 14 nt, Haemophilus influenzae Rd
cagcauaaauaaau

SEQ ID NO: 2706985 - RNA, 14 nt, Haemophilus influenzae Rd
cagcauauugaaau

SEQ ID NO: 2706986 - RNA, 18 nt, Haemophilus influenzae Rd
cagcaugagcuucaaaau

SEQ ID NO: 2706987 - RNA, 15 nt, Haemophilus influenzae Rd
cagcauggaagaaag

SEQ ID NO: 2706988 - RNA, 14 nt, Haemophilus influenzae Rd
cagccaaacaaauu

SEQ ID NO: 2706989 - RNA, 17 nt, Haemophilus influenzae Rd
cagccaaauuuuucuuu

SEQ ID NO: 2706990 - RNA, 18 nt, Haemophilus influenzae Rd
cagccaaauuuuucuuuu

SEQ ID NO: 2706991 - RNA, 19 nt, Haemophilus influenzae Rd
cagccaaauuuuucuuuuc

SEQ ID NO: 2706992 - RNA, 14 nt, Haemophilus influenzae Rd
cagccaagguuuuu

SEQ ID NO: 2706993 - RNA, 14 nt, Haemophilus influenzae Rd
cagccaucaauaaa

SEQ ID NO: 2706994 - RNA, 19 nt, Haemophilus influenzae Rd
cagccaucaauaaaaagcu

SEQ ID NO: 2706995 - RNA, 19 nt, Haemophilus influenzae Rd
cagccauggcuuuuuccug

SEQ ID NO: 2706996 - RNA, 21 nt, Haemophilus influenzae Rd
cagccauggcuuuuuccugau

SEQ ID NO: 2706997 - RNA, 12 nt, Haemophilus influenzae Rd
cagcccaaauaa

SEQ ID NO: 2706998 - RNA, 13 nt, Haemophilus influenzae Rd
cagcccaaauaaa

SEQ ID NO: 2706999 - RNA, 14 nt, Haemophilus influenzae Rd
cagcccaaauaaag

SEQ ID NO: 2707000 - RNA, 16 nt, Haemophilus influenzae Rd
cagcccuuuguuuuaa

SEQ ID NO: 2707001 - RNA, 15 nt, Haemophilus influenzae Rd
cagccgcaacggcag

SEQ ID NO: 2707002 - RNA, 18 nt, Haemophilus influenzae Rd
cagccuauuuuuagaaaa

SEQ ID NO: 2707003 - RNA, 23 nt, Haemophilus influenzae Rd
cagccugaaaaagcuaaaaaaac

SEQ ID NO: 2707004 - RNA, 21 nt, Haemophilus influenzae Rd
cagccugcgagcaguuuucgu

SEQ ID NO: 2707005 - RNA, 15 nt, Haemophilus influenzae Rd
cagccuuguucugca

SEQ ID NO: 2707006 - RNA, 23 nt, Haemophilus influenzae Rd
cagccuuucgacaagccucccgu

SEQ ID NO: 2707007 - RNA, 22 nt, Haemophilus influenzae Rd
cagcgaaguuaaacgcuccucu

SEQ ID NO: 2707008 - RNA, 21 nt, Haemophilus influenzae Rd
cagcgagcagugguaaauuuu

SEQ ID NO: 2707009 - RNA, 12 nt, Haemophilus influenzae Rd
cagcgcaccaca

SEQ ID NO: 2707010 - RNA, 16 nt, Haemophilus influenzae Rd
cagcgcaccacacaau

SEQ ID NO: 2707011 - RNA, 16 nt, Haemophilus influenzae Rd
cagcguaaaaaugcug

SEQ ID NO: 2707012 - RNA, 18 nt, Haemophilus influenzae Rd
cagcgugaauauaagaaa

SEQ ID NO: 2707013 - RNA, 20 nt, Haemophilus influenzae Rd
cagcuaaaaaugaauuaguu

SEQ ID NO: 2707014 - RNA, 13 nt, Haemophilus influenzae Rd
cagcuaaacauug

SEQ ID NO: 2707015 - RNA, 18 nt, Haemophilus influenzae Rd
cagcuaagccaauaauuu

SEQ ID NO: 2707016 - RNA, 15 nt, Haemophilus influenzae Rd
cagcuaauaacacau

SEQ ID NO: 2707017 - RNA, 16 nt, Haemophilus influenzae Rd
cagcuaauaacacauc

SEQ ID NO: 2707018 - RNA, 19 nt, Haemophilus influenzae Rd
cagcuaauccaaaucaagc

SEQ ID NO: 2707019 - RNA, 14 nt, Haemophilus influenzae Rd
cagcuaaugcuuua

SEQ ID NO: 2707020 - RNA, 18 nt, Haemophilus influenzae Rd
cagcuaauucagcuaaac

SEQ ID NO: 2707021 - RNA, 17 nt, Haemophilus influenzae Rd
cagcuacauucaucaaa

SEQ ID NO: 2707022 - RNA, 20 nt, Haemophilus influenzae Rd
cagcuacauucaucaaaaca

SEQ ID NO: 2707023 - RNA, 21 nt, Haemophilus influenzae Rd
cagcuaccguagauuccuaau

SEQ ID NO: 2707024 - RNA, 17 nt, Haemophilus influenzae Rd
cagcuaguccugcagcc

SEQ ID NO: 2707025 - RNA, 15 nt, Haemophilus influenzae Rd
cagcuauuaaaaaaa

SEQ ID NO: 2707026 - RNA, 20 nt, Haemophilus influenzae Rd
cagcugauaaguucauaaaa

SEQ ID NO: 2707027 - RNA, 19 nt, Haemophilus influenzae Rd
cagcugcacaagcaccacu

SEQ ID NO: 2707028 - RNA, 15 nt, Haemophilus influenzae Rd
cagcuggaaauucca

SEQ ID NO: 2707029 - RNA, 16 nt, Haemophilus influenzae Rd
cagcuggaaauuccac

SEQ ID NO: 2707030 - RNA, 16 nt, Haemophilus influenzae Rd
cagcuggaguucguua

SEQ ID NO: 2707031 - RNA, 22 nt, Haemophilus influenzae Rd
cagcuggcgguuugaaauuuau

SEQ ID NO: 2707032 - RNA, 18 nt, Haemophilus influenzae Rd
cagcuguuuaucaauaga

SEQ ID NO: 2707033 - RNA, 18 nt, Haemophilus influenzae Rd
cagcuuaucaaucaagaa

SEQ ID NO: 2707034 - RNA, 19 nt, Haemophilus influenzae Rd
cagcuuaucaaucaagaau

SEQ ID NO: 2707035 - RNA, 17 nt, Haemophilus influenzae Rd
cagcuuccauccaccau

SEQ ID NO: 2707036 - RNA, 17 nt, Haemophilus influenzae Rd
cagcuucuucaucgcuc

SEQ ID NO: 2707037 - RNA, 17 nt, Haemophilus influenzae Rd
cagcuugcgccauugaa

SEQ ID NO: 2707038 - RNA, 22 nt, Haemophilus influenzae Rd
cagcuuuacccgggccaaauaa

SEQ ID NO: 2707039 - RNA, 13 nt, Haemophilus influenzae Rd
cagcuuuccugua

SEQ ID NO: 2707040 - RNA, 23 nt, Haemophilus influenzae Rd
cagcuuuccuguacucgaauuau

SEQ ID NO: 2707041 - RNA, 16 nt, Haemophilus influenzae Rd
caguuaucgccaauaa

SEQ ID NO: 2707042 - RNA, 15 nt, Haemophilus influenzae Rd
caguuaugcaaauac

SEQ ID NO: 2707043 - RNA, 14 nt, Haemophilus influenzae Rd
caguucaauaaaaa

SEQ ID NO: 2707044 - RNA, 15 nt, Haemophilus influenzae Rd
caguucaauaaaaau

SEQ ID NO: 2707045 - RNA, 16 nt, Haemophilus influenzae Rd
caguucaauuuaacau

SEQ ID NO: 2707046 - RNA, 19 nt, Haemophilus influenzae Rd
caguuccugacccacauca

SEQ ID NO: 2707047 - RNA, 13 nt, Haemophilus influenzae Rd
caguucuccuucu

SEQ ID NO: 2707048 - RNA, 15 nt, Haemophilus influenzae Rd
caguugauagacaau

SEQ ID NO: 2707049 - RNA, 15 nt, Haemophilus influenzae Rd
caguuggguuaaaua

SEQ ID NO: 2707050 - RNA, 20 nt, Haemophilus influenzae Rd
caguuggguuaaauauaaau

SEQ ID NO: 2707051 - RNA, 19 nt, Haemophilus influenzae Rd
caguuuaagcuacagugag

SEQ ID NO: 2707052 - RNA, 19 nt, Haemophilus influenzae Rd
caguuuaucucuuucuuaa

SEQ ID NO: 2707053 - RNA, 21 nt, Haemophilus influenzae Rd
caguuuaucucuuucuuaaaa

SEQ ID NO: 2707054 - RNA, 22 nt, Haemophilus influenzae Rd
caguuuauucagugcuuuuuca

SEQ ID NO: 2707055 - RNA, 19 nt, Haemophilus influenzae Rd
caguuucacauccacaaaa

SEQ ID NO: 2707056 - RNA, 17 nt, Haemophilus influenzae Rd
caguuucugguuuaucg

SEQ ID NO: 2707057 - RNA, 23 nt, Haemophilus influenzae Rd
caguuucugguuuaucgucugca

SEQ ID NO: 2707058 - RNA, 12 nt, Haemophilus influenzae Rd
caguuuggaaag

SEQ ID NO: 2707059 - RNA, 13 nt, Haemophilus influenzae Rd
caguuuggaaaga

SEQ ID NO: 2707060 - RNA, 17 nt, Haemophilus influenzae Rd
caguuuggaaagaguaa

SEQ ID NO: 2707061 - RNA, 18 nt, Haemophilus influenzae Rd
caguuuuacguugcaacg

SEQ ID NO: 2707062 - RNA, 13 nt, Haemophilus influenzae Rd
cauaaaaaaugac

SEQ ID NO: 2707063 - RNA, 19 nt, Haemophilus influenzae Rd
cauaaaaaauggaauaaaa

SEQ ID NO: 2707064 - RNA, 13 nt, Haemophilus influenzae Rd
cauaaaaacaaua

SEQ ID NO: 2707065 - RNA, 13 nt, Haemophilus influenzae Rd
cauaaaaauucca

SEQ ID NO: 2707066 - RNA, 22 nt, Haemophilus influenzae Rd
cauaaaacacaucgcuugcauu

SEQ ID NO: 2707067 - RNA, 18 nt, Haemophilus influenzae Rd
cauaaaacaguauuuucc

SEQ ID NO: 2707068 - RNA, 21 nt, Haemophilus influenzae Rd
cauaaaacaguauuuuccuua

SEQ ID NO: 2707069 - RNA, 21 nt, Haemophilus influenzae Rd
cauaaaaggcaaagcaaaauc

SEQ ID NO: 2707070 - RNA, 20 nt, Haemophilus influenzae Rd
cauaaaagugcgguaaaaaa

SEQ ID NO: 2707071 - RNA, 14 nt, Haemophilus influenzae Rd
cauaaaaucuucua

SEQ ID NO: 2707072 - RNA, 16 nt, Haemophilus influenzae Rd
cauaaacaaaauaaac

SEQ ID NO: 2707073 - RNA, 17 nt, Haemophilus influenzae Rd
cauaaacaaaauaaacu

SEQ ID NO: 2707074 - RNA, 16 nt, Haemophilus influenzae Rd
cauaaacaauauaacc

SEQ ID NO: 2707075 - RNA, 21 nt, Haemophilus influenzae Rd
cauaaacagggugucguagaa

SEQ ID NO: 2707076 - RNA, 16 nt, Haemophilus influenzae Rd
cauaaacaucuugcau

SEQ ID NO: 2707077 - RNA, 14 nt, Haemophilus influenzae Rd
cauaaaccaacuau

SEQ ID NO: 2707078 - RNA, 15 nt, Haemophilus influenzae Rd
cauaaacgcaccaca

SEQ ID NO: 2707079 - RNA, 22 nt, Haemophilus influenzae Rd
cauaaacggcugccgcaucaac

SEQ ID NO: 2707080 - RNA, 16 nt, Haemophilus influenzae Rd
cauaaacgguauuuuc

SEQ ID NO: 2707081 - RNA, 14 nt, Haemophilus influenzae Rd
cauaaacuaaaaua

SEQ ID NO: 2707082 - RNA, 15 nt, Haemophilus influenzae Rd
cauaaacuaaaauau

SEQ ID NO: 2707083 - RNA, 14 nt, Haemophilus influenzae Rd
cauaaagaauaauu

SEQ ID NO: 2707084 - RNA, 22 nt, Haemophilus influenzae Rd
cauaaagacgcuguuucuuuuc

SEQ ID NO: 2707085 - RNA, 16 nt, Haemophilus influenzae Rd
cauaaagcucagccaa

SEQ ID NO: 2707086 - RNA, 16 nt, Haemophilus influenzae Rd
cauaaauaucaacagc

SEQ ID NO: 2707087 - RNA, 17 nt, Haemophilus influenzae Rd
cauaaaucuuuaaaugc

SEQ ID NO: 2707088 - RNA, 15 nt, Haemophilus influenzae Rd
cauaaaugacagaaa

SEQ ID NO: 2707089 - RNA, 15 nt, Haemophilus influenzae Rd
cauaaaugcuacuug

SEQ ID NO: 2707090 - RNA, 19 nt, Haemophilus influenzae Rd
cauaaauuccuuuuuaaug

SEQ ID NO: 2707091 - RNA, 15 nt, Haemophilus influenzae Rd
cauaacaaaauggcu

SEQ ID NO: 2707092 - RNA, 20 nt, Haemophilus influenzae Rd
cauaacaaaauggcuuuuuu

SEQ ID NO: 2707093 - RNA, 17 nt, Haemophilus influenzae Rd
cauaacauuguuuuaau

SEQ ID NO: 2707094 - RNA, 15 nt, Haemophilus influenzae Rd
cauaaccaaagggca

SEQ ID NO: 2707095 - RNA, 21 nt, Haemophilus influenzae Rd
cauaacccacuguuaaagugc

SEQ ID NO: 2707096 - RNA, 16 nt, Haemophilus influenzae Rd
cauaacccgccuuugu

SEQ ID NO: 2707097 - RNA, 18 nt, Haemophilus influenzae Rd
cauaacgcugcuuaaagc

SEQ ID NO: 2707098 - RNA, 15 nt, Haemophilus influenzae Rd
cauaacggcaagcaa

SEQ ID NO: 2707099 - RNA, 14 nt, Haemophilus influenzae Rd
cauaacguauuuuc

SEQ ID NO: 2707100 - RNA, 15 nt, Haemophilus influenzae Rd
cauaacguauuuucu

SEQ ID NO: 2707101 - RNA, 21 nt, Haemophilus influenzae Rd
cauaacguuuacgauacauag

SEQ ID NO: 2707102 - RNA, 13 nt, Haemophilus influenzae Rd
cauaacuauaauu

SEQ ID NO: 2707103 - RNA, 18 nt, Haemophilus influenzae Rd
cauaacuuaaauuuuuau

SEQ ID NO: 2707104 - RNA, 17 nt, Haemophilus influenzae Rd
cauaacuuaugaauaau

SEQ ID NO: 2707105 - RNA, 19 nt, Haemophilus influenzae Rd
cauaacuuaugaauaauaa

SEQ ID NO: 2707106 - RNA, 13 nt, Haemophilus influenzae Rd
cauaacuucacca

SEQ ID NO: 2707107 - RNA, 12 nt, Haemophilus influenzae Rd
cauaacuuucca

SEQ ID NO: 2707108 - RNA, 19 nt, Haemophilus influenzae Rd
cauaacuuuccauauaaca

SEQ ID NO: 2707109 - RNA, 13 nt, Haemophilus influenzae Rd
cauaagaucuucu

SEQ ID NO: 2707110 - RNA, 21 nt, Haemophilus influenzae Rd
cauaagaucuucuuugcgauu

SEQ ID NO: 2707111 - RNA, 13 nt, Haemophilus influenzae Rd
cauaagcaauaau

SEQ ID NO: 2707112 - RNA, 17 nt, Haemophilus influenzae Rd
cauaagcaauaauuuca

SEQ ID NO: 2707113 - RNA, 18 nt, Haemophilus influenzae Rd
cauaagcugcaucaauau

SEQ ID NO: 2707114 - RNA, 15 nt, Haemophilus influenzae Rd
cauaaggaccaagca

SEQ ID NO: 2707115 - RNA, 18 nt, Haemophilus influenzae Rd
cauaaggaccaagcaaug

SEQ ID NO: 2707116 - RNA, 16 nt, Haemophilus influenzae Rd
cauaaguaaaaccauu

SEQ ID NO: 2707117 - RNA, 13 nt, Haemophilus influenzae Rd
cauaaguaaaaua

SEQ ID NO: 2707118 - RNA, 17 nt, Haemophilus influenzae Rd
cauaaguaaaauaguca

SEQ ID NO: 2707119 - RNA, 17 nt, Haemophilus influenzae Rd
cauaagugagaaaauac

SEQ ID NO: 2707120 - RNA, 14 nt, Haemophilus influenzae Rd
cauaaguuaccgcu

SEQ ID NO: 2707121 - RNA, 13 nt, Haemophilus influenzae Rd
cauaauaaaaaaa

SEQ ID NO: 2707122 - RNA, 13 nt, Haemophilus influenzae Rd
cauaauaaaaauu

SEQ ID NO: 2707123 - RNA, 14 nt, Haemophilus influenzae Rd
cauaauaaaaauua

SEQ ID NO: 2707124 - RNA, 23 nt, Haemophilus influenzae Rd
cauaauaaaauuuauuacaaaca

SEQ ID NO: 2707125 - RNA, 13 nt, Haemophilus influenzae Rd
cauaauaaacaua

SEQ ID NO: 2707126 - RNA, 14 nt, Haemophilus influenzae Rd
cauaauacuugaac

SEQ ID NO: 2707127 - RNA, 14 nt, Haemophilus influenzae Rd
cauaauacuugaca

SEQ ID NO: 2707128 - RNA, 17 nt, Haemophilus influenzae Rd
cauaauacuugacaacg

SEQ ID NO: 2707129 - RNA, 15 nt, Haemophilus influenzae Rd
cauaauagaaacuaa

SEQ ID NO: 2707130 - RNA, 19 nt, Haemophilus influenzae Rd
cauaauauaaauuauguua

SEQ ID NO: 2707131 - RNA, 15 nt, Haemophilus influenzae Rd
cauaauaucuuucuu

SEQ ID NO: 2707132 - RNA, 21 nt, Haemophilus influenzae Rd
cauaauauugaaaacgucgau

SEQ ID NO: 2707133 - RNA, 13 nt, Haemophilus influenzae Rd
cauaauauuuaaa

SEQ ID NO: 2707134 - RNA, 14 nt, Haemophilus influenzae Rd
cauaauauuuaaaa

SEQ ID NO: 2707135 - RNA, 11 nt, Haemophilus influenzae Rd
cauaauauuuu

SEQ ID NO: 2707136 - RNA, 13 nt, Haemophilus influenzae Rd
cauaauauuuuua

SEQ ID NO: 2707137 - RNA, 15 nt, Haemophilus influenzae Rd
cauaaucaggcugug

SEQ ID NO: 2707138 - RNA, 18 nt, Haemophilus influenzae Rd
cauaauccacuaaaaacg

SEQ ID NO: 2707139 - RNA, 23 nt, Haemophilus influenzae Rd
cauaauccagcaugagcuucaaa

SEQ ID NO: 2707140 - RNA, 13 nt, Haemophilus influenzae Rd
cauaaucuugacc

SEQ ID NO: 2707141 - RNA, 21 nt, Haemophilus influenzae Rd
cauaauggcaauuuuauauuc

SEQ ID NO: 2707142 - RNA, 17 nt, Haemophilus influenzae Rd
cauaauggcuuaauaau

SEQ ID NO: 2707143 - RNA, 19 nt, Haemophilus influenzae Rd
cauaauggcuuaauaaugg

SEQ ID NO: 2707144 - RNA, 14 nt, Haemophilus influenzae Rd
cauaauguucccua

SEQ ID NO: 2707145 - RNA, 18 nt, Haemophilus influenzae Rd
cauaauguucccuauaaa

SEQ ID NO: 2707146 - RNA, 23 nt, Haemophilus influenzae Rd
cauaauguucccuauaaauaaac

SEQ ID NO: 2707147 - RNA, 19 nt, Haemophilus influenzae Rd
caucaaaagaucauuuuuu

SEQ ID NO: 2707148 - RNA, 20 nt, Haemophilus influenzae Rd
caucaaaagaucauuuuuuu

SEQ ID NO: 2707149 - RNA, 17 nt, Haemophilus influenzae Rd
caucaaaauaaauaaaa

SEQ ID NO: 2707150 - RNA, 12 nt, Haemophilus influenzae Rd
caucaaaauuua

SEQ ID NO: 2707151 - RNA, 15 nt, Haemophilus influenzae Rd
caucaaacacccaau

SEQ ID NO: 2707152 - RNA, 21 nt, Haemophilus influenzae Rd
caucaaaccugcuucauccac

SEQ ID NO: 2707153 - RNA, 18 nt, Haemophilus influenzae Rd
caucaaagcguucauuuu

SEQ ID NO: 2707154 - RNA, 18 nt, Haemophilus influenzae Rd
caucaaagcguuuuucua

SEQ ID NO: 2707155 - RNA, 23 nt, Haemophilus influenzae Rd
caucaaauugaugcucugcuagu

SEQ ID NO: 2707156 - RNA, 14 nt, Haemophilus influenzae Rd
caucaaauugauua

SEQ ID NO: 2707157 - RNA, 16 nt, Haemophilus influenzae Rd
caucaaauugauuaag

SEQ ID NO: 2707158 - RNA, 15 nt, Haemophilus influenzae Rd
caucaacaaauguca

SEQ ID NO: 2707159 - RNA, 19 nt, Haemophilus influenzae Rd
caucaaccaaaauacaauc

SEQ ID NO: 2707160 - RNA, 18 nt, Haemophilus influenzae Rd
caucaaccauaacaagaa

SEQ ID NO: 2707161 - RNA, 23 nt, Haemophilus influenzae Rd
caucaacuaauuuauuaaaaaua

SEQ ID NO: 2707162 - RNA, 20 nt, Haemophilus influenzae Rd
caucaacugcaacaauuuca

SEQ ID NO: 2707163 - RNA, 12 nt, Haemophilus influenzae Rd
caucaagaaagu

SEQ ID NO: 2707164 - RNA, 18 nt, Haemophilus influenzae Rd
caucaagcucaaaaguau

SEQ ID NO: 2707165 - RNA, 22 nt, Haemophilus influenzae Rd
caucaaguguuacugcaacgcu

SEQ ID NO: 2707166 - RNA, 21 nt, Haemophilus influenzae Rd
caucaauaacugaucgccauc

SEQ ID NO: 2707167 - RNA, 11 nt, Haemophilus influenzae Rd
caucaauauua

SEQ ID NO: 2707168 - RNA, 12 nt, Haemophilus influenzae Rd
caucaauuaaug

SEQ ID NO: 2707169 - RNA, 23 nt, Haemophilus influenzae Rd
caucaauuaauggaaugauauuc

SEQ ID NO: 2707170 - RNA, 19 nt, Haemophilus influenzae Rd
caucacaacuugcaaccau

SEQ ID NO: 2707171 - RNA, 16 nt, Haemophilus influenzae Rd
caucacauccacaaaa

SEQ ID NO: 2707172 - RNA, 16 nt, Haemophilus influenzae Rd
caucacauuuucaaau

SEQ ID NO: 2707173 - RNA, 19 nt, Haemophilus influenzae Rd
caucacauuuucaaauugu

SEQ ID NO: 2707174 - RNA, 15 nt, Haemophilus influenzae Rd
caucacccaucaaau

SEQ ID NO: 2707175 - RNA, 13 nt, Haemophilus influenzae Rd
caucaccugcuuu

SEQ ID NO: 2707176 - RNA, 11 nt, Haemophilus influenzae Rd
caucaccuuca

SEQ ID NO: 2707177 - RNA, 19 nt, Haemophilus influenzae Rd
caucaccuucaacauaagu

SEQ ID NO: 2707178 - RNA, 15 nt, Haemophilus influenzae Rd
caucacgaacuucag

SEQ ID NO: 2707179 - RNA, 23 nt, Haemophilus influenzae Rd
caucacgcauaauuuuacguagu

SEQ ID NO: 2707180 - RNA, 21 nt, Haemophilus influenzae Rd
caucacgccaucgccauucuc

SEQ ID NO: 2707181 - RNA, 22 nt, Haemophilus influenzae Rd
caucacguaaguaagucaagcu

SEQ ID NO: 2707182 - RNA, 17 nt, Haemophilus influenzae Rd
caucacguaauacaaaa

SEQ ID NO: 2707183 - RNA, 17 nt, Haemophilus influenzae Rd
caucacguuaucaaaga

SEQ ID NO: 2707184 - RNA, 13 nt, Haemophilus influenzae Rd
caucacuucaaaa

SEQ ID NO: 2707185 - RNA, 15 nt, Haemophilus influenzae Rd
caucacuucaaaaaa

SEQ ID NO: 2707186 - RNA, 16 nt, Haemophilus influenzae Rd
caucacuucaaaaaac

SEQ ID NO: 2707187 - RNA, 17 nt, Haemophilus influenzae Rd
caucacuucaaaaaacu

SEQ ID NO: 2707188 - RNA, 15 nt, Haemophilus influenzae Rd
caucagaaaaucaaa

SEQ ID NO: 2707189 - RNA, 17 nt, Haemophilus influenzae Rd
caucagaaauaucuuca

SEQ ID NO: 2707190 - RNA, 18 nt, Haemophilus influenzae Rd
caucagaaauaucuucaa

SEQ ID NO: 2707191 - RNA, 19 nt, Haemophilus influenzae Rd
caucagauuuuucgcauuu

SEQ ID NO: 2707192 - RNA, 16 nt, Haemophilus influenzae Rd
caucagcaaucauuug

SEQ ID NO: 2707193 - RNA, 18 nt, Haemophilus influenzae Rd
caucagccgcuuuuugau

SEQ ID NO: 2707194 - RNA, 19 nt, Haemophilus influenzae Rd
caucagcuccuacauuaaa

SEQ ID NO: 2707195 - RNA, 20 nt, Haemophilus influenzae Rd
caucagcuccuacauuaaaa

SEQ ID NO: 2707196 - RNA, 22 nt, Haemophilus influenzae Rd
caucagcuuaucaaucaagaau

SEQ ID NO: 2707197 - RNA, 14 nt, Haemophilus influenzae Rd
caucagcuucaauu

SEQ ID NO: 2707198 - RNA, 18 nt, Haemophilus influenzae Rd
caucaguauuaagaacuu

SEQ ID NO: 2707199 - RNA, 12 nt, Haemophilus influenzae Rd
caucauaacuac

SEQ ID NO: 2707200 - RNA, 12 nt, Haemophilus influenzae Rd
caucaucauuuu

SEQ ID NO: 2707201 - RNA, 19 nt, Haemophilus influenzae Rd
caucaucccaaucuucguc

SEQ ID NO: 2707202 - RNA, 20 nt, Haemophilus influenzae Rd
caucaucgcccgcuucuuuc

SEQ ID NO: 2707203 - RNA, 21 nt, Haemophilus influenzae Rd
caucaucugcugguuuuagcg

SEQ ID NO: 2707204 - RNA, 18 nt, Haemophilus influenzae Rd
caucaugagguuugccau

SEQ ID NO: 2707205 - RNA, 14 nt, Haemophilus influenzae Rd
caucauuaugaaaa

SEQ ID NO: 2707206 - RNA, 21 nt, Haemophilus influenzae Rd
caucauuaugaaaaaaagaaa

SEQ ID NO: 2707207 - RNA, 14 nt, Haemophilus influenzae Rd
caucauuggggaac

SEQ ID NO: 2707208 - RNA, 21 nt, Haemophilus influenzae Rd
caucauuuuagguucaauaau

SEQ ID NO: 2707209 - RNA, 15 nt, Haemophilus influenzae Rd
caucauuuuuauuua

SEQ ID NO: 2707210 - RNA, 16 nt, Haemophilus influenzae Rd
caucauuuuuuaccgc

SEQ ID NO: 2707211 - RNA, 14 nt, Haemophilus influenzae Rd
cauccaaaguacac

SEQ ID NO: 2707212 - RNA, 21 nt, Haemophilus influenzae Rd
cauccaagcaaagaaauuuua

SEQ ID NO: 2707213 - RNA, 16 nt, Haemophilus influenzae Rd
cauccacaaaauuccg

SEQ ID NO: 2707214 - RNA, 14 nt, Haemophilus influenzae Rd
cauccacuucaucc

SEQ ID NO: 2707215 - RNA, 17 nt, Haemophilus influenzae Rd
cauccacuucauccauu

SEQ ID NO: 2707216 - RNA, 15 nt, Haemophilus influenzae Rd
cauccacuuuuucug

SEQ ID NO: 2707217 - RNA, 21 nt, Haemophilus influenzae Rd
cauccagaaaauugcaccuuc

SEQ ID NO: 2707218 - RNA, 19 nt, Haemophilus influenzae Rd
cauccauaacggcaagcaa

SEQ ID NO: 2707219 - RNA, 13 nt, Haemophilus influenzae Rd
cauccaucaaauc

SEQ ID NO: 2707220 - RNA, 14 nt, Haemophilus influenzae Rd
cauccauuccugca

SEQ ID NO: 2707221 - RNA, 17 nt, Haemophilus influenzae Rd
cauccauucucaaauga

SEQ ID NO: 2707222 - RNA, 22 nt, Haemophilus influenzae Rd
cauccgcaauuaauccaucauu

SEQ ID NO: 2707223 - RNA, 21 nt, Haemophilus influenzae Rd
cauccgcuguucgcaaacaug

SEQ ID NO: 2707224 - RNA, 21 nt, Haemophilus influenzae Rd
caucgagcuuucaugauuaac

SEQ ID NO: 2707225 - RNA, 17 nt, Haemophilus influenzae Rd
caucgaguuuuaucuuc

SEQ ID NO: 2707226 - RNA, 17 nt, Haemophilus influenzae Rd
caucgcaucuaaacccc

SEQ ID NO: 2707227 - RNA, 16 nt, Haemophilus influenzae Rd
caucgcaucuguaucu

SEQ ID NO: 2707228 - RNA, 23 nt, Haemophilus influenzae Rd
caucgccaacuugaauaccugau

SEQ ID NO: 2707229 - RNA, 17 nt, Haemophilus influenzae Rd
caucgcccaauuuggca

SEQ ID NO: 2707230 - RNA, 16 nt, Haemophilus influenzae Rd
caucgcgcaaaauaau

SEQ ID NO: 2707231 - RNA, 16 nt, Haemophilus influenzae Rd
caucgcguuuuuucuu

SEQ ID NO: 2707232 - RNA, 16 nt, Haemophilus influenzae Rd
caucgcugaaauuaau

SEQ ID NO: 2707233 - RNA, 22 nt, Haemophilus influenzae Rd
caucgcuggauaaaugccgcca

SEQ ID NO: 2707234 - RNA, 21 nt, Haemophilus influenzae Rd
caucguaaccgacucguccau

SEQ ID NO: 2707235 - RNA, 23 nt, Haemophilus influenzae Rd
caucguaucaauuuuauugaaua

SEQ ID NO: 2707236 - RNA, 14 nt, Haemophilus influenzae Rd
caucguauuuccua

SEQ ID NO: 2707237 - RNA, 16 nt, Haemophilus influenzae Rd
caucgucaaaggaaca

SEQ ID NO: 2707238 - RNA, 13 nt, Haemophilus influenzae Rd
caucgucuucuuc

SEQ ID NO: 2707239 - RNA, 16 nt, Haemophilus influenzae Rd
caucgugaugauuuuc

SEQ ID NO: 2707240 - RNA, 16 nt, Haemophilus influenzae Rd
caucguguacuuuucg

SEQ ID NO: 2707241 - RNA, 19 nt, Haemophilus influenzae Rd
caucguguugccauuuuug

SEQ ID NO: 2707242 - RNA, 12 nt, Haemophilus influenzae Rd
caucuaaaaguu

SEQ ID NO: 2707243 - RNA, 14 nt, Haemophilus influenzae Rd
caucuaaaccgaua

SEQ ID NO: 2707244 - RNA, 18 nt, Haemophilus influenzae Rd
caucuaaggucauuaacu

SEQ ID NO: 2707245 - RNA, 18 nt, Haemophilus influenzae Rd
caucuaaguauucaugau

SEQ ID NO: 2707246 - RNA, 13 nt, Haemophilus influenzae Rd
caucuaauaauaa

SEQ ID NO: 2707247 - RNA, 19 nt, Haemophilus influenzae Rd
caucuaauaauaagauuuu

SEQ ID NO: 2707248 - RNA, 22 nt, Haemophilus influenzae Rd
caucuaauaauaagauuuuugg

SEQ ID NO: 2707249 - RNA, 18 nt, Haemophilus influenzae Rd
caucuaauucacuaccuc

SEQ ID NO: 2707250 - RNA, 20 nt, Haemophilus influenzae Rd
caucuaccacgauaaauccu

SEQ ID NO: 2707251 - RNA, 15 nt, Haemophilus influenzae Rd
caucuacccaauaaa

SEQ ID NO: 2707252 - RNA, 19 nt, Haemophilus influenzae Rd
cauuacgugcaaauaaauu

SEQ ID NO: 2707253 - RNA, 15 nt, Haemophilus influenzae Rd
cauuacguucauaua

SEQ ID NO: 2707254 - RNA, 22 nt, Haemophilus influenzae Rd
cauuacuuagauauauuauuua

SEQ ID NO: 2707255 - RNA, 20 nt, Haemophilus influenzae Rd
cauuacuucuaaacuuaauu

SEQ ID NO: 2707256 - RNA, 21 nt, Haemophilus influenzae Rd
cauuagcauccacaccaccag

SEQ ID NO: 2707257 - RNA, 23 nt, Haemophilus influenzae Rd
cauuaggaauaucuuugacuaaa

SEQ ID NO: 2707258 - RNA, 17 nt, Haemophilus influenzae Rd
cauuagucgucuauuua

SEQ ID NO: 2707259 - RNA, 18 nt, Haemophilus influenzae Rd
cauuagucgucuauuuau

SEQ ID NO: 2707260 - RNA, 14 nt, Haemophilus influenzae Rd
cauuaguuguuuua

SEQ ID NO: 2707261 - RNA, 18 nt, Haemophilus influenzae Rd
cauuauaaccaaaguuuc

SEQ ID NO: 2707262 - RNA, 13 nt, Haemophilus influenzae Rd
cauuaucaaaugc

SEQ ID NO: 2707263 - RNA, 16 nt, Haemophilus influenzae Rd
cauuauccaacauuaa

SEQ ID NO: 2707264 - RNA, 19 nt, Haemophilus influenzae Rd
cauuauccaacauuaauaa

SEQ ID NO: 2707265 - RNA, 15 nt, Haemophilus influenzae Rd
cauuauguaauauaa

SEQ ID NO: 2707266 - RNA, 15 nt, Haemophilus influenzae Rd
cauuauugccaauua

SEQ ID NO: 2707267 - RNA, 12 nt, Haemophilus influenzae Rd
cauuauugugau

SEQ ID NO: 2707268 - RNA, 19 nt, Haemophilus influenzae Rd
cauuauuuaauuuuuuaua

SEQ ID NO: 2707269 - RNA, 14 nt, Haemophilus influenzae Rd
cauuauuuggcaua

SEQ ID NO: 2707270 - RNA, 18 nt, Haemophilus influenzae Rd
cauuauuuuuacaaauag

SEQ ID NO: 2707271 - RNA, 14 nt, Haemophilus influenzae Rd
cauucaaaaauaaa

SEQ ID NO: 2707272 - RNA, 11 nt, Haemophilus influenzae Rd
cauucaaugca

SEQ ID NO: 2707273 - RNA, 22 nt, Haemophilus influenzae Rd
cauucaaugcaacaauacguug

SEQ ID NO: 2707274 - RNA, 18 nt, Haemophilus influenzae Rd
cauucaaugcagaaauac

SEQ ID NO: 2707275 - RNA, 19 nt, Haemophilus influenzae Rd
cauucaaugcagaaauacu

SEQ ID NO: 2707276 - RNA, 22 nt, Haemophilus influenzae Rd
cauucaaugcagaaauacuuuu

SEQ ID NO: 2707277 - RNA, 20 nt, Haemophilus influenzae Rd
cauucacaccuaaguaaguc

SEQ ID NO: 2707278 - RNA, 19 nt, Haemophilus influenzae Rd
cauucacaggguucagccc

SEQ ID NO: 2707279 - RNA, 21 nt, Haemophilus influenzae Rd
cauucacauucuuuuaaauac

SEQ ID NO: 2707280 - RNA, 15 nt, Haemophilus influenzae Rd
cauucacuuucacau

SEQ ID NO: 2707281 - RNA, 13 nt, Haemophilus influenzae Rd
cauucauuuugag

SEQ ID NO: 2707282 - RNA, 14 nt, Haemophilus influenzae Rd
cauucauuuugagc

SEQ ID NO: 2707283 - RNA, 23 nt, Haemophilus influenzae Rd
cauucauuuugucguaaugaaaa

SEQ ID NO: 2707284 - RNA, 19 nt, Haemophilus influenzae Rd
cauuccacccauaccgccc

SEQ ID NO: 2707285 - RNA, 20 nt, Haemophilus influenzae Rd
cauuccauuuugcauauuga

SEQ ID NO: 2707286 - RNA, 14 nt, Haemophilus influenzae Rd
cauucccaaauaau

SEQ ID NO: 2707287 - RNA, 20 nt, Haemophilus influenzae Rd
cauuccugcaagaaaaaugu

SEQ ID NO: 2707288 - RNA, 15 nt, Haemophilus influenzae Rd
cauucgcauauuuuu

SEQ ID NO: 2707289 - RNA, 17 nt, Haemophilus influenzae Rd
cauucgcauauuuuugc

SEQ ID NO: 2707290 - RNA, 12 nt, Haemophilus influenzae Rd
cauucuaauccu

SEQ ID NO: 2707291 - RNA, 15 nt, Haemophilus influenzae Rd
cauucuauuuuaaaa

SEQ ID NO: 2707292 - RNA, 17 nt, Haemophilus influenzae Rd
cauucuccguaaaaauc

SEQ ID NO: 2707293 - RNA, 17 nt, Haemophilus influenzae Rd
cauucuguaaacuaaau

SEQ ID NO: 2707294 - RNA, 13 nt, Haemophilus influenzae Rd
cauucuuaaauca

SEQ ID NO: 2707295 - RNA, 14 nt, Haemophilus influenzae Rd
cauucuuaaaucau

SEQ ID NO: 2707296 - RNA, 13 nt, Haemophilus influenzae Rd
cauucuuuuaaau

SEQ ID NO: 2707297 - RNA, 23 nt, Haemophilus influenzae Rd
cauugaaaccugaguaaauaaac

SEQ ID NO: 2707298 - RNA, 17 nt, Haemophilus influenzae Rd
cauugaaaccuuguaaa

SEQ ID NO: 2707299 - RNA, 18 nt, Haemophilus influenzae Rd
cauugaaaccuuguaaau

SEQ ID NO: 2707300 - RNA, 23 nt, Haemophilus influenzae Rd
cauugaagcgggcgaugaaagcg

SEQ ID NO: 2707301 - RNA, 15 nt, Haemophilus influenzae Rd
cauugaauuuuucua

SEQ ID NO: 2707302 - RNA, 20 nt, Haemophilus influenzae Rd
cauugaauuuuucuaaggua

SEQ ID NO: 2707303 - RNA, 15 nt, Haemophilus influenzae Rd
cauugaguuuuucug

SEQ ID NO: 2707304 - RNA, 16 nt, Haemophilus influenzae Rd
cauugauggaauaaau

SEQ ID NO: 2707305 - RNA, 18 nt, Haemophilus influenzae Rd
cauugauggaauaaauuu

SEQ ID NO: 2707306 - RNA, 22 nt, Haemophilus influenzae Rd
cauugauuuguuacuaaaauaa

SEQ ID NO: 2707307 - RNA, 19 nt, Haemophilus influenzae Rd
cauugcaagugcaguuuca

SEQ ID NO: 2707308 - RNA, 14 nt, Haemophilus influenzae Rd
cauugcaauuucag

SEQ ID NO: 2707309 - RNA, 19 nt, Haemophilus influenzae Rd
cauugcaauuucagcugcg

SEQ ID NO: 2707310 - RNA, 16 nt, Haemophilus influenzae Rd
cauugcauccacuuca

SEQ ID NO: 2707311 - RNA, 16 nt, Haemophilus influenzae Rd
cauugcauuuuuauaa

SEQ ID NO: 2707312 - RNA, 17 nt, Haemophilus influenzae Rd
cauugccaaagcauuua

SEQ ID NO: 2707313 - RNA, 23 nt, Haemophilus influenzae Rd
cauugcccgcuucuucgauaaaa

SEQ ID NO: 2707314 - RNA, 16 nt, Haemophilus influenzae Rd
cauugccuaaauacau

SEQ ID NO: 2707315 - RNA, 20 nt, Haemophilus influenzae Rd
cauugccuaaauacaucacu

SEQ ID NO: 2707316 - RNA, 15 nt, Haemophilus influenzae Rd
cauugcgccuuuuug

SEQ ID NO: 2707317 - RNA, 15 nt, Haemophilus influenzae Rd
cauugcguucacuca

SEQ ID NO: 2707318 - RNA, 16 nt, Haemophilus influenzae Rd
cauugcguucacucac

SEQ ID NO: 2707319 - RNA, 20 nt, Haemophilus influenzae Rd
cauugcuauggcaaugaaua

SEQ ID NO: 2707320 - RNA, 17 nt, Haemophilus influenzae Rd
cauugcuccacuucuua

SEQ ID NO: 2707321 - RNA, 15 nt, Haemophilus influenzae Rd
cauugcuuaacauua

SEQ ID NO: 2707322 - RNA, 14 nt, Haemophilus influenzae Rd
cauuggaaaaugcu

SEQ ID NO: 2707323 - RNA, 18 nt, Haemophilus influenzae Rd
cauuggaaugguauaaaa

SEQ ID NO: 2707324 - RNA, 17 nt, Haemophilus influenzae Rd
cauugggcguaauguug

SEQ ID NO: 2707325 - RNA, 16 nt, Haemophilus influenzae Rd
cauuggggaacggaag

SEQ ID NO: 2707326 - RNA, 15 nt, Haemophilus influenzae Rd
cauuggugaaaucaa

SEQ ID NO: 2707327 - RNA, 14 nt, Haemophilus influenzae Rd
cauuguaaaccaaa

SEQ ID NO: 2707328 - RNA, 19 nt, Haemophilus influenzae Rd
cauuguaaaccaaauuucu

SEQ ID NO: 2707329 - RNA, 21 nt, Haemophilus influenzae Rd
cauuguccacagcaaaagaaa

SEQ ID NO: 2707330 - RNA, 22 nt, Haemophilus influenzae Rd
cauuguccacagcaaaagaaau

SEQ ID NO: 2707331 - RNA, 16 nt, Haemophilus influenzae Rd
cauugucuuuuacguu

SEQ ID NO: 2707332 - RNA, 18 nt, Haemophilus influenzae Rd
cauugucuuuuacguuau

SEQ ID NO: 2707333 - RNA, 20 nt, Haemophilus influenzae Rd
cauugugacggugaauuuau

SEQ ID NO: 2707334 - RNA, 21 nt, Haemophilus influenzae Rd
cauugugacggugaauuuauc

SEQ ID NO: 2707335 - RNA, 17 nt, Haemophilus influenzae Rd
cauugugauguucuaaa

SEQ ID NO: 2707336 - RNA, 13 nt, Haemophilus influenzae Rd
cauugugcaauua

SEQ ID NO: 2707337 - RNA, 20 nt, Haemophilus influenzae Rd
cauugugccaaauucaguau

SEQ ID NO: 2707338 - RNA, 18 nt, Haemophilus influenzae Rd
cauugugggcuuuaagcu

SEQ ID NO: 2707339 - RNA, 13 nt, Haemophilus influenzae Rd
cauuguuaaaugu

SEQ ID NO: 2707340 - RNA, 20 nt, Haemophilus influenzae Rd
cauuguuacaaauuccucug

SEQ ID NO: 2707341 - RNA, 19 nt, Haemophilus influenzae Rd
cauuguuucaaucacuuua

SEQ ID NO: 2707342 - RNA, 22 nt, Haemophilus influenzae Rd
cauuguuucaaucacuuuaucu

SEQ ID NO: 2707343 - RNA, 18 nt, Haemophilus influenzae Rd
cauuguuucucaauaaau

SEQ ID NO: 2707344 - RNA, 17 nt, Haemophilus influenzae Rd
cauuguuugauccuuua

SEQ ID NO: 2707345 - RNA, 20 nt, Haemophilus influenzae Rd
cauuguuugcuaauguaguu

SEQ ID NO: 2707346 - RNA, 19 nt, Haemophilus influenzae Rd
cauuuaaaacaaaaggccu

SEQ ID NO: 2707347 - RNA, 21 nt, Haemophilus influenzae Rd
cauuuaaaaguaaaaauaaaa

SEQ ID NO: 2707348 - RNA, 22 nt, Haemophilus influenzae Rd
cauuuaaaaguaaaaauaaaaa

SEQ ID NO: 2707349 - RNA, 15 nt, Haemophilus influenzae Rd
cauuuaaaauauaua

SEQ ID NO: 2707350 - RNA, 18 nt, Haemophilus influenzae Rd
cauuuaaaauauauauua

SEQ ID NO: 2707351 - RNA, 13 nt, Haemophilus influenzae Rd
cauuuaaauaaaa

SEQ ID NO: 2707352 - RNA, 15 nt, Haemophilus influenzae Rd
cauuuaaauaaaaua

SEQ ID NO: 2707353 - RNA, 11 nt, Haemophilus influenzae Rd
cauuuaaauau

SEQ ID NO: 2707354 - RNA, 21 nt, Haemophilus influenzae Rd
cauuuaaccguaauuucaaau

SEQ ID NO: 2707355 - RNA, 19 nt, Haemophilus influenzae Rd
cauuuaacggggauuuuuu

SEQ ID NO: 2707356 - RNA, 17 nt, Haemophilus influenzae Rd
cauuuaacuugcaauca

SEQ ID NO: 2707357 - RNA, 17 nt, Haemophilus influenzae Rd
cauuuuuguuucaguuu

SEQ ID NO: 2707358 - RNA, 15 nt, Haemophilus influenzae Rd
cauuuuuuauuaaaa

SEQ ID NO: 2707359 - RNA, 17 nt, Haemophilus influenzae Rd
cauuuuuuauuaaaaaa

SEQ ID NO: 2707360 - RNA, 19 nt, Haemophilus influenzae Rd
cauuuuuugcaaacgcaag

SEQ ID NO: 2707361 - RNA, 15 nt, Haemophilus influenzae Rd
cauuuuuuuaaauau

SEQ ID NO: 2707362 - RNA, 15 nt, Haemophilus influenzae Rd
cauuuuuuuauucua

SEQ ID NO: 2707363 - RNA, 16 nt, Haemophilus influenzae Rd
cauuuuuuuauucuau

SEQ ID NO: 2707364 - RNA, 17 nt, Haemophilus influenzae Rd
cauuuuuuuugcauuua

SEQ ID NO: 2707365 - RNA, 12 nt, Haemophilus influenzae Rd
ccaaaaaagccc

SEQ ID NO: 2707366 - RNA, 15 nt, Haemophilus influenzae Rd
ccaaaaaagcccaag

SEQ ID NO: 2707367 - RNA, 12 nt, Haemophilus influenzae Rd
ccaaaaaccaga

SEQ ID NO: 2707368 - RNA, 13 nt, Haemophilus influenzae Rd
ccaaaaccauuca

SEQ ID NO: 2707369 - RNA, 19 nt, Haemophilus influenzae Rd
ccaaaagcugccaucugau

SEQ ID NO: 2707370 - RNA, 21 nt, Haemophilus influenzae Rd
ccaaaagcuggauuaaauaac

SEQ ID NO: 2707371 - RNA, 21 nt, Haemophilus influenzae Rd
ccaaaaguuguggaaguugcu

SEQ ID NO: 2707372 - RNA, 11 nt, Haemophilus influenzae Rd
ccaaaauauuu

SEQ ID NO: 2707373 - RNA, 12 nt, Haemophilus influenzae Rd
ccaaaaucauca

SEQ ID NO: 2707374 - RNA, 16 nt, Haemophilus influenzae Rd
ccaaaauuuaaaaucg

SEQ ID NO: 2707375 - RNA, 19 nt, Haemophilus influenzae Rd
ccaaaauuuaaagugguuu

SEQ ID NO: 2707376 - RNA, 13 nt, Haemophilus influenzae Rd
ccaaaauuucuga

SEQ ID NO: 2707377 - RNA, 11 nt, Haemophilus influenzae Rd
ccaaacauuuu

SEQ ID NO: 2707378 - RNA, 14 nt, Haemophilus influenzae Rd
ccaaacauuuuuau

SEQ ID NO: 2707379 - RNA, 19 nt, Haemophilus influenzae Rd
ccaaaccaucauaggcuuu

SEQ ID NO: 2707380 - RNA, 16 nt, Haemophilus influenzae Rd
ccaaacgguauuucaa

SEQ ID NO: 2707381 - RNA, 19 nt, Haemophilus influenzae Rd
ccaaacuccccuuaacuaa

SEQ ID NO: 2707382 - RNA, 19 nt, Haemophilus influenzae Rd
ccaaacugccaaacaaauu

SEQ ID NO: 2707383 - RNA, 14 nt, Haemophilus influenzae Rd
ccaaagaaagcgua

SEQ ID NO: 2707384 - RNA, 17 nt, Haemophilus influenzae Rd
ccaaagaaucaucuuca

SEQ ID NO: 2707385 - RNA, 22 nt, Haemophilus influenzae Rd
ccaaagcauuaaguuuuuagca

SEQ ID NO: 2707386 - RNA, 21 nt, Haemophilus influenzae Rd
ccaaagccaaugccaaaacca

SEQ ID NO: 2707387 - RNA, 14 nt, Haemophilus influenzae Rd
ccaaagcuauucau

SEQ ID NO: 2707388 - RNA, 23 nt, Haemophilus influenzae Rd
ccaaagcuguuugacaugacagu

SEQ ID NO: 2707389 - RNA, 19 nt, Haemophilus influenzae Rd
ccaaagugcgguauuuuuu

SEQ ID NO: 2707390 - RNA, 17 nt, Haemophilus influenzae Rd
ccaaaguuuccuucgcc

SEQ ID NO: 2707391 - RNA, 22 nt, Haemophilus influenzae Rd
ccaaaguuuccuucgccauuuu

SEQ ID NO: 2707392 - RNA, 22 nt, Haemophilus influenzae Rd
ccaaauaaaauuacaaaaccaa

SEQ ID NO: 2707393 - RNA, 19 nt, Haemophilus influenzae Rd
ccaaauaauccuagaguaa

SEQ ID NO: 2707394 - RNA, 18 nt, Haemophilus influenzae Rd
ccaaauaaugaccauugg

SEQ ID NO: 2707395 - RNA, 20 nt, Haemophilus influenzae Rd
ccaaauaauguuaaaucuaa

SEQ ID NO: 2707396 - RNA, 12 nt, Haemophilus influenzae Rd
ccaaauacaauu

SEQ ID NO: 2707397 - RNA, 16 nt, Haemophilus influenzae Rd
ccaaauacaauuuuuu

SEQ ID NO: 2707398 - RNA, 15 nt, Haemophilus influenzae Rd
ccaaauacauuuuug

SEQ ID NO: 2707399 - RNA, 16 nt, Haemophilus influenzae Rd
ccaaauacauuuuuga

SEQ ID NO: 2707400 - RNA, 16 nt, Haemophilus influenzae Rd
ccaaauaccacacccu

SEQ ID NO: 2707401 - RNA, 13 nt, Haemophilus influenzae Rd
ccaaauacuucac

SEQ ID NO: 2707402 - RNA, 16 nt, Haemophilus influenzae Rd
ccaaauagaugaaauu

SEQ ID NO: 2707403 - RNA, 22 nt, Haemophilus influenzae Rd
ccaaauagaugaaauuuauuau

SEQ ID NO: 2707404 - RNA, 15 nt, Haemophilus influenzae Rd
ccaaauauaaaauaa

SEQ ID NO: 2707405 - RNA, 22 nt, Haemophilus influenzae Rd
ccaaauaucuucauaucuuuga

SEQ ID NO: 2707406 - RNA, 14 nt, Haemophilus influenzae Rd
ccaaauaugaacuu

SEQ ID NO: 2707407 - RNA, 17 nt, Haemophilus influenzae Rd
ccaaauauucuucuaaa

SEQ ID NO: 2707408 - RNA, 22 nt, Haemophilus influenzae Rd
ccaaauccuuuugcauuauuga

SEQ ID NO: 2707409 - RNA, 17 nt, Haemophilus influenzae Rd
ccaaaucgccuuuuuga

SEQ ID NO: 2707410 - RNA, 19 nt, Haemophilus influenzae Rd
ccaaaugaugaaacaagcu

SEQ ID NO: 2707411 - RNA, 18 nt, Haemophilus influenzae Rd
ccaaaugcacauaacaaa

SEQ ID NO: 2707412 - RNA, 20 nt, Haemophilus influenzae Rd
ccaaaugcacauaacaaaau

SEQ ID NO: 2707413 - RNA, 18 nt, Haemophilus influenzae Rd
ccaaaugcggccaauacu

SEQ ID NO: 2707414 - RNA, 22 nt, Haemophilus influenzae Rd
ccaaauuaucaaagaauuuuuu

SEQ ID NO: 2707415 - RNA, 17 nt, Haemophilus influenzae Rd
ccaaauucauucuugcu

SEQ ID NO: 2707416 - RNA, 16 nt, Haemophilus influenzae Rd
ccaaauucauuuuuua

SEQ ID NO: 2707417 - RNA, 19 nt, Haemophilus influenzae Rd
ccaaauucauuuuuuauuu

SEQ ID NO: 2707418 - RNA, 23 nt, Haemophilus influenzae Rd
ccaaauuccauucacuuucacau

SEQ ID NO: 2707419 - RNA, 14 nt, Haemophilus influenzae Rd
ccaaauucguuacc

SEQ ID NO: 2707420 - RNA, 14 nt, Haemophilus influenzae Rd
ccaaauugauucau

SEQ ID NO: 2707421 - RNA, 23 nt, Haemophilus influenzae Rd
ccaaauugauucauuugauggua

SEQ ID NO: 2707422 - RNA, 22 nt, Haemophilus influenzae Rd
ccaaauuggguucgcaaauaac

SEQ ID NO: 2707423 - RNA, 23 nt, Haemophilus influenzae Rd
ccaaauuggguucgcaaauaacg

SEQ ID NO: 2707424 - RNA, 14 nt, Haemophilus influenzae Rd
ccaaauuuaaaaaa

SEQ ID NO: 2707425 - RNA, 14 nt, Haemophilus influenzae Rd
ccaaauuucuugcu

SEQ ID NO: 2707426 - RNA, 21 nt, Haemophilus influenzae Rd
ccaaauuuuccgcauaaauaa

SEQ ID NO: 2707427 - RNA, 22 nt, Haemophilus influenzae Rd
ccaaauuuuccgcauaaauaau

SEQ ID NO: 2707428 - RNA, 12 nt, Haemophilus influenzae Rd
ccaacaauuuca

SEQ ID NO: 2707429 - RNA, 13 nt, Haemophilus influenzae Rd
ccaacacauuauc

SEQ ID NO: 2707430 - RNA, 16 nt, Haemophilus influenzae Rd
ccaacagaaaucauuu

SEQ ID NO: 2707431 - RNA, 14 nt, Haemophilus influenzae Rd
ccaacauaaacauu

SEQ ID NO: 2707432 - RNA, 15 nt, Haemophilus influenzae Rd
ccaacauaaacauug

SEQ ID NO: 2707433 - RNA, 14 nt, Haemophilus influenzae Rd
ccaacauacauuaa

SEQ ID NO: 2707434 - RNA, 15 nt, Haemophilus influenzae Rd
ccaacauacauuaau

SEQ ID NO: 2707435 - RNA, 19 nt, Haemophilus influenzae Rd
ccaacauuucacuaaauaa

SEQ ID NO: 2707436 - RNA, 14 nt, Haemophilus influenzae Rd
ccaaccgguaaaau

SEQ ID NO: 2707437 - RNA, 14 nt, Haemophilus influenzae Rd
ccaacgaagaaaca

SEQ ID NO: 2707438 - RNA, 14 nt, Haemophilus influenzae Rd
ccaacgcacguaac

SEQ ID NO: 2707439 - RNA, 20 nt, Haemophilus influenzae Rd
ccaacgccuaauccauucaa

SEQ ID NO: 2707440 - RNA, 14 nt, Haemophilus influenzae Rd
ccaacguaaaaucg

SEQ ID NO: 2707441 - RNA, 14 nt, Haemophilus influenzae Rd
ccaacuaacuaagg

SEQ ID NO: 2707442 - RNA, 22 nt, Haemophilus influenzae Rd
ccaacuaaggugcagauuuuuu

SEQ ID NO: 2707443 - RNA, 19 nt, Haemophilus influenzae Rd
ccaacucauuacacaaaau

SEQ ID NO: 2707444 - RNA, 12 nt, Haemophilus influenzae Rd
ccaacugagcua

SEQ ID NO: 2707445 - RNA, 12 nt, Haemophilus influenzae Rd
ccaagaaucaag

SEQ ID NO: 2707446 - RNA, 15 nt, Haemophilus influenzae Rd
ccaagagucuugcca

SEQ ID NO: 2707447 - RNA, 18 nt, Haemophilus influenzae Rd
ccaagauaauaaaguuac

SEQ ID NO: 2707448 - RNA, 22 nt, Haemophilus influenzae Rd
ccaagaucaagcacuuuuccuu

SEQ ID NO: 2707449 - RNA, 14 nt, Haemophilus influenzae Rd
ccaagauucuaaau

SEQ ID NO: 2707450 - RNA, 18 nt, Haemophilus influenzae Rd
ccaagcaaagaaauuuua

SEQ ID NO: 2707451 - RNA, 22 nt, Haemophilus influenzae Rd
ccaagcaaugcuuuaaucauuu

SEQ ID NO: 2707452 - RNA, 22 nt, Haemophilus influenzae Rd
ccaagcaauuucaucacaucaa

SEQ ID NO: 2707453 - RNA, 19 nt, Haemophilus influenzae Rd
ccaagguuauuuagcccuu

SEQ ID NO: 2707454 - RNA, 14 nt, Haemophilus influenzae Rd
ccaagguugcucaa

SEQ ID NO: 2707455 - RNA, 22 nt, Haemophilus influenzae Rd
ccaagguugcucaauccaagua

SEQ ID NO: 2707456 - RNA, 19 nt, Haemophilus influenzae Rd
ccaagguuuuuuagauuau

SEQ ID NO: 2707457 - RNA, 14 nt, Haemophilus influenzae Rd
ccaaguaauacacc

SEQ ID NO: 2707458 - RNA, 19 nt, Haemophilus influenzae Rd
ccaaguccccauuuguaga

SEQ ID NO: 2707459 - RNA, 22 nt, Haemophilus influenzae Rd
ccaaguccccauuuguagaaag

SEQ ID NO: 2707460 - RNA, 23 nt, Haemophilus influenzae Rd
ccaagugaaauucuaccugcugu

SEQ ID NO: 2707461 - RNA, 18 nt, Haemophilus influenzae Rd
ccaagugcuuuaccuguu

SEQ ID NO: 2707462 - RNA, 18 nt, Haemophilus influenzae Rd
ccaaguuugcacuucuuc

SEQ ID NO: 2707463 - RNA, 21 nt, Haemophilus influenzae Rd
ccacucauacguucaacaauc

SEQ ID NO: 2707464 - RNA, 18 nt, Haemophilus influenzae Rd
ccacucgggcauauagac

SEQ ID NO: 2707465 - RNA, 21 nt, Haemophilus influenzae Rd
ccacucuuuuaauaaaaccau

SEQ ID NO: 2707466 - RNA, 21 nt, Haemophilus influenzae Rd
ccacugauuuuucuuuuucag

SEQ ID NO: 2707467 - RNA, 14 nt, Haemophilus influenzae Rd
ccacuggugcugaa

SEQ ID NO: 2707468 - RNA, 22 nt, Haemophilus influenzae Rd
ccacugugcauuaaaucaaauu

SEQ ID NO: 2707469 - RNA, 13 nt, Haemophilus influenzae Rd
ccacuguugugaa

SEQ ID NO: 2707470 - RNA, 18 nt, Haemophilus influenzae Rd
ccacuucacaacuuuuua

SEQ ID NO: 2707471 - RNA, 13 nt, Haemophilus influenzae Rd
ccacuucagcaga

SEQ ID NO: 2707472 - RNA, 16 nt, Haemophilus influenzae Rd
ccacuucauauaaauu

SEQ ID NO: 2707473 - RNA, 22 nt, Haemophilus influenzae Rd
ccacuucauuaaaaccaauuuu

SEQ ID NO: 2707474 - RNA, 20 nt, Haemophilus influenzae Rd
ccacuuccccaaguuugcac

SEQ ID NO: 2707475 - RNA, 13 nt, Haemophilus influenzae Rd
ccacuucugaauc

SEQ ID NO: 2707476 - RNA, 21 nt, Haemophilus influenzae Rd
ccacuugggcuaaaagcuguu

SEQ ID NO: 2707477 - RNA, 16 nt, Haemophilus influenzae Rd
ccacuuggugcaacca

SEQ ID NO: 2707478 - RNA, 14 nt, Haemophilus influenzae Rd
ccacuuucaacugu

SEQ ID NO: 2707479 - RNA, 22 nt, Haemophilus influenzae Rd
ccacuuuuccaguauagugcgc

SEQ ID NO: 2707480 - RNA, 15 nt, Haemophilus influenzae Rd
ccacuuuuucugcca

SEQ ID NO: 2707481 - RNA, 13 nt, Haemophilus influenzae Rd
ccagaaaauugca

SEQ ID NO: 2707482 - RNA, 16 nt, Haemophilus influenzae Rd
ccagaaaauugcaccu

SEQ ID NO: 2707483 - RNA, 18 nt, Haemophilus influenzae Rd
ccagaaaauugcaccuuc

SEQ ID NO: 2707484 - RNA, 22 nt, Haemophilus influenzae Rd
ccagaaaauugcaccuucuuuu

SEQ ID NO: 2707485 - RNA, 19 nt, Haemophilus influenzae Rd
ccagaaagcagguuuuucu

SEQ ID NO: 2707486 - RNA, 18 nt, Haemophilus influenzae Rd
ccagaaaguuuuaccccu

SEQ ID NO: 2707487 - RNA, 19 nt, Haemophilus influenzae Rd
ccagaaaugcuuacaggaa

SEQ ID NO: 2707488 - RNA, 20 nt, Haemophilus influenzae Rd
ccagaaauuggcuuguugcu

SEQ ID NO: 2707489 - RNA, 21 nt, Haemophilus influenzae Rd
ccagaaauuggcuuguugcug

SEQ ID NO: 2707490 - RNA, 14 nt, Haemophilus influenzae Rd
ccagaaugguaaug

SEQ ID NO: 2707491 - RNA, 17 nt, Haemophilus influenzae Rd
ccagaauuaagaucuaa

SEQ ID NO: 2707492 - RNA, 14 nt, Haemophilus influenzae Rd
ccagauaaaaacug

SEQ ID NO: 2707493 - RNA, 21 nt, Haemophilus influenzae Rd
ccagauaaaaacugugcgguc

SEQ ID NO: 2707494 - RNA, 13 nt, Haemophilus influenzae Rd
ccagaugcaauaa

SEQ ID NO: 2707495 - RNA, 23 nt, Haemophilus influenzae Rd
ccagauguuggaaauuuaaguga

SEQ ID NO: 2707496 - RNA, 16 nt, Haemophilus influenzae Rd
ccagauugguucauau

SEQ ID NO: 2707497 - RNA, 23 nt, Haemophilus influenzae Rd
ccagauugguucauaugcgauca

SEQ ID NO: 2707498 - RNA, 12 nt, Haemophilus influenzae Rd
ccagauuuuuag

SEQ ID NO: 2707499 - RNA, 20 nt, Haemophilus influenzae Rd
ccagauuuuuagacggucaa

SEQ ID NO: 2707500 - RNA, 16 nt, Haemophilus influenzae Rd
ccagauuuuuuuuaua

SEQ ID NO: 2707501 - RNA, 12 nt, Haemophilus influenzae Rd
ccagcaaaagca

SEQ ID NO: 2707502 - RNA, 14 nt, Haemophilus influenzae Rd
ccagcagugccaac

SEQ ID NO: 2707503 - RNA, 17 nt, Haemophilus influenzae Rd
ccagccccucagauaau

SEQ ID NO: 2707504 - RNA, 16 nt, Haemophilus influenzae Rd
ccagcguaaaaaugcu

SEQ ID NO: 2707505 - RNA, 16 nt, Haemophilus influenzae Rd
ccagcuaaagaaagca

SEQ ID NO: 2707506 - RNA, 11 nt, Haemophilus influenzae Rd
ccagcuugacg

SEQ ID NO: 2707507 - RNA, 18 nt, Haemophilus influenzae Rd
ccaggaguaaccacaaaa

SEQ ID NO: 2707508 - RNA, 19 nt, Haemophilus influenzae Rd
ccagguaauguuucauaaa

SEQ ID NO: 2707509 - RNA, 19 nt, Haemophilus influenzae Rd
ccaguaagcauauuugcaa

SEQ ID NO: 2707510 - RNA, 18 nt, Haemophilus influenzae Rd
ccaguaucaaucauauca

SEQ ID NO: 2707511 - RNA, 14 nt, Haemophilus influenzae Rd
ccagucaauaaacu

SEQ ID NO: 2707512 - RNA, 15 nt, Haemophilus influenzae Rd
ccagucaauaaacuc

SEQ ID NO: 2707513 - RNA, 21 nt, Haemophilus influenzae Rd
ccagucacuucuucaauacgu

SEQ ID NO: 2707514 - RNA, 18 nt, Haemophilus influenzae Rd
ccagugaccaagcgauua

SEQ ID NO: 2707515 - RNA, 20 nt, Haemophilus influenzae Rd
ccagugguugcgauuuuugc

SEQ ID NO: 2707516 - RNA, 18 nt, Haemophilus influenzae Rd
ccaguucuccuucuccau

SEQ ID NO: 2707517 - RNA, 17 nt, Haemophilus influenzae Rd
ccaguuggguuaaauau

SEQ ID NO: 2707518 - RNA, 16 nt, Haemophilus influenzae Rd
ccaguuucuugggauu

SEQ ID NO: 2707519 - RNA, 23 nt, Haemophilus influenzae Rd
ccauaaaagaccucucuaggcuu

SEQ ID NO: 2707520 - RNA, 13 nt, Haemophilus influenzae Rd
ccauaaacaauau

SEQ ID NO: 2707521 - RNA, 21 nt, Haemophilus influenzae Rd
ccauaaacaauauaaccagcc

SEQ ID NO: 2707522 - RNA, 23 nt, Haemophilus influenzae Rd
ccauaaaucggcguauuuuacaa

SEQ ID NO: 2707523 - RNA, 17 nt, Haemophilus influenzae Rd
ccauaacgcuaucuuuu

SEQ ID NO: 2707524 - RNA, 16 nt, Haemophilus influenzae Rd
ccauaacggcaagcaa

SEQ ID NO: 2707525 - RNA, 19 nt, Haemophilus influenzae Rd
ccauaacggcaagcaaaca

SEQ ID NO: 2707526 - RNA, 23 nt, Haemophilus influenzae Rd
ccauaagguuuggacaccuuuuu

SEQ ID NO: 2707527 - RNA, 14 nt, Haemophilus influenzae Rd
ccauaauacucacc

SEQ ID NO: 2707528 - RNA, 12 nt, Haemophilus influenzae Rd
ccauaauagaau

SEQ ID NO: 2707529 - RNA, 12 nt, Haemophilus influenzae Rd
ccauaauaucac

SEQ ID NO: 2707530 - RNA, 20 nt, Haemophilus influenzae Rd
ccauaauguucccuauaaau

SEQ ID NO: 2707531 - RNA, 21 nt, Haemophilus influenzae Rd
ccauaauuucagcaucagaaa

SEQ ID NO: 2707532 - RNA, 17 nt, Haemophilus influenzae Rd
ccauacaaguauuuucc

SEQ ID NO: 2707533 - RNA, 17 nt, Haemophilus influenzae Rd
ccauacaguaaaaauag

SEQ ID NO: 2707534 - RNA, 15 nt, Haemophilus influenzae Rd
ccauacauucagugg

SEQ ID NO: 2707535 - RNA, 22 nt, Haemophilus influenzae Rd
ccauacccuugcuucuggaaau

SEQ ID NO: 2707536 - RNA, 16 nt, Haemophilus influenzae Rd
ccauaccguauuuuuu

SEQ ID NO: 2707537 - RNA, 21 nt, Haemophilus influenzae Rd
ccauaccguauuuuuuuaauu

SEQ ID NO: 2707538 - RNA, 14 nt, Haemophilus influenzae Rd
ccauaccucuauuu

SEQ ID NO: 2707539 - RNA, 16 nt, Haemophilus influenzae Rd
ccauacgcgaugcauu

SEQ ID NO: 2707540 - RNA, 19 nt, Haemophilus influenzae Rd
ccauacgcgaugcauugau

SEQ ID NO: 2707541 - RNA, 20 nt, Haemophilus influenzae Rd
ccauacgcgaugcauugauu

SEQ ID NO: 2707542 - RNA, 14 nt, Haemophilus influenzae Rd
ccauagaaagcauu

SEQ ID NO: 2707543 - RNA, 22 nt, Haemophilus influenzae Rd
ccauaguggcaauaacuacaac

SEQ ID NO: 2707544 - RNA, 15 nt, Haemophilus influenzae Rd
ccauauaccaauaau

SEQ ID NO: 2707545 - RNA, 17 nt, Haemophilus influenzae Rd
ccauauacuugccaaaa

SEQ ID NO: 2707546 - RNA, 21 nt, Haemophilus influenzae Rd
ccauauaguaagcaccaaaau

SEQ ID NO: 2707547 - RNA, 14 nt, Haemophilus influenzae Rd
ccauaucugaaaau

SEQ ID NO: 2707548 - RNA, 13 nt, Haemophilus influenzae Rd
ccauauuaucugc

SEQ ID NO: 2707549 - RNA, 18 nt, Haemophilus influenzae Rd
ccauauucgcuuucauaa

SEQ ID NO: 2707550 - RNA, 12 nt, Haemophilus influenzae Rd
ccaucaaaacuu

SEQ ID NO: 2707551 - RNA, 20 nt, Haemophilus influenzae Rd
ccaucaaaagaucauuuuuu

SEQ ID NO: 2707552 - RNA, 21 nt, Haemophilus influenzae Rd
ccaucaaaagaucauuuuuuu

SEQ ID NO: 2707553 - RNA, 13 nt, Haemophilus influenzae Rd
ccaucaaaucuuu

SEQ ID NO: 2707554 - RNA, 22 nt, Haemophilus influenzae Rd
ccaucaaccauaacaagaauca

SEQ ID NO: 2707555 - RNA, 22 nt, Haemophilus influenzae Rd
ccaucaagaaaguuuuaagugc

SEQ ID NO: 2707556 - RNA, 12 nt, Haemophilus influenzae Rd
ccaucaaucaua

SEQ ID NO: 2707557 - RNA, 21 nt, Haemophilus influenzae Rd
ccaucaaucauaaaaacaaua

SEQ ID NO: 2707558 - RNA, 22 nt, Haemophilus influenzae Rd
ccaucacagucuuuuaacacau

SEQ ID NO: 2707559 - RNA, 15 nt, Haemophilus influenzae Rd
ccaucaccuucaaca

SEQ ID NO: 2707560 - RNA, 17 nt, Haemophilus influenzae Rd
ccaucacguaauacaaa

SEQ ID NO: 2707561 - RNA, 20 nt, Haemophilus influenzae Rd
ccaucacuacguguuaauaa

SEQ ID NO: 2707562 - RNA, 16 nt, Haemophilus influenzae Rd
ccaucagcuccuacau

SEQ ID NO: 2707563 - RNA, 20 nt, Haemophilus influenzae Rd
ccaucauagauaaaguauaa

SEQ ID NO: 2707564 - RNA, 13 nt, Haemophilus influenzae Rd
ccaucaucuuauc

SEQ ID NO: 2707565 - RNA, 20 nt, Haemophilus influenzae Rd
ccauccauaacggcaagcaa

SEQ ID NO: 2707566 - RNA, 16 nt, Haemophilus influenzae Rd
ccaucccagucaaaaa

SEQ ID NO: 2707567 - RNA, 17 nt, Haemophilus influenzae Rd
ccaucccagucaaaaau

SEQ ID NO: 2707568 - RNA, 20 nt, Haemophilus influenzae Rd
cccagcauuccguucacaaa

SEQ ID NO: 2707569 - RNA, 20 nt, Haemophilus influenzae Rd
cccagcguaaaaaugcuguu

SEQ ID NO: 2707570 - RNA, 23 nt, Haemophilus influenzae Rd
cccaguaaaacuugcaaaccaac

SEQ ID NO: 2707571 - RNA, 19 nt, Haemophilus influenzae Rd
cccauacaaguauuuuccu

SEQ ID NO: 2707572 - RNA, 21 nt, Haemophilus influenzae Rd
cccauagcggauaaccaaaau

SEQ ID NO: 2707573 - RNA, 22 nt, Haemophilus influenzae Rd
cccaugcgaacagguucauuaa

SEQ ID NO: 2707574 - RNA, 11 nt, Haemophilus influenzae Rd
cccaugcuuug

SEQ ID NO: 2707575 - RNA, 19 nt, Haemophilus influenzae Rd
cccauuaaugguauuguga

SEQ ID NO: 2707576 - RNA, 21 nt, Haemophilus influenzae Rd
cccauuaaugguauugugauu

SEQ ID NO: 2707577 - RNA, 15 nt, Haemophilus influenzae Rd
cccauuggaagauuu

SEQ ID NO: 2707578 - RNA, 18 nt, Haemophilus influenzae Rd
cccauuggaagauuucuu

SEQ ID NO: 2707579 - RNA, 21 nt, Haemophilus influenzae Rd
cccauuggaauauacaguuca

SEQ ID NO: 2707580 - RNA, 18 nt, Haemophilus influenzae Rd
cccauuuaugggugaggg

SEQ ID NO: 2707581 - RNA, 15 nt, Haemophilus influenzae Rd
cccauuucaucuuca

SEQ ID NO: 2707582 - RNA, 15 nt, Haemophilus influenzae Rd
cccauuugaauuuua

SEQ ID NO: 2707583 - RNA, 23 nt, Haemophilus influenzae Rd
cccauuugaauuuuacuucuuca

SEQ ID NO: 2707584 - RNA, 14 nt, Haemophilus influenzae Rd
cccauuuguagaaa

SEQ ID NO: 2707585 - RNA, 21 nt, Haemophilus influenzae Rd
cccauuugucucaaaauccaa

SEQ ID NO: 2707586 - RNA, 23 nt, Haemophilus influenzae Rd
ccccaaaaaguuagauugauuua

SEQ ID NO: 2707587 - RNA, 22 nt, Haemophilus influenzae Rd
ccccaaguuugcacuucuucag

SEQ ID NO: 2707588 - RNA, 15 nt, Haemophilus influenzae Rd
ccccaauaaaaagau

SEQ ID NO: 2707589 - RNA, 11 nt, Haemophilus influenzae Rd
ccccaauauuu

SEQ ID NO: 2707590 - RNA, 19 nt, Haemophilus influenzae Rd
ccccaauuaagucaaaaau

SEQ ID NO: 2707591 - RNA, 14 nt, Haemophilus influenzae Rd
ccccauaucucugc

SEQ ID NO: 2707592 - RNA, 16 nt, Haemophilus influenzae Rd
ccccauaucucugcca

SEQ ID NO: 2707593 - RNA, 15 nt, Haemophilus influenzae Rd
ccccgcucuuuccau

SEQ ID NO: 2707594 - RNA, 13 nt, Haemophilus influenzae Rd
ccccuauagcuua

SEQ ID NO: 2707595 - RNA, 18 nt, Haemophilus influenzae Rd
cccgcauauaaaauaaag

SEQ ID NO: 2707596 - RNA, 13 nt, Haemophilus influenzae Rd
cccgcucuuucca

SEQ ID NO: 2707597 - RNA, 20 nt, Haemophilus influenzae Rd
cccgcuguaauugcgccccc

SEQ ID NO: 2707598 - RNA, 15 nt, Haemophilus influenzae Rd
cccgcuucuaaggca

SEQ ID NO: 2707599 - RNA, 15 nt, Haemophilus influenzae Rd
cccgcuucuuucgca

SEQ ID NO: 2707600 - RNA, 20 nt, Haemophilus influenzae Rd
cccgugcagacuagugaaau

SEQ ID NO: 2707601 - RNA, 22 nt, Haemophilus influenzae Rd
cccguuaaauuuaucauuuaac

SEQ ID NO: 2707602 - RNA, 14 nt, Haemophilus influenzae Rd
cccguucaauuuga

SEQ ID NO: 2707603 - RNA, 21 nt, Haemophilus influenzae Rd
cccguuguguuucaacaaaaa

SEQ ID NO: 2707604 - RNA, 16 nt, Haemophilus influenzae Rd
cccuaaucguucauaa

SEQ ID NO: 2707605 - RNA, 19 nt, Haemophilus influenzae Rd
cccuacaaugcucacuucg

SEQ ID NO: 2707606 - RNA, 14 nt, Haemophilus influenzae Rd
cccuacaggcuucc

SEQ ID NO: 2707607 - RNA, 19 nt, Haemophilus influenzae Rd
cccuauacuccacuauaaa

SEQ ID NO: 2707608 - RNA, 16 nt, Haemophilus influenzae Rd
cccuauuacuuuccau

SEQ ID NO: 2707609 - RNA, 15 nt, Haemophilus influenzae Rd
cccucaaaauuauga

SEQ ID NO: 2707610 - RNA, 12 nt, Haemophilus influenzae Rd
cccucaaccacu

SEQ ID NO: 2707611 - RNA, 18 nt, Haemophilus influenzae Rd
cccucgccuugcaaauuu

SEQ ID NO: 2707612 - RNA, 17 nt, Haemophilus influenzae Rd
cccugaaagucgauuca

SEQ ID NO: 2707613 - RNA, 13 nt, Haemophilus influenzae Rd
cccugaagccaau

SEQ ID NO: 2707614 - RNA, 18 nt, Haemophilus influenzae Rd
cccugaaugcguucaugg

SEQ ID NO: 2707615 - RNA, 13 nt, Haemophilus influenzae Rd
cccuguucaaauu

SEQ ID NO: 2707616 - RNA, 22 nt, Haemophilus influenzae Rd
cccuguuuuaagguuuuuuccg

SEQ ID NO: 2707617 - RNA, 13 nt, Haemophilus influenzae Rd
cccuuaauuauuu

SEQ ID NO: 2707618 - RNA, 12 nt, Haemophilus influenzae Rd
cccuuacuuuau

SEQ ID NO: 2707619 - RNA, 21 nt, Haemophilus influenzae Rd
cccuucaaauauaacgacguu

SEQ ID NO: 2707620 - RNA, 17 nt, Haemophilus influenzae Rd
cccuuguuacaccuugg

SEQ ID NO: 2707621 - RNA, 20 nt, Haemophilus influenzae Rd
cccuuuguuuuaaugauaaa

SEQ ID NO: 2707622 - RNA, 17 nt, Haemophilus influenzae Rd
cccuuuuaguuuccccu

SEQ ID NO: 2707623 - RNA, 18 nt, Haemophilus influenzae Rd
cccuuuuaguuuccccug

SEQ ID NO: 2707624 - RNA, 14 nt, Haemophilus influenzae Rd
cccuuuucaaacaa

SEQ ID NO: 2707625 - RNA, 17 nt, Haemophilus influenzae Rd
cccuuuucuuauuucug

SEQ ID NO: 2707626 - RNA, 13 nt, Haemophilus influenzae Rd
cccuuuuguuauu

SEQ ID NO: 2707627 - RNA, 23 nt, Haemophilus influenzae Rd
ccgaaaaugguuacguuuuucca

SEQ ID NO: 2707628 - RNA, 16 nt, Haemophilus influenzae Rd
ccgaaagauauauaau

SEQ ID NO: 2707629 - RNA, 14 nt, Haemophilus influenzae Rd
ccgaaauucccauu

SEQ ID NO: 2707630 - RNA, 17 nt, Haemophilus influenzae Rd
ccgaauccaaugccuug

SEQ ID NO: 2707631 - RNA, 14 nt, Haemophilus influenzae Rd
ccgaaucugauugc

SEQ ID NO: 2707632 - RNA, 17 nt, Haemophilus influenzae Rd
ccgaauguggcagcaaa

SEQ ID NO: 2707633 - RNA, 22 nt, Haemophilus influenzae Rd
ccgaccguguuuuucaucaaug

SEQ ID NO: 2707634 - RNA, 20 nt, Haemophilus influenzae Rd
ccgacuuugucaauauaaag

SEQ ID NO: 2707635 - RNA, 22 nt, Haemophilus influenzae Rd
ccgaguaaauucaccaauuccg

SEQ ID NO: 2707636 - RNA, 19 nt, Haemophilus influenzae Rd
ccgauaaaaccuaaaauug

SEQ ID NO: 2707637 - RNA, 16 nt, Haemophilus influenzae Rd
ccgauaaaugcacauu

SEQ ID NO: 2707638 - RNA, 19 nt, Haemophilus influenzae Rd
ccgauuaagaauacugcac

SEQ ID NO: 2707639 - RNA, 13 nt, Haemophilus influenzae Rd
ccgauuaauucaa

SEQ ID NO: 2707640 - RNA, 18 nt, Haemophilus influenzae Rd
ccgauuucuuuacaaauu

SEQ ID NO: 2707641 - RNA, 12 nt, Haemophilus influenzae Rd
ccgauuuuaaau

SEQ ID NO: 2707642 - RNA, 13 nt, Haemophilus influenzae Rd
ccgauuuuaaauu

SEQ ID NO: 2707643 - RNA, 16 nt, Haemophilus influenzae Rd
ccgcaacuaauaaacc

SEQ ID NO: 2707644 - RNA, 20 nt, Haemophilus influenzae Rd
ccgcaacuaauaaaccaaua

SEQ ID NO: 2707645 - RNA, 18 nt, Haemophilus influenzae Rd
ccgcaagugguaaaaucc

SEQ ID NO: 2707646 - RNA, 22 nt, Haemophilus influenzae Rd
ccgcaauugggauuauuuuugu

SEQ ID NO: 2707647 - RNA, 15 nt, Haemophilus influenzae Rd
ccgcaauuucugcca

SEQ ID NO: 2707648 - RNA, 16 nt, Haemophilus influenzae Rd
ccgcacuucuaugaag

SEQ ID NO: 2707649 - RNA, 20 nt, Haemophilus influenzae Rd
ccgcacuuuaaacuguugcc

SEQ ID NO: 2707650 - RNA, 22 nt, Haemophilus influenzae Rd
ccgcacuuuaaauauuuaaaaa

SEQ ID NO: 2707651 - RNA, 17 nt, Haemophilus influenzae Rd
ccgcacuuuccccccuu

SEQ ID NO: 2707652 - RNA, 17 nt, Haemophilus influenzae Rd
ccgcacuuucuucuuuu

SEQ ID NO: 2707653 - RNA, 22 nt, Haemophilus influenzae Rd
ccgcacuuuggaauauucuuuu

SEQ ID NO: 2707654 - RNA, 21 nt, Haemophilus influenzae Rd
ccgcacuuuuauccaccagca

SEQ ID NO: 2707655 - RNA, 23 nt, Haemophilus influenzae Rd
ccgcacuuuuaucuauaaaaaga

SEQ ID NO: 2707656 - RNA, 23 nt, Haemophilus influenzae Rd
ccgcacuuuucaacaaaaaacac

SEQ ID NO: 2707657 - RNA, 19 nt, Haemophilus influenzae Rd
ccgcacuuuuguauuuuau

SEQ ID NO: 2707658 - RNA, 19 nt, Haemophilus influenzae Rd
ccgcacuuuuuauauuuuu

SEQ ID NO: 2707659 - RNA, 20 nt, Haemophilus influenzae Rd
ccgcacuuuuuaucuaaaaa

SEQ ID NO: 2707660 - RNA, 15 nt, Haemophilus influenzae Rd
ccgcacuuuuuuuau

SEQ ID NO: 2707661 - RNA, 14 nt, Haemophilus influenzae Rd
ccgcauaggccuca

SEQ ID NO: 2707662 - RNA, 13 nt, Haemophilus influenzae Rd
ccgcaucaaaauu

SEQ ID NO: 2707663 - RNA, 12 nt, Haemophilus influenzae Rd
ccgcaucuuugg

SEQ ID NO: 2707664 - RNA, 21 nt, Haemophilus influenzae Rd
ccgcauugcccgcuucuucga

SEQ ID NO: 2707665 - RNA, 22 nt, Haemophilus influenzae Rd
ccgcauuguaaaccaaauuucu

SEQ ID NO: 2707666 - RNA, 19 nt, Haemophilus influenzae Rd
ccgccaaaaugagcuuuuc

SEQ ID NO: 2707667 - RNA, 19 nt, Haemophilus influenzae Rd
ccgccaauauguuuaccac

SEQ ID NO: 2707668 - RNA, 14 nt, Haemophilus influenzae Rd
ccgccaaugcuuuu

SEQ ID NO: 2707669 - RNA, 14 nt, Haemophilus influenzae Rd
ccgcccaacauuuc

SEQ ID NO: 2707670 - RNA, 23 nt, Haemophilus influenzae Rd
ccgccuuaaucauugcaagugca

SEQ ID NO: 2707671 - RNA, 12 nt, Haemophilus influenzae Rd
ccgccuucuucc

SEQ ID NO: 2707672 - RNA, 13 nt, Haemophilus influenzae Rd
ccgccuucuucca

SEQ ID NO: 2707673 - RNA, 21 nt, Haemophilus influenzae Rd
ccucgccauuuugaggaauaa

SEQ ID NO: 2707674 - RNA, 15 nt, Haemophilus influenzae Rd
ccucgccuugcaaau

SEQ ID NO: 2707675 - RNA, 14 nt, Haemophilus influenzae Rd
ccucuaaauaaaaa

SEQ ID NO: 2707676 - RNA, 20 nt, Haemophilus influenzae Rd
ccucuaaauaaaaacgcccu

SEQ ID NO: 2707677 - RNA, 15 nt, Haemophilus influenzae Rd
ccucuacggcaauug

SEQ ID NO: 2707678 - RNA, 16 nt, Haemophilus influenzae Rd
ccucuacggcaauugg

SEQ ID NO: 2707679 - RNA, 20 nt, Haemophilus influenzae Rd
ccucucggcgguucuuguuu

SEQ ID NO: 2707680 - RNA, 23 nt, Haemophilus influenzae Rd
ccucucgggugcgccauuuuuaa

SEQ ID NO: 2707681 - RNA, 21 nt, Haemophilus influenzae Rd
ccucugcagggaaaaauuuua

SEQ ID NO: 2707682 - RNA, 15 nt, Haemophilus influenzae Rd
ccucuugcuucuaau

SEQ ID NO: 2707683 - RNA, 13 nt, Haemophilus influenzae Rd
ccucuuggauuuu

SEQ ID NO: 2707684 - RNA, 15 nt, Haemophilus influenzae Rd
ccucuuggauuuucu

SEQ ID NO: 2707685 - RNA, 13 nt, Haemophilus influenzae Rd
ccucuuuuuucau

SEQ ID NO: 2707686 - RNA, 22 nt, Haemophilus influenzae Rd
ccugaaagucgauucaaauaac

SEQ ID NO: 2707687 - RNA, 23 nt, Haemophilus influenzae Rd
ccugaacuuucgcguaauaacaa

SEQ ID NO: 2707688 - RNA, 16 nt, Haemophilus influenzae Rd
ccugaagcaucuggca

SEQ ID NO: 2707689 - RNA, 18 nt, Haemophilus influenzae Rd
ccugaauuaccauaaaac

SEQ ID NO: 2707690 - RNA, 17 nt, Haemophilus influenzae Rd
ccugacauuuuugccag

SEQ ID NO: 2707691 - RNA, 22 nt, Haemophilus influenzae Rd
ccugacucaacgccacucauau

SEQ ID NO: 2707692 - RNA, 17 nt, Haemophilus influenzae Rd
ccugauaaguagaaaaa

SEQ ID NO: 2707693 - RNA, 18 nt, Haemophilus influenzae Rd
ccugauaaguagaaaaau

SEQ ID NO: 2707694 - RNA, 21 nt, Haemophilus influenzae Rd
ccugauaaguagaaaaauugg

SEQ ID NO: 2707695 - RNA, 13 nt, Haemophilus influenzae Rd
ccugaugcagaag

SEQ ID NO: 2707696 - RNA, 20 nt, Haemophilus influenzae Rd
ccugaugcuuuaacaccaau

SEQ ID NO: 2707697 - RNA, 23 nt, Haemophilus influenzae Rd
ccugaugcuuuaacaccaauauu

SEQ ID NO: 2707698 - RNA, 17 nt, Haemophilus influenzae Rd
ccugauuaaucaaaaau

SEQ ID NO: 2707699 - RNA, 15 nt, Haemophilus influenzae Rd
ccugauuauugugau

SEQ ID NO: 2707700 - RNA, 15 nt, Haemophilus influenzae Rd
ccugauuuuuuuaga

SEQ ID NO: 2707701 - RNA, 20 nt, Haemophilus influenzae Rd
ccugcaaacgagacauuauu

SEQ ID NO: 2707702 - RNA, 15 nt, Haemophilus influenzae Rd
ccugcaaagccuuca

SEQ ID NO: 2707703 - RNA, 13 nt, Haemophilus influenzae Rd
ccugcagaaaggc

SEQ ID NO: 2707704 - RNA, 15 nt, Haemophilus influenzae Rd
ccugcagagaagaaa

SEQ ID NO: 2707705 - RNA, 22 nt, Haemophilus influenzae Rd
ccugcagagaagaaauacaauc

SEQ ID NO: 2707706 - RNA, 16 nt, Haemophilus influenzae Rd
ccugcagccauaauau

SEQ ID NO: 2707707 - RNA, 20 nt, Haemophilus influenzae Rd
ccugcagccauaauauuuaa

SEQ ID NO: 2707708 - RNA, 14 nt, Haemophilus influenzae Rd
ccugccaguagaaa

SEQ ID NO: 2707709 - RNA, 20 nt, Haemophilus influenzae Rd
ccugcccauaagugagaaaa

SEQ ID NO: 2707710 - RNA, 20 nt, Haemophilus influenzae Rd
ccugcuaauggcugaucuug

SEQ ID NO: 2707711 - RNA, 13 nt, Haemophilus influenzae Rd
ccugcuacauauu

SEQ ID NO: 2707712 - RNA, 21 nt, Haemophilus influenzae Rd
ccugcugcaguuacugccucu

SEQ ID NO: 2707713 - RNA, 18 nt, Haemophilus influenzae Rd
ccugcuggguuugcacuu

SEQ ID NO: 2707714 - RNA, 19 nt, Haemophilus influenzae Rd
ccugggcggaagcuaggua

SEQ ID NO: 2707715 - RNA, 16 nt, Haemophilus influenzae Rd
ccuguacguuaucuga

SEQ ID NO: 2707716 - RNA, 17 nt, Haemophilus influenzae Rd
ccugucaauuuuucuac

SEQ ID NO: 2707717 - RNA, 18 nt, Haemophilus influenzae Rd
ccugucaucgguucuuuu

SEQ ID NO: 2707718 - RNA, 18 nt, Haemophilus influenzae Rd
ccuuaaaucaaacaaaau

SEQ ID NO: 2707719 - RNA, 13 nt, Haemophilus influenzae Rd
ccuuaacauuuuc

SEQ ID NO: 2707720 - RNA, 19 nt, Haemophilus influenzae Rd
ccuuaauacugcugaauaa

SEQ ID NO: 2707721 - RNA, 22 nt, Haemophilus influenzae Rd
ccuuaauacugcugaauaaacc

SEQ ID NO: 2707722 - RNA, 12 nt, Haemophilus influenzae Rd
ccuuaauuauuu

SEQ ID NO: 2707723 - RNA, 13 nt, Haemophilus influenzae Rd
ccuuaauucuaag

SEQ ID NO: 2707724 - RNA, 16 nt, Haemophilus influenzae Rd
ccuuaccuuccacuuu

SEQ ID NO: 2707725 - RNA, 23 nt, Haemophilus influenzae Rd
ccuuacugccuuuuucuucuuuc

SEQ ID NO: 2707726 - RNA, 14 nt, Haemophilus influenzae Rd
ccuuagauuuaagc

SEQ ID NO: 2707727 - RNA, 19 nt, Haemophilus influenzae Rd
ccuuagcgugaauauauua

SEQ ID NO: 2707728 - RNA, 15 nt, Haemophilus influenzae Rd
ccuuauacaaaacua

SEQ ID NO: 2707729 - RNA, 18 nt, Haemophilus influenzae Rd
ccuuauucgcugcaaaau

SEQ ID NO: 2707730 - RNA, 12 nt, Haemophilus influenzae Rd
ccuuauuuuuug

SEQ ID NO: 2707731 - RNA, 23 nt, Haemophilus influenzae Rd
ccuuauuuuuuggaauauuaucu

SEQ ID NO: 2707732 - RNA, 16 nt, Haemophilus influenzae Rd
ccuucaacauuuuuug

SEQ ID NO: 2707733 - RNA, 21 nt, Haemophilus influenzae Rd
ccuucaaccacccauacuuua

SEQ ID NO: 2707734 - RNA, 12 nt, Haemophilus influenzae Rd
ccuucaaucgca

SEQ ID NO: 2707735 - RNA, 12 nt, Haemophilus influenzae Rd
ccuucacgaccc

SEQ ID NO: 2707736 - RNA, 19 nt, Haemophilus influenzae Rd
ccuucacuuggcgaaaauc

SEQ ID NO: 2707737 - RNA, 12 nt, Haemophilus influenzae Rd
ccuucagccacu

SEQ ID NO: 2707738 - RNA, 13 nt, Haemophilus influenzae Rd
ccuucagccacua

SEQ ID NO: 2707739 - RNA, 14 nt, Haemophilus influenzae Rd
ccuucaggauaaaa

SEQ ID NO: 2707740 - RNA, 19 nt, Haemophilus influenzae Rd
ccuucagggcggagauaua

SEQ ID NO: 2707741 - RNA, 17 nt, Haemophilus influenzae Rd
ccuucauauaauaaacg

SEQ ID NO: 2707742 - RNA, 20 nt, Haemophilus influenzae Rd
ccuuccaaauccaucauuuc

SEQ ID NO: 2707743 - RNA, 15 nt, Haemophilus influenzae Rd
ccuuccaucuuuuug

SEQ ID NO: 2707744 - RNA, 15 nt, Haemophilus influenzae Rd
ccuucgaaugcuugc

SEQ ID NO: 2707745 - RNA, 23 nt, Haemophilus influenzae Rd
ccuucgaccaacggauuaaaagu

SEQ ID NO: 2707746 - RNA, 13 nt, Haemophilus influenzae Rd
ccuucuaacgcca

SEQ ID NO: 2707747 - RNA, 14 nt, Haemophilus influenzae Rd
ccuucuaacgccau

SEQ ID NO: 2707748 - RNA, 14 nt, Haemophilus influenzae Rd
ccuucugccauaac

SEQ ID NO: 2707749 - RNA, 21 nt, Haemophilus influenzae Rd
ccuucugcggaaaugaaacca

SEQ ID NO: 2707750 - RNA, 16 nt, Haemophilus influenzae Rd
ccuucuuugauauaaa

SEQ ID NO: 2707751 - RNA, 14 nt, Haemophilus influenzae Rd
ccuugaaucauuuc

SEQ ID NO: 2707752 - RNA, 22 nt, Haemophilus influenzae Rd
ccuugaauugcuuuaauuucuu

SEQ ID NO: 2707753 - RNA, 20 nt, Haemophilus influenzae Rd
ccuugacauauucuguugaa

SEQ ID NO: 2707754 - RNA, 14 nt, Haemophilus influenzae Rd
ccuugagccaguuu

SEQ ID NO: 2707755 - RNA, 21 nt, Haemophilus influenzae Rd
ccuugauaaguaggcaaaauc

SEQ ID NO: 2707756 - RNA, 16 nt, Haemophilus influenzae Rd
ccuugauuauuuuuua

SEQ ID NO: 2707757 - RNA, 18 nt, Haemophilus influenzae Rd
ccuugauuauuuuuuaac

SEQ ID NO: 2707758 - RNA, 22 nt, Haemophilus influenzae Rd
ccuugcauaauuccuuuuucua

SEQ ID NO: 2707759 - RNA, 19 nt, Haemophilus influenzae Rd
ccuugcucacgggcagaau

SEQ ID NO: 2707760 - RNA, 17 nt, Haemophilus influenzae Rd
ccuugguuuucuugcca

SEQ ID NO: 2707761 - RNA, 21 nt, Haemophilus influenzae Rd
ccuuguaaacuuuccucaagu

SEQ ID NO: 2707762 - RNA, 16 nt, Haemophilus influenzae Rd
ccuuguaaccaagcug

SEQ ID NO: 2707763 - RNA, 19 nt, Haemophilus influenzae Rd
ccuuguaacguauuuaaaa

SEQ ID NO: 2707764 - RNA, 20 nt, Haemophilus influenzae Rd
ccuugugcgacaaguuugau

SEQ ID NO: 2707765 - RNA, 20 nt, Haemophilus influenzae Rd
ccuugugcuuugugcggaau

SEQ ID NO: 2707766 - RNA, 15 nt, Haemophilus influenzae Rd
ccuugugucuaccga

SEQ ID NO: 2707767 - RNA, 16 nt, Haemophilus influenzae Rd
ccuuguuuugcaauaa

SEQ ID NO: 2707768 - RNA, 16 nt, Haemophilus influenzae Rd
ccuuuaaggugcagau

SEQ ID NO: 2707769 - RNA, 19 nt, Haemophilus influenzae Rd
ccuuuacauuuggcaaaau

SEQ ID NO: 2707770 - RNA, 17 nt, Haemophilus influenzae Rd
ccuuuacgggauuuuuu

SEQ ID NO: 2707771 - RNA, 15 nt, Haemophilus influenzae Rd
ccuuuacguuuaacu

SEQ ID NO: 2707772 - RNA, 17 nt, Haemophilus influenzae Rd
ccuuuaugacuauuuuu

SEQ ID NO: 2707773 - RNA, 19 nt, Haemophilus influenzae Rd
ccuuuaugacuauuuuuuu

SEQ ID NO: 2707774 - RNA, 22 nt, Haemophilus influenzae Rd
ccuuuauugauccuagauguaa

SEQ ID NO: 2707775 - RNA, 14 nt, Haemophilus influenzae Rd
ccuuucaauaauuu

SEQ ID NO: 2707776 - RNA, 16 nt, Haemophilus influenzae Rd
ccuuucacacugcccu

SEQ ID NO: 2707777 - RNA, 15 nt, Haemophilus influenzae Rd
ccuuuccauugggaa

SEQ ID NO: 2707778 - RNA, 12 nt, Haemophilus influenzae Rd
cgagucuuagac

SEQ ID NO: 2707779 - RNA, 20 nt, Haemophilus influenzae Rd
cgaguuaauuauuuuaaaua

SEQ ID NO: 2707780 - RNA, 16 nt, Haemophilus influenzae Rd
cgaguucuuuugguaa

SEQ ID NO: 2707781 - RNA, 16 nt, Haemophilus influenzae Rd
cgaguuggaucacaaa

SEQ ID NO: 2707782 - RNA, 17 nt, Haemophilus influenzae Rd
cgaguuuuaucuucaaa

SEQ ID NO: 2707783 - RNA, 16 nt, Haemophilus influenzae Rd
cgaguuuuucaaaaau

SEQ ID NO: 2707784 - RNA, 17 nt, Haemophilus influenzae Rd
cgauaaaauauauuaau

SEQ ID NO: 2707785 - RNA, 13 nt, Haemophilus influenzae Rd
cgauaaaaucaaa

SEQ ID NO: 2707786 - RNA, 11 nt, Haemophilus influenzae Rd
cgauaaaaucg

SEQ ID NO: 2707787 - RNA, 22 nt, Haemophilus influenzae Rd
cgauaaauauuacuuaacauca

SEQ ID NO: 2707788 - RNA, 23 nt, Haemophilus influenzae Rd
cgauaaaugcacauuuuuaccaa

SEQ ID NO: 2707789 - RNA, 16 nt, Haemophilus influenzae Rd
cgauaacaauuuuugc

SEQ ID NO: 2707790 - RNA, 20 nt, Haemophilus influenzae Rd
cgauaacacgaccauugaau

SEQ ID NO: 2707791 - RNA, 15 nt, Haemophilus influenzae Rd
cgauaauauuuuugc

SEQ ID NO: 2707792 - RNA, 17 nt, Haemophilus influenzae Rd
cgauaaugccauuugcu

SEQ ID NO: 2707793 - RNA, 23 nt, Haemophilus influenzae Rd
cgauaauuggauacauuccauca

SEQ ID NO: 2707794 - RNA, 16 nt, Haemophilus influenzae Rd
cgauacggcaaauuaa

SEQ ID NO: 2707795 - RNA, 19 nt, Haemophilus influenzae Rd
cgauacggcaaauuaaauc

SEQ ID NO: 2707796 - RNA, 18 nt, Haemophilus influenzae Rd
cgauacuuuuaauuaaau

SEQ ID NO: 2707797 - RNA, 19 nt, Haemophilus influenzae Rd
cgauagaggcgaaccacau

SEQ ID NO: 2707798 - RNA, 20 nt, Haemophilus influenzae Rd
cgauagcggcgaauguggcu

SEQ ID NO: 2707799 - RNA, 14 nt, Haemophilus influenzae Rd
cgauagcuuuuguu

SEQ ID NO: 2707800 - RNA, 12 nt, Haemophilus influenzae Rd
cgauaguaaaaa

SEQ ID NO: 2707801 - RNA, 17 nt, Haemophilus influenzae Rd
cgauagucaccaucaca

SEQ ID NO: 2707802 - RNA, 21 nt, Haemophilus influenzae Rd
cgauagucaccaucacaagca

SEQ ID NO: 2707803 - RNA, 18 nt, Haemophilus influenzae Rd
cgauaguggaauaaugaa

SEQ ID NO: 2707804 - RNA, 20 nt, Haemophilus influenzae Rd
cgauaguuaauggcaauuuc

SEQ ID NO: 2707805 - RNA, 12 nt, Haemophilus influenzae Rd
cgauauucuuuu

SEQ ID NO: 2707806 - RNA, 12 nt, Haemophilus influenzae Rd
cgauauuuauaa

SEQ ID NO: 2707807 - RNA, 12 nt, Haemophilus influenzae Rd
cgauauuuuuuc

SEQ ID NO: 2707808 - RNA, 17 nt, Haemophilus influenzae Rd
cgaucacggcgcaauau

SEQ ID NO: 2707809 - RNA, 13 nt, Haemophilus influenzae Rd
cgaucacugcacc

SEQ ID NO: 2707810 - RNA, 23 nt, Haemophilus influenzae Rd
cgaucacugcaccguugaaugcu

SEQ ID NO: 2707811 - RNA, 19 nt, Haemophilus influenzae Rd
cgaucagggccaguugaaa

SEQ ID NO: 2707812 - RNA, 20 nt, Haemophilus influenzae Rd
cgaucaugagcgaaccgccc

SEQ ID NO: 2707813 - RNA, 16 nt, Haemophilus influenzae Rd
cgauccaaaauucugu

SEQ ID NO: 2707814 - RNA, 23 nt, Haemophilus influenzae Rd
cgauccguaaucgugccugccac

SEQ ID NO: 2707815 - RNA, 14 nt, Haemophilus influenzae Rd
cgauccuaaaaaac

SEQ ID NO: 2707816 - RNA, 17 nt, Haemophilus influenzae Rd
cgauccucccuaaugau

SEQ ID NO: 2707817 - RNA, 14 nt, Haemophilus influenzae Rd
cgaucgcuccacca

SEQ ID NO: 2707818 - RNA, 15 nt, Haemophilus influenzae Rd
cgaucguuuuccguu

SEQ ID NO: 2707819 - RNA, 20 nt, Haemophilus influenzae Rd
cgaucuauauucguuaaaua

SEQ ID NO: 2707820 - RNA, 17 nt, Haemophilus influenzae Rd
cgaugaaagcuauuucg

SEQ ID NO: 2707821 - RNA, 19 nt, Haemophilus influenzae Rd
cgaugacuaaacaaauaaa

SEQ ID NO: 2707822 - RNA, 17 nt, Haemophilus influenzae Rd
cgaugaugcaggaaagg

SEQ ID NO: 2707823 - RNA, 14 nt, Haemophilus influenzae Rd
cgaugcauacuugu

SEQ ID NO: 2707824 - RNA, 16 nt, Haemophilus influenzae Rd
cgauggaaaugaguaa

SEQ ID NO: 2707825 - RNA, 20 nt, Haemophilus influenzae Rd
cgauggcugggauuucaaac

SEQ ID NO: 2707826 - RNA, 17 nt, Haemophilus influenzae Rd
cgaugggcaauggcaau

SEQ ID NO: 2707827 - RNA, 15 nt, Haemophilus influenzae Rd
cgaugucuaaaugug

SEQ ID NO: 2707828 - RNA, 21 nt, Haemophilus influenzae Rd
cgaugugaccacggauaaaug

SEQ ID NO: 2707829 - RNA, 14 nt, Haemophilus influenzae Rd
cgauuaguuuauca

SEQ ID NO: 2707830 - RNA, 22 nt, Haemophilus influenzae Rd
cgauuauuuggcaaaugauaac

SEQ ID NO: 2707831 - RNA, 14 nt, Haemophilus influenzae Rd
cgauugccuuuuuu

SEQ ID NO: 2707832 - RNA, 15 nt, Haemophilus influenzae Rd
cgauugcucguuauu

SEQ ID NO: 2707833 - RNA, 22 nt, Haemophilus influenzae Rd
cgauugugaccgauuuucuaag

SEQ ID NO: 2707834 - RNA, 19 nt, Haemophilus influenzae Rd
cgauuuaacacuuuuucua

SEQ ID NO: 2707835 - RNA, 16 nt, Haemophilus influenzae Rd
cgauuucaguaucaau

SEQ ID NO: 2707836 - RNA, 14 nt, Haemophilus influenzae Rd
cgauuucaucuuca

SEQ ID NO: 2707837 - RNA, 21 nt, Haemophilus influenzae Rd
cgauuucauuggcgguuuugc

SEQ ID NO: 2707838 - RNA, 17 nt, Haemophilus influenzae Rd
cgauuucuuuugguuua

SEQ ID NO: 2707839 - RNA, 16 nt, Haemophilus influenzae Rd
cgauuugcacuuucua

SEQ ID NO: 2707840 - RNA, 16 nt, Haemophilus influenzae Rd
cgauuuuaauugugca

SEQ ID NO: 2707841 - RNA, 19 nt, Haemophilus influenzae Rd
cgauuuuaauugugcaauu

SEQ ID NO: 2707842 - RNA, 20 nt, Haemophilus influenzae Rd
cgauuuugcaagguuuccaa

SEQ ID NO: 2707843 - RNA, 18 nt, Haemophilus influenzae Rd
cgauuuuuauauaaauaa

SEQ ID NO: 2707844 - RNA, 17 nt, Haemophilus influenzae Rd
cgauuuuucuaaaauca

SEQ ID NO: 2707845 - RNA, 20 nt, Haemophilus influenzae Rd
cgcaaaaccuaacauaaugc

SEQ ID NO: 2707846 - RNA, 20 nt, Haemophilus influenzae Rd
cgcaaaauaucacuuuuuua

SEQ ID NO: 2707847 - RNA, 17 nt, Haemophilus influenzae Rd
cgcaaaaucuugcugaa

SEQ ID NO: 2707848 - RNA, 14 nt, Haemophilus influenzae Rd
cgcaaacaucauca

SEQ ID NO: 2707849 - RNA, 15 nt, Haemophilus influenzae Rd
cgcaaauacuucacc

SEQ ID NO: 2707850 - RNA, 18 nt, Haemophilus influenzae Rd
cgcaaauuuucguuuacc

SEQ ID NO: 2707851 - RNA, 18 nt, Haemophilus influenzae Rd
cgcaacuaaauuagcucu

SEQ ID NO: 2707852 - RNA, 18 nt, Haemophilus influenzae Rd
cgcaacuaauaaaccaau

SEQ ID NO: 2707853 - RNA, 15 nt, Haemophilus influenzae Rd
cgcaauaacaccgau

SEQ ID NO: 2707854 - RNA, 16 nt, Haemophilus influenzae Rd
cgcaauauagucaaau

SEQ ID NO: 2707855 - RNA, 17 nt, Haemophilus influenzae Rd
cgcaauauagucaaaua

SEQ ID NO: 2707856 - RNA, 13 nt, Haemophilus influenzae Rd
cgcaaucaagcaa

SEQ ID NO: 2707857 - RNA, 22 nt, Haemophilus influenzae Rd
cgcaaucacaaaauggcaaaca

SEQ ID NO: 2707858 - RNA, 13 nt, Haemophilus influenzae Rd
cgcaaugaaauuu

SEQ ID NO: 2707859 - RNA, 19 nt, Haemophilus influenzae Rd
cgcaaugcaaaaguaaaua

SEQ ID NO: 2707860 - RNA, 16 nt, Haemophilus influenzae Rd
cgcaauuaaugcagcc

SEQ ID NO: 2707861 - RNA, 12 nt, Haemophilus influenzae Rd
cgcaauuuagau

SEQ ID NO: 2707862 - RNA, 12 nt, Haemophilus influenzae Rd
cgcacaccaccu

SEQ ID NO: 2707863 - RNA, 21 nt, Haemophilus influenzae Rd
cgcacauucuauagaauuauu

SEQ ID NO: 2707864 - RNA, 16 nt, Haemophilus influenzae Rd
cgcaccuucagccacu

SEQ ID NO: 2707865 - RNA, 19 nt, Haemophilus influenzae Rd
cgcaccuuuacguuuaacu

SEQ ID NO: 2707866 - RNA, 15 nt, Haemophilus influenzae Rd
cgcacuuuagaaaau

SEQ ID NO: 2707867 - RNA, 12 nt, Haemophilus influenzae Rd
cgcacuuuauua

SEQ ID NO: 2707868 - RNA, 23 nt, Haemophilus influenzae Rd
cgcacuuucauuccauucuaaaa

SEQ ID NO: 2707869 - RNA, 17 nt, Haemophilus influenzae Rd
cgcacuuugauuuugcu

SEQ ID NO: 2707870 - RNA, 10 nt, Haemophilus influenzae Rd
cgcacuuugg

SEQ ID NO: 2707871 - RNA, 23 nt, Haemophilus influenzae Rd
cgcacuuuggaauauucuuuuua

SEQ ID NO: 2707872 - RNA, 18 nt, Haemophilus influenzae Rd
cgcacuuuucaacaaaaa

SEQ ID NO: 2707873 - RNA, 13 nt, Haemophilus influenzae Rd
cgcacuuuuuaau

SEQ ID NO: 2707874 - RNA, 14 nt, Haemophilus influenzae Rd
cgcacuuuuuacuu

SEQ ID NO: 2707875 - RNA, 12 nt, Haemophilus influenzae Rd
cgcacuuuuuau

SEQ ID NO: 2707876 - RNA, 19 nt, Haemophilus influenzae Rd
cgcacuuuuuauuuuuccu

SEQ ID NO: 2707877 - RNA, 23 nt, Haemophilus influenzae Rd
cgcacuuuuuuaugacuaauuaa

SEQ ID NO: 2707878 - RNA, 20 nt, Haemophilus influenzae Rd
cgcacuuuuuuguauaaaaa

SEQ ID NO: 2707879 - RNA, 22 nt, Haemophilus influenzae Rd
cgcacuuuuuuguuuucaggau

SEQ ID NO: 2707880 - RNA, 16 nt, Haemophilus influenzae Rd
cgcacuuuuuuuauau

SEQ ID NO: 2707881 - RNA, 20 nt, Haemophilus influenzae Rd
cgcacuuuuuuucuuauuuc

SEQ ID NO: 2707882 - RNA, 21 nt, Haemophilus influenzae Rd
cgcagaccaaagcuguaaaau

SEQ ID NO: 2707883 - RNA, 16 nt, Haemophilus influenzae Rd
cgcagcaucugccacu

SEQ ID NO: 2707884 - RNA, 21 nt, Haemophilus influenzae Rd
cggaaugaaagaagguuauac

SEQ ID NO: 2707885 - RNA, 14 nt, Haemophilus influenzae Rd
cggaauguaaaauu

SEQ ID NO: 2707886 - RNA, 16 nt, Haemophilus influenzae Rd
cggagcauuuugguaa

SEQ ID NO: 2707887 - RNA, 23 nt, Haemophilus influenzae Rd
cggauaaccaaaauauuucauuu

SEQ ID NO: 2707888 - RNA, 19 nt, Haemophilus influenzae Rd
cggauauuaguaauauauu

SEQ ID NO: 2707889 - RNA, 16 nt, Haemophilus influenzae Rd
cggauuaaaaguccgc

SEQ ID NO: 2707890 - RNA, 15 nt, Haemophilus influenzae Rd
cggauuauagaauuu

SEQ ID NO: 2707891 - RNA, 21 nt, Haemophilus influenzae Rd
cggauuauagaauuuaguccu

SEQ ID NO: 2707892 - RNA, 12 nt, Haemophilus influenzae Rd
cggauuuauuau

SEQ ID NO: 2707893 - RNA, 15 nt, Haemophilus influenzae Rd
cggauuucuuuauuc

SEQ ID NO: 2707894 - RNA, 15 nt, Haemophilus influenzae Rd
cggauuuuucaauug

SEQ ID NO: 2707895 - RNA, 22 nt, Haemophilus influenzae Rd
cggcaaagguuuuauuuugaac

SEQ ID NO: 2707896 - RNA, 23 nt, Haemophilus influenzae Rd
cggcaaagguuuuauuuugaaca

SEQ ID NO: 2707897 - RNA, 13 nt, Haemophilus influenzae Rd
cggcaagcaaaca

SEQ ID NO: 2707898 - RNA, 18 nt, Haemophilus influenzae Rd
cggcaucaaaccaaccac

SEQ ID NO: 2707899 - RNA, 20 nt, Haemophilus influenzae Rd
cggcaucaaaccaaccacag

SEQ ID NO: 2707900 - RNA, 21 nt, Haemophilus influenzae Rd
cggcaucaaaccaaccacagc

SEQ ID NO: 2707901 - RNA, 15 nt, Haemophilus influenzae Rd
cggcaugccaugauc

SEQ ID NO: 2707902 - RNA, 18 nt, Haemophilus influenzae Rd
cggcgaagagauucuaau

SEQ ID NO: 2707903 - RNA, 14 nt, Haemophilus influenzae Rd
cggcgaauguggcu

SEQ ID NO: 2707904 - RNA, 13 nt, Haemophilus influenzae Rd
cggcgcguaaauc

SEQ ID NO: 2707905 - RNA, 13 nt, Haemophilus influenzae Rd
cggcuaaaacaga

SEQ ID NO: 2707906 - RNA, 16 nt, Haemophilus influenzae Rd
cggcuaaauugugccg

SEQ ID NO: 2707907 - RNA, 14 nt, Haemophilus influenzae Rd
cggcuauuucagcu

SEQ ID NO: 2707908 - RNA, 13 nt, Haemophilus influenzae Rd
cggcugcuugcac

SEQ ID NO: 2707909 - RNA, 15 nt, Haemophilus influenzae Rd
cggcuucauuuugag

SEQ ID NO: 2707910 - RNA, 18 nt, Haemophilus influenzae Rd
cggcuuggaguagugcau

SEQ ID NO: 2707911 - RNA, 19 nt, Haemophilus influenzae Rd
cggcuuuuucaauacuuuu

SEQ ID NO: 2707912 - RNA, 20 nt, Haemophilus influenzae Rd
cgggauaacuuucaguuaaa

SEQ ID NO: 2707913 - RNA, 12 nt, Haemophilus influenzae Rd
cgggcaaaaacu

SEQ ID NO: 2707914 - RNA, 18 nt, Haemophilus influenzae Rd
cgggcgaaaccuuuuucu

SEQ ID NO: 2707915 - RNA, 14 nt, Haemophilus influenzae Rd
cgggcgauaaaauc

SEQ ID NO: 2707916 - RNA, 15 nt, Haemophilus influenzae Rd
cggggaucggaacag

SEQ ID NO: 2707917 - RNA, 18 nt, Haemophilus influenzae Rd
cgggugcgccauuuuuaa

SEQ ID NO: 2707918 - RNA, 18 nt, Haemophilus influenzae Rd
cggguuuauguaaauaag

SEQ ID NO: 2707919 - RNA, 22 nt, Haemophilus influenzae Rd
cgguaaaaaaaugaaauauuuu

SEQ ID NO: 2707920 - RNA, 14 nt, Haemophilus influenzae Rd
cgguaaaaaaguaa

SEQ ID NO: 2707921 - RNA, 17 nt, Haemophilus influenzae Rd
cgguaaaaaucauuaaa

SEQ ID NO: 2707922 - RNA, 20 nt, Haemophilus influenzae Rd
cgguaaaucugauucagaaa

SEQ ID NO: 2707923 - RNA, 14 nt, Haemophilus influenzae Rd
cgguaaauuuuuag

SEQ ID NO: 2707924 - RNA, 15 nt, Haemophilus influenzae Rd
cgguacuucacagua

SEQ ID NO: 2707925 - RNA, 16 nt, Haemophilus influenzae Rd
cgguauaaaccuugca

SEQ ID NO: 2707926 - RNA, 17 nt, Haemophilus influenzae Rd
cgguauuuuuuuauuua

SEQ ID NO: 2707927 - RNA, 16 nt, Haemophilus influenzae Rd
cggucagcauaaagag

SEQ ID NO: 2707928 - RNA, 15 nt, Haemophilus influenzae Rd
cggucuauuuugacc

SEQ ID NO: 2707929 - RNA, 19 nt, Haemophilus influenzae Rd
cggucuuuuuuuauauuuu

SEQ ID NO: 2707930 - RNA, 20 nt, Haemophilus influenzae Rd
cggucuuuuuuuauauuuuu

SEQ ID NO: 2707931 - RNA, 15 nt, Haemophilus influenzae Rd
cggugaaauuucacc

SEQ ID NO: 2707932 - RNA, 14 nt, Haemophilus influenzae Rd
cggugaauuuauca

SEQ ID NO: 2707933 - RNA, 15 nt, Haemophilus influenzae Rd
cggugaauuuuaacc

SEQ ID NO: 2707934 - RNA, 13 nt, Haemophilus influenzae Rd
cggugacuuuuug

SEQ ID NO: 2707935 - RNA, 16 nt, Haemophilus influenzae Rd
cggugcaauuugaaaa

SEQ ID NO: 2707936 - RNA, 18 nt, Haemophilus influenzae Rd
cggugcaauuugaaaaga

SEQ ID NO: 2707937 - RNA, 18 nt, Haemophilus influenzae Rd
cggugcuuacuuuauuuu

SEQ ID NO: 2707938 - RNA, 18 nt, Haemophilus influenzae Rd
cgguggauuaauuggcga

SEQ ID NO: 2707939 - RNA, 18 nt, Haemophilus influenzae Rd
cgguggauuuguugugaa

SEQ ID NO: 2707940 - RNA, 9 nt, Haemophilus influenzae Rd
cggugggcu

SEQ ID NO: 2707941 - RNA, 15 nt, Haemophilus influenzae Rd
cgguuaaaaaucaua

SEQ ID NO: 2707942 - RNA, 16 nt, Haemophilus influenzae Rd
cgguuaaaauugcccc

SEQ ID NO: 2707943 - RNA, 19 nt, Haemophilus influenzae Rd
cgguuaauuuuuuguucau

SEQ ID NO: 2707944 - RNA, 17 nt, Haemophilus influenzae Rd
cgguuacagcuuaauga

SEQ ID NO: 2707945 - RNA, 20 nt, Haemophilus influenzae Rd
cgguuauuacuucaccaauc

SEQ ID NO: 2707946 - RNA, 15 nt, Haemophilus influenzae Rd
cgguuauuuuuuucu

SEQ ID NO: 2707947 - RNA, 18 nt, Haemophilus influenzae Rd
cgguucuucuuuuaauaa

SEQ ID NO: 2707948 - RNA, 15 nt, Haemophilus influenzae Rd
cgguugaauuuuuuu

SEQ ID NO: 2707949 - RNA, 17 nt, Haemophilus influenzae Rd
cgguuggauuuuaacca

SEQ ID NO: 2707950 - RNA, 13 nt, Haemophilus influenzae Rd
cgguuuauuuuca

SEQ ID NO: 2707951 - RNA, 15 nt, Haemophilus influenzae Rd
cgguuuuuuuauuau

SEQ ID NO: 2707952 - RNA, 12 nt, Haemophilus influenzae Rd
cguaaaaauucg

SEQ ID NO: 2707953 - RNA, 17 nt, Haemophilus influenzae Rd
cguaaaaguaaauaagc

SEQ ID NO: 2707954 - RNA, 18 nt, Haemophilus influenzae Rd
cguaaaaguaaauaagcc

SEQ ID NO: 2707955 - RNA, 12 nt, Haemophilus influenzae Rd
cguaaaaguuuu

SEQ ID NO: 2707956 - RNA, 23 nt, Haemophilus influenzae Rd
cguaaaaucgccugacauuuuug

SEQ ID NO: 2707957 - RNA, 22 nt, Haemophilus influenzae Rd
cguaaaccguggcauaauuugg

SEQ ID NO: 2707958 - RNA, 13 nt, Haemophilus influenzae Rd
cguaaagccauac

SEQ ID NO: 2707959 - RNA, 17 nt, Haemophilus influenzae Rd
cguaaagggaagugaua

SEQ ID NO: 2707960 - RNA, 15 nt, Haemophilus influenzae Rd
cguaaaguaaaugcu

SEQ ID NO: 2707961 - RNA, 23 nt, Haemophilus influenzae Rd
cguaaaguuuguagcgauauucu

SEQ ID NO: 2707962 - RNA, 19 nt, Haemophilus influenzae Rd
cguaaaucagaacuggcuu

SEQ ID NO: 2707963 - RNA, 17 nt, Haemophilus influenzae Rd
cguaaauccugcuucuu

SEQ ID NO: 2707964 - RNA, 15 nt, Haemophilus influenzae Rd
cguaaauuauuuauu

SEQ ID NO: 2707965 - RNA, 17 nt, Haemophilus influenzae Rd
cguaaauuauuuauuua

SEQ ID NO: 2707966 - RNA, 21 nt, Haemophilus influenzae Rd
cguaaauucuguuuagucuuc

SEQ ID NO: 2707967 - RNA, 18 nt, Haemophilus influenzae Rd
cguaacaaaugcaaauaa

SEQ ID NO: 2707968 - RNA, 14 nt, Haemophilus influenzae Rd
cguaacccaaagca

SEQ ID NO: 2707969 - RNA, 15 nt, Haemophilus influenzae Rd
cguaaccgcccagca

SEQ ID NO: 2707970 - RNA, 13 nt, Haemophilus influenzae Rd
cguaacgcccaaa

SEQ ID NO: 2707971 - RNA, 18 nt, Haemophilus influenzae Rd
cguaacuaaaaaaguuua

SEQ ID NO: 2707972 - RNA, 18 nt, Haemophilus influenzae Rd
cguaaggaucuuuuucuu

SEQ ID NO: 2707973 - RNA, 14 nt, Haemophilus influenzae Rd
cguaaguaguaaag

SEQ ID NO: 2707974 - RNA, 13 nt, Haemophilus influenzae Rd
cguaauaaauaag

SEQ ID NO: 2707975 - RNA, 21 nt, Haemophilus influenzae Rd
cguaauaacaagcgaaaaacg

SEQ ID NO: 2707976 - RNA, 21 nt, Haemophilus influenzae Rd
cguaauaaguauuuugcagaa

SEQ ID NO: 2707977 - RNA, 19 nt, Haemophilus influenzae Rd
cguaauaauuguaguuaga

SEQ ID NO: 2707978 - RNA, 15 nt, Haemophilus influenzae Rd
cguaauacuuuugcu

SEQ ID NO: 2707979 - RNA, 15 nt, Haemophilus influenzae Rd
cguaauagauaaagu

SEQ ID NO: 2707980 - RNA, 14 nt, Haemophilus influenzae Rd
cguaauauucuuua

SEQ ID NO: 2707981 - RNA, 22 nt, Haemophilus influenzae Rd
cguaauauuugacgaaauaaau

SEQ ID NO: 2707982 - RNA, 17 nt, Haemophilus influenzae Rd
cguaaucccauuucauc

SEQ ID NO: 2707983 - RNA, 23 nt, Haemophilus influenzae Rd
cguaaucccauuucaucuucagu

SEQ ID NO: 2707984 - RNA, 19 nt, Haemophilus influenzae Rd
cguaaucuggcaaaucuuu

SEQ ID NO: 2707985 - RNA, 13 nt, Haemophilus influenzae Rd
cguaauuaaaaau

SEQ ID NO: 2707986 - RNA, 15 nt, Haemophilus influenzae Rd
cguaauuaaaaauaa

SEQ ID NO: 2707987 - RNA, 16 nt, Haemophilus influenzae Rd
cguaauuaaaaauaac

SEQ ID NO: 2707988 - RNA, 20 nt, Haemophilus influenzae Rd
cguaauuucaucuuuuaaau

SEQ ID NO: 2707989 - RNA, 15 nt, Haemophilus influenzae Rd
cguacaaacccacaa

SEQ ID NO: 2707990 - RNA, 21 nt, Haemophilus influenzae Rd
cguuggucgaagguucgaauc

SEQ ID NO: 2707991 - RNA, 14 nt, Haemophilus influenzae Rd
cguuguaagcaaaa

SEQ ID NO: 2707992 - RNA, 14 nt, Haemophilus influenzae Rd
cguuguucaauaau

SEQ ID NO: 2707993 - RNA, 17 nt, Haemophilus influenzae Rd
cguuguucuucuguuaa

SEQ ID NO: 2707994 - RNA, 17 nt, Haemophilus influenzae Rd
cguuguuguucuuucca

SEQ ID NO: 2707995 - RNA, 19 nt, Haemophilus influenzae Rd
cguuuaaccacguauuuuu

SEQ ID NO: 2707996 - RNA, 22 nt, Haemophilus influenzae Rd
cguuuaaccacguauuuuuuaa

SEQ ID NO: 2707997 - RNA, 20 nt, Haemophilus influenzae Rd
cguuuaacugcuuuuuucca

SEQ ID NO: 2707998 - RNA, 13 nt, Haemophilus influenzae Rd
cguuuaacuucaa

SEQ ID NO: 2707999 - RNA, 16 nt, Haemophilus influenzae Rd
cguuuacuuaaaaucu

SEQ ID NO: 2708000 - RNA, 17 nt, Haemophilus influenzae Rd
cguuuacuuaaaaucuu

SEQ ID NO: 2708001 - RNA, 15 nt, Haemophilus influenzae Rd
cguuuauuuaacaau

SEQ ID NO: 2708002 - RNA, 22 nt, Haemophilus influenzae Rd
cguuucaaaaauagccuucauc

SEQ ID NO: 2708003 - RNA, 15 nt, Haemophilus influenzae Rd
cguuucaucacuuca

SEQ ID NO: 2708004 - RNA, 18 nt, Haemophilus influenzae Rd
cguuucaucgagaaauac

SEQ ID NO: 2708005 - RNA, 20 nt, Haemophilus influenzae Rd
cguuucuacucguagaguuu

SEQ ID NO: 2708006 - RNA, 18 nt, Haemophilus influenzae Rd
cguuugaggacuuaaauu

SEQ ID NO: 2708007 - RNA, 14 nt, Haemophilus influenzae Rd
cguuugauauacca

SEQ ID NO: 2708008 - RNA, 15 nt, Haemophilus influenzae Rd
cguuugauuguaaaa

SEQ ID NO: 2708009 - RNA, 22 nt, Haemophilus influenzae Rd
cguuuuaaaaucucucaaaaau

SEQ ID NO: 2708010 - RNA, 20 nt, Haemophilus influenzae Rd
cguuuucgaguaauuucaua

SEQ ID NO: 2708011 - RNA, 15 nt, Haemophilus influenzae Rd
cguuuucugcuucag

SEQ ID NO: 2708012 - RNA, 14 nt, Haemophilus influenzae Rd
cguuuuucuuaaau

SEQ ID NO: 2708013 - RNA, 20 nt, Haemophilus influenzae Rd
cguuuuuuauaaacuucugc

SEQ ID NO: 2708014 - RNA, 15 nt, Haemophilus influenzae Rd
cguuuuuuuaucaua

SEQ ID NO: 2708015 - RNA, 22 nt, Haemophilus influenzae Rd
cguuuuuuuaucauagagccaa

SEQ ID NO: 2708016 - RNA, 23 nt, Haemophilus influenzae Rd
cuaaaaaaauaaccgcacuuuau

SEQ ID NO: 2708017 - RNA, 20 nt, Haemophilus influenzae Rd
cuaaaaaaauccuaaauaaa

SEQ ID NO: 2708018 - RNA, 22 nt, Haemophilus influenzae Rd
cuaaaaaacuaacgugcuguuu

SEQ ID NO: 2708019 - RNA, 22 nt, Haemophilus influenzae Rd
cuaaaaaagaguaaauauuguc

SEQ ID NO: 2708020 - RNA, 18 nt, Haemophilus influenzae Rd
cuaaaaaaguuuaagccc

SEQ ID NO: 2708021 - RNA, 12 nt, Haemophilus influenzae Rd
cuaaaaaauaac

SEQ ID NO: 2708022 - RNA, 13 nt, Haemophilus influenzae Rd
cuaaaaagaaaua

SEQ ID NO: 2708023 - RNA, 21 nt, Haemophilus influenzae Rd
cuaaaaagaaguauuauuugc

SEQ ID NO: 2708024 - RNA, 22 nt, Haemophilus influenzae Rd
cuaaaaagcccaaaugcaacaa

SEQ ID NO: 2708025 - RNA, 17 nt, Haemophilus influenzae Rd
cuaaaaauaauuuuacu

SEQ ID NO: 2708026 - RNA, 21 nt, Haemophilus influenzae Rd
cuaaaaauaauuuuacuugug

SEQ ID NO: 2708027 - RNA, 12 nt, Haemophilus influenzae Rd
cuaaaaaugccc

SEQ ID NO: 2708028 - RNA, 12 nt, Haemophilus influenzae Rd
cuaaaaauuuaa

SEQ ID NO: 2708029 - RNA, 15 nt, Haemophilus influenzae Rd
cuaaaaauuuaaaua

SEQ ID NO: 2708030 - RNA, 18 nt, Haemophilus influenzae Rd
cuaaaacacguuugccag

SEQ ID NO: 2708031 - RNA, 13 nt, Haemophilus influenzae Rd
cuaaaacgaacaa

SEQ ID NO: 2708032 - RNA, 19 nt, Haemophilus influenzae Rd
cuaaaacuuaguuuuaauu

SEQ ID NO: 2708033 - RNA, 24 nt, Haemophilus influenzae Rd
cuaaaacuuaguuuuaauucugca

SEQ ID NO: 2708034 - RNA, 15 nt, Haemophilus influenzae Rd
cuaaaagugcggcuu

SEQ ID NO: 2708035 - RNA, 13 nt, Haemophilus influenzae Rd
cuaaaaguuugau

SEQ ID NO: 2708036 - RNA, 15 nt, Haemophilus influenzae Rd
cuaaaauaaauuuug

SEQ ID NO: 2708037 - RNA, 17 nt, Haemophilus influenzae Rd
cuaaaauaaauuuuggu

SEQ ID NO: 2708038 - RNA, 20 nt, Haemophilus influenzae Rd
cuaaaauaaccuuaaaucaa

SEQ ID NO: 2708039 - RNA, 18 nt, Haemophilus influenzae Rd
cuaaaauaauuuuuugaa

SEQ ID NO: 2708040 - RNA, 15 nt, Haemophilus influenzae Rd
cuaaaauacaaauac

SEQ ID NO: 2708041 - RNA, 22 nt, Haemophilus influenzae Rd
cuaaaauauaacauuuauuuuu

SEQ ID NO: 2708042 - RNA, 20 nt, Haemophilus influenzae Rd
cuaaaaucacacuaaucuaa

SEQ ID NO: 2708043 - RNA, 17 nt, Haemophilus influenzae Rd
cuaaaaucgcacuuugu

SEQ ID NO: 2708044 - RNA, 22 nt, Haemophilus influenzae Rd
cuaaaauucgacgauaaccauc

SEQ ID NO: 2708045 - RNA, 17 nt, Haemophilus influenzae Rd
cuaaaauucuaagguuc

SEQ ID NO: 2708046 - RNA, 16 nt, Haemophilus influenzae Rd
cuaaaauugauuucau

SEQ ID NO: 2708047 - RNA, 23 nt, Haemophilus influenzae Rd
cuaaaauugcagggauauugccu

SEQ ID NO: 2708048 - RNA, 12 nt, Haemophilus influenzae Rd
cuaaacaaauaa

SEQ ID NO: 2708049 - RNA, 18 nt, Haemophilus influenzae Rd
cuaaacacauaauauuuu

SEQ ID NO: 2708050 - RNA, 19 nt, Haemophilus influenzae Rd
cuaaacagaauuuacgaaa

SEQ ID NO: 2708051 - RNA, 16 nt, Haemophilus influenzae Rd
cuaaacauccgaauaa

SEQ ID NO: 2708052 - RNA, 18 nt, Haemophilus influenzae Rd
cuaaaccaccaauaagcc

SEQ ID NO: 2708053 - RNA, 22 nt, Haemophilus influenzae Rd
cuaaaccauuuaauaaaacaaa

SEQ ID NO: 2708054 - RNA, 20 nt, Haemophilus influenzae Rd
cuaaaccgauagcuuuuguu

SEQ ID NO: 2708055 - RNA, 16 nt, Haemophilus influenzae Rd
cuaaaccugcaaguuc

SEQ ID NO: 2708056 - RNA, 13 nt, Haemophilus influenzae Rd
cuaaaccugcuuc

SEQ ID NO: 2708057 - RNA, 17 nt, Haemophilus influenzae Rd
cuaaaccugcuucuuuu

SEQ ID NO: 2708058 - RNA, 14 nt, Haemophilus influenzae Rd
cuaaaccuucccca

SEQ ID NO: 2708059 - RNA, 15 nt, Haemophilus influenzae Rd
cuaaacgaagaaaaa

SEQ ID NO: 2708060 - RNA, 21 nt, Haemophilus influenzae Rd
cuaaacgaaugaaguuagaaa

SEQ ID NO: 2708061 - RNA, 23 nt, Haemophilus influenzae Rd
cuaaacgaucuaauacaguuucu

SEQ ID NO: 2708062 - RNA, 20 nt, Haemophilus influenzae Rd
cuaaacgaugugcauugaau

SEQ ID NO: 2708063 - RNA, 14 nt, Haemophilus influenzae Rd
cuaaacgcacuuuu

SEQ ID NO: 2708064 - RNA, 16 nt, Haemophilus influenzae Rd
cuaaacgcucaaauaa

SEQ ID NO: 2708065 - RNA, 17 nt, Haemophilus influenzae Rd
cuaaacgcucuuuaaua

SEQ ID NO: 2708066 - RNA, 19 nt, Haemophilus influenzae Rd
cuaaacguaacuaaaaaag

SEQ ID NO: 2708067 - RNA, 21 nt, Haemophilus influenzae Rd
cuaaacguuuuugaauagcuc

SEQ ID NO: 2708068 - RNA, 15 nt, Haemophilus influenzae Rd
cuaaacuacaacagc

SEQ ID NO: 2708069 - RNA, 21 nt, Haemophilus influenzae Rd
cuaaacucggaauuuuuuuca

SEQ ID NO: 2708070 - RNA, 14 nt, Haemophilus influenzae Rd
cuaaacuucaauuu

SEQ ID NO: 2708071 - RNA, 17 nt, Haemophilus influenzae Rd
cuaaacuuguuaaauaa

SEQ ID NO: 2708072 - RNA, 18 nt, Haemophilus influenzae Rd
cuaaacuuguuaaauaaa

SEQ ID NO: 2708073 - RNA, 16 nt, Haemophilus influenzae Rd
cuaaacuuuucgcaaa

SEQ ID NO: 2708074 - RNA, 21 nt, Haemophilus influenzae Rd
cuaaacuuuucgcaaaauauc

SEQ ID NO: 2708075 - RNA, 13 nt, Haemophilus influenzae Rd
cuaaagaaagcaa

SEQ ID NO: 2708076 - RNA, 13 nt, Haemophilus influenzae Rd
cuaaagauggacg

SEQ ID NO: 2708077 - RNA, 21 nt, Haemophilus influenzae Rd
cuaaagauuuauguugaauuu

SEQ ID NO: 2708078 - RNA, 18 nt, Haemophilus influenzae Rd
cuaaagcaauauuuagau

SEQ ID NO: 2708079 - RNA, 13 nt, Haemophilus influenzae Rd
cuaaagcggaugg

SEQ ID NO: 2708080 - RNA, 21 nt, Haemophilus influenzae Rd
cuaaaggaauggcaaagaaua

SEQ ID NO: 2708081 - RNA, 19 nt, Haemophilus influenzae Rd
cuaaaggaguaaguuuuac

SEQ ID NO: 2708082 - RNA, 13 nt, Haemophilus influenzae Rd
cuaaaggcaaggu

SEQ ID NO: 2708083 - RNA, 22 nt, Haemophilus influenzae Rd
cuaaaggcacaaaaaauucuuu

SEQ ID NO: 2708084 - RNA, 17 nt, Haemophilus influenzae Rd
cuaaaggcuaaauaacc

SEQ ID NO: 2708085 - RNA, 21 nt, Haemophilus influenzae Rd
cuaaagugcgguaauuuuuag

SEQ ID NO: 2708086 - RNA, 20 nt, Haemophilus influenzae Rd
cuaaagugcgguuaauuuuu

SEQ ID NO: 2708087 - RNA, 22 nt, Haemophilus influenzae Rd
cuaaagugcgguuaauuuuuag

SEQ ID NO: 2708088 - RNA, 19 nt, Haemophilus influenzae Rd
cuaaaguuggcacuucaau

SEQ ID NO: 2708089 - RNA, 17 nt, Haemophilus influenzae Rd
cuaaauaaaaacgcccu

SEQ ID NO: 2708090 - RNA, 17 nt, Haemophilus influenzae Rd
cuaaauaaagauuauuu

SEQ ID NO: 2708091 - RNA, 21 nt, Haemophilus influenzae Rd
cuaaauaaccuaaaauauuua

SEQ ID NO: 2708092 - RNA, 19 nt, Haemophilus influenzae Rd
cuaaauaagcuaauuuuuc

SEQ ID NO: 2708093 - RNA, 21 nt, Haemophilus influenzae Rd
cuaaauaagcuaauuuuucag

SEQ ID NO: 2708094 - RNA, 19 nt, Haemophilus influenzae Rd
cuaaauaaggcguaaaacu

SEQ ID NO: 2708095 - RNA, 12 nt, Haemophilus influenzae Rd
cuaauaaaccaa

SEQ ID NO: 2708096 - RNA, 16 nt, Haemophilus influenzae Rd
cuaauaaaccaauaag

SEQ ID NO: 2708097 - RNA, 18 nt, Haemophilus influenzae Rd
cuaauaaauagaaauuac

SEQ ID NO: 2708098 - RNA, 13 nt, Haemophilus influenzae Rd
cuaauaagaagcu

SEQ ID NO: 2708099 - RNA, 22 nt, Haemophilus influenzae Rd
cuaauaagcuuggcuuauuuac

SEQ ID NO: 2708100 - RNA, 20 nt, Haemophilus influenzae Rd
cuaauaagugagaaaguuaa

SEQ ID NO: 2708101 - RNA, 17 nt, Haemophilus influenzae Rd
cuaauaauaagauuuuu

SEQ ID NO: 2708102 - RNA, 21 nt, Haemophilus influenzae Rd
cuaauaauccucuuuaaaauu

SEQ ID NO: 2708103 - RNA, 16 nt, Haemophilus influenzae Rd
cuaauaaucgcaaugc

SEQ ID NO: 2708104 - RNA, 13 nt, Haemophilus influenzae Rd
cuaauaaucuauu

SEQ ID NO: 2708105 - RNA, 15 nt, Haemophilus influenzae Rd
cuaauaaucuauuuc

SEQ ID NO: 2708106 - RNA, 13 nt, Haemophilus influenzae Rd
cuaauaauuuuag

SEQ ID NO: 2708107 - RNA, 14 nt, Haemophilus influenzae Rd
cuaauaauuuuagc

SEQ ID NO: 2708108 - RNA, 13 nt, Haemophilus influenzae Rd
cuaauacacgagg

SEQ ID NO: 2708109 - RNA, 23 nt, Haemophilus influenzae Rd
cuaauaccgcagcagguuuuccu

SEQ ID NO: 2708110 - RNA, 15 nt, Haemophilus influenzae Rd
cuaauacgcggucag

SEQ ID NO: 2708111 - RNA, 13 nt, Haemophilus influenzae Rd
cuaauacgucaau

SEQ ID NO: 2708112 - RNA, 13 nt, Haemophilus influenzae Rd
cuaauacuucaua

SEQ ID NO: 2708113 - RNA, 20 nt, Haemophilus influenzae Rd
cuaauagacaggcauauuuc

SEQ ID NO: 2708114 - RNA, 13 nt, Haemophilus influenzae Rd
cuaauaggcuuaa

SEQ ID NO: 2708115 - RNA, 14 nt, Haemophilus influenzae Rd
cuaauaugauuaau

SEQ ID NO: 2708116 - RNA, 18 nt, Haemophilus influenzae Rd
cuaauauugcgccuuguu

SEQ ID NO: 2708117 - RNA, 16 nt, Haemophilus influenzae Rd
cuaaucaauccagaac

SEQ ID NO: 2708118 - RNA, 21 nt, Haemophilus influenzae Rd
cuaaucauuaacaaauucucg

SEQ ID NO: 2708119 - RNA, 23 nt, Haemophilus influenzae Rd
cuaaucauuaacaaauucucggc

SEQ ID NO: 2708120 - RNA, 14 nt, Haemophilus influenzae Rd
cuaauccaaaucaa

SEQ ID NO: 2708121 - RNA, 23 nt, Haemophilus influenzae Rd
cuaauccagauugguauuccgcu

SEQ ID NO: 2708122 - RNA, 15 nt, Haemophilus influenzae Rd
cuaaucgguacuuca

SEQ ID NO: 2708123 - RNA, 19 nt, Haemophilus influenzae Rd
cuaaucgguacuucacagu

SEQ ID NO: 2708124 - RNA, 19 nt, Haemophilus influenzae Rd
cuaaucguugccccaucau

SEQ ID NO: 2708125 - RNA, 14 nt, Haemophilus influenzae Rd
cuaaucuuaaaaaa

SEQ ID NO: 2708126 - RNA, 16 nt, Haemophilus influenzae Rd
cuaaucuuaaaaaauc

SEQ ID NO: 2708127 - RNA, 17 nt, Haemophilus influenzae Rd
cuaaucuuaaaaaauca

SEQ ID NO: 2708128 - RNA, 13 nt, Haemophilus influenzae Rd
cuaaugaaauuuc

SEQ ID NO: 2708129 - RNA, 13 nt, Haemophilus influenzae Rd
cuaaugcaaaauu

SEQ ID NO: 2708130 - RNA, 14 nt, Haemophilus influenzae Rd
cuaaugcaauuuca

SEQ ID NO: 2708131 - RNA, 23 nt, Haemophilus influenzae Rd
cuaaugcauugaugacugcauca

SEQ ID NO: 2708132 - RNA, 18 nt, Haemophilus influenzae Rd
cuaaugccauugcuagcc

SEQ ID NO: 2708133 - RNA, 16 nt, Haemophilus influenzae Rd
cuaaugcccacgucca

SEQ ID NO: 2708134 - RNA, 23 nt, Haemophilus influenzae Rd
cuaaugcccacguccacuucauc

SEQ ID NO: 2708135 - RNA, 21 nt, Haemophilus influenzae Rd
cuaaugccgcaaauacuucac

SEQ ID NO: 2708136 - RNA, 22 nt, Haemophilus influenzae Rd
cuaaugcuuuaauuuguuuuuc

SEQ ID NO: 2708137 - RNA, 15 nt, Haemophilus influenzae Rd
cuaauggggauuuac

SEQ ID NO: 2708138 - RNA, 18 nt, Haemophilus influenzae Rd
cuaaugguugcauuugcu

SEQ ID NO: 2708139 - RNA, 21 nt, Haemophilus influenzae Rd
cuaaugguugcauuugcucaa

SEQ ID NO: 2708140 - RNA, 17 nt, Haemophilus influenzae Rd
cuaauuaacugaaaauu

SEQ ID NO: 2708141 - RNA, 22 nt, Haemophilus influenzae Rd
cuaauuaauuuagauaaaaauu

SEQ ID NO: 2708142 - RNA, 20 nt, Haemophilus influenzae Rd
cuaauucaagcaaauauuua

SEQ ID NO: 2708143 - RNA, 14 nt, Haemophilus influenzae Rd
cuaauucaauaucu

SEQ ID NO: 2708144 - RNA, 22 nt, Haemophilus influenzae Rd
cuaauucacgcauuuaaauaaa

SEQ ID NO: 2708145 - RNA, 15 nt, Haemophilus influenzae Rd
cuaauucaucuucuu

SEQ ID NO: 2708146 - RNA, 21 nt, Haemophilus influenzae Rd
cuaauucauuacauaauacuu

SEQ ID NO: 2708147 - RNA, 18 nt, Haemophilus influenzae Rd
cuaauuccauugcauugc

SEQ ID NO: 2708148 - RNA, 17 nt, Haemophilus influenzae Rd
cuaauuccccacucacg

SEQ ID NO: 2708149 - RNA, 16 nt, Haemophilus influenzae Rd
cuaauuccccuucaaa

SEQ ID NO: 2708150 - RNA, 16 nt, Haemophilus influenzae Rd
cuaauucggaagaauu

SEQ ID NO: 2708151 - RNA, 16 nt, Haemophilus influenzae Rd
cuaauucggcuucagu

SEQ ID NO: 2708152 - RNA, 15 nt, Haemophilus influenzae Rd
cuaauucguuaauaa

SEQ ID NO: 2708153 - RNA, 13 nt, Haemophilus influenzae Rd
cuaauucugcuaa

SEQ ID NO: 2708154 - RNA, 16 nt, Haemophilus influenzae Rd
cuaauucugcuaaauc

SEQ ID NO: 2708155 - RNA, 16 nt, Haemophilus influenzae Rd
cuaauucugcuuuucc

SEQ ID NO: 2708156 - RNA, 21 nt, Haemophilus influenzae Rd
cuaauucuucccagcguaaaa

SEQ ID NO: 2708157 - RNA, 23 nt, Haemophilus influenzae Rd
cuaauugauggcgugaaauauug

SEQ ID NO: 2708158 - RNA, 17 nt, Haemophilus influenzae Rd
cuaauugauucaaaucu

SEQ ID NO: 2708159 - RNA, 17 nt, Haemophilus influenzae Rd
cuaauugcggaaaaauu

SEQ ID NO: 2708160 - RNA, 12 nt, Haemophilus influenzae Rd
cuaauuggaaaa

SEQ ID NO: 2708161 - RNA, 22 nt, Haemophilus influenzae Rd
cuaauuggacaagaaauaauaa

SEQ ID NO: 2708162 - RNA, 19 nt, Haemophilus influenzae Rd
cuaauuggggugcagauuu

SEQ ID NO: 2708163 - RNA, 20 nt, Haemophilus influenzae Rd
cuaauugggucguuagcuca

SEQ ID NO: 2708164 - RNA, 14 nt, Haemophilus influenzae Rd
cuaauugguaaaau

SEQ ID NO: 2708165 - RNA, 16 nt, Haemophilus influenzae Rd
cuaauuggucguucca

SEQ ID NO: 2708166 - RNA, 13 nt, Haemophilus influenzae Rd
cuaauuguucagc

SEQ ID NO: 2708167 - RNA, 18 nt, Haemophilus influenzae Rd
cuaauuguucagcaauuu

SEQ ID NO: 2708168 - RNA, 22 nt, Haemophilus influenzae Rd
cuaauuguucagcaauuucucu

SEQ ID NO: 2708169 - RNA, 20 nt, Haemophilus influenzae Rd
cuaauuguuguaaaauaguu

SEQ ID NO: 2708170 - RNA, 16 nt, Haemophilus influenzae Rd
cuaauuuagucauaca

SEQ ID NO: 2708171 - RNA, 17 nt, Haemophilus influenzae Rd
cuaauuuauccaauacu

SEQ ID NO: 2708172 - RNA, 22 nt, Haemophilus influenzae Rd
cuaauuucguccaguuauaaua

SEQ ID NO: 2708173 - RNA, 19 nt, Haemophilus influenzae Rd
cuaauuugacgauaauauu

SEQ ID NO: 2708174 - RNA, 19 nt, Haemophilus influenzae Rd
cuaauuuucacauaauaaa

SEQ ID NO: 2708175 - RNA, 15 nt, Haemophilus influenzae Rd
cuaauuuugccauca

SEQ ID NO: 2708176 - RNA, 21 nt, Haemophilus influenzae Rd
cuaauuuugccaucaauaacu

SEQ ID NO: 2708177 - RNA, 11 nt, Haemophilus influenzae Rd
cuaauuuuuaa

SEQ ID NO: 2708178 - RNA, 19 nt, Haemophilus influenzae Rd
cuaauuuuuaaaauagaau

SEQ ID NO: 2708179 - RNA, 12 nt, Haemophilus influenzae Rd
cuaauuuuucag

SEQ ID NO: 2708180 - RNA, 16 nt, Haemophilus influenzae Rd
cuaauuuuugcaaugg

SEQ ID NO: 2708181 - RNA, 22 nt, Haemophilus influenzae Rd
cuaauuuuuguuguuuauauuc

SEQ ID NO: 2708182 - RNA, 14 nt, Haemophilus influenzae Rd
cuaauuuuuuaauu

SEQ ID NO: 2708183 - RNA, 14 nt, Haemophilus influenzae Rd
cuaauuuuuuucca

SEQ ID NO: 2708184 - RNA, 13 nt, Haemophilus influenzae Rd
cuaauuuuuuuuc

SEQ ID NO: 2708185 - RNA, 15 nt, Haemophilus influenzae Rd
cuacaaacaaauuuu

SEQ ID NO: 2708186 - RNA, 13 nt, Haemophilus influenzae Rd
cuacaaauaagcc

SEQ ID NO: 2708187 - RNA, 23 nt, Haemophilus influenzae Rd
cuacaacacagacuaaauucagu

SEQ ID NO: 2708188 - RNA, 23 nt, Haemophilus influenzae Rd
cuacaacacuguuccgccacaag

SEQ ID NO: 2708189 - RNA, 22 nt, Haemophilus influenzae Rd
cuacaacagcgaaauauuucac

SEQ ID NO: 2708190 - RNA, 13 nt, Haemophilus influenzae Rd
cuacaacuuuuua

SEQ ID NO: 2708191 - RNA, 16 nt, Haemophilus influenzae Rd
cuacaagaaaccaaaa

SEQ ID NO: 2708192 - RNA, 20 nt, Haemophilus influenzae Rd
cuacaaggguaucuaaauuu

SEQ ID NO: 2708193 - RNA, 23 nt, Haemophilus influenzae Rd
cuacaaguacuacuggcauuuuu

SEQ ID NO: 2708194 - RNA, 15 nt, Haemophilus influenzae Rd
cuacaauauuuauuu

SEQ ID NO: 2708195 - RNA, 18 nt, Haemophilus influenzae Rd
cuacaauauuuauuucua

SEQ ID NO: 2708196 - RNA, 17 nt, Haemophilus influenzae Rd
cuacaaucaaaaaaucu

SEQ ID NO: 2708197 - RNA, 15 nt, Haemophilus influenzae Rd
cuacaaugcucacuu

SEQ ID NO: 2708198 - RNA, 18 nt, Haemophilus influenzae Rd
cuacaauuucauuaauuu

SEQ ID NO: 2708199 - RNA, 22 nt, Haemophilus influenzae Rd
cuacaauuucauuaauuuuauu

SEQ ID NO: 2708200 - RNA, 21 nt, Haemophilus influenzae Rd
cuauauuugaguuauuuuuaa

SEQ ID NO: 2708201 - RNA, 19 nt, Haemophilus influenzae Rd
cuauauuuuccacauuuug

SEQ ID NO: 2708202 - RNA, 22 nt, Haemophilus influenzae Rd
cuauauuuugaauaauaaauug

SEQ ID NO: 2708203 - RNA, 23 nt, Haemophilus influenzae Rd
cuauauuuugaauaauaaauugg

SEQ ID NO: 2708204 - RNA, 13 nt, Haemophilus influenzae Rd
cuaucaaaaucaa

SEQ ID NO: 2708205 - RNA, 17 nt, Haemophilus influenzae Rd
cuaucaaugaauauaaa

SEQ ID NO: 2708206 - RNA, 15 nt, Haemophilus influenzae Rd
cuaucacaaaacaac

SEQ ID NO: 2708207 - RNA, 16 nt, Haemophilus influenzae Rd
cuaucaggcuuaacuu

SEQ ID NO: 2708208 - RNA, 18 nt, Haemophilus influenzae Rd
cuaucauccgcuuguaau

SEQ ID NO: 2708209 - RNA, 12 nt, Haemophilus influenzae Rd
cuauccauuucu

SEQ ID NO: 2708210 - RNA, 19 nt, Haemophilus influenzae Rd
cuaucgucauuaauacagu

SEQ ID NO: 2708211 - RNA, 15 nt, Haemophilus influenzae Rd
cuaucuaaaauauaa

SEQ ID NO: 2708212 - RNA, 21 nt, Haemophilus influenzae Rd
cuaucuaugauuucauuuucu

SEQ ID NO: 2708213 - RNA, 21 nt, Haemophilus influenzae Rd
cuaugauuauagauuuagucc

SEQ ID NO: 2708214 - RNA, 15 nt, Haemophilus influenzae Rd
cuaugauuucauuuu

SEQ ID NO: 2708215 - RNA, 16 nt, Haemophilus influenzae Rd
cuaugauuucauuuuc

SEQ ID NO: 2708216 - RNA, 14 nt, Haemophilus influenzae Rd
cuaugauuuuaaag

SEQ ID NO: 2708217 - RNA, 14 nt, Haemophilus influenzae Rd
cuaugccuucuuca

SEQ ID NO: 2708218 - RNA, 17 nt, Haemophilus influenzae Rd
cuaugccuucuucacua

SEQ ID NO: 2708219 - RNA, 13 nt, Haemophilus influenzae Rd
cuaugucaauuac

SEQ ID NO: 2708220 - RNA, 14 nt, Haemophilus influenzae Rd
cuauguuauuaaaa

SEQ ID NO: 2708221 - RNA, 16 nt, Haemophilus influenzae Rd
cuauguuauuaaaauu

SEQ ID NO: 2708222 - RNA, 19 nt, Haemophilus influenzae Rd
cuauguuauuaaaauuaau

SEQ ID NO: 2708223 - RNA, 12 nt, Haemophilus influenzae Rd
cuauuaaaaaaa

SEQ ID NO: 2708224 - RNA, 17 nt, Haemophilus influenzae Rd
cuauuaaaaaaagcaau

SEQ ID NO: 2708225 - RNA, 20 nt, Haemophilus influenzae Rd
cuauuaagcucaacugccac

SEQ ID NO: 2708226 - RNA, 19 nt, Haemophilus influenzae Rd
cuauuaauuacuuuuauau

SEQ ID NO: 2708227 - RNA, 14 nt, Haemophilus influenzae Rd
cuauuaauuuaauu

SEQ ID NO: 2708228 - RNA, 22 nt, Haemophilus influenzae Rd
cuauuaauuuaauucuaaauuc

SEQ ID NO: 2708229 - RNA, 15 nt, Haemophilus influenzae Rd
cuauuacccacuuca

SEQ ID NO: 2708230 - RNA, 22 nt, Haemophilus influenzae Rd
cuauuacgcuguccaauaauua

SEQ ID NO: 2708231 - RNA, 15 nt, Haemophilus influenzae Rd
cuauuacucuuaauu

SEQ ID NO: 2708232 - RNA, 22 nt, Haemophilus influenzae Rd
cuauuacuuacuacuuuggauu

SEQ ID NO: 2708233 - RNA, 13 nt, Haemophilus influenzae Rd
cuauuacuuucca

SEQ ID NO: 2708234 - RNA, 17 nt, Haemophilus influenzae Rd
cuauuacuuuccauaau

SEQ ID NO: 2708235 - RNA, 12 nt, Haemophilus influenzae Rd
cuauuagaauuu

SEQ ID NO: 2708236 - RNA, 18 nt, Haemophilus influenzae Rd
cuauuagacuuaauuuca

SEQ ID NO: 2708237 - RNA, 21 nt, Haemophilus influenzae Rd
cuauuagcuaugccuuuuuau

SEQ ID NO: 2708238 - RNA, 20 nt, Haemophilus influenzae Rd
cuauuauuccaaauaucuuc

SEQ ID NO: 2708239 - RNA, 16 nt, Haemophilus influenzae Rd
cuauucaucuaaaaaa

SEQ ID NO: 2708240 - RNA, 14 nt, Haemophilus influenzae Rd
cuauuccuaaugcg

SEQ ID NO: 2708241 - RNA, 14 nt, Haemophilus influenzae Rd
cuauuccuuucuuu

SEQ ID NO: 2708242 - RNA, 15 nt, Haemophilus influenzae Rd
cuauucgcugauaaa

SEQ ID NO: 2708243 - RNA, 22 nt, Haemophilus influenzae Rd
cuauucuaaccgcacuuuuuaa

SEQ ID NO: 2708244 - RNA, 23 nt, Haemophilus influenzae Rd
cuauucuaaccgcacuuuuuaau

SEQ ID NO: 2708245 - RNA, 17 nt, Haemophilus influenzae Rd
cuauucucacaucauca

SEQ ID NO: 2708246 - RNA, 15 nt, Haemophilus influenzae Rd
cuauucuucaauaga

SEQ ID NO: 2708247 - RNA, 19 nt, Haemophilus influenzae Rd
cuauugauucuaaaaacuc

SEQ ID NO: 2708248 - RNA, 17 nt, Haemophilus influenzae Rd
cuauuggcguaauacca

SEQ ID NO: 2708249 - RNA, 14 nt, Haemophilus influenzae Rd
cuauuuaagccuug

SEQ ID NO: 2708250 - RNA, 15 nt, Haemophilus influenzae Rd
cuauuuaagccuuga

SEQ ID NO: 2708251 - RNA, 23 nt, Haemophilus influenzae Rd
cuauuuacguaaaaaaguuugau

SEQ ID NO: 2708252 - RNA, 17 nt, Haemophilus influenzae Rd
cuauuuacuguuuuuau

SEQ ID NO: 2708253 - RNA, 19 nt, Haemophilus influenzae Rd
cuauuuacuguuuuuauau

SEQ ID NO: 2708254 - RNA, 17 nt, Haemophilus influenzae Rd
cuauuuauccccaauua

SEQ ID NO: 2708255 - RNA, 22 nt, Haemophilus influenzae Rd
cuauuuauccccaauuaaggau

SEQ ID NO: 2708256 - RNA, 17 nt, Haemophilus influenzae Rd
cuauuucagcuugaagu

SEQ ID NO: 2708257 - RNA, 14 nt, Haemophilus influenzae Rd
cuauuucaucuuua

SEQ ID NO: 2708258 - RNA, 21 nt, Haemophilus influenzae Rd
cuauuucuuugaguaaaaaau

SEQ ID NO: 2708259 - RNA, 21 nt, Haemophilus influenzae Rd
cuauuuuaucaagaacaguau

SEQ ID NO: 2708260 - RNA, 11 nt, Haemophilus influenzae Rd
cuauuuuuaau

SEQ ID NO: 2708261 - RNA, 13 nt, Haemophilus influenzae Rd
cuauuuuuaauuu

SEQ ID NO: 2708262 - RNA, 17 nt, Haemophilus influenzae Rd
cuauuuuuaauuuugaa

SEQ ID NO: 2708263 - RNA, 23 nt, Haemophilus influenzae Rd
cuauuuuucgcuacgccuuggau

SEQ ID NO: 2708264 - RNA, 13 nt, Haemophilus influenzae Rd
cuauuuuuuccug

SEQ ID NO: 2708265 - RNA, 16 nt, Haemophilus influenzae Rd
cuauuuuuucugcaaa

SEQ ID NO: 2708266 - RNA, 17 nt, Haemophilus influenzae Rd
cucaaaaaguuaaauaa

SEQ ID NO: 2708267 - RNA, 18 nt, Haemophilus influenzae Rd
cucaaaaaguuaaauaag

SEQ ID NO: 2708268 - RNA, 19 nt, Haemophilus influenzae Rd
cucaaaaaguuaaauaagc

SEQ ID NO: 2708269 - RNA, 18 nt, Haemophilus influenzae Rd
cucaaaaauuucagaauu

SEQ ID NO: 2708270 - RNA, 18 nt, Haemophilus influenzae Rd
cucaaaauacucacaagu

SEQ ID NO: 2708271 - RNA, 12 nt, Haemophilus influenzae Rd
cucaaaaucaag

SEQ ID NO: 2708272 - RNA, 19 nt, Haemophilus influenzae Rd
cucaaaaucaaguuaaaaa

SEQ ID NO: 2708273 - RNA, 21 nt, Haemophilus influenzae Rd
cucaaaauuaugacggauuac

SEQ ID NO: 2708274 - RNA, 21 nt, Haemophilus influenzae Rd
cucaaagaggagguagaaaau

SEQ ID NO: 2708275 - RNA, 23 nt, Haemophilus influenzae Rd
cucaaauaaauugcccucugcau

SEQ ID NO: 2708276 - RNA, 16 nt, Haemophilus influenzae Rd
cucaaaucuacuaaaa

SEQ ID NO: 2708277 - RNA, 17 nt, Haemophilus influenzae Rd
cucaaaucuacuaaaau

SEQ ID NO: 2708278 - RNA, 16 nt, Haemophilus influenzae Rd
cucaaaugaaaugcaa

SEQ ID NO: 2708279 - RNA, 19 nt, Haemophilus influenzae Rd
cucaaaugaggaauacucu

SEQ ID NO: 2708280 - RNA, 19 nt, Haemophilus influenzae Rd
cucaaaugugaaaacuacu

SEQ ID NO: 2708281 - RNA, 21 nt, Haemophilus influenzae Rd
cucaaauuuucuguugggaua

SEQ ID NO: 2708282 - RNA, 14 nt, Haemophilus influenzae Rd
cucaaauuuuucac

SEQ ID NO: 2708283 - RNA, 16 nt, Haemophilus influenzae Rd
cucaaauuuuucacag

SEQ ID NO: 2708284 - RNA, 22 nt, Haemophilus influenzae Rd
cucaacaacaucuuguuuuaau

SEQ ID NO: 2708285 - RNA, 19 nt, Haemophilus influenzae Rd
cucaacaccgcaaaaauac

SEQ ID NO: 2708286 - RNA, 21 nt, Haemophilus influenzae Rd
cucaagaauauauuuuaucaa

SEQ ID NO: 2708287 - RNA, 16 nt, Haemophilus influenzae Rd
cucaagacaaauuugu

SEQ ID NO: 2708288 - RNA, 20 nt, Haemophilus influenzae Rd
cucaagguugcccacaaaau

SEQ ID NO: 2708289 - RNA, 23 nt, Haemophilus influenzae Rd
cucaaguuuuauuugagaaaaau

SEQ ID NO: 2708290 - RNA, 16 nt, Haemophilus influenzae Rd
cucaauaaauaucuaa

SEQ ID NO: 2708291 - RNA, 14 nt, Haemophilus influenzae Rd
cucaauaauuucaa

SEQ ID NO: 2708292 - RNA, 18 nt, Haemophilus influenzae Rd
cucaauaauuucaauaua

SEQ ID NO: 2708293 - RNA, 18 nt, Haemophilus influenzae Rd
cucaauagauuuaauauc

SEQ ID NO: 2708294 - RNA, 23 nt, Haemophilus influenzae Rd
cucaauccaaguauuuuguggaa

SEQ ID NO: 2708295 - RNA, 20 nt, Haemophilus influenzae Rd
cucaaucucuuuacuguuca

SEQ ID NO: 2708296 - RNA, 23 nt, Haemophilus influenzae Rd
cucaaucucuuuacuguucaaau

SEQ ID NO: 2708297 - RNA, 16 nt, Haemophilus influenzae Rd
cucaaugaauuaaaag

SEQ ID NO: 2708298 - RNA, 17 nt, Haemophilus influenzae Rd
cucaauguuaaguucau

SEQ ID NO: 2708299 - RNA, 23 nt, Haemophilus influenzae Rd
cucaauguuaaguucaucauaaa

SEQ ID NO: 2708300 - RNA, 14 nt, Haemophilus influenzae Rd
cucaauuaagcuaa

SEQ ID NO: 2708301 - RNA, 15 nt, Haemophilus influenzae Rd
cucaauuccuucauc

SEQ ID NO: 2708302 - RNA, 19 nt, Haemophilus influenzae Rd
cucaauuccuucaucgucu

SEQ ID NO: 2708303 - RNA, 15 nt, Haemophilus influenzae Rd
cucaauugcaaaauc

SEQ ID NO: 2708304 - RNA, 20 nt, Haemophilus influenzae Rd
cucacaaaguguuuuauuua

SEQ ID NO: 2708305 - RNA, 20 nt, Haemophilus influenzae Rd
cucucaaagugcgguuaaau

SEQ ID NO: 2708306 - RNA, 16 nt, Haemophilus influenzae Rd
cucucacgugaaucac

SEQ ID NO: 2708307 - RNA, 23 nt, Haemophilus influenzae Rd
cucucgccaaaucucaaaaucag

SEQ ID NO: 2708308 - RNA, 22 nt, Haemophilus influenzae Rd
cucucgccaauagguugcaaau

SEQ ID NO: 2708309 - RNA, 23 nt, Haemophilus influenzae Rd
cucucgggugcgccauuuuuaaa

SEQ ID NO: 2708310 - RNA, 12 nt, Haemophilus influenzae Rd
cucucuuaauua

SEQ ID NO: 2708311 - RNA, 23 nt, Haemophilus influenzae Rd
cucugacuaaucguccaauuuca

SEQ ID NO: 2708312 - RNA, 17 nt, Haemophilus influenzae Rd
cucugcagggaaaaauu

SEQ ID NO: 2708313 - RNA, 20 nt, Haemophilus influenzae Rd
cucugcagggaaaaauuuua

SEQ ID NO: 2708314 - RNA, 19 nt, Haemophilus influenzae Rd
cucugcauaaaagccuuca

SEQ ID NO: 2708315 - RNA, 14 nt, Haemophilus influenzae Rd
cucugccauacuga

SEQ ID NO: 2708316 - RNA, 17 nt, Haemophilus influenzae Rd
cucugcuagucguucuu

SEQ ID NO: 2708317 - RNA, 21 nt, Haemophilus influenzae Rd
cucugcuagucguucuugaug

SEQ ID NO: 2708318 - RNA, 22 nt, Haemophilus influenzae Rd
cucuggagaaaauugcuggcuu

SEQ ID NO: 2708319 - RNA, 13 nt, Haemophilus influenzae Rd
cucuguuaaaaua

SEQ ID NO: 2708320 - RNA, 18 nt, Haemophilus influenzae Rd
cucuuaaccuaccggaaa

SEQ ID NO: 2708321 - RNA, 18 nt, Haemophilus influenzae Rd
cucuuacaguaccuauau

SEQ ID NO: 2708322 - RNA, 14 nt, Haemophilus influenzae Rd
cucuucagcuucuu

SEQ ID NO: 2708323 - RNA, 16 nt, Haemophilus influenzae Rd
cucuucuaaaaauuac

SEQ ID NO: 2708324 - RNA, 18 nt, Haemophilus influenzae Rd
cucuucugggucuuuuug

SEQ ID NO: 2708325 - RNA, 19 nt, Haemophilus influenzae Rd
cucuucuuguucaaauaau

SEQ ID NO: 2708326 - RNA, 21 nt, Haemophilus influenzae Rd
cucuugcgccccuuuuuuagu

SEQ ID NO: 2708327 - RNA, 22 nt, Haemophilus influenzae Rd
cucuugcguuugguucaucauu

SEQ ID NO: 2708328 - RNA, 16 nt, Haemophilus influenzae Rd
cucuuggauuuucuua

SEQ ID NO: 2708329 - RNA, 22 nt, Haemophilus influenzae Rd
cucuugugccaaauucauucuu

SEQ ID NO: 2708330 - RNA, 15 nt, Haemophilus influenzae Rd
cucuuuaauuguuug

SEQ ID NO: 2708331 - RNA, 21 nt, Haemophilus influenzae Rd
cucuuuacgacuaaaacgaac

SEQ ID NO: 2708332 - RNA, 15 nt, Haemophilus influenzae Rd
cucuuuacuguucaa

SEQ ID NO: 2708333 - RNA, 14 nt, Haemophilus influenzae Rd
cucuuucaaauaau

SEQ ID NO: 2708334 - RNA, 12 nt, Haemophilus influenzae Rd
cucuuucaaguu

SEQ ID NO: 2708335 - RNA, 13 nt, Haemophilus influenzae Rd
cucuuucaccauu

SEQ ID NO: 2708336 - RNA, 16 nt, Haemophilus influenzae Rd
cucuuucuuaaaauac

SEQ ID NO: 2708337 - RNA, 19 nt, Haemophilus influenzae Rd
cucuuugggaaugccauua

SEQ ID NO: 2708338 - RNA, 23 nt, Haemophilus influenzae Rd
cucuuuuucagaagucacauauu

SEQ ID NO: 2708339 - RNA, 16 nt, Haemophilus influenzae Rd
cucuuuuuuagauaaa

SEQ ID NO: 2708340 - RNA, 16 nt, Haemophilus influenzae Rd
cucuuuuuucauugca

SEQ ID NO: 2708341 - RNA, 18 nt, Haemophilus influenzae Rd
cugaaaaagcuaaaaaaa

SEQ ID NO: 2708342 - RNA, 15 nt, Haemophilus influenzae Rd
cugaaaaauaaaaaa

SEQ ID NO: 2708343 - RNA, 18 nt, Haemophilus influenzae Rd
cugaaaaauaaaaaauau

SEQ ID NO: 2708344 - RNA, 19 nt, Haemophilus influenzae Rd
cugaaaaugggcgggcaaa

SEQ ID NO: 2708345 - RNA, 17 nt, Haemophilus influenzae Rd
cugaaagucgauucaaa

SEQ ID NO: 2708346 - RNA, 18 nt, Haemophilus influenzae Rd
cugaaagucgauucaaau

SEQ ID NO: 2708347 - RNA, 13 nt, Haemophilus influenzae Rd
cugaaauacaaag

SEQ ID NO: 2708348 - RNA, 14 nt, Haemophilus influenzae Rd
cugaaauaccuucu

SEQ ID NO: 2708349 - RNA, 15 nt, Haemophilus influenzae Rd
cugaaauauagcuua

SEQ ID NO: 2708350 - RNA, 17 nt, Haemophilus influenzae Rd
cugaaauaucagcuacu

SEQ ID NO: 2708351 - RNA, 17 nt, Haemophilus influenzae Rd
cugaaaucccuuagaaa

SEQ ID NO: 2708352 - RNA, 22 nt, Haemophilus influenzae Rd
cugaaaucccuuagaaaaucac

SEQ ID NO: 2708353 - RNA, 18 nt, Haemophilus influenzae Rd
cugaaaugauuauaauua

SEQ ID NO: 2708354 - RNA, 17 nt, Haemophilus influenzae Rd
cugaaauuaauaagaaa

SEQ ID NO: 2708355 - RNA, 16 nt, Haemophilus influenzae Rd
cugaaauucuaaaaaa

SEQ ID NO: 2708356 - RNA, 17 nt, Haemophilus influenzae Rd
cugaaauucuaaaaaaa

SEQ ID NO: 2708357 - RNA, 19 nt, Haemophilus influenzae Rd
cugaaauucuaaaaaaauc

SEQ ID NO: 2708358 - RNA, 20 nt, Haemophilus influenzae Rd
cugaaauuuuuaucuaaauu

SEQ ID NO: 2708359 - RNA, 21 nt, Haemophilus influenzae Rd
cugaacacucuaucuaaaaua

SEQ ID NO: 2708360 - RNA, 19 nt, Haemophilus influenzae Rd
cugaacgcgcgccaauaaa

SEQ ID NO: 2708361 - RNA, 23 nt, Haemophilus influenzae Rd
cugaacggucauccaauguugca

SEQ ID NO: 2708362 - RNA, 20 nt, Haemophilus influenzae Rd
cugaacuaaaauaaccuuaa

SEQ ID NO: 2708363 - RNA, 18 nt, Haemophilus influenzae Rd
cugaagccauuuuaugcg

SEQ ID NO: 2708364 - RNA, 14 nt, Haemophilus influenzae Rd
cugaagcccacccu

SEQ ID NO: 2708365 - RNA, 22 nt, Haemophilus influenzae Rd
cugaagcuucuucaccugcguu

SEQ ID NO: 2708366 - RNA, 17 nt, Haemophilus influenzae Rd
cugaaggcgcuccccug

SEQ ID NO: 2708367 - RNA, 14 nt, Haemophilus influenzae Rd
cugaaggugcguuc

SEQ ID NO: 2708368 - RNA, 23 nt, Haemophilus influenzae Rd
cugaagguuuucuuuguuucccu

SEQ ID NO: 2708369 - RNA, 13 nt, Haemophilus influenzae Rd
cugaaguauaagc

SEQ ID NO: 2708370 - RNA, 14 nt, Haemophilus influenzae Rd
cugaauaaaaaaaa

SEQ ID NO: 2708371 - RNA, 13 nt, Haemophilus influenzae Rd
cugaauaaauaaa

SEQ ID NO: 2708372 - RNA, 12 nt, Haemophilus influenzae Rd
cugaauaaauuu

SEQ ID NO: 2708373 - RNA, 15 nt, Haemophilus influenzae Rd
cugaauaauuuccaa

SEQ ID NO: 2708374 - RNA, 20 nt, Haemophilus influenzae Rd
cugaauacacuuuaaauuuu

SEQ ID NO: 2708375 - RNA, 21 nt, Haemophilus influenzae Rd
cugaauacacuuuaaauuuuc

SEQ ID NO: 2708376 - RNA, 20 nt, Haemophilus influenzae Rd
cugaauauccagugccauuu

SEQ ID NO: 2708377 - RNA, 16 nt, Haemophilus influenzae Rd
cugaauccgaaauuaa

SEQ ID NO: 2708378 - RNA, 21 nt, Haemophilus influenzae Rd
cugaaugaucgaguaaaaaua

SEQ ID NO: 2708379 - RNA, 21 nt, Haemophilus influenzae Rd
cugaaugcuugcgccgaauaa

SEQ ID NO: 2708380 - RNA, 21 nt, Haemophilus influenzae Rd
cugaaugugaucaugguugua

SEQ ID NO: 2708381 - RNA, 14 nt, Haemophilus influenzae Rd
cugaauuaaaaacc

SEQ ID NO: 2708382 - RNA, 17 nt, Haemophilus influenzae Rd
cugaauuggacggcaaa

SEQ ID NO: 2708383 - RNA, 22 nt, Haemophilus influenzae Rd
cugaauuggacggcaaaaauau

SEQ ID NO: 2708384 - RNA, 14 nt, Haemophilus influenzae Rd
cugaauuuaaacuu

SEQ ID NO: 2708385 - RNA, 19 nt, Haemophilus influenzae Rd
cugaauuucauucaaaaau

SEQ ID NO: 2708386 - RNA, 16 nt, Haemophilus influenzae Rd
cugaauuuuguaccaa

SEQ ID NO: 2708387 - RNA, 20 nt, Haemophilus influenzae Rd
cugacacgguaguaaauaac

SEQ ID NO: 2708388 - RNA, 22 nt, Haemophilus influenzae Rd
cugacagaagacgauuuuagag

SEQ ID NO: 2708389 - RNA, 18 nt, Haemophilus influenzae Rd
cugacauuacauaaauuc

SEQ ID NO: 2708390 - RNA, 19 nt, Haemophilus influenzae Rd
cugaccaccagaaaguuuu

SEQ ID NO: 2708391 - RNA, 17 nt, Haemophilus influenzae Rd
cugaccgcacuuuuuga

SEQ ID NO: 2708392 - RNA, 13 nt, Haemophilus influenzae Rd
cugacgcauugca

SEQ ID NO: 2708393 - RNA, 23 nt, Haemophilus influenzae Rd
cugacguguaaaucuaaaauaau

SEQ ID NO: 2708394 - RNA, 21 nt, Haemophilus influenzae Rd
cugacuaaucguccaauuuca

SEQ ID NO: 2708395 - RNA, 13 nt, Haemophilus influenzae Rd
cugagauuuuguc

SEQ ID NO: 2708396 - RNA, 14 nt, Haemophilus influenzae Rd
cugagcuaacgacc

SEQ ID NO: 2708397 - RNA, 17 nt, Haemophilus influenzae Rd
cugaggcuaauaauaaa

SEQ ID NO: 2708398 - RNA, 20 nt, Haemophilus influenzae Rd
cugagguuccccuaaaaaau

SEQ ID NO: 2708399 - RNA, 22 nt, Haemophilus influenzae Rd
cugagguuccccuaaaaaauaa

SEQ ID NO: 2708400 - RNA, 19 nt, Haemophilus influenzae Rd
cugaguaaauaaacggaac

SEQ ID NO: 2708401 - RNA, 14 nt, Haemophilus influenzae Rd
cugaguaaauaauu

SEQ ID NO: 2708402 - RNA, 23 nt, Haemophilus influenzae Rd
cugaguccuuuuaguuuccccug

SEQ ID NO: 2708403 - RNA, 21 nt, Haemophilus influenzae Rd
cugauaaacgccuuuuaaacu

SEQ ID NO: 2708404 - RNA, 19 nt, Haemophilus influenzae Rd
cugauaaguagaaaaauug

SEQ ID NO: 2708405 - RNA, 13 nt, Haemophilus influenzae Rd
cugauaauuucug

SEQ ID NO: 2708406 - RNA, 14 nt, Haemophilus influenzae Rd
cugauacugccaac

SEQ ID NO: 2708407 - RNA, 15 nt, Haemophilus influenzae Rd
cugauagguaauaau

SEQ ID NO: 2708408 - RNA, 18 nt, Haemophilus influenzae Rd
cugauauagcuagaaagc

SEQ ID NO: 2708409 - RNA, 23 nt, Haemophilus influenzae Rd
cugauauagcuagaaagcaaugu

SEQ ID NO: 2708410 - RNA, 16 nt, Haemophilus influenzae Rd
cugcuuucuagaugau

SEQ ID NO: 2708411 - RNA, 13 nt, Haemophilus influenzae Rd
cugcuuuucuuca

SEQ ID NO: 2708412 - RNA, 14 nt, Haemophilus influenzae Rd
cugcuuuuuuacug

SEQ ID NO: 2708413 - RNA, 12 nt, Haemophilus influenzae Rd
cugcuuuuuuca

SEQ ID NO: 2708414 - RNA, 22 nt, Haemophilus influenzae Rd
cuggaauauggaaaugcuuaau

SEQ ID NO: 2708415 - RNA, 15 nt, Haemophilus influenzae Rd
cuggaccuaauccca

SEQ ID NO: 2708416 - RNA, 19 nt, Haemophilus influenzae Rd
cuggacgcucuacauuuac

SEQ ID NO: 2708417 - RNA, 22 nt, Haemophilus influenzae Rd
cuggagagugaguuuggaauac

SEQ ID NO: 2708418 - RNA, 17 nt, Haemophilus influenzae Rd
cuggaucggcuauuuca

SEQ ID NO: 2708419 - RNA, 15 nt, Haemophilus influenzae Rd
cuggaucuucagcau

SEQ ID NO: 2708420 - RNA, 20 nt, Haemophilus influenzae Rd
cuggaucuucagcauuuacc

SEQ ID NO: 2708421 - RNA, 18 nt, Haemophilus influenzae Rd
cuggauguuguaaaauau

SEQ ID NO: 2708422 - RNA, 13 nt, Haemophilus influenzae Rd
cuggauuaucuau

SEQ ID NO: 2708423 - RNA, 13 nt, Haemophilus influenzae Rd
cuggauuaucugu

SEQ ID NO: 2708424 - RNA, 16 nt, Haemophilus influenzae Rd
cuggauuaucuguaac

SEQ ID NO: 2708425 - RNA, 17 nt, Haemophilus influenzae Rd
cuggauucguuguacca

SEQ ID NO: 2708426 - RNA, 15 nt, Haemophilus influenzae Rd
cuggcguagcugcag

SEQ ID NO: 2708427 - RNA, 16 nt, Haemophilus influenzae Rd
cuggcguuuuuuauaa

SEQ ID NO: 2708428 - RNA, 14 nt, Haemophilus influenzae Rd
cuggcuaaauuuuu

SEQ ID NO: 2708429 - RNA, 16 nt, Haemophilus influenzae Rd
cuggcuaacaaauaau

SEQ ID NO: 2708430 - RNA, 23 nt, Haemophilus influenzae Rd
cuggcuaacaaauaaugccucau

SEQ ID NO: 2708431 - RNA, 17 nt, Haemophilus influenzae Rd
cuggcucaauguuaagu

SEQ ID NO: 2708432 - RNA, 18 nt, Haemophilus influenzae Rd
cuggcucaauguuaaguu

SEQ ID NO: 2708433 - RNA, 17 nt, Haemophilus influenzae Rd
cuggcucgcucuucagc

SEQ ID NO: 2708434 - RNA, 16 nt, Haemophilus influenzae Rd
cuggcucuacgcaagc

SEQ ID NO: 2708435 - RNA, 13 nt, Haemophilus influenzae Rd
cuggcucugcuga

SEQ ID NO: 2708436 - RNA, 16 nt, Haemophilus influenzae Rd
cuggcuugugaaauaa

SEQ ID NO: 2708437 - RNA, 19 nt, Haemophilus influenzae Rd
cuggggacgcaccuuuuga

SEQ ID NO: 2708438 - RNA, 13 nt, Haemophilus influenzae Rd
cuggguaaaauaa

SEQ ID NO: 2708439 - RNA, 14 nt, Haemophilus influenzae Rd
cuggguaaaauaau

SEQ ID NO: 2708440 - RNA, 19 nt, Haemophilus influenzae Rd
cuggguauugauucaauuc

SEQ ID NO: 2708441 - RNA, 13 nt, Haemophilus influenzae Rd
cugggucuuuuug

SEQ ID NO: 2708442 - RNA, 20 nt, Haemophilus influenzae Rd
cugggucuuuuuguggagca

SEQ ID NO: 2708443 - RNA, 17 nt, Haemophilus influenzae Rd
cuggguuucggauaaua

SEQ ID NO: 2708444 - RNA, 21 nt, Haemophilus influenzae Rd
cuggguuugcacuuuaaaaau

SEQ ID NO: 2708445 - RNA, 13 nt, Haemophilus influenzae Rd
cugguaauuugcu

SEQ ID NO: 2708446 - RNA, 18 nt, Haemophilus influenzae Rd
cugguagcaauaaccaau

SEQ ID NO: 2708447 - RNA, 15 nt, Haemophilus influenzae Rd
cugguagcauaaagg

SEQ ID NO: 2708448 - RNA, 18 nt, Haemophilus influenzae Rd
cugguauuuacaagucuc

SEQ ID NO: 2708449 - RNA, 17 nt, Haemophilus influenzae Rd
cuggugaaauuaauuua

SEQ ID NO: 2708450 - RNA, 23 nt, Haemophilus influenzae Rd
cuggugcuacuugagcuucagcu

SEQ ID NO: 2708451 - RNA, 15 nt, Haemophilus influenzae Rd
cuggugggaauaauu

SEQ ID NO: 2708452 - RNA, 17 nt, Haemophilus influenzae Rd
cuggugggaauaauuuu

SEQ ID NO: 2708453 - RNA, 18 nt, Haemophilus influenzae Rd
cugguguggagaaagaaa

SEQ ID NO: 2708454 - RNA, 21 nt, Haemophilus influenzae Rd
cugguguuauuggaaaauuca

SEQ ID NO: 2708455 - RNA, 14 nt, Haemophilus influenzae Rd
cugguucaaaaugg

SEQ ID NO: 2708456 - RNA, 12 nt, Haemophilus influenzae Rd
cugguuccauua

SEQ ID NO: 2708457 - RNA, 24 nt, Haemophilus influenzae Rd
cugguuccauuacguucauauaaa

SEQ ID NO: 2708458 - RNA, 13 nt, Haemophilus influenzae Rd
cuguaaaaaaccu

SEQ ID NO: 2708459 - RNA, 20 nt, Haemophilus influenzae Rd
cuguaaaaaaucuuuaagug

SEQ ID NO: 2708460 - RNA, 15 nt, Haemophilus influenzae Rd
cuguaaaccuucaaa

SEQ ID NO: 2708461 - RNA, 22 nt, Haemophilus influenzae Rd
cuguaaauggcguuuugcguga

SEQ ID NO: 2708462 - RNA, 15 nt, Haemophilus influenzae Rd
cuguaacguuaaaug

SEQ ID NO: 2708463 - RNA, 23 nt, Haemophilus influenzae Rd
cuguaacguuaaaugaacguuuu

SEQ ID NO: 2708464 - RNA, 23 nt, Haemophilus influenzae Rd
cuguaauauaugaaaaauaauca

SEQ ID NO: 2708465 - RNA, 17 nt, Haemophilus influenzae Rd
cuguaaugacagaaucu

SEQ ID NO: 2708466 - RNA, 12 nt, Haemophilus influenzae Rd
cuguaaugauca

SEQ ID NO: 2708467 - RNA, 23 nt, Haemophilus influenzae Rd
cuguaauugggcgcauaaccauu

SEQ ID NO: 2708468 - RNA, 16 nt, Haemophilus influenzae Rd
cuguaauuucacuucc

SEQ ID NO: 2708469 - RNA, 17 nt, Haemophilus influenzae Rd
cuguaauuucacuuccg

SEQ ID NO: 2708470 - RNA, 18 nt, Haemophilus influenzae Rd
cuguacguucaaaaagcu

SEQ ID NO: 2708471 - RNA, 17 nt, Haemophilus influenzae Rd
cuguacuagauaacuag

SEQ ID NO: 2708472 - RNA, 18 nt, Haemophilus influenzae Rd
cuguagaaauuaauaaug

SEQ ID NO: 2708473 - RNA, 16 nt, Haemophilus influenzae Rd
cuguaucaauuccuuc

SEQ ID NO: 2708474 - RNA, 13 nt, Haemophilus influenzae Rd
cuguaucuuuuug

SEQ ID NO: 2708475 - RNA, 23 nt, Haemophilus influenzae Rd
cuguauuagguaaauuugguuca

SEQ ID NO: 2708476 - RNA, 11 nt, Haemophilus influenzae Rd
cuguauuucgu

SEQ ID NO: 2708477 - RNA, 22 nt, Haemophilus influenzae Rd
cugucaaacgaaaaaaauaaaa

SEQ ID NO: 2708478 - RNA, 14 nt, Haemophilus influenzae Rd
cugucaauuuuucu

SEQ ID NO: 2708479 - RNA, 17 nt, Haemophilus influenzae Rd
cugucacgagcuaaaaa

SEQ ID NO: 2708480 - RNA, 23 nt, Haemophilus influenzae Rd
cugucauauaaccacguaauucu

SEQ ID NO: 2708481 - RNA, 16 nt, Haemophilus influenzae Rd
cugucauauucauuuu

SEQ ID NO: 2708482 - RNA, 17 nt, Haemophilus influenzae Rd
cugucauauucauuuuc

SEQ ID NO: 2708483 - RNA, 22 nt, Haemophilus influenzae Rd
cugucaucgguucuuuuaauuc

SEQ ID NO: 2708484 - RNA, 17 nt, Haemophilus influenzae Rd
cugucauuuauggaaau

SEQ ID NO: 2708485 - RNA, 22 nt, Haemophilus influenzae Rd
cuguccaauaauuaaacuuuca

SEQ ID NO: 2708486 - RNA, 14 nt, Haemophilus influenzae Rd
cugucgcuucuaau

SEQ ID NO: 2708487 - RNA, 16 nt, Haemophilus influenzae Rd
cugucgcuuuuuccuc

SEQ ID NO: 2708488 - RNA, 18 nt, Haemophilus influenzae Rd
cugugauaacuaugccuu

SEQ ID NO: 2708489 - RNA, 23 nt, Haemophilus influenzae Rd
cugugauauauaucacagauuuu

SEQ ID NO: 2708490 - RNA, 19 nt, Haemophilus influenzae Rd
cugugcaaaacuagucaua

SEQ ID NO: 2708491 - RNA, 19 nt, Haemophilus influenzae Rd
cugugcaaaguuaccauuu

SEQ ID NO: 2708492 - RNA, 16 nt, Haemophilus influenzae Rd
cugugcgaccugaaga

SEQ ID NO: 2708493 - RNA, 13 nt, Haemophilus influenzae Rd
cuguggcaaaauc

SEQ ID NO: 2708494 - RNA, 19 nt, Haemophilus influenzae Rd
cuguggcaaguugaagaga

SEQ ID NO: 2708495 - RNA, 17 nt, Haemophilus influenzae Rd
cugugguaaauaauuuu

SEQ ID NO: 2708496 - RNA, 15 nt, Haemophilus influenzae Rd
cuguggugaagugcg

SEQ ID NO: 2708497 - RNA, 18 nt, Haemophilus influenzae Rd
cuguggugaagugcgguu

SEQ ID NO: 2708498 - RNA, 20 nt, Haemophilus influenzae Rd
cugugguuuugugaguucaa

SEQ ID NO: 2708499 - RNA, 14 nt, Haemophilus influenzae Rd
cuguguaaaacauu

SEQ ID NO: 2708500 - RNA, 23 nt, Haemophilus influenzae Rd
cuguguuagaaagccuuuuaaaa

SEQ ID NO: 2708501 - RNA, 22 nt, Haemophilus influenzae Rd
cuguuaauugaguguggugaac

SEQ ID NO: 2708502 - RNA, 23 nt, Haemophilus influenzae Rd
cuguuacaucauccuuaccuucc

SEQ ID NO: 2708503 - RNA, 13 nt, Haemophilus influenzae Rd
cuguuaccaauaa

SEQ ID NO: 2708504 - RNA, 14 nt, Haemophilus influenzae Rd
cuguuacuucuuuc

SEQ ID NO: 2708505 - RNA, 13 nt, Haemophilus influenzae Rd
cuguucaaauaag

SEQ ID NO: 2708506 - RNA, 21 nt, Haemophilus influenzae Rd
cuguuccacccgguacgcaac

SEQ ID NO: 2708507 - RNA, 13 nt, Haemophilus influenzae Rd
cuguuccugcauu

SEQ ID NO: 2708508 - RNA, 20 nt, Haemophilus influenzae Rd
cuguucgcaaacaugcuccc

SEQ ID NO: 2708509 - RNA, 23 nt, Haemophilus influenzae Rd
cuguugagcaucuacccaauaaa

SEQ ID NO: 2708510 - RNA, 19 nt, Haemophilus influenzae Rd
cuguugaggccgaucauag

SEQ ID NO: 2708511 - RNA, 14 nt, Haemophilus influenzae Rd
cuguugauguuuua

SEQ ID NO: 2708512 - RNA, 17 nt, Haemophilus influenzae Rd
cuguugauguuuuaaca

SEQ ID NO: 2708513 - RNA, 19 nt, Haemophilus influenzae Rd
cuguugcgacagauacauu

SEQ ID NO: 2708514 - RNA, 21 nt, Haemophilus influenzae Rd
cuguugcgacagauacauuua

SEQ ID NO: 2708515 - RNA, 17 nt, Haemophilus influenzae Rd
cuuaucuaaaaagauuu

SEQ ID NO: 2708516 - RNA, 18 nt, Haemophilus influenzae Rd
cuuaucuacaaucaaaaa

SEQ ID NO: 2708517 - RNA, 19 nt, Haemophilus influenzae Rd
cuuaucuacaaucaaaaaa

SEQ ID NO: 2708518 - RNA, 12 nt, Haemophilus influenzae Rd
cuuaucuacugc

SEQ ID NO: 2708519 - RNA, 15 nt, Haemophilus influenzae Rd
cuuaucuuaaaaaag

SEQ ID NO: 2708520 - RNA, 15 nt, Haemophilus influenzae Rd
cuuaugcaaaguauu

SEQ ID NO: 2708521 - RNA, 16 nt, Haemophilus influenzae Rd
cuuauucaaacgcccu

SEQ ID NO: 2708522 - RNA, 21 nt, Haemophilus influenzae Rd
cuuauucauuaaggcuuuucu

SEQ ID NO: 2708523 - RNA, 22 nt, Haemophilus influenzae Rd
cuuauuccagucuacacuugua

SEQ ID NO: 2708524 - RNA, 14 nt, Haemophilus influenzae Rd
cuuauugaagaaag

SEQ ID NO: 2708525 - RNA, 19 nt, Haemophilus influenzae Rd
cuuauuguacucaauaagg

SEQ ID NO: 2708526 - RNA, 14 nt, Haemophilus influenzae Rd
cuuauuuacuuuau

SEQ ID NO: 2708527 - RNA, 16 nt, Haemophilus influenzae Rd
cuuauuuguuuuauag

SEQ ID NO: 2708528 - RNA, 15 nt, Haemophilus influenzae Rd
cuuauuuuaaauaaa

SEQ ID NO: 2708529 - RNA, 16 nt, Haemophilus influenzae Rd
cuuauuuuaaauaaaa

SEQ ID NO: 2708530 - RNA, 15 nt, Haemophilus influenzae Rd
cuuauuuuacuucaa

SEQ ID NO: 2708531 - RNA, 17 nt, Haemophilus influenzae Rd
cuuauuuuguguuugaa

SEQ ID NO: 2708532 - RNA, 18 nt, Haemophilus influenzae Rd
cuuauuuuguugcagcuu

SEQ ID NO: 2708533 - RNA, 13 nt, Haemophilus influenzae Rd
cuuauuuuuuaau

SEQ ID NO: 2708534 - RNA, 13 nt, Haemophilus influenzae Rd
cuucaaaaacaua

SEQ ID NO: 2708535 - RNA, 13 nt, Haemophilus influenzae Rd
cuucaaaaucacc

SEQ ID NO: 2708536 - RNA, 14 nt, Haemophilus influenzae Rd
cuucaaaauuuggc

SEQ ID NO: 2708537 - RNA, 19 nt, Haemophilus influenzae Rd
cuucaaaugaagugcguuu

SEQ ID NO: 2708538 - RNA, 16 nt, Haemophilus influenzae Rd
cuucaaauucuacaug

SEQ ID NO: 2708539 - RNA, 20 nt, Haemophilus influenzae Rd
cuucaaauugcaaaaaacuu

SEQ ID NO: 2708540 - RNA, 23 nt, Haemophilus influenzae Rd
cuucaacaacgauaucggauucu

SEQ ID NO: 2708541 - RNA, 21 nt, Haemophilus influenzae Rd
cuucaacauaaguacauucaa

SEQ ID NO: 2708542 - RNA, 13 nt, Haemophilus influenzae Rd
cuucaacauuuuu

SEQ ID NO: 2708543 - RNA, 16 nt, Haemophilus influenzae Rd
cuucaaccacccauac

SEQ ID NO: 2708544 - RNA, 14 nt, Haemophilus influenzae Rd
cuucaagucuuuuu

SEQ ID NO: 2708545 - RNA, 15 nt, Haemophilus influenzae Rd
cuucaagucuuuuuu

SEQ ID NO: 2708546 - RNA, 20 nt, Haemophilus influenzae Rd
cuucaauagaacguaauaau

SEQ ID NO: 2708547 - RNA, 18 nt, Haemophilus influenzae Rd
cuucaauagauaaaucaa

SEQ ID NO: 2708548 - RNA, 18 nt, Haemophilus influenzae Rd
cuucaaucaucauuuauu

SEQ ID NO: 2708549 - RNA, 19 nt, Haemophilus influenzae Rd
cuucaaucaucauuuauua

SEQ ID NO: 2708550 - RNA, 12 nt, Haemophilus influenzae Rd
cuucaaugguuu

SEQ ID NO: 2708551 - RNA, 14 nt, Haemophilus influenzae Rd
cuucaauuaccuua

SEQ ID NO: 2708552 - RNA, 14 nt, Haemophilus influenzae Rd
cuucaauuucuacc

SEQ ID NO: 2708553 - RNA, 13 nt, Haemophilus influenzae Rd
cuucacaaaccca

SEQ ID NO: 2708554 - RNA, 14 nt, Haemophilus influenzae Rd
cuucacagauuuca

SEQ ID NO: 2708555 - RNA, 18 nt, Haemophilus influenzae Rd
cuucacagauuucaauua

SEQ ID NO: 2708556 - RNA, 15 nt, Haemophilus influenzae Rd
cuucacauagaggaa

SEQ ID NO: 2708557 - RNA, 17 nt, Haemophilus influenzae Rd
cuucacgacccaccacu

SEQ ID NO: 2708558 - RNA, 14 nt, Haemophilus influenzae Rd
cuucacugugccaa

SEQ ID NO: 2708559 - RNA, 16 nt, Haemophilus influenzae Rd
cuucacuuuucgcaau

SEQ ID NO: 2708560 - RNA, 16 nt, Haemophilus influenzae Rd
cuucagaaagauuaca

SEQ ID NO: 2708561 - RNA, 24 nt, Haemophilus influenzae Rd
cuucagaaccugucgcaaugaaga

SEQ ID NO: 2708562 - RNA, 20 nt, Haemophilus influenzae Rd
cuucagaacugcuuucuucc

SEQ ID NO: 2708563 - RNA, 22 nt, Haemophilus influenzae Rd
cuucagaacugcuuucuuccaa

SEQ ID NO: 2708564 - RNA, 17 nt, Haemophilus influenzae Rd
cuucagcaguuuggcaa

SEQ ID NO: 2708565 - RNA, 16 nt, Haemophilus influenzae Rd
cuucagccacuaauuu

SEQ ID NO: 2708566 - RNA, 18 nt, Haemophilus influenzae Rd
cuucagccacuaauuuca

SEQ ID NO: 2708567 - RNA, 19 nt, Haemophilus influenzae Rd
cuucagccacuaauuucac

SEQ ID NO: 2708568 - RNA, 20 nt, Haemophilus influenzae Rd
cuucagcuuguuuaaucaca

SEQ ID NO: 2708569 - RNA, 16 nt, Haemophilus influenzae Rd
cuucaguuuucauuuu

SEQ ID NO: 2708570 - RNA, 18 nt, Haemophilus influenzae Rd
cuucaguuuucauuuuuu

SEQ ID NO: 2708571 - RNA, 14 nt, Haemophilus influenzae Rd
cuucauagugagau

SEQ ID NO: 2708572 - RNA, 20 nt, Haemophilus influenzae Rd
cuucauaguuggauuauuua

SEQ ID NO: 2708573 - RNA, 13 nt, Haemophilus influenzae Rd
cuucauauaaucu

SEQ ID NO: 2708574 - RNA, 22 nt, Haemophilus influenzae Rd
cuucauaucuuugaauugaagc

SEQ ID NO: 2708575 - RNA, 17 nt, Haemophilus influenzae Rd
cuucaucaccugcuuua

SEQ ID NO: 2708576 - RNA, 16 nt, Haemophilus influenzae Rd
cuucaucagccgcuuu

SEQ ID NO: 2708577 - RNA, 17 nt, Haemophilus influenzae Rd
cuucaucagccgcuuuu

SEQ ID NO: 2708578 - RNA, 23 nt, Haemophilus influenzae Rd
cuucauccaauacuguuuggcaa

SEQ ID NO: 2708579 - RNA, 13 nt, Haemophilus influenzae Rd
cuucaucgcucau

SEQ ID NO: 2708580 - RNA, 17 nt, Haemophilus influenzae Rd
cuucaucgucuucuucg

SEQ ID NO: 2708581 - RNA, 15 nt, Haemophilus influenzae Rd
cuucaucuaacaaua

SEQ ID NO: 2708582 - RNA, 14 nt, Haemophilus influenzae Rd
cuucaucuauauua

SEQ ID NO: 2708583 - RNA, 15 nt, Haemophilus influenzae Rd
cuucaucuuuaaaca

SEQ ID NO: 2708584 - RNA, 21 nt, Haemophilus influenzae Rd
cuucaugauuuuccaaaauuu

SEQ ID NO: 2708585 - RNA, 17 nt, Haemophilus influenzae Rd
cuucauuaaaaccaauu

SEQ ID NO: 2708586 - RNA, 23 nt, Haemophilus influenzae Rd
cuucauuaaacugaaucgcuugu

SEQ ID NO: 2708587 - RNA, 16 nt, Haemophilus influenzae Rd
cuucauuccauuuugc

SEQ ID NO: 2708588 - RNA, 12 nt, Haemophilus influenzae Rd
cuucauucucuu

SEQ ID NO: 2708589 - RNA, 19 nt, Haemophilus influenzae Rd
cuucauugauggaauaaau

SEQ ID NO: 2708590 - RNA, 23 nt, Haemophilus influenzae Rd
cuucauuuagugaccacauuucg

SEQ ID NO: 2708591 - RNA, 21 nt, Haemophilus influenzae Rd
cuucauuugcuuuaacccauu

SEQ ID NO: 2708592 - RNA, 18 nt, Haemophilus influenzae Rd
cuucauuuuaaauuauuu

SEQ ID NO: 2708593 - RNA, 12 nt, Haemophilus influenzae Rd
cuuccaaaauuu

SEQ ID NO: 2708594 - RNA, 18 nt, Haemophilus influenzae Rd
cuuccaaagaaucaucuu

SEQ ID NO: 2708595 - RNA, 19 nt, Haemophilus influenzae Rd
cuuccaaagaaucaucuuc

SEQ ID NO: 2708596 - RNA, 23 nt, Haemophilus influenzae Rd
cuuccaaagaaucaucuucaucu

SEQ ID NO: 2708597 - RNA, 22 nt, Haemophilus influenzae Rd
cuuccaccgcuuugcuugccca

SEQ ID NO: 2708598 - RNA, 14 nt, Haemophilus influenzae Rd
cuuccagaaaauug

SEQ ID NO: 2708599 - RNA, 15 nt, Haemophilus influenzae Rd
cuuccauaauacuca

SEQ ID NO: 2708600 - RNA, 22 nt, Haemophilus influenzae Rd
cuuccauaucacauuuuauuga

SEQ ID NO: 2708601 - RNA, 14 nt, Haemophilus influenzae Rd
cuuccaucuuuuug

SEQ ID NO: 2708602 - RNA, 17 nt, Haemophilus influenzae Rd
cuuccauuaauucauau

SEQ ID NO: 2708603 - RNA, 13 nt, Haemophilus influenzae Rd
cuuccauuuuuau

SEQ ID NO: 2708604 - RNA, 18 nt, Haemophilus influenzae Rd
cuuccauuuuuauuccuu

SEQ ID NO: 2708605 - RNA, 14 nt, Haemophilus influenzae Rd
cuucccaaucuugu

SEQ ID NO: 2708606 - RNA, 16 nt, Haemophilus influenzae Rd
cuucccccaaaaaguu

SEQ ID NO: 2708607 - RNA, 17 nt, Haemophilus influenzae Rd
cuuccgcaucggcuaac

SEQ ID NO: 2708608 - RNA, 21 nt, Haemophilus influenzae Rd
cuuccgcgcuuagcaauguuu

SEQ ID NO: 2708609 - RNA, 16 nt, Haemophilus influenzae Rd
cuuccguuccccaaug

SEQ ID NO: 2708610 - RNA, 22 nt, Haemophilus influenzae Rd
cuuccguugcauuuaacuuaau

SEQ ID NO: 2708611 - RNA, 22 nt, Haemophilus influenzae Rd
cuuccugcuggguuugcacuuu

SEQ ID NO: 2708612 - RNA, 20 nt, Haemophilus influenzae Rd
cuucgaaaauaacuucaucc

SEQ ID NO: 2708613 - RNA, 21 nt, Haemophilus influenzae Rd
cuucgaaaauaacuucaucca

SEQ ID NO: 2708614 - RNA, 23 nt, Haemophilus influenzae Rd
cuucgaaaauaacuucauccauu

SEQ ID NO: 2708615 - RNA, 16 nt, Haemophilus influenzae Rd
cuucgaccaacggauu

SEQ ID NO: 2708616 - RNA, 14 nt, Haemophilus influenzae Rd
cuucgauauuuucc

SEQ ID NO: 2708617 - RNA, 16 nt, Haemophilus influenzae Rd
cuucgauauuuuccgu

SEQ ID NO: 2708618 - RNA, 17 nt, Haemophilus influenzae Rd
cuucgaugcuuuuucau

SEQ ID NO: 2708619 - RNA, 19 nt, Haemophilus influenzae Rd
cuucgauuaguuuaucaga

SEQ ID NO: 2708620 - RNA, 14 nt, Haemophilus influenzae Rd
cuucgccauuuuua

SEQ ID NO: 2708621 - RNA, 20 nt, Haemophilus influenzae Rd
cuugcgcaauggcuuguucc

SEQ ID NO: 2708622 - RNA, 20 nt, Haemophilus influenzae Rd
cuugcguuugguucaucauu

SEQ ID NO: 2708623 - RNA, 13 nt, Haemophilus influenzae Rd
cuugcuaaaaaga

SEQ ID NO: 2708624 - RNA, 20 nt, Haemophilus influenzae Rd
cuugcuaaaaagaaauaaaa

SEQ ID NO: 2708625 - RNA, 13 nt, Haemophilus influenzae Rd
cuugcuauuuucu

SEQ ID NO: 2708626 - RNA, 18 nt, Haemophilus influenzae Rd
cuugcuauuuucuaauuu

SEQ ID NO: 2708627 - RNA, 13 nt, Haemophilus influenzae Rd
cuugcugauaaau

SEQ ID NO: 2708628 - RNA, 14 nt, Haemophilus influenzae Rd
cuugcugauaaauu

SEQ ID NO: 2708629 - RNA, 21 nt, Haemophilus influenzae Rd
cuugcugauaaauuccuucca

SEQ ID NO: 2708630 - RNA, 18 nt, Haemophilus influenzae Rd
cuugcugggcaagggauu

SEQ ID NO: 2708631 - RNA, 20 nt, Haemophilus influenzae Rd
cuugcuguugguuaaaaaua

SEQ ID NO: 2708632 - RNA, 21 nt, Haemophilus influenzae Rd
cuugcuguugguuaaaaauag

SEQ ID NO: 2708633 - RNA, 18 nt, Haemophilus influenzae Rd
cuugcuguuuuuccgcua

SEQ ID NO: 2708634 - RNA, 22 nt, Haemophilus influenzae Rd
cuugcuuaugcaaaguauuuuu

SEQ ID NO: 2708635 - RNA, 20 nt, Haemophilus influenzae Rd
cuugcuuuugguuuucuggu

SEQ ID NO: 2708636 - RNA, 19 nt, Haemophilus influenzae Rd
cuugcuuuuuaauugauuc

SEQ ID NO: 2708637 - RNA, 16 nt, Haemophilus influenzae Rd
cuuggaaauguuuaau

SEQ ID NO: 2708638 - RNA, 19 nt, Haemophilus influenzae Rd
cuuggaagaauaaaagaua

SEQ ID NO: 2708639 - RNA, 16 nt, Haemophilus influenzae Rd
cuuggaauaucaucua

SEQ ID NO: 2708640 - RNA, 23 nt, Haemophilus influenzae Rd
cuuggaaugcaccagaugcaaua

SEQ ID NO: 2708641 - RNA, 20 nt, Haemophilus influenzae Rd
cuuggaguucuugaauacaa

SEQ ID NO: 2708642 - RNA, 19 nt, Haemophilus influenzae Rd
cuuggaucauacauaucca

SEQ ID NO: 2708643 - RNA, 15 nt, Haemophilus influenzae Rd
cuuggaucguuuucu

SEQ ID NO: 2708644 - RNA, 22 nt, Haemophilus influenzae Rd
cuuggauuuucuuagcuucauc

SEQ ID NO: 2708645 - RNA, 22 nt, Haemophilus influenzae Rd
cuuggcaacccacuucugcacc

SEQ ID NO: 2708646 - RNA, 13 nt, Haemophilus influenzae Rd
cuuggcauuuuug

SEQ ID NO: 2708647 - RNA, 18 nt, Haemophilus influenzae Rd
cuuggcgaguaaauuuag

SEQ ID NO: 2708648 - RNA, 23 nt, Haemophilus influenzae Rd
cuuggcgugguucaaaaccaaau

SEQ ID NO: 2708649 - RNA, 20 nt, Haemophilus influenzae Rd
cuuggcuaacuucuuccacu

SEQ ID NO: 2708650 - RNA, 21 nt, Haemophilus influenzae Rd
cuuggcuaacuucuuccacuu

SEQ ID NO: 2708651 - RNA, 18 nt, Haemophilus influenzae Rd
cuuggcuuauuuacuuua

SEQ ID NO: 2708652 - RNA, 15 nt, Haemophilus influenzae Rd
cuugggcuaaaagcu

SEQ ID NO: 2708653 - RNA, 18 nt, Haemophilus influenzae Rd
cuugguaaacuucuucug

SEQ ID NO: 2708654 - RNA, 15 nt, Haemophilus influenzae Rd
cuugguaagaaagau

SEQ ID NO: 2708655 - RNA, 20 nt, Haemophilus influenzae Rd
cuugguagccuuuaugacua

SEQ ID NO: 2708656 - RNA, 18 nt, Haemophilus influenzae Rd
cuuggucacgauuuuuuu

SEQ ID NO: 2708657 - RNA, 16 nt, Haemophilus influenzae Rd
cuuggucacugguuca

SEQ ID NO: 2708658 - RNA, 15 nt, Haemophilus influenzae Rd
cuugguucgcuucau

SEQ ID NO: 2708659 - RNA, 20 nt, Haemophilus influenzae Rd
cuuguaaaauugguggggca

SEQ ID NO: 2708660 - RNA, 20 nt, Haemophilus influenzae Rd
cuuguaaagauuguccuuuu

SEQ ID NO: 2708661 - RNA, 18 nt, Haemophilus influenzae Rd
cuuguaagcguaaugcac

SEQ ID NO: 2708662 - RNA, 23 nt, Haemophilus influenzae Rd
cuuguaaugcaaaccauuuaucc

SEQ ID NO: 2708663 - RNA, 16 nt, Haemophilus influenzae Rd
cuuguaauuucauuuu

SEQ ID NO: 2708664 - RNA, 21 nt, Haemophilus influenzae Rd
cuuguacaacagcaauaagca

SEQ ID NO: 2708665 - RNA, 18 nt, Haemophilus influenzae Rd
cuuguacaguaauuguug

SEQ ID NO: 2708666 - RNA, 24 nt, Haemophilus influenzae Rd
cuuguacaguaauuguugguuacu

SEQ ID NO: 2708667 - RNA, 23 nt, Haemophilus influenzae Rd
cuuguagaucggcaaugguucga

SEQ ID NO: 2708668 - RNA, 22 nt, Haemophilus influenzae Rd
cuuguaguucaggaauuaaauc

SEQ ID NO: 2708669 - RNA, 23 nt, Haemophilus influenzae Rd
cuugucauugccauuucugcauu

SEQ ID NO: 2708670 - RNA, 17 nt, Haemophilus influenzae Rd
cuugucgcggcaaucca

SEQ ID NO: 2708671 - RNA, 18 nt, Haemophilus influenzae Rd
cuugugauguaccaauuu

SEQ ID NO: 2708672 - RNA, 17 nt, Haemophilus influenzae Rd
cuugugcauaaacaaau

SEQ ID NO: 2708673 - RNA, 15 nt, Haemophilus influenzae Rd
cuugugcuauacaaa

SEQ ID NO: 2708674 - RNA, 15 nt, Haemophilus influenzae Rd
cuugugcucgauuuu

SEQ ID NO: 2708675 - RNA, 18 nt, Haemophilus influenzae Rd
cuugugcucgauuuuuaa

SEQ ID NO: 2708676 - RNA, 22 nt, Haemophilus influenzae Rd
cuugugcuggaguugcagauuu
